United States Patent 11,078,247 (RNA ENCODING A THERAPEUTIC PROTEIN) - sequence listing, part 21

SEQ ID NO: 37392 - RNA, 837 nt, Artificial Sequence
  derived and/or modified sequence opt1 from TAF1D__Homo_sapiens__NP_077021
auggacaagagcggcaucgacucccuggaccacgugaccagcgacgccgucgagcucgccaaccgcuccgacaacagcuccgacagcucccuguucaagacccagugcauccccuacagcccgaagggggagaagcggaaccccauccgcaaguucgugcggacgcccgaguccgugcacgcgagcgacuccagcuccgacagcuccuucgagcccaucccgcugaccaucaaggccaucuucgagcgcuucaagaaccggaagaagcgcuacaagaagaagaagaagcggcgcuaccagcccaccggccggccccgcgggcggcccgagggccgccggaacccgaucuacagccucaucgacaagaagaagcaguuccgcucccgggggagcggcuuccccuuccuggaguccgagaacgagaagaacgcccccuggcgcaagauccugaccuucgagcaggccgucgcccggggcuucuucaacuacaucgagaagcucaaguacgagcaccaccugaaggagagccugaagcagaugaacgugggggaggaccucgagaacgaggacuucgacagccgccgguacaaguuccuggacgacgacggcuccaucagccccaucgaggaguccacggcggaggacgaggacgccacccaccuggaggacaacgagugcgacaucaagcucgccggggacagcuucaucguguccagcgaguucccgguccgccuguccguguaccuggaggaggaggacaucaccgaggaggccgcgcucagcaagaagcgggccaccaaggccaagaacacgggccagcgcgggcugaagauguga

SEQ ID NO: 37393 - RNA, 5688 nt, Artificial Sequence
  derived and/or modified sequence opt1 from TAF1__Homo_sapiens__NP_001273003
augggccccgggugcgaccugcuccugcgcaccgccgccaccaucaccgccgccgccaucaugagcgacaccgacuccgacgaggacagcgccggcgggggccccuucucccuggccggguuccucuucggcaacaucaacggcgcggggcagcuggagggcgagagcgugcuggacgacgagugcaagaagcaccucgccgggcugggcgcccuggggcucggcucccugaucaccgagcugaccgccaacgaggagcucacgggcaccgacggggcccuggugaacgacgagggcugggugcggagcaccgaggacgccguggacuacuccgacaucaacgagguggccgaggacgagagccgccgguaccagcagaccauggggucccugcagccccucugccacagcgacuacgacgaggacgacuacgacgccgacugcgaggacaucgacugcaagcugaugccgcccccgcccccgccgcccggccccaugaagaaggacaaggaccaggacuccaucacgggcgugagcgagaacggggagggcaucauccugcccuccaucaucgcccccagcucccucgcgagcgagaagguggacuucuccagcuccagcgacagcgaguccgagauggggccccaggaggccacccaggccgagagcgaggacggcaagcugacccugccccucgccgggaucaugcagcacgacgccaccaagcugcugcccuccgucacggagcuguuccccgaguuccgccccggcaaggugcugcgguuccugcgccucuucggccccgggaagaacgugcccagcgucuggcgguccgcgcgccggaagcgcaagaagaagcaccgggagcugauccaggaggagcagauccaggagguggagugcagcguggaguccgaggucagccagaagucccuguggaacuacgacuacgcgccgccgcccccgcccgagcagugccucagcgacgacgagaucaccaugauggcccccguggaguccaaguucagccaguccaccggcgacaucgacaaggugaccgacacgaagccccgcgucgccgaguggcgguacgggcccgcccgccugugguacgacaugcugggcgugcccgaggacgggagcggcuucgacuacggcuucaagcuccggaagaccgagcacgagcccgugaucaagucccgcaugaucgaggaguuccggaagcuggaggagaacaacgggaccgaccugcucgcggacgagaacuuccugauggucacccagcugcacugggaggacgacaucaucugggacggcgaggacgugaagcacaaggggacgaagccccagcgcgccagccucgccggcuggcugcccuccagcaugacccggaacgccauggccuacaacgugcagcagggguucgcggccacccuggacgacgacaagcccugguacuccaucuuccccaucgacaacgaggaccucgucuacggccgcugggaggacaacaucaucugggacgcccaggccaugccccggcugcuggagcccccggugcucacccuggaccccaacgacgagaaccugauccucgagauccccgacgagaaggaggaggcgacgagcaacagccccuccaaggagagcaagaaggaguccagccugaagaagucccgcauccugcugggcaagaccggggugaucaaggaggagccgcagcagaacaugagccagcccgaggucaaggaccccuggaaccucuccaacgacgaguacuacuaccccaagcagcagggccugcgcgggaccuucggcggcaacaucauccagcacagcaucccggccguggagcugcggcagcccuucuuccccacccacauggggcccaucaagcuccgccaguuccaccggccgccccugaagaaguacuccuucggcgcccugagccagcccgggccccacuccguccagccgcuccugaagcacaucaagaagaaggccaagaugcgcgagcaggagcggcaggccagcggcgggggcgagauguucuucaugcgcacgccccaggaccugaccggcaaggacggggaccucauccuggcggaguacuccgaggagaacggcccccugaugaugcaggucgggauggccaccaagaucaagaacuacuacaagcggaagcccggcaaggacccgggggcccccgacugcaaguacggcgagaccguguacugccacacgagccccuuccucggcucccugcacccggggcagcugcuccaggccuucgagaacaaccuguuccgcgcccccaucuaccugcacaagaugcccgagaccgacuuccucaucauccggacccgccagggcuacuacauccgggagcuggucgacaucuucgugguggggcagcagugcccccuguucgaggucccgggccccaacagcaagcgcgcgaacacccacauccgggacuuccuccagguguucaucuaccgccuguucuggaaguccaaggaccggccccgccggauccgcauggaggacaucaagaaggccuuccccagccacagcgaguccagcauccggaagcgccugaagcucugcgccgacuucaagcgcacggggauggacuccaacuggugggugcucaagagcgacuuccggcugccgaccgaggaggagauccgcgccauggucucccccgagcagugcugcgccuacuacagcaugaucgcggccgagcagcggcucaaggacgccggcuacggcgagaaguccuucuucgcccccgaggaggagaacgaggaggacuuccagaugaagaucgacgacgaggugcgcaccgcgcccuggaacaccacccgggccuucaucgccgccaugaaggggaagugccugcuggaggugacgggcgucgccgacccgaccgggugcggcgagggguucagcuacgugaagauccccaacaagcccacccagcagaaggacgacaaggagccccagccggugaagaagaccgucacgggcaccgacgcggaccuccgccggcugucccugaagaacgccaagcagcuccugcgcaaguucggcgugcccgaggaggagaucaagaagcugagccggugggaggugaucgacgucgugcgcaccauguccaccgagcaggcccggagcggggagggccccauguccaaguucgcccgcgggagccgguucuccguggccgagcaccaggagcgcuacaaggaggagugccagcggaucuucgaccuccagaacaagguccugagcuccacggaggugcugagcaccgacaccgacuccagcagcgcggaggacuccgacuucgaggagaugggcaagaacaucgagaacaugcuccagaacaagaagaccagcucccagcugagccgcgagcgggaggagcaggagcgcaaggagcugcagcggaugcuccuggccgccggcuccgccgccagcgggaacaaccaccgcgacgacgacacggcguccgugaccagccugaacuccagcgccaccggccggugccucaagaucuaccgcaccuuccgcgacgaggaggggaaggaguacguccggugcgagacggugcgcaagcccgccgugaucgacgccuacguccggauccgcaccaccaaggacgaggaguucauccggaaguucgcgcuguucgacgagcagcaccgcgaggagaugcggaaggagcgccggcgcauccaggagcagcugcggcgccucaagcggaaccaggagaaggagaagcugaagggcccgcccgagaagaagcccaagaagaugaaggagcgccccgaccugaagcucaagugcggggccugcggcgccaucggccacaugcggaccaacaaguucugcccgcuguacuaccagacgaacgcgccgcccuccaaccccguggccaugaccgaggagcaggaggaggagcuggagaagaccgugauccacaacgacaacgaggagcucaucaaggucgaggggaccaagaucgugcugggcaagcagcugaucgagagcgcggacgaggugcgccggaagucccucguccugaaguucccgaagcagcagcugccgcccaagaagaagcgccggguggggacgaccgugcacugcgacuaccucaaccgcccgcacaagagcauccaccgccggcgcaccgaccccauggucacccuguccagcauccuggaguccaucaucaacgacaugcgggaccuccccaacacguaccccuuccacaccccggugaacgccaagguggucaaggacuacuacaagaucaucacccgccccauggaccugcagacccugcgggagaacgugcgcaagcggcucuaccccagccgcgaggaguuccgggagcaccuggagcugaucgugaagaacuccgccacguacaacggccccaagcacagccucacccagaucagccaguccaugcuggaccugugcgacgagaagcucaaggagaaggaggacaagcuggcccgccuggagaaggccaucaacccgcuccuggacgacgacgaccaggucgcguucagcuucauccuggacaacaucgugacccagaagaugauggccgugcccgacuccuggcccuuccaccaccccgucaacaagaaguucgugccggacuacuacaaggugaucgucaaccccauggaccucgagaccauccggaagaacaucagcaagcacaaguaccagucccgcgagagcuuccuggacgacgugaaccugauccucgccaacuccgugaaguacaacgggcccgagagccaguacacgaagaccgcccaggagaucgucaacgugugcuaccagacccugaccgaguacgacgagcaccugacccagcucgagaaggacaucugcacggccaaggaggcggcccuggaggaggccgagcuggagucccucgaccccaugaccccgggccccuacacgccccaggccaagcccccggaccuguacgacaccaacacgagccuguccaugagccgggacgccuccgucuuccaggacgagagcaacauguccgugcucgacauccccagcgcgacccccgagaagcaggucacccaggagggcgaggacggggacggcgaccuggccgacgaggaggaggggaccguccagcagccccaggccuccgugcuguacgaggaccuccugaugagcgagggcgaggacgacgaggaggacgccggguccgacgaggagggcgacaacccguucagcgcgauccagcugagcgaguccggcagcgacuccgacguggggagcggcgggauccgccccaagcagccccggaugcugcaggagaacacgcgcauggacauggagaacgaggaguccaugaugagcuacgagggcgacggcggggaggccucccacggccucgaggacagcaacaucuccuacgggagcuacgaggagcccgacccgaaguccaacacccaggacaccagcuucuccagcaucggcggguacgaggucuccgaggaggaggaggacgaggaggaggaggagcagcggagcggccccuccgugcugagccaggugcaccuguccgaggacgaggaggacagcgaggacuuccacagcaucgccggcgacuccgaccucgacagcgacgaguga

SEQ ID NO: 37394 - RNA, 3600 nt, Artificial Sequence
  derived and/or modified sequence opt1 from TAF2__Homo_sapiens__NP_003175
augccccugaccggcguggagccggcccgcaugaaccggaagaagggggacaagggcuucgagagcccccgccccuacaagcucacccaccaggucgugugcaucaacaacaucaacuuccagcggaaguccguggucggguucguggagcugacgaucuuccccaccguggccaaccugaaccgcaucaagcucaacagcaagcagugccggaucuaccgcguccggaucaacgaccuggaggcggccuucaucuacaacgacccgacccuggaggugugccacuccgagagcaagcagcgcaaccucaacuacuucuccaacgccuacgccgccgcggugagcgccgucgaccccgacgccggcaacggggagcugugcaucaaggugcccuccgagcuguggaagcacguggacgagcucaagguccugaagauccacaucaacuucagccuggaccagcccaagggcggccuccacuucguggugccguccgucgaggggagcauggccgagcggggcgcgcacguguucuccugcggguaccagaacagcacccgcuucugguuccccugcguggacuccuacagcgagcugugcacguggaagcuggaguucaccgucgacgccgccaugguggccguguccaacggcgaccucgucgagaccguguacacccacgacaugcggaagaagacguuccacuacaugcugaccauccccaccgccgcgagcaacaucucccuggccaucgggcccuucgagauccucguggacccguacaugcacgaggucacccacuucugccugccccagcugcucccccugcugaagcacacgaccagcuaccuccacgagguguucgaguucuacgaggagauccugaccugccgcuaccccuacuccugcuucaagaccgucuucaucgacgaggccuacguggagguggccgccuacgcgagcaugagcaucuucuccacgaaccugcuccacagcgccaugaucaucgacgagaccccgcugacccggcgcugccuggcccagucccucgcccagcaguucuucggcugcuucaucagccggauguccuggagcgacgaguggguccugaagggcaucuccggguacaucuacggccuguggaugaagaagaccuucggggugaacgaguaccgccacuggaucaaggaggagcucgacaagaucguggccuacgagcugaagacgggcggcguccugcuccaccccaucuucgggggcgggaaggagaaggacaaccccgcgagccaccuccacuucuccaucaagcacccccacacccugagcugggaguacuacaccauguuccagugcaaggcccaccuggugaugcggcugaucgagaaccgcaucuccauggaguucaugcuccagguguucaacaagcugcugagccuggccuccaccgccagcucccagaaguuccagagccacauguggucccagaugcucgucagcacguccggcuuccucaagagcaucagcaacguguccgggaaggacauccagccgcugaucaagcaguggguggaccagagcggcgucgugaaguucuacggcuccuucgccuucaaccggaagcgcaacgugcuggagcuggagaucaagcaggacuacaccagccccgggacccagaaguacgucggcccccugaaggugaccgugcaggagcuggacggguccuucaaccacacgcuccagaucgaggagaacagccugaagcacgacauccccugccacuccaagagccggcgcaacaagaagaagaagaucccgcugaugaacggcgaggaggucgacauggaccucuccgcgauggacgccgacagcccccugcuguggauccgcaucgaccccgacauguccgugcuccggaagguggaguucgagcaggccgacuucauguggcaguaccagcugcgcuacgagcgggacgucguggcccagcaggagagcauccuggcgcucgagaaguuccccaccccggccucccgccuggcccugaccgacauccucgagcaggagcagugcuucuaccgggugcgcaugagcgccugcuucugccuggccaagaucgcgaacuccauggucagcaccuggacggggccgcccgccaugaagucccuguucacccggauguucugcugcaagagcugccccaacaucgugaagaccaacaacuucaugagcuuccaguccuacuuccuccagaagaccaugcccguggccauggcccugcugcgcgacguccacaaccucugccccaaggaggugcugacguucauccuggaccucaucaaguacaacgacaaccggaagaacaaguucagcgacaacuacuaccgcgccgagaugaucgacgcgcuggccaacuccgugacccccgccgucagcgugaacaacgaggugcggacccuggacaaccucaacccggacguccgccugauccuggaggagaucacccgguuccucaacauggagaagcugcugcccuccuaccgccacaccaucacggugagcugccuccgggccauccgcgugcugcagaagaacggccacguccccuccgaccccgcccuguucaagagcuacgcggaguacggccacuucguggacauccggaucgccgcccucgaggccguggucgacuacaccaagguggaccgcuccuacgaggagcugcaguggcugcucaacaugauccagaacgacccggugcccuacguccggcacaagauccugaacaugcugaccaagaacccgcccuucaccaagaacauggagagcccccucugcaacgaggcgcugguggaccagcuguggaagcucaugaacuccgggacgagccacgacuggcgccugcgcugcggcgccguggaccuguacuucacccucuucgggcugucccggcccagcugccugccccuccccgagcugggccugguccucaaccugaaggagaagaaggccgugcugaacccgaccaucauccccgaguccguggccgggaaccaggaggccgcgaacaaccccagcucccacccccagcucgucggcuuccagaacccguucagcuccagccaggacgaggaggagaucgacauggacaccgugcacgacagccaggccuucaucucccaccaccugaacaugcuggagcgccccagcacgcccggccucuccaaguaccggcccgccagcucccgcagcgcccugaucccgcagcacuccgccgggugcgacagcacccccaccaccaagccccaguggucccuggagcucgcgcggaagggcacggggaaggagcaggccccgcuggagaugagcaugcaccccgccgccuccgcgccccugagcguguucaccaaggaguccaccgccagcaagcacuccgaccaccaccaccaccaccaccacgagcacaagaagaagaagaagaagcacaagcacaagcacaagcacaagcacaagcacgacagcaaggagaaggacaaggagcccuucaccuucuccagcccggccuccggccgcagcauccggagccccucccucagcgacuga

SEQ ID NO: 37395 - RNA, 2790 nt, Artificial Sequence
  derived and/or modified sequence opt1 from TAF3__Homo_sapiens__NP_114129
augugcgagagcuacucccgcagccugcuccggguguccgucgcccagaucugccaggcccugggcugggacagcgugcagcuguccgcgugccaccuccugaccgacgugcugcagcgcuaccuccagcagcuggggcggggcugccaccgcuacagcgagcuguacgggcggaccgaccccauccucgacgacgucggcgaggccuuccagcugaugggggugucccugcacgagcucgaggacuacauccacaacaucgagccggugacguucccccaccagauccccagcuuccccgucuccaagaacaacgugcugcaguucccgcagcccggcagcaaggacgccgaggagcgcaaggaguacauccccgacuaccugcccccgaucguguccagccaggaggaggaggaggaggagcagguccccaccgacggcgggaccuccgccgaggccaugcaggucccccucgaggaggacgacgagcuggaggaggaggagaucaucaacgacgagaacuuccugggcaagcggccccucgacagcccggaggcggaggagcugcccgccaugaagcgcccccggcugcucuccaccaagggggacacgcuggacguggugcugcucgaggcccgcgagccccugagcuccaucaacacccagaagaucccgcccaugcugagccccgugcacgugcaggacuccaccgaccucgcgcccccgagccccgagccgcccaugcuggcccccgucgccaagagccagaugcccaccgccaagccccuggagacgaaguccuucacccccaagaccaagaccaagacgagcuccccgggccagaagaccaagagccccaagaccgcccagucccccgccaugguggggagcccgauccggucccccaagaccgugagcaaggagaagaagucccccggccgcagcaagucccccaagagcccgaagucccccaaggucacgacccacaucccccagacccccgugcggccggagacccccaaccgcacgcccagcgcgacccucuccgagaagaucagcaaggagaccauccaggugaagcagauccagacgcccccggacgccggcaagcugaacuccgagaaccagcccaagaaggccgucguggccgacaagaccaucgaggccagcaucgacgcggugaucgcccgggccugcgccgagcgcgagcccgaccccuucgaguucuccagcgggagcgaguccgagggcgacaucuucaccagcccgaagcggaucuccgggcccgagugcaccacccccaaggccagcacguccgcgaacaacuucaccaagagcggcuccacgccccugccgcucagcggcgggaccuccagcuccgacaacagcuggaccauggacgccuccaucgacgaggucgugcgcaaggccaagcugggcacccccagcaacaugccgcccaacuuccccuacaucuccagccccuccgucagcccgcccacccccgagccccugcacaagguguacgaggagaagaccaagcuccccagcuccguggaggucaagaagaagcugaagaaggagcugaagacgaagaugaagaagaaggagaagcagcgggaccgcgagcgggagaaggacaagaacaaggacaagagcaaggagaaggacaaggugaaggagaaggagaaggacaaggagaccgggcgcgagaccaaguacccguggaaggaguuccucaaggaggaggaggccgaccccuacaaguucaagaucaaggaguucgaggacguggaccccaaggucaagcugaaggacggccuggugcgcaaggagaaggagaagcacaaggacaagaagaaggaccgggagaaggggaagaaggacaaggacaagcgcgagaaggagaaggugaaggacaagggccgggaggacaagaugaaggcccccgcgccgccccucguccugccgcccaaggagcuggcccucccccuguucucccccgccaccgccagccgcgugcccgcgaugcugcccucccuccugccggugcugcccgagaagcuguucgaggagaaggagaaggucaaggagaaggagaagaagaaggacaagaaggagaagaagaagaagaaggagaaggagaaggagaagaaggagaaggagcgggagaaggagaagcgcgagcgggagaagcgcgagaaggagaaggagaagcacaagcacgagaagaucaagguggagcccguggcccucgcccccagcccggucaucccccggcugacccugcgcgugggcgccgggcaggacaagaucgugaucuccaaggucgugcccgcccccgaggcgaagccggcccccagccagaaccggcccaagacgcccccgcccgcccccgccccggcccccggccccaugcucgugucccccgcgccggucccccugccccugcucgcccaggccgccgccgggcccgcgcugcugccgagccccggccccgccgccuccggggccagcgcgaaggcccccgugcgcuccguggucaccgagaccgugagcaccuacgugauccgggacgaguggggcaaccagaucuggaucugcccgggcugcaacaagcccgacgacgggucccccaugaucggcugcgacgacugcgacgacugguaccacuggcccugcgucgggaucaugacggccccgcccgaggagaugcagugguucugccccaagugcgccaacaagaagaaggacaagaagcacaagaagcgcaagcaccgggcccacuga

SEQ ID NO: 37396 - RNA, 2604 nt, Artificial Sequence
  derived and/or modified sequence opt1 from TAF4B__Homo_sapiens__NP_001280654
augcccgccggccugaccgagccggccggggcggccccgcccgccgccgugagcgccuccggcaccgucacgauggcgcccgccggggcccuccccgugcgcguggagagcacccccgucgcccugggcgcggugaccaaggcccccguguccgucugcguggagcccaccgccagccagccgcugcggucccccguggggacgcucgucaccaagguggcccccgugagcgccccgcccaaggucuccagcggcccccgccugcccgcgccccagaucguggccgugaaggccccgaacaccaccacgauccaguuccccgccaaccugcagcucccgcccggcaccguccugaucaaguccaacagcgggccccugaugcucgugagcccccagcagaccgugacccgggccgagacgaccuccaacaucaccucccgccccgcgguccccgccaacccgcagaccgugaagaucugcacggugcccaacagcuccagccagcugaucaagaaggucgccgugacccccgugaagaagcuggcccagaucggcaccaccgucgugacgaccguccccaagccguccagcgugcaguccguggccguccccaccagcguggugaccgucacgcccgggaagccgcucaacaccgugaccacccugaagcccagcucccugggcgcgagcuccacgcccagcaacgagcccaaccucaaggccgagaacuccgccgccgugcagaucaaccugagcccgaccaugcuggagaacgucaagaagugcaagaacuuccucgccaugcugaucaagcuggcgugcuccgggagccagucccccgagaugggccagaacgugaagaagcucguggagcagcugcuggacgccaagaucgaggccgaggaguucacccggaagcucuacgucgagcucaagagcagcccccagccccaccuggugccguuccugaagaaguccguggucgcccugcgccagcugcuccccaacucccagagcuucauccagcagugcgugcagcagaccuccagcgacauggugaucgcgacgugcaccaccaccgucacgaccucccccguggugaccaccaccgucagcuccagccagagcgagaaguccaucaucgugagcggcgccacggcgccccggaccguguccguccagacccugaacccgcuggccgggcccgugggcgccaaggccgggguggucacccuccacagcgugggccccacggccgccaccggcgggaccaccgccggcacggggcugcugcagaccuccaagccccucgugaccagcgucgccaacaccgugacgaccgugucccugcagccggagaagcccgucgugagcggcaccgcggugacccugucccuccccgccgucacguucggggagaccagcggcgccgccaucugccugcccuccgugaagccgguggucagcuccgccggcaccaccagcgacaagcccgugaucgggacgcccgugcagaucaagcuggcgcagcccggcccgguccucucccagcccgccgggaucccccaggccguccaggugaagcagcuguucagccuguuccagguggugcagcagccguccggcgggaacgagaagcaggucaccaccaucagccacagcuccacccucacgauccagaagugcggccagaagaccaugcccgugaacaccaucauccccaccagccaguucccgcccgccuccauccugaagcagaucacgcugcccggcaacaagauccucagccugcaggcgucccccacccagaagaaccgcaucaaggagaacgugaccagcugcuuccgggacgaggacgacaucaacgacgugaccuccauggccggggucaaccugaacgaggagaacgccugcauccuggccacgaacagcgagcucgugggcacccugauccaguccugcaaggacgagcccuuccuguucaucggggcccuccagaagcgcauccuggacaucggcaagaagcacgacaucaccgagcugaacagcgacgcggucaaccucaucucccaggccacccaggagcggcugcgcgggcugcucgagaagcugacggccaucgcccagcaccggaugaccaccuacaaggccagcgagaacuacauccugugcuccgacacccgcagccagcucaaguuccuggagaagcuggaccagcucgagaagcagcggaaggaccuggaggagcgcgagaugcugcucaaggcggccaagucccggagcaacaaggaggacccggagcagcugcgccugaagcagaaggccaaggagcuccagcagcuggagcuggcccagauccagcaccgggacgccaaccucaccgcgcuggccgccaucggcccccgcaagaagcggccccuggaguccggcaucgaggggcucaaggacaaccugcuggccagcggcacguccagccucaccgcgaccaagcagcugcaccgcccccgcaucacccggaucugccugcgcgaccucaucuucugcauggagcaggagcgggagaugaaguacagccgcgcccuguaccuggcccuccugaaguga

SEQ ID NO: 37397 - RNA, 3258 nt, Artificial Sequence
  derived and/or modified sequence opt1 from TAF4__Homo_sapiens__NP_003176
auggccgccggcagcgaccugcucgacgagguguucuucaacuccgaggucgacgagaagguggugagcgaccuggucgggucccuggagagccagcucgcggccuccgccgcccaccaccaccaccuggcgccccgcaccccggaggugcgggccgccgccgccggcgcgcuggggaaccacguggucagcggcucccccgccggggccgccggcgccggccccgcggcccccgccgagggggccccgggcgccgcgcccgagcccccgcccgccgggcgcgcccggcccggcgggggcggcccccagcgccccgggccgcccagcccccggcgcccccucgugccggccggccccgccccgcccgcggccaagcugcggcccccgcccgagggguccgccggcagcugcgcccccgugcccgccgcggccgccgucgccgcgggccccgagcccgcccccgccgggccggccaagcccgccggccccgcggcccuggccgcccgcgccgggccgggccccgggcccggccccggcccggggcccggccccgggcccggcaagccggcggggcccggcgccgcccagacccucaacggcuccgccgcccugcugaacagccaccacgcggccgcccccgccgugucccucgugaacaacgggcccgcggcccugcugccgcuccccaagcccgccgcccccggcacggucauccagaccccgcccuucgugggggccgcggccccgcccgcccccgccgcccccagcccgcccgcggcccccgcccccgccgcccccgcggccgccccgcccccgccgccgcccgcccccgcgacccuggcccggccgcccggccaccccgccgggccgcccaccgccgcccccgcggugcccccgcccgccgccgcccagaacggcggcuccgccggggcggcccccgcccccgcccccgccgcgggcgggcccgccggcgucagcggccagcccgggcccggcgccgccgccgcggcccccgcccccggggugaaggccgagucccccaagcgcgugguccaggcggccccgcccgccgcccagacgcuggccgcgagcggccccgccuccaccgccgccagcauggugaucgggcccaccaugcagggcgcccuccccagccccgcggccgugccgccgcccgcccccggcacccccacggggcugcccaagggcgccgccggggcggucacccagucccugagccggacccccaccgccacgaccuccggcauccgcgccacccucacccccacggugcuggccccgcggcugccccagccgccccagaaccccaccaacauccagaacuuccagcucccgcccgggauggugcugguccgcagcgagaacggccagcugcucaugaucccccagcaggcgcuggcccagaugcaggcccaggcccacgcccagccccagaccaccauggcgccccggcccgccacgcccaccuccgccccgcccgugcagaucagcaccguccaggcccccggcacccccaucaucgcccgccaggugacgccgaccaccaucaucaagcaggucucccaggcgcagaccacggugcagcccagcgccacccugcagcggucccccggggugcagccccagcucgugcugggcggggccgcccagaccgccagccugggcaccgcgacggccguccagaccgggaccccgcagcgcaccgugcccggcgccacgaccaccuccagcgccgcgaccgagaccauggagaacgugaagaagugcaagaacuuccucuccacgcugaucaagcuggccagcuccggcaagcagagcaccgagaccgccgccaacgucaaggagcucgugcagaaccugcuggacgggaagaucgaggccgaggacuucaccucccggcucuaccgcgagcugaacagcagcccccagccguaccuggugcccuuccucaagcggucccugcccgcgcugcgccagcucacgcccgacagcgccgccuucauccagcagucccagcagcagccgcccccgcccaccagccaggccaccaccgcccugacggcggucgugcuguccagcuccgugcagcgcaccgccggcaagaccgccgccaccgucacgagcgcccuccagccgcccgugcugucccugacccagcccacccaggugggggucggcaagcaggggcagcccacgccccuggugauccagcagccgcccaagcccggcgcgcucauccggccgccccaggugacccugacccagacccccauggucgcccugcgccagccccacaaccggaucaugcucaccacgccccagcagauccagcugaacccccugcagcccgugcccguggucaagccggccgugcuccccggcaccaaggcccugagcgccguguccgcgcaggccgccgccgcgcagaagaacaagcugaaggagcccgggggcgggagcuuccgcgacgacgacgacaucaacgacgucgccuccauggccggcgugaaccucagcgaggaguccgcccggauccuggccaccaacagcgagcuggugggcacccucacgcgcuccugcaaggacgagaccuuccugcugcaggcgccgcuccagcggcgcauccuggagaucgggaagaagcacggcaucaccgagcugcaccccgacgucgugagcuacgugucccacgccacccagcagcggcuccagaaccuggucgagaagaucagcgagacggcccagcagaagaacuucagcuacaaggacgacgaccgcuacgagcaggccuccgacgugcgggcccagcugaaguucuucgagcagcucgaccagaucgagaagcagcgcaaggacgagcaggagcgggagauccugaugcgcgcggccaagagccggucccgccaggaggaccccgagcagcugcggcucaagcagaaggccaaggagaugcagcagcaggagcuggcccagaugcgccagcgggacgccaaccugaccgcgcucgccgccaucgggccccgcaagaagcgcaagguggacugcccgggccccgggagcggcgccgagggcuccgggcccggcagcgucgugcccggguccagcggcguggggaccccgcggcaguucacccgccagcggaucacgcgcgucaaccugcgggaccugaucuucugccucgagaacgagcgcgagaccucccacagccugcugcucuacaaggcguuccugaaguga

SEQ ID NO: 37398 - RNA, 978 nt, Artificial Sequence
  derived and/or modified sequence opt1 from TAF5L__Homo_sapiens__NP_001020418
augaagcgcgugcggaccgagcagauccagauggccgucagcugcuaccugaagcgccggcaguacguggacuccgacggcccccucaagcaggggcugcgccugagccagaccgccgaggagauggcggccaaccucacggugcaguccgagagcggcugcgccaacaucgucuccgccgccccgugccaggcggagccccagcaguacgaggugcaguucgggcggcugcgcaacuuccugaccgacagcgacucccagcacagccacgaggugaugccccuccuguacccccuguucgucuaccuccaccugaaccuggugcagaacucccccaagagcaccguggaguccuucuacagccgguuccacggcauguuccuccagaacgccucccagaaggacgucaucgagcagcugcagaccacgcagaccauccaggacauccugagcaacuucaagcuccgcgccuuccuggacaacaaguacguggugcggcugcaggaggacuccuacaacuaccucauccgcuaccugcagagcgacaacaacaccgcccugugcaagguccucacccugcacauccaccuggacgugcagcccgcgaagcggacggacuaccagcucuacgccuccgggagcuccagccgcagcgagaacaacggccuggagccgcccgacaugccgucccccauccugcagaacgaggccgcccucgaggugcugcaggagagcaucaagcgggucaaggacggcccgcccucccugaccaccaucugcuucuacgccuucuacaacaccgagcagcuccugaacacggcggagaucagccccgacuccaagcugcucgccgccggguucgacaacagcugcaucaagcuguggucccugcgcagcaagaagcucaaguccgagccccaccagguggacgugagccggauccaccuggccugcgacauccuggaggaggaggucuga

SEQ ID NO: 37399 - RNA, 2145 nt, Artificial Sequence
  derived and/or modified sequence opt1 from TAF6__Homo_sapiens__NP_001177344
augaccaagcgccggcugcagaccaucacggccugccuccagcugcgcgagggcucccccucccugcaccgggggcuccacccgagccgcgaggagaagcgggacucccgcauggccgaggagaagaagcugaagcugagcaacaccguccuccccuccgagagcaugaaggucguggcggaguccaugggcaucgcccagauccaggaggagaccugccagcugcugaccgacgaggugagcuaccggaucaaggagaucgcccaggacgcccucaaguucaugcacauggggaagcgccagaagcugacgaccuccgacaucgacuacgcccugaagcucaagaacgucgagccccuguacggcuuccacgcgcaggaguucauccccuuccgguucgccagcgggggcggccgcgagcuguacuucuacgaggagaaggagguggaccucuccgacaucaucaacaccccgcugccccgggugccccuggacgucugccucaaggcccacuggcugagcaucgaggggugccagcccgccaucccggagaacccgccgcccgcgcccaaggagcagcagaaggccgaggccaccgagccccugaaguccgccaagcccggccaggaggaggacgggccccucaagggcaaggggcagggcgccacgaccgcggacggcaaggggaaggagaagaaggccccgccccugcuggagggcgcgccccuccgccugaagccccggagcauccacgagcuguccguggagcagcagcucuacuacaaggagaucaccgaggccugcguggggagcugcgaggccaagcgcgccgaggcccugcaguccaucgccaccgacccgggccuguaccagaugcucccccgguucagcacguucaucuccgagggcguccgcgugaacgugguccagaacaaccuggcccugcucaucuaccugaugcggauggugaaggcccugauggacaaccccacccucuaccuggagaaguacgugcacgagcugauccccgcggucaugaccugcaucgugagccgccagcucugccugcggccggacguggacaaccacugggcccugcgcgacuucgccgcccggcucgucgcccagaucugcaagcacuucagcaccacgaccaacaacauccagucccgcaucaccaagaccuucaccaagagcuggguggacgagaagacgcccuggaccacccgcuacggguccaucgcgggccuggccgagcuggggcacgacgugaucaagacgcucauccugccccggcugcagcaggagggcgagcgcauccggagcguccucgacgggcccgugcuguccaacaucgaccgcaucggcgccgaccacgugcagagccugcugcucaagcacugcgccccgguccuggcgaagcugcggccgccgcccgacaaccaggacgccuaccgcgccgaguucggcucccucgggccccugcugugcagccagguggucaaggcccgggcccaggcggcccuccaggcccagcaggucaaccgcaccacccugaccaucacgcagccccggcccacccugacccucucccaggcgccccagcccggcccccgcacccccgggcugcugaaggugcccggcagcaucgcccuccccgugcagacgcugguguccgcccgggccgccgccccgccccagcccagcccgccgcccaccaaguucaucgugauguccagcuccagcuccgcccccagcacccagcagguccugucccucagcaccagcgcgcccggguccggcagcacgaccaccucccccgugaccaccacggugcccagcguccagcccaucgugaagcugguguccaccgccaccaccgccccgcccagcacggcccccuccggccccgggagcguccagaaguacaucguggugucccugccgcccaccggcgaggggaagggcgggcccaccagccaccccucccccgugcccccgcccgcgagcucccccagcccccucuccggcagcgcccugugcggcgggaagcaggaggccggcgacuccccgccgcccgcccccgggacccccaaggccaacggcagccagcccaacagcggcagcccccagcccgcgccguga

SEQ ID NO: 37400 - RNA, 1050 nt, Artificial Sequence
  derived and/or modified sequence opt1 from TAF7__Homo_sapiens__NP_005633
augagcaaguccaaggacgacgcgccccacgagcuggagagccaguucauccuccgccugccgcccgaguacgccuccaccgugcggcgcgccguccagagcggccacgugaaccugaaggaccggcucaccaucgagcugcaccccgacgggcgccacggcaucgugcgggucgaccgcgugccccuggccuccaagcucguggaccugccgugcgucauggagagccugaagacgaucgacaagaagaccuucuacaagaccgccgacaucugccagaugcucguguccaccguggacggggaccuguacccgcccgucgaggagcccguggccagcacggaccccaaggccuccaagaagaaggacaaggacaaggagaagaaguucaucuggaaccacggcaucacccugccccucaagaacgugcggaagcgccgguuccgcaagaccgcgaagaagaaguacaucgagagccccgacgucgagaaggaggugaagcggcugcuguccaccgacgccgaggccgugagcacgcgcugggagaucaucgccgaggacgagaccaaggaggcggagaaccaggggcucgacaucuccagccccggcauguccggccaccggcaggggcacgacagccuggagcacgacgagcugcgcgagaucuucaacgaccucuccagcuccagcgaggacgaggacgagacccagcaccaggacgaggaggacaucaacaucaucgacaccgaggaggaccuggagcggcagcugcaggacaagcucaacgagagcgacgagcagcaccaggagaacgagggcacgaaccagcuggucauggggauccagaagcagaucgacaacaugaagggcaagcugcaggagacccaggaccgcgccaagcggcaggaggaccucaucaugaagguggagaaccuggcccugaagaaccgcuuccaggccgugcucgacgagcugaagcagaaggaggaccgggagaaggagcagcuguccagccuccaggaggagcuggagucccugcucgagaaguga

SEQ ID NO: 37401 - RNA, 1131 nt, Artificial Sequence
  derived and/or modified sequence opt1 from TAF7L__Homo_sapiens__NP_001161946
augagcgagucccaggacgaggugcccgacgaggucgagaaccaguucauccugcgccucccgcuggagcacgccugcaccgugcggaaccuggcccgcagccaguccgugaagaugaaggacaagcucaagaucgaccugcugcccgacggccggcacgcggucguggagguggaggacgucccccucgccgccaagcugguggaccugcccugcgugaucgagagccuccgcacccuggacaagaagacguucuacaagaccgccgacaucucccagaugcuggucugcaccgccgacggggacauccaccucagcccggaggagcccgcggccuccaccgaccccaacaucgugcggaagaaggagcgcggccgggaggagaagugcguguggaagcacgggaucacgcccccgcugaagaacguccgcaagaagcgguuccgcaagacccagaagaaggugcccgacgugaaggagauggagaaguccagcuucaccgaguacaucgagagccccgacgucgagaacgaggugaagcggcugcuccgcuccgacgccgaggccgugagcacccggugggaggucaucgcggaggacggcacgaaggagaucgagucccaggggagcauccccggcuuccugaucuccagcggcauguccagccacaagcaggggcacaccuccagcgaguacgacaugcugcgcgagauguucagcgacucccggagcaacaacgacgacgacgaggacgaggacgacgaggacgaggacgaggacgaggacgaggacgaggacgaggacaaggaggaggaggaggaggacugcuccgaggaguaccucgagcgccagcugcaggccgaguucaucgagagcggccaguaccgggccaacgaggggaccuccagcaucgugauggagauccagaagcagaucgagaagaaggagaagaagcugcacaagauccagaacaaggcccagcgccagaaggaccucaucaugaagguggagaaccugacccugaagaaccacuuccaguccguccucgagcagcuggagcugcaggagaagcagaagaacgagaagcucaucagccugcaggagcagcugcagcgguuccucaagaaguga

SEQ ID NO: 37402 - RNA, 933 nt, Artificial Sequence
  derived and/or modified sequence opt1 from TAF8__Homo_sapiens__NP_612639
auggccgacgccgcggccaccgccggcgccgggggcagcgggacccgcuccggcagcaagcaguccacgaaccccgccgacaacuaccaccuggcgcggcgccggacccuccagguggucgugagcucccugcugaccgaggccggguucgagagcgccgagaaggccuccguggagacccucacggagaugcugcagagcuacaucuccgagaucggccgcagcgcgaaguccuacugcgagcacaccgcccggacccagccgacccugagcgacaucgucgugacgcucguggagaugggcuucaacgucgacacccugcccgccuacgccaagcgcucccagcggauggugaucaccgccccgcccgugaccaaccagcccgucacgcccaaggcgcugaccgccgggcagaaccgcccccacccgccccacauccccagccacuuccccgaguuccccgacccgcacaccuacaucaagacccccacguaccgggagcccguguccgacuaccaggugcuccgcgagaaggccgccagccagcggcgcgacgucgagcgggcccugacccgcuucauggcgaagaccggcgagacccagucccuguucaaggacgacgugagcacguucccccucaucgccgcccggccguucaccauccccuaccugaccgcccugcuccccuccgagcuggagaugcagcagauggaggagaccgacagcagcgagcaggacgagcagacggacaccgagaaccuggcccuccacaucuccauggaggacagcggggcggagaaggagaacaccuccgugcugcagcagaaccccagccuguccggcagccgcaacggggaggagaacaucaucgacaacccguaccuccggcccgucaagaagcccaagauccgccggaagaagucccugagcuga

SEQ ID NO: 37403 - RNA, 795 nt, Artificial Sequence
  derived and/or modified sequence opt1 from TAF9__Homo_sapiens__NP_003178
auggagagcggcaagaccgccucccccaagagcaugccgaaggacgcccagaugauggcgcagauccugaaggacauggggaucaccgaguacgagccccgcgugaucaaccagaugcucgaguucgccuuccgguacgucacgaccauccuggacgacgccaagaucuacuccagccacgccaagaaggccaccguggacgcggacgacgugcgccuggccauccagugccgggccgaccaguccuucaccagcccgccgccccgcgacuuccuccuggacaucgcccggcagcgcaaccagacgccccugccccucaucaagcccuacuccggcccccggcugccgcccgaccgcuacugccugaccgcgcccaacuaccggcucaagagccugcagaagaaggccuccaccagcgccgggcgcaucaccgucccccggcuguccgugggcagcgugacgucccgccccagcacccccacccucgggacccccacgccgcagaccauguccgucagcaccaaggugggcacccccaugucccugacgggccagcgguucaccgugcagaugcccaccagccagucccccgccgucaaggccagcaucccggcgaccagcgccgugcagaacgugcugaucaaccccucccucaucgggagcaagaacauccugaucacgaccaacaugauguccagccagaacaccgccaacgaguccagcaacgcccugaagcgcaagcgggaggacgacgacgacgacgacgacgacgacgacgacuacgacaaccucuga

SEQ ID NO: 37404 - RNA, 2007 nt, Artificial Sequence
  derived and/or modified sequence opt1 from TAGAP__Homo_sapiens__NP_001265662
augcgccggcugagccccgccuccgacuucagcggcgcccucgagaccgaccugaaggcgucccuguucgaccagccgcucagcaucaucugcggggacuccgacacccugccccgccccauccaggacauccugacgauccucugccugaagggccccagcaccgaggggaucuuccggcgcgccgccaacgagaaggcccggaaggagcugaaggaggagcucaacuccggcgacgccguggaccuggagcgccugccgguccaccuccuggcggugguguucaaggacuuccugcggagcaucccccgcaagcuccuguccagcgaccuguucgaggaguggaugggggcccucgagaugcaggacgaggaggaccggaucgaggcccugaagcaggucgccgacaagcugccccgccccaaccuccugcugcucaagcaccugguguacgugcugcaccucaucuccaagaacagcgaggucaaccggauggacuccagcaaccuggcgaucugcaucggcccgaacaugcugacccucgagaacgaccagucccugagcuucgaggcccagaaggaccugaacaacaaggugaagacccucguggaguuccugaucgacaacugcuucgagaucuucggcgagaacauccccguccacuccagcaucacguccgacgacagccuggagcacaccgacagcuccgacgugagcacccuccagaacgacuccgccuacgacagcaacgaccccgacguggaguccaacagcuccagcgggaucuccagccccucccgccagccgcagguccccauggccaccgccgcgggccuggacagcgccgggccccaggacgcccgggaggugucccccgagccgaucgugagcacggucgcccgccugaaguccagccucgcccagcccgaccggcgcuacuccgagcccagcaugcccuccagccaggagugccuggagagccgggugaccaaccagacccugaccaaguccgagggcgacuucccggugccccgcgucgggagccggcucgaguccgaggaggcggaggaccccuuccccgaggagguguucccggccgugcagggcaagacgaagcgccccgucgaccugaagaucaagaaccuggcccccggcagcgugcucccccgggcccuggugcugaaggccuucuccagcuccagccucgacgcguccagcgacuccagcccggucgccucccccagcucccccaagcgcaacuucuucagccgccaccaguccuucaccaccaagaccgagaaggggaagccgagccgggagaucaagaagcacagcauguccuucacguucgcgccccacaagaaggugcugaccaagaaccugagcgccggcuccgggaagucccaggacuucacccgcgaccacgucccccggggcgugcgcaaggagucccagcuggccggccggaucgugcaggagaacgggugcgagacccacaaccagacggcccgcggcuucugccuccggccccacgcccugagcgucgacgacguguuccagggggccgacugggagcgcccgggcuccccgcccagcuacgaggaggccaugcaggggcccgcggcccggcugguggccuccgagagccagaccgucggcuccaugaccgugggcagcaugcgcgcccggaugcucgaggcccacugccugcugccgccccugccgcccgcgcaccacguggaggacucccgccaccgggggagcaaggagccccuccccggccacgggcugagcccccuccccgagcgcuggaagcagagccggaccguccacgccuccggcgacagccuggggcacguguccggccccggccgccccgagcugcucccccugcggacggugagcgagagcguccagcgcaacaagcgggacugccuggugcgccgcugcucccagcccguguucgaggccgaccaguuccaguacgccaaggagagcuacaucuga

SEQ ID NO: 37405 - RNA, 663 nt, Artificial Sequence
  derived and/or modified sequence opt1 from TAGLN2__Homo_sapiens__NP_001264153
augagcgccuucucccuggcccucgcgcuggugagcagcccccagccgcccccgcccaucggcauggccaaccgcgggcccgccuacggccugagccgggagguccagcagaagaucgagaagcaguacgacgccgaccucgagcagauccugauccaguggaucaccacccagugccgcaaggacguggggcggccccagcccggccgcgagaacuuccagaacuggcugaaggacgggacggugcucugcgagcugaucaacgcccuguaccccgagggccaggcgccggucaagaagauccaggccuccaccauggccuucaagcagauggagcagaucagccaguuccuccaggccgcggagcgguacggcaucaacaccaccgacaucuuccagacgguggaccugugggaggggaagaacauggccugcgugcagcgcacccugaugaaccucggcgggcuggccgucgcccgggacgacggccuguucuccggggaccccaacugguuccccaagaaguccaaggagaacccccgcaacuucuccgacaaccagcuccaggagggcaagaacgugaucggccugcagauggggaccaaccggggcgccagccaggcggggaugaccggcuacggcaugccgcgccagauccuguga

SEQ ID NO: 37406 - RNA, 606 nt, Artificial Sequence
  derived and/or modified sequence opt1 from TAGLN__Homo_sapiens__NP_001001522
auggccaacaagggccccagcuacgggaugucccgcgaggugcagagcaagaucgagaagaaguacgacgaggagcuggaggagcggcucgucgaguggaucaucgugcagugcggcccggacguggggcgccccgaccggggccgccugggguuccaggucuggcugaagaacggcgugauccucuccaagcuggugaacagccuguaccccgacggcuccaagcccgucaaggugccggagaacccgcccagcaugguguucaagcagauggagcaggucgcccaguuccucaaggcggccgaggacuacggggugaucaagaccgacauguuccagaccguggaccuguucgagggcaaggacauggccgccguccagcggacgcugauggcccucgggucccuggcggugaccaagaacgacggccacuaccgcggggaccccaacugguucaugaagaaggcccaggagcacaagcgggaguucaccgagagccagcugcaggagggcaagcacgugaucggccuccagaugggguccaaccgcggcgccagccaggccgggaugaccggcuacggccggccccgccagaucaucuccuga

SEQ ID NO: 37407 - RNA, 996 nt, Artificial Sequence
  derived and/or modified sequence opt1 from TAL1__Homo_sapiens__NP_001277334
augaccgagcggcccccgagcgaggccgcccgcuccgacccccagcuggagggccgcgacgcggccgaggccagcauggccccgccccaccucgugcugcugaacggggucgccaaggagaccucccgggcggccgccgccgagccgcccgugaucgagcucggcgcgcgcgggggccccgggggcggccccgccgggggcgggggcgccgcccgggaccugaaggggcgcgacgccgcgacggccgaggcccggcaccgcgugccgaccaccgagcugugccggccgcccggccccgcccccgcccccgcgcccgccagcgucaccgccgagcuccccggcgacgggcgcauggugcagcuguccccgcccgcccuggccgcgcccgccgcccccggccgggcccuccuguacagccugucccagccgcucgccagccugggguccggcuucuucggcgagcccgacgcguuccccauguucacgaccaacaaccgcgugaagcggcgccccagcccguacgagauggagaucaccgacgggccccacaccaaggucgugcggcgcaucuucacgaacucccgggagcgcuggcggcagcagaacgugaacggcgccuucgccgagcugcgcaagcucauccccacccacccgcccgacaagaagcugagcaagaacgagauccugcggcucgccaugaaguacaucaacuuccuggcgaagcugcucaacgaccaggaggaggaggggacccagcgcgccaagaccggcaaggaccccgucgugggggccggcggcgggggcgggggcgggggcggcggggccccgcccgacgaccugcugcaggacgugcucucccccaacagcuccugcggcagcucccuggacggggccgcgagccccgacuccuacacggaggagcccgcccccaagcacaccgcccgcagccugcaccccgccaugcuccccgccgcggacggcgccgggccccgguga

SEQ ID NO: 37408 - RNA, 327 nt, Artificial Sequence
  derived and/or modified sequence opt1 from TAL2__Homo_sapiens__NP_005412
augacccgcaagaucuucaccaacacgcgggagcgcuggcggcagcagaacgugaacagcgccuucgccaagcugcgcaagcucauccccacccacccgcccgacaagaagcuguccaagaacgagacccugcggcucgcgaugcgcuacaucaacuuccuggucaaggugcugggcgagcagagccuccagcagaccgggguggccgcccagggcaacauccuggggcuguucccccagggcccccaccucccggggcuggaggaccggacgcugcucgagaacuaccagguccccucccccggccccagccaccacaucccguga

SEQ ID NO: 37409 - RNA, 1014 nt, Artificial Sequence
  derived and/or modified sequence opt1 from TALDO1__Homo_sapiens__NP_006746
augagcagcagccccgugaagcgccagcggauggaguccgcccuggaccagcucaagcaguucaccaccgucguggccgacacgggcgacuuccacgcgaucgacgaguacaagccgcaggacgccaccaccaaccccagccugauccuggccgccgcccagaugcccgcguaccaggagcucguggaggaggccaucgccuacgggcgcaagcugggcgggucccaggaggaccagaucaagaacgccaucgacaagcuguucguccucuucggcgcggagauccugaagaagauccccgggcgggugagcaccgagguggacgcccgccuguccuucgacaaggacgccauggucgcccgggcccgccggcucaucgagcuguacaaggaggcgggcaucagcaaggaccgcauccugaucaagcucuccagcacgugggagggcauccaggccgggaaggagcuggaggagcagcacggcauccacugcaacaugacccuccuguucuccuucgcccaggccguggccugcgcggaggccggggugacccugaucagcccguucgucggccggauccuggacuggcacguggccaacaccgacaagaaguccuacgagccccucgaggaccccggggucaagagcgugacgaagaucuacaacuacuacaagaaguucuccuacaagaccaucgugaugggcgccagcuuccgcaacaccggcgagaucaaggcccuggcggggugcgacuuccugaccaucucccccaagcuccugggcgagcugcuccaggacaacgccaagcuggugccgguccugagcgccaaggccgcccaggcguccgaccucgagaagauccaccuggacgagaaguccuuccgguggcugcacaacgaggaccagauggccguggagaagcucagcgacgggauccgcaaguucgccgccgacgcggugaagcuggagcggaugcugacggagcgcauguucaacgccgagaacggcaaguga

SEQ ID NO: 37410 - RNA, 951 nt, Artificial Sequence
  derived and/or modified sequence opt1 from TAMM41__Homo_sapiens__NP_620162
auggcccugcagacccuccagagcuccugggugaccuuccgcaagauccugagccacuuccccgaggagcugucccucgccuucgucuacggcagcgggguguaccggcaggcgggccccuccagcgaccagaagaacgccaugcuggacuucguguucacggucgacgaccccguggccuggcacuccaagaaccugaagaagaacuggagccacuacuccuuccucaaggugcuggggcccaagaucaucaccagcauccagaacaacuacggcgccggggucuacuacaacucccugaucaugugcaacggccgccucaucaaguacggcgugaucagcaccaacgugcugaucgaggaccugcucaacuggaacaaccuguacaucgccgggcggcugcagaagcccgucaagaucaucuccgugaacgaggacgugacccuccgcagcgcgcuggaccggaaccugaaguccgccgucacggccgccuuccucaugcugccggagagcuucuccgaggaggaccuguucaucgagaucgcgggccucagcuacuccggggacuuccgcaugguggugggcgaggacaagaccaagguccugaacaucgugaagcccaacaucgcccacuuccgggagcuguacgggagcauccuccaggagaacccccagguggucuacaagagccagcagggcuggcuggagaucgacaagucccccgagggccaguucacccagcugaugacccucccgaagacgcugcagcagcagaucaaccacaucauggacccgcccgggaagaaccgcgacguggaggagacccuguuccagguggcccacgaccccgacugcggcgacgucgugcggcucgggcugaagaaguccgugaucuacagcagccugaagcuccacaagauguggaagggcuggcugcgcaagaccuccuga

SEQ ID NO: 37411 - RNA, 5586 nt, Artificial Sequence
  derived and/or modified sequence opt1 from TANC1__Homo_sapiens__NP_203752
augcugaaggccgugcucaagaagucccgggagggcgggaagggcgggaagaaggaggccggcuccgacuucgggcccgagaccagcccgguccugcaccuggaccacuccgccgacagccccguguccagccuccccaccgccgaggacaccuaccgggugucccuggccaagggcgucagcaugucccugcccagcagcccccuccugccccgccagagccaccuggugcagucccgggugaacaagaagucccccggccccguccgcaagccgaaguacguggagagcccccgggugcccggggacgccgucaucaugcccuuccgcgagguggccaagccgaccgagcccgacgagcacgaggccaaggccgacaacgagcccagcugcucccccgccgcccaggagcuccugacccggcugggcuuccuccugggggagggcaucccgagcgccacccacaucaccaucgaggacaagaacgagaccaugugcaccgcccugucccaggggaucagccccugcagcacccucaccuccagcaccgccucccccagcaccgacucccccugcagcacccugaacuccugcgugagcaagaccgccgccaacaaguccccgugcgagaccaucagcucccccagcuccacccuggagagcaaggacuccggcaucaucgcgaccaucacgagcuccagcgagaacgacgaccgcuccggcagcagccucgaguggaacaaggacgggaaccugcggcugggcguccagaagggggugcuccacgaccgccgggccgacaacugcucccccguggccgaggaggagaccaccggcagcgccgaguccacccugcccaaggccgagagcuccgcgggcgacgggccgguccccuacagccagggcuccagcucccugaucaugccccgccccaacagcguggccgccacguccagcaccaagcucgaggaccuguccuaccuggacgggcagcggaacgccccgcuccgcaccagcauccggcugcccuggcacaacaccgccggcgggcgcgcgcaggaggugaaggcccgguucgcccccuacaagccgcaggacauccugcucaagccccugcuguucgagguccccuccaucacgaccgacagcguguucgugggccgcgacuggcuguuccaccagaucgaggagaaccugcggaacaccgagcuggccgagaaccgcggcgccgucgugguggggaacgucggcuucgggaagaccgcgaucaucuccaagcucguggcccugagcugccacggcagccggaugcgccagaucgccuccaacagccccggguccagcccgaagacguccgaccccacccaggaccugcacuucacgccccuccugagccccuccagcuccaccagcgccuccagcacggcgaagaccccgcugggcuccaucagcgccgagaaccagcgcccccgggaggacgccgucaaguaccucgccuccaaggugguggccuaccacuacugccaggcggacaacaccuacacgugccugguccccgaguucgugcacagcaucgccgcccugcucugccgcucccaccagcuggccgccuaccgggaccugcucaucaaggagccccagcugcagagcaugcugucccugcgcagcugcgugcaggacccggucgcggccuucaagcggggcgugcucgagccccugacgaaccugcgcaacgagcagaagauccccgaggaggaguacaucauccucaucgacgggcugaacgaggccgaguuccacaagcccgacuacggcgacacccugagcuccuucaucaccaagaucaucagcaaguucccggccuggcucaagcugaucgugaccguccgggccaacuuccaggagaucaucuccgcgcugcccuucgugaagcucucccuggacgacuuccccgacaacaaggacauccacuccgaccugcacgccuacgugcagcaccgcguccacagcucccaggacauccucagcaacaucucccugaacgggaaggccgacgccacccugaucgggaaggugagcucccaccucgugcugcggagccugggguccuaccucuaccugaagcugacgcucgaccuguuccagcgcggccaccuggucaucaagagcgcguccuacaagguggugcccgucagccucuccgagcuguaccugcuccagugcaacaugaaguucaugacccagagcgccuucgagcgggcccugccgauccugaacguggcccucgccucccugcaccccaugaccgacgagcagaucuuccaggcgaucaacgccggccacauccagggggagcagggcugggaggacuuccagcagcgcauggacgcccugagcugcuuccucaucaagcggcgcgacaagacccggauguucugccaccccagcuuccgcgaguggcugguguggcgggccgacggggagaacacggccuuccugugcgagccccgcaacggccacgcgcuccuggccuucauguucucccggcaggagggcaagcugaaccgccagcagaccauggagcucgggcaccacauccugaaggcccacaucuucaagggccugagcaagaagaccgggaucuccagcucccaccuccaggcccuguggaucggcuacagcaccgaggggcuguccgccgcgcucgccagccugcgcaaccuguacacgccgaacgucaaggugucccggcuccugauccugggcggcgccaacgugaacuaccgcaccgagguccucaacaacgcccccauccugugcgugcagagccaccuggggcacgaggagguggucacccuccugcuggaguucggcgcgugccucgacgggaccuccgagaacggcaugacggcccugugcuacgccgccgccgcggggcacaugaagcuggugugccuccugaccaagaagggcgugcgggucgaccaccuggacaagaagggccagugcgcccucgugcacagcgcccugcgcgggcacggcgacauccugcaguaccuccugaccugcgaguggucccccgggccgccccagcccggcacccugcgcaagagccacgcccuccagcaggcccugacggcggccgccuccauggggcacagcuccgugguccagugccugcucggcauggagaaggagcacgagguggaggugaacggcaccgacacccuguggggcgagaccgcccugacggccgcggccggccgcgggaagcucgaggucugcgagcugcugcucggccacggggccgccgugagccggaccaaccgccggggcgugcccccgcuguucugcgccgcgcgccagggccacuggcagaucguccggcugcuccuggagcgcgggugcgacgugaaccuguccgacaagcagggccggacgccccucaugguggccgccugcgaggggcaccugagcaccgucgaguuccugcucagcaagggcgccgcgcuguccagccuggacaaggagggccucuccgcccugagcugggccugccugaaggggcaccgcgccguggugcaguaccucgucgaggagggcgccgcgaucgaccagacggacaagaacgggcggacgccccucgaccuggccgccuucuacggcgacgccgagaccgugcuguaccucguggagaagggggccgucaucgagcacguggaccacuccggcaugcgcccccuggaccgggcgaucggcugccgcaacaccagcguggucguggcccugcuccggaagggggccaagcugggcaacgccgccugggcgauggccacguccaagccggacauccugaucauccuccugcagaagcugauggaggaggggaacgucauguacaagaagggcaagaugaaggaggccgcccagcgcuaccaguacgcgcuccggaaguucccccgcgagggguucggcgaggacaugcgccccuucaacgagcugcgggugagccuguaccucaaccugucccgcugccggcgcaagaccaacgacuucggcauggccgaggaguucgccagcaaggcccuggagcucaagcccaaguccuacgaggccuucuacgcgcgggcccgcgccaagcggaacagccgccaguucguggccgcccuggcggaccugcaggaggccgucaagcucugcccgaccaaccaggaggugaagcggcugcuggcccgcguggaggaggagugcaagcagcuccagcggucccagcagcagaagcagcaggggccccugcccgcgccccugaacgacagcgagaacgaggaggacaccccgacgcccggccucuccgaccacuuccacagcgaggagaccgaggaggaggagaccagcccccaggaggagagcgucucccccaccccgcgcagccagcccagcuccagcgugcccuccagcuacauccggaaccugcaggaggggcugcaguccaagggccgccccgugagcccgcagucccgggccgggaucggcaagagccuccgcgagcccgucgcgcagcccggccugcugcuccagcccuccaagcaggcccagaucgugaagacgagccagcaccugggguccggccagagcgccgugcggaacggguccaugaagguccagaucagcucccagaacccgccgcccagcccgaugcccggccgcaucgccgcgacccccgccggcucccggacccagcaccuggaggggaccggcaccuucacgacccgcgccgggugcggccacuucggggaccgccucggccccagccagaacgugcggcugcagugcggcgagaacgggccggcccacccccugcccuccaagaccaagaccacggagcgccuccugagccacagcuccguggccgucgacgcggcgccgcccaaccagggcgggcuggcgaccugcagcgacgugcggcaccccgccucccucaccagcuccggcagcuccgggagccccuccagcuccaucaagaugagcuccagcaccuccagccugacguccagcagcuccuucagcgacggcuucaaggugcagggccccgacacccgcaucaaggacaaggucgugacccacgugcaguccgggaccgccgagcaccggccccgcaacacgcccuucaugggcaucauggacaagaccgcgcgguuccagcagcagagcaacccgcccucccgcagcuggcacugcccggcccccgaggggcugcucaccaacaccuccagcgccgccggccugcaguccgccaacacggagaagcccagccugaugcaggucgggggcuacaacaaccaggcgaagaccugcuccgugagcacccucuccgccagcgugcacaacggcgcccaggucaaggagcuggaggaguccaagugccagauccccgugcacagccaggagaaccggaucaccaagacggugucccaccuguaccaggagagcaucuccaagcagcagccgcacaucagcaacgaggcccaccgcagccaccucaccgccgcgaagcccaagcgguccuucaucgagagcaacgucuga

SEQ ID NO: 37412 - RNA, 5973 nt, Artificial Sequence
  derived and/or modified sequence opt1 from TANC2__Homo_sapiens__XP_005257260
auguuccgcaacagccugaagaugcuccugaccggcgggaaguccagccggaagaaccgcuccagcgacggcggguccgaggagcccccggaccggcgccagagcuccgucgacagccggcagucccgcagcggccagggcgggaucuccaccgagagcgacugcgccuucgagcccgacuacgccgugccgccccucccgguguccgagggcgacgcggagcaggagcucgggccgccgcccagcguggacgaggccgccaacacccugaugacccggcugggcuuccuccugggggagaaggucaccgaggugcagccgggcgaccaguacuccauggaggugcaggacgagaaccagaccagcgccaucacccagcgcaucucccccugcagcacccugaccuccagcaccgccagcccgcccgcguccagccccugcuccacccugccgcccaucagcaccaacgccaccgccaaggacugcuccuacggggccgucaccagccccaccuccacccuggagagccgggacuccggcaucaucgcgacccugaccagcuacuccgagaacguggagcgcacgaaguacgccggcgagagcuccaaggagcucgggagcggcgggaacaucaagccguggcagucccagaaguccuccauggacagcugccuguaccggguggacgagaacaugaccgccuccaccuacagccugaacaagauccccgagcgcaaccucgagaccguccugagccaguccgugcagagcaucccccuguaccucaugccccggccgaacuccguggccgccaccagcuccgcgcaccuggaggaccuggccuaccucgacgagcagcgccacacgccccugcggaccagccugcgcaugccccggcaguccaugggcggcgcccgcacccagcaggaccuccggguccgcuucgcccccuaccggccgcccgacaucagccugaagccccuccuguucgaggugcccuccaucaccaccgagagcguguucgucgggcgcgacuggguguuccacgagaucgacgcccagcugcaguccagcaacgcguccgugaaccagggcgucgugaucguggggaacaucggcuucgggaagaccgccaucaucagccgccuggucgcccucuccugccacggcacccggaugcgccagaucgccagcgacuccccgcacgccagccccaagcacguggacgcgaaccgggagcugccccugacgcagccgcccagcgcccacuccagcaucaccuccggcagcugccccgggacccccgagaugcgccggcgccaggaggaggccaugcggcgccucgccucccagguggucgccuaccacuacugccaggcggacaacgccuacacgugccuggugccggaguucguccacaacguggccgcccugcucugccggagcccccagcugaccgcguaccgcgagcagcugcuccgggagccccaccuccaguccaugcugagccuccgcuccugcgugcaggaccccauggccagcuuccggcgcggcguccuggagccgcuggagaaccuccacaaggagcggaagauccccgacgaggacuucaucauccugaucgacgggcugaacgaggccgaguuccacaagcccgacuacggcgacaccaucguguccuuccucagcaagaugaucgggaaguuccccuccuggcugaagcugaucgugaccguccgcaccagccugcaggagaucacgaagcuccugccguuccaccggaucuuccuggaccgccucgaggagaacgaggccaucgaccaggaccugcaggccuacauccugcaccggauccacuccagcuccgagauccagaacaacaucagccucaacggcaagauggacaacaccaccuucggcaagcuguccagccaccugaagacccucagccagggguccuaccuguaccugaagcucaccuucgaccugaucgagaagggcuaccuggugcucaagagcuccagcuacaaggugguccccgugucccugagcgagguguaccugcuccagugcaacaugaaguuccccacgcaguccagcuucgaccgcgucaugccccugcugaacguggcgguggccucccuccacccgcugaccgacgagcacaucuuccaggccaucaacgccgggagcaucgagggcacccuggagugggaggacuuccagcagcgcauggagaaccucuccauguuccugaucaagcggcgcgacaugacccggauguucguccaccccagcuuccgcgaguggcugaucuggcgggaggagggggagaagacgaaguuccucugcgacccccgcuccggccacacccugcuggccuucugguucagccggcaggagggcaagcucaaccgccagcagaccaucgagcuggggcaccacauccugaaggcgcacaucuucaagggccucuccaagaaggugggggugagcuccagcauccugcagggccuguggaucuccuacagcaccgagggccucagcauggcccuggccucccugcggaaccucuacacgcccaacaucaaggucagccgccugcugauccucgggggcgccaacaucaacuaccggaccgaggugcugaacaacgccccgauccugugcgugcagucccaccucggguacaccgagauggucgcgcugcugcucgaguucggcgccaacguggacgccagcuccgagagcgggcugacgccccugggcuacgccgcggccgccggcuaccucuccaucgugguccugcugugcaagaagcgcgccaagguggaccaccucgacaagaacgggcagugcgcccuggugcacgcggcccugcggggccaccucgaggucgugaaguuccugauccagugcgacuggacgauggccgggcagcagcagggcguguucaagaagucccacgccauccagcaggcccugaucgcggccgccagcaugggguacaccgagaucgucagcuaccuccuggaccugcccgagaaggacgaggaggagguggagcgcgcccagaucaacuccuucgacagccucuggggcgagaccgcccugaccgcggccgccggccgggggaagcuggaggugugccgccuccugcuggagcagggcgccgcggucgcccagcccaaccggcgcggggccgugccccuguucuccacggugcggcagggccacuggcagaucgucgaccugcugcucacccacggggccgacgugaacauggccgacaagcagggccgcacgccccugaugauggcggccagcgagggccaccuggggaccguggacuuccuccuggcccagggcgccuccaucgcccugauggacaaggaggggcucacggcgcugagcugggccugccugaagggccaccucuccgucgugcggagccugguggacaacggggccgccaccgaccacgccgacaagaacggccgcacgccccuggaccucgcggccuucuacggcgacgccgaggucgugcaguuccugguggaccacggggccaugaucgagcacgucgacuacuccggcaugcgcccgcuggaccgggccguggggugccgcaacaccagcguggucgugacgcuccugaagaagggcgcgaagaucggccccgccaccugggccauggccaccagcaagcccgacaucaugaucauccugcucuccaagcugauggaggagggggacauguucuacaagaagggcaaggugaaggaggcggcccagcgguaccaguacgcccugaagaaguucccccgcgagggguucggcgaggaccucaagaccuuccgggagcugaaggucagccugcugcucaaccugucccgcugccggcgcaagaugaacgacuucgggauggccgaggaguucgccacgaaggcgcuggagcucaagcccaaguccuacgaggccuacuacgcccgggcccgcgccaagcgguccagccgccaguucgcggccgcccuggaggaccugaacgaggccaucaagcucugccccaacaaccgggagauccagcgccugcugcuccggguggaggaggagugccgccagaugcagcagccccagcagcccccgccgccgccccagccgcagcagcagcugcccgaggaggccgagcccgagccccagcacgaggacaucuacuccguccaggacaucuucgaggaggaguaccuggagcaggacguggagaacgugagcaucggccuccagaccgaggcgcggccgucccagggccugcccgucauccaguccccgcccuccagcccgccccaccgcgacuccgccuacaucagcuccagcccccuggggucccaccagguguucgacuuccggagcuccagcagcgugggcucccccacccgccagaccuaccagagcacguccccggcccucagccccacccaccagaacucccacuaccgccccuccccgccccacaccucccccgcccaccagggcgggagcuaccgguucagcccgccgcccgucgggggccagggcaaggaguaccccuccccgccgcccagcccccugcgccgggggccccaguaccgcgcgagcccgcccgccgaguccaugagcguguaccggucccagagcggcucccccgugcgcuaccagcaggagaccagcgucucccagcugcccgggcggcccaagagcccccucagcaagauggcccagcgccccuaccagaugccccagcugcccguggccgugccccagcagggccugcggcuccagcccgccaaggcgcagaucguccgcuccaaccagcccagccccgccgugcacuccagcacggugauccccaccggggccuacggccaggucgcccacuccauggccagcaaguaccaguccagccagggcgacaucggggugucccagagccggcugguguaccagggcuccaucgggggcaucgucggcgacgggcgccccgugcagcacgugcaggcgagccuguccgccggcgccaucugccagcacgggggccucaccaaggaggaccugccccagcggcccagcuccgccuaccgcgggggcguccgguacagccagacgccccagaucggccgcucccagagcgccagcuacuaccccgugugccacuccaagcuggaccucgagcggagcuccagccagcuggggucccccgacgugagccaccugauccgccggcccaucuccgucaaccccaacgagaucaagccccacccgcccacgccccggccccuccugcacagccaguccgugggccugcgguucagccccuccagcaacuccaucagcuccacgagcaaccucacccccaccuuccgccccuccagcuccauccagcagauggagaucccccugaagccggcguacgagcgcagcugcgacgagcugagccccgugucccccacccagggcggguaccccagcgagccgacgcggucccgcaccacccccuucauggggaucaucgacaagaccgcccggacgcagcaguacccccaccuccaccagcagaaccgcaccugggccgucagcuccguggacaccgugcugagccccaccuccccgggcaaccugccccagcccgagagcuucagcccgcccagcuccaucagcaacaucgccuucuacaacaagacgaacaacgcgcagaacggccaccuccuggaggacgacuacuacagcccccacgggaugcuggccaacggcagccgcggggaccuccuggagcgcgucucccaggccagcuccuaccccgacgugaagguggcccggacccugcccgucgcccaggcguaccaggacaaccucuaccgccagcugagccgggacucccgccagggccagaccagccccaucaagcccaagcggcccuucguggagagcaacguguga

SEQ ID NO: 37413 - RNA, 831 nt, Artificial Sequence
  derived and/or modified sequence opt1 from TANGO2__Homo_sapiens__NP_001270045
augugcaucaucuucuucaaguucgacccccgcccggugagcaagaacgccuaccggcugauccucgccgcgaaccgcgacgaguucuacucccggcccagcaagcuggccgacuucuggggcaacaacaacgagauccuguccgggcucgacauggaggagggcaaggagggcgggaccuggcuggggaucagcacccgcggcaagcuggccgcccucacgaacuaccugcagccccagcuggacuggcaggcccggggccgcggggagcucgucacccacuuccugaccaccgacguggacucccugagcuaccucaagaagguguccauggagggccaccuguacaacggguucaaccugaucgcggccgaccucagcacggccaagggcgacgucaucugcuacuacgggaaccggggcgagcccgacccgaucgugcugacccccggcaccuacgggcuguccaacgcccuccuggagacccccuggcgcaagcugugcuucggcaagcagcuguuccucgaggcgguggagcggagccaggcccugcccaaggacguccucaucgccucccugcuggacgugcucaacaacgaggaggcccagcugccggaccccgccaucgaggaccagggcggggaguacgugcagcccaugcugagcaaguacgcggccgucugcgugcgcugccccggcuacgggacgcggaccaacaccaucauccucguggacgccgacggccacgucaccuucacggagcgcuccaugauggacaaggaccugagccacugggagacccggaccuacgaguucacccugcaguccuga

SEQ ID NO: 37414 - RNA, 1278 nt, Artificial Sequence
  derived and/or modified sequence opt1 from TANK__Homo_sapiens__NP_004171
auggacaagaacaucggcgagcagcugaacaaggccuacgaggccuuccgccaggcgugcauggaccgggacagcgccgugaaggagcuccagcagaagaccgagaacuacgagcagcgcauccgggagcagcaggagcagcugucccugcagcagaccaucaucgacaagcucaagagccagcugcugcucgucaacuccacgcaggacaacaacuacgggugcgugccccugcuggaggacagcgagacccgcaagaacaaccucacccuggaccagccccaggacaaggugaucuccggcaucgcccgggagaagcugcccaagguccgccggcaggaggugagcagcccccgcaaggagaccuccgcccggucccucgggagcccccugcugcacgagcgcggcaacaucgagaagacguucugggaccucaaggaggaguuccacaagaucugcaugcuggccaaggcgcagaaggaccaccuguccaagcucaacaucccggacaccgccaccgagacccagugcagcgugcccauccagugcacggacaagaccgacaagcaggaggcccuguucaagccccaggccaaggacgacaucaaccgcggggcgcccuccaucaccagcgucaccccgcggggccugugccgggacgaggaggacacguccuucgagagccucuccaaguucaacgugaaguucccgcccauggacaacgacagcaccuuccugcacuccacccccgagcgccccggcauccugagccccgccaccagcgaggccgugugccaggagaaguucaacauggaguuccgggacaaccccgggaacuucgucaagacggaggagacccucuucgagauccagggcaucgaccccaucgccuccgccauccagaaccugaagaccaccgacaagacgaagccgagcaaccuggugaacacgugcauccgcaccacccucgaccgggcggccugccugccgcccggggaccacaacgcccuguacgugaacuccuucccccuccuggaccccagcgacgcccccuuccccucccuggacagccccggcaaggccauccgcgggccgcagcagcccaucuggaagcccuuccccaaccaggacuccgacagcgucgugcucuccggcaccgacagcgagcugcacaucccgcgggugugcgaguucugccaggcggucuucccgcccuccaucaccagccgcggcgacuuccugcggcaccucaacucccacuucaacggggagaccuga

SEQ ID NO: 37415 - RNA, 2562 nt, Artificial Sequence
  derived and/or modified sequence opt1 from TAOK1__Homo_sapiens__NP_079418
augcccagcaccaaccgcgccggcucccugaaggacccggagaucgccgagcuguucuucaaggaggaccccgagaagcuguucaccgaccugcgggagaucgggcacggcagcuucggggcgguguacuucgcccgcgacguccggacgaacgaggugguggccaucaagaagauguccuacagcggcaagcaguccaccgagaaguggcaggacaucaucaaggaggucaaguuccuccagcgcaucaagcaccccaacagcaucgaguacaaggggugcuaccugcgggagcacaccgccuggcuggugauggaguacugccucggcuccgccagcgaccugcuggaggugcacaagaagccccuccaggaggucgagaucgcggccaucacccacggcgcccugcaggggcuggccuaccuccacucccacacgaugauccaccgcgacaucaaggcgggcaacauccugcugaccgagccgggccaggugaagcucgccgacuucgggagcgccuccauggccagccccgccaacuccuucguggggacccccuacuggauggcgcccgaggucauccuggccauggacgagggccaguacgacggcaagguggacguguggagccuggggaucacgugcaucgagcucgccgagcggaagccgccccuguucaacaugaacgccauguccgcccuguaccacaucgcgcagaacgagagccccacgcuccaguccaacgaguggagcgacuacuuccgcaacuucgucgacuccugccugcagaagaucccccaggaccggccgaccagcgaggagcugcucaagcacaucuucgugcugcgcgagcggcccgagaccgugcugaucgaccucauccagcgcaccaaggacgccguccgggagcuggacaaccugcaguaccgcaagaugaagaagcuccuguuccaggaggcccacaacggccccgccguggaggcccaggaggaggaggaggagcaggaccacggggugggccggacgggcaccgucaacagcgugggguccaaccagagcauccccuccaugagcaucuccgcgagcucccagagcuccagcgugaacucccugccggacgucagcgacgacaaguccgagcucgacaugauggagggcgaccacaccgugaugagcaacuccagcgugauccaccugaagcccgaggaggagaacuaccgcgaggagggggacccccggacccgcgccuccgacccccagagcccgccccaggucucccggcacaagagccacuaccgcaaccgggagcacuucgccacgauccgcaccgccagccuggugacccgccagaugcaggagcacgagcaggacuccgagcuccgggagcagaugagcggcuacaagcgcaugcggcgccagcaccagaagcagcugaugacccuggagaacaagcucaaggccgagauggacgagcaccggcugcgccuggacaaggaccucgagacgcagcggaacaacuucgcggccgagauggagaagcugaucaagaagcaccaggccgccauggagaaggaggcgaaggucauguccaacgaggagaagaaguuccagcagcacauccaggcccagcagaagaaggagcugaacagcuuccucgagucccagaagcgcgaguacaagcugcggaaggagcagcugaaggagagcaaggagcuccagaucaagaagcaguuccaggacacgugcaagauccagacccgccaguacaaggcccugcggaaccaccuccuggagaccacccccaaguccgagcacaaggccgugcucaagcgccugaaggaggagcagacccggaagcuggccauccucgcggagcaguacgaccacagcaucaacgagaugcuguccacccaggcccugcgccucgacgaggcccaggaggccgagugccaggugcugaagaugcagcugcagcaggagcucgagcugcugaacgccuaccagagcaagaucaagaugcaggcggaggcccagcacgaccgggagcuccgcgagcuggagcagcgggucucccugcgccgggcccuccuggagcagaagaucgaggaggagaugcuggcccuccagaacgagcgcaccgagcgcauccggagccugcuggagcgccaggcccgggagaucgaggcguucgacuccgagagcaugcgccucggguucuccaacauggugcugagcaaccugucccccgaggccuucagccacagcuacccgggcgccuccggcuggagccacaaccccaccgggggccccgggccccacuggggccacccgaugggcgggccgccccaggccuggggccaccccaugcagggcgggccccagcccugggggcaccccuccggcccgaugcagggggugccccggggcagcuccaugggcguccgcaacagcccccaggcgcuccggcgcaccgccuccgggggccggaccgagcaggggaugagccgcuccaccagcgugacgucccagaucagcaacggcucccacaugagcuacaccuga

SEQ ID NO: 37416 - RNA, 3369 nt, Artificial Sequence
  derived and/or modified sequence opt1 from TAOK2__Homo_sapiens__NP_001238972
augcccgccggcgggcgcgccggcagccugaaggaccccgacguggcggagcuguucuucaaggacgaccccgagaagcuguucuccgaccugcgggagaucgggcacggcagcuucggggccgucuacuucgcccgcgacgugcggaacuccgagguggucgccaucaagaagaugagcuacuccggcaagcagagcaacgagaaguggcaggacaucaucaaggaggugcgcuuccuccagaagcugcggcaccccaacaccauccaguaccgcggcugcuaccugcgggagcacaccgccuggcucgugauggaguacugccugggguccgcgagcgaccugcucgagguccacaagaagccccugcaggagguggagaucgccgccgugacgcacggcgcccugcaggggcucgcguaccugcacucccacaacaugauccaccgcgacgucaaggccggcaacauccugcucagcgagccggggcuggugaagcugggcgacuucggcuccgccagcaucauggcccccgccaacuccuucguggggacccccuacuggauggcgcccgaggucauccucgccauggacgagggccaguacgacgggaagguggacguguggagccugggcaucacgugcaucgagcuggccgagcggaagccgccccucuucaacaugaacgccauguccgcccuguaccacaucgcgcagaacgagagccccguccugcaguccggccacuggagcgaguacuuccgcaacuucguggacuccugccuccagaagaucccccaggaccggccgaccagcgaggugcugcugaagcaccgcuucguccuccgggagcgcccgcccaccgugaucauggaccugauccagcggaccaaggacgccgugcgcgagcuggacaaccuccaguaccggaagaugaagaagauccuguuccaggaggcccccaacgggcccggcgccgaggcccccgaggaggaggaggaggcggagcccuacaugcaccgcgccgggacccugaccagccucgaguccagccacuccguccccagcauguccaucagcgccuccagccaguccagcuccgugaacagccuggccgacgccuccgacaacgaggaggaggaggaggaggaggaggaggaggaggaggaggaggagggcccggaggcgcgggagauggccaugaugcaggagggggagcacacggugaccagccacuccagcaucauccaccgccugcccggcuccgacaaccucuacgacgaccccuaccagcccgagaucaccccgagcccccugcagccgcccgccgcccccgcgcccaccuccacgaccagcagcgcccggcgccgcgccuacugccggaaccgcgaccacuucgccaccauccggaccgccucccuggucagccgccagauccaggagcacgagcaggacuccgcgcuccgggagcagcugagcggcuacaagcgcaugcggcgccagcaccagaagcagcugcucgcccuggagucccggcugcgcggggagcgggaggagcacagcgcccgccuccagcgggagcuggaggcccagcgcgccggcuucggggcggaggccgagaagcuggcccggcgccaccaggccaucggcgagaaggaggcccgggcggcccaggccgaggagcgcaaguuccagcagcacauccucgggcagcagaagaaggagcuggccgcgcugcuggaggcccagaagcggacguacaagcuccgcaaggagcagcugaaggaggagcugcaggagaaccccuccaccccgaagcgcgagaaggccgaguggcuccugcggcagaaggagcagcugcagcagugccaggccgaggaggaggccggccuccugcgccggcagcgccaguacuucgagcugcagugccggcaguacaagcgcaagaugcuccuggcgcggcacagccuggaccaggaccuccugcgcgaggaccugaacaagaagcagacccagaaggaccucgagugcgcccugcugcuccggcagcacgaggccacccgcgagcuggagcugcggcagcuccaggccgugcagcgcacgcgggccgagcugacccgccugcagcaccagaccgagcucggcaaccagcuggaguacaacaagcggcgcgagcaggagcugcggcagaagcacgcggcccagguccgccagcagcccaagucccucaaggagcggagcaucguggggcaggaggaggccggcaccuggucccugugggggaaggaggacgagagccugcucgacgaggaguucgagcugggcugggugcaggggcccgcccugacgcccgucccggaggaggaggaggaggaggaggagggcgcccccaucggcacgccccgcgaccccggggacggcugcccgucccccgacaucccgcccgagcccccgcccacccaccuccggcccugccccgcgagccagcugcccgggcugcucucccacggccugcuggccggccucagcuucgccgugggguccagcagcggccugcugccccuccugcugcuccugcugcucccccugcuggccgcgcagggcggcgggggccuccaggccgcccugcuggcccucgaggugggccuggucgggcugggcgccuccuaccuccugcugugcaccgcgcuccaccucccgagcucccuguuccuccugcuggcccaggggaccgcccucggcgccgugcuggggcugagcuggcgccgcggccucaugggcgugccccuggggcugggcgccgcguggcuccuggccuggcccgggcuggcccucccccuggucgccauggccgcgggcgggcggugggugcgccagcagggcccgcgggugcgccggggcaucucccgccuguggcuccggguccugcugcgccucagccccauggccuuccgggcccugcaggggugcggcgccgugggggaccgcggccuguucgcccucuaccccaagaccaacaaggacggguuccggucccgccugccggugcccggcccccggcgccggaacccccgcaccacccagcacccgcuggcgcuccuggcccgggucugggugcugugcaagggcuggaacuggcgccucgcccgggccagccaggggcuggcgucccaccucccgcccugggccauccacacgcuggccagcuggggccugcugcgcggggagcgccccacccggaucccccgccugcucccccggucccagcgccagcuggggccgcccgccagccggcagccccugcccggcacccucgccgggcgccggucccgcacccggcagagccgcgcgcugccgcccuggcgguga

SEQ ID NO: 37417 - RNA, 2697 nt, Artificial Sequence
  derived and/or modified sequence opt1 from TAOK3__Homo_sapiens__NP_057365
augcgcaagggcgugcugaaggaccccgagaucgccgaccucuucuacaaggacgacccggaggagcuguucaucgggcugcacgagaucggccacgggagcuucggcgccgucuacuucgcgaccaacgcccacaccuccgaggugguggccaucaagaagaugagcuacuccgggaagcagacgcacgagaaguggcaggacauccucaaggaggucaaguuccugcggcagcugaagcaccccaacaccaucgaguacaagggcugcuaccucaaggagcacaccgccuggcuggugauggaguacugccugggcagcgccuccgaccuccuggaggugcacaagaagccccugcaggaggucgagaucgcggccaucacccacggggcccuccacggccuggccuaccugcacagccacgcgcucauccaccgcgacaucaaggccgggaacauccugcugacggagcccggccaggugaagcucgccgacuucggguccgccagcauggccuccccggcgaacagcuucgugggcacccccuacuggauggcccccgaggucauccuggccauggacgagggccaguacgacgggaagguggacaucuggucccugggcaucacgugcaucgagcucgccgagcggaagcccccgcuguucaacaugaacgccaugagcgcgcuguaccacaucgcccagaacgacucccccacccuccagagcaacgaguggaccgacuccuuccgccgguucguggacuacugccugcagaagaucccccaggagcgccccaccagcgccgagcugcuccggcacgacuucguccgccgggaccgcccgcugcgggugcugaucgaccucauccagcgcaccaaggacgccgugcgggagcuggacaaccugcaguaccgcaagaugaagaagauccucuuccaggagacccggaacgggccccugaacgagucccaggaggacgaggaggacagcgagcacggcacgucccugaaccgcgagauggacagccucggcagcaaccacuccauccccagcauguccgucagcaccgggucccagagcuccagcgugaacuccaugcaggaggugauggacgagagcuccagcgagcuggucaugaugcacgacgacgaguccaccaucaacagcuccagcuccguggugcacaagaaggaccacgucuucauccgggacgaggccggccacggggacccccgcccggagccccggcccacccagagcgugcagucccaggcgcugcacuaccgcaaccgggagcgcuucgccacgaucaagagcgccagccucgugacccgccagauccacgagcacgagcaggagaacgagcugcgggagcagauguccggcuacaagcgcaugcggcgccagcaccagaagcagcugaucgcccucgagaacaagcugaaggccgagauggacgagcaccggcugaagcuccagaaggaggucgagacccacgcgaacaacagcuccaucgagcuggagaagcuggccaagaagcaggucgccaucaucgagaaggaggccaagguggcggccgccgacgagaagaaguuccagcagcagauccucgcccagcagaagaaggaccugaccacguuccuggagagccagaagaagcaguacaagaucugcaaggagaagaucaaggaggagaugaacgaggaccacuccacccccaagaaggagaagcaggagcgcaucagcaagcacaaggagaaccugcagcacacccaggccgaggaggaggcgcaccuccugacccagcagcggcuguacuacgacaagaacugccgcuucuucaagcggaagaucaugaucaagcgccacgagguggagcagcagaacauccgggaggagcucaacaagaagcgcacgcagaaggagauggagcacgccaugcugauccggcacgacgaguccacccgcgagcuggaguaccggcagcuccacacccugcagaagcugcgcauggaccucauccggcugcagcaccagaccgagcuggagaaccagcucgaguacaacaagcgccgggagcgcgagcugcaccgcaagcacgugauggagcugcggcagcagccgaagaaccucaaggccauggagaugcagaucaagaagcaguuccaggacacgugcaagguccagaccaagcaguacaaggcccugaagaaccaccagcuggaggugacccccaagaacgagcacaagaccauccucaagacgcugaaggacgagcagacccgcaagcuggccauccucgcggagcaguacgagcagagcaucaacgagaugauggccucccaggcccugcggcuggacgaggcccaggaggccgagugccaggcgcuccgccugcagcugcagcaggagauggagcuccugaacgccuaccagagcaagaucaagaugcagaccgaggcccagcacgagcgggagcugcagaagcucgagcagcgcgugucccugcggcgcgcccaccuggagcagaagaucgaggaggagcucgcggcccugcagaaggagcggagcgagcgcaucaagaaccugcucgagcggcaggagcgcgagaucgagaccuucgacauggagucccugcggaugggguucggcaaccuggucacgcucgacuuccccaaggaggacuaccgcuga

SEQ ID NO: 37418 - RNA, 2427 nt, Artificial Sequence
  derived and/or modified sequence opt1 from TAP1__Homo_sapiens__NP_000584
auggccgagcugcucgccagcgcgggcuccgccugcagcugggacuucccccgcgccccgcccuccuucccgccgcccgccgccagccgcgggggccucgggggcacccgguccuuccggccccaccgcggggcggagagcccccggcccggccgcgaccgggacggcgugcgcguccccauggccuccagccggugccccgcgccccgcgggugccggugccugcccggcgccucccucgccuggcuggggaccgugcugcuccugcuggccgacugggugcuccugcgcacggcccugccgcggaucuucagccuccugguccccaccgcccugccccuccugcgcgugugggccgugggccugucccggugggcgguccucuggcugggggccugcggcgugcugcgcgccaccgugggcagcaaguccgagaacgccggggcccagggcuggcucgcggcccugaagccccuggccgccgcccucgggcuggcgcugccgggccucgcccuguuccgggagcugaucagcuggggcgcccccggguccgccgacagcacccgccuccugcacuggggcucccaccccacggccuucgucgugagcuacgcggccgcccugcccgccgcggcccucuggcacaagcuggggucccugugggugccgggcgggcagggcggcagcgggaaccccguccggcgccuccugggcugccuggggagcgagacccggcgccucucccuguuccuggugcucgugguccugagcucccugggcgagauggccauccccuucuucaccgggcgccucaccgacuggauccugcaggacggcagcgccgacacguucacccggaaccugacccucauguccauccugaccaucgccagcgcggugcuggaguucgugggcgacgggaucuacaacaacacgaugggccacguccacucccaccuccagggggagguguucggcgccgugcugcgccaggagaccgaguucuuccagcagaaccagaccgggaacaucaugagccgggucaccgaggacacguccacccugagcgacucccugagcgagaaccucucccuguuccugugguaccucgugcgcggccugugccugcucggcaucaugcugugggggagcgugucccugaccauggucacccucaucacgcugccccugcuguuccugcugccgaagaaggugggcaagugguaccagcuccuggagguccaggugcgggagagccuggccaaguccagccagguggccaucgaggcccucuccgcgaugcccaccguccgcagcuucgccaacgaggagggggaggcccagaaguuccgggagaagcugcaggagaucaagacccugaaccagaaggaggccguggccuacgcggugaacagcuggaccacguccaucagcggcaugcuccugaaggucggcauccuguacaucgggggccagcucgugaccuccggggccgugagcuccggcaaccuggucaccuucgugcuguaccagaugcaguucacccaggccguggagguccuccugagcaucuacccccgcgugcagaaggccgugggguccagcgagaagaucuucgaguaccuggaccggacgccccgcugcccgcccuccggccuccugacgccccugcaccucgagggccugguccaguuccaggacgugagcuucgcguacccgaaccggcccgacgugcugguccuccaggggcugaccuucacccugcgccccggcgaggugaccgcccucguggggcccaacggcuccggcaagagcaccgucgccgcccugcugcagaaccucuaccagccgaccgggggccagcugcugcucgacgggaagccccugccccaguacgagcaccgguaccugcaccgccagguggccgcggugggccaggagccccaggucuucgggcggucccuccaggagaacaucgccuacggccugacccagaagccgacgauggaggagaucaccgccgccgccgucaagagcggggcgcacuccuucaucagcggccugccccagggcuacgacaccgagguggacgaggccgggucccagcucagcggcgggcagcgccaggccguggcccuggcccgggcgcugauccgcaagcccugcgugcucauccuggacgacgccaccagcgcccuggacgccaacucccagcuccagguggagcagcugcuguacgagagccccgagcgguacucccgcagcguccuccugaucacccagcaccugucccucguggagcaggcggaccacauccuguuccuggagggcggggccauccgcgagggcggcacgcaccagcagcucauggagaagaaggggugcuacugggccauggugcaggccccggccgacgcgcccgaguga

SEQ ID NO: 37419 - RNA, 2112 nt, Artificial Sequence
  derived and/or modified sequence opt1 from TAP2__Homo_sapiens__NP_000535
augcgccugcccgaccuccggccguggaccagccugcugcucguggacgccgcccugcuguggcuccugcagggcccccuggggacccuccugccccagggccugcccgggcucuggcuggagggcacgcugcgccucgggggccuguggggccugcucaagcugcgggggcugcucggcuucgucgggacccugcugcucccgcugugccuggcgacgccccucaccgugucccugcgcgcccugguggccggcgccagccgggccccgcccgcgcgcgucgccuccgcccccuggagcuggcuccuggugggguacggcgccgcgggccuguccuggagccucugggccgugcuguccccgcccggggcccaggagaaggagcaggaccaggucaacaacaaggugcugauguggcggcuccugaagcugagccgccccgaccucccccugcugguggccgccuucuucuuccucguccuggcggugcugggcgagacgcucaucccccacuacuccgggcgggugaucgacauccugggcggcgacuucgacccccacgccuucgccagcgccaucuucuucaugugccuguucuccuucgggagcucccucagcgccggcugccgcgggggcugcuucaccuacaccaugucccggaucaaccugcgcauccgggagcagcuguucagcucccugcuccgccaggaccugggguucuuccaggagaccaagacgggcgagcugaacagccggcucuccagcgacaccacccugaugagcaacuggcugccccucaacgcgaacguccugcugcgcucccucgugaagguggucggccuguacggguucaugcugagcaucuccccgcggcucacccugcugagccuccugcacaugcccuucacgaucgccgccgagaagguguacaacacccgccaccaggaggugcugcgggagauccaggacgccgucgcccgcgcgggccagguggugcgggaggccgucgggggccuccagaccgugcgcuccuucggggccgaggagcacgaggugugccgcuacaaggaggcccuggagcagugccggcagcuguacuggcgccgggaccucgagcgcgcccuguaccugcucguccggcgcgugcugcaccugggcguccagaugcucaugcugagcugcggccugcagcagaugcaggacggggagcucacccagggcucccugcugagcuucaugaucuaccaggaguccguggggagcuacgugcagacgcucgucuacaucuacggcgacaugcuguccaacgugggggcggccgagaagguguucagcuacauggaccggcagcccaaccugcccuccccgggcacccucgcccccaccacccugcagggcgucgugaaguuccaggacgugagcuucgccuaccccaaccgccccgaccggccgguccugaaggggcucacguucacccugcgccccggcgaggugaccgcgcugguggggcccaacggcuccggcaagagcaccgucgccgcccuccugcagaaccuguaccagcccaccgggggccaggugcuccuggacgagaagccgaucucccaguacgagcacugcuaccugcacagccagguggucuccguggggcaggagcccguccucuucagcggcagcgugcggaacaacaucgccuacgggcugcaguccugcgaggacgacaaggugauggccgcggcccaggccgcccacgccgacgacuucauccaggagauggagcacggcaucuacaccgacgugggcgagaaggggagccagcuggcggccggccagaagcagcgccucgccaucgcccgggcccugguccgcgacccccgggugcugauccucgacgaggcgaccuccgcccuggacgugcagugcgagcaggcccugcaggacuggaacagccgcggggaccggaccguccucgugaucgcccaccgccugcaggcggugcagcgggcccaccagauccugguccuccaggagggcaagcugcagaagcuggcccagcuccaggaggggcaggaccuguacucccgccuggugcagcagcgccucauggacuga

SEQ ID NO: 37420 - RNA, 1347 nt, Artificial Sequence
  derived and/or modified sequence opt1 from TAPBP__Homo_sapiens__NP_003181
augaagucccugucccuccugcuggccguggcccucggccuggcgaccgccgucagcgccgggcccgccgugaucgagugcugguucguggaggacgccuccggcaaggggcuggcgaagcgcccgggcgcccuccugcugcggcaggggcccggcgagcccccgccccgccccgaccucgaccccgagcuguaccugagcguccacgaccccgccggcgcccuccaggcggccuuccggcgcuacccgcgcggggcccccgcgccccacugcgagaugucccgguucgugccccugccggccagcgccaagugggccuccggccugacccccgcccagaacugcccccgggcccucgacggggccuggcugauggugagcaucuccagccccguccugucccucagcucccugcugcgcccgcagcccgagccccagcaggagcccgugcucaucaccauggcgaccgugguccugaccgugcugacccacacgccggcgccccgggugcgccucggccaggacgcccugcuggaccucagcuucgccuacaugccgcccaccagcgaggccgccagcucccuggcccccgggcccccgcccuucggccuggaguggcggcgccagcaccucggcaaggggcaccuccugcuggccgccacccccggccugaacgggcagaugcccgccgcgcaggagggcgccgucgccuucgccgcgugggacgacgacgagcccuggggcccguggaccgggaacggcacguucuggcugcccaccgugcagcccuuccaggaggggaccuaccucgccaccauccaccuccccuaccugcagggccaggugacgcuggagcuggccgucuacaagccgcccaaggugagccugaugcccgccacccucgcccgggcggcccccggggaggccccgcccgagcugcugugccucgugucccacuucuaccccagcggcggccuggaggucgagugggagcugcgcgggggccccgggggccggagccagaaggccgaggggcagcgcuggcucuccgcccugcggcaccacagcgacggcuccgugagccuguccggccaccuccagccgccgcccgugaccaccgagcagcacggggcgcgcuacgccugccggauccaccaccccagccugcccgccuccggccgcagcgccgaggucacgcuggagguggccgggcuguccggccccagccucgaggacuccguggggcuguuccugagcgcguuccuccugcugggccucuucaaggcccugggcugggccgccgucuaccuguccacgugcaaggacagcaagaagaaggcggaguga

SEQ ID NO: 37421 - RNA, 1407 nt, Artificial Sequence
  derived and/or modified sequence opt1 from TAPBPL__Homo_sapiens__NP_060479
augggcacccaggagggguggugccugcugcugugccuggcccucagcggcgccgcggagaccaagccccacccggccgaggggcaguggcgcgccguggacgucgugcuggacugcuuccuggccaaggacggcgcccaccgcggggcgcucgccuccagcgaggaccgggcccgggccucccuggugcugaagcagguccccgugcucgacgacggcagccuggaggacuucacggacuuccagggcgggacccuggcgcaggacgacccgcccaucaucuucgaggccuccguggaccucguccagaucccccaggccgaggcccugcugcacgccgacugcagcggcaaggaggugaccugcgagaucucccgcuacuuccuccagaugaccgagacgaccgugaagaccgcggccugguucauggccaacaugcaggucagcgggggcgggcccuccaucagccuggugaugaagacgccccgggugaccaagaacgaggcccuguggcaccccacccucaaccugccgcugagcccccagggcaccguccgcaccgccguggaguuccaggugaugacgcagacccagucccucuccuuccugcugggcagcuccgcgagccucgacugcggguucuccauggcccccggccuggaccugaucagcgucgaguggcggcuccagcacaaggggcgcggccagcugguguacuccuggaccgccggccaggggcaggccgugcggaagggcgccacccuggagcccgcgcagcucgggauggcccgcgacgccagccugacgcugccgggccucaccauccaggacgaggggaccuacaucugccagaucaccacgagccuguaccgggcccagcagaucauccagcugaacauccaggccucccccaagguccgccucagccuggcgaacgaggcccugcuccccacccugaucugcgacaucgccggcuacuacccccuggacgugguggucaccuggacccgggaggagcucggcggguccccggcccaggugagcggcgcguccuucagcucccugcgccagagcguggccgggacguacuccaucagcuccagccugaccgccgagcccggcuccgccggggccaccuacacgugccaggucacccacaucagccucgaggagccccugggcgcguccacccagguggugcccccggagcggcgcaccgcccugggcgucaucuucgccagcucccucuuccugcuggcccugauguuccucgggcugcagcggcgccaggcccccaccggccuggggcuccugcaggcggagcggugggagacgaccagcugcgccgacacccaguccagccaccuccacgaggaccgcaccgcccgggugagccagcccuccuga

SEQ ID NO: 37422 - RNA, 4866 nt, Artificial Sequence
  derived and/or modified sequence opt1 from TARBP1__Homo_sapiens__NP_005637
auggagugggugcuggccgaggcccuccugagccagucccgcgacccccgggcgcugcucggcgcccugugccagggggaggccagcgccgagcgcgucgagacccugcgguuccuccugcagcgccuggaggacgaggaggcccggggcuccgggggcgcgggggcccucccggaggccgcccgcgagguggcggccggcuaccuggugccccugcuccggagccugcgcggccggcccgccgggggccccgacccgucccugcagccccgccaccggcgccggguccuccgcgccgccggggcggcccugcggagcugcgugcgccuggccggccggccccagcucgccgccgcgcuggccgaggaggcccugcgcgaccuccuggccggguggcgggcccccggcgcggaggccgccguggagguccuggccgccgugggcccgugccuccgcccccgggaggacgggccccugcuggagcgcguggcgggcaccgccgucgcccucgcccucgggggcggcggggacggcgacgaggcggggcccgccgaggacgccgccgcccugguggcgggccgccuccugccggugcugguccagugcgggggcgccgcccuccgggccguguggggcgggcuggccgcgcccggcgccucccuggggagcggccgcguggaggagaagcuccugguccuguccgcccucgccgagaagcugcugcccgagcccgggggcgaccgggcccgcggcgcgcgggaggccgggccggacgcccgccggugcuggcgcuucuggcggacggugcaggccggccucgggcaggcggacgcccugacccgcaagcgggcccgcuaccugcuccagcgggccguggaggucagcgccgagcugggcgcggacugcacgugcgggccccaggagggcaacggccccucccuguucugguggagcgagcgcaagaaggacgagcuccugaaguucugggagaacuacauccugaucauggagacccuggaggggaaccagauccacgugaucaagcccgugcucccgaagcugaacaaccuguucgaguacgccgucuccgaggagaacggcugcuggcuguuccaccccagcuggcacaugugcaucuacaagcggauguucgaguccgagaacaagauccugagcaaggagggggugauccacuuccuggagcucuacgagaccaagauccugcccuucucccccgaguucagcgaguucaucaucggcccgcugauggacgcccucuccgagagcagccuguacucccgcagccccggccagcccaucggguccugcagcccccugggccucaagcugcagaaguuccuggugaccuacaucucccuccugccggaggagaucaagagcuccuuccugcucaaguucauccggaagaugaccagccgccacuggugcgccguccccauccuguuccuguccaaggcccucgcgaacgugccccggcacaaggcccuggggaucgacggccugcucgcccugcgcgacgucauccacugcaccaugaucacgcaccagauccugcuccgcggggccgcccagugcuaccugcugcagaccgcgaugaaccuccuggacguggagaaggugagccuguccgacgucagcaccuuccucaugucccugcggcaggaggagagccugggccgcggcaccucccucuggacggagcugugcgacuggcugcgggugaacgagagcuacuucaagccguccccgaccugcagcuccaucgggcuccacaagaccagccugaacgccuacgucaagagcaucgugcaggaguacgugaaguccagcgccugggagaccggcgagaacugcuucaugcccgacugguucgaggccaagcuggugucccucaugguccugcuggcgguggacguggaggggaugaagacgcaguacagcggcaagcagcgcaccgagaacguccuccggaucuuccuggacccccugcucgacgugcugaugaaguucuccaccaacgccuacaugccccugcucaagaccgaccgcugccugcagcugcuccugaagcugcucaacacgugccggcugaaggggagcuccgcccaggacgacgaggugagcaccguccugcagaacuucuucauguccaccaccgagagcaucuccgaguucauccuccgccggcugacgaugaacgagcugaacagcguguccgaccucgaccgcugccaccuguaccugauggugcucaccgagcugaucaaccugcaccucaaggucggcuggaagcggggcaaccccaucuggcgcgugaucagccugcugaagaacgccuccauccagcaccuccaggagauggacagcgggcaggagcccaccgugggcucccagauccagcgggucgugagcauggccgcgcuggccauggugugcgaggccaucgaccagaagcccgagcugcagcucgacagccugcacgccgggccgcuggaguccuuccucagcucccugcagcugaaccagacccuccagaagccccacgccgaggagcagagcuccuacgcgcacccccuggagugcagcuccguccuggaggagagcuccagcucccagggcugggggaagaucguggcccaguacauccacgaccagugggugugccucagcuuccugcugaagaaguaccacacgcucauccccaccaccggcuccgagauccuggagccguuccugcccgccguccagaugcccauccgcacccuccagagcgcccuggaggcccugacggugcucuccagcgaccaggugcugcccgucuuccacugccugaaggugcuggugccgaagcuccugaccuccagcgagucccugugcaucgagagcuucgacauggcguggaagaucaucagcucccucagcaacacccagcugaucuucugggccaaccugaaggccuucguccaguucguguucgacaacaaggugcucaccaucgccgccaagaucaagggccaggcguacuucaagaucaaggagaucauguacaagaucaucgagauguccgccaucaagacgggggucuucaacacccugaucagcuacugcugccaguccuggaucgugagcgccuccaacgugagccagggcucccugagcuccgccaagaacuacagcgagcucauccuggaggcgugcaucuucgggaccgucuuccggcgcgaccagcggcuggugcaggacgugcagaccuucaucgagaaccucggccacgacugcgccgccaacaucgucauggagaacaccaagcgcgaggaccacuacgugcggaucugcgccgugaaguuccugugccugcucgacggguccaacaugagccacaagcuguucaucgaggaccuggccaucaagcuccuggacaaggacgagcuggucuccaagagcaagaagcgcuacuacgugaacucccuccagcaccgggugaagaaccgcgucuggcagacgcugcugguccucuucccccgccuggaccagaacuuccugaacggcaucaucgaccggaucuuccaggcgggcuucaccaacaaccaggccagcaucaaguacuucaucgaguggaucaucauccucauccugcacaaguucccccaguuccugcccaaguucugggacugcuucuccuacggggaggagaaccucaagaccagcaucugcaccuuccuggccgugcugagccaccucgacaucaucacgcagaacaucccggagaagaagcugauccugaagcaggcccucaucguggugcugcaguggugcuucaaccacaacuucuccguccgccuguacgcccucguggcgcugaagaagcuguggaccgugugcaagguccucagcguggaggaguucgacgcccugacccccgugaucgaguccagccugcaccaggucgaguccaugcacggcgccgggaacgccaagaagaacuggcagcggauccaggagcacuucuucuucgccaccuuccacccccucaaggacuacugccuggagacgaucuucuacauccugccccgccucagcggccugaucgaggacgaguggaucaccaucgacaaguucacccgguucaccgacgugccgcuggcggccggcuuccagugguaccucucccagacgcagcugagcaagcugaagcccggggacuggucccagcaggacaucggcaccaaccucguggaggccgacaaccaggccgaguggaccgacguccagaagaagaucauccccuggaacagccgcguguccgaccuggaccuggagcuccuguuccaggaccgggcggcccgccuggggaaguccaucagccggcucaucguggucgccagccugaucgacaagccgaccaaccugggcgggcucugccgcacgugcgagguguucggcgccuccgugcuggucgugggcagccugcagugcaucuccgacaagcaguuccagcaccucagcguguccgccgagcaguggcugccccuggucgaggugaagccgccccagcucaucgacuaccugcagcagaagaagaccgagggguacaccaucaucggcguggagcagaccgccaagagccuggaccucacgcaguacugcuuccccgagaagucccugcugcuccuggggaacgagcgggagggcauccccgcgaaccugauccagcagcucgacgucugcguggagaucccccagcaggggaucauccgcagccugaacgugcacgucagcggcgcccugcucaucugggaguacacccggcagcagcugcugucccacggcgacaccaagcccuga

SEQ ID NO: 37423 - RNA, 1101 nt, Artificial Sequence
  derived and/or modified sequence opt1 from TARBP2__Homo_sapiens__NP_599150
augagcgaggaggagcagggcuccgggaccaccacgggcugcgggcugcccagcaucgagcagaugcucgccgccaacccgggcaagacccccaucucccugcugcaggaguacgggacccgcaucggcaagacccccguguacgaccuccugaaggcggagggccaggcccaccagcccaacuucacguuccgggucaccgugggggacaccagcugcaccggccaggggccguccaagaaggccgccaagcacaaggccgcggagguggcccugaagcaccucaagggcgggagcaugcuggagcccgcccuggaggacuccagcuccuucagcccccucgacuccagccugcccgaggacaucccggucuucacggccgcggccgccgccacccccgugcccuccgugguccugacccgcagcccgcccauggagcuccagccgcccgugagcccccagcaguccgagugcaaccccgugggcgcccugcaggagcuggucgugcagaagggcuggcggcuccccgaguacaccgugacgcaggaguccgggcccgcgcaccgcaaggaguucaccaugaccugccgggucgagcgcuucaucgagaucggcagcgggaccuccaagaagcuggccaagcggaacgccgccgccaagaugcugcuccgcgugcacacggugccccuggacgcgcgggacggcaacgaggucgagccggacgacgaccacuucagcaucggcguggggagccgccuggacggccuccggaaccgcgggcccggcugcaccugggacucccugcggaacagcgugggggagaagauccugucccuccgcagcugcucccugggcagccugggcgcccucgggcccgccugcugccggguccuguccgagcugagcgaggagcaggccuuccacguguccuaccucgacaucgaggagcugagccuguccggccucugccagugccugguggagcugagcacccagcccgccaccgucugccacggguccgcgacgacccgcgaggccgcccggggcgaggccgcccgccgggcgcuccaguaccugaagaucauggccgggagcaaguga

SEQ ID NO: 37424 - RNA, 924 nt, Artificial Sequence
  derived and/or modified sequence opt1 from TARP__Homo_sapiens__XP_011513708
auguucaucggcaacagcccccugcuccugaccguggggcugggccucuccaaggucgagcaguuccagcugagcaucuccaccgaggugaagaaguccaucgacaucccgugcaagaucagcagcacgcgcuucgagaccgacgugauccacugguaccggcagaagcccaaccaggcccuggagcaccucaucuacaucgucuccaccaagagcgccgcgcgccgguccauggggaagaccagcaacaagguggaggcccgcaagaacucccagacgcugaccagcauccugaccaucaaguccguggagaaggaggacauggccgucuacuacugcgccgccugggacuucggccacuacaagaagcuguucgggagcggcaccacgcugguggugaccgacaagcagcuggacgcggacgucucccccaagcccaccaucuuccucccgagcaucgccgagaccaagcugcagaaggccggcacguaccugugccuccuggagaaguucuuccccgacgugaucaagauccacuggcaggagaagaaguccaacaccauccuggggagccaggagggcaacaccaugaagaccaacgacacguacaugaaguucuccuggcucaccgugcccgagaagucccuggacaaggagcaccggugcaucguccgccacgagaacaacaagaacgggguggaccaggagaucaucuucccgcccaucaagaccgacgugaucaccauggaccccaaggacaacugcagcaaggacgccaacgacacgcugcuccugcagcugaccaacaccagcgcguacuacauguaccuccugcugcuccucaagagcgucguguacuucgccaucaucacgugcugccugcuccggcgcaccgccuucugcugcaacggcgagaaguccuga

SEQ ID NO: 37425 - RNA, 2172 nt, Artificial Sequence
  derived and/or modified sequence opt1 from TARS__Homo_sapiens__NP_001245366
auguucgaggagaaggccagcucccccagcggcaagaugggcggggaggagaagccgaucggggccggcgaggagaagcagaaggagggcgggaagaagaagaacaaggagggcuccggggacggcgggcgcgcggagcugaaccccuggcccgaguacaucuacacccggcucgagauguacaacauccugaaggccgagcacgacagcauccuggccgagaaggccgagaaggacuccaagcccaucaaggugacccucccggacggcaagcaggucgacgccgagagcuggaagacgacccccuaccagaucgcgugcgggaucucccagggccuggccgacaacaccgugaucgccaaggugaacaacgucgugugggaccuggaccgcccccucgaggaggacugcacccuggagcugcucaaguucgaggacgaggaggcccaggcgguguacuggcacagcuccgcccacaucaugggcgaggccauggagcgggucuacgggggcugccugugcuacgggcccccgaucgagaacggcuucuacuacgacauguaccuggaggagggcggggugagcuccaacgacuucagcucccucgaggcccugugcaagaagaucaucaaggagaagcaggccuucgagcgccuggaggugaagaaggagacgcuccuggcgauguucaaguacaacaaguucaagugccggauccugaacgagaaggucaacacccccaccaccacgguguaccgcugcggcccccucaucgaccugugccgggggccccacgugcgccacaccggcaagaucaaggcccugaagauccacaagaacagcuccaccuacugggaggggaaggccgacauggagacccuccagcggaucuacggcaucagcuucccggaccccaagaugcugaaggagugggagaaguuccaggaggaggccaagaaccgcgaccaccggaagaucggccgcgaccaggagcuguacuucuuccacgagcucucccccgggagcugcuucuuccugcccaagggcgccuacaucuacaacgcgcugaucgaguucauccgguccgaguaccgcaagcggggguuccaggaggucgugacgccgaacaucuucaacagccgccucuggaugaccagcggccacuggcagcacuacuccgagaacauguucagcuucgagguggagaaggagcuguucgcccugaagcccaugaacugccccgggcacugccucauguucgaccaccggccccgcuccuggcgggagcugccgcugcgccucgccgacuucggcguccugcaccggaacgagcugagcggcgcccucaccgggcugacccgcgugcgccgguuccagcaggacgacgcccacaucuucugcgcgauggagcagaucgaggacgagaucaagggcugccuggacuuccuccgcacgguguacuccgucuucggguucagcuucaagcugaaccuguccacccggcccgagaaguuccucggcgacaucgaggugugggaccaggccgagaagcagcuggagaacagccugaacgaguucggggagaagugggagcucaacuccggcgacggcgccuucuacgggcccaagaucgacauccagaucaaggacgccaucggccgcuaccaccagugcgccaccauccagcuggacuuccagcugcccauccgguucaaccucaccuacgugagccacgacggggacgacaagaagcgcccggucaucgugcaccgggcgauccugggcuccguggagcgcaugaucgccauccugacggagaacuacggcgggaaguggcccuucuggcugagcccccggcaggucauggugguccccgugggcccgaccugcgacgaguacgcccagaaggugcgccagcaguuccacgacgccaaguucauggcggacaucgaccucgaccccgggugcacccugaacaagaagauccggaacgcccagcuggcccaguacaacuucauccucgucgugggcgagaaggagaagaucuccgggaccgugaacauccgcacgcgggacaacaagguccacggcgagcgcaccaucagcgagaccaucgagcggcugcagcagcugaaggaguuccgcuccaagcaggccgaggaggaguucuga

SEQ ID NO: 37426 - RNA, 2409 nt, Artificial Sequence
  derived and/or modified sequence opt1 from TARSL2__Homo_sapiens__NP_689547
auggccgccgaggcgcuggccgccgaggccguggccagccgccucgagcggcaggaggaggacauccgcuggcugugguccgaggucgagcggcugcgcgacgagcagcucaacgcgcccuacagcugccaggccgagggcccgugccugacccgggagguggcccagcugcgcgccgagaacugcgaccuccggcaccgccugugcucccugcggcucugccuggcggaggagcgcagccggcaggccacccuggaguccgccgagcucgaggccgcccaggaggcgggggcccagcccccgcccagccagucccaggacaaggacaugaagaagaagaagaugaaggagagcgaggccgacuccgaggugaagcaccagcccaucuucaucaaggagcgccugaagcuguucgagauccucaagaaggaccaccagcugcugcucgccaucuacggcaagaagggggacacgagcaacaucaucaccguccggguggccgacggccagaccgugcagggggaggucuggaagaccacgcccuaccagguggcggccgagaucucccaggagcuggccgagagcaccgugaucgccaaggucaacggcgagcugugggaccucgaccgcccccuggagggcgacuccagccuggagcuccugaccuucgacaacgaggaggcccaggcgguguacuggcacuccagcgcccacauccugggggaggccauggagcucuacuacggcgggcaccugugcuacgggcccccgaucgagaacggguucuacuacgacauguucaucgaggaccgggccguguccagcaccgagcuguccgcccucgagaacaucugcaaggcgaucaucaaggagaagcagcccuucgagcgccuggaggucagcaaggagauccugcucgagauguucaaguacaacaaguucaagugccggauccugaacgagaaggugaacacggccaccaccaccguguaccgcugcggcccccugaucgaccucugcaagggcccccacguccggcacacggggaagaucaagaccaucaagaucuucaagaacagcuccaccuacugggagggcaacccggagauggagacccugcagcgcaucuacgggaucagcuuccccgacaacaagaugaugcgggacugggagaaguuccaggaggaggccaagaaccgcgaccaccgcaagaucggcaaggagcaggagcuguucuucuuccacgaccucucccccggcagcugcuucuuccugccccggggcgccuucaucuacaacacgcugaccgacuucauccgcgaggaguaccacaagcgggacuucaccgaggugcucuccccgaacauguacaacagcaagcugugggaggcguccggccacuggcagcacuacagcgagaacauguucaccuucgagaucgagaaggacacguucgcccugaagcccaugaacugccccgggcacugccucauguucgcccaccgcccccgguccuggcgcgagaugccgauccgguucgccgacuucggcgugcugcaccgcaacgagcugagcgggacccucuccggccugacccggguccgccgguuccagcaggacgacgcccacaucuucugcaccguggagcagaucgaggaggagaucaagggcugccugcaguuccugcagagcguguacuccacguucggguucagcuuccagcucaaccuguccacccgccccgagaacuuccugggcgagaucgagauguggaacgaggcggagaagcagcuccagaacagccugauggacuucggggagcccuggaagaugaaccccggcgacggggccuucuacggcccgaagaucgacaucaagaucaaggacgccaucggccgguaccaccagugcgccaccauccagcuggacuuccagcuccccauccgcuucaaccugaccuacgucuccaaggacggggacgacaagaagcggcccgugaucauccaccgcgccauccugggcagcguggagcggaugaucgcgauccucuccgagaacuacgggggcaaguggcccuucuggcugagcccgcgccaggucauggugauccccgucgggcccacgugcgagaaguacgcccuccaggugagcuccgaguucuucgaggagggcuucauggccgacguggaccuggaccacagcugcacccugaacaagaagauccggaacgcccagcuggcccaguacaacuucauccucgucgugggcgagaaggagaagaucgacaacgcggugaacguccgcacccgcgacaacaagauccacggggagauccuggugaccuccgccaucgacaagcugaagaaccuccggaagacgcgcacccugaacgccgaggaggccuucuga

SEQ ID NO: 37427 - RNA, 924 nt, Artificial Sequence
  derived and/or modified sequence opt1 from TAS2R10__Homo_sapiens__NP_076410
augcugcgcguggucgagggcaucuucaucuucgugguggucagcgaguccguguucggggugcucggcaacggguucaucggccuggucaacugcaucgacugcgccaagaacaagcugagcaccaucggguucauccucaccggccuggccaucucccggaucuuccugaucuggaucaucaucacggacggcuucauccagaucuucagccccaacaucuacgcguccgggaaccucaucgaguacaucagcuacuucugggugaucggcaaccaguccagcaugugguucgccaccucccugagcaucuucuacuuccugaagaucgccaacuucuccaacuacaucuuccucuggcucaagagccgcaccaacauggugcugccguucaugaucgucuuccugcugaucuccagccugcucaacuucgccuacaucgccaagauccugaacgacuacaagaccaagaacgacacggugugggaccugaacauguacaaguccgaguacuucaucaagcagauccuccugaaccugggggugaucuucuucuucacccucagccugaucacgugcaucuuccugaucaucucccucuggcggcacaaccgccagaugcagagcaacgucaccggccugcgggacuccaacaccgaggcgcacgugaaggccaugaaggugcugaucagcuucaucauccucuucauccuguacuucaucgggauggccaucgagaucagcugcuucaccguccgcgagaacaagcugcuccugauguucggcaugaccaccacggccaucuaccccuggggccacuccuucauccugauccucgggaacagcaagcugaagcaggcgucccugcgggugcuccagcagcugaagugcugcgagaagcgcaagaaccugcgggugaccuga

SEQ ID NO: 37428 - RNA, 912 nt, Artificial Sequence
  derived and/or modified sequence opt1 from TAS2R13__Homo_sapiens__NP_076409
auggagagcgcccugcccuccaucuucacccucgugaucaucgccgaguucaucaucggcaaccugagcaacggguucaucguccugaucaacugcaucgacuggguguccaagcgcgagcucagcuccguggacaagcugcugaucauccucgcgaucagccggaucggccugaucugggagauccuggucuccugguuccucgcccugcacuaccuggccaucuucgugagcgggaccggccuccgcaucaugaucuucuccuggaucgugagcaaccacuucaaccuguggcuggccacgaucuucuccaucuucuaccuccugaagaucgccagcuucuccagcccggcguuccuguaccucaaguggcgggucaacaaggugauccugaugauccugcucgggacccugguguuccuguuccucaaccugauccagaucaacaugcacaucaaggacuggcuggaccgcuacgagcggaacaccaccuggaacuucuccaugagcgacuucgagacguucuccgucagcgugaaguucaccaugaccauguucucccucacccccuucacgguggccuucaucagcuuccugcugcucaucuucagccugcagaagcaccuccagaagaugcagcucaacuacaagggccaccgcgacccccggaccaagguccacaccaacgcccugaagaucgugaucuccuuccugcuguucuacgccagcuucuuccugugcgugcugaucuccuggaucagcgagcucuaccagaacaccgucaucuacaugcugugcgagacgaucggcguguucucccccagcucccacagcuuccugcucauccuggggaacgcgaagcugcgccaggccuuccuccugguggccgccaaggucugggccaagcgguga

SEQ ID NO: 37429 - RNA, 954 nt, Artificial Sequence
  derived and/or modified sequence opt1 from TAS2R14__Homo_sapiens__NP_076411
augggcggggugaucaagagcaucuucaccuucguccugaucguggaguucaucaucggcaaccucgggaacuccuucaucgcccuggugaacugcaucgacugggucaagggccgcaagaucagcuccguggaccggauccugaccgcccucgcgaucagccgcaucucccugguguggcugaucuucgggagcuggugcgucuccguguucuuccccgcccucuucgccacggagaagauguuccggaugcugaccaacaucuggaccgugaucaaccacuucagcgucuggcuggccaccggccucggcacguucuacuuccugaagaucgccaacuucuccaacagcaucuuccuguaccucaaguggcgcgugaagaaggugguccuggugcugcuccuggugaccuccgucuuccuguuccucaacaucgcgcugaucaacauccacaucaacgccagcaucaacggguaccggcgcaacaagaccugcuccagcgacuccagcaacuucacccgguucuccagccugaucgugcucacguccaccguguucaucuucaucccguucacccugagccuggccauguuccuccugcugaucuucagcauguggaagcaccgcaagaagaugcagcacaccgucaagaucuccggcgacgccagcacgaaggcgcaccgcggggugaaguccgugaucaccuucuuccuccuguacgccaucuucagccuguccuucuucaucagcgucuggaccuccgagcggcucgaggagaaccugaucauccugagccaggugaugggcauggccuaccccuccugccacagcugcgugcucauccuggggaacaagaagcugcggcaggccucccucagcguccugcuguggcuccgcuacauguucaaggacggcgagcccuccggccacaaggaguuccgggagagcuccuga

SEQ ID NO: 37430 - RNA, 876 nt, Artificial Sequence
  derived and/or modified sequence opt1 from TAS2R16__Homo_sapiens__NP_058641
augauccccauccagcugaccguguucuucaugaucaucuacguccucgagagccugaccaucaucgugcaguccagccugaucguggccguccucggccgcgaguggcuccaggugcggcgccugaugccgguggacaugauccugaucucccuggggaucagccgguucugccugcagugggccuccaugcucaacaacuucugcagcuacuucaaccugaacuacguccugugcaaccucacgaucaccugggaguucuucaacauccugaccuucuggcugaacucccuccugaccguguucuacugcaucaaggugagcuccuucacgcaccacaucuuccuguggcuccgcuggcggauccugcgccuguuccccuggauccuccugggcagccugaugaucacgugcgucaccaucauccccuccgcgaucgggaacuacauccagauccagcuccugaccauggagcaccucccccggaacagcaccgugaccgacaagcuggagaacuuccaccaguaccaguuccaggcccacaccguggcccuggucaucccguucauccuguuccucgccuccaccaucuuccugauggccagccugacgaagcagauccagcaccacuccaccggccacugcaaccccagcaugaaggcgcgcuucaccgcccuccggucccuggccgugcuguucaucguguucaccagcuacuuccucacgauccugaucaccaucaucgggacccuguucgacaagcgcugcuggcucugggucugggaggccuucguguacgcguucauccugaugcacuccaccagccugaugcucagcucccccacgcugaagcggauccugaagggcaagugcuga

SEQ ID NO: 37431 - RNA, 900 nt, Artificial Sequence
  derived and/or modified sequence opt1 from TAS2R1__Homo_sapiens__NP_062545
augcuggagagccaccucaucaucuacuuccugcuggccgugauccaguuccuccugggcaucuucaccaacgggaucaucgucguggugaacggcaucgaccugaucaagcaccgcaagauggcgccccucgaccugcugcucuccugccuggccgucagccggaucuuccugcagcuguucaucuucuacgugaacgugaucgucaucuucuucaucgaguucaucaugugcuccgccaacugcgccauccuccuguucaucaacgagcucgagcuguggcuggccaccuggcucgggguguucuacugcgccaagguggcgagcguccgccacccgcuguucaucuggcugaagaugcggaucuccaagcucgugcccuggaugauccugggcagccugcucuacguguccaugaucugcgucuuccacagcaaguacgccggguucauggugcccuacuuccugcgcaaguucuucucccagaacgccacgauccagaaggaggacacccuggccauccagaucuucagcuucguggcggaguucuccgucccccuccugaucuuccuguucgccgugcuccugcugaucuucagccucggccggcacacccgccagaugcggaacaccguggccggcucccgcgucccggggcggggcgcccccaucagcgcccugcuguccauccucagcuuccugauccuguacuucucccacugcaugaucaagguguuccucagcucccugaaguuccacauccgccgguucaucuuccuguucuucauccucgugaucgggaucuaccccagcggccacagccugauccugauccucgggaaccccaagcugaagcagaacgcgaagaaguuccugcuccacuccaagugcugccaguga

SEQ ID NO: 37432 - RNA, 1002 nt, Artificial Sequence
  derived and/or modified sequence opt1 from TAS2R38__Homo_sapiens__NP_789787
augcugacccucacccgcauccggacggugagcuacgagguccgcuccaccuuccuguucaucagcgugcuggaguucgccgugggcuuccucaccaacgccuucgucuuccuggugaacuucugggacguggucaagcggcaggcgcuguccaacagcgacugcgugcuccugugccuguccaucagccgccucuuccugcacgggcuccuguuccuguccgccauccagcugacccacuuccagaagcucagcgagccccugaaccacuccuaccaggccaucaucaugcuguggaugaucgccaaccaggccaaccucuggcuggcggccugccugagccuccuguacugcuccaagcugauccgguucagccacacguuccucaucugccuggccuccugggugagccgcaagaucucccagaugcugcucggcaucauccugugcagcugcaucugcaccguccugugcguguggugcuucuucucccggccgcacuucaccgugaccacgguccucuucaugaacaacaacacccgccugaacuggcagaucaaggaccugaaccucuucuacagcuuccuguucugcuaccugugguccgugccgcccuuccuccuguuccuggugagcagcgggaugcucaccgucucccugggccggcacaugcgcaccaugaagguguacacgcggaacagccgcgaccccucccuggaggcccacaucaaggcgcucaagagccugguguccuucuucugcuucuucgucaucagcuccugcguggccuucaucagcgugccccugcucauccuguggcgggacaagaucggggucauggugugcgugggcaucauggccgccugccccuccggccacgccgcgauccugaucagcgggaacgccaagcuccgccgggccgucaugaccauccugcugugggcccaguccagccugaaggugcgcgccgaccacaaggcggacucccggacccucugcuga

SEQ ID NO: 37433 - RNA, 900 nt, Artificial Sequence
  derived and/or modified sequence opt1 from TAS2R50__Homo_sapiens__NP_795371
augaucaccuuccuguacaucuucuucagcauccucaucauggugcuguucguccugggcaacuucgccaacggguucaucgcccucgugaacuucaucgacugggugaagcgcaagaagaucuccagcgcggaccagauccugaccgcccuggccgucucccggaucggccuccugugggcccugcuccugaacugguaccugacggugcucaaccccgccuucuacagcguggagcugcgcaucaccuccuacaacgcgugggucgugaccaaccacuucagcauguggcuggccgccaaccucuccaucuucuaccugcugaagaucgccaacuucagcaaccuccuguuccugcaccucaagcggcgcgugcgguccgucauccuggugauccugcucgggacccugaucuuccuggugugccaccuccuggucgcgaacauggacgagagcaugugggccgaggaguacgagggcaacaugacggggaagaugaagcugcgcaacaccgugcaccucuccuaccugaccgugaccacgcuguggagcuucaucccguucacccucucccugaucagcuuccugaugcucaucugcucccugugcaagcaccugaagaagaugcagcuccacggcgagggcagccaggaccuguccaccaagguccacaucaaggcccugcagacccucaucagcuuccugcugcucugcgccaucuucuuccuguuccugaucguguccguguggagcccccggcgccuccggaacgaccccgucgugauggugagcaaggccgucgggaacaucuaccuggcguucgacuccuucauccugaucuggcgcacgaagaagcugaagcacaccuuccuccugauccugugccagauccggugcuga

SEQ ID NO: 37434 - RNA, 957 nt, Artificial Sequence
  derived and/or modified sequence opt1 from TAS2R60__Homo_sapiens__NP_803186
augaacggcgaccacauggugcuggggagcuccgucaccgacaagaaggccaucauccucgugaccauccugcugcuccugcgccugguggccaucgcgggcaacggguucaucacggccgcccucggcgucgagugggugcugcggcgcaugcugcuccccugcgacaagcugcuggugagccucggggccucccgguucugccugcagagcgucgugaugggcaagaccaucuacguguuccugcacccgauggccuuccccuacaaccccguccuccaguuccuggcguuccagugggacuuccugaacgccgccacccucugguccagcaccuggcuguccguguucuacugcgugaagaucgccacguucacccaccccgucuucuucuggcugaagcacaagcucagcggcuggcugccguggaugcuguucuccagcguggggcucuccagcuucaccaccauccuguucuucaucggcaaccaccgcauguaccagaacuaccugcggaaccaccuccagcccuggaacgugacgggggacuccauccgcagcuacugcgagaaguucuaccuguucccccugaagaugaucaccuggaccaugcccaccgcggucuucuucaucugcaugauccuccugaucacgucccugggccggcaccgcaagaaggcccuccugaccaccagcggguuccgggagccguccgugcaggcccacaucaaggcccugcucgcccugcugagcuucgcgaugcuguucaucuccuacuuccugagccugguguucagcgccgccggcaucuucccgccccucgacuucaaguucugggucugggaguccgugaucuaccugugcgccgccgugcaccccaucauccuccucuucagcaacugccgccugcgggcgguccugaagucccgccggagcucccgcugcggcacccccuga

SEQ ID NO: 37435 - RNA, 939 nt, Artificial Sequence
  derived and/or modified sequence opt1 from TAS2R9__Homo_sapiens__NP_076406
augcccagcgccaucgaggccaucuacaucauccugaucgcgggcgagcucaccaucgggaucuggggcaacggguucaucgugcuggucaacugcaucgacuggcugaagcgccgggacaucucccucaucgacaucauccugaucagccuggccaucucccgcaucugccuccugugcgugaucagccuggacggcuucuucaugcuccuguucccggggaccuacggcaacuccgugcuggucagcaucgugaacguggucuggacguucgccaacaacuccagccucugguucaccuccugccugagcaucuucuaccugcucaagaucgccaacaucucccaccccuucuucuucuggcugaagcugaagaucaacaaggugaugcucgccauccugcugggcagcuuccucaucucccugaucaucagcgugcccaagaacgacgacaugugguaccaccuguucaaggucucccacgaggagaacaucaccuggaaguucaaggugagcaagauccccgggaccuucaagcagcucacgcugaaccugggcgugauggucccguucauccucugccugaucuccuucuuccugcuccuguucagccuggugcggcacaccaagcagauccgccuccacgcgaccggguuccgggaccccuccaccgaggcccacaugcgcgccaucaaggccgugaucaucuuccugcugcuccugaucgucuacuaccccguguuccuggugaugacgagcagcgcgcucaucccccagggcaagcugguccugaugaucggggacaucgugaccgugaucuucccguccagccacuccuucauccucaucaugggcaacagcaagcugcgggaggccuuccugaagaugcuccgcuucgucaagugcuuccugcggcgccggaagcccuucgugcccuga

SEQ ID NO: 37436 - RNA, 1263 nt, Artificial Sequence
  derived and/or modified sequence opt1 from TASP1__Homo_sapiens__NP_060184
augaccauggagaagggcaugagcuccggggagggccugcccagccgcuccagccagguguccgccgggaagaucaccgccaaggagcucgagacgaagcagagcuacaaggagaagcggggcggguucguccuggugcacgcgggcgccggcuaccacuccgagagcaaggccaaggaguacaagcacgugugcaagcgcgccugccagaaggccaucgagaagcugcaggcgggggcccucgccaccgacgccgucaccgcggcccugguggagcuggaggacuccccguucaccaacgccggcauggggagcaaccucaaccugcugggcgagaucgagugcgacgccuccaucauggacggcaagagccucaacuucggggccgugggcgcgcuguccgggaucaagaaccccgucagcguggccaaccggcugcucugcgagggccagaaggggaagcuguccgccggccgcaucccgcccugcuuccuggugggcgagggggccuaccggugggccgucgaccacggcauccccagcugcccgcccaacaucaugacgacccgcuucucccucgcggccuucaagcggaacaagcgcaagcuggagcuggccgagcggguggacaccgacuucaugcagcucaagaagcgccggcagagcuccgagaaggagaacgacagcgggacccuggacacggugggcgccgucgugguggaccacgaggggaacgucgccgcggccgugagcuccggcggccuggcccucaagcaccccgggcgcgugggccaggccgcccuguacgggugcggcugcugggcggagaacaccggggcccacaaccccuacagcaccgccgucuccaccagcggcugcggcgagcaccuggugcggacgauccucgcccgcgagugcucccacgcgcugcaggccgaggacgcccaccaggcccugcucgagaccaugcagaacaaguucaucagcucccccuuccuggccagcgaggacggggugcugggcggggucaucgugcuccgguccugccgcugcagcgcggagcccgacuccagccagaacaagcagacccugcugguggaguuccucuggucccacaccacggagagcaugugcgucggcuacauguccgcccaggacgggaaggccaagacccacaucagccggcugcccccgggcgccguggccggccaguccgucgcgaucgagggcggggugugccgccuggagagccccgugaacuga

SEQ ID NO: 37437 - RNA, 753 nt, Artificial Sequence
  derived and/or modified sequence opt1 from TATDN1__Homo_sapiens__NP_001139632
augaucaccggcgggaaccugcaggacagcaaggacgcccuccaccuggcccagaccaacggcauguucuucuccacgguggggugccaccccacccgcugcggcgaguucgagaagaacaacccggaccuguaccucaaggagcugcugaaccucgcggagaacaacaaggggaaggucguggccaucggcgagugcggccuggacuucgaccggcugcaguucugccccaaggacacccagcucaaguacuucgagaagcaguucgagcugagcgagcagaccaagcugcccauguuccuccacugccgcaacucccacgccgaguuccuggacaucaugaagcggaaccgcgaccggugcgucgggggcguggugcacagcuucgacgggacgaaggaggccgccgcggcccugaucgaccucgaccuguacaucggcuucaacgggugcucccugaagaccgaggccaaccucgaggugcucaagagcauccccuccgagaagcugaugaucgagaccgacgccccguggugcggcgucaagagcacccacgcgggcuccaaguacauccgcacggccuuccccaccaagaagaagugggagagcgggcacugccugaaggaccggaacgagcccugccacaucauccagauccuggagaucauguccgccgugcgcgacgaggacccccuggagcucgccaacacccuguacaacaacaccaucaagguguucuucccgggcaucuga

SEQ ID NO: 37438 - RNA, 1365 nt, Artificial Sequence
  derived and/or modified sequence opt1 from TAT__Homo_sapiens__NP_000344
auggaccccuacaugauccagaugagcuccaagggcaaccugccgagcauccucgacgugcacgucaacgucgggggccgcuccagcgugcccgggaagaugaagggccggaaggcccgcugguccgugcggcccagcgacauggccaagaagaccuucaaccccauccgcgcgaucguggacaacaugaaggugaagccgaaccccaacaagaccaugaucucccugagcaucggggaccccacggucuucggcaaccugcccaccgacccggaggugacccaggccaugaaggacgcccucgacuccggcaaguacaacggguacgcccccagcaucggcuuccuguccagccgggaggagaucgccuccuacuaccacugccccgaggcgccccuggaggccaaggacgugauccucaccagcgggugcucccaggccaucgaccugugccuggccguccucgcgaacccgggccagaacauccuggugccccgccccggguucagccuguacaagacgcucgccgaguccaugggcaucgaggugaagcuguacaaccugcuccccgagaaguccugggagaucgaccugaagcagcuggaguaccucaucgacgagaagaccgccugccugaucgucaacaacccgagcaaccccugcggcagcguguucagcaagcggcaccuccagaagauccuggccguggccgcgcgccagugcguccccauccuggccgacgagaucuacggggacaugguguucuccgacugcaaguacgagccccuggccacccucagcaccgacgugccgauccuguccugcggcgggcuggccaagcgguggcucguccccggcuggcgccugggcuggauccugauccacgaccggcgcgacaucuucgggaacgagauccgggacggccucgugaagcugagccagcgcauccuggggcccugcacgaucgugcagggcgcccucaaguccauccugugccggacccccggggaguucuaccacaacacccugagcuuccucaaguccaacgcggaccugugcuacggcgcccuggccgccaucccgggccuccgccccguccggcccagcggggccauguaccugauggugggcaucgagauggagcacuuccccgaguucgagaacgacguggaguucaccgagcgccuggucgcggagcaguccgugcacugccucccggccacgugcuucgaguaccccaacuucauccgggucgugaucaccgugcccgaggucaugaugcuggaggccugcagccgcauccaggaguucugcgagcagcacuaccacugcgccgaggggucccaggaggagugcgacaaguga

SEQ ID NO: 37439 - RNA, 2244 nt, Artificial Sequence
  derived and/or modified sequence opt1 from TAX1BP1__Homo_sapiens__NP_001073333
augaccagcuuccaggaggugccccugcagaccuccaacuucgcccacgucaucuuccagaacguggccaagagcuaccuccccaacgcgcaccuggagugccacuacacgcugacccccuacauccacccccaccccaaggacugggugggcaucuucaaggucgggugguccaccgcccgcgacuacuacaccuuccucuggagcccgaugcccgagcacuacguggagggcuccacggugaacugcguccuggccuuccagggguacuaccugcccaacgacgacggcgaguucuaccaguucugcuacgugacccacaagggggagauccggggcgccagcacccccuuccaguuccgcgccuccagcccgguggaggagcuccugaccauggaggacgagggcaacuccgacaugcuggucgugacgaccaaggcggggcuccuggagcugaagaucgagaagaccaugaaggagaaggaggagcuccugaagcugaucgccgugcucgagaaggagaccgcccagcugcgggagcaggucggccgcauggagcgggagcugaaccacgagaaggagcgcugcgaccagcuccaggccgagcagaaggggcugacggaggugacccagagccugaagauggagaacgaggaguucaagaagcgguucuccgacgcgaccagcaaggcccaccagcucgaggaggacaucguguccgucacccacaaggccaucgagaaggagacggagcuggacagccugaaggacaagcucaagaaggcccagcacgagcgcgagcagcuggagugccagcugaagaccgagaaggacgagaaggagcucuacaaggugcaccugaagaacaccgagaucgagaacaccaagcugauguccgaggugcagacgcucaagaaccuggacggcaacaaggagagcgucaucacccacuucaaggaggagaucgggcggcugcagcucugccuggccgagaaggagaaccugcagcgcaccuuccuccugaccacguccagcaaggaggacacgugcuuccugaaggagcagcuccggaaggcggaggagcagguccaggccacccgccaggaggugguguuccuggccaaggagcuguccgacgccgugaacgugcgggaccgcaccauggccgaccuccacaccgcgcggcuggagaacgagaaggucaagaagcagcuggccgacgccguggccgagcucaagcugaacgccaugaagaaggaccaggacaagaccgacacccuggagcacgagcuccgccgggaggucgaggaccugaagcugcgccugcagauggcggccgaccacuacaaggagaaguucaaggagugccagcggcuccagaagcagaucaacaagcugagcgaccagagcgccaacaacaacaacguguucaccaagaagacgggcaaccagcagaaggugaacgacgccuccgucaacaccgaccccgccaccagcgcguccaccguggacgugaagcccagccccuccgccgccgaggccgacuucgacaucgucacgaagggccaggugugcgagaugaccaaggagaucgcggacaagaccgagaaguacaacaagugcaagcagcugcuccaggacgagaaggccaagugcaacaaguacgccgacgagcuggccaagauggagcugaaguggaaggagcaggucaagaucgccgagaacgugaagcucgagcuggcggaggugcaggacaacuacaaggagcugaagcgcagccucgagaacccggccgagcggaagauggaggacggggccgacggcgccuucuaccccgacgagauccagcgcccgcccgugcgcguccccuccugggggcuggaggacaacguggugugcagccagcccgcccggaacuucucccgccccgacggccuggaggacagcgaggacuccaaggaggacgagaacguccccaccgcgccggacccgcccagccagcaccuccggggccacgggaccggcuucugcuucgacuccagcuucgacgugcacaagaagugcccccugugcgagcugauguucccgcccaacuacgaccaguccaaguucgaggagcacguggagagccacuggaaggucugccccaugugcuccgagcaguucccgcccgacuacgaccagcaggucuucgagcgccacgugcagacgcacuucgaccagaacgugcucaacuucgacuga

SEQ ID NO: 37440 - RNA, 375 nt, Artificial Sequence
  derived and/or modified sequence opt1 from TAX1BP3__Homo_sapiens__NP_055419
augagcuacauccccggccagccggugaccgccgucgugcagcgcguggagauccacaagcugcggcagggggagaaccucauccugggcuucuccaucgggggcgggaucgaccaggaccccagccagaaccccuucuccgaggacaagaccgacaagggcaucuacgucacgcgcgugagcgagggcgggcccgccgagaucgcgggccugcagaucggggacaagaucaugcaggucaacggcugggacaugaccauggugacccacgaccaggcccggaagcgccucaccaagcgguccgaggagguggugcgccugcuggucacgcggcagagccuccagaaggccgugcagcaguccaugcugagcuga

SEQ ID NO: 37441 - RNA, 879 nt, Artificial Sequence
  derived and/or modified sequence opt1 from TAZ__Homo_sapiens__NP_000107
augccccugcacgugaaguggccguuccccgccgucccgccccucaccuggacccuggccagcuccguggugaugggccuggucgggacguacagcugcuucuggaccaaguacaugaaccaccucaccgugcacaaccgcgaggugcuguacgagcugaucgagaagcggggccccgcgacgccccucaucaccgucuccaaccaccagagcugcauggacgacccccaccugugggggauccugaagcuccgccacaucuggaaccugaagcugaugcgguggacccccgccgccgccgacaucugcuucaccaaggagcuccacucccacuucuucagccugggcaagugcgugccggugugccgcggggccgaguucuuccaggcggagaacgagggcaagggcguccuggacaccgggcggcacaugcccggcgccgggaagcgccgggagaagggcgacgggguguaccagaagggcauggacuucauccucgagaagcugaaccacggcgacugggugcacaucuuccccgaggggaaggucaacauguccagcgaguuccugcgcuucaaguggggcaucgggcggcucaucgccgagugccaccugaaccccaucauccugccgcucuggcacgugggcaugaacgacgugcugcccaacuccccgcccuacuucccccgcuucggccagaagaucacgguccugaucgggaagcccuucagcgcccuccccgugcuggagcggcugcgcgcggagaacaaguccgccguggagaugcggaaggcccucaccgacuucauccaggaggaguuccagcaccugaagacccaggccgagcagcugcacaaccaccuccagcccggccgcuga

SEQ ID NO: 37442 - RNA, 1482 nt, Artificial Sequence
  derived and/or modified sequence opt1 from TBATA__Homo_sapiens__XP_011537769
auggccaccgacgugcagcuggccgacuacccccucaugagcccgcggucccugcggggcgaguggcgcauggagcaggagacccaggggcccagccaguggagcccccagcggguccgcggccggcacgcgcugcucuccaccucccgcgugcaccuguacagcaagcggacccccuucucccaggggcaccgcgagaagggcaugcagaccgccaucagcccgaaggccgagcugaagcucgagaagaaguccgggcggaagccccgcagcccccgggacuccggcccccagaaggagcuggugaucccgggcaucgucgacuucgagcgcauccggcgcgcccugcggacccccaagccccagacgcccgggaccuacugcuucggccgccucagccaccacuccuucuucagccggcaccacccgcacccccagcacgugacccacauccaggaccugaccgggaagcccgugugcgucgugcgcgacuuccccgccccgcugcccgaguccacgguguucagcggcugccagauggggauccccaccaucuccguccccaucggcgacccgcagagcaaccggaacccccagcucuccagcgcguggaagaaggagcugaaggagcuggccagccgcguggccuuccucaccaaggaggacgagcugaagaagaaggaggacaccacgucccugaacuggaacugcaagagccggcgcccccaggcccccggccucuccgggaccgaccugggcgcggccgagcuggggaucaagaaggagcagaaggaggagccgcuccgcgagcagggcgccaaguacagcgccgagaccggccggcugauccccgccuccacccgcgcgguggggcggcgccggagccaccagggccagcagucccagagcuccagccgccacgaggggguccaggccuuccugcuccaggaccaggagcugcuggugcucgagcugcugugccggauccucgagacggaccugcuguccgccauccaguucuggcuccuguacgccccgcccaaggagaaggaccuggcccucggccugcugcagaccgcgguggcccagcuccugccccagccccuggucagcauccccaccgagaagcuccugucccagcugccggaggugcacgagccgccccaggagaagcaggagccgcccugccgcugggcgccccaccccgcccuccccuucugcagccugcuguccagccaguccauccccgaggagaacgaggacaucaccuucuacaagaagcggaagacgcgcgugcacuggcggagcuccagcccgcccgacgccuucaagcccgagcaccgcgaggaggacaucgaggccgaggggcgggagcuccgcggccccaacacgugcacgugccuggcccaggagcagccccagggcuuccgcggggucagcguguccaccaccuucaccgccgugcccgacagccugcccuga

SEQ ID NO: 37443 - RNA, 2025 nt, Artificial Sequence
  derived and/or modified sequence opt1 from TBC1D15__Homo_sapiens__NP_001139685
auggccgccgcgggcguggucagcgggaagaucaucuacgagcaggagggcguguacauccacuccagcugcgggaagaccaacgaccaggacggccugaucuccgggauccuccgcgugcuggagaaggacgccgaggucaucguggacuggcggccccuggacgacgcccucgacagcuccagcauccuguacgcccgcaaggacuccagcuccguggucgaguggacccaggccccgaaggagcggggccaccgcggcagcgagcaccugaacuccuacgaggcggagugggacauggugaacacggugagcuucaagcggaagccccacaccaacggggacgcccccucccaccgcaacggcaagagcaagugguccuuccucuucagccugaccgaccugaaguccaucaagcagaacaaggaggggaugggcuggagcuaccucgucuucugccugaaggacgacguggugcugcccgcccuccacuuccaccagggggacuccaagcugcugaucgagagccucgagaaguacgucgugcugugcgagagcccgcaggacaagcggacccugcucgugaacugccagaacaagucccugagccaguccuucgagaaccugcucgacgagcccgccuacggccugauccagaagaucaagaaggaccccuacacggcgaccaugaucggcuucagcaaggucaccaacuacaucuucgacucccugcgcgggagcgaccccuccacccaccagcggccgcccagcgagauggccgacuuccucuccgacgccauccccggccugaagaucaaccagcaggaggagcccggguucgaggugaucacgcgcaucgaccugggcgagcggccggugguccagcgccgggagcccgugagccucgaggaguggaccaagaacaucgacuccgagggccgcauccugaacguggacaacaugaagcagaugaucuuccgcgggggccugagccacgcccuccggaagcaggccuggaaguuccugcugggguacuuccccugggacuccaccaaggaggagcggacccagcuccagaagcagaagacggacgaguacuuccgcaugaagcugcaguggaaguccaucagccaggagcaggagaagcggaacagccgccugcgggacuaccgcucccucaucgagaaggacgucaaccgcaccgaccggaccaacaaguucuacgagggccaggacaaccccgggcugauccugcuccacgacauccugaugaccuacugcauguacgacuucgaccugggcuacgugcagggcaugagcgaccuccuguccccgcugcucuacgugauggagaacgaggucgacgcguucuggugcuucgccagcuacauggaccagaugcaccagaacuucgaggagcagaugcaggggaugaagacgcagcugauccagcugagcacccuccugcgccugcuggacuccggcuucugcagcuaccucgagucccaggacagcggguaccuguacuucugcuuccgguggcugcucauccgcuucaagcgggaguucuccuuccuggacauccugcgccucugggaggugauguggaccgagcugcccugcaccaacuuccaccuccugcugugcugcgccauccuggagagcgagaagcagcagaucauggagaagcacuacggcuucaacgagauccucaagcacaucaacgagcuguccaugaagaucgacgucgaggacauccugugcaaggccgaggccaucagccuccagauggugaagugcaaggagcugccccaggcggugugcgagauccuggggcuccagggcuccgaggucacgacccccgacagcgacgugggcgaggacgagaacguggucaugaccccgugccccaccuccgccuuccagagcaacgcccugcccacgcuguccgccagcggggcccggaacgacucccccacccagaucccggugagcuccgacgugugccgccucacccccgcguga

SEQ ID NO: 37444 - RNA, 1218 nt, Artificial Sequence
  derived and/or modified sequence opt1 from TBC1D16__Homo_sapiens__NP_001258774
augaagguggcccccgacaagaccugcaugcaguucagcauccgccggccgaagcugcccuccagcgagacccaccccgaggaguccauguacaagcgccucggcgucagcgccuggcugaaccaccugaacgagcucgggcaggucgaggaggaguacaagcugcggaaggcgaucuucuucggcgggaucgacguguccauccgcggcgagguguggcccuuccugcuccgguacuacagccacgaguccaccagcgaggagcgcgaggcccugcggcugcagaagcgcaaggaguacuccgagauccagcagaagcggcucagcaugaccccggaggagcaccgcgccuucuggcggaacgugcaguucaccguggacaaggacgucgugcgcaccgaccggaacaaccaguucuuccgcggggaggacaaccccaacguggaguccaugcggcgcauccugcugaacuacgccgucuacaaccccgccgugggcuacagccagggcauguccgaccucguggcgcccauccuggccgagguccuggacgagagcgacacguucuggugcuucguggggcucaugcagaacaccaucuucguguccagcccgcgggacgaggacauggagaagcagcugcuguaccuccgcgagcugcugcggcucacccacguccgcuucuaccagcaccuggugucccugggcgaggacgggcuccagaugcuguucugccaccgguggcugcuccugugcuucaagcgcgaguuccccgaggccgaggcccugcgcaucugggaggcgugcugggcccacuaccagaccgacuacuuccaccucuucaucugcguggccaucgucgccaucuacggcgacgacgugaucgagcagcagcuggccacggaccagaugcugcuccacuucgggaaccuggcgaugcacaugaacggcgagcuggugcuccggaaggcccgcagccugcuguaccaguuccggcuccugccccgcauccccugcucccugcacgaccucugcaagcugugcggcagcgggaugugggacagcggcuccaugccggccgucgagugcaccgggcaccaccccggcagcgaguccugccccuacggcgggaccguggagaugcccagcccgaagucccugcgggagggcaagaaggggcccaagacgccccaggacggcuucggguuccgccgguga

SEQ ID NO: 37445 - RNA, 3480 nt, Artificial Sequence
  derived and/or modified sequence opt1 from TBC1D1__Homo_sapiens__NP_001240841
auggagcccaucaccuucaccgcccgcaagcaccuccucagcaacgagguguccgucgacuucggccugcagcugguggggagccucccggugcacucccugacgaccaugcccaugcugcccugggucguggccgaggugcggcgccucagccggcaguccacccgcaaggagcccgucaccaagcagguccggcugugcgugagcccguccggccugcgcugcgagcccgagcccgggcggagccagcagugggacccccucaucuacuccagcaucuucgagugcaagccgcagcgcguccacaagcugauccacaacucccacgaccccagcuacuucgcgugccugaucaaggaggacgccgugcaccggcaguccaucugcuacguguucaaggccgacgaccagacgaagguccccgagaucaucagcuccauccgccaggccggcaagaucgcccggcaggaggagcuccacugccccagcgaguucgacgacaccuucuccaagaaguucgaggugcuguucugcgggcgcgugaccgucgcgcacaagaaggccccgcccgcccugaucgacgagugcaucgagaaguucaaccacgugagcggcucccggggcagcgagagcccccgccccaacccgccccacgccgcgcccaccgggucccaggagcccgugcggcgcccgaugcgcaagagcuucucccagcccggccuccgcagccuggccuuccggaaggagcugcaggacgggggccuccgcuccagcggguucuucuccagcuucgaggaguccgacaucgagaaccaccugaucagcggccacaacaucguccagcccacggacaucgaggagaaccggaccaugcuguucaccaucggccaguccgagguguaccucaucagccccgacaccaagaagaucgcccuggagaagaacuucaaggagaucuccuucugcagccaggggauccgccacguggaccacuucggcuucaucugccgcgaguccagcgggggcggcggguuccacuucgucugcuacguguuccagugcacgaacgaggcccugguggacgagaucaugaugacccucaagcaggccuucaccgucgcggccgugcagcagaccgccaaggccccggcccagcugugcgagggcugcccccugcagucccugcacaagcugugcgagcggaucgaggggaugaacagcuccaagacgaagcuggagcuccagaagcaccugaccacccugaccaaccaggagcaggcgacgaucuucgaggaggugcagaagcuccggccccggaacgagcagcgcgagaacgagcugaucaucagcuuccugcggugccucuacgaggagaagcagaaggagcacauccacaucggcgagaugaagcagaccagccagauggccgccgagaacaucggguccgagcugcccccgagcgccacccgcuuccggcuggacaugcucaagaacaaggccaagcgcucccugaccgagagccuggaguccauccucagccggggcaacaaggcgcgcggccugcaggagcacuccaucagcguggaccuggacuccagccucuccagcacgcuguccaacaccagcaaggagcccuccgugugcgagaaggaggcccugcccaucagcgaguccagcuucaagcuccuggggagcuccgaggaccugagcuccgacagcgagucccaccucccggaggagcccgcgccccugagcccccagcaggccuuccggcgccgggccaacacccugucccacuucccgaucgagugccaggagccgccccagcccgcccgcggcagccccggggucucccagcggaagcugaugcgcuaccacagcguguccaccgagacgccccacgagcggaacguggaccccagccccgucggcgaguccaagcaccgcccggggcagagcuccgcccccgccccgccgccccggcucaaccccagcgccuccagccccaacuucuucaaguaccugaagcacaacuccagcggcgagcagagcggcaacgcggugcccaaguccaucagcuaccgcaacgcccugcgcaagaagcuccacuccagcuccagcgugcccaacuuccugaaguuccuggcccccgucgacgagaacaacaccuccgacuucaugaacaccaagcgggacuucgagagcaaggccaaccaccucggggacuccggcgggacccccgugaagacgcgccggcacagcuggcgccagcagaucuuccugcggguggccacgccccagaaggcgugcgacuccagcucccgcuacgaggacuacagcgagcugggcgagcucccgccccggagcccccuggagccggucugcgaggacgggcccuucggcccgccgcccgaggagaagaagcgcaccucccgggagcugcgcgagcucuggcagaaggccauccugcagcagauccugcuccugcggauggagaaggagaaccagaagcugcaggccuccgagaacgaccuccugaacaagcgccugaagcucgacuacgaggagaucacccccugccugaaggaggugaccaccgugugggagaagaugcugagcacccccggccgguccaagaucaaguucgacauggagaagaugcacagcgccgucgggcagggcgugccccgccaccaccgcggggagaucuggaaguuccucgccgagcaguuccaccugaagcaccaguuccccagcaagcagcagcccaaggacgugcccuacaaggagcugcucaagcagcugaccucccagcagcacgcgauccugaucgaccucggccggaccuuccccacgcacccguacuucagcgcccagcugggcgccgggcagcugucccucuacaacauccugaaggccuacagccugcucgaccaggaggucggcuacugccaggggcuguccuucguggccggcauccugcuccugcacaugagcgaggaggaggcguucaagaugcugaaguuccucauguucgacauggggcugcggaagcaguaccgccccgacaugaucauccugcagauggagaagaccaucaaccagguguucgagauggacaucgccaagcagcuccaggccuacgaggucgaguaccacgugcugcaggaggagcugaucgacuccagcccccucuccgacaaccagcggauggacaagcuggagaagaccaacagcucccugcgcaagcagaaccucgaccugcuggagcagcuccagguggccaacggccggauccagagccuggaggcgaccaucgagaagcugcucuccagcgaguccaagcugaagcaggccaugcugacgcucgagcuggagcgcagcgcccugcuccagaccgucgaggagcugcgccggcgcuccgccgagcccagcgaccgggagccggagugcacccagcccgagcccaccggcgacuga

SEQ ID NO: 37446 - RNA, 1212 nt, Artificial Sequence
  derived and/or modified sequence opt1 from TBC1D20__Homo_sapiens__NP_653229
auggcccugcgcagcgcccagggcgacgggcccaccuccggccacugggacgggggcgcggagaaggccgacuucaacgccaagcggaagaagaagguggccgagauccaccaggcccucaacagcgacccgaccgacgucgcggcccugcgccggauggccaucuccgagggcgggcugcucacggacgagauccgccggaagguguggcccaagcugcugaacgugaacgccaacgacccgccgcccaucagcggcaagaaccuccgccagauguccaaggacuaccagcagguccugcuggacgugcggcgcagccuccggcgcuucccgcccgggaugcccgaggagcagcgggagggccugcaggaggagcugaucgacaucauccuccugauccuggagcgcaacccccagcuccacuacuaccagggguaccacgacaucguggucaccuuccugcugguggugggcgagcggcucgcgaccucccuggucgagaagcugagcacccaccaccuccgcgacuucauggaccccacgauggacaacaccaagcacauccugaacuaccugaugcccaucaucgaccaggugaaccccgagcuccacgacuucaugcaguccgccgagguggggaccaucuucgcccugagcuggcugaucaccugguucggccacguccucuccgacuuccggcacguggugcgccuguacgacuucuuccuggccugccacccccucaugcccaucuacuucgccgcggucaucgugcuguaccgggagcaggaggugcuggacugcgacugcgacauggccagcguccaccaccuccugucccagaucccccaggaccugcccuacgagacgcucaucagccgcgccggcgaccuguucgugcaguucccgcccuccgagcuggcccgggaggccgcggcccagcagcaggccgagcgcaccgccgccagcaccuucaaggacuucgagcucgcguccgcccagcagcggcccgacauggugcugcgccagcgcuuccgggggcugcuccgccccgaggaccggaccaaggacguccugacgaagccgcgcaccaaccgguucgugaagcuggccgugaugggccucaccgucgcccugggggccgcggcccuggccguggucaagagcgcccucgagugggcgcccaaguuccagcugcagcuguuccccuga

SEQ ID NO: 37447 - RNA, 1320 nt, Artificial Sequence
  derived and/or modified sequence opt1 from TBC1D22A__Homo_sapiens__NP_001271232
auggccagcgacggcgcccgcaagcaguucuggaagcgguccaacagcaagcugcccgggucccuccugcgcagcaccgcgaagaugccgaccacgcccgugaaggccaagcgggucuccaccuuccaggaguucgagagcaacaccuccgacgccugggacgccggcgaggacgacgacgagcugcucgccauggcggccgagagccugaacuccgagguggugauggagaccgccaaccgcguccugcggaaccacagccagcgccaggggcggcccacgcuccaggagggccccgggcugcagcagaagccgcgccccgaggccgagccgcccuccccgcccagcggcgaccugcggcucgugaaguccgugagcgagucccacaccagcugccccgcggaggagcugcgccggcuguccuggagcggcauccccaagcccguccgccccaugaccuggaagcuccuguccggguaccugcccgccaacguggaccggcgccccgccacccuccagcggaagcagaaggaguacuucgccuucaucgagcacuacuacgacagccgcaacgacgaggugcaccaggacacguaccggcagauccacaucgacaucccgcgcaugagccccgaggcccugauccugcagcccaaggucaccgagaucuucgagcggauccucuucaucugggcgauccgccaccccgccuccggcuacgugcaggggaucaacgaccuggugaccccguucuucgucguguucaucugcgaguacaucgaggccgaggagguggacaccgucgacgugagcggcgugcccgccgagguccugugcaacaucgaggccgacacguacuggugcauguccaagcuccuggacgggauccaggacaacuacaccuucgcgcagcccggcauccagaugaaggugaagaugcuggaggagcucgugagccggaucgacgagcagguccaccgccaccuggaccagcacgaggugcgcuaccugcaguucgccuuccgguggaugaacaaccuccugaugcgcgaggugccccugcggugcaccauccgccucugggacaccuaccaguccgagccggacggcuucagccacuuccaccuguacgucugcgccgccuuccuggugcgguggcgcaaggagauccucgaggagaaggacuuccaggagcugcuccuguuccugcagaaccugcccacggcccacugggacgacgaggacaucucccuccugcuggcggaggccuaccggcucaaguucgccuucgccgacgcccccaaccacuacaagaaguga

SEQ ID NO: 37448 - RNA, 1518 nt, Artificial Sequence
  derived and/or modified sequence opt1 from TBC1D22B__Homo_sapiens__NP_060242
auggccgccgagaacagcaagcaguucuggaagcgcuccgcgaagcugcccggcagcauccagccgguguacggggcccagcacccgccccucgacccccggcugaccaagaacuucaucaaggagcgcuccaaggucaacaccgugccgcugaagaacaagaaggccagcuccuuccacgaguucgcccggaacacgagcgacgccugggacaucggcgacgacgaggaggaggacuucuccagccccuccuuccagacccucaacagcaagguggcgcuggccaccgccgcccagguccuggagaaccacuccaagcuccgcgugaagcccgagcggagccaguccaccacgagcgacgugcccgcgaacuacaaggucaucaaguccagcuccgacgcccagcugagccgcaacuccagcgacacgugccugcggaacccgcuccacaagcagcagagccugccccugcgccccaucaucccccucguggcccggaucuccgaccagaacgccagcggggccccgcccaugaccgugcgcgagaagacccggcuggagaaguuccgccagcugcucuccagccagaacaccgaccuggacgagcugcggaagugcuccuggcccggcgucccccgcgaggugcggccgaucaccuggcgccuccugagcggguaccugcccgcgaacaccgagcggcgcaagcucacccugcagcggaagcgcgaggaguacuucggcuucaucgagcaguacuacgacucccggaacgaggagcaccaccaggacacguaccgccagauccacaucgacaucccccgcaccaacccccugaucccccucuuccagcagccccuggugcaggagaucuucgagcggauccuguucaucugggccauccgccaccccgccagcggcuacguccaggggaucaacgaccucgugacccccuucuucguggucuuccuguccgaguacguggaggaggacguggagaacuucgacgucaccaaccugagccaggacaugcuccgguccaucgaggccgacagcuucuggugcauguccaagcugcuggacggcauccaggacaacuacacguucgcccagccggggauccagaagaaggugaaggcgcucgaggagcuggugagccgcaucgacgagcagguccacaaccacuuccggcgcuacgagguggaguaccugcaguucgccuuccgguggaugaacaaccuccugaugcgcgagcugccccuccggugcaccauccgccugugggacaccuaccaguccgagcccgagggcuucagccacuuccaccuguacgugugcgccgccuuccucaucaaguggcggaaggagauccuggacgaggaggacuuccaggggcugcucaugcugcugcagaaccuccccaccauccacuggggcaacgaggagaucggccugcugcuggccgaggcguaccgccucaaguacauguucgccgacgccccgaaccacuaccggcgcuga

SEQ ID NO: 37449 - RNA, 1680 nt, Artificial Sequence
  derived and/or modified sequence opt1 from TBC1D24__Homo_sapiens__NP_001186036
auggacagccccggcuacaacugcuucguggacaaggacaagauggacgccgccauccaggaccuggggccgaaggagcucuccugcaccgagcugcaggagcugaagcagcucgcgcgccagggcuacugggcccagagccacgcccugcgggggaagguguaccagcgccugauccgggacauccccugccgcaccgugacgcccgacgccuccguguacagcgacaucgucggcaagaucguggggaagcacuccagcuccugccucccccugccggaguucguggacaacacccagguccccagcuacugccugaacgcccggggcgagggcgcggugcgcaagauccuccugugccuggccaaccaguuccccgacaucuccuucugccccgcccucccggccguggucgcgcugcugcuccacuacagcaucgacgaggccgagugcuucgagaaggccugccggauccuggccugcaacgaccccgggcgccggcugaucgaccaguccuuccucgccuucgagagcuccugcaugaccuucggcgaccuggugaacaaguacugccaggcggcccacaagcugaugguggccgucagcgaggacgugcuccagguguacgccgacuggcagcgcuggcuguucggggagcugccccucugcuacuucgcccgggucuucgacguguuccugguggagggcuacaagguccuguaccgcguggcgcucgccauccugaaguucuuccacaaggugcgggccgggcagccccuggaguccgacagcgucaagcaggacauccgcaccuucgugcgggacaucgccaagacgguguccccggagaagcuccuggagaaggccuucgcgauccgccuguucagccggaaggagauccagcuccugcagauggccaacgagaaggcccugaagcagaagggcaucaccgucaagcagaaguccgugagccucagcaagcgccaguucguccaccuggccgugcacgccgagaacuuccgguccgagaucgugagcguccgcgagaugcgggacaucugguccugggugcccgagcgcuucgcgcugugccagccccuccugcuguucagcucccuccagcacggcuacagccuggcccgcuucuacuuccagugcgaggggcacgagcccacccugcuccugaucaagaccacgcagaaggaggugugcggcgccuaccuguccaccgacuggagcgagcggaacaaguucgggggcaagcucggcuucuucgggaccggcgagugcuucgucuuccgccugcagccggaggugcagcgguacgaguggguggucaucaagcaccccgagcugaccaagcccccgccccugauggccgcggagcccacggcgccccucucccacagcgccuccagcgaccccgccgaccgccuguccccguuccuggccgcccggcacuucaaccuccccagcaagaccgaguccauguucauggccgggggcagcgacugccugaucgucgggggcggcgggggccaggcccuguacaucgacggggaccucaaccgcggccggaccucccacugcgacaccuucaacaaccagccccugugcagcgagaacuuccugaucgccgccguggaggcguggggguuccaggaccccgacacgcaguga

SEQ ID NO: 37450 - RNA, 2067 nt, Artificial Sequence
  derived and/or modified sequence opt1 from TBC1D25__Homo_sapiens__NP_002527
auggccaccgccagcggcgcguccgaccugagcggguccggcgcgccgccgcccggggugggcgcccaggccgccgcggccgccgaggaggaggagcgcgaggucgugcgggugcgcgucaagaagugcgagagcuuccucccgcccgaguuccgguccuucgccguggacccccagaucaccagccuggacgugcugcagcacauccucauccgcgcguucgaccuguccgggaagaagaacuucggcaucagcuaccugggccgggaccgccucgggcaggaggucuaccugucccugcucagcgacugggaccuguccacggccuucgccaccgccagcaagcccuaccugcagcuccggguggacauccgccccuccgaggacagcccccugcuggaggacugggacaucaucucccccaaggacgugaucggcagcgacguccuccuggccgagaagcgguccagccugaccaccgcggcccuccccuucacgcaguccauccugacccagguggggcgcacccugagcaaggugcagcagguccucagcugguccuacggcgaggacgugaagcccuucaagccgccccugagcgacgccgaguuccacaccuaccugaaccacgaggggcagcucucccggcccgaggagcugcgccugcggaucuaccacggcggcguggagcccagccuccgcaaggucguguggcgguaccugcugaacguguaccccgacgggcucacgggccgcgagcggauggacuacaugaagcgcaagucccgggaguacgagcagcucaagagcgagugggcccagcgcgccaaccccgaggaccuggaguucauccgguccaccguccugaaggacgugcugcgcaccgaccgcgcgcaccccuacuacgccgggcccgaggacggcccccaccuccgggcccugcacgaccugcugaccacguacgccgugacccacccgcaggucagcuacugccagggcauguccgaccucgccagccccauccuggcggugauggaccacgaggggcacgccuucgugugcuucugcggcaucaugaagcgccuggccgccaacuuccaccccgacgggcgggccauggcgaccaaguucgcccaccucaagcugcugcuccgccacgccgaccccgacuucuaccaguaccugcaggaggccggcgcggacgaccuguucuucugcuaccgguggcuccugcuggagcugaagcgcgaguucgccuucgacgacgcccuccggaugcuggaggucaccugguccagccugccgcccgacccgcccgagcacgagguggagcucgucgggccgcccucccagguggccgacgccggcuucggcgggcaccgcggcuggcccgugcggcagcgccacaugcugcggcccgccgggggcgggggcagcacguucgaggacgccgucgaccaccuggccaccgccucccagggccccgggggcgggggccgccuccugcggcaggccagccuggacgggcuccagcagcugcgcgacaacaugggcucccggcgcgacccccuggugcagcucccccacccggcggcccugaucagcuccaagagccugagcgagccccuccugaacucccccgacccccugcucagcuccuucagccacccggacucccccagcuccagcuccccgcccagcacccaggaggccucccccaccggcgacauggccguggggagcccccugaugcaggaggucggcucccccaaggaccccggcaagagccugccgcccgugccgcccauggggcugcccccgccccaggaguucggccgggggaaccccuucaugcuguuccucugccucgccauccugcuggagcaccgcgaccacaucaugcggaacggccucgacuacaacgagcuggcgaugcacuucgaccgccuggugcgcaagcaccaccucgggcggguccugcgccgggcccgcgcccuguucgccgacuaccuccaguccgaggugugggacagcgaggagggcgcggaggccacggccgccuccuga

SEQ ID NO: 37451 - RNA, 2787 nt, Artificial Sequence
  derived and/or modified sequence opt1 from TBC1D2__Homo_sapiens__NP_001254500
auggagggcgccggggagaacgcccccgagagcuccagcuccgcgccgggcagcgaggaguccgcccgcgacccccaggugccgccgcccgaggaggagagcggggacugcgcccggucccuggaggccguccccaagaagcucugcggcuaccugagcaaguucgggggcaagggccccauccgcggguggaagucccggugguucuucuacgacgagcgcaagugccagcuguacuacagccggaccgcccaggacgcgaacccccucgacuccaucgaccugagcuccgccguguucgacugcaaggccgacgccgaggagggcaucuucgagaucaagacccccagccgcgugaucacgcugaaggcggccaccaagcaggccaugcucuacuggcugcagcagcugcagaugaagcggugggaguuccacaacuccccgcccgcgccgcccgccacccccgacgccgcccucgccgggaacggccccguccugcaccuggagcucgggcaggaggaggccgagcuggaggaguuccugugccccgugaagaccccgcccggccucgugggcgucgccgcggcccugcagcccuuccccgcccugcagaacaucagccucaagcaccuggggacggagauccagaacaccaugcacaacauccgcggcaacaagcaggcccaggggaccggccacgagccgcccggcgaggacagcccccaguccggggagccccagcgggaggagcagccccuggccuccgacgcgagcacccccggccgcgagcccgaggacagccccaagccggcccccaagcccucccucacgaucagcuucgcccagaaggccaagcggcagaacaacaccuucccguucuucuccgaggggaucacccgcaaccggaccgcccaggagaagguggcggcccuggagcagcagguccugaugcucacgaaggagcucaagagccagaaggagcuggugaagauccugcacaaggcccuggaggccgcgcagcaggagaagcgcgccuccagcgccuaccuggccgccgcggaggacaaggaccggcucgagcuggugcgccacaaggugcggcagaucgccgagcugggccgccgggucgaggcccucgagcaggagcgcgagucccuggcccacaccgccagccugcgggagcagcagguccaggagcuccagcagcacgugcagcugcugauggacaagaaccacgcgaagcagcaggucaucugcaagcucuccgagaaggugacccaggacuucacccacccgcccgaccagagcccccugcgccccgacgccgccaaccgcgacuuccugucccagcaggggaagaucgagcaccucaaggacgacauggaggccuaccggacgcagaacugcuuccugaacagcgagauccaccaggugaccaagaucuggcgcaagguggccgagaaggagaaggcgcugcucaccaagugcgccuaccugcaggcccggaacugccagguggaguccaaguaccuggccggccuccgccggcugcaggaggcgcugggcgacgaggccagcgagugcuccgagcugcuccgccagcuggugcaggaggcccugcagugggaggccggggaggccagcuccgacagcaucgagcucucccccaucagcaaguacgacgaguacggcuuccugaccguccccgacuacgagguggaggaccugaagcuccuggcgaagauccaggcccuggagagccggucccaccaccuccuggggcuggaggccguggaccgcccccuccgggagcgcugggccgcccugggcgaccuggucccgagcgcggagcucaagcagcugcugcgggccggggugccccgcgagcaccggccccgcgucuggcgguggcucgugcaccuccgggugcagcaccuccacacgcccggcugcuaccaggagcugcugucccgcggccaggcccgcgagcacccggccgcccggcagaucgagcuggaccugaaccgcaccuuccccaacaacaagcacuucacgugccccaccagcuccuuccccgacaagcugcgccggguccugcucgcguucagcuggcagaacccgaccaucggguacugccagggccugaaccgccuggccgccaucgcccuccuggugcuggaggaggaggaguccgcguucuggugccucguggccaucgucgagaccaucaugcccgccgacuacuacugcaacacccugaccgccagccagguggaccagcgggugcugcaggaccuccuguccgagaagcugccccgccucauggcccaccuggggcagcaccacgucgaccugagccucgugacguucaacugguuccugguggucuucgcggacucccugaucagcaacauccuccugcgggugugggacgccuuccuguacgagggcaccaagguggucuuccgcuacgcccucgccaucuucaaguacaacgagaaggagauccugcggcugcagaacgggcucgagaucuaccaguaccugcgcuucuucaccaagaccaucuccaacagccggaagcugaugaacaucgccuucaacgacaugaaccccuuccgcaugaagcagcuccggcagcugcgcauggugcaccgggagcgccuggaggcggagcuccgggagcuggagcagcugaaggccgaguaccucgagcgccgggccucccgccggcgcgccgugagcgagggcugcgccuccgaggacgaggucgagggcgaggcguga

SEQ ID NO: 37452 - RNA, 3774 nt, Artificial Sequence
  derived and/or modified sequence opt1 from TBC1D32__Homo_sapiens__NP_689943
auggcccacuucagcuccgaggaccaggccaugcugcaggccaugcuccgccggcuguuccagagcgugaaggagaagaucaccggcgcccccucccuggagugcgccgaggagauccuccugcaccuggaggagaccgacgagaacuuccacaacuacgaguucgucaaguaccuccgccagcacaucgggaacacgcugggcagcaugaucgaggaggagauggagaagugcaccuccgaccggaaccagggggaggagugcggcuacgacaccguggugcagcaggucaccaagcgcacgcaggagagcaaggaguacaaggagaugaugcacuaccugaagaacaucaugaucgccgugguggaguccaugaucaacaaguucgaggaggacgagacccggaaccaggagcgccagaagaagauccagaaggagaagucccacagcuaccggaccgacaacugcagcgacuccgacagcucccucaaccagagcuacaaguucugccaggggaagcugcagcugauccucgaccagcuggacccgggccagcccaaggagguccgcuacgaggcccugcagacccucugcuccgcgccgcccagcgacgugcugaacugcgagaacuggacgacccugugcgagaagcucaccgugucccugagcgaccccgaccccgucuucuccgaccggauccugaaguucugcgcccagaccuuccuccugagcccccugcacaugacgaaggagaucuacaccagccucgccaaguaccuggaguccuacuuccugagccgcgagaaccacauccccacccucuccgccggcguggacaucaccaacccgaacaugacgcggcugcugaagaaggugcgccuccugaacgaguaccagaaggaggcgcccagcuucuggauccggcaccccgagaaguacauggaggagaucgucgaguccacccugagccuccugaccgugaagcacaaccagucccacguggucagccagaagauccuggaccccaucuacuucuucgcccucguggacaccaaggccgugugguucaagaaguggaugcacgcccacuacucccgcacgaccguccugcggcugcucgagaccaaguacaagagccuggugaccacggccauccagcagugcgugcaguacuucgagaugugcaagacccgcaaggcggacgagacccuggggcacuccaagcacugccggaacaagcagaagaccuucuacuaccucggccaggagcugcaguacaucuacuucauccacagccugugccuccuggggcgccugcucaucuacaagcagggccggaagcuguucccgaucaagcugaagaacaagaaggggcuggucucccucaucgaccugcuggugcuguucacgcagcugaucuacuacagccccuccugccccaagaugaccagcgccgcccacuccgagaacuacagccccgccuccauggugaccgagguccuguggauccucagcgaccagaaggagugcgccguggagugccuguacaacaacaucgucaucgagacccugcuccagccgauccacaaccugaugaagggcaacgaggcgagccccaacugcuccgagacggcccugauccacaucgccggcauccucgcccgcaucgccagcguggaggaggggcugauccugcuccuguacggcgcgaacaugaacuccagcgaggagucccccaccggggcccacaucaucgcccaguucagcaagaagcugcucgacgaggacaucuccaucuucagcggcuccgagaugcugcccguggucaagggcgccuucaucagcgugugccggcacaucuacuccacgugcgaggggcuccaggugcucaucaccuacaaccugcacgagagcaucgccaaggcguggaagaagaccucccugcucagcgagcgcaucccgacccccgucgagggcuccgacagcguguccagcgugagccaggagucccagaacaucauggccugggaggacaaccugcuggacgaccuccugcacuucgccgccacccccaaggggcugcuccugcugcagcgcaccggcgcgaucaacgagugcgucaccuucaucuucaaccgguacgccaagaagcuccaggugagccgccacaagaaguucggguacggcgugcuggucacgcggguggccuccaccgccgccggcgggaucgcgcugaagaaguccggcuucaucaacgagcucaucaccgagcuguggagcaaccuggaguacgggcgcgacgacgugcgggucacccacccccgcacgaccccgguggaccccaucgaccggagcugccagaaguccuuccucgcccuggugaaccugcucagcuaccccgccaucuacgagcugguccgcaaccaggaccugcccaacaagaccgaguacucccuccgggaggugccgaccugcgugaucgacaucaucgaccgccugaucauccugaacagcgaggccaagauccggucccucuucaacuacgagcagagccacaucuucggccugcgcgacuucaucaucgacgggcuguccgucgagcggaaccacgugcucgugcgcaucaaccuggucggcggcccccuggagcggauccugcccccgcgccugcuggagaaguccgacaaccccuaccccuggcccauguucagcagcuacccgcuccccaacugcuaccuguccgacaucacgcggaacgccgggaucaagcaggacaacgaccuggacaagcuccugcugugccucaagaucagcgacaagcagaccgaguggaucgagaacugccagcgccaguucugcaagaugaugaaggcgaagcccgacaucaucuccggcgaggcccugaucgagcugcucgagaaguucgugcugcaccugaccgagagccccagcgagugcuacuucccguccguggaguacaccgccacggacgccaacgucaagaacgagagccucuccagcgugcagcagcuggggaucaagaugaccgugcgguacggcaaguuccugucccuccugaaggacggggccgagaacgaccugaccuggguccucaagcacugcgagcgcuuccugaagcagcagcagaccagcaucaaguccagccugcucugccugcagggcaacuacgcgggccacgacugguucguguccagccuguucaugaucaugcucggggacaaggagaagacguuccaguuccugcaccaguucucccgccugcucaccagcgccuuccuguggcugccccggcuccacaucuccagcuaccugcccaacgacaccguggaguccggcauccaccccgucuacuucugcagcacccacuacaucgagaugcugcucaaggccgagcugccgcugguguucuccgccuuccacaugagcggguucgcgcccucccagaucugccuccaguggaucacgcagugcuucuggaacuaccuggacuggaucgagaucugccacuacaucgcgaccugcguguuccugggccccgacuaccaggucuacaucugcaucgccguguucaagcaccuccagcaggacauccuccagcacacccagacccaggaccuccagguguuccugaaggaggaggcccugcacggcuuccgcgucagcgacuacuucgaguacauggagauccuggagcagaacuaccggacggugcugcuccgcgacaugcggaacauccgccugcagagcaccuga

SEQ ID NO: 37453 - RNA, 1584 nt, Artificial Sequence
  derived and/or modified sequence opt1 from TBC1D3C__Homo_sapiens__XP_006721970
auggacguggucgagguggccggcagcuggugggcccaggagcgcgaggacaucaucaugaaguacgagaaggggcaccgggcgggccugcccgaggacaaggggccgaagcccuuccgcuccuacaacaacaacguggaccaccucggcaucguccacgagaccgagcugccgccccugaccgcccgggaggccaagcagauccgccgggagaucagccgcaaguccaaguggguggacaugcucggggacugggagaaguacaagagcucccggaagcugaucgaccgcgccuacaagggcaugcccaugaacauccggggccccauguggagcgugcugcucaacacggaggagaugaagcugaagaaccccgggcgcuaccagaucaugaaggagaagggcaagcgguccagcgagcacauccagcgcaucgaccgggacgucuccgggacccugcgcaagcacaucuucuuccgggaccgcuacggcaccaagcagcgggagcuccugcacauccugcucgccuacgaggaguacaaccccgaggugggguacugccgcgaccugagccacaucgcggcccuguuccuccuguaccugccggaggaggacgccuucugggcccucgugcagcugcuggcguccgagcggcacagccuccagggcuuccacucccccaacggcgggaccguccagggccugcaggaccagcaggagcacgugguggccacgagccagcccaagaccauggggcaccagaucucccugggccucacccugcgccugugggacgucuaccucguggagggcgagcaggcccugaugcccaucacccggaucgccuucaaggugcagcagaagcgccugacgaagaccagccgcugcgggccgugggcccgguucugcaaccgcuucgucgacaccugggcgcgggacgaggacaccgugcucaagcaccuccgcgccuccaugaagaagcugacgcggaagaagggcgaccugcccccgcccgccaagcccgagcaggggagcuccgccagccgccccgugcccgccagccggggcgggaagacccugugcaagggcgaccgccaggcgcccccgggcccgcccgcccgguucccccgccccaucugguccgccagcccgccccgggcgccccgcuccagcacccccugccccgggggcgccguccgggaggacaccuaccccguggggacgcagggcgugccgucccccgcccuggcccagggcgggccccagggcagcuggcgcuuccuccaguggaacuccaugccccggcugccgaccgaccuggacgucgaggggcccugguuccgccacuacgacuuccggcagagcugcugggugcgcgccaucucccaggaggaccagcucgcccccugcuggcaggccgagcaccccgcggagcgggugcgcagcgccuucgccgccccguccaccgacagcgaccagggcacccccuuccgcgcgcgggacgagcagcagugcgcccccacguccgggcccugccugugcggccugcaccucgagagcucccaguucccgcccggguucuga

SEQ ID NO: 37454 - RNA, 1650 nt, Artificial Sequence
  derived and/or modified sequence opt1 from TBC1D3F__Homo_sapiens__NP_115634
auggacguggucgagguggccggcagcuggugggcccaggagcgcgaggacaucaucaugaaguacgagaaggggcaccgggcgggccugcccgaggacaaggggcccaagcccuuccgcuccuacaacaacaacguggaccaccucggcaucguccacgagaccgagcugccgccccugaccgcccgggaggccaagcagauccgccgggagaucagccgcaaguccaaguggguggacaugcucggggacugggagaaguacaagagcucccggaagcugaucgaccgcgccuacaagggcaugcccaugaacauccggggccccauguggagcgugcugcucaacaucgaggagaugaagcugaagaaccccgggcgcuaccagaucaugaaggagaagggcaagcgguccagcgagcacauccagcgcaucgaccgggacgucuccgggacgcugcgcaagcacaucuucuuccgggaccgcuacggcaccaagcagcgggagcuccugcacauccugcucgccuacgaggaguacaaccccgaggugggguacugccgcgaccugagccacaucgcggcccuguuccuccuguaccugccggaggaggacgccuucugggcccucgugcagcugcuggcguccgagcggcacagccuccagggcuuccacucccccaacggcgggaccguccagggccugcaggaccagcaggagcacgugguggccaccagccagcccaagacgauggggcaccaggacaagaaggaccugugcggccagugcagcccccucggcugccugauccgcauccugaucgacgggaucucccucggccugacccugcggcucugggacgucuaccugguggagggggagcaggcccugaugccgaucacccgcaucgccuucaaggugcagcagaagcgccucaccaagacgucccggugcggccccugggcccgcuucugcaaccgguucgucgacaccugggcgcgcgacgaggacaccgugcugaagcaccuccgggccagcaugaagaagcugacccgcaagaagggggacgugcccccgcccgccaagcccgagcagggcuccagcgccagccggcccguccccgccucccgcggcgggaagacgcugugcaagggcgaccggcaggcgccgcccgggccgcccgcccgcuucccccggcccaucuggagcgccuccccgccccgcgcgccccggagcuccacccccugccccggcggggccgugcgcgaggacaccuacccggugggcacccagggcguccccagccccgcccuggcccagggcgggccccagggguccuggcgguuccuccaguggaacagcaugccgcgccugcccacggaccuggacguggagggccccugguuccggcacuacgacuuccgccaguccugcugggugcgggccaucagccaggaggaccagcucgcccccugcuggcaggccgagcacccggcggagcgcguccgcuccgccuucgccgcccccagcaccgacuccgaccaggggacccccuuccgggcgcgcgacgagcagcagugcgcccccaccagcggcccgugccugugcggccugcaccucgaguccagccaguucccgcccggguucuga

SEQ ID NO: 37455 - RNA, 3873 nt, Artificial Sequence
  derived and/or modified sequence opt1 from TBC1D4__Homo_sapiens__NP_001273587
auggagcccccgagcugcauccaggacgagcccuucccccacccccuggagccggagcccggcguguccgcccagcccgggcccggcaagccgagcgacaagcgcuuccggcucugguacgucgggggcuccugccuggaccaccgcaccacccugcccaugcuccccuggcugauggccgagauccggcgccggagccagaagcccgaggccgggggcugcggcgcgccggccgcccgcgaggugauccuggugcucuccgcccccuuccugcggugcguccccgcgcccggggccggcgccagcgggggcacguccccgagcgccacccagcccaaccccgcgguguucaucuucgagcacaaggcccagcacaucucccgcuucauccacaacagccacgaccugaccuacuucgccuaccucaucaaggcccagcccgacgacccggagucccagauggccugccacguguuccgggcgaccgaccccagccagguccccgacgugaucuccagcauccgccagcuguccaaggccgccaugaaggaggacgccaagcccagcaaggacaacgaggacgccuucuacaacucccagaaguucgaggugcuguacugcgggaaggucacggugacccacaagaaggcgccgagcucccucaucgacgacugcauggagaaguucagccugcacgagcagcagcggcugaagauccagggcgagcagcgcggccccgaccccggggaggaccucgccgaccuggagguggucgugcccggcagcccgggggacugccugcccgaggaggccgacggcaccgacacccaccucggccugcccgccggggccucccagccggcgcugacgagcucccgggugugcuuccccgagcgcauccucgaggacagcggcuucgacgagcagcaggaguuccggucccgcugcagcuccgucaccggggugcagcggcgcgugcacgagggcagccagaagucccagccccggcgccggcacgccagcgcccccucccacguccagccgagcgacuccgagaagaaccgcaccaugcuguuccagguggggcgcuucgagaucaaccugaucagccccgacaccaaguccgugguccucgagaagaacuucaaggacaucagcuccugcagccagggcaucaagcacguggaccacuucggcuucaucugccgggagucccccgagcccgggcugagccaguacaucugcuacguguuccagugcgccagcgagucccuggucgacgaggugaugcucacgcugaagcaggccuucagcaccgcggccgcccugcaguccgccaagacccagaucaagcucugcgaggcgugcccgaugcacagccugcacaagcugugcgagcgcaucgagggccucuacccgccccgggccaagcuggucauccagcgccaccuguccagccucaccgacaacgagcaggccgacaucuucgagcgggugcagaagaugaagcccguguccgaccaggaggagaacgagcuggucauccugcaccuccgccagcugugcgaggccaagcagaagacgcacgugcacaucggggagggccccagcaccaucuccaacagcaccauccccgagaacgccaccuccagcgggcgguucaagcuggacauccucaagaacaaggcgaagcgcucccugacgagcucccuggagaacaucuucagccggggcgccaaccgcaugcggggccgccucggguccguggacagcuucgagcggagcaacucccuggccagcgagaaggacuacucccccggcgacagcccgcccgggaccccgcccgccuccccgcccagcuccgccuggcagaccuuccccgaggaggacagcgacagcccccaguuccgccggcgcgcgcacaccuucucccacccgcccuccagcacgaagcggaagcugaaccuccaggacggccgcgcccaggggguccggagcccccugcugcgccaguccuccagcgagcagugcuccaaccugagcuccgugcgccggauguacaaggagagcaacagcuccagcucccuccccagccugcacaccuccuucagcgcccccuccuucaccgcccccagcuuccugaaguccuucuaccagaacagcggccgccucagcccccaguacgagaacgagaucuccgacggcgaggggcggaagcgcaccuccagcacgugcuccaacgagagccuguccgugggcgggaccagcgucacgccccggcgcaucuccuggcggcagcgcaucuuccugcggguggccagcccgaugaacaagagccccuccgcgaugcagcagcaggacggccucgaccgcaacgagcugcugccccucagcccccuguccccgaccauggaggaggagccccugguggucuuccucagcggcgaggacgaccccgagaagaucgaggagcggaagaaguccaaggagcugcgcagccuguggcggaaggccauccaccagcagauccuccugcugcgcauggagaaggagaaccagaagcucgaggccucccgggacgagcugcagagccgcaaggugaagcuggacuacgaggaggugggggccugccagaaggagguccucaucaccugggacaagaagcugcugaacugccgggcgaagauccgcugcgacauggaggacauccacacccuccugaaggagggcgugcccaagucccggcgcggggagaucuggcaguuccuggcccuccaguaccggcugcgccaccgccugccgaacaagcagcagccgcccgacaucagcuacaaggagcuccugaagcagcugaccgcccagcagcacgccauccucguggaccugggccggaccuuccccacgcaccccuacuucuccguccagcuggggcccggccagcucagccuguucaaccugcucaaggccuacucccugcuggacaaggaggugggcuacugccaggggaucagcuucguggcgggcguccuccugcugcacauguccgaggagcaggccuucgagaugcucaaguuccugauguacgaccugggguuccgcaagcaguaccggcccgacaugaugagccuccagauccagauguaccagcugucccgccugcuccacgacuaccaccgggaccuguacaaccaccuggaggagaacgagaucagccccucccucuacgccgccccgugguuccugacccuguucgccagccaguucagccucggcuucguggcgcgcguguucgacaucaucuuccugcaggggaccgaggucaucuucaagguggcccugucccuccugagcucccaggagacccugaucauggagugcgagagcuucgagaacaucguggaguuccucaagaacacccugcccgacaugaacacguccgagauggagaagaucaucacccaggucuucgagauggacaucagcaagcagcugcacgccuacgagguggaguaccacgugcuccaggacgagcugcaggaguccagcuacuccugcgaggacagcgagacccuggagaagcucgagcgggccaacucccagcugaagcgccagaacauggaccugcucgagaagcugcaggucgcccacaccaagauccaggcgcuggagagcaaccucgagaaccugcugacgcgggagaccaagaugaagucccucauccgcacccuggagcaggagaagauggccuaccagaagaccguggagcagcugcggaagcuccugcccgccgacgcccuggugaacugcgaccuccugcugcgcgaccucaacugcaaccccaacaacaaggcgaagaucggcaacaagccguga

SEQ ID NO: 37456 - RNA, 2454 nt, Artificial Sequence
  derived and/or modified sequence opt1 from TBC1D5__Homo_sapiens__NP_001127853
auguaccacagccuguccgagacccgccacccccuccagccggaggagcaggaggugggcaucgacccccugagcuccuacagcaacaaguccgggggcgacagcaacaagaacgggcggcgcaccuccagcacgcuggacuccgagggcaccuucaacagcuaccggaaggagugggaggagcuguucgucaacaacaacuaccuggccaccauccgccagaaggggaucaacggccagcugcgguccagccgcuuccgguccaucugcuggaagcuguuccucugcgugcugccccaggacaagagccaguggaucucccgcaucgaggagcuccgggccugguacagcaacaucaaggagauccacaucaccaacccccgcaagguggucggccagcaggaccugaugaucaacaacccgcugucccaggacgaggggagccucuggaacaaguucuuccaggacaaggagcugcgguccaugaucgagcaggacgugaagcgcacguuccccgagaugcaguucuuccagcaggagaacgugcggaagauccugaccgacguccucuucugcuacgcgcgcgagaacgagcagcugcuguacaagcagggcaugcacgagcuccuggcccccaucguguucgugcugcacugcgaccaccaggccuuccuccacgccagcgagagcgcccagcccuccgaggagaugaagaccguccugaacccggaguaccuggagcacgacgcguacgccguguucagccagcucauggagaccgccgagcccugguucuccacguucgagcacgacgggcagaagggcaaggagacccugaugacccccauccccuucgcccggccgcaggaccuggggcccaccaucgcgaucgugacgaaggucaaccagauccaggaccaccuccugaagaagcacgacaucgagcuguacaugcaccucaaccgccuggagaucgcgccccagaucuacggccugcggugggugcgccuccuguucggccgggaguucccccugcaggaccuccugguggucugggacgcccuguucgccgacgggcucagccugggccugguggacuacaucuucguggccaugcuccuguacauccgcgacgcccugaucuccagcaacuaccagaccugccucgggcugcugaugcacuacccguucaucggcgacguccacucccucauccugaaggcccuguuccugcgggaccccaagcgcaacccccgccccgugaccuaccaguuccacccgaaccucgacuacuacaaggcccggggcgccgaccugaugaacaagagccgcaccaacgccaagggggcgccccugaacaucaacaagguguccaacagccucaucaacuucggccggaagcugaucucccccgccauggcccccgggagcgccggcgggccgguccccggcggcaacuccagcuccagcuccagcguggugauccccacgcgcaccuccgccgaggcgcccagccaccaccuccagcagcagcagcagcagcagcggcucaugaaguccgagagcaugccgguccagcugaacaagggggacguggucaccggcagcgacgcccagguguccgugcccguccagacccugacggaccuccaggggcugagcuccaagaacaucagcuccagccccuccguggagagccugccgggcgggcgcgaguucaccggcuccccgcccagcuccgccaccaagaaggacagcuucuucuccaacaucagccggucccgcagccacagcaagaccaugggccggaaggaguccgaggaggagcucgaggcccagaucagcuuccugcaggggcagcugaacgaccucgacgccaugugcaaguacugcgcgaaggugauggacacgcaccuggucaacauccaggacgugauccugcaggagaaccucgagaaggaggaccagauccuggugucccuggccggccucaagcagaucaaggacauccugaaggggagccugcgcuucaaccagucccagcucgaggccgaggagaacgagcagaucaccaucgccgacaaccacuacugcagcuccggccaggggcagggccggggccaggggcagagcguccagauguccggcgcgaucaagcaggccagcuccgagacccccgggugcaccgaccgcggcaacagcgacgacuucauccugaucuccaaggacgacgacggcagcuccgcccgggggagcuucuccggccaggcccagccccugcgcacgcuccggagcaccuccggcaagagccaggcccccgugugcagcccccugguguucuccgacccccugauggggccggcgagcgccuccagcuccaaccccagcuccagccccgacgacgacuccagcaaggacuccggguucaccaucgucagcccccucgacaucuga

SEQ ID NO: 37457 - RNA, 801 nt, Artificial Sequence
  derived and/or modified sequence opt1 from TBC1D7__Homo_sapiens__NP_001137438
augaccgaggacagccagcgcaacuuccgguccguguacuacgagaaggucggcuuccgcgggguggaggagaagaagucccuggagauccuccugaaggacgaccggcugggcauccugcccccgcaccacgagagccacgccaaggugaugauguaccgcaaggagcaguaccuggacguccugcacgcccucaagguggugcgguucgucagcgacgcgacgccccaggccgagguguaccugcgcauguaccagcuggaguccgggaagcucccccggagccccuccuucccgcuggagcccgacgacgagguguuccuggccaucgccaaggccauggaggagauggucgaggacagcguggacugcuacuggaucacccgccgguucgugaaccagcucaacaccaaguaccgcgacucccugccccagcugcccaaggcguucgagcaguaccucaaccuggaggacggccggcugcucacccaccuccgcaugugcagcgccgccccgaagcugcccuacgaccucugguucaagcggugcuucgccgggugccugcccgaguccagccugcagcgcgucugggacaaggugguguccggcagcugcaagauccucgucuucguggcgguggagauccugcugaccuucaagaucaaggucauggcccucaacuccgccgagaagaucacgaaguuccuggagaacaucccccaggacagcuccgacgccaucgugagcaaggccaucgaccuguggcacaagcacugcggcaccccggugcacuccagcuga

SEQ ID NO: 37458 - RNA, 3423 nt, Artificial Sequence
  derived and/or modified sequence opt1 from TBC1D8__Homo_sapiens__NP_001095896
auguggcugaagcccgaggaggugcuccugaagaacgcccugaagcucugggucacccagaaguccagcugcuacuucauccugcagcgccggcgcggccacggggagggcgggggccggcugaccgggcgccucgugggcgcccuggacgcggugcuggacagcaacgcccgggucgccccguuccgcauccuccuccaggugcccggcucccagguguacagccccaucgccugcggggccacgcuggaggagaucaaccagcacugggacuggcucgagcagaaccugcugcacacccucuccgucuucgacaacaaggacgacaucgcgagcuucgugaagggcaaggugaaggcccugaucgccgaggagaccuccagccggcuggccgagcaggaggaggagcccgagaaguuccgcgaggcgcucgucaaguucgaggcccgguucaacuucccggaggccgagaagcuggugaccuacuacuccugcugcugcuggaaggggcgcgugccccggcagggcuggcuguaccucagcaucaaccaccugugcuucuacuccuucuuccuggggaaggagcucaagcuggucgugcccuggguggacauccagaagcuggagcgcacgagcaacgucuuccucaccgacaccauccggaucaccacgcagaacaaggagcgcgacuucuccauguuccugaaccuggacgagguguucaaggugauggagcagcucgccgacgucacccugcggcgccugcucgacaacgagguguucgaccuggaccccgaccugcaggagccgagccagaucaccaagcgggaccucgaggcccgcgcgcagaacgaguucuuccgggccuucuuccgccugccccggaaggagaagcugcacgccguggucgacugcucccucuggacccccuucagccgcugccacacgaccggccgcauguucgccuccgacagcuacaucugcuucgccucccgggaggacggcugcugcaagaucauccugccccugcgcgagguggugagcaucgagaagauggaggacaccagccuccugccgcaccccaucaucgucuccauccggagcaagguggcguuccaguucaucgagcugcgcgaccgggacucccucgucgaggcccugcuggcccgccucaagcagguccacgccaaccaccccgugcacuacgacaccagcgccgacgacgacauggcgucccugguguuccacagcacguccaugugcagcgaccaccgguucggggaccuggagaugauguccagccagaacuccgaggagagcgagaaggagaaguccccgcugaugcaccccgacgcccucgugaccgccuuccagcagagcggcucccagagccccgacucccgcaugagccgggagcagaucaagaucucccuguggaacgaccacuucguggaguacgggcgcaccgucugcauguuccggaccgagaagauccgcaagcugguggccaugggcauccccgagagccuccggggccgccuguggcugcuguucagcgacgccgugacggaccuggcgucccaccccggguacuacggcaaccuggucgaggagagccucgggaagugcugccuggugaccgaggagaucgagcgggaccugcaccgcucccucccggagcaccccgccuuccagaacgagaccggcaucgccgcccugcggcgcgugcugaccgcguacgcccaccggaaccccaagaucggguacugccagagcaugaacauccucacguccguccugcugcucuacaccaaggaggaggaggccuucuggcugcugguggccgugugcgagcgcaugcuccccgacuacuucaaccaccgcgucaucggcgcccagguggaccagagcguguucgaggagcugaucaagggccaccucccggagcuggcggagcacaugaacgaccuguccgcccuggccagcgucucccucagcugguuccugacccuguuccucuccaucaugccccuggagagcgccgugaacguggucgacugcuucuucuacgacgggaucaaggccaucuuccagcugggccucgcggugcuggaggccaacgccgaggaccugugcuccagcaaggacgacgggcaggcccucaugauccugucccgguuccuggaccacaucaagaacgaggacagccccgggcccccggugggcucccaccacgccuucuucagcgacgaccaggagcccuaccccgucaccgacaucagcgaccucauccgcgacuccuacgagaaguucggcgaccagagcguggagcagaucgagcaccuccgguacaagcaccgcauccgggugcugcagggccacgaggacacgaccaagcagaacguccugcgcguggugaucccggaggucuccauccugcccgaggaccuggaggagcucuacgaccuguucaagcgggagcacaugaugagcugcuacugggagcagccccgccccauggcgucccggcacgacccgagccgccccuacgccgagcaguaccggaucgacgcccgccaguucgcccaccuguuccagcucgugucccccuggaccugcggggcgcacaccgagauccuggccgagcggacguuccgccugcucgacgacaacauggaccagcugaucgaguucaaggccuucgugagcugccuggacaucauguacaacggcgagaugaacgagaagaucaagcuccuguaccggcugcacaucccgcccgcccucaccgagaacgaccgcgacucccagagcccccugcggaacccccugcucuccaccagccgcccccuggucuucgggaagccgaacggcgacgccguggacuaccagaagcagcugaagcagaugaucaaggaccucgcgaaggagaaggacaagaccgagaaggagcugcccaagaugucccagcgggaguucauccaguucugcaagacgcuguacagcauguuccacgaggaccccgaggagaacgaccucuaccaggccaucgccaccgugaccacccugcugcuccagaucggggaggucggccagcgcggcuccagcuccgggagcugcucccaggagugcggcgaggagcugcgggccagcgcccccagcccggaggacuccguguucgcggacaccgggaagacgccccaggacagccaggccuuccccgaggccgccgagcgcgacuggaccgugucccuggagcacauccucgccagccugcugaccgagcagucccucgucaacuucuucgagaagccccuggacaugaaguccaagcuggagaacgcgaagaucaaccaguacaaccucaagaccuucgagaugagccaccagagccaguccgagcugaagcugagcaaccucuga

SEQ ID NO: 37459 - RNA, 3801 nt, Artificial Sequence
  derived and/or modified sequence opt1 from TBC1D9__Homo_sapiens__NP_055945
augugggugaaccccgaggagguccugcucgccaacgcccuguggaucaccgagcgcgcgaacccguacuucauccugcagcggcgcaagggccacgccggggacggcgggggcgggggcggccucgccgggcugcuggugggcacccucgacgugguccuggacagcuccgcccggguggcccccuaccgcauccuguaccagacgcccgacagccucguguacuggaccaucgcgugcgggggcucccggaaggagaucaccgagcacugggaguggcuggagcagaaccugcuccagacccugagcaucuucgagaacgagaacgacaucacgaccuucguccgcgggaagauccagggcaucaucgccgaguacaacaagaucaacgacgugaaggaggacgacgacaccgagaaguucaaggaggccaucgugaaguuccaccggcuguucggcaugcccgaggaggagaagcucgucaacuacuacuccugcagcuacuggaaggggaaggugccgcgccagggcuggauguaccuguccaucaaccaccugugcuucuacagcuuccucauggggcgggaggccaagcuggugauccgcugggucgacaucacccagcuggagaagaacgcgacgcuccugcugcccgacgugaucaagguguccacccggagcuccgagcacuucuucagcgucuuccucaacaucaacgagaccuucaagcugauggagcagcuggccaacaucgccaugcgccagcuccuggacaacgagggcuucgagcaggaccggucccugcccaagcucaagcgcaagagccccaagaagguguccgcccugaagcgggaccuggacgcccgcgcgaaguccgagcgguaccgcgcccucuuccggcugccgaaggacgagaagcuggacggccacaccgacugcacgcucuggacccccuucaacaagaugcacauccuggggcagauguucgugagcaccaacuacaucugcuucaccagcaaggaggagaaccugugcucccucaucaucccccugcgcgaggucacgaucguggagaaggccgacagcagcuccgugcugcccagcccgcucuccaucagcacccggaaccgcaugaccuuccuguucgccaaccugaaggaccgcgacuuccucguccagcggaucuccgacuuccugcagcagaccacgagcaagaucuacuccgacaaggaguucgccggcagcuacaacuccagcgacgacgagguguacucccgccccagcucccuggugagcuccagcccccagcgguccaccagcuccgacgcggacggggagcgccaguucaaccucaacggcaacagcguccccaccgccacccagacgcugaugaccauguaccggcgccggagcccggaggaguucaaccccaagcuggccaaggaguuccugaaggagcaggccuggaagauccacuucgccgaguacgggcagggcaucugcauguaccgcaccgagaagacccgggagcucgugcugaagggcauccccgaguccaugcgcggggagcuguggcuccugcugagcggcgcgaucaacgagaaggccacgcaccccggguacuacgaggaccucgucgagaaguccaugggcaaguacaaccuggccaccgaggagaucgagcgggaccugcaccgcagccucccggagcaccccgccuuccagaacgagauggggaucgccgcgcugcggcgcgugcugaccgccuacgccuuccggaaccccaacaucggcuacugccaggccaugaacaucgugaccuccguccuccugcuguacgcgaaggaggaggaggccuucuggcuccugguggcccugugcgagcgcaugcuccccgacuacuacaacacgcggguggucggcgcccugguggaccaggggguguucgaggagcuggcccgcgacuacgucccgcagcucuacgacugcaugcaggaccugggcgugaucagcaccaucucccugagcugguuccucacccuguuccuguccgugaugcccuucgagagcgcggucgugguggucgacugcuucuucuacgaggggaucaaggugaucuuccagcucgcccuggccgugcuggacgccaacgucgacaagcuccugaacugcaaggacgacggcgaggccaugaccgugcuggggcgguaccucgacuccgugacgaacaaggacagcacccugccgcccaucccccaccuccacucccugcugagcgacgacgucgagcccuaccccgagguggacaucuuccgccugauccgcaccuccuacgagaaguucggcaccauccgggcggaccucaucgagcagaugcgcuucaagcagcggcugaaggugauccagacccuggaggacacgaccaagcgcaacgucgugcggaccaucgugaccgagacgagcuucaccaucgacgagcucgaggagcuguacgcccuguucaaggccgagcaccucaccuccugcuacuggggcgggagcagcaacgcccuggaccgccacgacccgucccugcccuaccucgagcaguaccggaucgacuucgagcaguucaagggcauguucgcccugcuguuccccugggcgugcgggacccacagcgacguccucgccucccgccuguuccagcugcucgacgagaacggcgacagccugaucaacuuccgggaguucguguccggccugagcgccgccugccacggggaccucacggagaagcugaagcugcucuacaagaugcacgugcugcccgagccguccagcgaccaggacgagcccgacuccgcguucgaggccacccaguacuucuucgaggacaucacccccgagugcacccacgucgugggccuggacagccgcuccaagcagggggccgacgacggcuucgugacggucagccucaagcccgacaaggggaagcgggccaacucccaggagaaccgcaacuaccugcggcuguggaccccggagaacaagagcaaguccaagaacgccaaggaccuccccaagcugaaccagggccaguucaucgagcugugcaagaccauguacaacauguucagcgaggaccccaacgagcaggagcucuaccacgcgaccgccgccgugacgucccugcugcucgagaucggcgagguggggaagcuguucgucgcccagcccgccaaggagggcgggagcggcggguccggcccgagcugccaccagggcauccccggggugcuguuccccaagaagggccccgggcagccguacguggucgagagcguggagccccuccccgcgucccuggcccccgacagcgaggagcacucccugggcgggcagauggaggacaucaagcucgaggacagcuccccgcgcgacaacggcgccugcagcuccaugcugaucagcgacgacgacaccaaggacgacuccagcauguccagcuacuccgugcugagcgccggcucccacgaggaggacaagcuccacugcgaggacaucggggaggacaccguccuggugcggagcggccaggggaccgccgcgcugccccgcuccacgagccucgaccgggacugggccaucaccuucgagcaguuccuggccucccugcucaccgagcccgcccuggugaaguacuucgacaagcccgucugcaugauggcgcgcaucaccagcgccaagaacauccggaugaugggcaagccgcugacgagcgccuccgacuacgagaucagcgccauguccggguga

SEQ ID NO: 37460 - RNA, 390 nt, Artificial Sequence
  derived and/or modified sequence opt1 from TBCA__Homo_sapiens__NP_001284667
auggccgacccccgcgugcggcagaucaagaucaagaccggcgucgugaagcgccuggugaaggagaaggucauguacgagaaggaggccaagcagcaggaggagaagaucgagaagaugcgggcggaggacggggagaacuacgacaucaagaagcaggccgagauccuccaggagagccgcaugaugaucccggacugccagcggcgccuggaggccgccuaccuggaccuccagcggauccugguguccaaggacuucugcgugauguucaaguucuucuucagcauccaguacauggagucccagaaguucaaguaccugacccuccgcaccagcuggcaguacuuccuguucacgugcccccuguaccgguacauccucaaguga

SEQ ID NO: 37461 - RNA, 1041 nt, Artificial Sequence
  derived and/or modified sequence opt1 from TBCC__Homo_sapiens__NP_003183
auggagagcguguccugcagcgccgccgcgguccgcaccggcgacauggagucccagcgggaccugagccucgugcccgagcgccugcagcggcgcgagcaggagcggcagcuggagguggagcgccggaagcagaagcgccagaaccaggaggucgagaaggagaacucccacuucuucguggccaccuucgcccgggagcgcgccgccguggaggagcuccuggagcgggcggagagcgucgagcgccuggaggaggccgccucccggcuccaggggcugcagaagcugaucaacgacagcguguucuuccucgccgcguacgaccugcgccagggccaggaggcccuggcccggcuccaggccgcccuggcggagcgccggcgcgggcugcagccgaagaagcgguucgccuucaagacgcgcggcaaggacgccgccuccagcaccaagguggacgccgcgcccgggaucccgcccgccgucgaguccauccaggacagcccccuccccaagaaggccgagggcgaccugggccccuccugggugugcggguucagcaaccuggagucccaggugcucgagaagcgggccagcgagcugcaccagcgcgacguccugcucaccgagcuguccaacugcaccgugcgccuguacggcaaccccaacacgcuccggcugaccaaggcccacagcugcaagcugcucugcgggccgguguccaccagcgucuuccuggaggacugcagcgacugcgugcuggcgguggccugccagcagcuccgcauccacuccaccaaggacacgcggaucuuccugcaggucaccagccgcgccaucguggaggacugcuccggcauccaguucgcccccuacaccuggagcuaccccgagaucgacaaggacuucgaguccagcgggcuggaccgguccaagaacaacuggaacgacguggacgacuucaacuggcucgcccgcgacauggcgagccccaacugguccauccugccggaggaggagcggaacauccagugggacuga

SEQ ID NO: 37462 - RNA, 3579 nt, Artificial Sequence
  derived and/or modified sequence opt1 from TBCD__Homo_sapiens__NP_005984
auggcccugagcgacgagcccgccgcgggcgggccggaggaggaggccgaggacgagacccucgccuucggcgccgcccuggaggcguucggggaguccgccgagacccgcgcccugcucggccggcugcgcgaggugcacgggggcggcgccgagcgggaggucgcgcuggagcgcuuccgggugaucauggacaaguaccaggagcagccccaccuccuggacccccaccuggaguggaugaugaaccuccugcuggacaucgugcaggaccagacgagccccgccucccucguccaccuggccuucaaguuccuguacaucaucaccaaggugcgcggguacaagaccuuccuccggcuguucccgcacgagguggccgacgucgagcccgugcuggaccucgugaccauccagaaccccaaggaccacgaggccugggagacgcgcuacaugcugcugcucuggcugagcgugaccugccugauccccuucgacuucucccggcucgacggcaaccugcugacccagccggggcaggcgcgcaugagcaucauggaccggauccuccagaucgccgaguccuaccugaucgugagcgacaaggcccgcgacgccgccgcggugcuggucucccgguucaucacccgccccgacgugaagcagagcaagauggccgaguuccucgacuggucccugugcaaccuggcccggagcuccuuccagacgaugcagggcgugaucaccauggacgggacccuccaggcccuggcccagaucuucaagcacggcaagcgcgaggacugccugcccuacgcggccaccguccuccggugccuggacggcugccgccugcccgagagcaaccagacgcuccugcggaagcugggggugaagcucgugcagcgccugggccugaccuuccucaagccgaaggucgccgccuggcgguaccagcgcgggugccgcucccuggccgcgaaccugcagcuccugacccagggccagagcgagcagaagccccugauccugaccgaggacgacgacgaggacgacgacgugcccgagggcguggagcgggucaucgagcagcuccugguggggcugaaggacaaggacacggugguccgcugguccgccgccaagggcaucgggcggauggccggccgccucccccgggcgcuggccgacgacguggucgggagcgugcuggacugcuucuccuuccaggagaccgacaaggccuggcacggcggcugccucgcccuggccgagcuggggcgccggggccuccugcugccgagccgccucguggacgucguggcggugauccugaaggcccugaccuacgacgagaagcgcggggccugcagcgucggcaccaacgugcgggacgccgccugcuacgugugcugggcguucgcccgggccuacgagccccaggagcucaagcccuucgucacggccaucuccagcgcccuggugaucgcggccguguucgaccgcgacaucaacugccggcgcgccgccuccgcggccuuccaggagaacgucgggcggcagggcaccuucccccacggcaucgacauccugaccaccgccgacuacuucgccguggggaaccgcagcaacugcuuccucgugaucuccgucuucaucgccggcuucccggaguacacgcagcccaugaucgaccaccuggugaccaugaagaucagccacugggacggggugauccgggagcuggcggcccgcgcccuccacaaccuggcccagcaggcccccgaguucuccgcgacccaggucuucccccggcugcucagcaugacccuguccccggaccugcacaugcgccacggcagcauccucgccugcgccgagguggccuacgcccuguacaagcuggcggcccaggagaaccgccccgugacggaccaccucgacgagcaggccguccaggggcugaagcagauccaccagcagcuguacgaccggcagcucuaccgcggccugggcgggcagcugaugcggcaggccgugugcgugcucaucgagaagcugucccugagcaagaugcccuuccgcggcgacaccgucaucgacggguggcaguggcucaucaacgacacccugcggcaccuccaccucaucuccagccacucccgccagcagaugaaggacgcggccgugagcgcccuggccgcccugugcuccgaguacuacaugaaggagcccggcgaggcggacccggccauccaggaggagcucaucacccaguaccuggccgagcugcggaaccccgaggagaugacgcgcugcggcuucagccucgcccugggggcccugcccggcuuccuccugaaggggcggcugcagcagguccucaccggccugcgcgcggucacccacaccuccccggaggacgugagcuucgccgagagccggcgcgacgggcugaaggccaucgcccggaucugccagacggugggcgucaaggccggcgcgcccgacgaggccgugugcggggagaacgugucccagaucuacugcgcccuccugggcugcauggacgacuacaccaccgacagccgcggggacgucggcaccugggugcggaaggccgccaugaccucccugauggaccucacgcugcugcucgcgcgcagccagcccgagcugaucgaggcccacacgugcgagcggaucaugugcugcguggcccagcaggccuccgagaagaucgaccgcuuccgggcgcacgccgccagcgucuuccugacccuccugcacuucgacuccccgcccaucccccacgugccccaccgcggggagcuggagaagcuguucccccggagcgacguggccuccgucaacuggagcgccccgucccaggcguucccccgcaucacccagcugcugggccuccccaccuaccgcuaccacgugcugcugggccucguggucagccucgggggccugaccgaguccaccauccggcacagcacccagucccuguucgaguacaugaaggggauccagagcgacccccaggcccugggcuccuucagcgggacgcugcuccagaucuucgaggacaaccugcugaacgagcgcgugagcgugccgcuccugaagacccuggaccacguccucacccacggcugcuucgacaucuucaccacggaggaggaccaccccuucgccgugaagcugcuggcccucugcaagaaggagaucaagaacuccaaggacauccagaagcugcugagcggcaucgccguguucugcgagaugguccaguuccccggggacgugcggcgccaggcgcuccugcagcugugccugcuccugugccaccgguucccccugauccgcaagaccaccgccucccagguguacgagacccuccugacguacagcgacgucgugggcgccgacguccuggacgagguggugaccguccucuccgacaccgccugggacgccgagcuggcgguggugcgggagcagcgcaaccggcugugcgaccuccugggggucccgcgcccccagcuggugccccagcccggcgccugcuga

SEQ ID NO: 37463 - RNA, 1584 nt, Artificial Sequence
  derived and/or modified sequence opt1 from TBCE__Homo_sapiens__NP_001072983
augagcgacacccugaccgccgacgugaucggccgccgggucgaggugaacggggagcacgccacggugcgcuucgcgggcgucgugcccccgguggccgggcccuggcucggcgucgagugggacaaccccgagcgggggaagcacgacggcucccacgagggcaccguguacuucaagugccgccaccccaccgggggcagcuucauccggccgaacaaggugaacuucgggaccgacuuccugacggccaucaagaaccgcuacguccuggaggacggccccgaggaggaccggaaggagcagaucgugaccaucgggaacaagcccguggagaccaucggcuucgacuccaucaugaagcagcagagccagcucuccaagcugcaggaggucagccugcgcaacugcgccguguccugcgccggcgagaagggcgggguggcggaggccugccccaacauccggaaggucgaccucagcaagaaccugcuguccagcugggacgaggugauccacaucgccgaccagcuccgccaccuggaggugcugaacgucuccgagaacaagcucaaguucccgagcggguccgugcugaccggcacgcugagcgugcucaagguccuggugcugaaccagaccggcaucaccugggccgaggugcuccggugcgucgcggggugccccggccuggaggagcuguaccucgaguccaacaacaucuucaucagcgagcgccccaccgacgugcugcagacggucaagcugcucgaccuguccagcaaccagcugaucgacgagaaccagcucuaccugaucgcccaccucccccggcuggagcagcugauccuguccgacaccgggaucagcagccuccacuucccggacgccggcaucgggugcaagaccuccauguuccccagccugaaguaccugguggugaacgacaaccagaucucccaguggagcuucuucaacgagcucgagaagcugcccucccugcgcgcccucagcugccugcggaacccccugaccaaggaggacaaggaggccgagacggcgcgccuccugaucaucgccuccaucggccagcugaagacccucaacaagugcgagauccugccggaggagcggcgccgggccgagcuggacuaccgcaaggccuucggcaacgaguggaagcaggccgggggccacaaggaccccgagaagaaccggcucagcgaggaguuccugaccgcgcacccccgcuaccaguuccugugccugaaguacggggcccccgaggacugggagcucaagacccagcagccgcugaugcugaagaaccagcuccugacgcugaagaucaaguacccccaccagcucgaccagaagguccuggagaagcagcugcccggcuccaugaccauccagaaggugaaggggcuccugagccgccugcucaaggugcccgucuccgaccugcugcucagcuacgaguccccgaagaagcccggccgggagaucgagcuggagaacgaccucaagagccugcaguucuacuccguggagaacggcgacugccugcuggugcgcugguga

SEQ ID NO: 37464 - RNA, 1275 nt, Artificial Sequence
  derived and/or modified sequence opt1 from TBCEL__Homo_sapiens__NP_001123519
auggaccagcccagcggccgcuccuucaugcagguccugugcgagaaguacagcccggagaacuuccccuaccggcgcgggcccggcaugggggugcacgugcccgccaccccgcagggcucccccaugaaggaccggcucaaccugcccagcgugcugguccucaacuccugcgggaucacgugcgccggcgacgagaaggagaucgcggccuucugcgcccacgugagcgagcuggaccuguccgacaacaagcucgaggacuggcacgaggugagcaagaucgucuccaacgugccccagcuggaguuccugaaccucagcuccaacccgcugaaccugagcgugcucgagcggaccugcgccggcuccuucagcgggguccgcaagcuggugcugaacaacuccaaggccagcugggagaccgugcacaugauccuccaggagcugcccgaccuggaggagcuguuccucugccugaacgacuacgagaccgucuccugccccagcaucugcugccacucccucaagcugcugcacaucaccgacaacaaccuccaggacuggacggagauccgcaagcugggcgugauguuccccagccuggacacccucgugcuggcgaacaaccaccugaacgccaucgaggagccggacgacagccucgcccggcuguuccccaaccugcgcuccaucagccuccacaaguccgggcugcagagcugggaggacaucgacaagcugaacuccuuccccaagcucgaggagguccggcugcugggcaucccccuccugcagccguacaccaccgaggagcgccggaagcuggugaucgcccgccuccccagcguguccaagcugaacgggagcgucgugacggacggcgagcgggaggacuccgagcgcuucuucauccgguacuacguggacgucccccaggaggaggugcccuuccgcuaccacgagcugaucaccaaguacggcaagcucgagccgcuggcggagguggaccugcggccccagagcuccgccaaggucgaggugcacuucaacgaccaggucgaggagaugagcauccgccucgaccagaccguggccgagcugaagaagcagcugaagacccuggugcagcuccccacguccaacaugcugcuguacuacuucgaccacgaggcccccuucgggccggaggagaugaaguacagcucccgggcccuccacagcuucggcauccgcgacggggacaagaucuacgucgaguccaagaccaaguga

SEQ ID NO: 37465 - RNA, 2190 nt, Artificial Sequence
  derived and/or modified sequence opt1 from TBK1__Homo_sapiens__XP_005268867
augcagagcaccuccaaccaccuguggcuccugagcgacauccugggccagggggccaccgccaacguguuccgcggccggcacaagaagacgggggaccucuucgcgaucaaggucuucaacaacaucuccuuccugcgccccguggacgugcagaugcgggaguucgagguccugaagaagcucaaccacaagaacaucgugaagcuguucgccaucgaggaggagaccaccacccgccacaaggugcugaucauggaguucugcccgugcggcagccucuacacgguccuggaggagcccuccaacgccuacgggcugcccgagagcgaguuccucaucgugcugcgggacguggucggcggcaugaaccaccuccgcgagaacgggaucgugcaccgggacaucaagcccggcaacaucaugcgcgugaucggggaggacggccaguccgucuacaagcugaccgacuucggggccgcccgggagcuggaggacgacgagcaguucgugagccuguacggcaccgaggaguaccuccacccggacauguacgagcgcgcggugcugcggaaggaccaccagaagaaguacggcgccaccgucgaccugugguccaucggggugacguucuaccacgccgccaccggcagccuccccuuccgccccuucgaggggccccggcgcaacaaggaggugauguacaagaucaucaccggcaagccguccggcgcgaucagcgggguccagaaggccgagaacggccccaucgacugguccggggacaugcccgugagcugcucccugagccggggccuccaggugcugcugacccccguccuggccaacauccucgaggccgaccaggagaagugcuggggguucgaccaguucuucgccgagacguccgacauccugcaccgcauggugauccacguguucagccugcagcagaugaccgcgcacaagaucuacauccacuccuacaacaccgccaccaucuuccacgagcucgucuacaagcagacgaagaucaucagcagcaaccaggagcugaucuacgagggccggcgccuggugcucgagccgggccggcuggcccagcacuuccccaagaccaccgaggagaaccccaucuucgucgugucccgcgagccccugaacaccaucgggcucaucuacgagaagaucagccugccgaaggugcacccccgguacgaccuggacggcgacgccuccauggccaaggcgaucacgggggucgugugcuacgccugccgcaucgccagcacccuccugcuguaccaggagcucaugcgcaagggcauccgguggcugaucgagcugaucaaggacgacuacaacgagaccgugcacaagaagaccgaggucgugaucacgcucgacuucugcauccgcaacaucgagaagaccgugaaggucuacgagaagcugaugaagaucaaccuggaggccgccgagcucggggagaucuccgacauccacaccaagcugcugcggcugagcuccagccagggcaccaucgagacgucccuccaggacaucgacagccgccugucccccggcgggagccuggcggacgccugggcccaccaggagggcacccaccccaaggaccggaacguggagaagcuccaggugcugcugaacugcaugaccgagaucuacuaccaguucaagaaggacaaggccgagcgccggcucgccuacaacgaggagcagauccacaaguucgacaagcagaagcuguacuaccacgcgaccaaggccaugacgcacuucaccgacgagugcgucaagaaguacgaggccuuccugaacaaguccgaggaguggauccgcaagaugcuccaccuccggaagcagcugcugagccugaccaaccagugcuucgacaucgaggaggagguguccaaguaccaggaguacaccaacgagcugcaggagacgcucccgcagaagauguucaccgccagcuccgggaucaagcacaccaugacccccaucuaccccagcuccaacacccugguggagaugacgcugggcaugaagaagcucaaggaggagauggagggggucgugaaggagcuggcggagaacaaccacauccuggagcgcuucggcagccucaccauggacggcgggcugcggaacguggacugccuguga

SEQ ID NO: 37466 - RNA, 1848 nt, Artificial Sequence
  derived and/or modified sequence opt1 from TBKBP1__Homo_sapiens__NP_055541
auggagagcauguucgaggacgacaucuccauccugacccaggaggcccucggccccagcgagguguggcuggacuccccgggggaccccagccugggcggggacaugugcuccgccagccacuucgcgcucaucaccgccuacggcgacaucaaggagcgccuggggggccuggagcgggagaacgccacgcuccgccggcgccugaaggucuacgagaucaaguacccccugaucuccgacuucggcgaggagcacggguucagccucuacgagaucaaggacggcucccugcuggagguggagaaggugagccuccagcagcggcugaaccaguuccagcacgagcugcagaagaacaaggagcaggaggagcagcucggggagaugauccaggccuacgagaagcugugcgucgagaaguccgaccuggagaccgagcuccgcgagaugcgggcccugguggagacccaccugcgccagaucugcggccucgagcagcagcugcggcagcagcaggggcugcaggacgcggccuucagcaaccucucccccccgcccgcccccgcccccccgugcaccgaccuggaccugcacuaccucgcgcugcgcggcggcagcgggcugucccacgccggcuggcccgggagcacgcccuccgugagcgaccucgagcggcgccggcuggaggaggcccuggaggccgcccagggcgaggcgcgcggcgcccagcuccgggaggagcagcugcaggccgagugcgagcgccugcagggggagcucaagcagcugcaggagacccgggcccaggaccuggccuccaaccagagcgagcgcgacauggcgugggucaagcgggugggcgacgaccaggugaaccucgcccuggccuacaccgagcugaccgaggagcucgggcgccugcgggagcugagcucccuccagggccgcauccugcgcacgcugcuccaggagcaggcccggagcgggggccagcgccacuccccccugagccagcggcacuccccggccccccagugccccagccccuccccgcccgcgcgcgccgccccccccugcccgcccugccagagccccgucccccagcggcgcuccccggugccccccugccccagcccgcagcagcggcgcucccccgccagccccuccugcccgagccccgugccccagcggcgcucccccgucccgcccagcugccagucccccagcccccagcggcgcuccccggugccccccagcugccccgccccgcagccccggccccccccgcccccccccccgggcgagcgcacccuggcggagcgggccuacgccaagccccccagccaccacgugaaggccggguuccagggccgccgguccuacagcgagcuggcggagggggccgccuacgccggcgccucccccccguggcuccaggcggaggccgccacccugcccaagccccgcgccuacgggagcgagcuguacggcccgggccggccccucuccccccgccgcgccuucgaggggauccggcugcgcuucgagaagcagcccagcgaggaggacgagugggcggucccgaccuccccccccagccccgaggugggcacgauccggugcgccuccuucugcgccggguucccgauccccgagagccccgccgccaccgcguacgcccacgccgagcacgcccaguccuggcccagcaucaaccugcucauggagaccgugggcuccgacauccgcagcugcccgcugugccagcugggguuccccgucggcuaccccgacgacgcgcucaucaagcacaucgacucccaccuggagaacagcaagaucuga

SEQ ID NO: 37467 - RNA, 1734 nt, Artificial Sequence
  derived and/or modified sequence opt1 from TBL1X__Homo_sapiens__NP_001132938
augaccgagcuggccggcgccagcuccagcugcugccaccgccccgcggggcggggcgccaugcaguccgugcuccaccacuuccagcgccugcgggggcgcgagggcgggagccacuucaucaacaccuccagcccgcggggcgaggccaagauguccaucacgagcgacgaggucaacuuccugguguaccgcuaccuccaggaguccggcuucagccacuccgccuucaccuucgggaucgagagccacaucucccagagcaacaucaacggcacccuggugccgcccgccgcgcugaucuccauccuccagaaggggcugcaguacgucgaggccgagaucagcaucaacgaggacggcaccguguucgacgggcggcccaucgagucccugagccucaucgacgccgugaugcccgacgucgugcagacgcgccagcaggccuuccgggagaagcuggcgcagcagcaggccuccgccgccgccgcggccgccgccgccaccgcggccgccaccgccgccaccacgaccagcgcgggcgugagccaccagaaccccuccaagaaccgcgaggccaccgucaacggcgaggagaaccgggcccacagcgugaacaaccacgccaagcccauggagaucgacggggagguggagauccccuccagcaaggccaccguccugcgcggccacgaguccgagguguucaucugcgcguggaacccggugagcgaccuccuggccuccgggagcggcgacuccacggcccggaucuggaaccugaacgagaacagcaacggcggguccacccagcucguccugcgccacugcauccgggagggcgggcacgacgugcccagcaacaaggacgugaccucccuggacuggaacaccaacggcacgcuccuggccaccgggagcuacgacggcuucgcgcgcaucuggaccgaggacggcaaccuggccuccacccucgggcagcacaagggccccaucuucgcccugaaguggaaccggaaggggaacuacauccugagcgccggcgucgacaagacgaccaucaucugggacgcccacaccggggaggcgaagcagcaguuccccuuccacuccgccccggcccucgacguggacuggcagaacaacaccacguucgccagcugcuccaccgacaugugcauccacgugugccgccugggcugcgaccggcccgucaagaccuuccagggccacaccaacgaggugaacgccaucaagugggaccccagcgggaugcugcucgcgagcugcuccgacgacaugacgcugaagaucuggagcaugaagcaggaggugugcauccacgaccugcaggcccacaacaaggagaucuacaccaucaaguggucccccaccggcccggccaccagcaaccccaacuccaacaucaugcucgccagcgccuccuucgacagcacgguccgccugugggacaucgagcgcggggugugcacccacacccugaccaagcaccaggagcccgucuacuccguggcguucagccccgacggcaaguaccucgccuccgggagcuucgacaagugcgugcacaucuggaacacgcaguccggcaaccugguccacagcuaccggggcaccgggggcaucuucgaggugugcuggaacgcccgcggggacaaggugggcgccuccgcgagcgacggcuccgucugcgugcuggaccuccggaaguga

SEQ ID NO: 37468 - RNA, 1575 nt, Artificial Sequence
  derived and/or modified sequence opt1 from TBL1XR1__Homo_sapiens__XP_005247828
augggcgugaagcaccagcagcagcagcuggucaucgggggcgaccgcaucuucagcugcaccagcccccaccagugcaccgccaacggguucucccacuccgccuucacguucggcaucgagagccacaucucccagagcaacaucaacggggcgcucgugccgcccgccgcccugaucuccaucauccagaagggccugcaguacguggaggccgaggucagcaucaacgaggacggcacccucuucgacgggcggcccaucgagucccugagccugaucgacgccgugaugcccgacgugguccagacccgccagcaggcguaccgggacaagcucgcccagcagcaggccgccgcggccgccgccgccgcggccgccgccucccagcagggcagcgccaagaacggggagaacaccgcgaacggcgaggagaacggggcccacacgaucgccaacaaccacaccgacaugauggagguggacggcgacguggagaucccgcccaacaaggccgucgugcugcgcggccacgaguccgagguguucaucugcgccuggaaccccgucagcgaccugcucgcguccgggagcggcgacuccaccgcccggaucuggaaccugagcgagaacuccaccagcgggagcacgcagcuggugcuccgccacugcauccgggagggcggccaggacgugcccuccaacaaggacgucaccagccuggacuggaacuccgaggggacccugcucgccaccggcagcuacgacggguucgcccgcaucuggacgaaggacggcaaccuggccuccacccuggggcagcacaagggcccgaucuucgcgcucaaguggaacaagaagggcaacuucauccugagcgccgggguggacaagaccaccaucaucugggacgcccacacgggcgaggccaagcagcaguuccccuuccacuccgcgcccgcccuggacguggacuggcagagcaacaacaccuucgccuccugcagcaccgacaugugcauccacgucugcaagcucgggcaggaccggcccaucaagaccuuccagggccacacgaacgaggugaacgccaucaagugggacccgaccgggaaccugcuggccuccugcagcgacgacaugacccucaagaucugguccaugaagcaggacaacugcgugcacgaccugcaggcgcacaacaaggagaucuacaccaucaaguggagccccacgggccccggcaccaacaaccccaacgccaaccugaugcucgccuccgccagcuucgacuccaccguccgccugugggacguggaccgggggaucugcauccacacccugacgaagcaccaggagccgguguacagcgucgccuucucccccgacggccgcuaccucgcgagcgggagcuucgacaagugcgugcacaucuggaacacccagaccggcgcccugguccacuccuaccgggggaccggcggcaucuucgaggugugcuggaacgccgccggggacaaggugggcgccagcgcguccgacgggagcgucugcgugcuggaccuccgcaaguga

SEQ ID NO: 37469 - RNA, 1569 nt, Artificial Sequence
  derived and/or modified sequence opt1 from TBL1Y__Homo_sapiens__NP_599021
augagcaucaccuccgacgaggugaacuuccuggucuaccgguaccuccaggagagcggcuucucccacagcgccuucaccuucgggaucgagucccacaucagccaguccaacaucaacggcacgcuggugcccccgagcgcccugaucuccauccuccagaaggggcugcaguacguggaggcggagaucagcaucaacaaggacggcaccgucuucgacucccggcccaucgagagccugucccucaucguggccgugauccccgacgucgugcagaugcgccagcaggccuucggggagaagcugacccagcagcaggccagcgccgcggccaccgaggccuccgccauggcgaaggccgccacgaugacccccgccgccaucagccagcagaacccgcccaagaaccgggaggcgaccgugaacggcgaggagaacggcgcccacgagaucaacaaccacuccaagcccauggagaucgacggggacgucgagaucccgcccaacaaggccaccgugcugcgcggccacgagagcgagguguucaucugcgccuggaaccccgucuccgaccuccuggccagcgggagcggcgacuccacggcgcggaucuggaaccugaacgagaacagcaacgggggcuccacccagcucgugcugcgccacugcauccgggagggcgggcacgacgugcccagcaacaaggacgucaccucccuggacuggaacagcgacggcacccuccuggccaugggguccuacgacggcuucgcccgcaucuggacggagaacggcaaccuggccagcacccucgggcagcacaagggccccaucuucgcccugaaguggaacaagaaggggaacuacgugcuguccgcgggcguggacaagaccaccaucaucugggacgcccacacgggggaggccaagcagcaguucccguuccacagcgcccccgcccucgacgucgacuggcagaacaacaugaccuucgcguccugcagcaccgacaugugcauccacgugugccggcugggcugcgaccaccccgugaagaccuuccagggccacacgaacgaggucaacgccaucaagugggaccccuccgggaugcugcucgccagcugcuccgacgacaugacccugaagaucuggagcaugaagcaggacgccugcgugcacgaccugcaggcgcacuccaaggagaucuacaccaucaaguggagcccgaccggccccgccacguccaaccccaacagcagcaucaugcucgccuccgccagcuucgacuccaccgugcgccugugggacgucgagcagggggugugcacccacacccugaugaagcaccaggagcccgucuacagcguggccuucuccccggacggcaaguaccucgcgagcggguccuucgacaaguacgugcacaucuggaacacgcagagcggcucccugguccacagcuaccagggcaccgggggcaucuucgaggugugcuggaacgcccgcggggacaaggugggcgccuccgccagcgacggguccgucugcgugcuggaccucuga

SEQ ID NO: 37470 - RNA, 1344 nt, Artificial Sequence
  derived and/or modified sequence opt1 from TBL2__Homo_sapiens__NP_036585
auggagcugagccagauguccgagcucaugggccugagcgugcugcucgggcugcuggcccucauggccaccgcggccgucgcccgcggcuggcugcgggccggggaggagcgcuccggccggcccgccugccagaaggcgaacggguucccgcccgacaagagcuccggcagcaagaagcagaagcaguaccagcgcauccggaaggagaagccccagcagcacaacuucacccaccgccugcucgccgccgcccugaagucccacagcggcaacaucuccugcauggacuucagcuccaacgggaaguaccuggcgacgugcgccgacgaccggaccauccgcaucuggagcaccaaggacuuccuccagcgggagcaccgcuccaugcgggccaacguggagcuggaccacgccacccuggugcgcuucagccccgacugccgggccuucaucgucuggcucgcgaacggcgacacgcugcgcguguucaagaugaccaagcgggaggacgggggcuacaccuucaccgccacgccggaggacuuccccaagaagcacaaggcccccgugaucgacaucgggaucgccaacaccggcaaguucaucaugaccgccuccagcgacaccacgguccugaucuggucccucaagggccaggugcugagcaccaucaacaccaaccagaugaacaacacccacgcggccgugucccccugcgggcgcuucgucgccagcugcggcuucacgccggacgugaaggugugggaggucugcuucgggaagaagggcgaguuccaggagguggugcgggccuucgagcugaagggccacagcgccgcgguccacuccuucgccuucagcaacgacucccgccggauggccagcguguccaaggacgggaccuggaagcucugggacaccgacguggaguacaagaagaagcaggaccccuaccugcugaagaccggccgcuucgaggaggccgccggggcggcccccugccggcucgcccugagccccaacgcccagguccuggcgcucgccuccggcagcuccauccaccuguacaacacgcgccgcggggagaaggaggagugcuucgagcgggugcacggcgagugcaucgccaaccugagcuucgacaucaccggccgcuuccucgccuccugcggggaccgggccgugcgccuguuccacaacaccccgggccaccgggcgauggucgaggagaugcaggggcaccugaagcgcgccagcaacgaguccacccggcagcgccuccagcagcagcugacgcaggcccaggagacccucaagagccugggcgcccugaagaaguga

SEQ ID NO: 37471 - RNA, 2427 nt, Artificial Sequence
  derived and/or modified sequence opt1 from TBL3__Homo_sapiens__NP_006444
auggccgagaccgccgcgggcguggggcgcuucaagaccaacuacgccgucgagcggaagaucgagcccuucuacaagggcgggaaggcccagcuggaccagacgggccagcaccucuucugcgugugcgggacccgcgugaacauccuggaggucgccagcggcgccgugcugcggucccucgagcaggaggaccaggaggacaucaccgcguucgaccugagcccggacaacgaggugcuggucaccgccucccgcgcccuccugcuggcccagugggcguggcaggagggcagcgugacgcggcucuggaaggccauccacaccgcccccguggccaccauggccuucgaccccaccuccacgcugcuggcgaccgggggcugcgacggggccguccgcgugugggacaucgugcggcacuacggcacccaccacuuccgcgggagccccggcgucgugcaccucguggccuuccacccggaccccacccggcugcuccuguucuccagcgccacggacgccgcgauccgcgucuggucccugcaggaccggagcugccuggccgugcucaccgcccacuacuccgccgugaccagccuggccuucuccgcggacggccacaccaugcugagcuccgggcgcgacaagaucugcaucaucugggaccuccagagcugccaggccacgcggaccguccccguguucgaguccguggaggccgccguccugcugcccgaggagccggugagccagcucggcgugaagucccccgggcuguacuuccugaccgccggcgaccagggcacccuccgcgucugggaggcggccagcgggcagugcguguacacgcaggcccagccgcccggccccgggcaggagcugacccacugcacccuggcccacaccgcgggcgucgugcucacggccaccgccgaccacaaccugcugcucuacgaggcccggagccugcgccugcagaagcaguucgccggguacuccgaggaggugcucgacguccgguuccugggccccgaggacagccacgugguggucgcguccaacagccccugccugaagguguucgagcuccagaccuccgccugccagauccugcacggccacaccgacaucgugcuggcccucgacgucuuccgcaagggguggcuguucgccagcugcgccaaggaccaguccgugcggaucuggcgcaugaacaaggcgggccaggugaugugcgucgcccaggggagcggccacacgcacuccguggggaccgugugcugcagccggcugaaggaguccuuccucgucaccggcagccaggacugcaccgugaagcuguggccccugccgaaggcccuccuguccaagaacacggcccccgacaacggccccauccugcugcaggcccagaccacccagcgcugccacgacaaggacaucaacagcguggcgaucgcccccaacgacaagcuccuggccaccgggucccaggaccgcacggccaagcugugggcgcucccgcagugccagcugcugggcgucuucagcgggcaccggcgcggccucuggugcgugcaguucucccccauggaccaggugcuggccaccgccagcgccgacgggaccaucaagcugugggcccuccaggacuucuccugccugaagaccuucgagggccacgacgcgagcguccugaagguggccuucgugagccggggcacccagcuccuguccagcggguccgacggccuggucaagcucuggacgaucaagaacaacgagugcgugcgcacccuggacgcccacgaggacaaggugugggggcugcacugcagccggcucgacgaccacgcccugaccggcgccuccgacagccgcgucauccuguggaaggacgugaccgaggcggagcaggccgaggagcaggcccggcaggaggagcaggucgugcgccagcaggagcucgacaaccugcugcacgagaagcgguaccuccgcgcccugggccuggccaucucccucgaccggccccacacggugcugaccgugauccaggcgauccgccgggaccccgaggccugcgagaagcuggaggccaccaugcuccgccugcggcgcgaccagaaggaggcccugcuccgguucugcgucaccuggaacacgaacagccgccacugccacgaggcgcaggccgugcugggggugcugcuccggcgcgaggccccggaggagcugcuggccuacgagggcguccgcgccgcgcucgaggcccugcugcccuacaccgagcggcacuuccagcgccucucccggacccugcaggccgccgccuuccuggacuuccucuggcacaacaugaagcugcccgugcccgcggccgccccgacccccugggagacgcacaagggggcccugcccuga

SEQ ID NO: 37472 - RNA, 960 nt, Artificial Sequence
  derived and/or modified sequence opt1 from TBP__Homo_sapiens__NP_001165556
augacccccggcaucccgaucuucagccccaugaugcccuacgggaccggccugacgccccagccgauccagaacaccaacucccucagcauccuggaggagcagcagcgccagcagcagcagcagcagcagcagcagcagcagcagcagcagcagcagcagcagcagcagcagcagcagcagcagcagcagcagcagcagcagcagcagcagcagcagcagcaggccguggccgcggccgccguccagcaguccaccagccagcaggccacccaggggacguccggccaggcgccccagcuguuccacagccagacccucaccaccgcgccccugcccgggacgaccccgcuguaccccucccccaugacccccaugaccccgaucacgcccgccacccccgccagcgaguccagcggcaucgugccccagcuccagaacaucguguccaccgucaaccugggcugcaagcuggaccucaagaccaucgcccugcgggcgcgcaacgccgaguacaacccgaagcgguucgccgccgugaucaugcgcauccgggagccccgcacgaccgcccugaucuucagcuccgggaagauggugugcaccggcgccaagagcgaggagcagucccggcucgccgcccgcaaguacgcccgggucgugcagaagcugggguuccccgccaaguuccuggacuucaagauccagaacauggugggcagcugcgacgucaaguuccccauccgccucgaggggcuggugcugacccaccagcaguucuccagcuacgagccggagcuguuccccggccucaucuaccggaugaucaagccccgcaucgugcugcucaucuucgucuccggcaagguggugcugacgggggcgaagguccgggccgagaucuacgaggccuucgagaacaucuaccccauccugaagggcuuccgcaagaccaccuga

SEQ ID NO: 37473 - RNA, 561 nt, Artificial Sequence
  derived and/or modified sequence opt1 from TBPL1__Homo_sapiens__NP_004856
auggacgccgacagcgacguggcccuggacauccucaucaccaacgucgugugcguguuccgcacccggugccaccugaaccugcgcaagaucgcgcucgagggcgccaacgucaucuacaagcgggacguggggaaggugcugaugaagcugcgcaagccccggaucacggccaccaucugguccagcggcaagaucaucugcaccggggccaccuccgaggaggaggccaaguucggcgcgcgccggcucgcccgcagccugcagaagcugggguuccaggucaucuucacggacuucaagguggugaacguccucgccgugugcaacaugccguucgagauccggcugcccgaguucaccaagaacaaccgcccccacgccuccuacgagcccgagcugcacccggcggugugcuaccggaucaagagccuccgcgccacccugcagaucuucuccaccggcagcaucacggucaccggccccaacgugaaggccguggccaccgccgucgagcagaucuaccccuucguguucgagucccggaaggagauccuguga

SEQ ID NO: 37474 - RNA, 1128 nt, Artificial Sequence
  derived and/or modified sequence opt1 from TBPL2__Homo_sapiens__NP_950248
auggccagcgcccccuggccggagcgcgugccccggcugcucgcgccccgccugcccuccuacccgcccccgccgcccaccgucggccugcggagcauggagcaggaggagaccuaccucgagcuguaccuggaccagugcgccgcccaggacgggcucgccccgccccgcagcccccuguucucccccguggugcccuacgacauguacauccugaacgccuccaaccccgacacggcguucaacagcaaccccgaggucaaggagaccuccggcgacuucagcuccguggaccucagcuuccugcccgacgaggugacccaggagaacaaggaccagcccgucaucuccaagcacgagaccgaggagaacagcgagucccagagcccccagucccggcugcccagcccguccgagcaggacguggggcucggccugaacagcuccagccugagcaacucccacagccagcuccaccccggggacacggacuccgugcagcccagccccgagaagccgaacuccgacagccugucccuggccagcaucacccccaugacccccaugacccccaucuccgagugcugcggcaucgucccgcagcuccagaacaucgugagcacggugaaccuggccugcaagcuggaccucaagaagaucgcccugcacgcgaagaacgccgaguacaaccccaagcgcuucgccgccgucaucaugcggauccgcgagccccggaccaccgcccugaucuucuccagcggcaagauggugugcaccggggcgaaguccgaggagcagagccgccucgccgcccggaaguacgcccgcgugguccagaagcugggcuucccggcccgguuccuggacuucaagauccagaacauggugggguccugcgacgugcgcuuccccauccggcucgagggccugguccugacgcaccagcaguucagcuccuacgagcccgagcuguuccccgggcucaucuaccgcauggugaagccgcggaucgugcugcucaucuucgucagcggcaagguggugcugaccggcgcgaaggagcgcuccgagaucuacgaggccuucgagaacaucuaccccauccugaagggguucaagaaggccuga

SEQ ID NO: 37475 - RNA, 2049 nt, Artificial Sequence
  derived and/or modified sequence opt1 from TBR1__Homo_sapiens__NP_006584
augcagcuggagcacugccucagccccuccaucaugcugagcaagaaguuccugaacguguccagcuccuacccgcacagcggcggguccgagcucguccugcacgaccaccccaucaucagcaccaccgacaaccuggagcgcuccagcccccucaagaagaucacgcggggcaugaccaaccaguccgacaccgacaacuuccccgacagcaaggacuccccgggggacgugcagcgcagcaagcugucccccgugcuggacggcgucagcgagcuccggcacuccuucgacgggagcgccgccgaccgcuaccugcugucccagagcagccagccccaguccgcggccaccgcccccagcgccauguucccguaccccggccagcacggccccgcccaccccgcguucuccaucgggagcccgucccgguacauggcccaccaccccgugaucacgaacggcgccuacaacagccuccuguccaacagcagcccccagggguaccccaccgccggcuacccguacccccagcaguacgggcacuccuaccagggcgcgcccuucuaccaguucuccagcacccagcccggccuggugccggggaaggcccaggucuaccucugcaaccgcccccuguggcugaaguuccaccggcaccagaccgagaugaucaucacgaagcagggccgccggauguuccccuuccucuccuucaacaucagcgggcuggaccccaccgcccacuacaacaucuucguggacgugauccuggccgacccgaaccacuggcgcuuccagggcggcaaguggguccccugcgggaaggccgacaccaacgugcagggcaaccggguguacaugcaccccgacucccccaacaccggggcgcacuggaugcgccaggagaucagcuucggcaagcucaagcugacgaacaacaagggggccuccaacaacaacggccagauggucgugcugcagagccuccacaaguaccagccgcggcugcacguggucgaggugaacgaggacggcaccgaggacaccucccagcccgggcgcgugcagaccuucacguuccccgagacccaguucaucgccgucaccgccuaccagaacaccgacaucacgcagcugaagaucgaccacaacccguucgccaagggcuuccgggacaacuacgacaccaucuacaccgggugcgacauggaccgccucacccccagccccaacgacagcccccggucccagaucgugccgggcgcgcgcuacgccauggccgggagcuuccugcaggaccaguucguguccaacuacgccaaggcccgguuccaccccggcgcgggcgccgggcccggccccgggacggaccgcagcgucccgcacaccaacggccugcucagcccccagcaggccgaggaccccggggcccccuccccgcagcggugguucgugacccccgccaacaaccgccuggacuucgcggccuccgccuacgacaccgccacggacuucgcgggcaacgccgccacccugcucagcuacgccgccgcgggcgugaaggcccugccccugcaggccgccgggugcaccggccgcccccucggguacuacgccgacccguccggcuggggcgcgcggagcccgccccaguacugcgggaccaaguccggcagcguccugcccugcuggcccaacuccgccgccgccgccgcgcgcauggccggggccaaccccuaccugggcgaggaggccgaggggcucgcggccgagcggagcccccugcccccgggcgccgccgaggacgccaagcccaaggaccuguccgacagcuccuggaucgagacgcccagcagcaucaaguccaucgacagcuccgacagcggcaucuacgagcaggcgaagcgccggcgcaucuccccggccgacacccccgugagcgaguccagcagcccccucaaguccgagguccuggcccagcgggacugcgagaagaacugcgccaaggacaucuccggguacuacggcuucuacagccacuccuga

SEQ ID NO: 37476 - RNA, 1236 nt, Artificial Sequence
  derived and/or modified sequence opt1 from TBRG1__Homo_sapiens__NP_116200
augagccugcuggacggccuggccuccagcccccgcgccccgcugcaguccagcaaggcgcggaugaagaagcugcccaagaagucccagaacgagaaguaccgccugaaguaccugcggcuccgcaaggccgccaaggccaccguguucgagaacgccgcgaucugcgacgagaucgcccggcuggaggagaaguuccugaaggccaaggaggagcgccgguaccuccugaagaagcugcuccagcugcaggcccugaccgagggggagguccaggcggccgcccccagccacuccagcucccucccccugacguacggcguggccagcuccguggggaccauccagggcgccgggccgaucagcggccccuccaccggcgcggaggagcccuucgggaagaagaccaagaaggagaagaaggagaagggcaaggagaacaacaagcuggagguccucaagaagacgugcaagaagaagaagauggccgggggcgcccgcaagcuggugcagcccaucgcccuggacccgagcgggcggcccguguuccccaucggccucggcgggcugaccgucuacucccugggcgagaucaucaccgaccgccccggguuccacgacgagagcgccaucuacccggugggcuacugcuccacccggaucuacgcgagcaugaagugccccgaccagaagugccucuacacgugccagaucaaggacggcggggugcagccccaguucgagaucguccccgaggacgacccgcagaacgccaucguguccagcagcgccgacgccugccacgccgagcugcugcgcaccaucuccaccaccaugggcaagcucaugcccaaccugcugcccgcgggggccgacuucuucggcuucagccaccccgccauccacaaccucauccaguccugcccgggggcccggaagugcaucaacuaccagugggugaaguucgacgucugcaagcccggcgacggccagcugcccgaggggcugcccgagaacgacgccgcgaugagcuucgaggccuuccagcgccagaucuucgacgaggaccagaacgacccgcuccugcccggcucccuggaccuccccgagcugcagcccgccgccuucgugagcuccuaccagccgauguaccugacgcacgagccccucguggacacccaccuccagcaccucaagagccccucccaggggagcccgauccaguccagcgacuga

SEQ ID NO: 37477 - RNA, 1158 nt, Artificial Sequence
  derived and/or modified sequence opt1 from TBX10__Homo_sapiens__NP_005986
auggccgccuuccugagcgcgggccucgggauccuggcccccuccgagaccuacccgcugcccaccacgagcuccggcugggagccccgccucgggagccccuucccguccggccccugcaccagcuccaccggggcccaggccguggccgagcccaccggccagggccccaagaacccgcgggucagccgcgugacggugcagcuggagaugaagccccugugggaggaguucaaccagcucgggaccgagaugaucgucaccaaggcgggccggcgcauguucccgcccuuccaggugaagauccuggggauggacucccuggccgacuacgcccuccugauggacuucaucccccuggacgacaagcgguaccgcuacgccuuccacagcuccgcguggcucguggccggcaaggccgaccccgccacccccgggcggguccacuuccaccccgacagcccggccaagggcgcgcaguggaugcgccagaucguguccuucgacaagcugaagcugacgaacaaccuccuggacgacaacggccacaucauccugaacagcaugcaccgguaccagccccgcuuccacguggucuucguggacccccggaaggacuccgagcgcuacgcccaggagaacuucaagagcuucaucuucaccgagacccaguucaccgccgugacggccuaccagaaccaccggaucacccagcucaagaucgccuccaaccccuucgcgaagggguuccgcgagagcgaccuggacuccuggccggucgcgccccggccccugcucagcgugcccgcccgcagccacuccagccuguccccgugcgugcugaagggcgccaccgaccgggagaaggaccccaacaaggccagcgccuccaccagcaagacgcccgccuggcuccaccaccagcugcugcccccgcccgagguccuccuggcccccgccaccuaccgcccggugaccuaccagucccuguacagcggggcccccucccaccucggcaucccccggacccgccccgcgccguacccccugcccaacauccgggccgaccgcgaccagggcgggcugccccucccggccggccuggggcugcucagccccacgguggucugccugggccccgggcaggacucccaguga

SEQ ID NO: 37478 - RNA, 1824 nt, Artificial Sequence
  derived and/or modified sequence opt1 from TBX18__Homo_sapiens__NP_001073977
auggccgagaagcgccggggcagccccugcuccaugcugagccucaaggcccacgcguucuccguggaggcccugaucggggccgagaagcagcagcagcugcagaagaagcgccggaagcucggcgccgaggaggccgcgggggccgucgacgacggcgggugcagccgcggcggcggggccggcgagaagggguccagcgagggcgacgagggggccgcgcugccgccgcccgccggcgccaccuccggccccgcccggagcggggccgaccuggagcgcggcgcggccgggggcugcgaggacggcuuccagcagggggccagcccccucgccucccccggcgggucccccaagggcagccccgcccggucccuggcgcgcccggggacgccccugcccagcccccaggccccgcggguggaccuccagggcgccgagcuguggaagcgcuuccacgagaucggcaccgagaugaucaucaccaaggccgggcggcgcauguuccccgccaugcgggugaagaucuccggccuggacccccaccagcaguacuacaucgcgauggacaucguccccguggacaacaagcgcuaccgguacguguaccacagcuccaaguggauggucgccgggaacgccgacagcccggugccgccccgcguguacauccaccccgacucccccgccagcggcgagaccuggaugcggcaggucaucagcuucgacaagcucaagcugaccaacaacgagcuggacgaccaggggcacaucauccuccacuccaugcacaaguaccagccccgcgugcacgugauccggaaggacugcggcgacgaccugagccccaucaagcccgucccguccggcgagggggugaaggccuucagcuuccccgagacgguguucaccaccgucaccgcguaccagaaccagcagaucacgcgccugaagaucgaccggaaccccuucgccaagggcuuccgcgacuccgggcgcaaccggaugggccucgaggcccugguggagagcuacgccuucuggcgccccucccugcggacccucaccuucgaggacaucccggggauccccaagcagggcaacgcgagcuccagcacccugcugcagggcacggggaacggcgugcccgccacccacccgcaccuccuguccgggagcuccugcagcucccccgccuuccaccugggccccaacaccagccagcucugcucccuggcccccgccgacuacagcgcgugcgcccgcuccggccugacccucaaccgguacagcacgagccuggccgagaccuacaaccgccugaccaaccaggccggggagaccuucgccccgccccggacgcccuccuacgucggcgugagcuccagcaccuccgugaacaugagcaugggcgggaccgacggggacaccuucuccugcccccagacgagccucuccaugcagaucagcggcauguccccgcagcugcaguacaucaugcccagccccuccagcaacgcguucgccaccaaccagacccaccagggcuccuacaacaccuuccgccugcacagccccugcgcccucuacggguacaacuucuccacgagcccgaagcuggccgccagccccgagaagaucgucuccagccagggcuccuuccuggggagcucccccagcggcaccaugaccgaccggcagaugcugcccccgguggagggggugcaccuccuguccagcggcggccagcaguccuucuucgacagccgcacccucgggucccugacgcugagcuccagccaggucuccgcgcacaugguguga

SEQ ID NO: 37479 - RNA, 1347 nt, Artificial Sequence
  derived and/or modified sequence opt1 from TBX19__Homo_sapiens__NP_005140
auggccaugagcgagcugggcacccgcaagcccuccgacgggaccgugagccaccuccugaacgucguggaguccgagcugcaggccggccgggagaagggggacccgacggagaagcagcuccagaucauccuggaggacgcgccccuguggcagcgcuucaaggaggugaccaacgagaugaucgucaccaagaacggccggcgcauguuccccgugcucaagaucagcgugaccgggcuggaccccaacgccauguacucccugcuccuggacuucgucccgacggacagccaccgguggaaguacgugaacggcgagugggugcccgccggcaagcccgaggucuccagccacuccugcguguacauccaccccgacagcccgaacuucggggcccacuggaugaaggcccccaucuccuucagcaaggugaagcugaccaacaagcucaacggcgggggccagaucaugcugaacucccugcacaaguacgagccccagguccacaucgugcgcguggggagcgcgcaccggauggucaccaacugcuccuuccccgagacccaguucaucgccgugacggccuaccagaacgaggagaucaccgcccucaagaucaaguacaacccguucgcgaaggccuuccuggacgccaaggagcgcaaccaccuccgggacgugcccgaggccaucagcgagucccagcacgucaccuacagccaccugggcggcuggaucuucuccaaccccgacggggugugcaccgccggcaacagcaacuaccaguacgcggcgccccugccgcugcccgcgccccacacgcaccacgggugcgagcacuacagcggccuccgcggccaccggcaggcccccuacccguccgccuacaugcaccgcaaccacagccccuccgugaaccugaucgagagcuccagcaacaaccugcaggucuucuccgggcccgacagcuggaccucccucagcuccacgccccacgccagcauccuguccgugccgcacaccaacggccccaucaaccccgggcccagcccguaccccugccuguggaccaucuccaacggcgccgggggccccagcggcccggggcccgaggugcacgccuccacccccggcgccuuccuccuggggaaccccgccgucaccagcccgcccuccgugcugagcacccaggcccccacgagcgccggcgucgaggugcucggggagcccucccugaccagcaucgccguguccaccuggaccgccgucgccagccacccguucgcgggcuggggcgggcccggcgccgggggccaccacucccccagcucccuggacggguga

SEQ ID NO: 37480 - RNA, 1119 nt, Artificial Sequence
  derived and/or modified sequence opt1 from TBX1__Homo_sapiens__NP_005983
augcacuucagcaccgugacccgcgacauggaggccuucacggccuccagccuguccagccucggcgcggccgggggcuuccccggggccgccucccccggcgccgaccccuacgggccccgggagcccccgcccccgcccccgcgcuacgaccccugcgcggccgccgcccccggcgcgcccggcccgcccccgccgccccacgccuaccccuucgcccccgccgccggggcggccaccagcgccgccgccgagcccgagggccccggggcguccugcgccgccgccgccaaggcgcccgucaagaagaacgccaagguggccggcgugagcguccagcuggagaugaaggcccugugggacgaguucaaccagcucgggaccgagaugaucgugaccaaggccggccggcgcauguuccccacguuccaggugaagcuguucggcauggaccccauggcggacuacaugcugcucauggacuucguccccguggacgacaagcgguaccgcuacgccuuccacuccagcuccuggcugguggccgggaaggccgaccccgcgacccccggccggguccacuaccaccccgacagcccggccaagggggcccaguggaugaagcagaucguguccuucgacaagcugaagcucaccaacaaccugcuggacgacaacggccacaucauccucaacagcaugcaccgcuaccagccccgguuccacguggucuacguggacccccgcaaggacuccgagaaguacgccgaggagaacuucaagaccuucguguucgaggagacgcgguucaccgccgucaccgcguaccagaaccaccgcaucacccagcugaagaucgccagcaacccguucgccaagggcuuccgggacugcgaccccgaggacuggccccgcaaccaccggcccggggcccugccgcucauguccgccuucgcgcgcagccggaaccccguggccucccccacgcagcccagcggcaccgagaaggggcuggugaccgagggcagcgggcugcagccgggccuccuggacguccugcucaagccgcccuccaagaaguccgagagccugcgcccgccccacugcaaggacaccuga

SEQ ID NO: 37481 - RNA, 1344 nt, Artificial Sequence
  derived and/or modified sequence opt1 from TBX20__Homo_sapiens__NP_001071121
auggaguucaccgccagccccaagccgcagcuguccagccgcgccaacgcguucuccaucgccgcccucaugagcuccggcgggagcaaggagaaggaggccaccgagaacacgaucaagccccuggagcaguucguggagaaguccagcugcgcccagccccugggcgagcucaccucccuggacgcgcacggggaguucggcgggggcagcggcuccagccccuccagcuccagccugugcaccgagccgcucauccccaccacgcccaucauccccuccgaggagauggccaagaucgccugcagccuggagaccaaggagcugugggacaaguuccacgagcucgggaccgagaugaucaucaccaaguccggccggcgcauguucccgacgauccgggucagcuucagcgggguggaccccgaggccaaguacaucgugcugauggacaucguccccguggacaacaagcgcuaccgguacgcguaccaccgcuccagcuggcugguggccggcaaggccgacccgccccuccccgcccggcuguacguccaccccgacucccccuucaccggggagcagcugcucaagcagauggugagcuucgagaaggugaagcugaccaacaacgagcuggaccagcacggccacaucauccucaacuccaugcacaaguaccagccgcgcguccacaucaucaagaagaaggaccacaccgccagccugcugaaccucaaguccgaggaguuccggacguucaucuuccccgagaccguguucaccgcggugaccgccuaccagaaccagcugaucacgaagcugaagaucgacagcaaccccuucgccaagggcuuccgcgacuccagccggcucaccgacaucgagcgcgaguccgucgagagccugauccagaagcacuccuacgcccggagccccauccgcaccuacgggggcgaggaggacgugcugggggacgagucccagaccacgccgaaccggggcagcgccuucaccaccuccgacaaccucagccuguccagcugggugagcuccagcuccagcuuccccggcuuccagcacccccagucccugaccgcgcucgggacgagcaccgccuccaucgccacccccaucccgcaccccauccagggcagccugccgcccuacucccgccuggggaugccccucacccccagcgccaucgccuccagcaugcagggcuccgggcccacguucccgagcuuccacaugccccgguaccaccacuacuuccagcagggccccuacgcggccauccagggccugcgccacuccagcgccgucaugacccccuucguguga

SEQ ID NO: 37482 - RNA, 1608 nt, Artificial Sequence
  derived and/or modified sequence opt1 from TBX21__Homo_sapiens__NP_037483
augggcaucguggagcccgggugcggcgacaugcugaccgggaccgagccgaugcccggcagcgacgaggggcgcgcccccggcgccgacccccagcaccgguacuucuacccggagcccggcgcgcaggacgccgacgagcgccgcgggggcgggucccucggcagccccuaccccgggggcgcccuggucccggccccgcccucccgguuccugggcgccuacgcguacccgccccggccccaggccgccggguuccccggcgccggggagagcuucccgccgcccgcggacgccgagggcuaccagcccggcgagggguacgccgcccccgacccccgcgccggccucuaccccgggccccgggaggacuacgcgcugcccgccggccuggagguguccgggaagcuccgcguggcccugaacaaccaccuccuguggagcaaguucaaccagcaccagacggagaugaucaucaccaagcagggccggcgcauguuccccuuccuguccuucaccgucgccggccuggagcccaccagccacuaccggauguucguggacgugguccucguggaccagcaccacuggcgcuaccaguccgggaagugggugcagugcggcaaggccgaggggagcaugcccggcaaccggcuguacguccaccccgacuccccgaacacgggggcgcacuggaugcgccaggaggugagcuucggcaagcugaagcucaccaacaacaagggcgccuccaacaacgugacccagaugaucguccugcagagccugcacaaguaccagccccggcuccacaucguggaggugaacgacggggagcccgaggccgccugcaacgccuccaacacccacaucuucacguuccaggagacccaguucaucgcggucaccgccuaccagaacgccgagaucacccagcugaagaucgacaacaacccguucgccaagggcuuccgcgagaacuucgagagcauguacacguccguggacaccagcauccccuccccgcccgggcccaacugccaguuccugggcggggaccacuacagcccccuccugcccaaccaguaccccgugccgagccgguucuaccccgaccugcccggccaggccaaggacgucgugccccaggcguacuggcucggcgccccgcgcgaccacuccuacgaggccgaguuccgggccgugagcaugaagcccgcguuccugcccuccgcccccgggccgaccaugagcuacuaccgcggccaggagguccuggcccccggggccggcuggcccguggcgccccaguacccgcccaagaugggccccgccuccugguuccggcccaugcgcacccucccgauggagcccgggcccggcgggagcgagggccgcgggccggaggaccagggcccgccccugguguggacggagaucgcccccauccggcccgaguccagcgacuccggccugggggagggcgacagcaagcgccggcgcgucucccccuaccccagcuccggggacagcuccagccccgccggcgccccgucccccuucgacaaggaggccgaggggcaguucuacaacuacuuccccaacuga

SEQ ID NO: 37483 - RNA, 1563 nt, Artificial Sequence
  derived and/or modified sequence opt1 from TBX22__Homo_sapiens__NP_001103348
auggcccugagcucccgcgcccgggcguucagcguggaggcccucgucggccgccccuccaagcggaagcugcaggacccgauccaggccgagcagcccgagcugcgcgagaagaagggcggggaggaggaggaggagcggcgcagcuccgccgccgggaaguccgagccccucgagaagcagcccaagaccgagccguccaccagcgcguccagcggcugcggguccgacagcggcuacggcaacuccagcgagucccuggaggagaaggacauccagauggagcugcaggggagcgagcucuggaagcgguuccacgacaucggcacggagaugaucaucaccaaggccgggcgccggauguuccccuccgugcgcgugaaggucaagggccuggaccccgggaagcaguaccacguggccaucgacgugguccccguggacagcaagcgguaccgcuacguguaccacuccagccaguggauggucgccggcaacaccgaccaccugugcaucaucccgcgguucuacgugcaccccgacagccccugcuccggcgagaccuggaugcgccagaucaucagcuucgaccggaugaagcucacgaacaacgagauggacgacaaggggcacaucauccugcaguccaugcacaaguacaagccccgcgugcacgucaucgagcagggcagcuccguggaccugagccagauccagucccucccgaccgagggggugaagaccuucagcuucaaggagaccgaguucacgaccgucaccgcguaccagaaccagcagaucaccaagcugaagaucgagcggaaccccuucgccaagggcuuccgcgacacgggccggaaccgcggggugcuggacggccuccuggagaccuaccccuggcggcccuccuucacccuggacuucaagaccuucggggccgacacgcagagcggcuccagcggguccagcccggugaccuccagcggcggcgcccccagcccccucaacagccugcugagcccccucugcuucuccccgauguuccaccuccccaccagcucccuggggaugcccugccccgaggccuaccugccgaacgucaaccugccccugugcuacaagaucugccccaccaacuucuggcagcagcagccccucgugcugccggcgcccgagcgccuggccagcuccaacagcucccagagccucgcgccccugaugauggaggugccgaugcuguccagccucggcgucacgaacuccaagagcggguccagcgaggacuccagcgaccaguaccugcaggcccccaacuccaccaaccagaugcuguacggccuccagagccccgggaacaucuuccugcccaacuccaucaccccggaggcccugagcugcagcuuccaccccuccuacgacuucuaccgcuacaacuucagcaugcccucccggcucaucagcggcuccaaccaccugaaggugaacgacgacagccagguguccuucggcgaggggaagugcaaccacguccacugguaccccgccaucaaccacuaccuguga

SEQ ID NO: 37484 - RNA, 2139 nt, Artificial Sequence
  derived and/or modified sequence opt1 from TBX2__Homo_sapiens__XP_011523460
augcgcgagcccgcccuggccgcgagcgccauggccuaccacccguuccacgcgccccggcccgccgacuuccccauguccgccuuccucgccgccgcccagccgagcuucuuccccgcgcuggcccugccgcccggcgcccucgccaagccccugcccgaccccgggcuggccggcgcggccgccgccgccgcggccgccgccgccgcggccgaggccgggcuccacguguccgcccugggcccccacccgcccgccgcgcaccuccgcagccugaagucccuggagcccgaggacgaggucgaggacgaccccaaggugacccuggaggccaaggagcucugggaccaguuccacaagcuggggaccgagauggugaucaccaagagcggccggcgcauguucccgcccuucaagguccggguguccggccuggacaagaaggccaaguacauccuccugauggacaucguggccgcggacgacugccgcuacaaguuccacaacagccgguggauggucgccgggaaggccgaccccgagaugcccaagcgcauguacauccacccggacucccccgccacgggcgagcaguggauggccaagcccguggcguuccacaagcugaagcucaccaacaacaucagcgacaagcacggguucaccauccugaacuccaugcacaaguaccagccccgguuccacaucgugcgcgccaacgacauccugaagcucccguacagcacguuccggaccuacgucuuccccgagaccgacuucaucgccgugaccgccuaccagaacgacaagaucacgcagcugaagaucgacaacaaccccuucgccaagggcuuccgcgacaccgggaacggccggcgcgagaagcggaagcagcugacccuccccucccugcgccuguacgaggagcacugcaagccggagcgggacggcgcggagagcgacgccuccagcugcgacccgccgcccgcccgcgagccgcccaccucccccggggccgcccccagcccccuccggcugcaccgcgcgcgggccgaggagaaguccugcgccgccgacagcgaccccgagcccgagcgccugagcgaggagcgcgcgggcgcgccccucgggcggucccccgcccccgacagcgccucccccacgcgccugaccgagccggagcgggcccgcgagcggcgcagccccgagcggggcaaggagcccgccgaguccggcggggacggccccuucgggcugcgcagccucgagaaggagcgggccgaggcccgccggaaggacgagggccgcaaggaggccgccgaggggaaggagcagggccuggcgccgcuggugguccagaccgacuccgccagcccccucggcgccgggcaccuccccggccuggccuucuccagccaccuccacgggcagcaguucuucggcccccugggggccggccagccgcuguuccugcaccccggccaguucaccauggggcccggcgcguucuccgccauggggaugggccaccuccuggccagcguggccgggggcggcaacgggggcgggggcggccccgggacggcggccggccuggacgccgggggccuggggccggccgccuccgcggccagcaccgccgcccccuuccccuuccaccugucccagcacaugcucgccagccagggcaucccgaugcccaccuucggcgggcuguuccccuaccccuacaccuacauggcggccgccgccgccgcggccuccgcccugccggccacgagcgccgcggccgccgccgcggccgccgccggcucccugagccggagccccuuccucggguccgcccgcccccggcugcgcuucagccccuaccagaucccggugaccaucccgcccuccaccagccugcucaccacgggccuggcguccgaggggagcaaggccgccggcggcaacucccgggagcccagcccccugcccgagcucgcccugcgcaaggucggggcccccucccggggcgcgcugagccccuccgggagcgccaaggaggccgccaacgagcuccaguccauccagcgccuggugagcggccuggagucccagcgcgcccucagcccggggcgggagucccccaaguga

SEQ ID NO: 37485 - RNA, 2172 nt, Artificial Sequence
  derived and/or modified sequence opt1 from TBX3__Homo_sapiens__NP_005987
augagccuguccaugcgcgaccccgugaucccgggcaccagcauggccuaccaccccuuccucccccaccgggcccccgacuucgcgauguccgccguccuggggcaccagccgcccuucuuccccgcccugacccugcccccgaacggcgccgccgcgcugagccugcccggggcccucgccaagcccaucauggaccagcuggugggcgccgcggagacggggauccccuucuccagccugggcccgcaggcccaccuccgcccccugaagaccauggagcccgaggaggagguggaggacgaccccaagguccaccuggaggccaaggagcucugggaccaguuccacaagcggggcaccgagauggugaucaccaaguccgggcgccggauguucccgcccuucaaggugcgcugcagcggccuggacaagaaggccaaguacauccugcucauggacaucaucgccgcggacgacugccgguacaaguuccacaacucccgcuggauggucgccgggaaggccgaccccgagaugcccaagcggauguacauccacccggacagccccgccacgggcgagcaguggauguccaagguggugaccuuccacaagcugaagcugaccaacaacaucagcgacaagcacggguucaccauccucaacuccaugcacaaguaccagccccgcuuccacaucguccgggccaacgacauccugaagcugcccuacagcacguuccgcaccuaccucuucccggagaccgaguucaucgcggugaccgccuaccagaacgacaagaucacgcagcugaagaucgacaacaaccccuucgccaagggcuuccgggacaccggcaacgggcgccgggagaagcgcaagcagcugacccuccaguccaugcggguguucgacgagcgccacaagaaggagaacggcaccagcgacgaguccagcuccgagcaggccgccuucaacugcuucgcgcaggccagcagccccgccgccuccacggucgggaccagcaaccugaaggaccugugccccuccgagggcgagagcgacgccgaggcggaguccaaggaggagcacggcccggaggccugcgacgccgccaagaucagcaccaccacguccgaggagcccugccgggacaaggggagccccgcggugaaggcccaccucuucgccgccgagcgcccgcgggacuccggccgccuggacaaggccagccccgacucccgccacagccccgcgaccaucuccagcuccacccgggggcugggcgccgaggagcgccggagccccgugcgcgaggggaccgccccggccaaggucgaggaggcccgggcgcuccccggcaaggaggccuucgcgccccugacggugcagaccgacgccgccgccgcccaccuggcccagggcccccucccggggcugggcuucgcccccgggcuggcgggccagcaguucuucaacgggcacccccucuuccugcaccccucccaguucgccaugggcggcgccuucagcuccauggccgccgcggggaugggcccgcugcucgccaccgugagcggggccagcaccggcgucuccgggcuggacagcacggccauggccuccgcggccgccgcccagggccugagcggcgccuccgcggccacccuccccuuccaccuccagcagcacgugcuggccagccaggggcucgccaugucccccuucggcagccuguuccccuacccguacaccuacauggcggccgccgccgccgcguccagcgccgccgccuccagcuccgugcaccgccaccccuuccugaaccucaacaccaugcggccccgccugcgguacagccccuacuccaucccgguccccgugcccgacgggagcucccugcugacgaccgcccuccccagcauggcggccgccgccggcccgcuggacggcaagguggccgcgcuggccgccagccccgccuccgucgccguggacagcggguccgagcucaacagccgcuccagcacccuguccagcuccagcaugucccugagccccaagcucugcgcggagaaggaggccgccaccuccgagcugcagagcauccagcggcuggucuccggccucgaggccaagccggaccgcagccgguccgcgagccccuga

SEQ ID NO: 37486 - RNA, 1638 nt, Artificial Sequence
  derived and/or modified sequence opt1 from TBX4__Homo_sapiens__NP_060958
augcugcaggacaagggccucagcgaguccgaggaggccuuccgcgcccccgggcccgcgcugggcgaggccagcgccgccaacgcccccgagcccgcgcuggccgcccccgggcucuccggcgccgcgcuggggagcccgcccggccccggcgccgacguggucgccgccgccgcggccgagcagaccaucgagaacaucaagguggggcugcacgagaaggagcucuggaagaaguuccacgaggccggcaccgagaugaucaucacgaaggccgggcggcgcauguuccccuccuacaaggugaaggucaccggcaugaacccgaagaccaaguacauccugcugaucgacaucgugcccgccgacgaccaccgguacaaguucugcgacaacaaguggaugguggcggggaaggccgagcccgccaugcccggccgccucuacguccacccggacagccccgccaccggcgcccacuggaugcggcagcugguguccuuccagaagcugaagcucacgaacaaccaccuggaccccuucgggcacaucauccugaacagcaugcacaaguaccagccccgccuccacaucgugaaggcggacgagaacaacgccuucggcuccaagaacaccgccuucugcacccacgucuucccggagaccagcuucaucuccgugacgagcuaccagaaccacaagaucacccagcugaagaucgagaacaaccccuucgccaagggguuccggggcuccgacgacagcgaccugcgcguggcccggcuccaguccaaggaguaccccgucaucagcaaguccaucaugcgccagcggcugaucagcccccagcuguccgcgaccccggacgugggcccccuccuggggacccaccaggcccugcagcacuaccagcacgagaacggcgcccacagccagcucgccgagccccaggaccugccccugagcacguucccgacccagcgcgacuccagccucuucuaccacugccugaagcggcgcgacgggacccggcaccuggaccuccccugcaagcgcuccuaccuggaggcgcccagcuccgugggcgaggaccacuacuuccggagcccgccgcccuacgaccagcagaugcugucccccagcuacugcuccgaggucaccccgcgcgaggccugcauguacagcggguccggccccgagaucgccggcgugagcgggguggacgaccugcccccgccgccccucuccugcaacauguggacgagcgucucccccuacaccagcuacuccgugcagaccauggagaccgugcccuaccagcccuuccccacgcacuucaccgccaccaccaugaugccccggcugcccacgcucagcgcccaguccagccagccgcccggcaacgcgcacuucagcgucuacaaccagcugucccagagccaggugcgcgagcgggggcccuccgccagcuucccccgcgagcgcggccugccccaggggugcgagcggaagccgcccagcccccaccucaacgccgccaacgaguuccuguacucccagaccuucucccugagccgcgaguccagccuccaguaccacuccggcaugggcaccguggagaacuggaccgacggguga

SEQ ID NO: 37487 - RNA, 1407 nt, Artificial Sequence
  derived and/or modified sequence opt1 from TBX5__Homo_sapiens__NP_542448
auggagggcaucaagguguuccugcacgagcgcgagcucuggcugaaguuccacgaggucgggaccgagaugaucaucaccaaggccggccggcgcauguuccccagcuacaaggugaaggugacggggcugaacccgaagaccaaguacauccuccugauggacaucguccccgccgacgaccaccgguacaaguucgcggacaacaagugguccgugaccggcaaggccgagcccgccaugcccgggcgccuguacgugcacccggacagccccgccaccggcgcccacuggaugcggcagcucgucuccuuccagaagcugaagcugacgaacaaccaccucgaccccuucggccacaucauccugaacagcaugcacaaguaccagccccgccugcacaucgugaaggcggacgagaacaacggguucggcuccaagaacaccgccuucugcacccacguguucccggagaccgccuucaucgccgucacgagcuaccagaaccacaagaucacccagcucaagaucgagaacaaccccuucgcgaagggguuccggggcuccgacgacauggagcugcaccgcaugagccggaugcaguccaaggaguaccccguggugccccgcagcaccguccggcagaagguggccuccaaccacagcccguucuccagcgagucccgcgcccugagcaccuccagcaaccucgggucccaguaccagugcgagaacggcgugagcggccccagccaggaccugcugcccccgcccaaccccuacccccucccccaggagcacucccagaucuaccacugcacgaagcggaaggaggaggagugcagcaccaccgaccacccguacaagaagcccuacauggagaccucccccagcgaggaggacuccuucuaccgcagcuccuacccccagcagcaggggcugggcgccagcuaccggacggaguccgcccagcgccaggcgugcauguacgccagcuccgccccgcccagcgagcccguccccucccuggaggacaucagcugcaacaccuggccguccaugcccagcuacuccagcugcaccgugaccacggugcagcccauggaccggcucccguaccagcacuucuccgcccacuucaccagcgggccccuggucccccgccuggccggcauggcgaaccacggcagcccccagcucggggagggcauguuccagcaccagaccuccguggcccaccagccggugguccggcagugcgggccccagaccggccugcagagccccgggacgcugcagcccccggaguuccucuacucccacggcgugccccgcacccugagcccccaccaguaccacuccgugcacggcgucgggauggugcccgaguggagcgacaacuccuga

SEQ ID NO: 37488 - RNA, 1311 nt, Artificial Sequence
  derived and/or modified sequence opt1 from TBX6__Homo_sapiens__NP_004599
auguaccacccccgcgagcuguacccgagccucggcgccggguaccggcugggccccgcccagcccggggccgacuccagcuucccgcccgcccuggccgagggcuaccgcuaccccgagcucgacacccccaagcuggacugcuuccuguccgggauggaggccgcgccccggacccucgccgcccacccgccccugccccugcugcccccggccaugggcacggagcccgcccccagcgcgcccgaggcccugcacucccugccgggcgugagccucucccuggagaaccgcgagcuguggaaggaguucagcuccgucgggaccgagaugaucaucaccaaggccggccggcgcauguuccccgccugccgggugagcgugaccgggcucgaccccgaggcccgcuaccuguuccugcucgacgucauccccguggacggcgcgcgguaccgcuggcaggggcggcgcugggagccguccggcaaggccgagccccggcugcccgaccgcguguacauccaccccgacagcccggccacgggcgcccacuggaugcggcagcccgucuccuuccaccgcgugaagcugaccaacagcacccucgacccccacgggcaccugauccugcacuccaugcacaaguaccagccccggauccaccucgugcgcgccgcgcagcugugcagccagcacuggggcgggauggccuccuuccgguucccggagaccacguucaucagcgucaccgccuaccagaacccccagaucacccagcugaagaucgccgccaaccccuucgcgaagggcuuccgcgagaacggccggaacugcaagcgcgagcgcgacgcccgggugaagcgcaagcuccgggggccggagcccgccgccaccgaggccuacggcuccggggacacgcccggcgggcccugcgacagcacccugggcggcgacauccgcgagagcgacccggagcaggcgcccgcccccggggaggccaccgccgcgcccgccccgcugugcggcgggcccuccgccgaggccuaccuccugcaccccgccgcguuccacggcgcccccagccaccucccgacccggucccccagcuuccccgaggcccccgacuccgggcgcagcgccccguacuccgccgcguuccucgagcugccccacggcagcggcggguccggcuaccccgccgcgcccccggccgugcccuucgcgccccacuuccugcagggcgggcccuucccgcuccccuacacggcccccgggggcuaccuggacgucggcagcaagccgauguacuga

SEQ ID NO: 37489 - RNA, 1224 nt, Artificial Sequence
  derived and/or modified sequence opt1 from TBXA2R__Homo_sapiens__NP_963998
auguggcccaacggcagcucccuggggcccugcuuccgccccaccaacaucacccucgaggagcggcgccugaucgccagccccugguucgccgcguccuucugcguggucggccuggccagcaaccuccuggcccuguccgugcucgccggggcccggcagggcgggagccacacgcgcuccagcuuccugaccuuccugugcggccucgugcugaccgacuuccugggccuccuggucaccgggacgaucguggugucccagcacgcggcccuguucgaguggcacgccgucgaccccggcugccggcucugccgcuucauggggguggugaugaucuucuucggccugagcccgcugcuccugggggccgcgauggccuccgagcgguaccugggcaucacccgccccuucagccggcccgccgucgccucccagcgccgggccugggcgaccgugggccucgugugggccgccgcccuggcccuggggcuccugccccugcucggcgucgggcgcuacaccgugcaguacccgggcagcuggugcuuccugacgcugggcgcggaguccggggacguggccuucggccuccuguucagcaugcucgggggccucuccgucgggcugagcuuccugcucaacaccguguccguggccacccugugccacgucuaccacggccaggaggccgcccagcagcggccccgcgacagcgagguggagaugauggcgcagcugcucggcaucaugguggucgccagcgugugcuggcugccccugcucguguucaucgcccagaccguccugcggaacccgcccgccaugucccccgccgggcagcugagccgcacgaccgagaaggagcuccugaucuaccugcggguggcgaccuggaaccagauccucgaccccugggucuacauccuguuccgccgggccgugcugcgccggcugcagccccgccucuccacccgcccgcggcgcagccugacgcuguggcccucccucgaguacagcggcaccaucuccgcccacugcaaccugcggcugcccgggagcuccgacagccgcgccuccgcgagccgggccgccggcaucaccggggugucccacugcgcccgccccugcaugcuguucgacccggaguucgaccugcuggccggcguccagcuccugcccuucgagccgcccaccggcaaggcgcugagccggaaggacuga

SEQ ID NO: 37490 - RNA, 1605 nt, Artificial Sequence
  derived and/or modified sequence opt1 from TBXAS1__Homo_sapiens__NP_001052
augauggaggcccugggcuuccucaagcuggaggugaacgggcccauggucaccguggcccugagcguggcgcuccuggcccugcucaagugguacuccaccagcgccuucucccgccuggagaagcugggccuccggcacccgaagcccagccccuucaucgggaaccugacguucuuccgccagggcuucugggagucccagauggagcugcggaagcucuacgggccccugugcggcuacuaccugggccgccggauguucaucgucaucagcgagccggacaugaucaagcagguccucguggagaacuucuccaacuucaccaaccgcauggccagcgggcuggaguucaaguccguggccgacagcgugcuguuccuccgggacaagcgcugggaggaggugcggggcgcgcugauguccgccuucagccccgagaagcugaacgagauggucccccucaucucccaggccugcgaccugcugcucgcccaccugaagcgcuacgcggagagcggggacgccuucgacauccagcggugcuacugcaacuacaccaccgacgugguggccuccgucgccuucggcacgcccguggacagcuggcaggccccggaggaccccuucgugaagcacugcaagcgcuucuucgaguucugcaucccccggcccauccugguccuccugcuguccuucccgagcaucauggugccccucgcgcgcauccugcccaacaagaaccgggacgagcugaacggguucuucaacaagcucauccgcaacgugaucgcccugcgggaccagcaggccgccgaggagcgccggcgcgacuuccugcagaugguccucgacgcccggcacuccgcgagccccaugggcgugcaggacuucgacaucgugcgcgacgucuucagcuccaccggcugcaagccgaaccccagccgccagcaccagcccucccccauggcccggccgcugaccguggacgagaucguggggcaggccuucaucuuccugaucgccggcuacgagaucaucaccaacacgcucagcuucgccaccuaccugcuggcgaccaaccccgacugccaggagaagcuccugcgcgaggucgacguguucaaggagaagcacauggcccccgaguucugcucccuggaggaggggcuccccuaccuggacauggucaucgccgagacccugcggauguacccgcccgccuuccgcuucacgcgggaggccgcgcaggacugcgaggugcucggccagcgcauccccgccggcgccgugcuggagauggccgucggggcgcugcaccacgaccccgagcacuggccgagccccgagaccuucaaccccgagcgguucaccgccgaggcccgccagcagcaccggccguucaccuaccugcccuucggcgccgggccccgcuccugccucggcgugcggcuggggcugcucgaggugaagcugacgcugcuccacguccugcacaaguuccgcuuccaggccugccccgagacccaggugccgcugcagcucgagagcaaguccgcgcugggccccaagaacggcguguacaucaagaucgucagccgguga

SEQ ID NO: 37491 - RNA, 213 nt, Artificial Sequence
  derived and/or modified sequence opt1 from TCAIM__Homo_sapiens__NP_001025010
auguucugccaccuccgccccaugcggcgccugugccuggagaagaucuucccgcacugguuccccuucagccgggcccuguccggcgccgaggcggugaacgcccuccgccccuucuacuucgccguccaccccgacuucuucgggcagcacccgguggagcgggacgacaccuggaaguccuuccagugccccagcgacuucagccuguga

SEQ ID NO: 37492 - RNA, 504 nt, Artificial Sequence
  derived and/or modified sequence opt1 from TCAP__Homo_sapiens__NP_003664
auggccaccagcgagcuguccugcgaggugagcgaggagaacugcgagcgccgggaggccuucugggcggaguggaaggaccucacccuguccacgcgccccgaggagggcugcagccugcacgaggaggacacccagcggcacgagaccuaccaccagcaggggcagugccagguccucgugcagcgcuccccguggcugaugaugcggaugggcauccuggggcgcggccuccaggaguaccagcugcccuaccagcgggugcugccccuccccaucuucaccccggccaagaugggggccacgaaggaggagcgcgaggacacccccauccagcugcaggagcugcucgcccuggagaccgcccugggcggccagugcgucgaccggcaggagguggcggagaucaccaagcagcucccgcccgugguccccgugagcaagcccggggcccugcgccggucccugagccgcuccaugagccaggaggcccagcggggcuga

SEQ ID NO: 37493 - RNA, 906 nt, Artificial Sequence
  derived and/or modified sequence opt1 from TCEA1__Homo_sapiens__NP_006747
auggaggacgaggugguccgcuucgccaagaagauggacaagauggugcagaagaagaacgccgcgggcgcccuggaccuccugaaggagcugaagaacauccccaugacccucgagcugcugcagagcacccggaucgggauguccgugaacgccauccgcaagcagagcacggacgaggaggucaccucccucgccaagagccugaucaaguccuggaagaagcugcucgacggcccgagcaccgagaaggaccuggacgagaagaagaaggagcccgccaucaccucccagaacagccccgaggcgcgggaggaguccacgagcuccgggaacgugagcaaccgcaaggacgagaccaacgcccgggacaccuacguguccagcuucccccgcgccccguccaccagcgacuccguccggcugaagugccgcgagaugcucgccgcggcccugcggacgggcgacgacuacaucgccaucggggccgacgaggaggagcugggcagccagaucgaggaggccaucuaccaggagauccgcaacaccgacaugaaguacaagaaccgggugcgcucccggaucagcaaccucaaggacgcgaagaaccccaaccugcgcaagaacgugcugugcggcaacaucccgcccgaccucuucgcccggaugaccgccgaggagauggccagcgacgagcugaaggagaugcgcaagaaccugaccaaggaggccauccgggagcaccagauggcgaagaccgggggcacccagaccgaccucuucacgugcgggaagugcaagaagaagaacugcacguacacccagguccagacccgcuccgccgacgagcccaugaccacguucguggugugcaacgagugcggcaaccgguggaaguucugcuga

SEQ ID NO: 37494 - RNA, 900 nt, Artificial Sequence
  derived and/or modified sequence opt1 from TCEA2__Homo_sapiens__NP_003186
augaugggcaaggaggaggagaucgcccgcaucgcccggcgccuggacaagauggugaccaagaaguccgcggagggggccauggaccuccugcgggagcugaaggccaugcccaucacccuccaccuccugcagagcacgcgcgucggcaugagcgugaacgcccugcggaagcaguccagcgacgaggaggugaucgcccuggcgaagucccugaucaagagcuggaagaagcuccuggacgccuccgacgccaaggcccgcgagcgggggcgcggcaugccgcugcccaccagcucccgggacgcgagcgaggcccccgaccccucccgcaagcggccggagcucccccgcgcccccagcacgccccggaucaccacguucccgcccguccccgugaccugcgacgccgugcgcaacaagugccgggagaugcugaccgccgcgcugcagaccgaccacgaccacgucgccaucggggccgacugcgagcgccucuccgcccagaucgaggagugcaucuuccgggacgugggcaacacggacaugaaguacaagaaccgcgugcggagccgcaucuccaaccugaaggacgccaagaaccccgaccugcggcgcaacguccucugcggcgcgaucaccccgcagcagaucgccgugaugaccagcgaggagauggccuccgacgagcugaaggagauccgcaaggccaugaccaaggaggccauccgggagcaccagauggcgcgcaccgggggcacccagaccgaccuguucacgugcgggaagugccggaagaagaacugcaccuacacccaggugcagacccgcagcuccgacgagcccaugaccacguucgucgugugcaacgagugcggcaaccgguggaaguucugcuga

SEQ ID NO: 37495 - RNA, 1032 nt, Artificial Sequence
  derived and/or modified sequence opt1 from TCEA3__Homo_sapiens__XP_011540358
augggccaggaggaggagcugcuccgcaucgccaagaagcuggagaagaugguggcccggaagaacaccgagggggcgcuggaccuccugaagaagcugcacagcugccagauguccauccagcuccugcagaccacgcgcaucggcgucgccgugaacggggugcggaagcacugcagcgacaaggaggucgugucccuggccaaggugcucaucaagaacuggaagcgccugcuggacagccccggcccgcccaagggggagaagggcgaggagcgggagaaggccaagaagaaggagaagggccucgagugcuccgacuggaagcccgaggccgggcugagcccgccccgcaagaagcgggaggaccccaagacccgcuccaacagcuccaagagcaaggcggagucccccaagacccccagcuccccgcugacccccacguucgccagcuccaugugccuccuggcccccugcuaccugaccggcgacagcguccgggacaagugcguggagaugcucuccgccgcgcugaaggccgacgacgacuacaaggacuacggggugaacugcgacaagauggccagcgagaucgaggaccacaucuaccaggagcugaaguccaccgacaugaaguaccgcaaccggguccgcagccggaucagcaaccucaaggacccccgcaacccgggccugcggcgcaacgugcuguccggggccaucagcgccggccucaucgcgaagaugaccgccgaggagauggccuccgacgagcugcgggagcugcgcaacgccaugacgcaggaggccauccgggagcaccagauggcgaagaccggcgggaccaccacggaccucuuccagugcagcaagugcaagaagaagaacugcaccuacaaccaggugcagacccgcuccgccgacgagcccaugaccacguucguccugugcaacgagugcggcaaccgguggaagccgcccuggcgcaugccccgcaaccugagcaacuucguggccuuccucgugcuguga

SEQ ID NO: 37496 - RNA, 480 nt, Artificial Sequence
  derived and/or modified sequence opt1 from TCEAL1__Homo_sapiens__NP_001006641
auggacaagccccgcaaggagaacgaggaggagccccagagcgcccccaagaccgacgaggagcggccgcccguggagcacucccccgagaagcagagccccgaggagcaguccagcgaggagcaguccagcgaggaggaguucuuccccgaggagcugcuccccgagcugcugccggagaugcuccuguccgaggagcgcccgccccaggagggccugagccggaaggaccucuucgaggggcgcccgcccauggagcagccgcccugcggcgucgggaagcacaagcuggaggagggcuccuucaaggagcggcuggcccgcagccggccccaguuccgcggggacauccacggccggaaccucuccaacgaggagaugauccaggcggccgacgagcuggaggagaugaagcgcgugcggaacaagcugaugaucaugcacuggaaggccaagcgcagccggcccuaccccaucuga

SEQ ID NO: 37497 - RNA, 684 nt, Artificial Sequence
  derived and/or modified sequence opt1 from TCEAL2__Homo_sapiens__NP_525129
auggagaagcuguucaacgagaacgagggcaugcccagcaaccaggggaagaucgacaacgaggagcagccgccccacgagggcaagcccgagguggccugcauccucgaggacaagaagcuggagaacgaggggaacaccgagaacaccggcaagcgcgucgaggagccccugaaggacaaggagaagccggaguccgccgggaaggccaagggcgagggcaagagcgagcggaaggggaaguccgagaugcagggcgggagcaagacggagggcaagcccgagcgcgggggccgggccgagggcgagggggagcccgacuccgagcgcgagcccgagagcgagggcgagccggaguccgagacccgggccgccgggaagcgccccgccgaggacgacaucccccggaaggcgaagcgcaagaccaacaagggccucgcccaguaccugaagcaguacaaggaggccauccacgacaugaacuucagcaacgaggacaugauccgggaguucgacaacauggcccgcguggaggacaagcggcgcaaguccaagcagaagcugggcgcguuccucuggaugcagcggaaccugcaggaccccuucuacccgcgcgggccccgggaguuccgcggcgggugccgggcgccccgccgggacaccgaggacauccccuacguguga

SEQ ID NO: 37498 - RNA, 1077 nt, Artificial Sequence
  derived and/or modified sequence opt1 from TCEAL4__Homo_sapiens__NP_001287830
augcccgccggcgggcaggccccgcagcugacccccgugauccccgcguucugggaggcccgcggccuccccaacagcaaggggcgggacaagguccacaucugccagugcgaggaguggaagggccacaucuccuacguggagcgcgacaucaccacgagcgagaucaagucccugccgcaggucagcguccgggccuuccacgccgccuccgggacccuggaguggcgcaagggcaacggcuacgggcggggcaagggguggggcugggggcgcguggagagccgggaggcgggccccuccguggaccgcgacggcgggcuccgggucugcugcagccagcgcuccgccaagcccgagaaggaggagcagcccgugcagaacccgcggcgcagcgugaaggaccggaagcgccggggcaaccuggacauggagaagcuguacuccgagaacgaggggauggccagcaaccagggcaagauggagaacgaggagcagccccaggacgagcgcaagcccgaggugaccugcacccucgaggacaagaagcuggagaacgagggcaagacggagaacaaggggaagaccggcgacgaggagaugcugaaggacaaggggaagcccgaguccgagggcgaggccaaggagggcaagagcgagcgggagggggaguccgagauggagggcgggagcgagcgcgagggcaagccggagaucgaggggaagcccgaguccgagggcgagcccgggagcgagacccgggcggccggcaagcgccccgccgaggacgacgugccgcggaaggccaagcgcaagaccaacaagggccucgcccacuaccugaaggaguacaaggaggcgauccacgacaugaacuucuccaacgaggacaugauccgcgaguucgacaacauggccaaggugcaggacgagaagcgcaagagcaagcagaagcugggggccuuccucuggaugcagcggaaccugcaggaccccuucuacccccggggcccccgcgaguuccgcgggggcugccgggccccgcggcgcgacaucgaggacauccccuacgucuga

SEQ ID NO: 37499 - RNA, 303 nt, Artificial Sequence
  derived and/or modified sequence opt1 from TCEAL7__Homo_sapiens__NP_689491
augcagaagcccugcaaggagaacgagggcaagccgaagugcagcgugcccaagcgcgaggagaagcggcccuacggggaguucgagcgccagcagaccgagggcaacuuccggcagcgccugcuccagucccuggaggaguucaaggaggacaucgacuaccggcacuucaaggacgaggagaugacccgcgagggggacgagauggagcggugccuggaggagauccgcggccuccggaagaaguuccgcgcccugcacagcaaccaccggcacucccgcgaccggcccuacccgaucuga

SEQ ID NO: 37500 - RNA, 291 nt, Artificial Sequence
  derived and/or modified sequence opt1 from TCEB1__Homo_sapiens__NP_001191793
auguacgugaagcugaucagcuccgacggccacgaguucaucgucaagcgcgagcacgcccucaccagcgggaccaucaaggccaugcuguccggccccgggcaguucgcggagaacgagacgaacgaggugaacuuccgggagaucccgagccacgugcuguccaaggucugcauguacuucaccuacaaggugcgcuacaccaacagcuccaccgagauccccgaguuccccaucgcccccgagaucgcccucgagcugcugauggccgccaacuuccucgacugcuga

SEQ ID NO: 37501 - RNA, 357 nt, Artificial Sequence
  derived and/or modified sequence opt1 from TCEB2__Homo_sapiens__NP_009039
auggacguguuccugaugauccgccggcacaagaccaccaucuucacggacgccaaggagagcuccaccgucuucgagcucaagcgcaucguggagggcauccugaagcggcccccggacgagcagcgccuguacaaggacgaccagcuccuggacgacgggaagacccugggcgagugcggguucaccagccagacggcccggccccaggcgcccgccaccgugggccucgccuuccgcgccgacgacaccuucgaggcccugugcaucgagcccuucuccagcccgcccgagcugcccgacgucaugaagccccaggacuccgggagcuccgcgaacgagcaggccgugcaguga

SEQ ID NO: 37502 - RNA, 1641 nt, Artificial Sequence
  derived and/or modified sequence opt1 from TCEB3C__Homo_sapiens__NP_663628
auggccgccggcagcaccacccugcgcgcgguggggaagcuccagguccggcuggccacgaagaccgagcccaagaagcuggagaaguaccuccagaagcuguccgcccugccgaugaccgccgacauccucgccgagaccggcauccgcaagacggugaagcggcugcgcaagcaccagcacgugggggacuucgcgcgggaccuggccgcccgcuggaagaagcucguccugguggaccggaacaccggccccgacccccaggaccccgaggagagcgccucccgccagcgguucggggaggcgcugcaggagcgcgagaaggccuggggcuucccggagaacgccaccgcgccccggagccccucccacagccccgagcaccgccggaccgcccgccggacgccgcccggccagcagcgcccccacccccgguccccgagccgcgagccccgggccgagcgcaagcggccccgcauggcccccgccgacuccgggccgcaccgcgacccgcccacccggaccgcgccccuccccaugcccgagggccccgagcccgccgugccgggggagcagcccggccgcgggcacgcccacgccgcccagggcggcccccugcuggggcagggcugccaggggcagccccagggcgaggccgucggcagccacuccaaggggcacaagagcucccggggcgccagcgcgcagaaguccccgcccgugcaggagagccaguccgagcgccuccaggccgccggggccgacagcgccggccccaagaccgugccgucccacgucuucagcgagcugugggaccccagcgaggcguggaugcaggccaacuacgaccugcucuccgccuucgaggccaugacgagccaggcgaaccccgaggcccuguccgcccccgcccugcaggaggaggccgcguucccggggcggcgcgugaacgccaagaugcccguguacagcggcucccggcccgccugccagcuccagguccccacccugcgccagcagugccugcgggugccgcgcaacaaccccgacgcccucggcgacguggaggggguccccuacagcgugcuggagcccgugcuggagggcuggaccccggaccagcucuaccggaccgagaaggacaacgccgcgcuggcccgcgagacggacgagcuguggcggauccacugccuccaggacuucaaggaggagaagccccaggagcacgaguccuggcgcgagcuguaccugcggcuccgcgacgcccgggagcagcgccugcgggucgugaccaccaagauccgcagcgcccgcgagaacaagcccuccgggcggcagaccaagaugaucugcuucaacagcguggccaagacgcccuacgacgcgucccgccggcaggagaaguccgccggcgccgccgacccggggaacggcgagauggagcccgcgcccaagcccgccggcagcagccaggccccguccgggcugggcgacggggacggcgggagcgucuccggcggcgggagcuccaaccgccacgccgcccccgcggacaagacccggaagcaggccgccaagaagguggcgccccucauggccaaggccauccgcgacuacaagggccgguucagccgccgguga

SEQ ID NO: 37503 - RNA, 3234 nt, Artificial Sequence
  derived and/or modified sequence opt1 from TCERG1__Homo_sapiens__NP_001035095
auggccgagcgcggcggggacggcggggagagcgagcgguucaaccccggcgagcugcgcauggcccagcagcaggcgcuccgguuccgcgggccggcccccccccccaacgccgugaugcggggcccgcccccccugaugcgccccccgccccccuucggcaugaugcgggggcccccgccccccccccgcccgcccuucggccggccccccuucgacccgaacaugccccccaugcccccgcccgggggcaucccccccccgauggggcccccccaccugcagcgcccgcccuucaugccccccccgauguccagcaugcccccccccccgggcaugauguucccccccggcaugcccccggucaccgcccccgggacccccgcccuccccccgacggaggagaucuggguggagaacaagacccccgacggcaagguguacuacuacaacgcgcggacccgcgaguccgccuggaccaagcccgacggggucaaggugauccagcagagcgagcugacgcccaugcuggccgcccaggcgcaggugcaggcccaggcccaggcccaggcccaggcgcaggcccaggcccaggcccaggcccaggcgcaggcccaggcccaggcccaggcccaggcgcaggcccaggcccaggcccaggcccaggcgcaggcccaggcccaggcccaggcgcaggcccaggcccaggcccaggcccaggcgcagguccaggcccaggugcaggcccaggugcaggcccaggccgucggcgcguccaccccgaccaccagcucccccgcccccgccgugagcacguccaccagcuccagcacccccuccagcaccacguccaccaccaccacggccaccagcguggcccagaccgucuccaccccgacgacccaggaccagacccccagcuccgcggugagcguggccacccccacggucagcguguccaccccggcccccaccgccacccccgugcagacggucccccagccgcacccccagacccucccccccgcggugccgcacagcgugccccagcccaccaccgccauccccgccuucccgcccgucauggugccccccuuccgggugccgcugcccggcaugcccaucccccugccggggguccuccccggcauggccccccccaucgugccgaugauccacccccaggucgccaucgcggccucccccgccacgcuggccggggccaccgcggugagcgaguggaccgaguacaagaccgccgacggcaagacguacuacuacaacaaccgcacccuggaguccaccugggagaagccccaggagcucaaggagaaggagaagcuggaggagaagaucaaggagccgaucaaggagcccagcgaggagccccugccgauggagaccgaggaggaggaccccaaggaggagcccaucaaggagaucaaggaggagcccaaggaggaggagaugaccgaggaggagaaggccgcccagaaggccaagccgguggcgacggcccccauccccgggacccccuggugcgucguguggaccggcgacgagcggguguucuucuacaacccgaccacgcgccucuccaugugggaccggcccgacgaccugaucggccgcgccgacgucgacaagaucauccaggagcccccccacaagaaggggauggaggagcugaagaagcuccggcacccgacccccaccaugcugagcauccagaaguggcaguucuccaugagcgccaucaaggaggagcaggagcugauggaggagaucaacgaggacgagcccgugaaggcgaagaagcgcaagcgggacgacaacaaggacaucgacuccgagaaggaggccgccauggaggccgagaucaaggccgcgcgcgagcgcgccaucgugccccucgaggcccggaugaagcaguucaaggacaugcugcuggagcgcggcgucagcgccuucuccaccugggagaaggagcuccacaagaucguguucgacccgcgguaccugcugcucaaccccaaggagcgcaagcagguguucgaccaguacgucaagacgcgggccgaggaggagcgccgggagaagaagaacaagaucaugcaggcgaaggaggacuucaagaagaugauggaggaggccaaguucaacccccgcgccaccuucagcgaguucgccgccaagcacgcgaaggacucccgguucaaggccaucgagaagaugaaggaccgcgaggcccuguucaacgaguucguggccgccgcgcggaagaaggagaaggaggacagcaagacccgcggggagaagaucaaguccgacuucuucgagcugcucagcaaccaccaccuggacucccagagccgguggagcaaggugaaggacaaggucgaguccgacccccgcuacaaggccguggacagcuccagcaugcgggaggaccuguucaagcaguacaucgagaagaucgccaagaaccucgacuccgagaaggagaaggagcuggagcgccaggcccggaucgaggcgagccugcgcgagcgggagcgcgaggugcagaaggcccgcuccgagcagaccaaggagaucgaccgggagcgcgagcagcacaagcgggaggaggccauccagaacuucaaggcccuccugagcgacaugguccgcuccagcgacguguccuggagcgacacgcggcgcacccugcggaaggaccaccgcugggaguccggcagccuccuggagcgggaggagaaggagaagcuguucaacgagcacaucgaggcccucaccaagaagaagcgcgagcacuuccggcagcugcuggacgagaccuccgcgaucacgcucaccagcaccuggaaggaggugaagaagaucaucaaggaggacccgcgcugcaucaaguucuccagcagcgaccggaagaagcagcgcgaguucgaggaguacauccgggacaaguacaucaccgccaaggccgacuuccgcacgcugcugaaggagaccaaguucaucaccuaccgguccaagaagcucauccaggagagcgaccagcaccugaaggacgucgagaagauccugcagaacgacaagcgcuaccuggugcucgacugcgugcccgaggagcggcgcaagcugaucgucgccuacguggacgaccuggaccggcgcgggccccccccgccccccaccgccuccgagcccacgcgccggagcaccaaguga

SEQ ID NO: 37504 - RNA, 1761 nt, Artificial Sequence
  derived and/or modified sequence opt1 from TCERG1L__Homo_sapiens__NP_777597
augcaggccggcgcccgcuuccagcggcgccggcgccagcugcagcagcagcagccccggcgccggcagccgcuccuguggcccauggacgcggagccgccgcccccgccgcccuggguguggaugguccccgggagcgccggccugcuccgccuguccgccggggugguggucccgcccgugcugcucgccagcgcgccgccgcccgccgcgccccugcugcccggccuccccggguggcccgcccccuccgagcccgugcugccccugcucccccugcccagcgcccccgacuccgccgccgccgccgccgcgcaccccuuccccgcccugcacggccaguggcuguucggcgggcacagccccucccugggccugcccccgagcuccaccgucgagcucgugcccguguucccccaccugugcccgagcgcccuggccacccccaucgggaaguccuggaucgacaagcggauccccaacugcaagaucuucuucaacaacagcuucgcccucgacuccacguggauccaccccgaggagagccgcuucuuccacggccacgagaagccgcggcugcuggcgaaccaggucgccgugucccucagccgccccgcccccgccucccggccccuccccaccgugguccuggcgccccagcccauccccgggggcugccacaacagccucaaggugaccuccagcccggccaucgccaucgccaccgccgccgcggccgccauggugagcgucgaccccgagaaccugcgcggccccucccccagcuccgugcagccgcggcacuuccugacgcucgcccccaucaagaucccccugcgcaccagccccguguccgacacccggaccgagcgcgggcgggucgcgcgcccgcccgcccugaugcuccgggcccagaagucccgcgacggcgacaaggaggacaaggagccgccgcccaugcucgggggcggcgaggacagcacggcccgcgggaaccggcccguggccagcacccccgugcccggcucccccuggugcgucguguggaccggggacgaccgcguguucuucuucaaccccaccaugcaccugagcgucugggagaagcccauggaccugaaggaccggggcgaccugaaccgcaucaucgaggacccgccccacaagcggaagcuggaggcgcccgccacggacaacuccgacgggagcuccagcgaggacaaccgcgaggaccaggacgugaagaccaagcggaaccgcaccgagggcugcggcucccccaagccggaggaggccaagcgggaggacaaggggacccgcacgcccccgccccagauccuccugccccuggaggagcgggucacccacuuccgcgacaugcuccuggagcggggcgugagcgccuucuccaccugggagaaggagcugcacaagaucguguucgacccccgcuaccuccugcugaacagcgaggagcggaagcagaucuucgagcaguucgucaagacccgcaucaaggaggaguacaaggagaagaaguccaagcuccugcuggccaaggaggaguucaagaagcugcucgaggagagcaaggugagcccccggacgaccuucaaggaguucgcggagaaguacgggcgcgaccagcgguuccgccuggugcagaagcgcaaggaccaggagcacuucuucaaccaguucauccugauccucaagaagcgggacaaggagaaccgccugcggcugcgcaagaugcgguga

SEQ ID NO: 37505 - RNA, 2049 nt, Artificial Sequence
  derived and/or modified sequence opt1 from TCF12__Homo_sapiens__NP_003196
augaacccccagcagcagcgcauggccgccaucggcaccgacaaggagcugagcgaccuccuggacuucuccgcgauguucagcccgcccgugaacuccgggaagacccggcccacgacccugggcagcucccaguucagcggguccggcaucgacgagcgcgggggcaccaccagcuggggcacguccgggcagcccagcccguccuacgacagcucccggggcuucaccgacagcccccacuacuccgaccaccucaacgacagccgccugggggcccacgagggccugucccccacccccuucaugaacagcaaccucauggggaagaccuccgagcggggcagcuucagccuguacucccgcgacacgggccugccggggugccagagcucccuccugcggcaggaccugggccucgggagccccgcccagcuguccagcuccggcaagcccggcaccgccuacuacagcuucuccgccaccagcucccgccggcgcccccugcacgacagcgcggcccucgacccgcugcaggccaagaagguccggaaggugccgcccgggcugcccuccagcguguacgcccccucccccaacagcgacgacuucaaccgcgagucccccagcuaccccuccccgaagccgcccaccagcauguucgcgagcacguucuucaugcaggacggcacccacaacuccagcgaccucugguccagcuccaacgggaugagccagcccggcuucgggggcauccugggcaccuccaccagccacaugucccagagcuccagcuacgggaaccugcacucccacgaccggcucagcuacccgccccacuccgucagccccacggacaucaacaccucccugccgcccaugagcagcuuccaccgcggcuccaccagcuccagccccuacguggccgccucccacacgccgcccaucaacgggagcgacuccauccugggcacccgggggaacgccgccggcagcucccagaccggcgacgcgcucgggaaggcccuggccagcaucuacucccccgaccacaccagcuccagcuuccccuccaaccccagcacccccgugggcucccccagcccccugacggggaccucccaguggccccgcccgggcgggcaggcccccagcagccccuccuacgagaacagccuccacucccugcagagccggauggaggaccgccuggaccggcucgacgacgccauccacguccugcgcaaccacgcggugggccccuccaccagccugccggccggccacuccgacauccacagccuccuggggcccucccacaacgcccccaucggcagccugaacuccaacuacgggggcagcucccucguggccagcucccggagcgccuccauggucggcacccaccgcgaggacagcgugucccugaacgggaaccacagcgugcugagcuccacggucaccaccagcuccaccgaccucaaccacaagacgcaggagaacuaccgcggcgggcugcagagccaguccggcaccguggugaccaccgagaucaagacggagaacaaggagaaggacgagaaccugcacgagcccccgagcuccgacgacaugaaguccgacgacgagagcagccagaaggacaucaaggucuccagccgggggcgcaccuccagcaccaacgaggacgaggaccucaaccccgagcagaagaucgagcgggagaaggagcgccggauggcgaacaacgcccgcgagcggcugcgcgugcgggacaucaacgaggccuucaaggagcugggccgcaugugccagcuccaccugaaguccgagaagccccagaccaagcugcucauccugcaccaggccguggccgucauccugagccuggagcagcagguccgggagcgcaaccucaaccccaaggcggccugccugaagcggcgcgaggaggagaagguguccgccgugagcgccgagccgcccaccacgcugcccggcacccaccccgggcucuccgagaccaccaacccgaugggccacauguga

SEQ ID NO: 37506 - RNA, 600 nt, Artificial Sequence
  derived and/or modified sequence opt1 from TCF15__Homo_sapiens__NP_004600
auggccuucgcccugcuccgccccgugggcgcccacguccuguacccggacgugcggcugcucagcgaggacgaggagaaccgcuccgagagcgacgccuccgaccagagcuucgggugcugcgagggccccgaggccgcccggcgcgggcccggccccgggggcggccggcgcgccgggggcgggggcggggcgggcccgguggucguggugcggcagcgccaggccgccaacgcccgggagcgcgaccggacccaguccgucaacaccgcguucacggcccugcgcacccugauccccaccgagcccguggaccggaagcucagcaagaucgagacccugcgccuggccuccagcuacaucgcccaccucgccaacgugcugcugcucggcgacuccgcggacgacgggcagcccugcuuccgggccgccggcagcgccaagggggccgucccggcggccgccgacggcggccgccagccccgguccaucugcacguucugccugagcaaccagcgcaagggcggcgggcggcgcgaccugggcggguccugccucaaggugcgcgggguggcgccccugcggggcccccgccgguga

SEQ ID NO: 37507 - RNA, 1038 nt, Artificial Sequence
  derived and/or modified sequence opt1 from TCF19__Homo_sapiens__XP_005249391
augcugcccugcuuccagcuccugcgcaucggcgggggccgcgggggcgaccuguacaccuuccacccgcccgccggggccggcugcaccuaccggcucggccaccgggcggaccugugcgacguggcccugcgcccccagcaggagcccgggcucaucagcggcauccacgccgagcugcacgccgagccgcgcggggacgacuggcgggucucccuggaggaccacagcucccagggcacgcucgugaacaacgugcggcugccccgcgggcaccggcuggagcucagcgacggcgaccugcugaccuucggccccgaggggcccccgggcaccucccccagcgaguucuacuucauguuccagcagguccgcgugaagccccaggacuucgccgcgaucaccaucccccggucccgcggggaggcccgggugggcgccggcuuccgcccgaugcuccccagccagggggcgccccagcggccccuguccacguucagcccggcccccaaggccacccugauccucaacuccaucggcagccuguccaagcugcgcccccagccccucaccuucagcccguccuggggcgggcccaagagccugcccguccccgccccgcccggggagaugggcaccacgcccuccgccccgccccagcggaaccgccgcaagagcgugcaccgggugcuggccgagcucgacgacgaguccgagccgcccgagaacccgccgcccguccugauggagccccggaagaagcugcgcguggacaaggcgccccucacccccaccggcaaccgccgggggcgcccccggaaguaccccgugagcgcccccauggccccgcccgccgucggcgggggcgagcccugcgccgcgcccugcugcugccugccccaggaggagaccguggccugggugcagugcgacgggugcgacgucugguuccacguggccugcgugggcugcagcauccaggccgcccgcgaggcggacuuccggugccccggcugccgcgccgggauccagacguga

SEQ ID NO: 37508 - RNA, 5883 nt, Artificial Sequence
  derived and/or modified sequence opt1 from TCF20__Homo_sapiens__NP_005641
augcagagcuuccgcgagcaguccagcuaccacggcaaccagcaguccuacccccaggaggugcacgggagcucccggcuggaggaguucagcccccgccaggcccagauguuccagaacuucggcgggaccggcggguccagcggcuccagcggcuccgggagcggcgggggccggcgcggggccgccgccgccgccgccgcgauggccuccgagaccagcggccaccagggcuaccagggguuccggaaggaggccggcgacuucuacuacauggccgggaacaaggaccccgugaccaccggcacgccccagccgccccagcgccggcccuccggccccgugcagagcuacgggccgccccagggcuccagcuucgggaaccaguacggcuccgaggggcacgugggccaguuccaggcgcagcacagcggccucgggggcgucagccacuaccagcaggacuacaccgggcccuucucccccggcagcgcccaguaccagcagcaggccuccagccagcagcagcagcagcagguccagcagcugcgccagcagcuguaccagucccaccagccccucccccaggccacggggcagcccgccagcuccagcucccaccuccagcccaugcagcggcccagcacccugcccuccagcgcggccggcuaccagcuccgcgugggccaguucgggcagcacuaccaguccagcgccuccagcuccagcuccagcagcuuccccagcccccagcgguucagccaguccggccagagcuacgacggguccuacaacgucaacgccggcagccaguacgaggggcacaacgugggcuccaacgcccaggcguacggcacccagagcaacuacuccuaccagccccagagcaugaagaacuucgagcaggccaagaucccccaggggacccagcagggccagcagcagcagcagccccagcagcagcagcaccccucccagcacgugaugcaguacaccaacgccgccaccaagcugccccugcagagccaggucgggcaguacaaccagcccgaggugcccgugcgcucccccaugcaguuccaccagaacuucagccccaucuccaaccccagccccgccgcguccgucgugcagagccccagcugcuccagcacccccagcccccugaugcagaccggcgagaaccugcagugcggccaggggagcgugcccaugggcucccggaaccgcauccugcagcucaugccccagcugagcccgacgcccuccaugaugcccagccccaacucccacgccgccggguucaagggcuucgggcuggagggcgucccggagaagcggcucaccgaccccggccugagcucccugagcgcccucuccacccagguggccaaccugcccaacaccgugcagcacaugcugcucagcgacgcgcugacgccccagaagaagaccuccaagcgcccgagcuccagcaagaaggccgacuccugcaccaacagcgaggggagcucccagcccgaggagcagcugaagucccccauggccgagucccucgacggcgggugcagcuccagcuccgaggaccagggcgagcggguccgccagcugagcgggcaguccaccagcuccgacacgaccuacaagggcggcgccagcgagaaggcgggguccagccccgcccagggcgcccagaacgagccgccccggcugaacgccucccccgccgcgcgcgaggaggccaccagccccggggccaaggacaugccgcucuccagcgacggcaaccccaaggugaacgagaagaccgugggggucaucgugucccgggaggccaugacgggccgcguggagaagcccggcgggcaggacaagggcagccaggaggacgaccccgccgcgacccagcgcccgcccagcaacgggggcgccaaggagaccucccacgccagccugccccagccggagccgcccgggggcggcggguccaagggcaacaagaacggggacaacaacagcaaccacaacggcgagggcaacgggcaguccggccacagcgccgccgggcccggcuucaccucccggacggagccgagcaagucccccgggagccugcgcuacuccuacaaggacagcuucggcuccgcggucccccggaacgugagcggcuucccccaguacccgaccgggcaggagaagggcgacuucaccgggcacggcgagcgcaaggggcggaacgagaaguuccccucccuccugcaggagguccugcagggcuaccaccaccaccccgaccgccgguacagccgcuccacccaggagcaccagggcauggccgggagccucgagggcacgacccggcccaacgugcuggugucccagaccaacgagcuggccagccgcgggcuccugaacaagagcaucggcucccugcucgagaacccgcacugggggcccugggagcggaaguccuccagcaccgcccccgagaugaagcagaucaaccugacggacuaccccaucccgcgcaaguucgagaucgagccccaguccagcgcgcacgagcccggcggcucccugagcgagcggcgcuccgucaucugcgacaucagcccccuccggcagaucgugcgcgacccgggggcccacucccugggccacaugagcgccgacacccggaucgggcgcaacgaccggcugaaccccacccucucccagagcgugauccugcccggcggccuggucuccauggagaccaagcucaagagccaguccgggcagaucaaggaggaggacuucgagcagagcaagucccaggccagcuucaacaacaagaaguccggcgaccacugccacccgcccuccaucaagcacgagagcuaccgcgggaacgccucccccggcgcggccacccacgacagccuguccgacuacgggccccaggacagccgccccacgcccaugcggcgcgugcccggccgggugggcgggcgcgagggcaugcgggggcgcucccccagccaguaccacgacuucgccgagaagcugaagauguccccgggccggagccgcgggcccggcggcgacccccaccacaugaacccccacaugaccuucuccgagcgggccaaccgcagcucccugcacaccccguucagccccaacuccgagacccucgccagcgcguaccacgccaacacgcgggcccacgccuacggggaccccaacgccggccugaacucccagcugcacuacaagcgccagauguaccagcagcagcccgaggaguacaaggacuggagcuccgggagcgcgcagggcgucaucgccgccgcccagcaccggcaggaggggccgcgcaagagcccccggcagcagcaguuccucgaccgcgugcggagcccccugaagaacgacaaggacggcaugauguacgggccgcccguggggaccuaccacgaccccagcgcgcaggaggccggccgcugccugauguccagcgacgggcuccccaacaagggcauggagcugaagcacgggucccagaagcugcaggagagcugcugggaccucucccggcagaccagccccgccaaguccagcggcccgcccggcauguccagccagaagcgcuacgggccgccccacgagaccgacggccacgggcuggccgaggccacgcaguccagcaagcccggcuccgucaugcugcggcuccccggccaggaggaccacagcucccagaacccccugaucaugcgccgccgggugcgcagcuucaucagccccaucccguccaagcggcagagccaggacgugaagaacuccagcaccgaggacaaggggcgccugcuccacuccagcaaggagggcgcggacaaggccuucaacuccuacgcccaccugagccacucccaggacaucaagagcauccccaagcgggacuccagcaaggaccugcccucccccgacagccgcaacugcccggccgucacccucaccucccccgccaagacgaagauccugcccccgcggaaggggcgcggccugaagcucgaggcgaucgugcagaagaucaccagccccaacauccggcgcuccgccagcuccaacagcgccgaggccgggggcgacaccgugacccuggacgacauccugagccucaaguccgggccgcccgagggcggcagcgucgccgugcaggacgcggacaucgagaagcggaagggggagguggccuccgaccuggucagcccggccaaccaggagcugcacguggagaagccccucccccgcuccagcgaggaguggcggggcuccguggacgacaaggucaagacggagacccacgccgagaccgugaccgccgggaaggagcccccgggcgcgaugacgagcaccaccucccagaagcccggcagcaaccaggggcgccccgacggcucccugggcggcaccgcgccccugaucuucccggacagcaagaacgugccgcccgucgggauccucgcccccgaggccaacccgaaggcggaggagaaggagaacgacacggugaccaucucccccaagcaggagggcuucccgcccaagggcuacuuccccagcgggaagaagaagggccggcccaucggguccgugaacaagcagaagaagcagcagcagccgccgccgcccccgccccagccgccccagauccccgagggcagcgccgacggggagcccaagcccaagaagcagcgccagcggcgcgagcggcgcaagcccggcgcccagccccgcaagcggaagaccaagcaggccguccccaucguggagccccaggagcccgagaucaagcugaaguacgccacccagccccuggacaagacggacgcgaagaacaaguccuucuacccguacauccacguggucaacaagugcgagcucggcgccgugugcaccaucaucaacgccgaggaggaggagcagaccaagcuggugcgcgggcggaagggccagcgcagccugacgccgccgcccuccagcacggagagcaaggcccucccggccuccagcuucaugcugcaggggcccgucgugaccgaguccagcgugaugggccaccuggucugcugccucugcggcaagugggcguccuaccggaacaugggggaccuguucggccccuucuacccccaggacuacgccgccacccugccgaagaacccgccgcccaagcgcgccaccgagaugcagagcaaggugaaggugcggcacaaguccgccagcaacggguccaagacggacaccgaggaggaggaggagcagcagcagcagcagaaggagcagcgcagccucgcggcccacccgcgguucaagcgccggcaccgcuccgaggacugcggcgggggcccccggagccugucccgcggccugcccugcaagaaggccgccaccgaggggagcuccgagaagaccguccucgacagcaagcccuccgugccgaccacgagcgagggcgggcccgagcuggagcugcagauccccgagcucccgcuggacuccaacgaguucugggugcacgagggcugcauccugugggcgaacgggaucuaccucgucugcggccggcuguacggccugcaggaggcccucgagaucgcccgcgagaugaagugcagccacugccaggaggccggggccacccugggcugcuacaacaaggggugcagcuuccgguaccacuaccccugcgcgaucgacgccgacugccugcuccacgaggagaacuucuccgugcgcugccccaagcacaagcccccgcugcccugcccccugcccccgcuccagaacaagaccgccaagggcagccuguccaccgagcagagcgagcggggguga

SEQ ID NO: 37509 - RNA, 540 nt, Artificial Sequence
  derived and/or modified sequence opt1 from TCF21__Homo_sapiens__NP_003197
augagcaccggcucccugagcgacguggaggaccuccaggaggucgagaugcuggagugcgacgggcugaagauggacuccaacaaggaguucgugaccagcaacgaguccacggaggagagcuccaacugcgagaacggcagcccccagaaggggcgcggcgggcucggcaagcggcgcaaggccccgaccaagaaguccccccugagcggcgugucccaggaggggaagcagguccagcggaacgccgcgaacgcccgcgagcgggcccgcaugcgggugcugagcaaggccuucucccgccucaagaccacccugcccugggugcccccggacacgaagcugagcaagcucgacacccugcggcuggccuccagcuacaucgcgcaccuccgccagauccuggccaacgacaaguacgagaacggcuacauccaccccgucaaccugaccuggcccuucaugguggccgggaagcccgaguccgaccucaaggagguggucaccgccagccggcugugcggcacgaccgcguccuga

SEQ ID NO: 37510 - RNA, 2031 nt, Artificial Sequence
  derived and/or modified sequence opt1 from TCF25__Homo_sapiens__NP_055787
augagccgccgggcccugcgccggcuccgcggcgagcagcgggggcaggagccccugggcccgggggcccugcacuucgaccuccgcgacgacgacgacgcggaggaggagggccccaagcgggagcugggggugcgccggcccggcggcgccgggaaggagggcguccgcgugaacaaccgguucgagcugaucaacaucgacgaccucgaggacgaccccguggucaacggggagcgcuccggcugcgcccugaccgacgccguggccccggggaacaagggccggggccagcgcgggaacaccgagagcaagacggacggcgacgacaccgagaccgugcccuccgagcagagccacgcguccgggaagcugcggaagaagaagaagaagcagaagaacaagaaguccagcaccggcgaggccagcgagaacggccucgaggacaucgaccgcauccuggagcggaucgaggacuccacggggcugaaccgccccggccccgccccgcucagcucccggaagcacguccuguacguggagcaccgccaccugaaccccgacaccgagcucaagcgguacuucggggcccgcgcgauccugggcgagcagcgcccccggcagcgccagcggguguaccccaagugcaccuggcugaccacgcccaagagcaccuggccccgcuacuccaagcccgggcucagcaugcggcugcuggaguccaagaagggccucagcuucuucgccuucgagcacuccgaggaguaccagcaggcccagcacaaguuccuggucgccguggagagcauggagcccaacaacaucgugguccugcuccagaccuccccguaccacguggacagccugcugcagcucagcgacgccugccgcuuccaggaggaccaggagauggcgcgggaccugguggagcgcgcccuguacuccauggagugcgccuuccacccccucuucagccugaccuccggcgccugccggcuggacuaccgccggcccgagaaccgcagcuucuaccucgcccuguacaagcagauguccuuccuggagaagcgggggugcccccgcacggcgcucgaguacugcaagcugauccugagccucgagccggacgaggacccccugugcaugcugcuccugaucgaccaccuggcccuccgggcccgcaacuacgaguaccugauccggcuguuccaggagugggaggcccaccgcaaccucucccagcugcccaacuucgccuucagcgucccccuggcguacuuccugcucucccagcagaccgaccugccggagugcgagcagagcuccgcccggcagaaggccagccugcucauccagcaggcccugaccauguuccccggcgugcugcucccccugcuggaguccugcagcgugcgccccgacgccuccgucagcucccaccgcuucuucgggccgaacgcggagaucagccagccgcccgcccucucccagcuggugaaccuguaccucggccggagccacuuccuguggaaggagccggccaccaugagcuggcuggaggagaacgugcacgagguccuccaggccguggacgcgggggaccccgccguggaggccugcgagaaccgccggaagguccuguaccagcgcgcgccccggaacauccaccgccacgugauccuguccgagaucaaggaggccgucgccgcccugcccccggacgugacgacccagagcgugaugggcuucgacccccucccgcccuccgacaccaucuacagcuacguccggcccgagcgccugucccccaucagccacggcaacaccaucgcccucuucuuccggucccugcugcccaacuacacgauggagggggagcgccccgaggagggcguggccgggggccucaaccggaaccaggggcugaaccgccugaugcucgccgugcgggacaugauggcgaacuuccaccugaacgaccuggaggccccgcacgaggacgacgccgagggcgagggcgagugggacuga

SEQ ID NO: 37511 - RNA, 1956 nt, Artificial Sequence
  derived and/or modified sequence opt1 from TCF3__Homo_sapiens__NP_001129611
augaaccagccccagcgcauggccccggugggcaccgacaaggagcugagcgaccuccuggacuucuccaugauguucccccugcccgucaccaacgggaagggccggcccgccagccucgccggggcccaguucggcggguccggccuggaggaccgcccgagcuccggcagcuggggguccggcgaccagagcuccagcuccuucgaccccagccggacguucuccgaggggacccacuucaccgagagccacuccagccuguccagcuccaccuuccucggccccgggcugggcggcaagagcggggagcgcggcgccuacgccagcuucgggcgggacgccggcgugggcgggcugacgcaggcgggcuuccucuccggggagcuggcccugaacagccccggcccgcucucccccagcgggaugaagggcaccucccaguacuaccccagcuacuccggcagcucccgccggcgcgccgccgacgggagccuggacacccagcccaagaaggugcggaaggucccgcccggccugcccuccagcguguacccgcccuccagcggggaggacuacggccgcgacgcgaccgccuaccccuccgccaagacgcccagcuccaccuaccccgccccguucuacguggccgacgggagccuccaccccuccgcggagcuguggagcccgcccggccaggccggcuucgggcccaugcugggcgggggcagcagcccccucccccugcccccgggguccggccccgucggcuccagcggguccagcuccaccuucggcgggcugcaccagcacgagcggaugggcuaccagcuccacggcgccgaggugaacgggggccugcccagcgccuccagcuucuccagcgccccgggggcgaccuacggcgggguguccagccacacgccgcccgucuccggcgccgacagccugcucggcucccgcgggaccaccgccggcagcagcggggacgcccugggcaaggcccuggcguccaucuacagccccgaccacuccagcaacaacuucuccagcucccccagcacccccguggggagcccccagggccucgccggcacgucccaguggccccgggccggggccccgggcgcccugucccccagcuacgacgggggccugcacgggcuccaguccaagaucgaggaccaccuggacgaggcgauccacgugcugcgcagccacgccgucggcaccgccggcgacaugcacacccuccugcccgggcacggcgcccuggcguccggguucaccggccccaugagccucgggggccggcacgccggccuggucgggggcucccacccggaggacgggcuggccggcagcacgucccucaugcacaaccacgccgcccugcccagccagcccggcacccugcccgaccucagccgcccgcccgacuccuacagcgggcugggccgggcgggggccaccgccgccgccuccgagaucaagcgcgaggagaaggaggacgaggagaacaccagcgcggccgaccacuccgaggaggagaagaaggagcugaaggcgccccgggcccgcacgagcuccaccgacgaggugcucagccuggaggagaaggaccugcgggaccgcgagcgccggauggccaacaacgcccgcgagcgggugcgcgugcgggacaucaacgaggccuuccgcgagcucggccggaugugccagaugcaccugaaguccgacaaggcccagaccaagcugcugauccuccagcaggccgugcaggucauccuggggcuggagcagcagguccgcgagcggaaccucaaccccaaggcggccugccugaagcgccgggaggaggagaaggugagcggcguggugggcgacccgcagauggugcuguccgcgccccaccccgggcucagcgaggcccacaaccccgccggccacauguga

SEQ ID NO: 37512 - RNA, 2322 nt, Artificial Sequence
  derived and/or modified sequence opt1 from TCF4__Homo_sapiens__NP_001230155
auguucagcaagcgccuggagaagaucccccaggugccgcuccuguuccccuucaucuucaucauccugaccaacuacuccaagauggagggcgccgucgagagccagcccuccuucuucaagaccagccaggacaucgugacgugcaccuggguggagaacugcuacuccagcuucucccggcgcccccucgagcagauguucugcaagcaccagagcaagaacaucaucuccuggaccgggauggucgcccacacgugcaacccgagcacccugggcgggcagggccugugcgacuucgcgaagaugcaccaccagcagcggauggccgcccucgggaccgacaaggagcuguccgaccugcucgacuucagcgccauguucuccccgcccgugagcuccggcaagaacggccccaccagccuggccuccgggcacuucaccggcagcaacguggaggaccgcuccagcagcggguccuggggcaacgggggccaccccagccccucccggaacuacggcgacgggacgcccuacgaccacaugaccagccgcgaccugggcucccacgacaaccucagcccgcccuucgucaacucccggauccagagcaagaccgagcgcggguccuacagcuccuacggccgggagagcaaccugcagggcugccaccagcagucccugcucgggggcgacauggacauggggaaccccggcacccugagccccacgaagcccgggucccaguacuaccaguacagcuccaacaacccgcgccggcgcccccugcacagcuccgcgauggaggugcagaccaagaaggugcggaaggucccgcccggccuccccagcagcguguacgcccccuccgccagcaccgccgacuacaaccgcgacucccccggcuaccccagcuccaagccggcgaccagcacguuccccuccagcuucuucaugcaggacgggcaccacuccagcgaccccugguccagcuccagcggcaugaaccagcccggguacgccggcaugcuggggaacuccagccacaucccgcaguccagcagcuacugcucccugcacccccacgagcggcucagcuaccccucccacagcuccgccgacaucaacagcucccugccgcccaugagcaccuuccaccgcuccggcaccaaccacuacagcaccuccagcugcacgccgcccgccaacggcaccgacuccaucauggccaaccgggggagcggcgcggccggguccagccagaccggcgacgcccuggggaaggcccucgccuccaucuacagccccgaccacaccaacaacuccuucagcagcaaccccuccacgcccgugggcagcccgcccucccugagcgcgggcaccgccgucuggucccgcaacgggggccaggccagcuccagccccaacuacgaggggccccugcacucccuccagagccggaucgaggaccgccuggagcggcuggacgacgccauccacgugcuccgcaaccacgccgugggccccuccaccgcgaugccgggcgggcacggcgacaugcacgggaucaucggccccagccacaacggggccaugggcggccugggguccggcuacgggaccggccugcucagcgccaaccgccacucccugauggucgggacgcaccgggaggacggcguggcccugcgcggcagccacucccuccugcccaaccaggugcccgucccgcagcugcccgugcagagcgccaccucccccgaccucaacccgccccaggaccccuaccgggggaugccgcccggccugcaggggcagagcgugagcuccggcagcuccgagaucaagagcgacgacgagggggacgagaaccugcaggacaccaaguccagcgaggacaagaagcucgacgacgacaagaaggacaucaaguccaucacccgcagccgguccagcaacaacgacgacgaggaccugacgcccgagcagaaggcggagcgcgagaaggagcggcgcauggccaacaacgcccgggagcgccugcggguccgcgacaucaacgaggccuucaaggagcucggccggauggugcagcugcaccugaaguccgacaagccccagaccaagcuccugauccugcaccaggcgguggccgucauccugagccucgagcagcagguccgcgagcggaaccugaaccccaaggccgccugccugaagcgccgggaggaggagaagguguccagcgagccgccgccccucucccuggccggcccccaccccgggaugggcgacgcgagcaaccacauggggcagauguga

SEQ ID NO: 37513 - RNA, 810 nt, Artificial Sequence
  derived and/or modified sequence opt1 from TCF7__Homo_sapiens__NP_001128323
auguacaaggagaccguguacagcgccuucaaccugcucaugcacuacccgccgcccuccggcgccgggcagcacccccagccccagccgccccugcacaaggcgaaccagccgccccacggcgucccccagcugagccucuacgagcacuucaacagcccccaccccacccccgccccggccgacaucucccagaagcagguccaccgcccccugcagacgcccgaccuguccggguucuacagccucaccuccggcagcauggggcagcugccccacaccguguccugguucacccaccccagccugaugcucggcuccggcgugcccgggcaccccgccgccaucccccacccggcgaucgugccgcccagcggcaagcaggagcugcagcccuucgaccggaaccugaagacgcaggccgaguccaaggccgagaaggaggccaagaagcccaccaucaagaagccccucaacgcguucaugcuguacaugaaggagaugcgcgccaaggugaucgccgagugcacccugaaggagagcgccgccaucaaccagauccucgggcggcgcuggcacgcgcugucccgggaggagcaggccaaguacuacgagcuggcccgcaaggagcggcagcuccacaugcagcuguaccccggcuggagcgcccgcgacaacuacgggaagaagaagcggcgcucccgggagaagcaccaggagagcaccacggagaccaacuggccccgcgagcugaaggacggcaacggccaggagucccucagcaugagcuccagcuccagcccggccuga

SEQ ID NO: 37514 - RNA, 1767 nt, Artificial Sequence
  derived and/or modified sequence opt1 from TCF7L1__Homo_sapiens__NP_112573
augccccagcugggcgggggcgggggcgggggcggcgggggcagcgggggcgggggcggcuccagcgccggggccgcgggcgggggcgacgaccucggcgccaacgacgagcugaucccguuccaggacgagggcggggaggagcaggagcccuccagcgacuccgccagcgcccagcgcgaccuggacgaggugaaguccagccucgucaacgaguccgagaaccagagcuccagcuccgacagcgaggccgagcggcgcccccagcccgugcgggacaccuuccagaagccgcgcgacuacuucgcggaggugcggcgcccccaggacuccgccuucuucaaggggccgcccuaccccggcuaccccuuccugaugauccccgaccugagcucccccuaccucagcaacgggccgcugucccccggcggcgcccggaccuaccugcagaugaaguggccccuccuggacguccccagcagcgccacggugaaggacacccgcuccccgagccccgcgcaccuguccaacaaggugcccgucgugcagcacccccaccacaugcacccgcucacgccccugaucaccuacagcaacgaccacuucucccccgggagcccgcccacccaccugucccccgagaucgaccccaagaccggcaucccccggccgccccaccccagcgagcucuccccguacuacccccugagccccggggccgugggccagaucccccacccgcugggguggcucgucccccagcagggccagcccauguacucccugcccccgggcggguuccgccaccccuaccccgcccuggccaugaacgccagcauguccagccucguguccagccgguucagcccccacaugguggcgccggcccaccccggccugcccaccuccgggaucccccacccggccaucgucucccccaucgugaagcaggagcccgcgcccccgagccugagccccgccguguccgucaagagccccgugaccgugaagaaggaggaggagaagaagccccacgucaagaagccgcucaacgccuucaugcuguacaugaaggagaugcgcgccaaggugguggccgagugcacgcugaaggaguccgccgccaucaaccagauccucggccggaaguggcacaaccugagccgcgaggagcaggcgaaguacuacgagcuggcccggaaggagcgccagcuccacucccagcuguaccccaccuggagcgcccgggacaacuacgggaagaagaagaagcgcaagcgggagaagcagcugucccagacccagagccagcagcagguccaggaggccgagggcgcccucgcguccaagagcaagaagcccugcgugcaguaccugccgcccgagaagcccugcgacucccccgccagcucccacggcagcaugcuggacuccccggccacccccagcgccgcgcucgccucccccgccgcccccgccgcgacgcacagcgagcaggcccagccgcugagccugaccaccaagcccgagacccgcgcccagcucgcccugcacuccgccgcguuccugagcgccaaggccgccgccuccagcuccgggcagaugggcagccagccgccccuccugucccggccccugccccucgggagcaugcccacggcgcugcuggccuccccgcccagcuuccccgccacccuccacgcccaccaggcgcugcccgugcugcaggcccagccccugucccucgucaccaagagcgcccacuga

SEQ ID NO: 37515 - RNA, 1809 nt, Artificial Sequence
  derived and/or modified sequence opt1 from TCF7L2__Homo_sapiens__NP_001139746
augccccagcugaacggcgggggcggggacgaccucggcgccaacgacgagcugaucagcuucaaggacgagggggagcaggaggagaaguccagcgagaacuccagcgccgagcgcgaccuggcggacgugaaguccagccucgucaacgaguccgagaccaaccagaacagcuccagcgacuccgaggccgagcggcggcccccgccccgcagcgaguccuuccgcgacaagagccgggagucccuggaggaggccgccaagcgccaggacggcggccuguucaaggggccgcccuaccccggcuaccccuucaucaugauccccgaccucaccagccccuaccugcccaacgggucccugagccccacggcccggacccuccacuuccaguccggcagcacccacuacagcgcguacaagaccaucgagcaccagaucgccgugcaguaccugcagaugaaguggccccugcucgacgugcaggccgggucccugcagagccgccaggcccugaaggacgcgcgguccccgagccccgcccacaucgucuccaacaaggugcccgugguccagcacccccaccacgugcacccgcucacgccccugaucaccuacagcaacgagcacuucacccccggcaacccgccgccccaccuccccgccgacguggaccccaagaccggcaucccccgcccgccccacccgcccgacaucucccccuacuacccccugagccccgggacggucggccagaucccccacccccugggguggcuggugccccagcagggccagccgguguaccccaucaccaccggcggguuccggcaccccuaccccaccgcccucacggucaacgccuccaugagccgcuucccgccccacauggugccgccccaccacacccugcacaccaccggcaucccccaccccgcgaucgugacgcccaccgucaagcaggaguccagccaguccgacguggggagccugcacuccagcaagcaccaggacuccaagaaggaggaggagaagaagaagccccacaucaagaagccgcucaacgccuucaugcuguacaugaaggagaugcgggccaagguggucgccgagugcacccugaaggagagcgccgcgaucaaccagauccucggccgccgguggcacgcccugucccgcgaggagcaggccaaguacuacgagcuggcccggaaggagcgccagcuccacaugcagcuguaccccggguggagcgcccgggacaacuacggcaagaagaagaagcgcaagcgggacaagcagcccggcgagaccaacgacgcgaacacgcccaagaagugccgcgcccuguucgggcucgaccgccagacccuguggugcaagccgugccggcgcaagaagaagugcgugcgguacauccagggcgaggggagcugccuguccccgcccagcuccgacggcagccuccuggacuccccgccgcccagccccaaccugcucggguccccgccccgcgacgccaagagccagaccgagcagacccagccccugucccugagccucaagcccgacccccuggcccaccuguccaugaugcccccgccgcccgcccuccugcuggcggaggccacgcacaaggccagcgcccucugccccaacggcgcgcuggaccugccgcccgccgcccugcagcccgccgcccccuccagcuccaucgcgcagcccagcaccuccagccuccacagccacuccagccuggccggcacccagccccagccccugucccucgugaccaagagccuggaguga

SEQ ID NO: 37516 - RNA, 1503 nt, Artificial Sequence
  derived and/or modified sequence opt1 from TCFL5__Homo_sapiens__NP_006593
augagcggccccgggccgcgcgagcccccgcccgaggccggcgccgccgggggcgaggcggccguggagggggccggcggcggggacgccgcgcugggcgagcccgggcucuccuucaccaccacggaccugagccuggucgagaugaccgagguggaguacacccagcuccagcacauccugugcucccacauggaggccgccgccgacggcgagcuggagacccggcucaacagcgcgcugcuggccgccgccgggcccggcgccggcgccgggggcuucgcggccgggggccagggcggggccgcccccguguaccccguccucugcccguccgcgcuggccgccgacgcccccugccugggccacaucgacuuccaggagcuccgcaugaugcugcugagcgaggccggggcggccgagaagacguccggcgggggcgacggcgcccgggcccgcgccgacggggcggccaaggagggcgccggggccgcggccgccgccgccggccccgacggggcgcccgaggcccgggccaagccggccgugcgcgugcggcucgaggaccgcuucaacagcauccccgccgagcccccgcccgcgccccggggccccgagcccccggagcccggcggggcccugaacaaccuggucacccucauccgccaccccuccgagcugaugaacgugccccugcagcagcagaacaagugcaccgcccucgugaagaacaagaccgccgccacgaccaccgcgcugcaguucaccuacccgcuguucacgaccaacgccugcagcaccuccggcaacagcaaccucucccagacccagagcuccagcaacuccugcagcguccuggaggccgccaagcaccaggacaucgggcugccccgggcguucuccuucugcuaccagcaggagaucgagagcacgaagcagacccucggcagccgcaacaaggugcugcccgagcaggucuggaucaaggugggggaggccgcccugugcaagcaggcccucaagcggaaccgcucccggaugcgccagcuggacaccaacguggagcggcgcgcccugggcgagauccagaacgugggcgagggggcgaccgccacgcagggcgccuggcagagcuccgagagcucccaggccaaccucggggagcaggcccagagcggcccccagggcgggcggucccagcgccgggagcgccacaaccgcauggagcgggaccgccggcgccggauccgcaucugcugcgacgagcugaaccugcucgucccguucugcaacgcggagaccgacaaggccaccacccugcaguggacgaccgccuuccugaaguacauccaggagcggcacggcgacagccucaagaaggaguucgaguccguguucugcgggaagaccggccgccggcugaagcugacccgccccgacagccucgugacgugccccgcccaggggucccugcagagcuccccgagcauggagaucaaguga

SEQ ID NO: 37517 - RNA, 5832 nt, Artificial Sequence
  derived and/or modified sequence opt1 from TCHH__Homo_sapiens__NP_009044
augagcccccugcuccgcagcaucugcgacaucaccgagaucuucaaccaguacgugagccacgacugcgacggcgccgcccugaccaagaaggaccugaagaaccuccuggagcgggaguucggggcggugcugcgccggccgcacgaccccaagacgguggaccucauccuggagcugcucgaccuggacuccaacggccgcguggacuucaacgaguuccuccuguucaucuucaaggucgcccaggccugcuacuacgcccuggggcaggccaccggccuggacgaggagaagcgggcgcgcugcgacgggaaggagagccuccugcaggaccggcgccaggaggaggaccagcggcgcuucgagccccgggaccgccagcuggaggaggagcccggccagcggcgccggcagaagcgccaggagcaggagcgggagcucgccgagggcgaggagcaguccgagaagcaggagcgccuggagcagcgggaccgccagcggcgcgacgaggagcuguggcgccagcggcaggaguggcaggagcgcgaggagcggcgcgccgaggaggagcagcuccagagcugcaaggggcacgagaccgaggaguuccccgacgaggagcagcugcggcgccgggagcugcucgagcugcgccggaagggccgcgaggagaagcagcagcagcggcgcgagcggcaggaccgcguguuccaggaggaggaggagaaggaguggcggaagcgcgagaccgugcugcggaaggaggaggagaagcuccaggaggaggagccccagcgccagcgggagcugcaggaggaggaggagcagcugcgcaagcucgagcgccaggagcugcggcgcgagcggcaggaggaggagcagcagcagcagcgccugcggcgcgagcagcagcuccggcgcaagcaggaggaggagcggcgcgagcagcaggaggagcggcgcgagcagcaggagcggcgcgagcagcaggaggagcggcgcgagcagcagcugcggcgcgagcaggaggagcggcgcgagcagcagcugcggcgcgagcaggaggaggagcgccgggagcagcagcuccgccgggagcaggaggaggagcgccgggagcagcagcugcgccgggagcagcagcugcgccgggagcagcagcuccgccgggagcagcagcugcgccgggagcagcagcugcgccgggagcagcagcuccgccgggagcagcagcugcgccgggagcagcagcugcgccgcgagcagcagcuccggcgcgagcaggaggaggagcggcacgagcagaagcacgagcaggagcgccgggagcagcgccugaagcgggagcaggaggagcgccgggacuggcugaagcgcgaggaggagacggagcggcacgagcaggagcgccggaagcagcagcucaagcgcgaccaggaggaggagcggcgcgagcgguggcugaagcuggaggaggaggagcgccgggagcagcaggagcgccgggagcagcagcugcgccgcgagcaggaggagcggcgcgagcagcggcucaagcgccaggaggaggaggagcggcugcagcagcgccugcgguccgagcagcagcuccgccgggagcaggaggagcgccgggagcagcugcugaagcgcgaggaggagaagcggcucgagcaggagcgccgggagcagcgccugaagcgggagcaggaggagcgccgggaccagcugcucaagcgcgaggaggagcgccggcagcagcgccugaagcgggagcaggaggagcgccuggagcagcggcucaagcgcgaggaggucgagcggcuggagcaggaggagcgccgggagcagcgccugaagcgggaggagcccgaggaggagcgccggcagcagcuccugaaguccgaggagcaggaggagcgccggcagcagcagcugcgccgggagcagcaggagcgccgggagcagcgccucaagcgggaggaggaggaggagcgccuggagcagcgccugaagcgggagcacgaggaggagcgccgggagcaggagcucgccgaggaggagcaggagcaggcgcgcgagcggaucaagucccgcauccccaaguggcaguggcagcuggagagcgaggccgacgcccggcaguccaagguguacagccgcccgcggaagcaggaggggcagcgccggcgccaggagcaggaggagaagcggcgccggcgcgaguccgagcugcaguggcaggaggaggagcgggcccaccgccagcagcaggaggaggagcagcggcgcgacuucaccuggcaguggcaggccgaggagaaguccgagcgcggccggcagcgccucuccgcgcggccgccccugcgcgagcagcgggagcgccagcugcgggccgaggagcgccagcagcgggagcagcgcuuccuccccgaggaggaggagaaggagcagcggcgccggcagcgccgggagcgcgagaaggagcugcaguuccuggaggaggaggagcagcuccagcggcgcgagcgggcccagcagcugcaggaggaggaggacgggcugcaggaggaccaggagcgccggcgcagccaggagcagcgccgggaccagaaguggcgcuggcagcucgaggaggagcggaagcgccggcgccacacccuguacgccaagccggcccugcaggagcagcuccggaaggagcagcagcugcugcaggaggaggaggaggagcuccagcgcgaggagcgggagaagcgccggcgccaggagcaggagcggcaguaccgcgaggaggagcagcugcagcaggaggaggagcagcugcuccgggaggagcgcgagaagcggcgccggcaggagcgcgagcgccaguaccggaaggacaagaagcugcagcagaaggaggagcagcugcucggcgaggagcccgagaagcgccggcgccaggagcgggagaagaaguaccgcgaggaggaggagcugcagcaggaggaggagcagcugcuccgggaggagcgcgagaagcggcgccggcaggagugggagcgccaguaccggaagaaggacgagcugcagcaggaggaggagcagcugcuccgcgaggagcgggagaagcgccggcugcaggagcgcgagcggcaguaccgcgaggaggaggagcugcagcaggaggaggagcagcuccugggcgaggagcgggagacccgccgccggcaggagcuggagcgccaguaccggaaggaggaggagcuccagcaggaggaggagcagcugcugcgcgaggagcccgagaagcggcgccggcaggagcgcgagcggcagugccgcgaggaggaggagcuccagcaggaggaggagcagcugcugcgggaggagcgcgagaagcggcgccggcaggagcucgagcgccaguaccgggaggaggaggaggugcagcaggaggaggagcagcugcugcgcgaggagcccgagaagcggcgccgccaggagcucgagcggcaguaccgcgaggaggaggagcugcagcaggaggaggagcagcugcuccgggaggagcaggagaagcgccggcaggagcgcgagcggcaguaccgcgaggaggaggagcugcagcggcagaagcgcaagcagcgguaccgcgacgaggaccagcgguccgaccugaaguggcagugggagccggagaaggagaacgcgguccgcgacaacaagguguacugcaaggggcgggagaacgagcaguuccgccagcucgaggacagccagcugcgggaccgccagucccagcaggaccugcagcaccuccugggcgagcagcaggagcgggaccgcgagcaggagcggcgccgcuggcagcagcgggaccgccacuuccccgaggaggagcagcuggagcgggaggagcagaaggaggccaagcgccgggaccgcaagagccaggaggagaagcagcuccugcgggaggagcgcgaggagaagcggcgccggcaggagacggaccgcaaguuccgggaggaggagcagcugcuccaggagcgcgaggagcagccccugcggcgccaggagcgggaccgcaaguuccgggaggaggagcugcgccaccaggagcaggggcgcaaguuccucgaggaggagcagcggcugcgccggcaggagcgcgagcggaaguuccugaaggaggagcagcagcuccgcugccaggagcgggagcagcagcugcgccaggaccgggaccgcaaguuccgggaggaggagcagcagcugagccgccaggagcgggaccgcaaguuccgggaggaggagcagcagguccgccggcaggagcgcgagcggaaguuccucgaggaggagcagcagcugcgccaggagcggcaccgcaaguuccgcgaggaggagcagcugcuccaggagcgggaggagcagcagcugcaccgccaggagcgggaccgcaaguuccuggaggaggagcagcagcugcggcgccaggagcgggaccgcaaguuccgggagcaggagcuccgcucccaggagcccgagcggaaguuccuggaggaggagcagcagcugcaccgccagcagcggcagcgcaaguuccuccaggaggagcagcagcugcggcgccaggagcggggccagcagcgccggcaggaccgcgaccgcaaguuccgggaggaggagcagcugcgccaggagcgggaggagcagcagcucagccgccaggagcgggaccgcaaguuccggcuggaggagcagaagguccgccggcaggagcaggagcgcaaguucauggaggacgagcagcagcugcggcgccaggagggccagcagcagcuccggcaggagcgcgaccggaaguuccgcgaggacgagcagcugcugcaggagcgggaggagcagcagcuccaccgccaggagcgggaccgcaaguuccuggaggaggagccgcagcugcggcgccaggagcgcgagcagcagcuccggcacgaccgcgaccggaaguuccgcgaggaggagcagcugcugcaggagggggaggagcagcagcuccggcgccaggagcgggaccgcaaguuccgggaggaggagcagcagcugcgccggcaggagcgcgagcggaaguuccugcaggaggagcagcagcuccgccggcaggagcuggagcgcaaguuccgggaggaggagcagcugcgccaggagaccgagcaggagcagcuccggcgccaggagcgcuaccggaagauccuggaggaggagcagcugcgccccgagcgggaggagcagcagcuccgccggcaggagcgcgaccggaaguuccgcgaggaggagcagcugcggcaggagcgcgaggagcagcagcugcggucccaggagagcgaccgcaaguuccgggaggaggagcagcuccgccaggagcgggaggagcagcagcugcgcccccagcagcgggacggcaaguaccgcugggaggaggagcagcugcagcucgaggagcaggagcagcggcugcgccaggagcgggaccgccaguaccgcgccgaggagcaguucgccacccaggagaagucccggcgcgaggagcaggagcuguggcaggaggaggagcagaagcggcgccaggagcgggagcgcaagcuccgggaggagcacauccgccggcagcagaaggaggagcagcgccaccgccaggugggggagaucaagagccaggagggcaaggggcacggccggcugcuggagcccggcacccaccaguucgccuccgugccgguccggagcagcccccucuacgaguacauccaggagcagcgcagccaguaccggcccuga

SEQ ID NO: 37518 - RNA, 1497 nt, Artificial Sequence
  derived and/or modified sequence opt1 from TCHP__Homo_sapiens__XP_011537139
auggcccugcccacccucccgagcuacuggugcucccagcagcgccugaaccagcagcuggcccggcagcgcgagcaggaggcgcggcuccgccagcagugggagcagaacagccgguacuuccgcauguccgacaucugcagcuccaagcaggccgaguggagcuccaagaccagcuaccagcgguccaugcacgccuaccagcgcgagaagaugaaggaggagaagcggcgcagccuggaggcccggcgcgagaagcugcggcagcucaugcaggaggagcaggaccugcuggcccgcgagcucgaggagcugcggcuguccaugaaccuccaggagcgccggauccgcgagcagcacggcaagcucaagagcgcgaaggaggagcagcggaagcugaucgccgagcagcugcuguacgagcacuggaagaagaacaaccccaagcugcgcgagauggagcucgaccugcaccagaagcacguggucaacuccugggagaugcagaaggaggagaagaagcagcaggaggccacggccgagcaggagaacaagcgguacgagaacgaguacgagcgcgcgcgccgggaggcccuggagcgcaugaaggccgaggaggagcggcgccagcucgaggacaagcugcaggccgaggcccugcuccagcagauggaggagcugaagcugaaggagguggaggcgaccaagcucaagaaggagcaggagaaccugcugaagcagcggugggagcucgagcgccuggaggaggagcggaagcagauggaggccuuccgccagaaggccgagcuggggcgguuccuccgccaccaguacaacgcccagcugagccggcgcacccagcagauccaggaggagcuggaggccgaccggcgcauccuccaggcgcugcuggagaaggaggacgagucccagcggcuccaccuggcccgccgggagcaggucauggccgacguggccuggaugaagcaggccaucgaggagcagcugcagcucgagcgcgcgcgggaggccgagcugcagaugcugcuccgcgaggaggccaaggagaugugggagaagcgcgaggccgagugggcccgggagcgcagcgcgcgggaccgccugauguccgaggugcugaccggccggcagcagcagauccaggagaagaucgagcagaaccgccgggcccaggaggagagccucaagcaccgcgagcagcugauccggaaccuggaggaggugcgcgagcuggcccggcgcgagaaggaggaguccgagaagcucaagagcgcccggaagcaggagcuggaggcgcaggucgccgagcgccggcugcaggccugggaggccgaccagcaggaggaggaggaggaggaggaggcccgccggguggagcagcucagcgacgcgcugcugcagcaggaggccgagacgauggccgagcagggguaccgccccaagcccuacggccacccgaagaucgccuggaacuga

SEQ ID NO: 37519 - RNA, 1845 nt, Artificial Sequence
  derived and/or modified sequence opt1 from TCIRG1__Homo_sapiens__NP_006044
augaccuuccugaucagcuacuggggcgagcagaucgggcagaagauccgcaagaucaccgacugcuuccacugccacguguuccccuuccuccagcaggaggaggcccggcugggcgcccugcagcagcuccagcagcagucccaggagcugcaggagguccugggggagacggagcgcuuccucagccaggugcugggccgggugcugcagcuccugccgcccgggcagguccaggugcacaagaugaaggcgguguaccuggcccucaaccagugcuccgucagcaccacccacaagugccugaucgccgaggccuggugcuccgugcgcgaccugcccgcccuccaggaggcgcugcgggacagcuccauggaggagggcgugagcgccgucgcccaccgcauccccugccgggacaugccgcccacccugauccgcacgaaccgguucaccgccuccuuccagggcaucguggacgcguacggggugggccgcuaccaggaggucaaccccgcccccuacaccaucaucaccuucccguuccucuucgccgugauguucggggacgugggccacgggcugcugauguuccucuucgcccuggccaugguccuggcggagaaccggcccgccgugaaggccgcccagaacgagaucuggcagacguucuuccgcggccgguaccuccugcugcucaugggccuguucagcaucuacaccggguucaucuacaacgagugcuucucccgcgccaccagcaucuuccccuccggcuggagcguggcggccauggccaaccaguccggguggagcgacgccuuccuggcccagcacaccaugcucacgcuggaccccaacgucaccggcguguuccugggcccguaccccuucgggaucgaccccaucuggucccucgcggccaaccaccugagcuuccugaacuccuucaagaugaagaugagcgugauccucggcgucgugcacauggccuucggggugguccugggcguguucaaccacguccacuucgggcagcggcaccgccugcuccuggagacccugcccgagcucaccuuccugcugggccucuucggcuaccugguguuccuggugaucuacaaguggcucugcgucugggccgcccgggcggccagcgccccguccauccugauccacuucaucaacauguuccuguucagccacucccccagcaaccgccugcucuacccccggcaggagguggugcaggccacgcuggucgugcuggcgcucgccauggugcccauccugcugcucgggaccccgcugcaccuccugcaccgccaccggcgccgccugcggcgccggcccgccgaccgccaggaggagaacaaggccggccugcucgaccugcccgacgccuccgucaacggguggagcuccgacgaggagaaggcgggcgggcuggacgacgaggaggaggccgagcucgugcccagcgaggugcugaugcaccaggccauccacaccaucgaguucugccugggcugcgucuccaacaccgccagcuaccuccggcugugggcccugucccucgcgcacgcccagcugagcgaggugcugugggccauggugaugcgcaucggccucgggcugggccgggaggucgggguggccgccgugguccuggugccgaucuucgcggccuucgccgugaugacggucgccauccuccuggugauggagggccuguccgcguuccuccacgcccugcgccugcacuggguggaguuccagaacaaguucuacagcgggaccggcuacaagcucucccccuucaccuucgccgccaccgacgacuga

SEQ ID NO: 37520 - RNA, 345 nt, Artificial Sequence
  derived and/or modified sequence opt1 from TCL1A__Homo_sapiens__NP_001092195
auggccgagugccccacccugggcgaggccgugaccgaccacccggaccgccucugggcgugggagaaguucgucuaccuggacgagaagcagcacgccuggcugccccucacgaucgagaucaaggaccggcugcagcugcgcgugcuccugcggcgcgaggacgugguccuggggcggcccaugacccccacccagaucggcccgagccuccugcccaucauguggcagcuguaccccgacgggcgcuaccgguccagcgacuccagcuucuggcgccucguguaccacaucaagaucgacggcguggaggacaugcugcuggagcuccugcccgacgacuga

SEQ ID NO: 37521 - RNA, 387 nt, Artificial Sequence
  derived and/or modified sequence opt1 from TCL1B__Homo_sapiens__NP_004909
auggccagcgaggccuccgugcgccugggcgugcccccggggcggcucuggauccagcgccccggcaucuacgaggacgaggaggggcggaccugggucaccguggucgugcgcuucaaccccagccggcgcgagugggcgcgggccucccagggcagccgcuacgagcccuccaucacggugcaccuguggcagauggccguccacacccgggagcugcucagcuccgggcagaugccguucagccagcugcccgccguguggcagcuguaccccggccgcaaguaccgggccgcggacuccagcuucugggagaucgccgaccacggccagaucgacuccauggagcagcucgugcugaccuaccagcccgagcgcaaggacuga

SEQ ID NO: 37522 - RNA, 1302 nt, Artificial Sequence
  derived and/or modified sequence opt1 from TCN1__Homo_sapiens__NP_001053
augcgccagagccaccagcugccccucgugggccugcuccucuucuccuucaucccgagccagcugugcgagaucugcgaggucuccgaggagaacuacauccggcugaagccccuccugaacaccaugauccagagcaacuacaaccgcgggaccuccgccgugaacgugguccugagccucaagcuggugggcauccagauccagacccugaugcagaagaugauccagcagaucaaguacaacgugaagucccggcucagcgacgucuccagcggggagcuggcccugaucauccucgcgcugggcgugugccgcaacgccgaggagaaccugaucuacgacuaccaccucaucgacaagcuggagaacaaguuccaggccgagaucgagaacauggaggcccacaacgggacgccccugaccaacuacuaccagcucucccuggacgugcuggcccucugccuguucaacggcaacuacagcaccgcggaggucgugaaccacuucacccccgagaacaagaacuacuacuucggcucccaguucagcguggacaccggggccauggccguccuggcccugaccugcgugaagaagucccugaucaacggccagaucaaggcggacgaggggagccugaagaacaucuccaucuacaccaagagccucguggagaagauccuguccgagaagaaggagaacggccugaucgggaacacguucagcaccggcgaggccaugcaggcccucuucgucagcuccgacuacuacaacgagaacgacuggaacugccagcagacccugaacaccgugcugacggagaucagccagggcgccuucuccaacccgaacgccgcggcccaggugcuccccgcccugauggggaagaccuuccuggacaucaacaaggacagcuccugcgucagcgccuccggcaacuucaacaucagcgccgacgagcccaucaccgugacgcccccggacucccagagcuacaucuccgugaacuacagcguccggaucaacgagaccuacuucaccaacgugaccgugcucaacggguccgucuuccugagcgugauggagaaggcgcagaagaugaacgacaccaucuucggcuucacgauggaggagcgcuccuggggccccuacaucacgugcauccaggggcugugcgccaacaacaacgaccggaccuacugggagcuccugagcggcggggagccccugucccagggcgccgggagcuacgucgugcgcaacggcgagaaccucgaggugcggugguccaaguacuga

SEQ ID NO: 37523 - RNA, 1284 nt, Artificial Sequence
  derived and/or modified sequence opt1 from TCN2__Homo_sapiens__NP_000346
augcgccaccugggcgccuuccucuuccugcugggggugcucggcgcccugaccgagaugugcgagauccccgagauggacagccaccuggucgagaagcucgggcagcaccuccugccguggauggaccggcugucccuggagcaccugaaccccagcaucuacgugggccuccgccuguccagccugcaggcggggaccaaggaggaccucuaccugcacucccugaagcucggcuaccagcagugccugcugggcagcgccuucuccgaggacgacggggacugccagggcaagcccagcauggggcagcucgcccuguaccugcucgcccugcgggccaacugcgaguucgugcgcggccacaagggggaccggcuggucucccagcucaagugguuccuggaggacgagaagcgcgcgaucggccacgaccacaagggccacccccacaccagcuacuaccaguacgggcugggcauccucgcccugugccugcaccagaagcgggugcacgacuccguggucgacaagcuccuguacgccguggagccguuccaccaggggcaccacagcguggacaccgccgcgauggccggccuggccuucacgugccucaagcgcuccaacuucaaccccggccggcgccagcggaucaccauggccauccgcaccguccgggaggagauccugaaggcccagacccccgaggggcacuucggcaacguguacagcacgccccuggcgcuccaguuccugaugaccuccccgaugcgcggggccgagcugggcaccgccugccucaaggcccggguggcccugcuggcgagccuccaggacggggccuuccagaacgcccugaugaucucccagcugcuccccguccugaaccacaagaccuacaucgaccugaucuuccccgacugccuggcgccccgcgugaugcucgagccggccgccgagaccaucccccagacccaggagaucaucagcgugacgcugcagguccugucccuccugccgcccuaccggcagagcaucagcgugcuggccggcuccaccguggaggacguccucaagaaggcccacgagcugggcggguucaccuacgagacccaggccagccuguccggccccuaccucacgagcgugauggggaaggccgcgggcgagcgcgaguucuggcagcugcugcgggaccccaacacgccccuccugcaggggaucgccgacuaccgccccaaggacggcgagaccaucgagcugcggcucguguccugguga

SEQ ID NO: 37524 - RNA, 4236 nt, Artificial Sequence
  derived and/or modified sequence opt1 from TCOF1__Homo_sapiens__NP_000347
auggccgaggcccgcaagcggcgcgagcugcucccccugaucuaccaccaccugcuccgggcgggcuacgugcgcgccgcccgggaggucaaggagcagagcgggcagaagugcuuccuggcccagccggugacccugcucgacaucuacacccacuggcagcagacguccgagcugggccgcaagcggaaggccgaggaggacgcggcccugcaggccaagaagacccgcgugagcgaccccaucuccaccagcgaguccagcgaggaggaggaggaggccgaggcggagaccgccaaggccacgccccggcucgccuccaccaacagcuccguccugggggccgaccugcccagcuccaugaaggagaaggcgaaggccgagaccgagaaggccggcaagaccgggaacagcaugccgcaccccgccacgggcaagaccguggccaaccuccuguccggcaagagcccccgcaaguccgcggagcccagcgccaacaccacccugguguccgagacggaggaggaggggagcgucccggccuucggcgccgccgcgaagcccgggaugguguccgccggccaggccgacagcagcuccgaggacaccagcuccagcuccgacgagaccgacguggaggucaaggccagcgagaagauccuccaggugcgggccgcguccgcccccgccaaggggacccccggcaagggcgccacgccggcgccccccgggaaggccggcgccguggccagccagaccaaggccgggaagcccgaggaggacuccgagagcuccagcgaggaguccagcgacuccgaggaggagaccccggcggccaaggcccugcugcaggccaaggccagcggcaagaccucccaggucggcgcggccagcgcccccgccaaggaguccccccgcaagggggccgcgcccgccccgcccggcaagacggggcccgccguggccaaggcgcaggccggcaagcgggaggaggacagccagagcuccagcgaggaguccgacagcgaggaggaggcccccgcccaggccaagccguccgggaaggcgccccaggugcgcgccgccagcgcccccgccaaggaguccccccggaagggcgcggccccggcccccccccgcaagaccggcccggccgccgcgcagguccagguggggaagcaggaggaggacagccgguccagcuccgaggagagcgacuccgaccgcgaggcccucgccgccaugaacgcggcccaggugaagccccugggcaagagcccccaggucaagcccgccuccaccauggggaugggcccgcuggggaagggcgccggccccgugccccccgggaaggugggcccggccacccccagcgcgcaggucgggaagugggaggaggacuccgagagcagcuccgaggagagcuccgacagcuccgacggcgaggugcccacggccguggcccccgcccaggagaagagccucgggaacauccugcaggccaagccgaccuccagccccgcgaagggccccccccagaaggccggcccggucgccgugcaggucaaggccgagaagcccauggacaacuccgagagcuccgaggagagcuccgacagcgccgacuccgaggaggcgcccgccgccaugaccgccgcccaggcgaagcccgcccugaagaucccgcagaccaaggccugccccaagaagacgaacaccaccgccagcgcgaagguggcccccgugcgggucgggacccaggccccccgcaaggccggcacggccaccuccccggcggggagcucccccgccguggccggcggcacccagcggcccgccgaggacagcagcuccagcgaggaguccgacagcgaggaggagaagaccgggcucgccgugacggucggccaggcgaaguccguggggaagggccugcaggugaaggccgccagcgucccggugaaggggucccugggccagggcaccgcccccgugcuccccgggaagaccggccccaccgucacccaggugaaggccgagaagcaggaggacagcgaguccagcgaggaggaguccgacagcgaggaggcggccgccuccccggcccaggugaagacgagcgucaagaagacccaggcgaaggccaaccccgccgccgcccgcgcgcccuccgccaaggggaccaucagcgcccccggcaagguggugaccgccgccgcgcaggccaagcagcgcuccccgagcaaggucaagccccccgugcggaacccccagaacuccacggugcuggcccgcgggccggccagcguccccagcgugggcaaggccguggcgaccgccgcccaggcccagaccggccccgaggaggacuccgggagcuccgaggaggagagcgacuccgaggaggaggcggagacccuggcccaggucaagcccagcggcaagacgcaccagauccgggccgcccucgccccggcgaaggaguccccccgcaagggggccgcccccacccccccgggcaagaccgggcccagcgccgcccaggcgggcaagcaggacgacuccggcagcuccagcgaggaguccgacagcgacggggaggcccccgccgccgugaccuccgcccaggugaucaagcccccgcugaucuucgucgaccccaaccggagccccgcgggccccgccgccacgccggcccaggcccaggcggccuccaccccccgcaaggcccgggccagcgaguccaccgcgcgcagcagcuccagcgaguccgaggacgaggacgugauccccgccacccagugccugacgccggggauccggaccaacguggucaccaugcccaccgcccacccccgcaucgcccccaaggccagcauggcgggcgccuccagcuccaaggagagcucccggaucagcgacgggaagaagcaggagggcccggccacgcagguguccaagaagaaccccgccagccucccccugacccaggccgcgcugaaggugcucgcccagaaggccuccgaggcccagcccccggucgcccgcacccagcccagcuccggcguggacagcgcgguggggacccugcccgccacguccccccagagcaccuccguccaggccaagggcaccaacaagcugcggaagccgaagcuccccgaggugcagcaggccaccaaggcgcccgagagcagcgacgacuccgaggacagcuccgacagcuccagcggguccgaggaggacggcgagggcccccagggggccaagagcgcccacacgcugggcccgacccccucccgcaccgagacccugguggaggagacggccgccgagagcuccgaggacgacgucguggcgcccagccagucccuccugagcggguacaugacccccggccugaccccggccaacucccaggccagcaaggccacccccaagcucgacuccagccccuccgugagcagcacgcuggccgcgaaggacgaccccgacgggaagcaggaggccaagccgcagcaggccgccggcaugcugucccccaagaccggcgggaaggaggccgcgagcggcaccaccccccagaagucccggaagcccaagaagggggccggcaacccgcaggccagcacccucgcccugcaguccaacaucacgcagugccugcuggggcagcccuggccccucaacgaggcgcagguccaggccagcguggugaagguccugaccgagcugcucgagcaggagcgcaagaaggugguggacaccaccaaggaguccagccggaagggcugggagucccgcaagcggaagcugagcggcgaccagccggccgcccgcacgccccgcuccaagaagaagaagaagcugggggccggcgaggggggcgaggcgagcgucucccccgagaagaccagcaccaccuccaaggggaaggccaagcgggacaaggccagcggcgacgugaaggagaagaagggcaaggggucccucggcagccagggggccaaggacgagcccgaggaggagcugcagaagggcaugggcacgguggaggggggcgaccagagcaacccgaaguccaagaaggagaagaagaagagcgacaagcgcaagaaggacaaggagaagaaggagaagaagaagaaggccaagaaggcguccaccaaggacagcgagucccccagccagaagaagaagaagaagaagaagaagaccgccgagcagaccgucuga

SEQ ID NO: 37525 - RNA, 981 nt, Artificial Sequence
  derived and/or modified sequence opt1 from TCP10__Homo_sapiens__NP_004601
auggagaagacccccgccgccgcggaggugccgcgcgaggacagcaacgccggcgagaugcccucccugcagcagcagaucaccagccuccaccaggagcuggggcggcagcagucccugugggccgacauccaccgcaagcuccagagccacauggacgcccugcggaagcagaaccgcgagcugcgggaggagcuccgcggccugcagcggcagcagugggaggccgggaagaagcccgcggccagcccccacgccggccgcgagucccacacgcuggcccucgagccggcguucgggaagaucucccaccugagcgccgacgaggacaccacccccaaguacgccggccggaagucccagagcgccacccugcucggccagcgcugguccagcaaccaccuggccccgcccaagcccaugucccugaagacggagcggaucaacagcgggaagaccccgccccaggaggaccgcgagaaguccccgcccggccggcgccaggaccggagccccgcgcccaccgggcgccccacccccggcgccgagcggcgcggggucuccgaggacggcaagaucaugcaccccagcucccggagcccccagaacagcggcgggcgcaagucccccgugcaggccagccaggccacgacccuccaggagcagaccgccgcggcccggggcgccgaccgcuccagcuccgugcuggggagcuccgagggcggcuuccugagccgcguccaggccgacgaguucgccuccagcgcgccggacuccgccgagcggcagaaccuccccgugaacccgcccagcucccuggagaucgcccaggccauggacaccaagaugaagaaggaggaggugcaggaggagaagcgccaccccaaggggaaggccgacgacugccggcgcagcggcuuccccuccgaguuccccggggcgcugcacgccgcccccagccggcaggacaugggcccguga

SEQ ID NO: 37526 - RNA, 1062 nt, Artificial Sequence
  derived and/or modified sequence opt1 from TCP10L2__Homo_sapiens__NP_001138593
augcuggagggccagcucgaggcccgcgagcccaaggaggggacccacccggaggaccccugccccggcgccggggcggccauggagaagacccccgccgccgccgaggugccgcgggaggacagcaacgcgggcgagaugcccucccugcagcagcagaucacgagccugcaccaggagcucgggcgccagcagucccugugggccgacauccaccggaagcugcagagccacauggacgcccuccgcaagcagaaccgggagcugcgcgaggagcugcggggccuccagcgccagcagugggaggccggcaagaagcccgcggccagcccccacgccgggcgggagucccacacccuggcccuggagccggccuucggcaagaucagcccccucuccgcggacgaggagaccacccccaaguacgccgggcgcaagucccagagcgccacgcugcugggccagcggugguccagcaaccaccucgcgccgcccaagcccaugucccugaagaccgagcgcaucaacagcgggaagaccccgccccaggaggaccgggagaaguccccgcccggccgccggcaggaccgcagccccgcccccaccggccggcccacgcccggggccgagcgccgggaggucuccgaggacggcaagaucaugcaccccagcucccgcagccugcagaacagcgggggccggaagucccccgugcaggccagccaggccgccacccuccaggagcagaccgccgcggccggcguggccgaccgcuccagcuccguccuggggagcuccgagggcggguuccugagccgcgugcaggccgaggaguucgccuccagcuccccggacagcgcggagcggcagaaccuccccgugaacccgcccuccagccuggagaucgcccaggccauggacaccaagaugaagaaggaggagguccaggaggagaagcgccaccccaacggcaaggccgacgacugccggcgcuccggguuccccagcgaguuccccggcgcgcugcacgccgccccgucccggcaggacaugggccccuga

SEQ ID NO: 37527 - RNA, 1530 nt, Artificial Sequence
  derived and/or modified sequence opt1 from TCP11L1__Homo_sapiens__NP_060863
augagcgagaaccuggacaaguccaacgugaacgaggccggcaagagcaaguccaacgacagcgaggaggggcucgaggacgccgucgagggcgcggacgaggcccugcagaaggccaucaaguccgacagcuccagcccccagcgcgugcagcggccgcacuccagcccgccccgcuucgugaccgucgaggagcugcucgagaccgcccgcggggugacgaacauggcccuggcgcacgagaucguggucaacggcgacuuccagaucaagcccguggagcugccggagaacucccucaagaagcgggugaaggagaucguccacaaggccuucugggacugccugagcgugcagcuguccgaggacccgcccgccuacgaccacgccaucaagcucgugggggagaucaaggagacccugcugagcuuccuccugcccggccacacccggcugcgcaaccagaucaccgagguccucgaccuggaccugaucaagcaggaggcggagaacggcgcccucgacaucuccaagcuggccgaguucaucaucgggaugaugggcacgcugugcgcccccgcccgggacgaggaggugaagaagcucaaggacaucaaggagaucgugccccuguuccgcgagaucuucagcguccuggaccucaugaagguggacauggcgaacuucgccaucuccagcauccggccccaccugaugcagcaguccguggaguacgagcgcaagaaguuccaggagauccuggagcggcagcccaacagccucgacuucgucacccaguggcuggaggaggccagcgaggaccugaugacccagaaguacaagcacgcccucccggucgggggcauggccgcgggguccggcgacaugccccgccugagccccguggccgugcagaacuacgccuaccugaagcuccugaagugggaccaccuccagcggcccuucccggagaccgugcugauggaccagucccgcuuccacgagcugcagcugcagcucgagcagcugacgauccugggcgccgugcuccuggucaccuucagcauggccgcgcccgggaucuccagccaggccgacuucgccgagaagcugaagaugaucgugaagauccuccugaccgacaugcaccuccccuccuuccaccugaaggacguccugaccacgaucggcgagaaggugugccuggaggugagcuccugccugagccucugcggguccagccccuucaccaccgacaaggagaccguccugaagggccagauccaggccguggccuccccggacgaccccauccggcgcaucauggagagccggauccugacguuccucgagaccuaccuggcguccggccaccagaagccccugcccaccgugcccgggggccucagccccguccagcgcgagcuggaggagguggccaucaaguucgcccggcuggugaacuacaacaagauggucuucugccccuacuacgacgccauccucuccaagauccuggugcgcagcuga

SEQ ID NO: 37528 - RNA, 1206 nt, Artificial Sequence
  derived and/or modified sequence opt1 from TCP1__Homo_sapiens__NP_001008897
augagcuccaagaucaucggcaucaacggggacuucuucgccaacaugguggucgacgccgugcuggcgaucaaguacaccgacauccgcggccagccccgguacccggugaacagcgucaacauccucaaggcccacgggcgcucccagauggagagcaugcugaucuccggcuacgcccugaacugcgugguggggagccagggcaugcccaagcggaucgucaacgccaagaucgccugccucgacuucucccugcagaagaccaagaugaagcugggcguccagguggugaucacggaccccgagaagcucgaccagauccgccagcgggagagcgacaucaccaaggagcgcauccagaagauccuggcgaccggggccaacgugauccugaccacgggcgggaucgacgacaugugccucaaguacuucguggaggccggcgccauggcgguccggcgcgugcugaagcgggaccugaagcgcaucgccaaggccuccggggccaccauccucagcacccuggccaaccuggagggcgaggagaccuucgaggcggccaugcucggccaggccgaggaggugguccaggagcggaucugcgacgacgagcugauccugaucaagaacacgaaggcccgcaccuccgccagcaucauccuccgcggggcgaacgacuucaugugcgacgagauggagcggucccugcacgacgcccugugcguggugaagcggguccucgagagcaaguccguggugcccggcgggggcgccgucgaggccgcccugagcaucuaccuggagaacuacgcgaccuccaugggcagccgcgagcagcucgccaucgccgaguucgcccggucccugcuggugaucccgaacacccucgccgugaacgcggcccaggacagcacggaccuggucgccaagcugcgcgccuuccacaacgaggcccaggugaaccccgagcggaagaaccucaaguggaucgggcuggaccugagcaacggcaagccccgcgacaacaagcaggcgggggucuucgagcccaccaucgugaaggugaagucccucaaguucgccaccgaggccgccaucaccauccugcggaucgacgaccugaucaagcuccacccggagagcaaggacgacaagcacggcuccuacgaggacgcgguccacagcggggcccugaacgacuga

SEQ ID NO: 37529 - RNA, 312 nt, Artificial Sequence
  derived and/or modified sequence opt1 from TCTA__Homo_sapiens__NP_071503
auggccgagagcugguccggccaggcccugcaggcgcuccccgccaccgugcugggggcccugggcagcgaguuccuccgcgagugggaggcccaggacaugcgggucacccuguucaagcugcuccugcuguggcucgugcugucccugcucgggauccagcuggccuggggcuucuacgggaacacggugaccggccuguaccaccgcccgggccucgggggccagaacgggagcacccccgacggcuccacccacuuccccagcugggagauggcggccaacgagccccugaagacgcaccgggaguga

SEQ ID NO: 37530 - RNA, 1506 nt, Artificial Sequence
  derived and/or modified sequence opt1 from TCTE1__Homo_sapiens__XP_011512640
augcaggacaccgugaccacgagcgcccugcucgaccccucccacagcuccgucagcacccaggacaacuccagcaccggcgggcacaccuccagcacguccccgcagcugagcaagcccuccaucacccccgugcccgccaagagccgcaacccgcacccccgggcgaacauccgccggaugcgccggaucaucgccgaggaccccgaguggucccuggccaucgugccccuccugaccgagcugugcauccagcacaucauccgcaacuuccagaagaacccgauccucaagcagaugcugcccgagcaccagcagaagguccugaaccaccucagccccgaccugccccuggccgugaccgccaaccucaucgacuccgagaacuacuggcugcggugcugcaugcaccgcuggccggugugccacgucgcgcaccacggcgggagcuggaagcggauguucuucgagcgccaccuggagaaccuccugaagcacuucauccccggcacgaccgaccccgccgugauccuggaccuccugccccugugccggaacuacgugcgccggguccacguggaccaguuccucccgcccgugcagcugcccgcccagcugcgccccggggaccaguccgacagcggcuccgagggcgagauggaggagccgaccgucgaccacuaccagcucggggaccugguggccggccugagccaccucgaggagcuggaccugguguacgacgucaaggacugcgggaugaacuucgaguggaaccucuuccuguucaccuaccgggacugccugagccucgcggccgccaucaaggccugccacacgcugaagaucuucaagcugacccgcuccaagguggacgacgacaaggcccggaucaucauccgcagccuccuggaccaccccgugcuggaggagcucgaccugucccagaaccugaucggcgaccgcggggcgcggggcgccgccaagcuccugagccacucccggcugcgcguccucaaccuggccaacaaccaggugcgcgcccccggcgcgcagagccuggcccacgcccucgcccacaacaccaaccugaucucccugaaccugcggcucaacugcaucgaggacgagggcgggcaggcccuggcgcacgcccugcagaccaacaagugccucacgacccugcaccucgggggcaacgagcugagcgagcccaccgccacccugcugucccaggugcucgccaucaacacgacccugaccagcaucaaccuguccugcaaccacaucggccucgacgggggcaagcagcugcuggaggggaugagcgacaacaagacccuccuggaguucgaccugcgccucuccgacgucgcccaggagagcgaguaccugaucggccaggcgcuguacgccaaccgggaggccgcccgccagcgggcgcucaacccgucccacuucaugagcacgaucaccgccaacgggcccgagaacuccgugggcuga

SEQ ID NO: 37531 - RNA, 1764 nt, Artificial Sequence
  derived and/or modified sequence opt1 from TCTN1__Homo_sapiens__NP_001076006
augcgcccccggggccugccgccccuccuggugguccugcucgggugcugggccagcguguccgcccagaccgacgcgacccccgccgugacgaccgagggccugaacagcaccgaggccgcccuggccaccuucgggacguuccccuccacccgcccgcccggcacgccccgggcgcccgggccgagcuccggcccccgccccacccccgucaccgacguggccgugcucugcgucugcgaccugagcccggcccagugcgacaucaacugcugcugcgaccccgacugcuccagcguggacuucuccguguucagcgccugcuccguccccguggugaccggcgacagccaguucugcucccagaaggcggucaucuacagccugaacuucaccgccaacccgccccagcggguguucgagcucguggaccagaucaaccccuccaucuucugcauccacaucaccaacuacaagcccgcccugagcuucaucaaccccgaggucccggacgagaacaacuucgacacgcugaugaagaccuccgacggguucacccucaacgccgagagcuacguguccuucaccacgaagcuggacauccccaccgccgcgaaguacgaguacggcgugccccugcagaccagcgacagcuuccuccgcuuccccuccagccugaccuccagccugugcacggacaacaacccggccgccuuccucgucaaccaggccgugaagugcacccggaagaucaaccuggagcagugcgaggagaucgaggcccuguccauggcguucuacagcucccccgagauccuccgcgugcccgacagccggaagaagguccccaucaccgugcaguccaucgugauccagagccugaacaagacccugacgcgccgggaggacaccgacguccuccagccgacccuggugaacgccgggcacuucucccugugcgucaacguggugcucgaggucaaguacagccugaccuacacggacgccggcgaggugaccaaggccgaccuguccuucgugcucgggaccgucagcuccgugguggucccccugcagcagaaguucgagauccacuuccugcaggagaacacccagcccgugccgcucagcggcaaccccggcuacguggucgggcugccccuggccgcgggcuuccagccccacaagggguccggcaucauccagacgaccaaccgcuacggccagcucaccauccugcacagcaccacggagcaggacugccuggcccucgagggggugcggaccccggugcuguucggcuacaccaugcaguccgggugcaagcugcgccucaccggcgcccugcccugccagcuggucgcccagaaggucaagagccuccugugggggcagggcuuccccgacuacguggcccccuucggcaacagccaggcgcaggacaugcuggacugggugccgauccacuucaucacccaguccuucaaccggaaggacagcugccagcuccccggggcccuggugaucgaggugaaguggacgaaguacggcucccugcugaacccccaggccaagaucgucaacgugaccgccaaccucaucagcuccagcuuccccgaggcgaacuccgggaacgagcgcaccauccugaucagcaccgccgugacguucgucgacguguccgccccggccgaggccggcuuccgggcgccgcccgccaucaacgcccgccugcccuucaacuucuucuuccccuucguguga

SEQ ID NO: 37532 - RNA, 2091 nt, Artificial Sequence
  derived and/or modified sequence opt1 from TCTN2__Homo_sapiens__NP_001137322
augggcuuccagcccccggccgcccugcuccugcgccuguuccuccugcaggggauccugcggcuccuguggggcgaccuggcguucaucccgcccuucauccgcaugagcgggcccgccguguccgccagccucgucggcgacaccgagggggugaccgugucccuggccguccugcaggacgaggccggcauccuccccauccccacgugcggcgugcugaacaacgagaccgaggacuggagcgugaccgucauccccggggcggugcuggaggugaccguccgguggaagcgcggccucgacuggugcuccagcaacgagacggacuccuucagcgagucccccugcauccugcagacccugcucgugagcgccucccacaacagcuccugcagcgcccaccuccugauccagguggagaucuacgccaacuccagccucacccacaacgcguccgagaacgucaccgugaucccgaaccagguguaccagccccuggggcccugccccugcaaccugacggccggcgccugcgacguccggugcugcugcgaccaggagugcagcuccaaccucaccacccuguuccgccggagcugcuucaccgggguguucggcggcgacgugaacccgcccuucgaccagcugugcagcgccgggacgaccacccgcggcguccccgacugguuccccuuccucugcgugcaguccccgcuggccaacacccccuuccugggguacuucuaccacggcgcggugagccccaagcaggacuccagcuucgaggucuacguggacacggacgccaaggacuucgccgacuucggcuacaagcagggggaccccaucaugaccgugaagaaggccuacuucaccaucccgcaggucucccucgccggccagugcaugcagaacgcgcccguggccuuccugcacaacuucgacgucaagugcgugaccaaccuggagcucuaccaggagcgggacgggaucaucaacgccaagaucaagaacguggcccugggcgggaucgucacgcccaaggugaucuacgaggaggccaccgaccuggacaaguucaucaccaacaccgagacgccccucaacaacggcagcaccccgcgcaucgugaacgucgaggagcacuacaucuucaaguggaacaacaacaccaucuccgagaucaacgugaagaucuuccgggcggagaucaacgcccaccagaagggcaucaugacccagcgcuucguggucaaguuccugagcuacaacuccgggaacgaggaggagcugagcggcaaccccggguaccagcucggcaagcccgugcgggcccugaacaucaaccgcaugaacaacgugacgacccugcaccucuggcaguccgccgggcggggccugugcaccagcgccaccuucaagcccauccuguucggcgagaacguccucuccgggugccugcuggaggugggcaucaacgagaacugcacgcagcuccgcgagaacgcgguggagcggcuggacagccugauccaggccacccacgucgccaugcgcgggaacuccgacuacgccgaccugagcgacggcuggcucgagaucauccggguggacgcgccggaccccggggccgacccccuggccuccagcgugaacggcaugugccuggacaucccggcccaccucuccauccgcauccugaucagcgacgccggcgcggucgaggggaucacccagcaggagauccugggcguggagacccgguucagcuccgugaacuggcaguaccagugcgggcucacgugcgagcacaaggccgaccugcugcccaucagcgccuccguccaguucaucaagauccccgcccagcucccccacccgcugacccgcuuccagaucaacuacaccgaguacgacugcaaccgcaacgaggugugcuggccccagcugcucuaccccuggacccaguacuaccagggcgagcugcacagccagugcguggccaagggccugcuccugcugcuguuccugacccuggcccucuuccuguccaaccccuggacgcggaucugcaaggcguacagcuga

SEQ ID NO: 37533 - RNA, 1380 nt, Artificial Sequence
  derived and/or modified sequence opt1 from TCTN3__Homo_sapiens__NP_001137445
augcgcacgccccagcuggcccuccuccagguguucuuccuggucuucccggacggcgugcggccccagcccagcuccagccccuccggggccgugccgaccagccuggagcugcagcgcggcaccgacgggggcacccugcagucccccagcgaggcgaccgccacccggcccgccguccccgggcucccgacgguggugcccacccuggucacccccuccgcccccggcaaccgcaccguggaccuguucccggugcuccccaucugcgucugcgaccugacgcccggcgccugcgacaucaacugcugcugcgaccgggacugcuaccugcuccacccccgcaccguguucagcuucugccugccgggguccgugcggagcuccagcugggucugcguggacaacuccgugaucuuccgcagcaacucccccuuccccagccgggucuucauggacuccaacggcauccgccaguucugcgugcacgugaacaacugcuuccuggagagcaaguccacgaccugcacccgguucuucaagaaccucgcgagcagcugcacccuggacuccgcccugaacgccgccagcuacuacaacuucaccguccucaaggugccccgcuccaugaccgacccgcagaacauggaggcguuccagcagagcacggccgccucccugaccagcccccgguccgggaaccccggcuacaucguggggaagccccugcucgcccugaccgacgacaucagcuacuccaugacccugcuccagagccagggcaacggcuccugcagcgucaagcgccacgaggugcaguucggggugaacgccaucuccggcugcaagcugcggcugaagaaggcggacugcagccaccuccagcaggagaucuaccagacgcugcacgggcgcccgcggcccgaguacgucgccaucuucggcaacgccgaccccgcccagaagggcggguggacccgcauccugaaccggcacugcuccaucagcgccaucaacugcaccuccugcugccucauccccgugagccuggagauccagguccugugggcguacgugggccuccuguccaacccgcaggcccacgugagcgggguccgcuuccuguaccagugccagagcauccaggacucccagcaggucaccgaggugagccucacgacccuggugaacuucguggacaucacccagaagccccagcccccgcggggccagcccaagauggacuggaaguggcccuucgacuucuuccccuucaagguggccuucucccgcggggucuucagccagaagugcuccgugagcccgauccugauccucugccugcugcuccugggcgugcugaaccucgagaccauguga

SEQ ID NO: 37534 - RNA, 519 nt, Artificial Sequence
  derived and/or modified sequence opt1 from TDGF1__Homo_sapiens__NP_001167607
auggccaucagcaagguguucgagcugggccucgucgccgggcugggccaccaggaguucgcgcgccccucccggggguaccuggccuuccgcgacgacagcaucuggccgcaggaggagcccgccauccggccccgcuccagccagcgggugcccccgaugggcauccagcacuccaaggagcucaaccggaccugcugccugaacgggggcacgugcaugcugggcagcuucugcgccugcccgcccuccuucuacgggcgcaacugcgagcacgacgugcgcaaggagaacugcggcagcgucccccacgacaccuggcuccccaagaagugcucccugugcaagugcuggcacgggcagcugcggugcuucccccaggccuuccuccccggcugcgacgggcuggugauggacgagcaccugguggcgagccgcacccccgagcucccgcccuccgcccggaccaccacguucaugcuggucggcaucugccugagcauccaguccuacuacuga

SEQ ID NO: 37535 - RNA, 1233 nt, Artificial Sequence
  derived and/or modified sequence opt1 from TDG__Homo_sapiens__NP_003202
auggaggccgagaacgccggcagcuacucccugcagcaggcgcaggccuucuacaccuuccccuuccagcagcucauggccgaggccccgaacauggccguggucaacgagcagcagaugcccgaggaggugcccgcgcccgccccggcccaggagcccgugcaggaggcccccaaggggcgcaagcggaagccccgcaccacggagccgaagcagcccgucgagcccaagaagcccguggagagcaagaaguccggcaagagcgcgaaguccaaggagaagcaggagaagaucaccgacaccuucaaggugaagcggaaggucgaccgcuucaacggggugagcgaggccgagcugcugaccaagacgcucccggacauccugaccuucaaccuggacaucgugaucaucggcaucaaccccgggcucauggccgccuacaagggccaccacuaccccggccccgggaaccacuucuggaagugccuguucauguccggccugagcgagguccagcucaaccacauggacgaccacacccugccggggaaguacggcaucggguucaccaacaugguggagcggacgacccccggcuccaaggaccugagcuccaaggaguuccgcgagggcgggcggauccucgugcagaagcugcagaaguaccagccccgcaucgccgucuucaacggcaagugcaucuacgagaucuucagcaaggagguguucggggugaaggucaagaaccuggaguucggccuccagccccacaagaucccggacaccgagacccugugcuacgugaugcccuccagcuccgcgcggugcgcccaguucccccgcgcccaggacaaggugcacuacuacaucaagcugaaggaccuccgggaccagcugaagggcaucgagcgcaacauggacguccaggaggugcaguacacguucgaccugcagcucgcccaggaggacgccaagaagauggcggugaaggaggagaaguacgaccccggguacgaggccgccuacggcggggccuacggcgagaacccgugcagcuccgagcccugcggguucagcuccaacggccugaucgagagcgucgagcugcggggcgagagcgccuucuccgggauccccaacggccaguggaugacccagagcuucaccgaccagauccccuccuucagcaaccacugcgggacccaggagcaggaggaggagucccacgcguga

SEQ ID NO: 37536 - RNA, 1221 nt, Artificial Sequence
  derived and/or modified sequence opt1 from TDO2__Homo_sapiens__NP_005642
augagcggcugccccuuccuggggaacaacuucggcuacaccuucaagaagcucccgguggagggguccgaggaggacaagagccagaccggcgucaaccgcgccuccaagggcgggcugaucuacggcaacuaccugcaccucgagaaggugcugaacgcccaggagcugcagagcgagacgaaggggaacaagauccacgacgagcaccucuucaucaucacccaccaggcguacgagcugugguucaagcagauccugugggagcucgacuccgugcgggagaucuuccagaacggccacguccgcgacgagcggaacaugcugaagguggugagccgcaugcaccgggucuccgugauccugaagcuccuggugcagcaguucagcauccuggagaccaugaccgcccucgacuucaacgacuuccgcgaguaccugucccccgccagcggguuccagucccugcaguuccggcuccuggagaacaagaucggcguccugcagaacaugcgcgugcccuacaaccggcgccacuaccgggacaacuucaagggggaggagaacgagcuccugcucaagagcgagcaggagaagacgcugcuggagcugguggaggccuggcucgagcgcacccccggccuggagccgcacggcuucaacuucugggggaagcuggagaagaacaucacccggggccucgaggaggaguucauccgcauccaggccaaggaggaguccgaggagaaggaggagcaggucgcggaguuccagaagcagaaggaggugcugcugagccucuucgacgagaagcggcacgagcaccuccuguccaagggggagcgccggcugagcuaccgcgcccugcagggcgcccugaugaucuacuucuaccgggaggagccccgcuuccaggugcccuuccagcuccugaccucccugauggacaucgacagccucaugacgaaguggcgguacaaccacgucugcauggugcaccgcaugcugggcuccaaggccgggaccggcgggagcagcggcuaccacuaccugcgcuccaccgugagcgaccgguacaaggucuucguggaccucuucaaccuguccaccuaccugaucccccgccacuggaucccgaagaugaaccccacgauccacaaguuccucuacaccgcggaguacugcgacagcuccuacuucagcuccgacgagagcgacuga

SEQ ID NO: 37537 - RNA, 1032 nt, Artificial Sequence
  derived and/or modified sequence opt1 from TDP1__Homo_sapiens__XP_006720263
augaugcugcuccuguacgaggagggccugcgcguggucauccacaccagcaaccucauccacgccgacuggcaccagaagacccaggggaucuggcugagcccccuguacccgcggaucgccgacggcacgcacaaguccggggagucccccacccacuucaaggcggaccucaucagcuaccugauggccuacaacgcccccucccugaaggaguggaucgacgugauccacaagcacgaccucagcgagaccaacguguaccugaucggcuccacccccgggcgcuuccagggcagccagaaggacaacuggggccacuuccggcugaagaagcuccugaaggaccacgccuccagcaugccgaacgccgaguccuggcccgucguggggcaguucagcuccgugggcagccugggggcggacgaguccaaguggcucugcagcgaguucaaggaguccaugcugacgcugggcaaggagagcaagacccccgggaaguccagcgucccccucuaccugaucuacccgagcguggagaacgugcgcaccucccuggagggcuaccccgccggcgggagccuccccuacuccauccagaccgccgagaagcagaacuggcugcacagcuacuuccacaagugguccgccgagacgagcggccgguccaacgcgaugccccacaucaagaccuacaugcgcccgagccccgacuucuccaagaucgccugguuccuggucaccagcgccaaccucuccaaggccgccuggggcgcgcuggagaagaacgggacccagcugaugauccggagcuacgagcucggcgugcuguuccugcccuccgccuucgggcucgacagcuucaaggugaagcagaaguucuucgccggcucccaggagcccauggccacguucccgguccccuacgaccugccgcccgagcuguacgggagcaaggaccgccccuggaucuggaacauccccuacgugaaggcccccgacacccacggcaacaugugggugcccuccuga

SEQ ID NO: 37538 - RNA, 1089 nt, Artificial Sequence
  derived and/or modified sequence opt1 from TDP2__Homo_sapiens__NP_057698
auggagcugggcagcugccucgagggcgggcgcgaggccgccgaggaggagggggagcccgaggugaagaagcggcgccugcugugcgucgaguucgcguccguggccagcugcgacgccgccguggcccagugcuuccucgcggagaacgacugggagauggagcgggcccugaacuccuacuucgagccgcccgucgaggagagcgcccuggagcgccggcccgagaccaucuccgagcccaagaccuacguggaccucacgaacgaggagaccaccgacagcaccacguccaagaucagcccguccgaggacacccagcaggagaacggcagcauguucucccugaucaccuggaacaucgacgggcuggaccucaacaaccugagcgagcgcgcccggggcgugugcuccuaccuggcgcucuacagccccgacgucaucuuccugcaggaggugaucccgcccuacuacuccuaccugaagaagcgcagcuccaacuacgagaucaucaccggccacgaggagggguacuucacggccaucaugcucaagaagucccgggugaagcucaagagccaggagaucauccccuuccccagcaccaagaugaugcgcaaccugcugugcguccacgugaacgugagcggcaacgagcugugccugaugaccucccaccucgagagcacccgggggcacgccgccgagcgcaugaaccagcugaagaugguccugaagaagaugcaggaggcccccgaguccgcgacggugaucuucgccggcgacaccaaccuccgggaccgcgaggugacccggugcgggggccugcccaacaacaucgucgacgugugggaguuccugggcaagccgaagcacugccaguacaccugggacacgcagaugaacagcaaccucgggaucaccgccgccugcaagcugcgcuucgaccggaucuucuuccgcgccgcggccgaggagggccacaucaucccccggucccuggaccuccuggggcuggagaagcucgacugcggccgcuuccccagcgaccacuggggccugcugugcaaccucgacaucauccuguga

SEQ ID NO: 37539 - RNA, 3570 nt, Artificial Sequence
  derived and/or modified sequence opt1 from TDRD1__Homo_sapiens__NP_942090
augagcgugaagucccccuucaacgucaugagccgcaacaaccuggaggccccgcccugcaagaugaccgagcccuucaacuucgagaagaacgagaacaagcugcccccgcacgagucccugcggagccccggcacccugcccaaccaccccaacuuccgccucaaguccagcgagaacgggaacaagaagaacaacuuccugcugugcgagcagacgaagcaguaccucgccucccaggaggacaacagcguguccagcaacccgaacggcaucaacggggagguggucggcuccaagggggaccggaagaagcugcccgcgggcaacagcguguccccgcccagcgccgaguccaacagcccgcccaaggaggugaacaucaagcccggcaacaacguccgccccgccaaguccaagaagcugaacaagcucguggagaacagccuguccaucagcaaccccgggcuguucaccagccucggcccgccccugcgguccacgaccugccaccgcugcgggcuguucggcagccuccggugcucccagugcaagcagacguacuacugcagcaccgccugccagcgccgggacugguccgcccacagcaucgugugccgccccguccagcccaacuuccacaagcuggagaacaaguccagcaucgagaccaaggacguggaggugaacaacaaguccgacugcccccugggggucaccaaggagaucgcgaucugggccgagcggaucauguucagcgaccuccgcucccugcagcugaagaagacgauggagaucaagggcaccgugaccgaguucaagcaccccggcgacuucuacgugcagcucuacagcuccgagguccuggaguacaugaaccagcugagcgccucccucaaggagaccuacgccaacgugcacgagaaggacuacauccccgugaagggggaggucugcaucgcgaaguacacgguggaccagaccuggaaccgggccaucauccagaacguggacguccagcagaagaaggcccacgugcuguacaucgacuacggcaacgaggagaucaucccgcugaaccgcaucuaccaccucaaccggaacaucgaccuguucccgcccugcgccaucaagugcuucguggccaacgucauccccgcggaggggaacuggagcuccgacugcaucaaggccaccaagccccugcucauggagcaguacugcagcaucaagaucguggacauccuggaggaggagguggugaccuucgccguggaggucgagcugcccaacuccggcaagcuccuggaccacgugcugaucgagaugggcuacgggcucaagcccagcggccaggacagcaagaaggagaacgccgaccaguccgacccggaggacguggggaagaugaccaccgagaacaacaucgucguggacaagagcgaccugauccccaaggugcugacccucaacgucggcgacgaguucugcggggugguggcccacauccagacccccgaggacuucuucugccagcagcugcaguccggccgcaagcuggcggagcuccaggccagccuguccaaguacugcgaccagcugcccccgcggagcgacuucuaccccgccaucggcgacaucugcugcgcccaguucuccgaggacgaccagugguaccgcgccagcguccucgcguacgccuccgaggagagcgugcuggugggguacgucgacuacggcaacuucgagauccugucccucaugcggcugugccccaucauccccaagcugcuggagcucccgaugcaggccaucaagugcgugcuggccggggugaagcccagccugggcaucuggacgcccgaggccaucugccucaugaagaagcugguccagaacaagaucaucaccgugaagguggucgacaagcuggagaacuccagccucguggagcugaucgacaaguccgagacgccccacgugagcgucuccaaggugcugcucgacgcgggguucgccgugggcgagcagagcauggucaccgacaagccgagcgacgugaaggagaccuccgugccccugggcgucgaggggaaggugaacccccuggaguggaccuggguggagcucggcgucgaccagaccguggacguggucgugugcgugaucuacagccccggggaguucuacugccacguccugaaggaggacgcccugaagaagcucaacgaccugaacaagucccuggccgagcacugccagcagaagcucccgaacggcuucaaggcggagaucgggcagcccugcugcgccuucuucgccggcgacggcagcugguaccgcgcccuggugaaggagauccugcccaacgggcacgugaagguccacuucguggacuacggcaacaucgaggaggugaccgccgacgagcuccggaugaucuccagcacguuccugaaccugcccuuccaggggauccgcugccagcucgcggacauccagucccgcaacaagcacuggagcgaggaggccaucacccgguuccagaugugcgucgccggcaucaagcugcaggcccgcgugguggaggucaccgagaacggcaucgggguggagcugaccgaccucuccacgugcuacccgcggaucaucagcgacgugcugaucgacgagcaccugguccucaaguccgccagcccccacaaggaccugcccaacgaccgccuggugaacaagcacgagcuccagguccacgugcagggccugcaggcgaccuccagcgccgagcaguggaagaccaucgagcugcccguggacaagaccauccaggccaacguccucgagaucaucuccccgaaccuguucuacgcccugcccaaggggaugcccgagaaccaggagaagcucugcaugcugacggccgagcugcucgaguacugcaacgcgcccaagagccggccgcccuaccgcccccggaucggcgacgccugcugcgccaaguacaccuccgacgacuucugguaccgcgccguggugcuggggaccagcgacaccgacgucgaggugcuguacgcggacuacggcaacaucgagacccucccgcugugccgggugcagcccaucacguccagccaccuggcccuccccuuccagaucauccgcugcagccuggagggccugauggagcucaacggguccagcucccagcugaucaucaugcugcucaagaacuucaugcugaaccagaacgucaugcugagcgugaagggcaucaccaagaacgugcacaccgucuccguggagaagugcagcgagaacgggaccguggacgucgccgacaagcucgugacguucggccuggccaagaacaucacgccccagcggcaguccgcccugaacaccgagaagauguaccgcaugaacugcugcugcaccgagcuccagaagcaggucgagaagcacgagcacauccugcuguuccuccugaacaacagcaccaaccagaacaaguucaucgagaugaagaagcugcucaagaagaccgcgucccucgggggcaagccgcuguga

SEQ ID NO: 37540 - RNA, 2235 nt, Artificial Sequence
  derived and/or modified sequence opt1 from TDRD3__Homo_sapiens__NP_001139542
auggcccagguggccggcgcggcccugagccaggccgggugguaccucuccgacgagggcaucgaggccugcaccagcucccccgacaaggucaacgugaacgacaucauccugaucgcccugaacaccgaccuccgcacgaucgggaagaaguuccugccgagcgacaucaacuccggcaagguggagaagcuggaggggcccugcguccuccagauccagaagauccggaacguggcggcccccaaggacaacgaggagagccaggccgcgccccgcaugcugcggcugcagaugaccgacggccacaucuccugcaccgccguggaguucagcuacauguccaagaucagccucaacaccccgcccggcacgaaggucaagcuguccgggaucguggacaucaagaacggcuuccugcuccugaacgacagcaacaccaccgugcucgggggcgaggucgagcaccugaucgagaagugggagcugcagcgcucccugagcaagcacaaccgguccaacaucgggaccgagggcggcccgccgcccuucgugcccuucgggcagaagugcgugagccacguccagguggacucccgcgagcucgaccggcgcaagacgcuccaggugaccaugcccgucaagcccaccaacgacaacgacgaguucgagaagcagcggaccgccgccaucgccgagguggccaagagcaaggagacgaagaccuucggcgggggcggcgggggcgcgcgcuccaaccugaacaugaacgccgccgggaaccggaaccgcgaggugcugcagaaggagaaguccaccaagagcgagggcaagcacgagggggucuaccgggagcugguggacgagaaggcccugaagcacaucaccgagaugggcuucagcaaggaggccagccgccaggcgcucauggacaacggcaacaaccuggaggccgcccugaacgugcuccugacguccaacaagcagaagcccgucauggggccgccccugcggggccgcgggaagggccgggggcgcauccggagcgaggacgaggaggaccucggcaacgcccgccccuccgcccccagcacccuguucgacuuccuggaguccaagaugggcacccucaacguggaggagcccaagagccagccccagcagcugcaccaggggcaguaccgguccagcaacaccgagcagaacggcgugaaggacaacaaccaccuccgccacccgccccgcaacgacacgcggcagccccgcaacgagaagccgccccgguuccagcgcgacucccagaacagcaaguccguccuggaggggagcggccugccccggaaccgcggguccgagcggcccagcaccuccagcguguccgaggucugggcggaggaccgcaucaagugcgaccggcccuacagccgcuacgaccggaccaaggacaccagcuacccccugggcucccagcacagcgacggcgccuucaagaagcgcgacaacuccaugcagagccgguccgggaagggcccgagcuucgccgaggccaaggagaacccccucccccagggguccguggacuacaacaaccagaagcgcggcaagcgggagagccagacguccaucccggacuacuucuacgaccgcaagagccagaccaucaacaacgaggccuucuccggcaucaagaucgagaagcacuucaacgugaacaccgacuaccagaaccccguccggagcaacuccuucaucggggugcccaacggcgagguggagaugccccugaaggggcgccggaucggcccgaucaagcccgcggggcccgucaccgccgugcccugcgacgacaagaucuucuacaacagcggcccgaagcgccgcuccggccccaucaagcccgagaagauccuggagagcuccauccccauggaguacgccaagauguggaagccgggggacgagugcuucgcccucuacugggaggacaacaaguucuaccgggcggagguggaggcccugcacagcagcggcaugacggccgucgugaaguucaucgacuacgggaacuacgaggaggugcugcucuccaacaucaagcccauccagaccgaggccugggaggaggagggcaccuacgaccagacccuggaguuccgccgcgggggcgacggccagccccggcggagcacgcgccccacccagcaguucuaccagccgccccgggcccgcaacuga

SEQ ID NO: 37541 - RNA, 2946 nt, Artificial Sequence
  derived and/or modified sequence opt1 from TDRD5__Homo_sapiens__NP_001186020
augagcgagcaggagcgcauccaggagugccugcggaaggagauccgcucccuccugaucagcaccaaggacggccugagcccccaggagcucgagaaggaguaccugcugaugguggggaaccaccucccgcugcggauccugggcuaccgcagcaccauggagcucguccuggacaugcccgacguggugcgggucugccccggggccggcgggacggugauccugaaggccauccccgacgaguccaccaagggcaucgcgagccucguggccaagcagcgcuccagccacaagcugcggaacuccaugcacaagggccgcccgagcaucuacuccgggccccggagccaccgccggguccccuaccgcggccggguggcccccauccugccggccguggucaaguccgagcucaaggaccugcuggcccucagccccgugcugcuguccgacuucgagaaggcguucgccaagcgcuucgggcggagcuuccaguacaugcaguacggcuuccucuccauguucgaggugcugaacgccgccagcgacgucaucuccguggagcagacccgcgcggggagccugcucaugcugaagaaguccgugaccgaggagaagccccggggcugccccgccggcaagaucuucacgcagccguuccgcaugaagcagggguccuacagcaccggcuuccccgucgccaagcccugcuucucccagcccaccagcaacauggagccgcccaagcagaucauguccauggagaagaccagcaagcugaacgugguggagacgucccggcucaaccacaccgagaagcugaaccagcuggagaacaccuucaagagcgucaucgcccagaucgggcccggcggcaccaucuccagcgagcucaagcacaagaucaaguucgugguguccaaguuccccgaggggcuguucaucagcaagcugcucggcgaguacgaggucaucuucaaggagcagcuguccccgaagaagcugggguuccucaacgugacggagcuggugggcgcccugagcgacauccuccacgucgaguuccgcaaggggcaccaggaccugcugguguucgacgcggacaagaagccccucccgcccguccaguccgacaagaagaucgaggccaaggccugcgugagcuccccgccccggaacagccuguccaccgccgccgugaaggagaccgucuggaacugccccagcaagaagcagaaggagccccagcagaagaucugcaagaagccgaaccugguggugaagccccuccagcugcaggucgagaccaacaagagcgagcugaaccucgcgauggccaaccacgacaucccgcccgacgccgugcccaacaagaagcugugccgccugccgccccuggacacguccagccucaucggcguguucgucgaguacaucaucucccccagccaguucuacauccgcaucuacucccgggacagcuccgagcugcuggaggacaugaugaucgagaugcgccggugcuacagcaaccagcucguguccgaccgcuacgugaugcccgagugcuucauccagcccggccaccugugcugcguccggaucagcgaggacaaguggugguaccgcgugaucauccaccgggugcuggagaagcaggaggucgagguguucuaccccgacuucgggaacaucggcaucgugcagaaguccagccuccgcuuccugaagugcugcuacaccaagcugcccgcccaggccauccccugcucccucgcguggguccggcccguggaggagcacuggaccagcaaggccauccugcaguuccagaagcugugcgggcucaagccccuggugggcgucguggacgaguacguggacgggauccugaacaucuuccucugcgacaccuccagcaacgaggacgucuacuuccaccacgugcugcgcacggagggccacgccaucgugugccgggagaacaucuccagcaagggcuucagcgagcugaacccgcucgcccuguacaccaccuccagcgggggccccgaggacaucguccugaccgagcucggguaccccucccagcagcacuacuucaacgaggaccgcaagaucagcccccaguccaaggagagcgagcugcggauccuggacgagaucccgacgggcaugcccugccucgaguccgugaccaucggggacgacaucugggacgagaacuggcugccccugcaggccaagaugggcaagggcggggacgcggccagccaccucuucaccgccucccugggcgggaagaaccaguacagcuccugcaaggagaugccccagaaggacuggugcuucagcaccccgaaggacacgugggacgacuccuggcagcccagcggccuggugaacggcaccaaggucgaggugcacaagcccgaggugcucggggcccaggagaagaacaccggcaccaaccgcacgcagaagcagcuggacaucaacggguccagcgacuccagcacccugcccaagcucgaggaguucugcaccucccugacccagagcgagcagagcgcggacggcucccagagcgagccgaacaacucccagacgcagcccaagcagauccagcugagcaccgccgcccccugcuccaccaccgccgucgacgacagcgccgagaagccguccgggagcguggaguccagccccgagauccucaagaacgaggacuucuccagcucccgggcgaucacccuguacaaggacaagcgccaggagagcguggaccagcugucccucauccugagcuacgagugccagaucucccagaagcuguacaucccccggagcacggccaccgccgcccucggcgccgcggcccgccuggccaccucccggagccugcuccacugguaccccagcgucaagcgcauggaggccuga

SEQ ID NO: 37542 - RNA, 6291 nt, Artificial Sequence
  derived and/or modified sequence opt1 from TDRD6__Homo_sapiens__NP_001010870
augugcagcacccccggcaugccggcccccggggccucccuggcgcuccgcgugagcuucgucgacgugcaccccgacgugauccccguccagcuguggggccuggugggggagcggcgcggcgaguaccuccggcugucccgcgagauccaggaggccgccgccacccgggggcagugggcccugggcagcgcguccgccagcccgggcgagcucugccuggugcaggucgggcugcucuggcaccgcugccggguggugucccgccaggcccaggagagccgggucuuccugcuggacgagggccgcacgaucaccgccggggcgggcucccucgcccccgggcggcgcgaguucuucaaccugcccagcgaggugcugggcugcgugcucgccggccugguccccgccgggugcggcgccggguccggcgagccgccccagcacuggcccgcggacgccguggacuuccugagcaaccuccagggcaaggaggugcacgggugcguccuggacgugcugcuccugcaccggcuggugcuccuggagguccccgacguguuccagcagaugcgcgagcugggccucgcccggcgcgugccggacucccuguuccggagccugcucgagcgcuaccugaccgccgccaccgcguccgucgggagcggcgugcccgugcugucccgggucccccucaagcagaagcagcccgggcuggacuacuucuacccgcagcugcagcucggcgugacggaggccgucgugaucacccaggugugccacccccaccgcauccacugccagcugcggagcgucucccaggagauccaccgccugagcgagagcauggcccagguguaccgcggcuccaccgggaccggcgacgagaacagcacguccgccaccugggaggagcgggaggagagccccgacaagcccggguccccgugcgccagcugcggccucgacgggcacugguaccgcgcgcugcugcucgagaccuuccggccccagcgcugcgcccaggugcugcacgucgacuacggccggaaggagcugguguccugcagcucccuccgcuaccugcugcccgaguacuuccggaugcccguggucaccuacccgugcgcccucuacggccugugggacgggggccgcggguggagccggucccaggugggcgaccugaagacgcugauccucgggaaggccgugaacgccaagaucgaguucuacugcagcuucgagcacgucuacuacgugucccuguacggcgaggacggcaucaaccugaaccgcguguucgggguccagagcugcugccucgcggaccgggugcugcagucccaggccaccgaggaggaggagcccgagaccagccagucccagagccccgccgaggagguggacgaggagaucucccugcccgcccuccgcagcauccggcugaagaugaacgcguucuacgacgcccaggucgaguucgugaagaacccgagcgaguucuggauccgccugcggaagcacaacgugaccuucuccaagcucaugcgccggaugugcggcuucuacagcuccgccagcaagcuggacggggucgugcugaagcccgagcccgacgaccucugcugcgugaaguggaaggagaacggcuacuaccgcgccaucgucacgaagcuggacgacaaguccguggacguguuccuggucgaccggggcaacagcgagaacguggacugguacgacgugcgcaugcuccugccgcaguuccgccagcugcccauccucgccgucaagugcacccuggcggacaucuggccccuggggaagaccuggucccaggaggccgugagcuucuucaagaagaccgugcuccacaaggagcuggucauccacauccuggacaagcaggaccaccaguacgugaucgagauccucgacgagucccggacgggcgaggagaacaucagcaaggugaucgcccaggccggguacgccaaguaccaggaguucgagaccaaggagaacauccuggucaacgcgcacucccccggccacgugagcaaccacuucaccaccgaguccaacaagaucccguucgccaagacgggggagggcgagcagaaggccaagcgcgagaacaagaccaccagcguguccaaggcccugagcgacaccacggucgugaccaacggcuccaccgagcucgugguccaggagaaggugaagcgggccagcguguacuucccccugaugcagaacugccuggagaucaagcccgggagcuccagcaagggcgagcucgaggucggguccaccguggaggugcgcgucagcuacguggagaaccccggcuacuucuggugccagcugacgcggaacauccaggggcugaagacccucauguccgacauccaguacuacugcaagaacaccgcggccccgcaccagcgcaacacccuggccugccuggccaagcggacggugaaccgccaguggagccgggcgcucaucuccggcauccagagcgucgagcacgugaacgucaccuucguggacuacggcgaccgcgagaugguguccgucaagaacaucuacagcaucuccgaggaguuccugaaggugaaggcccaggccuuccggugcagccuguacaaccucauccagcccguggggcagaaccccuucgucugggacgugaaggccauccaggccuucaacgaguucaucgacaacgcguggcagaagaaccuggagcugaagugcaccaucuucgcccucgccuccaucaacgaggagcuguucaacaucguggaccugcucacccccuuccagagcgccugccacuuccuggucgagaagcgccuggcccggccggugaagcuccagaagccccuggaguccagcgugcagcugcacuccuacuucuacagcacccacgacaugaagaucggcuccgaggagcucgucuacaucacgcacaucgacgaccccuggaccuucuacugccagcuggcgcgcaacgccaacauccuggagcagcucagcugcagcaucacccagcuguccaaggugcugcucaaccugaagaccagcccccugaacccggggacgcucugccuggccaaguacaccgacggcaacugguaccgggggaucgugaucgagaaggagcccaagaaggucuucuucguggacuucggcaacaucuacguggucaccuccgacgaccugcuccccauccccagcgacgccuacgacgugcugcugcucccgaugcaggccgugcgcugcucccugagcgacauccccgaccacauccccgaggaggucguggugugguuccaggagaccauccuggacaagucccucaaggcgcuggucguggccaaggaccccgacggcacgcugaucaucgagcucuacggggacaacauccagaucagcgccuccaucaacaagaagcugggccugcucagcuacaaggaccggauccgcaagaaggaguccgaggugcugugcagcaccaccgagacccuggaggagaagaacgagaacaugaagcucccgugcacggaguaccuguccaagagcgucggguacaagcugcccaacaaggagauccucgaggaguccuacaagccccagaucaacagcuccuacaaggagcugaagcugcuccagagccugaccaagaccaaccuggugacccaguaccaggacuccgugggcaacaagaacagccaggucuucccgcucacgaccgagaagaaggaggagaucagcgccgagaccccccugaagaccgcgcggguggaggccacgcuguccgagcgcaagaucggggacagcugcgacaaggaccucccccugaaguucugcgaguucccccagaagaccaucaugccgggcuucaagaccaccguguacgucucccacaucaacgaccugagcgacuucuacgugcagcucaucgaggacgaggccgagaucucccaccugagcgagcggcugaacuccgugaagacgcgccccgaguacuacgucggccccccccugcagcgcggggacaugaucugcgccguguucccggaggacaaccucugguaccgggccgugaucaaggagcagcagcccaacgaccugcugagcguccaguucaucgacuacggcaacguguccgugguccacaccaacaagaucgggcgccucgaccuggugaacgcgauccugcccggccucugcauccacugcagccugcagggcuucgaggugcccgacaacaagaacuccaagaagaugaugcacuacuucagccagcggaccuccgaggccgccauccgcugcgaguucgucaaguuccaggaccggugggaggugauccuggccgacgagcacgggaucaucgccgacgacaugaucagccgcuacgcgcucuccgagaagagccagguggagcuguccacccaggucaucaagagcgccuccagcaagagcgugaacaaguccgacaucgacacgagcguguuccugaacugguacaacccggagaagaagaugauccgggccuacgccaccgucaucgacggccccgaguacuucuggugccaguucgccgacaccgagaagcuccagugccuggagguggagguccagaccgcgggggagcagguggccgaccgccggaacugcauccccugccccuacaucggcgacccgugcaucgugcgcuaccgggaggacgggcacuacuaccgcgcccugaucacgaacaucugcgaggacuaccucgucuccgugcggcugguggacuucggcaacaucgaggacugcgucgaccccaaggcccugugggccauccccagcgagcuccuguccgugcccaugcaggcguucccgugcugccugagcggcuucaacaucuccgaggggcucugcagccaggagggcaacgacuacuucuacgagaucaucaccgaggacgugcuggagaucaccauccuggagauccgccgggacgucugcgacaucccccucgccaucguggaccugaaguccaaggggaagagcaucaacgagaagauggagaaguacuccaagaccggcaucaagagcgcccugcccuacgagaacaucgacuccgagaucaagcagacgcucgggagcuacaaccuggacgugggccugaagaagcucuccaacaaggccguccagaacaagaucuacauggagcagcagaccgacgagcuggcggagaucaccgagaaggacgugaacaucaucggcaccaagcccagcaacuuccgcgacccgaagaccgacaacaucugcgagggguucgagaaccccugcaaggacaagaucgacacggaggagcuggagggcgagcucgagugccaccugguggacaaggccgaguucgacgacaaguaccugaucaccggguucaacacccuccugccccacgccaacgagaccaaggagauccuggagcucaacucccuggaggucccccugagcccggacgacgaguccaaggaguuccucgagcuggagagcaucgagcugcagaacagccucgugguggacgaggagaagggcgagcugucccccguccccccgaacgugccccugagccaggagugcgugacgaagggggccauggagcucuucacccugcagcugccccucuccugcgaggccgagaagcagcccgagcuggagcugccgaccgcgcagcucccccuggacgacaagauggacccccugagccucggcgucucccagaaggcccaggagagcaugugcaccgaggacaugcggaaguccagcugcguggaguccuucgacgaccagcgccggaugagccugcaccugcacggcgccgacugcgaccccaagacgcagaacgagaugaacaucugcgaggaggaguucguggaguacaagaaccgcgacgccaucuccgcccucaugccgcuguucagcgaggaggaguccagcgacggguccaagcacaacaacggccugcccgaccacaucagcgcgcagcuccagaacaccuacacccugaaggccuucaccgucggguccaagugcgugguguggagcucccugcgcaacacguggagcaagugcgagauccucgagaccgccgaggagggcacccggguccugaaccugagcaacggcauggaggagaucgugaaccccgagaacguguggaacgggauccccaagcucgacaaguccccgcccgagaagcgcggccuggaggucauggagaucuga

SEQ ID NO: 37543 - RNA, 3075 nt, Artificial Sequence
  derived and/or modified sequence opt1 from TDRD7__Homo_sapiens__NP_001289813
auggccugcaccgagaccgcccgcaucgcgcagcugguggcccggcagcgcagcuccaagcggaagacgggccgccaggucaacugccagaugcgggugaagaagaccaugcccuucuuccucgaggggaagccgaaggccacccugcgccagcccggcuucgccagcaacuucuccguggggaagaagcccaaccccgccccgcugcgggacaagggcaacagcgucggggugaagcccgacgcggagaugucccccuacaugcuccacaccacgcugggcaacgaggccuucaaggacauccccgugcagcgccacgucaccaugagcaccaacaaccgguucuccccgaaggccagccugcagccgccccuccagaugcaccugucccgcaccagcacgaaggagauguccgacaaccugaaccagaccguggagaagcccaacgugaagccgcccgccagcuacaccuacaagauggacgagguccagaaccggaucaaggagauccucaacaagcacaacaacggcaucuggaucuccaagcugccccacuucuacaaggagcuguacaaggaggaccucaaccaggggauccugcagcaguucgagcacuggccccacaucugcaccguggagaagcccugcagcggcgggcaggaccugcuccuguaccccgcgaagcgcaagcagcugcuccgguccgagcuggacacggagaaggugccccugagcccccucccgggccccaagcagaccccgccccugaaggggugccccaccgucauggccggcgacuucaaggagaagguggccgaccugcucgugaaguacaccuccggccugugggccagcgcccugcccaaggcguucgaggagauguacaaggucaaguuccccgaggacgcccucaagaaccuggccucccugagcgacgugugcagcaucgacuacaucuccgggaacccccagaaggccauccucuacgccaagcugccgcugcccacggacaagauccagaaggacgcgggccaggcccacggggacaacgacaucaaggccaugguggagcaggaguaccuccaggucgaggagagcaucgccgaguccgccaacaccuucauggaggacaucaccgugcccccgcugaugauccccaccgaggcgagccccuccgugcuggucguggagcucagcaacacgaacgagguggucauccgcuacgugggcaaggacuacuccgccgcccaggagcugauggaggacgagaugaaggaguacuacagcaagaaccccaagaucaccccgguccaggccgugaacgugggccagcugcucgccgucaacgcggaggaggacgccuggcugcgggcccaggugaucuccaccgaggagaacaagaucaaggugugcuacgucgacuacggguucagcgagaacguggagaaguccaaggccuacaagcugaaccccaaguucugcagccucuccuuccaggcgaccaagugcaagcuggccggccuggaggugcucagcgacgaccccgaccuggucaaggugguggagucccugacgugcgggaagaucuucgccgucgagauccucgacaaggccgacaucccccugguggugcuguacgacaccagcggcgaggacgacaucaacaucaacgcgaccugccugaaggccaucugcgacaagucccucgagguccaccuccagguggacgccauguacaccaacgugaaggucacgaacaucugcagcgacgggacccuguacugccaggugccgugcaagggccugaacaagcuguccgaccugcuccgcaagaucgaggacuacuuccacugcaagcacaugaccagcgagugcuucgugagccugcccuucugcggcaagaucugccuguuccacugcaaggggaaguggcuccgggucgagaucaccaacgugcacuccagccgcgcccuggacgugcaguuccuggacuccggcacggucaccagcgugaagguguccgagcuccgggagaucccgccccgcuuccugcaggagaugaucgccaucccgccccaggccaucaagugcugccuggcggaccucccccagagcaucgggauguggacccccgacgccguccuguggcugcgggacuccgugcucaacugcagcgacugcuccaucaaggugaccaaggucgacgagacgcgcggcaucgcccacguguaccuguucacccccaagaacuuccccgacccccaccgcagcaucaaccggcagaucaccaacgccgaccuguggaagcaccagaaggacguguuccucuccgccaucagcuccggggcggacagccccaacuccaagaacggcaacaugccgaugagcggcaacaccggggagaacuuccgcaagaaccugaccgacgucaucaagaaguccaugguggaccacacgagcgccuucagcaccgaggagcugcccccgcccgugcaccucuccaagcccggcgagcacauggacgucuacgugcccguggccugccaccccggguacuucgucauccagccguggcaggagauccacaagcuggaggugcugauggaggagaugauccucuacuacagcguguccgaggagcggcacaucgccgucgagaaggaccagguguacgcggccaagguggagaacaaguggcaccgcguccugcugaagggcauccucaccaacgggcuggugagcguguacgagcuggacuacggcaagcacgagcucgucaacauccggaaggugcagccccugguggacauguuccgcaagcugcccuuccaggccgucaccgcccagcucgccggcgugaagugcaaccagugguccgaggaggcgagcauggucuuccggaaccacguggagaagaagccccugguggcccugguccagacggugaucgagaacgccaacccgugggaccgcaagguggucguguaccucguggacaccucccugcccgacaccgacaccuggauccacgacuucaugagcgaguaccugaucgagcucuccaaggucaacuga

SEQ ID NO: 37544 - RNA, 4149 nt, Artificial Sequence
  derived and/or modified sequence opt1 from TDRD9__Homo_sapiens__NP_694591
augcugcgcaagcucaccaucgagcagaucaacgacugguucaccaucggcaagacggugaccaacgucgagcugcugggggcgcccccggccuuccccgccggcgccgcccgggaggaggugcagcgccaggacguggcccccggggccggccccgcggcccaggccccggcccucgcgcaggcccccgcccggcccgccgccgcguucgagcgcagccugucccagcggagcuccgaggucgaguacaucaacaaguaccgccagcuggaggcccaggagcucgacgugugccggagcgugcagcccaccuccgggccgggcccccgccccagccuggccaagcuguccagcgugaccugcauccccggcacgaccuacaaguacccggaccuccccaucucccgguacaaggaggagguggugagccugaucgaguccaacagcgucgugaucauccacggggccaccggcuccggcaagagcacccagcugccccaguacauccucgaccacuacgugcagcgcuccgccuacugcagcaucgucgugacgcagccccggaagaucggggcguccagcaucgcccgcuggaucuccaaggagcgggccuggacccucgggggcguggucggcuaccagguggggcuggagaagaucgccaccgaggacacccgccugaucuacaugacgaccggcgugcugcugcagaagaucgucagcgccaagagccucauggaguucacccacaucaucaucgacgaggugcacgagcggaccgaggagauggacuuccugcugcucgugguccgcaagcugcugcggacgaacucccgcuucgugaaggugguccucaugagcgcgaccaucuccugcaaggaguucgccgacuacuucgccgugccgguccagaacaagaugaaccccgccuacaucuucgagguggaggggaagccccacagcguggaggaguacuaccugaacgaccuggagcacauccaccacuccaagcucagcccccaccuccuggaggagccggucaucaccaaggacaucuacgagguggccgugucccugauccagauguucgacgaccuggacaugaaggagagcggcaacaaggcgugguccggcgcccaguucguccuggagcggagcuccgugcucguguuccugcccgggcugggcgagaucaacuacaugcacgagcuccugaccagccugguccacaagcgccuccagguguacccccugcacuccagcguggcccuggaggagcagaacaacgucuuccucucccccgugccgggguaccggaagaucauccugagcacgaacaucgccgaguccagcgugaccguccccgacgugaaguacgugaucgacuucugccugacccgcacccucgucugcgacgaggacacgaacuaccagucccugcgccugagcugggcgagcaagaccuccugcaaccagcggaagggccgcgccgggcgggugagccgcggcuacugcuaccggcucgugcacaaggacuucugggacaacuccauccccgaccacgucgugcccgagaugcugcgcugcccgcugggcagcaccauccugaaggugaagcuccuggacaugggggagccccgggcccugcucgccaccgcccuguccccgcccggccugagcgacaucgagcgcacgauccuccugcugaaggaggucggggcgcucgccguguccggccagcgggaggacgagaacccccacgacggggagcugaccuuccugggccgcgugcucgcccagcugcccgucaaccagcagcugggcaagcucaucgugcuggggcacguguucggcugccuggacgagugccucaucaucgccgccgcgcugagccugaagaacuucuucgccaugcccuuccggcagcaccucgacggguaccgcaacaaggucaacuucuccggcagcuccaagagcgacugcaucgcccugguggaggccuucaagaccuggaaggccugccggcagaccggggagcugcgcuacccgaaggacgagcucaacuggggccggcugaacuacauccagaucaagcgcauccgggagguggcggagcuguacgaggagcucaagacgcgcaucucccaguucaacaugcacgucgacagccggcgccccgugauggaccaggaguacaucuacaagcagcgcuucauccuccaggugguccuggccggcgccuucuaccccaacuacuucaccuucgggcagcccgacgaggagauggccgugcgggagcuggcgggcaaggacccgaagaccaccgugguccugaagcacaucccgcccuacggguuccuguacuacaagcagcuccagucccuguuccgccagugcggccaggucaagagcaucguguucgacggcgccaaggccuucgucgaguucucccggaaccccacggagcgcuucaagacccugcccgccguguacauggccaucaagaugagccagcucaaggugagccuggagcuguccguccacagcgcggaggagaucgaggggaaggugcagggcaugaacguguccaagcuccggaacacccgcgucaacguggacuuccagaagcagaccguggaccccaugcaggucagcuucaacaccuccgaccggagccagacggugaccgaccugcugcucaccaucgacgucaccgaggugguggaggucgggcacuucuggggcuaccgcaucgacgagaacaacuccgagauccugaagaagcugacggccgagaucaaccagcucacccuggugccccugcccacccacccgcaccccgaccucgugugccuggcccccuucgccgacuucgacaagcagcgguacuuccgcgcccagguccuguacgugagcgggaacuccgcggagguguucuucgucgacuacggcaacaagagccacguggaccuccaccuccugauggagauccccugccaguuccuggagcugccguuccaggcccuggaguucaagaucugcaagaugcggcccuccgccaagagccucgugugcggcaagcacugguccgacggggccagccagugguucgccucccuggucagcggcugcacccugcucgugaagguguucuccgucgugcacagcgugcugcacgucgacguguaccaguacuccggggugcaggacgcgaucaacauccgcgacguccugauccagcagggcuacgccgagcucacggaggagagcuacgagagcaagcagucccacgaggugcugaaggggcuguucagcaaguccguggagaacaugaccgacggcagcguccccuuccccaugaaggacgacgagaaguaccucauccggauccugcuggaguccuucagcaccaacaagcucggcaccccgaacugcaaggccgagcugcacgggcccuucaaccccuacgagcugaagugccacucccucacgcgcaucagcaaguuccggugcguguggaucgagaaggaguccaucaacagcgugaucaucuccgacgccccggaggaccugcaccagcgcaugcuggucgcggccagccucuccaucaacgccaccggcagcaccaugcugcugcgggagaccucccucaugccccacauccccgggcugcccgcccugcucagcaugcuguucgccccggugaucgagcugcgcaucgaccagaacggcaaguacuacacgggggugcucugcggccugggcuggaaccccgcgaccggggccuccauccugcccgagcacgacauggagcucgccuucgacguccaguucagcguggaggacguggucgaggugaacauccugcgggccgccaucaacaagcuggugugcgacggccccaacgggugcaagugccucggcccggagcgcgucgcgcagcugcaggacaucgcccggcagaagcugcucgggcuguucugccaguccaagccccgcgagaagaucgugcccaaguggcacgagaagcccuacgaguggaaccagguggacccgaagcuggucauggagcaggccgaccgcgagagcagccggggcaagaacaccuuccuguaccagcuccacaagcugguggugcugggcaccuga

SEQ ID NO: 37545 - RNA, 1551 nt, Artificial Sequence
  derived and/or modified sequence opt1 from TDRKH__Homo_sapiens__NP_001077433
augagcaccgagcgcaccuccuggacgagccuguccaccauccagaagaucgcccucggccuggggauccccgccagcgcgaccguggccuacauccuguaccggcgcuaccgggagucccgcgaggagcggcucaccuucgucggcgaggacgacaucgagaucgagaugcgcgugccgcaggaggccgugaagcugaucaucgggcggcagggcgccaacaucaagcagcugcgcaagcagacgggggcccggaucgacgucgacaccgaggacgugggcgacgagcgcgugcuccugaucagcggcuuccccguccaggcguccggggccaagaucacgugcgacaaggagagcgagggcacccugcuccugucccggcugaucaagaucagcgggacccagaaggagguggccgccgcgaagcaccucauccuggagaagguguccgaggacgaggagcugcgcaagcggaucgcccacagcgccgagacccgcgucccccggaagcagcccaucuccgugcgccgggaggacaugaccgagccgggcggggccggcgagcccgcccucuggaagaacaccagcuccagcauggagcccacggcgccccuggugaccccgccgcccaagggcgggggcgacauggccgucgugguguccaaggaggggagcugggagaagcccuccgacgacagcuuccagaaguccgaggcccaggccauccccgagaugcccauguucgagauccccagccccgacuucagcuuccacgccgacgaguaccuggaggucuacguguccgcgagcgagcacccgaaccacuucuggauccagaucgugggcucccgcagccuccagcuggacaagcuggucaacgagaugacccagcacuacgagaacuccgugcccgaggaccucaccgugcacgucggcgacaucguggccgcgccccugcccacgaacgggagcugguaccgggcccgcgugcugggcacccucgagaacgggaaccuggaccuguacuucgucgacuucggcgacaacggggacugcccgcucaaggaccugcgggcccugcgcuccgacuuccucagccugcccuuccaggccaucgagugcucccuggcccgcaucgcccccagcggcgaccagugggaggaggaggcccucgacgaguucgaccggcugacccacugcgccgacuggaagccccugguggcgaagaucuccagcuacguccagaccggcaucuccacguggccgaagaucuaccucuacgacaccagcaacgggaagaagcuggacaucggccuggagcucgugcacaagggguacgccaucgagcugcccgaggacaucgaggagaaccgcgccgugcccgacaugcugaaggacauggccaccgagaccgacgcgucccucagcacgcugcugaccgagaccaagaaguccagcggcgagaucacccacacgcucagcugccugucccugagcgaggccgccuccaugagcggggacgacaaccucgaggacgacuaccugcuguga

SEQ ID NO: 37546 - RNA, 597 nt, Artificial Sequence
  derived and/or modified sequence opt1 from TDRP__Homo_sapiens__NP_001243042
auguggaagcugggccgcgggcgggugcuccuggacgagcccccggaggaggaggacggccugcgcggcgggcccccgcccgccgccgcggccgccgcccaggcccagguccagggggcgagcuuccggggcuggaaggaggugaccucccucuucaacaaggacgacgagcagcaccuccuggagcgcugcaagagccccaaguccaagggcaccaaccugcggcugaaggaggagcugaaggccgagaagaaguccggguucugggacaaccucgugcugaagcagaacauccagagcaagaagcccgacgagaucgagggcugggagccgcccaagcuggcccucgaggacaucagcgccgaccccgaggacacggucgggggccaccccuccuggagcgggugggaggacgacgcgaagggcuccaccaaguacaccagccuggccuccagcgccaacuccagccgcuggucccugcgggccgccggccgccucaucaaggagguguggaucaacuucagccagcugaucaucuccuuccggaagcacugccuggcgcacuaccgcgagcuccggcugugcaucaaguacuga

SEQ ID NO: 37547 - RNA, 1281 nt, Artificial Sequence
  derived and/or modified sequence opt1 from TEAD1__Homo_sapiens__NP_068780
auggagcccagcuccuggagcggcuccgagagcccggccgagaacauggagcgcauguccgacagcgccgacaagcccaucgacaacgacgcggaggggguguggucccccgacaucgagcagagcuuccaggaggcccuggccaucuacccgcccugcggccggcgcaagaucauccucuccgacgaggggaagauguacggccggaacgagcugaucgcccgcuacaucaagcugcggaccgggaagacccgcacgcggaagcaggucagcucccacauccaggugcucgcccgccgcaagagccgggacuuccacuccaagcugaaggaccagaccgcgaaggacaaggcccugcagcacauggccgccaugagcuccgcgcagaucgugagcgccaccgccauccacaacaagcucggccugcccggcaucccccggcccaccuucccgggggcccccggcuucuggcccgggaugauccagacgggccagcccggguccagccaggacgucaagccguucgugcagcaggccuaccccauccagcccgcggugaccgcccccaucccgggcuucgagcccgccuccgcccccgcccccagcgucccggcguggcagggccgcagcaucgggaccaccaagcugcggcucguggaguucuccgccuuccuggagcagcagcgcgaccccgacagcuacaacaagcaccuguucgugcacaucggccacgccaaccacuccuacagcgacccccuccuggaguccgucgacauccggcagaucuacgacaaguuccccgagaagaagggcgggcugaaggagcuguucggcaaggggccgcagaacgccuucuuccuggugaaguucugggccgaccugaacugcaacauccaggacgacgcgggcgccuucuacggggugacgagccaguacgaguccagcgagaacaugaccgugaccugcuccaccaaggugugcagcuucggcaagcaggucgucgagaagguggagacggaguacgcccgcuucgagaacgggcgguucguguaccgcaucaaccggucccccaugugcgaguacaugaucaacuucauccacaagcucaagcaccuccccgagaaguacaugaugaacagcguccuggagaacuucaccauccuccugguggugaccaaccgcgacacccaggagacgcugcucugcauggccugcgucuucgagguguccaacagcgagcacggcgcccagcaccacaucuaccggcuggugaaggacuga

SEQ ID NO: 37548 - RNA, 1353 nt, Artificial Sequence
  derived and/or modified sequence opt1 from TEAD2__Homo_sapiens__NP_001243587
augggcgagccccgcgccggggccgcgcuggacgacggcagcggguggaccggcuccgaggaggggagcgaggagggcaccggcggguccgagggcgccgggggcgacgggggcccggacgccgagggcguguggagccccgacaucgagcaguccuuccaggaggcccucgccaucuacccgcccugcgggcggcgcaagaucauccugagcgacgagggcaagauguacgggcggaacgagcugaucgcgcgcuacaucaagcuccggacgggcaagacccgcacccggaagcaggucuccagccacauccaggugcuggcccgccggaagucccgcgagauccagagcaagcugaaggaccagguguccaaggacaaggccuuccagaccauggccacgaugagcuccgcgcagcucaucagcgcccccucccugcaggccaagcugggccccaccgggccccaggucgugcaggccagcgagcuguuccaguucugguccggcgggagcgggcccccguggaacgugcccgacgucaagcccuucucccagacccccuucacccugagccugacgccgcccagcaccgaccuccccggcuacgagcccccgcaggcccugagcccccugcccccgcccacccccuccccgcccgcguggcaggcccggggccucggcaccgcccgccugcagcugguggaguucuccgccuucguggagccgcccgacgccgucgacagcuaccagcggcaccucuucgugcacaucucccagcacugccccagccccggggcgccgccccuggaguccguggacguccgccagaucuacgacaaguuccccgagaagaagggcgggcugcgggagcucuacgaccgcggcccgccccacgccuucuuccuggugaaguucugggccgaccugaacugggggcccagcggcgaggaggccggcgccgggggcuccaucagcuccgggggcuucuacggggugagcucccaguacgagagccucgagcacaugacgcugaccugcuccagcaaggucugcuccuucggcaagcaggucguggagaagguggagaccgagcgggcgcagcuggaggacggccgcuucguguaccggcuccugcgcagccccaugugcgaguaccuggugaacuuccuccacaagcugcggcagcugcccgagcgcuacaugaugaacuccguccucgagaacuucaccauccuccagguggugacgaaccgcgacacccaggagcugcuccugugcaccgccuacgucuucgaggugagcaccagcgagcgcggggcccagcaccacaucuaccggcugguccgggacuga

SEQ ID NO: 37549 - RNA, 1308 nt, Artificial Sequence
  derived and/or modified sequence opt1 from TEAD3__Homo_sapiens__NP_003205
auggccagcaacuccuggaacgccagcuccagccccggcgaggcgcgcgaggacgggccggagggccuggacaaggggcucgacaacgacgccgagggcguguggucccccgacaucgagcagagcuuccaggaggcccuggccaucuacccgcccugcgggcggcgcaagaucauccuguccgacgagggcaagauguacggccggaacgagcucaucgcccgcuacaucaagcugcggaccgggaagacccgcacgcggaagcaggucagcucccacauccaggugcuggcgcgcaagaaggugcgggaguaccaggucggcaucaaggccaugaaccucgaccaggugagcaaggacaaggcccugcaguccauggccagcauguccagcgcgcagaucguguccgccagcguccugcagaacaaguucuccccgcccagcccccucccccaggccguguucuccaccagcagccgcuucugguccagcccgccccugcuggggcagcagcccggccccucccaggacaucaagcccuucgcccagcccgccuaccccauccagcccccgcucccgcccacccugagcuccuacgagccccuggcgccccuccccagcgccgccgccuccgugcccgucuggcaggaccggaccaucgccagcucccgccugcggcugcucgaguacagcgcguucauggaggugcagcgcgaccccgacacguacuccaagcaccuguucgugcacaucgggcagaccaacccggccuucagcgacccgccccuggaggccgucgacgugcggcagaucuacgacaaguuccccgagaagaagggcggccucaaggagcuguacgagaaggggccgcccaacgccuucuuccuggugaaguucugggccgaccucaacuccaccauccaggagggccccggggcguucuacggcgucagcucccaguacagcuccgccgacagcaugaccaucuccgugagcacgaaggugugcagcuucggcaagcaggucguggagaagguggagaccgaguacgcccgccuggagaacgggcgguucgucuaccgcauccaccggucccccaugugcgaguacaugaucaacuucauccacaagcugaagcaccuccccgagaaguacaugaugaacagcgugcuggagaacuucaccauccuccagguggucaccucccgcgacagccaggagacgcugcuggugaucgccuucgucuucgagguguccaccagcgagcacggcgcccagcaccacguguacaagcuggucaaggacuga

SEQ ID NO: 37550 - RNA, 1305 nt, Artificial Sequence
  derived and/or modified sequence opt1 from TEAD4__Homo_sapiens__NP_003204
auggagggcaccgccgggaccaucacgagcaacgagugguccagccccaccuccccggagggcagcaccgccuccgggggcagccaggcgcuggacaagcccaucgacaacgacgccgaggggguguggucccccgacaucgagcagagcuuccaggaggcccucgccaucuacccgcccugcggccgccggaagaucauccuguccgacgagggcaagauguacgggcgcaacgagcugaucgcccgguacaucaagcuccgcaccggcaagacgcggacccgcaagcaggucagcucccacauccaggugcuggcgcggcgcaaggcccgggagauccaggccaagcugaaggaccaggccgcgaaggacaaggcccuccagagcauggccgccauguccagcgcccagaucaucuccgcgaccgccuuccacagcuccauggcccuggcccgcgggcccggccggcccgccgugagcggguucuggcagggcgcgcugcccggccaggccgggaccucccacgacgucaagccguucagccagcagacguacgccgugcagccgccccucccccugcccggcuucgagagccccgccgggcccgcccccuccccgagcgcgccgcccgccccgcccuggcagggccgcuccguggccagcuccaagcuguggaugcucgaguucagcgccuuccuggagcagcagcaggaccccgacaccuacaacaagcaccuguucguccacaucggccaguccagccccuccuacagcgaccccuaccucgaggccguggacauccggcagaucuacgacaaguuccccgagaagaagggcgggcugaaggaccuguucgagcgcgggcccuccaacgcguucuuccucgugaaguucugggccgaccugaacaccaacaucgaggacgagggcagcuccuucuacggggucagcucccaguacgagagccccgagaacaugaucaucacgugcuccaccaaggugugcagcuucggcaagcaggucguggagaagguggagaccgaguacgcccgguacgagaacggccacuacuccuaccgcauccaccggagcccccugugcgaguacaugaucaacuucauccacaagcucaagcaccucccggagaaguacaugaugaacagcgugcuggagaacuucaccauccugcaggucgugaccaaccgcgacacgcaggagacccugcugugcaucgccuacguguucgaggucuccgcgagcgagcacggggcccagcaccacaucuaccggcucgugaaggaguga

SEQ ID NO: 37551 - RNA, 1896 nt, Artificial Sequence
  derived and/or modified sequence opt1 from TEC__Homo_sapiens__XP_011512038
augaacuucaacaccauccuggaggagauccucaucaagcgcagccagcagaagaagaagaccagcccccugaacuacaaggagcggcuguucgugcucacgaaguccaugcugaccuacuacgagggccgcgccgagaagaaguaccggaagggguucaucgacgucuccaagaucaagugcguggagaucgugaagaacgacgacggcgucaucccgugccagaacaaguaccccuuccagguggugcacgacgccaacacccuguacaucuucgcgcccagcccccagucccgcgaccucugggucaagaagcugaaggaggagaucaagaacaacaacaacaucaugaucaaguaccacccgaaguucuggaccgacgggagcuaccagugcugccggcagacggagaagcuggcccccggcugcgagaaguacaaccucuucgaguccagcauccgcaaggcccugccgcccgcccccgagaccaagaagcggcgcccgcccccgcccaucccccuggaggaggaggacaacuccgaggagaucgugguggccauguacgacuuccaggcggccgaggggcacgaccuccggcuggagcgcggccaggaguaccugauccucgagaagaacgacguccacugguggcgggcccgcgacaaguacggcaacgagggguacauccccagcaacuacgugaccggcaagaaguccaacaaccuggaccaguacgagugguacugccggaacaugaaccgcagcaaggccgagcagcugcuccgguccgaggacaaggagggcggguucauggugcgcgacagcucccagcccgggcuguacaccgucagccuguacacgaaguucggcggcgagggguccagcggcuuccggcacuaccacaucaaggagaccaccaccucccccaagaaguacuaccucgcggagaagcacgccuucgggagcauccccgagaucaucgaguaccacaagcacaacgccgccggccuggugacgcgccugcgguaccccgugagcgucaagggcaagaacgcccccaccaccgcgggguucuccuacgagaagugggagaucaacccgagcgagcucaccuucaugcgcgagcugggcuccgggcuguucggcguggugcggcucgggaaguggcgcgcccaguacaaggucgccaucaaggccauccgcgagggcgccaugugcgaggaggacuucaucgaggaggcgaaggugaugaugaagcugacgcaccccaagcuggugcagcucuacggcgucugcacccagcagaagcccaucuacaucgugaccgaguucauggagcgggggugccugcugaacuuccuccgccagcggcagggccacuucagccgcgacgugcugcuguccaugugccaggacgucugcgaggggauggaguaccucgagcggaacagcuucauccaccgcgaccuggccgcccggaacugccugguguccgaggccggcgucgugaaggugagcgacuucgggauggcccgcuacguccucgacgaccaguacaccuccagcuccggcgcgaaguuccccgugaaguggugcccgcccgagguguucaacuacagccgguucuccagcaaguccgacgucuggagcuucggcgugcugaugugggagguguucacggaggggcgcaugcccuucgagaaguacaccaacuacgaggucgugaccauggugacccggggccaccgccuguaccagcccaagcucgccuccaacuacgucuacgaggugaugcugcggugcuggcaggagaagccggaggggcgccccagcuucgaggaccugcuccggacgaucgacgagcugguggagugcgaggagaccuucggccgcuga

SEQ ID NO: 37552 - RNA, 3804 nt, Artificial Sequence
  derived and/or modified sequence opt1 from TECPR2__Homo_sapiens__NP_001166102
auggccagcaucuccgagcccgugaccuuccgcgaguucugcccgcuguacuaccuccugaacgccauccccaccaagauccagaagggcuuccggagcaucgugguguaccugacggcgcucgacaccaacggggacuacaucgccgugggcuccagcaucgggaugcuguaccuguacugccgccaccucaaccagaugcggaaguacaacuucgagggcaagaccgaguccaucaccgucgugaagcugcugagcugcuucgacgaccucguggccgccgggacggccuccggccgcgucgcgguguuccagcuggugagcucccugcccggccggaacaagcagcuccgccgguucgacgucaccgggauccacaagaacagcaucaccgcccuggccuggucccccaacggcaugaagcuguucagcggggacgacaagggcaagaucguguacuccagccucgaccuggaccaggggcugugcaacucccagcucgugcuggaggagccgagcuccaucguccagcuggacuacagccagaaggugcuccugguguccacccugcagcgcagccuccuguucuacacggaggagaaguccguccggcagaucggcacccagccccgcaagagcaccggcaaguucggggccugcuucauccccggccugugcaagcagagcgaccucacccuguacgcgucccggcccgggcugcgccucuggaaggccgacgugcacggcacggugcaggccaccuucauccugaaggacgccuucgccggcggggucaagccguucgagcugcacccccggcucgagagccccaacuccggcagcugcucccugcccgagcgccaccuggggcucgugagcugcuucuuccaggagggcugggugcuguccuggaacgaguacagcaucuaccugcucgacaccgucaaccaggcgaccguggccgggcuggagggcuccggcgacaucgugagcgucuccugcacggagaacgagaucuucuuccugaagggggaccggaacaucauccgcaucagcucccggccggagggccucaccagcaccgugcgcgacgggcuggagauguccggcugcagcgagcggguccacgugcagcaggccgagaagcugcccggggccaccguguccgagacgcgccuccggggcagcagcauggccuccagcgucgcguccgagccccgcagccgcuccagcucccugaacagcaccgacuccggcagcgggcugcugcccccgggccuccaggccacccccgagcuggggaagggcucccagccccugagccagcgguucaacgccaucuccagcgaggacuucgaccaggagcucguggugaagcccaucaaggucaagcgcaagaagaagaagaagaagaccgagggcgggucccggagcacgugccacuccagccuggagagcaccccgugcuccgaguuccccggcgacagcccccagucccugaacaccgaccuccugagcaugaccuccagcgugcugggguccagcguggaccagcucuccgccgagagccccgaccaggaguccagcuucaacggcgaggucaacggggugccgcaggagaacacggaccccgagaccuucaacgugcuggaggucuccggcagcaugcccgacucccuggccgaggaggacgacauccgcaccgagaugccccacugccaccacgcgcacggccgggagcuccugaacggggcccgcgaggacgugggcgggagcgacgugaccggccugggggacgagccgugccccgccgacgacggccccaacuccacgcagcucccguuccaggagcaggacagcucccccggcgcccacgacggggaggacauccagcccaucggcccccagagcaccuucugcgaggucccgcugcugaacagccucaccgugcccuccagccuguccugggcccccagcgcggagcaguggcugcccgggacccgggccgacgagggcuccccgguggagcccagccaggagcaggacauccucacguccauggaggccagcgggcaccuguccaccaaccuguggcacgccgucaccgacgacgacaccggccagaaggagauccccaucagcgagcgcgugcucggcuccgucgggggccagcugacccccgugagcgcgcuggccgccuccacgcacaagccguggcucgagcagccgccccgggaccagacccugaccagcuccgacgaggaggacaucuacgcccacgggcugcccagcuccagcuccgagaccagcgugacggagcucggccccagcugcucccagcaggaccugagccgccugggggccgaggacgcgggccuccugaagcccgaccaguucgccgaguccuggaugggcuacagcgggcccggcuacgggauccugucccucguggucagcgagaaguacaucuggugccuggacuacaagggcgggcuguucugcuccgcccuccccggcgccggccugcgguggcagaaguucgaggacgccgugcagcaggucgcggugagcccguccggggcccugcucuggaagaucgagcagaaguccaaccgcgccuucgccugcggcaaggugaccaucaaggggaagcggcacugguacgaggcccugccccaggcgguguucgucgcccugagcgacgacaccgccuggaucauccgcaccagcggcgaccucuaccugcagacgggccuguccguggaccggcccugcgcccgcgcggugaaggucgacugccccuacccgcucagccagaucaccgcccggaacaacguggugugggcccugaccgagcagcgcgcccugcucuaccgggagggggucuccagcuucugccccgagggcgagcaguggaagugcgacaucguguccgagcgccaggcccuggagcccgugugcaucacccugggggaccagcagacgcucugggcgcuggacauccacggcaaccugugguuccgcaccgggaucaucagcaagaagccgcagggcgacgacgaccacugguggcaggucuccaucaccgacuacgugguguucgaccagugcagccucuuccagaccaucauccacgccacgcacagcgucgccaccgccgcccaggcgcccguggagaagguggccgacaagcugcggauggccuucuggucccagcagcugcagugccagcccagccuccugggcgucaacaacuccgggguguggaucagcuccggcaagaacgaguuccacguggccaaggggagccugaucggcaccuacuggaaccacgucgugccccgcgggaccgccuccgcgacgaagugggccuucgugcucgccagcgccgcgccgaccaaggagggcuccuuccuguggcugugccagagcuccaaggaccucugcagcgucuccgcccagagcgcccagucccggcccagcaccgugcagcugccgcccgaggccgagaugcgcgccuacgcggccugccaggacgcccugugggcccucgacucccugggccaggucuucauccggacccugagcaaguccugccccacggggaugcacuggacccgccucgaccugagccagcugggcgccgugaagcucaccagccuggcgugcgggaaccagcacaucugggccugcgacucccggggcgggguguacuuccgcgucggcacccagccccugaaccccagccucaugcugcccgccuggaucaugaucgagccgcccguccaggugucccggagcuga

SEQ ID NO: 37553 - RNA, 927 nt, Artificial Sequence
  derived and/or modified sequence opt1 from TECR__Homo_sapiens__NP_612510
augaagcacuacgagguggagauccuggacgccaagacccgcgagaagcucugcuuccuggacaaggucgagccccacgccaccaucgcggagaucaagaaccuguucacgaagacccacccgcagugguaccccgcccggcagagccuccgccuggaccccaagggcaagucccugaaggacgaggacgugcuccagaagcugcccguggggaccaccgccacgcuguacuuccgggaccucggcgcccagaucagcugggucaccguguuccugaccgaguacgccgggccgcuguucaucuaccuccuguucuacuuccgcgugcccuucaucuacggccacaaguacgacuucaccuccagccggcacacggucgugcaccuggcgugcaucugccacuccuuccacuacaucaagcgccuccuggagacccuguucgugcaccgguucagccacgggaccaugccccuccgcaacaucuucaagaacugcaccuacuacuggggcuucgccgccuggauggccuacuacaucaaccacccccuguacacgccgcccaccuacggcgcgcagcaggucaagcuggcccucgccaucuucgugaucugccagcuggggaacuucuccauccacauggcccugcgggaccuccgccccgccggcagcaagacccggaagauccccuacccgaccaagaaccccuucacguggcuguuccugcucguguccugccccaacuacaccuacgaggucgggagcuggaucggcuucgcgaucaugacccagugccugcccguggcccuguucucccucgugggguucacccagaugacgaucugggccaagggcaagcaccgcagcuaccugaaggaguuccgggacuacccgccccugcgcaugcccaucauccccuuccuccuguga

SEQ ID NO: 37554 - RNA, 1092 nt, Artificial Sequence
  derived and/or modified sequence opt1 from TECRL__Homo_sapiens__NP_001010874
auguucaagcgccacaagagccuggccuccgagcggaagcgcgcccuccugagccagcgggcgacccgcuucauccugaaggacgacaugcggaacuuccacuuccucuccaagcuggugcugagcgccggcccccuccgcccgacccccgccgucaagcacuccaagacgacccacuucgagaucgagaucuucgacgcccagacccggaagcagaucugcauccuggacaaggugacccagagcuccacgauccacgacgugaagcagaaguuccacaaggccugccccaagugguaccccagccgcgucgggcugcagcucgagugcggcgggccguuccugaaggacuacaucaccauccaguccaucgcggccagcuccaucgugacccuguacgccaccgaccucggccagcaggucagcuggacgaccguguuccuggccgaguacaccgggccccugcucaucuaccugcuguucuaccuccggauccccugcaucuacgacggcaaggaguccgcgcgccggcugcgccaccccguggugcaccuggccugcuucugccacugcauccacuacauccgguaccuccuggagacccuguucguccacaaggugagcgccggccacacgccgcucaagaaccugaucauguccugcgccuucuacuggggguucaccagcuggaucgccuacuacaucaaccacccccuguacaccccgcccuccuucggcaaccgccagaucaccgugagcgcgaucaacuuccucaucugcgaggccgggaaccacuucaucaacgucaugcugucccaccccaaccacacgggcaacaacgccugcuuccccagccccaacuacaaccccuucaccuggauguucuuccuggugagcugcccgaacuacaccuacgagaucggguccuggaucagcuucaccgugaugacgcagacccuccccgucggcaucuucacccugcugauguccauccagaugagccucugggcccagaagaagcacaagaucuaccugcggaaguucaacuccuacauccaccgcaagagcgccaugauccccuucauccuguga

SEQ ID NO: 37555 - RNA, 6468 nt, Artificial Sequence
  derived and/or modified sequence opt1 from TECTA__Homo_sapiens__NP_005413
augaacuacagcuccuuccugcgcaucugggugagcuucaucuucgcgcucguccagcaccaggcccagccccgcgagcugauguaccccuucuggcagaacgacaccaagacccccaagguggacgacggcuccagcuccgagaucaagcuggcgauccccguguucuucuucgggguccccuaccgcaccguguacgugaacaacaacggcgucgugagcuucaacgugcucgucucccaguucaccccggagagcuucccccugaccgacgggcgggccuucguggcccccuucugggccgacgugcacaacggcauccgcggggagaucuacuaccgggagaccauggagcccgccauccugaagcgcgcgacgaaggacauccggaaguacuucaaggacauggccaccuucuccgccaccugggucuucaucgugaccugggaggaggugacguucuacggcggcagcuccaccaccccggucaacaccuuccaggccgugcucgugagcgacggguccuacacguucacccuguucaacuacuacgagaucaacuggaccaccggcacggcgagcgggggcgacccccugaccgggcucggcggcgucauggcccaggccggguucaacggcgggaaccugaccaacuucuucucccugcccggcagccgcacccccgagaucgugaacauccaggagacgaccaacgugaacgucccgggccggugggccuucaagguggacgggaaggagaucgaccccgccaacggcugcaccucccgcgggcaguuccuccggcgcggcgagguguucugggacgaccugaacugcaccgucaagugccggugccuggacuucaacaacgagaucuacugccaggaggcgagcugcucccccuacgaggugugcgagcccaaggggaaguucuucuacugcagcgccgucgagacguccacgugcgugguguucggcgagccgcacuaccacaccuucgacggcuuccucuuccacuuccagggguccugcgccuaccugcuggcccgccagugccuccagaccagcucccugcccuucuucagcgucgaggccaagaacgagcaccggcgcggcuccgcggugagcugggugaaggagcuguccgucgaggugaacggguacaagauccucauccccaagggcagcuacgggcgggugaaggucaacgaccuggugaccucccugcccgugacccucgaccugggcaccgucaagaucuaccagagcggcaucuccaccgccguggagacggacuucgggcugcucgugaccuucgacggccagcacuacgccagcaucuccgucccggggagcuacaucaacagcacgugcggccugugcgggaacuacaacaagaacccccuggacgacuuccuccgccccgacggccggcccgccaugagcgugcuggaccugggcgaguccuggcgcguguaccacgccgacuggaagugcgacagcgggugcgucgacaacugcacccagugcgacgcggccaccgaggcccucuacuucggcuccgacuacugcggguuccugaacaagaccgacggcccgcugugggagugcggcaccgugguggaccccaccgccuucguccacagcugcguguacgaccucugcagcgugcgggacaacgggacccugcugugccaggccauccaggcguacgcccucgucugccaggcccugggcauccccaucggggacuggcgcacgcagaccggcugcguguccaccgugcagugccccagcuucucccacuacagcgucugcaccuccagcugcccggacacgugcuccgaccugaccgccagccgcaacugcgcgacccccugcaccgaggggugcgagugcaaccagggcuucgugcucuccacgagccagugcgugccccugcacaagugcggcugcgacuucgacgggcacuacuacaccaugggcgaguucuucugggccaccgccaacugcaccguccagugccugugcgaggagggcggggacguguacugcuucaacaagacgugcggguccggcgaggugugcgccgucgaggacggcuaccaggggugcuucccgaagcgggagaccgugugccuccugagccagaaccaggugcugcacaccuucgacggcgccuccuacgcguuccccagcgaguucuccuacacccuccugaagacgugccccgagcgccccgaguaccuggagaucgacaucaacaagaagaagccggacgccgggcccgccuggcugcggggccuccgcauccuggucgccgaccaggaggugaagaucgggggcaucggcgccagcgaggugaagcugaacgggcaggaggucgagcuccccuucuuccaccccuccggcaagcuggagaucuaccggaacaagaacagcaccaccguggagagcaaggggguggucaccgugcaguacuccgacaucggccugcucuacauccgccugagcacgaccuacuucaacugcaccgggggccugugcggcuucuacaacgcgaacgccuccgacgaguucugccucccgaacgggaagugcaccgacaaccuggccguguuccuggagagcuggacgaccuucgaggagaucugcaacggcgagugcggggaccuccugaaggccugcaacaacgacuccgagcugcucaaguucuaccggagccgcucccggugcggcaucaucaacgaccccagcaacuccagcuuccuggagugccacggcgucgugaacgugaccgccuacuaccggaccugccuguuccggcucugccaguccgggggcaacgagagcgagcugugcgacuccgucgcgcgcuacgccagcgccugcaagaacgccgacguggagguggggcccuggcggacguacgacuucugcccccuggagugcccggagaacucccacuucgaggagugcaucacgugcaccgagaccugcgagacgcucacccugggccccaucugcgucgacagcugcuccgaggggugccagugcgacgagggcuacgcgcugcucggcagccagugcgugacccgcuccgagugcgggugcaacuucgagggccaccagcuggccaccaacgagacguucugggucgaccuggacugccagaucuucugcuacugcagcgggaccgacaaccgggugcacugcgagaccauccccugcaaggacgacgaguacugcauggaggagggcgggcucuacuacugccaggcccgcaccgacgccagcugcaucguguccggcuacggccacuaccugaccuucgacggguuccccuucgacuuccagacgagcugcccgcugauccucugcaccaccggcucccggcccagcuccgacagcuuccccaaguucgucgugaccgccaagaacgaggaccgcgaccccucccuggcgcugugggugaagcaggucgacgugacgguguucggguacagcaucgucauccaccgggccuacaagcacaccgugcucgugaacuccgagcgccuguaccugccgcucaagcugggccaggggaagaucaacaucuucagcuucggcuuccacgucgugguggagaccgacuucggccugaaggucguguacgacuggaagaccuuccucuccaucacggugccccgcagcaugcagaacuccaccuacgggcugugcggccgguacaacgggaaccccgacgacgaccuggagaugcccaugggccuccuggccagcuccgucaacgaguucggccagagcugggugaagcgcgacaccuucugccagguggggugcggcgaccggugcccguccugcgccaaggucgagggguucagcaaggugcagcagcugugcucccucauccccaaccagaacgccgcguucagcaagugccacagcaaggugaaccccaccuucuucuacaagaacugccuguucgacuccugcaucgacggcggggccguccagacggccugcagcuggcugcagaacuacgccagcacgugccagacccagggcaucaccgugaccggcuggcgcaacuacaccagcugcaccgugaccugcccgcccaacucccacuacgagagcugcgucuccgugugccagccccggugcgccgcgauccgccucaagagcgacugcucccacuacugcguggaggggugccacugcgacgccggcuacguccugaacggcaaguccugcauccugccccacuccugcggcugcuacagcgacgggaaguacuacgagccgaagcagcuguucuggaacuccgacugcacgcggcgcugccggugcuuccgccggaacgugauccagugcgacccccgccagugcaagagcgacgaggagugcgcccugcggaacggcgugcgcggcugcuucuccaccaagaccagcuacugccuggccgccgggggcggggucuuccggaccuucgacggggccuuccuccgcuuccccgccaacugcgccuucgugcuguccacgaucugccagaagcugcccgacaucagcuuccagcucaucaucaacuucgacaagugguccgccccgaaccugaccaucaucagccccguguacuucuacaucaacgaggagcagauccugaucaacgaccggaacaccgucaaggugaacgggacccaggugaacguccccuucaucacgggccucgcgaccaagaucuacagcuccgagggcuuccuggugaucgacaccagccccgacauccagaucuacuacaacggguucaacgugaucaagaucuccaucagcgagcgccugcagaacaaggucugcggccucugcgggaacuucaacggcgaccugaccgacgacuacgugacgcugcgggggaagccgguggucuccagcguggugcucgcccaguccuggaagaccaacggcaugcagaagcgcccccuggcccccagcugcaacgagcugcaguucucccaguacgccgccaugugcgacaacguccacauccagaagaugcagggcgacggguacugccucaagcugaccgacaugaagggcuucuuccagcccugcuacgggcugcucgacccgcugcccuucuacgagagcugcuaccuggacggcugcuacucccacaagaaguuccagcucugcggcagccuggcggccuacggggaggccugccgguccuucggcauccugagcaccgaguggaucgagaaggagaacugcuccggggugguggaggaccccugcgucggcgccgacugccccaaccgcacgugcgagcucgggaacggccgcgagcugugcggcugcaucgagccgccgcccuacgggaacaacagccacgacaucaucgacgccgaggugaccugcaaggcggcccagauggaggucuccaucagcaagugcaagcuguuccagcucggcuucgagcgggagggggugcgcaucaacgaccggcagugcaccggcaucgagggggaggacuucaucuccuuccagaucaacaacaccaagggcaacugcggcaacaucgugcagagcaacgggacccacaucauguacaagaacacgcuguggaucgagagcgccaacaacaccggcaacaucaucacccgcgaccggaccaucaacgucgaguucuccugcgccuacgagcuggacaucaagaucagccucgacuccguggugaagcccaugcugagcgucaucaaccugacggugccgacccaggagggguccuucaucaccaagauggcccucuacaagaacgcgagcuacaagcaccccuaccgccagggcgaggugguccugaccacgcgggacgugcuguacgugggggucuucguggugggcgccgacgccacccaccucauccugacccugaacaagugcuacgccacccccacgcgcgacuccaacgacaagcuccgguacuucaucaucgagggcgggugccagaaccugaaggacaacaccaucggcaucgaggagaacgcggucagccugaccugccgcuuccacgugaccguguucaaguucaucggggacuacgacgagguccaccuccacugcgccgugucccugugcgacagcgagaaguacuccugcaagaucacgugcccccacaacagccggaucgccaccgacuacaccaaggagccgaaggagcagaucaucuccgugggccccauccgccggaagcgccuggacuggugcgaggacaacgggggcugcgagcagaucugcaccagccgggucgacggcccccugugcuccugcgugacggggacccuccaggaggacggcaagagcugccgcgccuccaacagcuccauggagcuccagguguggacccugcuccugaucaugauccagaucagccuguggcacuucgucuacaagagcgggaccacguccuga

SEQ ID NO: 37556 - RNA, 822 nt, Artificial Sequence
  derived and/or modified sequence opt1 from TEF__Homo_sapiens__NP_001138870
auggacaugcccgaggugcucaagagccugcuggagcacucccugccguggcccgagaagcgcaccgacaaggagaagggcaaggagaagcucgaggaggacgaggccgccgcggccagcaccauggccgucuccgccagccugaugccgcccaucugggacaagacgauccccuacgacggggaguccuuccaccuggaguacauggaccucgacgaguuccugcuggagaacggcauccccgccagccccacccaccucgcgcacaaccugcugcuccccguggccgagcuggaggggaaggaguccgccagcuccagcaccgccuccccgcccagcuccagcaccgcgaucuuccagcccuccgagacggugagcuccaccgagagcucccuggagaaggagcgggagacccccagcccgaucgaccccaacugcgucgagguggacgugaacuucaaccccgaccccgccgaccucguccugagcuccgugccgggcggggagcuguucaacccccgcaagcacaaguucgccgaggaggaccucaagccccagcccaugaucaagaaggccaagaagguguucgucccggacgagcagaaggacgagaaguacuggacccggcgcaagaagaacaacguggccgcgaagcggagccgcgacgcccggcgccugaaggagaaccagaucacgauccgggccgccuuccuggagaaggagaacaccgcccuccgcaccgagguggcggagcugcggaaggaggucggcaagugcaagaccaucguguccaaguacgagacgaaguacggcccccuguga

SEQ ID NO: 37557 - RNA, 1083 nt, Artificial Sequence
  derived and/or modified sequence opt1 from TEFM__Homo_sapiens__NP_078959
augagcggcuccgugcuguucaccgccggggagcgcuggcggugcuuccucacccccagccgcuccagccuguacugggcccugcacaacuucugcugccggaagaaguccacgaccccgaagaagaucacccccaacgucaccuucugcgacgagaacgcgaaggagcccgagaacgcccucgacaagcuguucagcuccgagcagcaggccagcauccugcacgugcucaacacggccuccaccaaggagcuggaggccuuccgccugcuccggggccgccggagcaucaacaucguggagcaccgcgagaacuucgggcccuuccagaaccuggagucccugaugaacgucccccucuucaaguacaagagcaccguccaggugugcaacuccauccugugcccgaagaccggccgggagaagcgcaagagccccgagaaccgguuccugcgcaagcuccugaagcccgacaucgagcgggagcgccugaaggcggugaacuccaucaucagcaucguguucgggacgcggcgcaucgccugggcccaccucgaccggaagcugaccgugcuggacuggcagcaguccgaccgcuggagccucaugcggggcaucuacuccagcagcgucuaccuggaggagaucuccagcaucaucuccaagaugccgaaggccgacuucuacgugcuggagaagaccggccucagcauccagaacuccagccuguuccccauccugcuccacuuccacaucauggaggcgaugcuguacgcccugcucaacaagaccuucgcccaggacgggcagcaccaggugcuguccaugaaccgcaacgccgucggcaagcacuucgagcugaugaucggggacagccggacguccggcaaggagcucgugaagcaguuccuguucgacagcauccugaaggccgacccccgcguguucuuccccuccgacaagaucguccacuaccgccagauguuccucagcaccgagcugcagcggguggaggagcuguacgacucccuccugcaggcgaucgccuucuacgagcuggccguguucgacagccagccguga

SEQ ID NO: 37558 - RNA, 3375 nt, Artificial Sequence
  derived and/or modified sequence opt1 from TEK__Homo_sapiens__NP_000450
auggacagccuggccucccucgugcugugcggcgucagccugcuccuguccgggaccguggagggcgccauggaccugauccucaucaacagccugccccugguguccgacgcggagaccagccucacgugcaucgccuccggguggcgcccgcacgagcccaucaccaucggccgggacuucgaggcccugaugaaccagcaccaggacccccuggaggucacccaggacgugacccgcgagugggccaagaagguggucuggaagcgggagaaggccagcaagaucaacggggcguacuucugcgagggccgcgugcggggcgaggccauccgcauccggacgaugaagaugcgccagcaggccuccuuccuccccgccacccugaccaugaccguggacaagggggacaacgucaacaucagcuucaagaaggugcugaucaaggaggaggacgcggugaucuacaagaacggcuccuucauccacagcgucccgcggcacgaggugcccgacauccucgaggugcaccucccccacgcccagccccaggacgccggggucuacuccgcccgcuacaucggcgggaaccuguucacgagcgccuucacccggcucaucgugcgccggugcgaggcgcagaaguggggcccggagugcaaccaccugugcaccgccugcaugaacaacggcgugugccacgaggacaccggggagugcaucugcccgcccggcuucauggggcgcacgugcgagaaggccugcgagcugcacaccuucggccggaccugcaaggagcgcugcuccggccaggaggggugcaagagcuacgucuucugccuccccgaccccuacggcugcuccugcgccaccggguggaagggccugcagugcaacgaggccugccaccccggguucuacggccccgacugcaagcugcggugcagcugcaacaacggcgagaugugcgaccgcuuccaggggugccucugcucccccggcuggcaggggcugcagugcgagcgggagggcaucccgcgcaugacgcccaagaucguggaccugcccgaccacaucgaggugaacagcgggaaguucaaccccaucugcaaggcgagcggcuggccgcuccccaccaacgaggagaugacccuggucaagcccgacggcaccgugcugcaccccaaggacuucaaccacacggaccacuucuccguggccaucuucaccauccaccggauccucccgcccgacagcggggucugggugugcuccgucaacaccguggccggcaugguggagaagcccuucaacaucagcgucaaggugcugcccaagccgcugaacgcccccaacgugaucgacaccgggcacaacuucgccgucaucaacaucuccagcgagcccuacuucggcgacgggccgaucaaguccaagaagcuccuguacaagcccgugaaccacuacgaggcguggcagcacauccaggugacgaacgagaucgucacccugaacuaccucgagccccgcaccgaguacgagcugugcgugcagcuggugcgccggggcgagggcggggagggccaccccgggccgguccgccgguucaccacggccagcaucggccugcccccgccccgcggccugaaccugcuccccaagucccagaccacccugaaccugaccuggcagcccaucuuccccagcuccgaggacgacuucuacguggagguggagcggcgcagcguccagaaguccgaccagcagaacaucaaggugcccgggaaccucacgagcgugcugcugaacaaccuccacccgcgggagcaguacgucgugcgcgcccgggugaacaccaaggcccagggcgagugguccgaggaccugaccgccuggacccugagcgacauccugccgccccagcccgagaacaucaagaucuccaacaucacgcacagcuccgcggucaucagcuggaccauccucgacggguacagcaucuccagcaucaccauccgcuacaaggugcagggcaagaacgaggaccagcacguggacgucaagaucaagaacgccaccaucacccaguaccagcugaaggggcuggagcccgagacggccuaccagguggacaucuucgccgagaacaacaucggcuccagcaaccccgcguucucccacgagcucgugacccugcccgagagccaggcccccgccgaccugggcgggggcaagaugcuccugaucgccauccugggguccgccggcaugaccugccucaccguccugcuggcguuccucaucauccugcagcugaagcgggccaacgugcagcgccggauggcccaggccuuccagaacgugcgcgaggagccggccguccaguucaacagcgggacgcucgcgcugaaccggaaggugaagaacaaccccgaccccaccaucuaccccgugcuggacuggaacgacaucaaguuccaggacgucaucggcgagggcaacuucggccaggugcucaaggcccgcaucaagaaggacgggcugcggauggacgccgccaucaagcgcaugaaggaguacgccuccaaggacgaccaccgggacuucgcgggggagcuggaggugcucugcaagcugggccaccacccgaacaucaucaaccugcucggggccugcgagcaccgcggcuaccuguaccuggccaucgaguacgcgccccacggcaaccuccuggacuuccugcgcaagagccggguccucgagaccgaccccgccuucgccaucgccaacuccaccgccagcacgcuguccagccagcagcugcuccacuucgccgcggacguggcccgcgggauggacuaccugucccagaagcaguucauccaccgggaccuggccgcccgcaacauccucgugggcgagaacuacgucgccaagaucgcggacuucgggcugagccggggccaggagguguacgugaagaagaccauggggcgccugccgguccgguggauggccaucgagucccucaacuacagcguguacaccaccaacagcgacgugugguccuacggcguccugcugugggagaucgugagccucggcgggacgcccuacugcggcaugaccugcgccgagcuguacgagaagcugccccagggguaccgccucgagaagccccugaacugcgacgacgagguguacgaccugaugcggcagugcuggcgcgagaagccguacgagcggcccuccuucgcccagauccucgucagccugaaccgcaugcuggaggagcggaagaccuacgugaacaccacgcucuacgagaaguucaccuacgccggcaucgacugcuccgcggaggaggccgccuga

SEQ ID NO: 37559 - RNA, 1257 nt, Artificial Sequence
  derived and/or modified sequence opt1 from TEKT1__Homo_sapiens__NP_444515
auggccaagcugcuccagcccccgcccaaguuccugcccagcgaguggcacaucgccaacaagaaccaguaccaccgcgcggacgcccagcggucccgcagcgagcggcugguggccgagucccagcgccucgucgacgagaucgagaagaccacccgcaagagccaguccgacgugaacaagaagcuggagcagcggcuggaggaggugcaguucuggaagaaggagcucgacgacaagcuggagcagcuggucaacgugacggacgaccuccugaucuacaagauccggcuggagaaggcccucgagacccugaaggagccccugcacaucaccgagaccugccucgccuaccgcgagaagcggaucggcaucgaccuggugcacgacacggucgagcacgagcugaucaaggaggcggagaucauccaggggaucauggcccuccugacccgcacccuggaggaggccagcgagcagauccggaugaaccgcuccgccaaguacaaccucgagaaggaccugaaggacaaguucguggcgcugaccaucgacgacaucugcuucagccucaacaacaacuccccgaacauccgguacagcgagaacgccgugcgcaucgagcccaacuccgucagccuggaggacuggcuggacuucuccagcacgaacguggagaaggccgacaagcagcggaacaacucccucaugcugaaggcccugguggaccgcauccucagccagaccgccaacgaccugcggaagcagugcgacgucguggacaccgcguucaagaacggccugaaggacaccaaggacgcccgcgacaagcucgccgaccaccuggccaaggugauggaggagaucgccucccaggagaagaacaucacggcgcuggagaaggccauccucgaccaggaggggcccgccaaggucgcccacacccggcuggagacccgcacccaccggcccaacguggagcugugccgcgacguggcccaguaccgccucaugaaggagguccaggagaucacgcacaacguggcgcggcugaaggagacccuggcccaggcccaggccgagcucaagggccugcaccgccggcagcuggcccuccaggaggagauccaggugaaggagaacaccaucuacaucgacgagguccugugcaugcagaugcgcaagagcaucccgcugcgggacggggaggaccacggcgugugggcgggcgggcuccgccccgacgccgugugcuga

SEQ ID NO: 37560 - RNA, 1458 nt, Artificial Sequence
  derived and/or modified sequence opt1 from TEKT5__Homo_sapiens__NP_653275
auggaguuccugggcaccacccagacggccagcuacugcgggcccaagaagugcugcggccucaccucccugccggccgugcaggcgcccgucauccaggagugcuaccagcccuacuaccugcccggguaccgcuaccucaacagcuggcggccgucccuguucuacaagaucgccaacgugcagaccugccccgacgagagcaccuccacgcugcgcccgcccaccauccuccccacccugcggagcgcccuguucucccgcuacagcccccacgacugggaccaguccaaccagcuccaggugcggggcgccgaggccagccgccugugggcgucccggcugaccgacgacagcaugcgccuccugcaggacaaggaccagcugacgcaccagaugcaggaggggaccugccggaaccucggccagcgccuguccgacaucggcuucuggaaguccgagcugagcuacgagcucgaccggcugcugaccgagaaccagaaccucgagaccgucaagcgccggcuggagugcgccgccaacgaggugaacugcccccuccagguggcccuggagugccuguaccaccgcgagaagcggaucgggaucgaccugguccacgacaacguggagaagaaccucauccgcgagguggaccugcugaagugcugccaggagcagaugcggaagcucgcgcagcgcaucgacauccagaugcgggacaaccgcgacgcccagcacguccuggagcgggaccuggaggacaagagcuccgcccagugcaucgacgagaagugcuucaaccuccgcaacacgagcgacugcaucuccuucuuccacggcauggagaagaucgacgggaccaucagcgugcccgagaccugggccaaguucagcaacgacaacaucaagcacucccagaacaugcgcgccaacagcauccagcugcgggaggaggcggagcaccuguucgagacccucuccgaccagauguggcgccaguucacggacaccaaccuggccuucaacgcccggaucagcgaggugaccgacgucaagaacaagcugcagacccagcucgccaagacgcugcaggagaucuuccaggccgagaacaccaucaugcugcucgagcgcuccaucauggcgaaggagggcccgcugaagguggcccagacccggcuggagugccgcacccggcgccccaacauggagcucugccgggacaucccccagcugaagcuggugaacgaggucuucacgaucgacgacacccuccagacccugaagcugcgccugcgggagacccaggacacgcuccagcugcuggugaugaccaagugccgccucgagcacgagcuggccaucaaggccaacacccugugcaucgacaaggagaagugcauggggaugcggaagaccuuccccugcacgccgcgccucgugggccacaccuga

SEQ ID NO: 37561 - RNA, 2514 nt, Artificial Sequence
  derived and/or modified sequence opt1 from TELO2__Homo_sapiens__NP_057195
auggagcccgcccccagcgaggugcgccuggccguccgggaggcgauccacgcccucuccagcuccgaggacggcgggcacaucuucugcacccuggagagccugaagcgcuaccucggcgagauggagccgcccgcccugccccgggagaaggaggaguucgccuccgcccacuucagccccgugcugcgcugccucgcgucccggcugagccccgccuggcuggagcuccugccccacgggcgccuggaggagcucugggccuccuucuuccuggagggccccgccgaccaggcguuccuggugcucauggagaccaucgagggggccgccggcccgagcuuccggcugaugaagauggcccgccugcucgcccgguuccugcgcgagggccggcuggcgguccucauggaggcccagugccgccagcagacgcagcccggguucauccugcugcgggagacccuccugggcaaggugguggcccugcccgaccaccucgggaaccgccugcagcaggagaaccuggccgaguucuucccccagaacuacuuccggcuccugggcgaggaggucgugcgcgugcugcaggccgucguggacucccuccagggcggccuggacagcuccgugagcuucgucucccaggugcugggcaaggcgugcgugcacgggcggcagcaggagauccucggcguccuggugccgcgccuggccgcccucacccaggggagcuaccugcaccagcgggugugcuggcgccuggucgagcagguccccgaccgggccauggaggccgugcucaccggccugguggaggcggcccugggccccgaggugcucucccgccugcuggggaaccucguggucaagaacaagaaggcccaguucgugaugacgcagaagcugcuguuccugcagagccgccucaccacccccaugcugcagucccugcucggccaccuggccauggacagccagcggcgcccgcugcuccugcagguccugaaggagcuccuggagaccugggggagcuccagcgccauccggcacacgccccugccccagcagcgccacguguccaaggcggugcucaucugccuggcccagcugggcgagcccgagcuccgggacagccgcgacgagcugcuggccuccaugauggccggggucaagugccggcucgacagcucccugccgcccgugcgccggcugggcaugaucguggcggaggucgugagcgcccgcauccaccccgaggggcccccgcucaaguuccaguacgaggaggacgagcugucccuggagcuccuggcccuggccagcccccagcccgccggggacggcgcguccgaggccgggaccagccucgugcccgccaccgccgagccgcccgccgagacccccgcggagaucgucgacggcggggugccgcaggcccagcuggccggcuccgacagcgaccuggacuccgacgacgaguucgugcccuacgacaugagcggcgaccgggagcucaaguccagcaaggcccccgccuacguccgcgacugcguggaggcgcugacgaccuccgaggacaucgagcggugggaggccgcccugcgcgcccucgaggggcugguguaccggagccccaccgcgacccgcgaggucagcguggagcuggccaaggugcuccugcaccuggaggagaagacgugcgucgugggcuucgccgggcuccggcagcgcgcccugguggccgucaccgugaccgacccggcgcccguggccgacuaccugaccucccaguucuacgcccucaacuacagccugcggcagcgcauggacauccuggacguccucacgcuggccgcccaggagcugucccgccccggcugccucgggcggacgccccagccgggcagccccucccccaacacccccugccugccggaggcggccgugagccagcccggcuccgccguggccagcgacuggcgcgucgugguggaggagcggauccgcuccaagacccagcggcugagcaagggcgggccccgccaggggcccgccggcuccccgagccgguucaacuccgucgcgggccacuucuucuucccccuccugcagcgcuucgaccggccccuggugaccuucgaccuccugggggaggaccagcuggugcucggccgccuggcccacacccugggggcccucaugugccuggccgucaacaccaccguggcgguggccaugggcaaggcccugcucgaguucgucugggcccugcgguuccacaucgacgccuacgugcgccaggggcugcucagcgcgguguccagcguccugcugucccuccccgccgcccggcugcuggaggaccucauggacgagcugcuggaggcccgcagcuggcucgccgacguggcggagaaggacccggacgaggacugccggacgcuggcccugcgcgcccuccugcugcuccagcggcugaagaaccgccugcucccgcccgccagccccuga

SEQ ID NO: 37562 - RNA, 8178 nt, Artificial Sequence
  derived and/or modified sequence opt1 from TENM1__Homo_sapiens__NP_055068
auggagcagaccgacugcaagcccuaccagccccugcccaaggugaagcacgagauggaccuggcguacaccagcuccagcgacgaguccgaggacggccgcaagccccggcagagcuacaacucccgcgagacccugcacgaguacaaccaggagcugcggaugaacuacaacagccagucccgcaagcggaaggagguggagaaguccacccaggagauggaguucugcgagaccucccacacccucugcagcggguaccagaccgacaugcacuccgugagccgccacggcuaccagcuggagaugggguccgacguggacaccgagaccgagggcgccgcgagccccgaccacgcccugcggauguggauccgcgggaugaaguccgagcacagcuccugccucagcucccgggccaacagcgcccugagccugaccgacacggaccacgagcgcaaguccgacggcgagaacggcuucaaguucagccccgucugcugcgacauggaggcccaggcgggguccacccaggacgugcagagcagcccgcacaaccaguucaccuuccggccccugccgccgcccccgccgccgccccacgccugcacgugcgcccgcaagcccccgcccgccgcggacagccugcagcggcgcuccaugacgacccggagccagcccucccccgccgcccccgccccgcccaccagcacccaggacuccgugcaccuccacaacagcuggguccucaacuccaacaucccccuggagacgcgccacuuccuguucaagcacggcagcggguccagcgccaucuucuccgcggccagccagaacuacccccucaccuccaacaccguguacagcccgccgccccggccccugccccgcagcaccuucucccggcccgccuucacguucaacaagcccuaccgcugcugcaacuggaagugcaccgcccugagcgccaccgcgaucaccgugacgcucgcccugcugcucgccuacgucaucgccgugcaccuguucggccugaccuggcagcuccagcccguggagggggagcuguacgccaacggcgucuccaagggcaaccgggggaccgagagcauggacaccacguacucccccaucggcgggaaggugagcgacaaguccgagaagaagguguuccagaagggccgcgcgaucgacaccggcgaggucgacaucggggcccaggugaugcagaccaucccgcccggccuguucuggcgcuuccagaucaccauccaccaccccaucuaccucaaguucaacaucagccuggccaaggacucccugcucgggaucuacggccggcgcaacaucccgcccacgcacacccaguucgacuucgugaagcugauggacgggaagcagcuggucaagcaggacagcaagggcuccgacgacacccagcacagcccccggaaccucauccugaccucccugcaggagacgggcuucaucgaguacauggaccaggggcccugguaccucgccuucuacaacgacggcaagaagauggagcaggucuucgugcugaccaccgccaucgagaucauggacgacugcagcaccaacugcaacgggaacggcgagugcaucuccgggcacugccacugcuuccccggcuuccugggccccgacugcgcgcgcgacagcugccccguccucugcgggggcaacggggaguacgagaagggccacugcgugugccggcacggguggaagggccccgagugcgacgugcccgaggagcagugcaucgaccccacgugcuucggccacgggaccugcaucaugggcgucugcaucugcgugcccggguacaagggcgagaucugcgaggaggaggacugccuggaccccaugugcuccaaccacggcaucugcgucaagggggagugccacugcagcaccggcuggggcggggugaacugcgagacgccccuccccgugugccaggagcagugcagcgggcacggcaccuuccuccuggacgccggcgucugcuccugcgaccccaaguggacggggagcgacugcuccaccgagcugugcaccauggagugcggcagccacggggugugcucccgcggcaucugccagugcgaggaggggugggugggcccgaccugcgaggagcggagcugccacucccacugcacggagcacggccagugcaaggacgggaagugcgagugcagccccggcugggagggggaccacugcaccaucgcccacuaccucgacgccguccgcgacggcugccccgggcugugcuucggcaacggccggugcacccuggaccagaacggguggcacugcgugugccaggugggcugguccgggaccggcugcaacgucgugauggagaugcucugcggggacaaccuggacaacgacggcgacggccugacggacugcguggaccccgacugcugccagcagagcaacugcuacaucuccccgcugugccaggggagccccgacccccucgaccugauccagcagucccagacccuguucagccagcacaccucccgccucuucuacgaccggaucaaguuccugaucggcaaggacagcacccacgucaucccgcccgagguguccuucgacagccgccgggcgugcgugauccgcgggcaggucguggccaucgacggcacgccccuggugggcgucaacguguccuuccuccaccacagcgacuacggguucaccaucagccggcaggacggcuccuucgaccugguggccaucgggggcaucagcgucauccugaucuucgaccgcucccccuuccuccccgagaagcggacccuguggcugcccuggaaccaguucaucgugguggagaaggucaccaugcagcgcguggugagcgacccgcccuccugcgacaucagcaacuucaucuccccgaaccccaucguccuccccagcccccugaccuccuucgggggcagcugcccggagcggggcaccaucgugcccgagcuccaggugguccaggaggagauccccauccccuccagcuucgugcgccucuccuaccugagcucccgcaccccgggguacaagacccugcuccggauccugcugacgcacagcaccauccccgugggcaugaucaagguccaccucaccguggccguggaggggcgccugacccagaagugguuccccgccgcgaucaaccuggucuacacguucgccuggaacaagaccgacaucuacggccagaaggugugggggcucgccgaggcccugguguccgucggcuacgaguacgagaccugccccgacuucauccugugggagcagcggaccguggugcuccagggcuucgagauggacgccagcaaccugggcggguggucccugaacaagcaccacauccucaacccgcagagcgggaucauccacaaggggaacggggagaacauguucaucagccagcagccgcccgucaucuccacgaucaugggcaacggccaccagcgcagcguggcgugcaccaacugcaacgggcccgcccacaacaacaagcuguucgccccgguggcccuggccuccggccccgacgggagcgucuacgugggcgacuucaacuucgugcggcgcaucuuccccuccggcaacagcgucuccauccucgagcugagcaccucccccgcgcacaaguacuaccuggccauggacccggugagcgagucccucuaccugagcgacaccaacacgcggaagguguacaagcugaagucccucgucgagaccaaggaccugagcaagaacuucgagguggucgccgggaccggcgaccagugccugcccuucgaccagucccacugcggggacggcgggcgcgccagcgaggcgucccucaacagcccccggggcaucaccguggaccgccacggcuucaucuacuucguggacgggaccaugauccggaagaucgacgagaacgccgucaucacgaccgugaucggcuccaacgggcugaccagcacccagccgcugagcugcgacuccggcauggacaucacccaggugcgccucgaguggcccaccgaccuggccgucaaccccauggacaacagccuguacgugcucgacaacaacaucgugcugcagaucuccgagaaccggcgcguccggaucaucgccgggcgccccauccacugccaggugccgggcaucgaccacuuccuggugagcaaggucgccauccacuccacccucgagagcgcgcgggccaucuccgugagccacuccggccugcuguucaucgccgagaccgacgagcgcaaggugaaccggauccagcaggucacgaccaacggggagaucuacaucaucgccggcgcccccaccgacugcgacugcaagaucgaccccaacugcgacugcuucagcggggacggcggguacgcgaaggacgccaagaugaaggcccccuccagccucgccguguccccggacggcacccuguacguggccgaccugggcaacguccgcauccggacgaucagccgcaaccaggcgcaccucaacgacaugaacaucuacgagaucgccucccccgccgaccaggagcuguaccaguucaccgugaacgggacccaccuccacacccugaaccugaucacgcgcgacuacguguacaacuucaccuacaacagcgagggcgaccugggggccaucaccuccagcaacggcaacuccguccacauccggcgcgacgccgggggcaugccccucuggcugguggugcccggcgggcaggucuacuggcugaccaucagcagcaacggcgugcucaagcggguguccgcccagggguacaaccuggcccugaugacguacccgggcaacaccggccuccuggccaccaagagcaacgagaacggguggaccacggucuacgaguacgaccccgagggccaccugaccaacgccaccuuccccaccggggagguguccagcuuccacuccgaccucgagaagcugacgaagguggagcuggacaccagcaaccgcgagaacguccucauguccaccaaccugaccgcgacgagcaccaucuacauccugaagcaggagaacacccaguccaccuaccgggugaaccccgacggcagccuccgcgugacguucgccuccgggauggagaucggccugagcuccgagccgcacauccuggccggcgccgucaaccccacccucgggaagugcaacaucagccugcccggcgagcacaacgccaaccugaucgaguggcggcagcgcaaggagcagaacaaggggaacguguccgcguucgagcggcgccuccgggcccacaaccgcaaccugcugagcaucgacuucgaccacaucacccggaccggcaagaucuacgacgaccaccgcaaguucacccuccggauccuguacgaccagacggggcgccccauccugugguccccggugagccgguacaacgaggucaacaucaccuacucccccagcggccucgugaccuucauccagcgcggcaccuggaacgagaagauggaguacgaccagagcgggaagaucaucucccggacgugggccgacggcaagaucuggagcuacaccuaccuggagaaguccgugaugcugcuccugcacagccagcgccgcuacaucuucgaguacgaccagcccgacugccugcuguccgucaccaugcccagcauggugcggcacucccuccagaccaugcugagcgugggguacuaccgcaacaucuacacgccgcccgacuccagcaccuccuucauccaggacuacagccgggacggccgccugcuccagacccugcaccuggggaccggccggcgcguccucuacaaguacacgaagcaggcccggcuguccgaggugcuguacgacaccacccaggugacccucacguacgaggagagcuccggcgucaucaagaccauccaccugaugcacgacggguucaucugcaccauccgcuaccggcagaccggcccccugaucgggcgccagaucuuccgguucagcgaggagggccucgugaacgcccgcuucgacuacuccuacaacaacuuccgggugacgagcaugcaggcggucaucaacgagacgccccugccgaucgaccuguaccgcuacguggacgugagcgggcggaccgagcaguucggcaaguucuccgucaucaacuacgaccucaaccaggugaucaccacgaccgucaugaagcacaccaagaucuucagcgccaacggccaggugaucgaggugcaguacgagauccugaaggccaucgccuacuggaugaccauccaguacgacaacgucgggcgcauggugaucugcgacauccgggugggcgucgacgccaacaucacgcgcuacuucuacgaguacgacgcggacgggcagcugcagaccguguccgugaacgacaagacccaguggcgguacagcuacgaccucaacggcaacaucaaccugcugucccacggcaagagcgcccgccucacgccccugcgguacgaccugcgcgaccgcaucacgcggcucggggagauccaguacaagauggacgaggacggcuuccugcgccagcgggggaacgacaucuucgaguacaacuccaacggccugcuccagaaggccuacaacaaggccagcggguggaccguccaguacuacuacgacggccugggccgccggguggcguccaagagcucccuggggcagcaccuccaguucuucuacgccgaccugaccaaccccauccgcgugacccaccuguacaaccacacgagcuccgagaucaccagccucuacuacgaccugcagggccaccugaucgccauggagcucuccagcggggaggaguacuacgucgccugcgacaacaccggcaccccgcuggccguguucuccagccggggccaggugaucaaggagauccuguacacgcccuacggcgacaucuaccacgacaccuaccccgacuuccaggucaucaucggcuuccacgggggccucuacgacuuccugaccaagcuggugcaccucgggcagcgcgacuacgacguggucgcgggccgguggaccacccccaaccaccacaucuggaagcagcugaaccugcucccgaagcccuucaaccuguacuccuucgagaacaacuaccccguggggaagauccaggacguggccaaguacacgaccgacauccgcagcuggcuggagcuguucggcuuccagcugcacaacguccugcccggcuucccgaagcccgagcucgagaaccuggagcugaccuacgagcuccugcggcugcagaccaagacgcaggagugggaccccgggaagaccauccucggcauccagugcgagcugcagaagcagcugcgcaacuucaucagccucgaccagcugcccaugaccccgcgguacaacgacgggcgcugccuggagggcggcaagcagccccgguucgccgccgugcccuccguguucgggaagggcaucaaguucgccaucaaggacgggaucgucaccgcggacaucaucggcguggccaacgaggacagccgccggcucgccgccauccugaacaacgcccacuaccuggagaaccuccacuucacgaucgaggggcgcgacacccacuacuucaucaagcugggcucccuggaggaggaccucgugcugaucggcaacaccgggggccggcgcauccuggagaacggggucaacgugaccgugagccagaugacguccguccucaacggccgcacccggcgcuucgcggacauccagcugcagcacggggcccugugcuucaacauccgguacggcaccaccguggaggaggagaagaaccacgugcucgagaucgcccgccagcgggccgucgcgcaggccuggacgaaggagcagcgccggcugcaggagggcgaggaggggauccgcgccuggaccgagggcgagaagcagcagcugcucagcaccgggcgggugcagggcuacgacggguacuucgugcuguccgucgagcaguaccuggagcucagcgacuccgccaacaacauccacuucaugcgccagagcgagaucggccggcgcuga

SEQ ID NO: 37563 - RNA, 8298 nt, Artificial Sequence
  derived and/or modified sequence opt1 from TENM2__Homo_sapiens__NP_001116151
auggacgugaaggaccggcggcaccgcagccugacccggggccgcugcgggaaggagugccgguacaccuccagcucccucgacagcgaggacugccgcgugcccacccagaaguccuacagcuccagcgagacccugaaggccuacgaccacgacucccggaugcacuacggcaaccgcgugaccgaccugauccaccgggagagcgacgaguucccccgccaggggaccaacuucacccucgccgagcugggcaucugcgagcccagcccccaccggagcggguacugcuccgacaugggcauccugcaccagggcuacagccucuccaccgggagcgacgcggacuccgacaccgagggcgggaugagccccgagcacgccauccgccuguggggccgggggaucaagucccgccggagcagcggccuguccagccgcgagaacuccgcccucacccugaccgacagcgacaacgagaacaaguccgacgacgagaacggccggcccaucccgcccaccagcucccccagccugcuccccuccgcccagcugcccagcucccacaacccgccgcccgugagcugccagaugccccugcucgacuccaacaccagccaccagaucauggacaccaaccccgacgaggaguucucccccaacagcuaccugcugcgcgccugcuccgggccccagcaggcgagcuccagcgggccgcccaaccaccacagccaguccacccuccggccgccccugcccccgccccacaaccacacccugagccaccaccacuccagcgccaacucccucaaccgcaacagccugaccaaccggcgcucccagauccacgcccccgcccccgcgcccaacgaccuggccaccacgcccgagagcguccagcuccaggacuccugggugcugaacagcaacgugccccuggagacccgccacuuccucuucaagaccuccagcggguccacgccccucuucagcuccagcucccccggcuacccccugacgagcggcaccgucuacacgccgccgccccggcuccugccccgcaacaccuucagccggaaggccuucaagcugaagaagcccuccaaguacugcagcuggaagugcgccgcccucuccgcgaucgccgccgcccugcugcucgccauccugcuggcguacuucaucgccaugcaccuccuggggcugaacuggcagcuccagcccgccgacggccacacguucaacaacgggauccgcaccggccugcccgggaacgacgacguggccaccaugccgagcggcggcaaggugcccuggucccugaagaacagcuccaucgacagcggggaggccgaggucggccggcgcgugacccaggaggugccgcccggggucuucuggcggucccagauccacaucagccagccgcaguuccucaaguucaacaucucccugggcaaggacgcgcuguucgggguguacauccgccggggccugccgcccagccacgcccaguacgacuucauggagcgccuggacggcaaggagaagugguccguggucgagagcccccgggagcgccgguccauccagacgcuggugcagaacgaggccguguucguccaguaccuggacguggggcucuggcaccuggccuucuacaacgacggcaaggacaaggagauggugagcuucaacaccgucgugcuggacuccgugcaggacugcccgcgcaacugccacgggaacggcgagugcgucagcggggugugccacugcuuccccggcuuccucggcgccgacugcgcgaaggccgccugccccguccugugcuccgggaacggccaguacagcaaggggaccugccagugcuacagcggcuggaagggcgccgagugcgacgugcccaugaaccagugcaucgacccguccugcgggggccacgggagcugcaucgacggcaacugcgugugcuccgcgggguacaagggcgagcacugcgaggaggucgacugccuggacccgaccugcagcucccacggcgugugcgugaacggggagugccucugcagccccggcuggggcgggcugaacugcgagcuggcccggguccagugccccgaccagugcuccgggcacggcacguaccucccggacaccggccugugcagcugcgaccccaacuggauggggcccgacugcuccguggaggugugcagcgucgacugcggcacccacggggugugcaucggcggggccugccgcugcgaggagggcuggaccggcgccgccugcgaccagcgggugugccacccgcgcugcaucgagcacgggacgugcaaggacggcaagugcgagugccgggagggguggaacggcgagcacugcaccaucgacgggugccccgaccugugcaacggcaacggccgcugcacccucgggcagaacuccuggcagugcgucugccagaccggcuggcgcgggcccggcugcaacguggcgauggagaccagcugcgccgacaacaaggacaacgagggcgacgggcugguggacugccuggaccccgacugcugccuccaguccgccugccagaacagccugcugugccggggcucccgcgacccgcucgacaucauccagcaggggcagacggacuggcccgccgucaagagcuucuacgaccggaucaagcugcuggccggcaaggacuccacccacaucauccccggggagaaccccuucaacagcucccucgugagccugauccgcggccagguggucaccaccgacggcacgccccuggugggggugaacgucagcuucgugaaguaccccaaguacggcuacaccaucacccggcaggacgggaccuucgaccucaucgcgaacggcggggccucccugacgcugcacuucgagcgcgcccccuucaugagccaggagcggaccguguggcuccccuggaacuccuucuacgccauggacacccuggucaugaagaccgaggagaacagcaucccguccugcgaccugagcggcuucgugcgccccgaccccaucaucaucuccagcccccucuccacguucuucagcgccgcgccgggccagaaccccaucgugcccgagacccagguccugcacgaggagaucgagcugcccggguccaacgugaagcuccgguaccugagcucccgcaccgccggcuacaagagccugcucaagaucaccaugacgcaguccaccgugccgcugaaccugauccggguccaccucaugguggccguggaggggcaccuguuccagaaguccuuccaggccucccccaaccuggcguacaccuucaucugggacaagaccgacgccuacggccagcgcgucuacgggcucagcgacgccgugguguccgucggcuucgaguacgagacgugccccagccugauccugugggagaagcggaccgcccuccugcagggcuucgagcuggaccccagcaaccucgggggcuggucccuggacaagcaccacauccugaacgucaagagcgggauccuccacaagggcaccggcgagaaccaguuccugacccagcagccggccaucaucacguccaucauggggaacggccgccggcgcagcaucuccugccccagcugcaacgggcuggcggagggcaacaagcuccuggcccccguggcccuggccgucgggaucgacggcucccucuacgugggcgacuucaacuacauccggcgcaucuuccccagccggaacgugaccuccauccuggagcugcgcaacaaggaguucaagcacagcaacaacccggcccacaaguacuaccucgcggucgaccccguguccgggagccuguacguguccgacaccaacagccggcgcaucuaccgcgucaagucccugagcggcaccaaggaccucgccgggaacuccgaggugguggccggcacgggggagcagugccugcccuucgacgaggcccggugcggcgacggcgggaaggccaucgacgcgacccugaugagcccgcgcggcaucgccgucgacaagaacgggcucauguacuucguggacgccaccaugauccggaagguggaccagaacggcaucaucuccacccugcuggggagcaacgaccucacggccguccgcccccugagcugcgacuccagcauggacguggcgcagguccggcuggaguggcccaccgaccucgccgugaaccccauggacaacucccuguacgugcuggagaacaacgucauccuccgcaucaccgagaaccaccaggugagcaucaucgccggccggccgaugcacugccaggugcccggcaucgacuacucccugagcaagcuggccauccacuccgcccucgagagcgcguccgccaucgccaucagccacaccgggguccuguacaucacggagaccgacgagaagaagaucaaccgccugcgccaggugaccaccaacggcgagaucugccuccuggccggggccgcguccgacugcgacugcaagaacgacgugaacugcaacugcuacagcggcgacgacgccuacgccaccgacgccauccugaacucccccagcucccucgccgucgcgcccgacgggacgaucuacaucgccgaccugggcaacauccggauccgggccgugagcaagaacaagccggugcugaacgccuucaaccaguacgaggccgcgucccccggcgagcaggagcucuacgucuucaacgccgacgggauccaccaguacaccgugagccuggugaccggcgaguaccuguacaacuucaccuacuccacggacaacgacgucaccgagcucaucgacaacaacgggaacagccugaagauccgccgggacagcuccggcaugccccgccaccuccugaugcccgacaaccagaucaucacccugaccgugggcacgaacgggggccugaagguggucagcacccagaaccuggagcucgggcugaugaccuacgacggcaacaccgggcugcucgccacgaaguccgacgagaccggcuggaccaccuucuacgacuacgaccacgagggccggcugacgaacgugacccgcccgaccgggguggucaccagccugcaccgggagauggagaaguccaucacgaucgacaucgagaacagcaaccgcgacgacgacgugaccgugaucaccaaccucuccagcgucgaggccuccuacaccguggugcaggaccagguccggaacagcuaccagcugugcaacaacggcacgcugcgcgugauguacgcgaacgggaugggcaucuccuuccacagcgagccccacgugcucgccgggaccaucacccccaccaucggccgcugcaacaucucccugcccauggagaacggccugaacagcaucgaguggcggcuccgcaaggagcagaucaaggggaaggucacgaucuucggccggaagcugcgcgugcacgggcggaaccugcucuccaucgacuacgaccgcaacauccggaccgagaagaucuacgacgaccaccgcaaguucacccugcggaucaucuacgaccaggugggccgcccguuccuguggcuccccagcuccgggcuggccgccgucaacgugagcuacuucuucaacggccggcuggccggccuccagcgcggggcgaugagcgagcggaccgacaucgacaagcagggccgcaucgugucccggauguucgccgacgggaaggucuggagcuacuccuaccuggacaagagcauggugcugcuccugcagucccagcgccaguacaucuucgaguacgacagcuccgaccggcugcucgccgugacgaugcccagcgucgcccgccacuccaugagcacccacaccuccaucggcuacauccggaacaucuacaacccgcccgagagcaacgccuccgugaucuucgacuacagcgacgacgggcgcauccugaagaccuccuuccugggcacgggccgccagguguucuacaaguacgggaagcucagcaagcuguccgagaucgucuacgacagcaccgcggugaccuucggcuacgacgagaccaccggggugcugaagauggucaaccuccaguccggcggcuucagcugcacgauccgcuaccgcaagaucgggccccugguggacaagcagaucuaccgguucagcgaggagggcauggugaacgcccgcuucgacuacaccuaccacgacaacuccuuccggaucgccagcaucaagcccgucaucuccgagacgccccugcccguggaccucuaccgcuacgacgagaucagcgggaagguggagcacuucggcaaguucggggucaucuacuacgacaucaaccagaucaucaccacggccgugaugacccuguccaagcacuucgacacccacggccggaucaaggagguccaguacgagauguuccgcagccugauguacuggaugaccgugcaguacgacuccaugggccgggugaucaagcgcgagcucaagcuggggcccuacgccaacacgaccaaguacaccuacgacuacgacggcgacgggcagcugcagagcgucgcggugaacgaccggcccaccuggcgcuacuccuacgaccucaacggcaaccugcaccuccugaaccccgggaacagcgugcggcugaugccgcugcgcuacgaccuccgggaccgcaucacgcggcugggcgacguccaguacaagaucgacgacgacggcuaccugugccagcgcggguccgacaucuucgaguacaacagcaagggccuccugacccgggccuacaacaaggccuccggguggagcgugcaguaccgcuacgacggcguggggcggcgcgccuccuacaagaccaaccugggccaccaccuccaguacuucuacagcgaccugcacaaccccacccgcaucacgcacgucuacaaccacuccaacagcgagaucaccucccuguacuacgaccuccagggccaccuguucgcgauggagagcagcuccggggaggaguacuacguggccagcgacaacaccggcacgccccuggccguguucuccaucaacgggcucaugaucaagcagcugcaguacacggccuacggcgagaucuacuacgacagcaacccggacuuccagauggucaucggcuuccacgggggccuguacgacccccucaccaagcuggugcacuucacccagcgggacuacgacgugcuggccgggcgcuggaccucccccgacuacacgauguggaagaacgucggcaaggagcccgcgccguucaaccucuacauguucaagagcaacaacccccuguccagcgagcuggaccucaagaacuacgugaccgacgugaaguccuggcuggucauguucggguuccagcugagcaacaucauccccggcuucccccgggccaagauguacuucgugccgccgcccuacgagcucuccgagagccaggccuccgagaacggccagcugaucaccggggugcagcagaccacggagcgccacaaccaggccuucauggcccuggagggccaggucaucaccaagaagcuccacgcgagcauccgggagaaggccgggcacugguucgccaccaccacgcccaucaucggcaaggggaucauguucgccaucaaggagggccgcgugaccaccggcguguccagcaucgccuccgaggacagccggaaggucgcguccgugcugaacaacgccuacuaccuggacaagaugcacuacagcaucgaggggaaggacacccacuacuucgugaagaucggcagcgccgacggggaccucgucacgcugggcaccaccaucgggcgcaaggugcuggaguccggcgugaacgucaccgugagccagccgacgcuccuggugaacggccggacccgccgguucaccaacaucgaguuccaguacuccacccugcuccugagcauccgcuacgggcugacccccgacacgcucgacgaggagaaggcccggguccuggaccaggcgcgccagcgggcccugggcaccgccugggccaaggagcagcagaaggcccgcgacgggcgggagggcucccgccucuggaccgagggggagaagcagcagcugcugagcaccggccgggugcagggcuacgagggguacuacgugcuccccgucgagcaguaccccgagcuggcggacuccagcuccaacauccaguuccugcgccagaacgagaugggcaagcgguga

SEQ ID NO: 37564 - RNA, 8100 nt, Artificial Sequence
  derived and/or modified sequence opt1 from TENM3__Homo_sapiens__NP_001073946
auggacgugaaggagcggcggcccuacugcagccugaccaagagccggcgggagaaggagcgccgguacaccaacagcagcgccgacaacgaggagugccgcgugcccacccagaaguccuacuccagcuccgagacccucaaggccuucgaccacgacagcucccggcugcuguacggcaaccgcgugaaggaccucgugcaccgggaggcggacgaguucacccgccagggccagaacuucacccugcggcagcugggcgucugcgagcccgccacccgccgggggcucgccuucugcgccgagaugggccugccccaccgcggguacagcaucuccgccggcagcgacgcggacaccgagaacgaggccgugaugucccccgagcacgccaugcggcuguggggccgcggggugaaguccggccgguccagcugccucuccagccgcuccaacagcgcccugacccugaccgacaccgagcacgagaacaagagcgacuccgagaacgagcagcccgccagcaaccaggggcaguccacccuccagccccugccgcccagccacaagcagcacuccgcccagcaccacccgagcaucaccucccugaaccggaacagccucaccaaccgccggaaccagucccccgcgccgcccgccgcccugcccgcggagcugcagaccacccccgagagcguccagcuccaggacuccugggugcugggcagcaacgugccccuggagucccgccacuuccucuucaagaccgggaccggcaccacgccccucuucagcaccgccaccccgggcuacacgauggccuccgggagcgucuacagcccgcccacccgcccccugccgcggaacacccucagccgcuccgccuucaaguucaagaaguccagcaaguacugcuccuggaagugcaccgcccugugcgcggugggcgugagcguccugcucgccauccugcuguccuacuucaucgccaugcaccucuucgggcugaacuggcagcugcagcagacggagaacgacaccuucgagaacggcaaggugaacagcgacaccaugcccaccaacacggugucccuccccagcggcgacaacgggaagcugggcggguucacccaggagaacaacaccaucgacuccggcgagcuggacaucgggcggcgcgccauccaggagaucccgcccggcaucuucuggcggagccagcuguucaucgaccagccccaguuccugaaguucaacaucucccugcagaaggacgcccucaucggcgucuacgggcgcaagggccugccgcccagccacacccaguacgacuucguggagcugcucgacgggucccggcugaucgcgcgcgagcagcggagccugcucgagacggagcgcgccggccggcaggcccgcuccgugagccugcacgaggccggguucauccaguaccuggacuccggcaucuggcaccucgccuucuacaacgacggcaagaacgcggagcaggucagcuucaacaccaucgugaucgaguccguggucgagugcccgcggaacugccacgggaacggcgagugcgugagcgggaccugccacugcuuccccggcuuccuggggcccgacugcagccgcgccgccugcccggugcugugcuccggcaacggccaguacagcaaggggcggugccugugcuucuccggcuggaaggggaccgagugcgacguccccacgacccagugcaucgacccccagugcggcggccgcgggaucugcaucaugggcagcugcgccugcaacuccggguacaagggcgagagcugcgaggaggcggacugcaucgaccccgggugcuccaaccacggcgugugcauccacggcgagugccacugcagcccgggguggggcggguccaacugcgagauccucaagaccaugugccccgaccagugcagcggccacgggaccuaccugcaggaguccggcagcugcacgugcgaccccaacuggacgggccccgacugcuccaacgagaucugcagcgucgacugcgggucccacggcgugugcaugggcgggaccugccggugcgaggagggguggaccggcccggccugcaaccagcgcgccugccacccccggugcgccgagcacgggaccugcaaggacgggaagugcgagugcagccagggcuggaacggggagcacugcacgaucgagggcugccccgggcugugcaacuccaacggccgcugcacccucgaccagaacggcuggcacugcgugugccagcccggguggcgcggcgccgggugcgacgucgcgauggagacccugugcaccgacagcaaggacaacgagggcgacggccugaucgacugcauggacccggacugcugccuccaguccagcugccagaaccagcccuacugccgggggcugcccgacccccaggacaucaucagccagucccugcagagcccgucccagcaggccgccaagagcuucuacgaccgcaucuccuuccucaucggcagcgacuccacgcacgugauccccggggagagccccuucaacaagucccuggccagcgugauccggggccagguccugaccgccgacgggacgccccucaucggcgugaacguguccuucuuccacuacccggaguacggcuacaccaucacgcgccaggacgggauguucgaccuggucgcgaacggcggggccagccugacccucguguucgagcggucccccuuccugacccaguaccacaccguguggauccccuggaacgucuucuacgugauggacacgcuggugaugaagaaggaggagaacgacauccccagcugcgaccucuccggcuucguccgccccaaccccaucaucgugagcagcccccugagcaccuucuuccgguccagcccggaggacagccccaucauccccgagacccaggugcugcacgaggagaccacgauccccgggaccgaccucaagcuguccuaccugagcucccgcgccgccggcuacaagagcguccucaagaucaccaugacccaguccaucaucccguucaaccugaugaaggugcaccugaugguggccgucgugggccgccucuuccagaagugguuccccgcgagccccaaccuggccuacacguucaucugggacaagaccgacgccuacaaccagaagguguacgggcuguccgaggccgucgugagcgugggcuacgaguacgaguccugccucgaccugacccugugggagaagcgcaccgcgauccuccagggguacgagcuggacgccagcaacaugggcggguggacgcuggacaagcaccacguccucgacgugcagaacggcauccuguacaagggcaacggggagaaccaguucaucucccagcagcccccgguggucagcuccaucaugggcaacgggcggcgccggagcaucuccugccccagcugcaacggccaggccgacggcaacaagcugcucgcccccguggcccuggcgugcgggaucgacggcucccuguacgugggggacuucaacuacguccgccggaucuuccccagcggcaacgugaccuccgugcucgagcugagcagcaacccggcccaccgcuacuaccuggccaccgaccccgucaccggggaccucuacguguccgacacgaacacccggcgcaucuaccggcccaagagccugaccggcgccaaggaccugaccaagaacgccgagguggucgcgggcacgggggagcagugccuccccuucgacgaggcccgcugcggcgacgggggcaaggccguggaggccacccugauguccccgaaggggauggccguggacaagaacggccugaucuacuucgucgacggcaccaugauccggaagguggaccagaacgggaucaucagcacccuccugggcuccaacgaccugaccagcgcgcgcccccucacgugcgacaccuccaugcacaucagccaggugcgccuggaguggcccaccgaccuggccaucaaccccauggacaacuccaucuacguccucgacaacaacguggugcugcagaucaccgagaaccggcagguccgcaucgccgccgggcggccgaugcacugccaggugcccggcguggaguaccccgucgggaagcacgcggugcagacgacccuggagagcgccaccgccaucgccgucuccuacagcggcgugcucuacaucaccgagacggacgagaagaagaucaaccgcauccgccaggugaccaccgacggcgagaucucccuggucgccgggauccccagcgagugcgacugcaagaacgacgcgaacugcgacugcuaccaguccggcgacggguacgccaaggacgccaagcugagcgccccguccagccucgccgcgucccccgacggcacccuguacaucgccgaccuggggaacauccgcauccgggccgugagcaagaacaagccccuccugaacagcaugaacuucuacgagguggccucccccacggaccaggagcuguacaucuucgacaucaacggcacccaccaguacaccgucagccucgugaccggcgacuaccuguacaacuucuccuacagcaacgacaacgacaucacggccgugaccgacuccaacgggaacacccugcgcauccggcgcgacccgaaccggaugcccguccgcguggugagccccgacaaccaggucaucuggcucaccaucggcacgaacgggugccugaaguccaugaccgcgcagggccuggagcucgugcuguucaccuaccacggcaacagcgggcugcucgccaccaaguccgacgagacgggcuggaccaccuucuucgacuacgacagcgaggggcggcugaccaacgugacguucccgaccggcgucgugaccaaccugcacggggacauggacaaggccaucaccguggacaucgaguccagcucccgcgaggaggacgucagcaucacguccaaccucagcuccaucgacagcuucuacaccauggugcaggaccagcugcggaacuccuaccagaucggcuacgacggcagccugcgcaucaucuacgccagcgggcucgacucccacuaccagaccgagccccacgugcuggccggcaccgcgaaccccacggucgccaagcggaacaugacccugcccggggagaacggccagaaccucguggaguggcgcuuccggaaggagcaggcccaggggaaggugaacgucuucggccgcaagcugcgcgugaacggccggaaccugcucagcguggacuucgaccgcaccaccaagaccgagaagaucuacgacgaccaccggaaguuccugcugcgcaucgccuacgacacguccgggcacccgacccucuggcugcccagcuccaagcugauggcggucaacgugaccuacagcuccaccggccagaucgccagcauccagcgggggacgaccuccgagaagguggacuacgacggccaggggcgcaucgucagccggguguucgccgacggcaagaccugguccuacaccuaccuggagaaguccauggugcuccugcugcacucccagcgccaguacaucuucgaguacgacaugugggaccggcucagcgccaucacgaugcccuccgucgcccgccacaccaugcagaccauccggagcaucggcuacuaccgcaacaucuacaacccgcccgaguccaacgcgagcaucaucaccgacuacaacgaggaggggcugcugcuccagacggccuuccugggcaccagccggcgcgugcuguucaaguaccggcgccagacccggcucuccgagauccuguacgacagcacccgcguguccuucacguacgacgagaccgccgggguccugaagaccgugaaccuccagagcgacggcuucaucugcaccauccgguaccgccagaucgggccccugaucgaccggcagaucuuccgcuucuccgaggacggcauggugaacgcccgcuucgacuacagcuacgacaacuccuuccgggucacgagcaugcagggcgugaucaacgagacgccccugcccaucgaccucuaccaguucgacgacaucuccgggaagguggagcaguucggcaaguucggggucaucuacuacgacaucaaccagaucaucagcaccgccgugaugaccuacacgaagcacuucgacgcgcacggccgcaucaaggagauccaguacgagaucuuccggucccugauguacuggaucaccauccaguacgacaacaugggccgcgugaccaagcgggagaucaagaucgggcccuucgccaacaccacgaaguacgccuacgaguacgacgucgacggccagcugcagaccguguaccucaacgagaagaucauguggcgcuacaacuacgaccugaacgggaaccugcaccuccugaaccccagcaacuccgcccggcugacgccccuccgcuacgaccugcgggaccgcaucacccggcugggcgacgugcaguaccgccucgacgaggacggguuccugcggcagcgcggcacggagaucuucgaguacagcuccaagggccugcucacccgggucuacagcaagggguccggcuggaccgugaucuaccgcuacgacgggcugggccggcgcgugagcuccaagaccagccuggggcagcaccuccaguucuucuacgccgaccugacguaccccacccggaucacccacgucuacaaccacagcuccagcgagaucaccucccuguacuacgaccuccagggccaccuguucgcgauggagaucagcuccggcgacgaguucuacaucgccagcgacaacacggggaccccgcuggccguguucuccagcaacggccucaugcugaagcagauccaguacaccgccuacggggagaucuacuucgacuccaacaucgacuuccagcuggucaucggcuuccacgggggccucuacgacccccugaccaagcugauccacuucggcgagcgcgacuacgacauccucgcggggcgcuggaccacgcccgacaucgagaucuggaagcggaucggcaaggaccccgccccguucaaccuguacauguuccgcaacaacaaccccgccagcaagauccacgacgugaaggacuacaucaccgacgugaacuccuggcuggucaccuucggguuccaccuccacaacgccauccccggcuuccccgugccgaaguucgaccugaccgagcccagcuacgagcuggugaagucccagcagugggacgacaucccgcccaucuucggcguccagcagcaggucgcccggcaggcgaaggccuuccucagccuggggaagauggccgaggugcaggucucccgccggcgcgccggcggggcccagagcuggcugugguucgcgacggugaagucccucaucggcaagggggugaugcuggccgucagccagggccgggugcagaccaacgugcugaacaucgccaacgaggacugcaucaaggucgccgccgugcucaacaacgcguucuaccuggagaaccugcacuucaccaucgagggcaaggacacccacuacuucaucaagacgaccaccccggaguccgaccucgggacccugcgccugacgagcggccggaaggcccucgagaacgggaucaacgugaccgucagccaguccaccaccguggugaacggccgcacgcggcgcuucgccgacgucgagaugcaguucggggcccuggcgcugcacgugcgguacggcaugacccucgacgaggagaaggcccgcauccuggagcaggcccggcagcgcgcccuggcccgggcgugggcccgcgagcagcagcgggugcgcgacggcgaggagggggcccggcucuggaccgagggcgagaagcgccagcugcugagcgccgggaagguccagggcuacgacggguacuacgugcucuccguggagcaguaccccgagcuggccgacagcgcgaacaacauccaguuccugcgccaguccgagaucggccggcgcuga

SEQ ID NO: 37565 - RNA, 8310 nt, Artificial Sequence
  derived and/or modified sequence opt1 from TENM4__Homo_sapiens__NP_001092286
auggacgugaaggagcgcaagcccuaccggucccugacccggcggcgcgacgccgagcggcgcuacaccuccuccuccgccgacagcgaggagggcaaggcgccccagaaguccuacagcuccagcgagacccucaaggccuacgaccaggacgcccggcuggccuacgggucccgcgucaaggacaucgugccccaggaggccgaggaguucugccggaccggcgcgaacuucacccugcgcgagcucgggcuggaggaggugacgccgccccacggcacccuguaccggaccgacaucgggcucccccacugcggcuacagcaugggcgccggguccgacgccgacauggaggccgacaccguccugagccccgagcaccccgugcgccuguggggccgguccacccgcagcgggcgguccagcugccucuccagccgcgcgaacuccaaccugacccugaccgacaccgagcacgagaacaccgagaccgaccaccccggcgggcuccagaaccacgcccggcugcgcaccccgcccccgccccugagccacgcccacacccccaaccagcaccacgccgccagcaucaacucccucaaccggggcaacuucacgccccggagcaaccccucccccgcgcccaccgaccacagccuguccggcgagccgcccgccgggggcgcccaggagcccgcccacgcccaggagaacuggcugcucaacagcaacaucccccuggagacccggaaccuggggaagcagcccuuccucggcacccugcaggacaaccugaucgagauggacauccucggcgcgucccgccacgacggggccuacagcgacggccacuuccuguucaagcccgggggcaccagcccccuguucugcaccaccagcccgggguacccccucaccuccagcaccguguacagcccgccgccccgcccccugccccggagcacguucgcccgccccgccuucaaccugaagaagcccuccaaguacugcaacuggaagugcgccgcgcucagcgccaucgucaucuccgccacccuggugauccugcucgccuacuucguggccaugcaccuguucggccugaacuggcaccuccagcccauggagggccagauguacgagaucaccgaggacaccgcgagcuccuggcccgucccgacggacgugagccuguaccccagcgggggcaccgggcuggagacccccgaccggaagggcaaggggaccacggagggcaagcccuccagcuucuucccggaggacuccuucaucgacagcggcgagaucgacguggggcgccgggccucccagaagaucccgcccggcaccuucuggcgcagccaggucuucaucgaccaccccgugcaccucaaguucaacgugucccuggggaaggccgcccuggucggcaucuacgggcggaagggccucccgcccagccacacccaguucgacuucguggagcugcuggacggccgccggcuccugacccaggaggcgcgcucccuggaggggacgccccggcagagccgcggcaccgugcccccguccagccacgagaccggguucauccaguaccucgacuccggcaucuggcaccuggccuucuacaacgacggcaaggagagcgaggucguguccuuccugaccaccgccaucgagagcguggacaacugccccuccaacugcuacgggaacggcgacugcaucagcgggacgugccacugcuuccugggcuuccucgggcccgacugcggccgggccagcugccccguccugugcuccggcaacgggcaguacaugaagggccgcugccugugccacagcggguggaagggcgccgagugcgacgugccgaccaaccagugcaucgacguggcgugcuccaaccacgggaccugcaucaccggcacgugcaucugcaaccccggcuacaagggggagagcugcgaggaggucgacugcauggacccgaccugcuccggccgcggggugugcguccggggcgagugccacugcagcgugggguggggcggcaccaacugcgagacgccccgggccacgugccucgaccagugcuccgggcacggcaccuuccugcccgacaccgggcugugcagcugcgaccccuccuggaccggccacgacugcagcaucgagaucugcgccgccgacugcgggggccacggcgugugcgucgggggcacgugccgcugcgaggacggguggaugggcgccgcgugcgaccagcgggccugccacccccgcugcgccgagcacgggaccugccgcgacgggaagugcgagugcuccccgggcuggaacggggagcacugcaccaucgcccacuaccucgaccggguggugaaggagggcugccccgggcugugcaacggcaacggccgcugcacccuggaccucaacggguggcacugcgucugccagcugggcuggcgcggcgccggcugcgacacgagcauggagaccgcgugcggggacuccaaggacaacgacggcgacggccugguggacugcauggaccccgacugcugccuccagccccugugccacaucaacccgcugugccucgggagccccaacccccuggacaucauccaggagacccaggugcccgucucccagcagaaccugcacagcuucuacgaccgcaucaaguuccucgugggccgggacuccacccacaucaucccgggggagaaccccuucgacggcgggcacgccugcgugauccgcggccaggucaugacgagcgacggcacgccccuggugggggugaacaucuccuucgucaacaacccccuguucggcuacaccaucagccggcaggacgggagcuucgaccucgugaccaacggcggcaucuccaucauccugcgcuucgagcgggccccguucaucacccaggagcacacccuguggcuccccugggaccgcuucuucgugauggagaccaucaucaugcggcacgaggagaacgagauccccagcugcgaccuguccaacuucgcccgccccaacccggucgugagccccagcccccugaccagcuucgcguccagcugcgccgagaaggggcccaucgugccggagauccaggcccuccaggaggagaucuccaucagcggcugcaagaugcggcuguccuaccugagcucccgcacgcccggguacaagagcguccuccggaucucccugacccaccccaccauccccuucaaccugaugaaggugcaccucaugguggccgucgagggccgccuguuccggaagugguucgccgcggccccggaccugagcuacuacuucaucugggacaagaccgacguguacaaccagaagguguucgggcucuccgaggccuucgucagcgugggcuacgaguacgaguccugccccgaccugauccugugggagaagcgcacgaccgugcuccagggcuacgagaucgacgccagcaagcucggcggguggagccuggacaagcaccacgcccucaacauccaguccgggauccugcacaaggggaacggggagaaccaguucgucagccagcagccgcccgugaucggcuccaucaugggcaacgggcggcgccggagcaucuccugcccgagcugcaacggccuggcggacgggaacaagcuccuggcccccguggcccugaccugcggcuccgacgggagccucuacgucggcgacuucaacuacauccgccgcaucuuccccuccggcaacgugaccaacauccuggagcugcggaacaaggacuuccgccacagccacuccccggcccacaaguacuaccucgccacggaccccaugagcggggcgguguuccuguccgacagcaacucccggcgcgucuucaagaucaagagcaccgugguggucaaggaccuggugaagaacuccgagguggucgccggcaccggggaccagugccuccccuucgacgacacccggugcggcgacgggggcaaggccaccgaggccacgcugaccaacccccgcggcaucaccguggacaaguucgggcugaucuacuucguggacggcaccaugauccggcgcaucgaccagaacgggaucaucagcacgcuccugggcuccaacgaccugaccagcgcgcggccgcucagcugcgacuccgucauggacaucagccaggugcaccuggaguggcccaccgaccuggccaucaaccccauggacaacucccucuacgugcuggacaacaacgucgugcugcagaucagcgagaaccaccaggugcgcaucgucgccggccggcccaugcacugccaggugccggggaucgaccacuuccuccuguccaaggucgccauccacgccacccuggagagcgcgacggcccucgccgugucccacaacggcgugcuguacaucgccgagaccgacgagaagaagaucaaccgcauccggcaggucaccaccagcggggagaucucccugguggccggcgcgcccagcgggugcgacugcaagaacgacgccaacugcgacugcuucuccggcgacgacggcuacgccaaggacgccaagcucaacacgcccagcucccuggccgugugcgcggacggggagcuguacgucgccgaccucggcaacauccgcauccgguucauccgcaagaacaagcccuuccugaacacccagaacauguacgagcugagcuccccgaucgaccaggagcucuaccuguucgacaccaccgggaagcaccuguacacgcagagccuccccaccggcgacuaccuguacaacuucaccuacaccggggacggcgacaucacgcugaucaccgacaacaacggcaacauggugaacgugcggcgcgacuccaccgggaugccccucuggcuggucgugcccgacggccagguguacugggucaccauggggacgaacagcgcccugaaguccgugaccacccagggccacgagcucgccaugaugaccuaccacgggaacagcggccugcuggccaccaaguccaacgagaacggcuggaccaccuucuacgaguacgacuccuucgggcggcucaccaacgugacguucccgaccggccaggucagcuccuuccgcagcgacaccgacuccagcgugcacgugcaggucgagaccuccagcaaggacgacgugacgaucaccaccaaccuguccgcgagcggggccuucuacacccugcuccaggaccaggugcgcaacuccuacuacaucggcgccgacgggagccugcggcugcugcucgccaacggcauggaggucgcgcugcagaccgagccccaccuccuggccggcacggugaaccccaccguggggaagcgcaacgucacccugcccaucgacaacggccugaaccugguggaguggcggcagcgcaaggagcaggcccggggccaggugaccgucuucggccgccggcugcgcgugcacaaccggaaccugcucucccuggacuucgaccgcgugacgcggaccgagaagaucuacgacgaccaccgcaaguucacccugcggauccucuacgaccaggccggccgcccgagccuguggucccccagcucccggcugaacggggucaacgugaccuacagccccggcggguacaucgccggcauccagcgcgggaucauguccgagcggauggaguacgaccaggcgggccgcaucacgagccggaucuucgccgacggcaagaccuggagcuacaccuaccucgagaaguccauggugcugcugcuccacagccagcgccaguacaucuucgaguucgacaagaacgaccggcuguccagcgucaccaugcccaacguggcccgccagacgcuggagaccauccgcuccgugggguacuaccggaacaucuaccagccgcccgagggcaacgccagcgucauccaggacuucaccgaggacgggcaccuccugcacaccuucuaccugggcacggggcgccgggugaucuacaaguacggcaagcucuccaagcuggccgagacccuguacgacaccaccaaggugagcuucacguacgacgagaccgcgggcaugcucaagaccaucaaccugcagaacgagggguucacgugcacgauccgcuaccggcagaucggcccccugaucgaccgccagaucuuccgguucaccgaggaggggauggucaacgcccgcuucgacuacaacuacgacaacuccuuccgggugaccagcaugcaggccgugaucaacgagacgccccugccgaucgaccuguaccgcuacgacgacgucuccggcaagacggagcaguucgggaaguucggcgugaucuacuacgacaucaaccagaucaucaccaccgccgugaugacccacacgaagcacuucgacgccuacggccggaugaaggagguccaguacgagaucuuccgcagccugauguacuggaugaccgugcaguacgacaacauggggcggguggucaagaaggagcucaaggugggccccuacgcgaacaccacccgcuacuccuacgaguacgacgccgacgggcagcugcagacggugagcaucaacgacaagccccuguggcgguacuccuacgaccucaacggcaaccugcaccuccucagcccgggcaacuccgcccgccugacgccccugcgguacgacauccgcgaccggaucacccgccucggggacguccaguacaagauggacgaggacggcuuccugcgccagcgcgggggcgacaucuucgaguacaacagcgccgggcugcucaucaaggcguacaaccgcgccggcagcugguccgugcgguaccgcuacgacggccuggggcggcgcgucagcuccaagagcucccacagccaccaccuccaguucuucuacgccgaccugaccaaccccacgaaggugacccaccuguacaaccacuccagcuccgagaucaccagccuguacuacgaccuccagggccaccuguucgccauggagcuguccagcggggacgaguucuacaucgccugcgacaacaucggcacgccccucgcgguguucuccgggaccggccugaugaucaagcagauccuguacacggccuacggcgagaucuacauggacaccaacccgaacuuccagaucaucaucggguaccacggcgggcucuacgacccccugaccaagcugguccacaugggccggcgcgacuacgacgugcucgccgggcgguggaccagccccgaccacgagcuguggaagcaccuguccagcuccaacgugaugcccuucaaccucuacauguucaagaacaacaacccgaucagcaacucccaggacaucaagugcuucaugacggacgucaacagcuggcugcugaccuucggcuuccagcuccacaacgugauccccggcuaccccaagcccgacauggacgccauggagccgagcuacgagcugauccacacccagaugaagacccaggagugggacaacuccaagagcauccugggggugcagugcgagguccagaagcagcucaaggccuucgugacgcuggagcgcuucgaccagcuguacggcuccaccaucaccagcugccagcaggcgcccaagaccaagaaguucgccuccagcggguccguguucggcaagggggucaaguucgcccucaaggacggccgggugacgaccgacaucaucagcguggccaacgaggacggccgccgggucgccgcgauccugaaccacgcccacuaccuggagaaccuccacuucaccaucgacgggguggacacccacuacuucgugaagcccggccccuccgagggggaccuggccauccugggccucagcggcgggcgccggacgcuggagaacggcgucaacgugaccgugucccagaucaacaccguccugaacgggcgcacccggcgcuacacggacauccagcuccaguacggcgcccugugccugaacacccgguacgggaccacccucgacgaggagaaggcgcgcgugcuggagcuggcccggcagcgcgccgugcgccaggccugggcccgggagcagcagcgccuccgggagggcgaggagggccugcgcgcguggacggagggggagaagcagcagguccugagcaccggccgggugcagggguacgacggcuucuucgugaucuccgucgagcaguacccggagcucagcgacuccgccaacaacauccacuucaugcgccagagcgagauggggcggcgcuga

SEQ ID NO: 37566 - RNA, 7884 nt, Artificial Sequence
  derived and/or modified sequence opt1 from TEP1__Homo_sapiens__XP_005268084
auggagaagcugcacggccacgugagcgcccaccccgacauccucagccuggagaaccgcugccuggccaugcuccccgaccugcagccccuggagaagcuccaccagcacgugagcacccacagcgacauccugagccugaagaaccagugccucgccacccugcccgaccugaagaccauggagaagccccacggguacgugagcgcccaccccgacauccucagccuggagaaccagugccuggccacccucuccgaccugaagaccauggagaagccccacggccacgugagcgcccaccccgacauccugucccucgagaaccggugccuggccacccugagcucccucaagagcacgguguccgcgagcccccuguuccagucccugcagaucagccacaugacccaggccgaccucuaccgcgugaacaacuccaacugccugcugagcgagccgcccuccuggcgggcccagcacuucagcaaggggcucgaccuguccacgugccccaucgcccugaaguccaucagcgcgaccgagacggcccaggaggccacccucggccgcugguucgacuccgaggagaagaagggggccgagacccagaugcccagcuacucccugagccugggcgaggaggaggagguggaggaccucgccgugaagcugaccuccggcgacagcgagucccaccccgagcccacggaccacgugcugcaggagaagaagauggcgcuccugagccugcucugcuccacccuggugagcgaggucaacaugaacaacaccuccgaccccacccuggccgccaucuucgagaucugccgggagcucgcccugcuggagcccgaguucauccucaaggccagccuguacgcgcgccagcagcugaacgugcggaacguggccaacaacauccucgccaucgccgccuuccugccggcgugccgcccccaccuccgccgcuacuucugcgccaucguccagcugcccuccgacuggauccagguggccgagcuguaccagagccuggccgagggggacaagaacaagcuggugccccucccggccugccugcggacggcgaugaccgacaaguucgcccaguucgacgaguaccagcuggccaaguacaacccccgcaagcaccgggccaagcgccacccccggcggccgccccggucccccggcauggagccgcccuucagccaccgcugcuucccccgguacaucggguuccuccgcgaggagcagcggaaguucgagaaggcgggcgacaccgucuccgagaagaagaacccgccccgcuucacccugaagaagcuggugcagcgccuccacauccacaagccggcccagcacgugcaggcccugcugggguaccgguaccccagcaaccuccagcuguucagccgcucccggcugcccggccccugggacagcucccgcgccggcaagcggaugaagcucagccgcccggagacgugggagcgggagcugucccugcgcgggaacaaggccagcgucugggaggagcucaucgagaacggcaagcugcccuucauggcgaugcugcggaaccucugcaaccugcugcgcguggggaucuccagccggcaccacgagcucauccugcagcgccugcagcacgccaaguccgugauccacagccggcaguuccccuuccgcuuccucaacgcccacgacgccaucgacgcccuggaggcgcagcugcggaaccaggcccuccccuucccguccaacaucacccugaugcgccggauccugacccgcaacgagaagaaccggccccgccgccgguuccucugccaccugagccgccagcagcugcggauggccaugcgcauccccguccucuacgagcagcugaagcgggagaagcugcgcgugcacaaggcccggcaguggaaguacgacggcgagaugcucaaccgcuaccggcaggcccuggagaccgcggugaaccuguccgucaagcacagccucccccugcugccgggccgcacggugcucgucuaccugaccgacgccaacgccgaccggcugugccccaaguccaacccccaggggcccccgcucaacuacgcccugcugcucaucggcaugaugaucacccgcgcggagcaggucgacgugguccugugcgggggcgacacccugaagacggccgugcucaaggccgaggaggggauccugaagaccgccaucaagcugcaggcccaggugcaggaguucgacgagaacgacggcuggagccucaacaccuucggcaaguaccugcugucccucgcggggcagcggguccccguggaccgcgugauccugcugggccagagcauggacgacgggaugaucaacgucgccaagcagcucuacuggcagcgggugaacagcaagugccuguucgugggcauccugcuccgccggguccaguaccuguccaccgaccugaaccccaacgacgugacgcucagcgggugcaccgacgccauccugaaguucaucgccgagcacggcgccucccaccuccuggagcacgugggccagauggacaagaucuucaagaucccgccgccgcccgggaagaccggcguccagagccugcgcccccuggaggaggacacccccagcccccuggcgcccgugagccagcagggguggcgguccauccgccuguucaucagcuccacguuccgggacaugcacggcgagcgcgaccugcuccugcgcagcgugcugcccgcccuccaggcccgggccgcgccccaccgcaucucccugcacgggaucgaccugcgguggggcgucaccgaggaggagacccgccggaaccgccagcucgaggugugccugggcgagguggagaacgcgcagcuguucgucgggauccucggcagccgguacggguacaucccgcccuccuacaaccugccggaccacccccacuuccacugggcccagcaguaccccagcggccgcuccgugaccgagauggaggugaugcaguuccugaaccggaaccagcgccuccagcccagcgcccaggcccugaucuacuuccgggacuccagcuuccuguccagcgucccggacgcguggaaguccgacuucguguccgagagcgaggaggccgcccgccggaucuccgagcucaagagcuaccugucccgccagaagggcaucacgugccggcgcuaccccugcgaguggggcgggguggccgccgggcggcccuacgucggcgggcuggaggaguucggccagcuggugcuccaggacguguggaacaugauccagaagcuguaccugcagcccggcgcgcuccuggagcagccggucagcauccccgacgacgaccuggugcaggccacguuccagcagcuccagaagccgcccuccccggcccgcccccggcugcugcaggacaccgugcagcgccucaugcugccccacgggcgccugagccucgucaccggccaguccgggcagggcaagaccgccuuccuggccagccugguguccgcgcuccaggcccccgacggggccaagguggccagccuggucuucuuccacuucuccggcgcccggccggaccagggccuggcgcucacgcugcugcgccggcucugcaccuaccugcgcgggcagcugaaggagcccggcgcccuccccagcaccuaccggucccuggugugggagcugcagcagcgccuccugcccaagagcgccgagucccugcacccggggcagacccaggugcucaucaucgacggcgccgaccggcuggucgaccagaacgggcagcugaucagcgacuggauccccaagaagcucccccgcugcgugcaccuggugcuguccgucagcagcgacgccggccucggcgagacgcuggagcagucccagggggcgcacgugcuggcccucggcccccuggaggccagcgcccgggcgcgccuggugcgggaggagcucgcccuguacgggaagcgccuggaggaguccccguucaacaaccagaugcggcuccugcuggucaagcgcgagagcggccggccccucuaccugcgccuggugaccgaccaccuccggcuguucacccuguacgagcaggucuccgagcgccuccggacccugcccgccacggucccgcugcuccugcagcacauccugagcacccucgagaaggagcacgggcccgacgugcugccccaggcccugaccgcccucgaggugacccgcuccggccugacggucgaccagcugcacggcgugcucagcgucuggcggacccugcccaaggggaccaaguccugggaggaggcgguggccgccggcaacagcggggacccguaccccaugggccccuucgccugccuggugcagucccuccgcagccugcugggcgaggggccccucgagcgcccgggcgcccggcugugccugcccgacgggccccuccgcaccgcggccaagcggugcuacggcaagcgccccgggcuggaggacacggcccacauccugaucgccgcccagcucuggaagaccugcgacgcggacgccuccggcaccuuccggagcugcccgcccgaggcccugggcgaccugcccuaccaccuccugcaguccgggaaccgcggccugcucagcaaguuccugaccaaccugcacgucguggccgcgcaccucgagcuggggcuggugucccggcuccuggaggcccacgcccuguacgccagcuccguccccaaggaggagcagaagcucccggaggccgacguggcgguguuccgcacguuccugcggcagcaggccagcauccugagccaguacccccgccuccugccccagcaggccgccaaccagccccuggacuccccgcucugccaccaggccagccugcugucccggcgcuggcaccuccagcacacccuccgguggcugaacaagccccgcaccaugaagaaccagcagagcuccagccugucccucgcggucagcuccagccccaccgccguggccuucuccacgaacggccagcgggccgccguggggaccgcgaacggcaccgucuaccugcuggaccuccgcaccuggcaggaggagaaguccgugguguccggcugcgacgggaucagcgccugccuguuccuguccgacgacacccucuuccugaccgccuucgacggccugcucgagcugugggaccugcagcacgggugccggguccuccagaccaaggcccaccaguaccagaucaccggcugcugccugagccccgacugccgccugcucgcgacggugugccugggcgggugccugaagcucugggacaccgugcgggggcagcuggccuuccagcacaccuacccgaagucccugaacugcgucgccuuccaccccgagggccaggugaucgccaccggcagcugggccggguccaucagcuucuuccagguggacggccucaaggucaccaaggaccugggcgcgcccggggccagcauccgcacgcuggccuucaacgugcccggcgggguggucgccgugggccgccucgacuccaugguggagcugugggccuggcgggagggggcgcgccuggccgccuucccggcccaccacggcuucgucgccgcggcccucuuccugcacgccggcugccagcugcucaccgccggggaggacggcaagguccagguguggagcgggucccugggccggccccgcgggcaccugggcagccucucccugagccccgcccuguccgucgcgcucagcccggacggcgaccggguggccgugggguaccgcgccgacggcauccggaucuacaagaucuccagcgggucccagggcgcccaggggcaggcgcuggacgucgccgugagcgcccuggccuggcucucccccaaggugcuggucagcggcgccgaggacggcucccugcaggggugggcgcucaaggagugcagccugcagucccuguggcuccugagccgcuuccagaagcccgugcugggccucgccaccucccaggagcugcuggccagcgccagcgaggacuucaccgugcagcucuggccccggcagcugcugacgcgcccgcacaaggccgaggacuuccccugcgggaccgagcuccggggccacgaggggcccgucuccugcugcagcuucuccaccgacggcggcagccuggcgaccgggggccgcgaccggucccugcucugcugggacgugcgcacgcccaagaccccggugcugauccacagcuuccccgccugccaccgggacugggucaccgggugcgccuggaccaaggacaaccugcucaucuccugcagcuccgacggcagcgugggccugugggaccccgaguccgggcagcgccugggccaguuccucgggcaccagagcgccguguccgccgucgcggccguggaggagcacguggucagcgugucccgggacggcacgcugaaggugugggaccaccagggggucgagcugaccagcauccccgcccacuccggcccgaucagccacugcgccgcggccauggagccccgcgccgccggccagcccgggagcgagcuccugguggucaccgugggccuggacggggccacccggcucuggcacccccugcuggugugccagacgcacacccuccugggccacuccgggccgguccgcgcggccgccgugagcgagaccuccggccugaugcucaccgccagcgaggacggcuccgugcggcuguggcagguccccaaggaggccgacgacacgugcaucccccgcagcuccgcggccgugaccgccguggccugggcccccgacgggagcauggcggucuccggcaaccaggccggggagcugauccucuggcaggaggccaaggccguggcgaccgcccaggccccgggccacaucggggcccugaucuggagcuccgcccacaccuucuucgugcugagcgcggacgagaagaucuccgaguggcaggucaagcuccgcaagggcagcgcccccggcaaccugucccugcaccucaaccggauccugcaggaggaccugggggugcucacgagccuggacugggcccccgacggccacuuccugauccucgccaaggccgaccugaagcugcucugcaugaagcccggggacgcgccguccgagaucuggagcuccuacaccgagaaccccaugauccugagcacccacaaggaguacggcaucuucgugcugcagcccaaggacccggggguccugagcuuccuccgccagaaggaguccggcgaguucgaggagcggcugaacuucgacaucaaccuggagaaccccagccgcacccucaucuccaucacgcaggccaagcccgagagcgaguccagcuuccugugcgccuccagcgacggcauccuguggaaccucgccaagugcucccccgagggggaguggaccaccggcaacauguggcagaagaaggccaacaccccggagacgcagacccccgggaccgaccccuccacgugccgggaguccgacgcgagcauggacuccgacgccagcauggacuccgagcccaccccgcaccugaagacccgccagcggcgcaagauccacagcggcuccgugaccgcccugcacgugcuccccgagcugcuggucaccgccagcaaggaccgggacgugaagcucugggagcgccccuccaugcagcugcugggccucuuccggugcgaggggagcgugagcugccuggagcccuggcugggcgccaacuccacccuccagcuggcggucggggacgugcagggcaacguguacuuccugaacugggaguga

SEQ ID NO: 37567 - RNA, 897 nt, Artificial Sequence
  derived and/or modified sequence opt1 from TEPP__Homo_sapiens__NP_950247
augggcaucgugugcgcccagugcagcuucauccugcuccuguccaucauccgcgcccggcccccgcccuuccuguucugcccccucagcucccagcgcaccgagagccccuacaagccgguccaccuggggcugggccccaccgacaagguggcggccaucgccauggcccggaucaucgaccucgugcccugggacgacggguccacgcacgucuacgccagccccgcgauccugcugccgauggagcgccagcggaaccagcucgccggcgugaagcagcagcuguaccaccccgcccugcccacccuccgccacauggaccgggacaccgugaaggccugccugcccgacgagcacugccaguccaccacguacugccgcaaggacgaguucgacaacgcgcacuucacccugcucggggucccgaacaagccccugcagugccuggacaucaccgccaccggccagaagcuccggaaccgcuaccacgagggcaagcuggcccccaucgcccccgggaucaaccggguggacuggccgugcuucacgcgcgccaucgaggacuggagccacuucguguccagcgcgggcgaguucaagcugcccugccuccggaagcgcgccgaggggcuguccggcuacgccguccgguaccugaagcccgacgugacccagaccuggcgccaggaggcccucugcggggccugggcgggccggcccugcagcccggacagcccccgccccuaccccugcugcccgccccaguacugccugucccagaaccccucccuggaccgguacggccagaagccccucccguucgacagccugaacaccuuccgcuccuucgggagcuccuacagccgggugaacuaccugacgcccuggcacuga

SEQ ID NO: 37568 - RNA, 1260 nt, Artificial Sequence
  derived and/or modified sequence opt1 from TERF1__Homo_sapiens__NP_003209
auggccgaggacgugagcuccgccgcgcccagcccgcgcggcugcgccgacgggcgggacgccgaccccaccgaggagcagauggccgagaccgagcgcaacgacgaggagcaguucgagugccaggagcugcucgagugccagguccaggugggcgcccccgaggaggaggaggaggaggaggaggacgcggggcugguggccgaggccgaggccgucgcggccggcuggaugcuggacuuccucugccugucccugugccgggccuuccgcgacgggcggagcgaggacuuccgccggacgcgcaacuccgccgaggccaucauccacggccucagcucccugaccgcgugccagcugcggaccaucuacaucugccaguuccucacccgcaucgccgccggcaagacgcuggacgcccaguucgagaacgacgagcggaucacgccccuggagagcgcccucaugaucuggggguccaucgagaaggagcacgacaagcugcacgaggagauccagaaccugaucaagauccaggcgaucgccgugugcauggagaacggcaacuucaaggaggccgaggagguguucgagcgcaucuucggggacccgaacagccacaugcccuucaaguccaagcuccugaugaucaucagccagaaggacaccuuccacuccuucuuccagcacuucagcuacaaccacaugauggagaagaucaaguccuacgucaacuacgugcugagcgagaaguccagcaccuuccucaugaaggccgccgcgaagguggucgaguccaagcggacccgcaccaucaccagccaggacaagcccagcggcaacgacguggagauggagaccgaggccaaccuggacacgcggaagcgcucccacaagaaccuguuccucagcaagcugcagcacgggacccagcagcaggaccugaacaagaaggagcggcgcgugggcacgccccaguccaccaagaagaagaaggagagccggcgcgccaccgagucccggaucccggucagcaagucccagcccgugacccccgagaagcaccgcgcccgcaagcggcaggccuggcucugggaggaggacaagaaccugcgcagcggcgugcggaaguacggggagggcaacugguccaagauccugcuccacuacaaguucaacaaccgcaccagcgucaugcugaaggaccgguggcgcaccaugaagaagcugaagcucaucuccagcgacuccgaggacuga

SEQ ID NO: 37569 - RNA, 1629 nt, Artificial Sequence
  derived and/or modified sequence opt1 from TERF2__Homo_sapiens__NP_005643
auggccgccggcgcggggaccgccggccccgccagcgggccgggcgugguccgcgaccccgccgccucccagccccggaagcgccccgggcgggagggcggcgagggggcgcgccggagcgacaccauggccggcgggggcggguccagcgacggcuccggccgcgccgccgggcggcgcgcgagccgguccagcggccgcgcccggcgcgggcggcacgagccgggccugggcgggcccgccgagcgcggcgccggggaggcccggcucgaggaggcggugaaccgcugggugcugaaguucuacuuccacgaggcccugcgggccuuccgcggcucccgguacggggacuuccgccagauccgggacaucaugcaggcccuccugguccgcccccugggcaaggagcacacggugagccgccuccugcgggugaugcagugccugucccgcaucgaggagggcgagaaccucgacugcagcuucgacauggaggccgagcugacgccccuggaguccgcgaucaacguccucgagaugaucaagaccgaguucacccugaccgaggccgugguggagagcucccggaagcuggucaaggaggccgccgugaucaucugcaucaagaacaaggaguucgagaaggccagcaagauccucaagaagcacauguccaaggacccgaccacccagaagcugcgcaacgaccugcucaacaucauccgggagaagaaccuggcgcaccccgugauccagaacuucagcuacgagaccuuccagcagaagaugcugcgcuuccucgagucccaccuggacgacgccgagcccuaccugcucacgauggccaagaaggcccucaagagcgagagcgccgcguccagcaccgggaaggaggacaagcagcccgccccgggccccgucgagaagccgccccgggagcccgcccgccagcugcggaacccgcccaccaccaucgggaugaugacgcugaaggccgcguucaagacccuguccggcgcccaggacagcgaggccgccuucgccaagcuggaccagaaggaccucgugcugcccacccaggcgcugcccgccucccccgcccucaagaacaagcgcccccggaaggacgagaacgagagcuccgcccccgccgacggggagggcggcagcgagcugcagccgaagaacaagcgcaugaccaucucccggcuggugcucgaggaggacagccaguccacggagcccagcgcggggcugaacuccagccaggaggccgccuccgccccgcccagcaagcccaccguccugaaccagccccuccccggcgagaagaacccgaaggugcccaaggggaaguggaacuccagcaacggcguggaggagaaggagaccugggucgaggaggacgagcuguuccaggugcaggccgcgcccgacgaggacuccaccacgaacaucaccaagaagcagaaguggaccguggaggagagcgagugggucaaggccggggugcagaaguacggcgagggcaacugggccgccaucagcaagaacuaccccuucgugaaccgcaccgcggucaugaucaaggaccgguggcgcacgaugaagcggcuggggaugaacuga

SEQ ID NO: 37570 - RNA, 1200 nt, Artificial Sequence
  derived and/or modified sequence opt1 from TERF2IP__Homo_sapiens__NP_061848
auggccgaggccauggaccugggcaaggaccccaacgggccgacccacagcuccacccucuucgugcgcgacgacggcagcuccaugagcuucuacguccggcccucccccgcgaagcgccggcugagcacgcugauccuccacgggggcgggaccgugugccgcgugcaggagcccggcgccguccugcuggcccagccgggcgaggcccucgccgaggcguccggggacuucaucagcacccaguacauccuggacugcguggagcggaacgagcgccuggagcucgaggccuaccggcugggccccgccuccgccgcggacaccgggagcgaggccaagcccggcgcccuggccgagggggccgcggagcccgagccgcagcgccacgccggccggaucgccuucacggacgccgacgacguggccauccucaccuacgucaaggagaacgcgcgcucccccagcuccgugaccggcaacgcccuguggaaggccauggagaaguccagccugacccagcacagcuggcagucccucaaggaccgguaccugaagcaccuccgcgggcaggagcacaaguaccugcugggcgacgcccccgugagccccuccagccagaagcugaagcggaaggccgaggaggacccggaggcggccgacagcggggagccccagaacaagcgcacgcccgaccuccccgaggaggaguacgucaaggaggagauccaggagaacgaggaggccgugaagaagaugcugguggaggccacccgggaguucgaggaggucgugguggacgaguccccgcccgacuucgagauccacaucaccaugugcgacgacgacccgcccacccccgaggaggacagcgagacgcagcccgacgaggaggaggaggaggaggaggagaaggucucccagcccgaggugggcgccgcgaucaagaucauccgccagcugauggagaaguucaaccucgaccugagcaccgugacccaggccuuccugaagaacuccggcgagcucgaggccaccagcgccuuccuggcguccgggcagcgggccgacggcuaccccaucuggagccgccaggacgacaucgaccugcagaaggacgacgaggacacgcgggaggcccucgucaagaaguucggggcccagaacguggcccgccggaucgaguuccgcaagaaguga

SEQ ID NO: 37571 - RNA, 3210 nt, Artificial Sequence
  derived and/or modified sequence opt1 from TERT__Homo_sapiens__NP_001180305
augccccgcgccccgcggugccgcgccgugcggagccugcuccgcucccacuaccgggagguccugccccuggcgaccuucgugcgccggcucggcccccagggguggcgccuggugcagcggggcgaccccgccgccuuccgcgcccuggucgcccagugccucgugugcgugccgugggacgcgcggcccccgcccgccgcccccagcuuccgccaggucuccugccugaaggagcugguggcccgggugcuccagcgccugugcgagcgcggggcgaagaacguccuggccuucggcuucgcccuccuggacggggcccggggcggcccgcccgaggccuucaccacgagcgugcgguccuaccugcccaacaccgugaccgacgcgcuccgcgggagcggcgccugggggcugcugcuccggcgcgucggcgacgacgugcuggugcaccuccucgcccggugcgcccuguucguccugguggcccccuccugcgcguaccaggugugcgggccgccccucuaccagcugggcgccgccacccaggcccgcccgccgccccacgccagcggcccccgccggcgccuggggugcgagcgggcguggaaccacuccguccgcgaggccggcgugccccucgggcugcccgcccccggcgcccggcgccggggcgggagcgccucccgcagccugccccuccccaagcggccccgccggggcgcggcccccgagcccgagcgcacgcccguggggcagggcuccugggcccacccggggcggacccgcggccccagcgaccggggcuucugcgucgugucccccgcccgcccggcggaggaggccaccagccuggagggggcccuguccggcacccggcacagccaccccuccguggggcgccagcaccacgccggcccgcccagcacgagccggccgccccgccccugggacacccccugcccgcccgucuacgccgagaccaagcacuuccucuacuccagcggggacaaggagcagcugcgccccuccuuccugcucagcucccugcggcccagccugaccggcgcgcgccggcugguggagacgaucuuccugggcucccgccccuggaugcccgggacgccccggcgccugccccggcucccgcagcgcuacuggcagaugcggccccuguuccuggagcuccugggcaaccacgcccagugccccuacgggguccugcucaagacccacugcccccugcgcgccgccgugaccccggccgcgggcgugugcgcccgggagaagccccaggggagcgucgccgcccccgaggaggaggacaccgacccccgccggcuggugcagcugcuccgccagcacuccagcccguggcaggucuacggcuucgugcgggccugccugcgccggcuggugccgcccggccucugggggucccgccacaacgagcggcgcuuccugcggaacaccaagaaguucaucagccugggcaagcacgcgaagcucucccugcaggagcugaccuggaagaugagcgugcgcgacugcgccuggcuccgccggucccccggggucggcugcgugcccgccgccgagcaccgccugcgggaggagauccuggcgaaguuccuccacuggcugaugagcguguacgucguggagcugcuccgcuccuucuucuacgugaccgagacgaccuuccagaagaaccggcuguucuucuaccgcaagagcgucugguccaagcugcagagcaucggcauccggcagcaccucaagcgcgugcagcugcgggagcugagcgaggccgaggugcgccagcaccgggaggcccgccccgcccuccugaccucccggcugcgcuucauccccaagccggacgggcuccggcccaucgucaacauggacuacguggugggcgcccgcaccuuccggcgcgagaagcgggcggagcgccugacgagccgcgucaaggcccuguucuccgugcucaacuacgagcgggcccgccggcccgggcugcugggcgccagcgugcucgggcuggacgacauccaccgcgccuggcggaccuucguccugcgcgugcgggcgcaggacccgccgcccgagcucuacuucgugaaggucgacgugaccggcgccuacgacaccaucccccaggaccgccugacggaggugaucgccuccaucaucaagccccagaacaccuacugcguccggcgcuacgccguggugcagaaggccgcgcacggccacguccggaaggccuucaagagccacguguccacccugaccgaccuccagcccuacaugcgccaguucguggcccaccuccaggagacgagcccccugcgggacgccgucgugaucgagcaguccagcucccugaacgaggcgagcuccgggcuguucgacguguuccugcgcuucaugugccaccacgccguccggauccgcggcaagagcuacgugcagugccaggggaucccccagggcuccauccucagcacccugcugugcucccucugcuacggggacauggagaacaagcuguucgccggcauccggcgcgacggccugcuccugcggcugguggacgacuuccuccuggucacgccccaccugacccacgccaagaccuuccucagcuacgcccgcaccagcauccgggcgucccugaccuucaaccgcggguucaaggccggccgcaacaugcggcgcaagcuguucggggugcuccggcugaagugccacagccuguuccucgaccuccaggugaacucccugcagaccgucugcaccaacaucuacaagauccugcugcugcaggccuaccgcuuccacgccugcgugcuccagcugccguuccaccagcaggucuggaagaaccccacguucuuccugcgggugaucagcgacaccgccucccucugcuacagcauccugaaggcgaagaacgccggcaugucccugggggccaagggcgccgccggcccccuccccagcgaggcggugcaguggcugugccaccaggccuuccugcucaagcugacccgccaccgggugaccuacgucccgcugcucgggucccugcgcacggcccagacccagcugagccggaagcuccccggcaccacccugacggcccuggaggccgcggccaaccccgcccuccccuccgacuucaagaccauccuggacuga

SEQ ID NO: 37572 - RNA, 564 nt, Artificial Sequence
  derived and/or modified sequence opt1 from TESC__Homo_sapiens__NP_001161797
augggcgccgcccacagcgcguccgaggaggugcgcgagcuggaggggaagaccggcuucagcuccgaccagaucgagcagcuccaccggcgcuucaagcagcugagcggggaccagcccaccauccggaaccugcgcaagggcccguccgggcucgccgacgagaucaacuucgaggacuuccugacgaucaugagcuacuuccggcccaucgacaccaccauggacgaggagcaggucgagcugucccgcaaggagaagcuccgguuccuguuccacauguacgacagcgacuccgacggccgcaucacccuggaggaguaccggaacgugguggaggagcuccugagcggcaacccccacaucgagaaggaguccgcccgcagcaucgccgacggggccaugauggaggcggccuccgucugcaugggccagauggagcccgaccagguguacgaggggaucacguucgaggacuuccugaagaucuggcagggcaucgacaucgagaccaagaugcacgugcgguuccucaacauggagaccauggcccugugccacuga

SEQ ID NO: 37573 - RNA, 1266 nt, Artificial Sequence
  derived and/or modified sequence opt1 from TES__Homo_sapiens__NP_056456
auggaccuggagaacaaggugaagaagaugggccucgggcacgagcagggcuucggggcccccugccugaagugcaaggagaagugcgagggcuucgagcugcacuucuggcgcaagaucugccggaacugcaagugcgggcaggaggagcacgacguccuccugagcaacgaggaggaccgcaaggugggcaagcuguucgaggacaccaaguacaccacgcucaucgccaagcugaaguccgacggcaucccgauguacaagcggaacgugaugauccugaccaaccccgucgcggccaagaagaacgugagcaucaacaccgugaccuacgagugggccccgcccguccagaaccaggcccucgcccgccaguacaugcagaugcugcccaaggagaagcagcccguggcgggguccgagggcgcccaguaccggaagaagcagcuggccaagcagcuccccgcccacgaccaggaccccagcaagugccacgagcuguccccgcgcgaggugaaggagauggagcaguucgucaagaaguacaagagcgaggcgcugggggugggcgacgugaagcuccccugcgagauggacgcccaggggcccaagcagaugaacauccccggcggcgaccgguccacgccggccgccgucggggccauggaggacaagagcgcggagcacaagcgcacccaguacuccugcuacugcugcaagcugagcaugaaggagggcgaccccgccaucuacgccgagcgggccggguacgacaagcuguggcaccccgccugcuucgugugcuccacgugccacgagcuccugguggacaugaucuacuucuggaagaacgagaagcuguacugcggccgccacuacugcgacagcgagaagccccggugcgcgggcugcgacgagcucaucuucuccaacgaguacacccaggccgagaaccagaacuggcaccugaagcacuucugcugcuucgacugcgacagcauccuggccggggagaucuacgucauggugaacgacaagccggugugcaagcccugcuacgucaagaaccacgccguggugugccagggcugccacaacgccaucgaccccgagguccagcgcgugaccuacaacaacuucuccuggcacgcgagcaccgagugcuuccucugcuccugcugcagcaagugccugaucgggcagaaguucaugcccguggagggcauggucuucugcuccguggagugcaagaagcggaugagcuga

SEQ ID NO: 37574 - RNA, 1566 nt, Artificial Sequence
  derived and/or modified sequence opt1 from TESPA1__Homo_sapiens__NP_001129502
auggaggccagcgugcugucccccaccagcugggagaagcgccgggccuggcuccgccagucccggaacuggcagacccagguccuggaggaggaggcggccgccgcccugcaggacgugccggaccccgagcccagcucccucgacgacguguuccaggagggcaaccccaucaacaagaucgaggacuggcugcaggacugcggguacagcgaggagggcuucuccgaggaggccgggcaguucaucuacaacggcuucugcagccacgggacguccuucgaggacgaccugacccucggcgcggaggccacccugcuggccgccaacggcaagcuguucagccgcuccuuccuggagaccgcgcggccgugccagcugcucgaccuggggugcagccuggccuccagcuccaugacgggcgggaccaacaagaccagcuccagcaucuccgagauccucgacaagguccaggaggacgccgaggacgugcuguucagccugggcuucgggcaggaggaccacaaggacaccagccgcauccccgcccgguucuucacgacccccucccaggccaagggcaucgacuuccagcuguuccucaagagccaggugcgccggaucgagauggaggaccccugccucaugcucgcgucccgcuucaagcagguccagacccuggccgugaccgccgacgccuucuucugccuguacagcuacguguccaagacgccgguccagaaguucacccccagccacauguucuggaacugcaaccaccccaccgacgugcccuccauccggauccucagccgcgagccggagccccagagcccccgggaccgccugcggaaggccaucagcaagaugugccuguacacgugcccccgcgaccggccgcccccgccccacaacacccccaagcgcaacucccucgaccaggugguccuggaggugauggacaaggugaaggaggagaagcaguuccugcagcaggacagcgaccucggccaguucucccaggaggaccccgucccgcccgcggaggggaagaagcugcccaccagccccuaccccugcguguucugcugcgaggaggagacccagcagcggauguccaccgugcuggcccccagccagacgcucgacuccaacccgaagguccccugcugcacccacagccugcccaucgaggacccgcagugguccaccgaccccgcccagauccgccgggagcugugcagccuccccgccaccaacacggagacccaccccgccaaggacgagaccuucuggaagcgcaagagccgcgcgcggaagucccuguuccagaagaaccugaugggccgcaaggugaagucccucgaccuguccaucacccagcagaaguggaagcagagcguggaccggccggagcugcgccggucccucagccagcagccccaggacacguucgaccuggaggagguccaguccaacagcgaggaggagcagucccagagccgcuggcccucccggccccgccacccgcaccaccaccagaccuucgccgggaaggacagcuga

SEQ ID NO: 37575 - RNA, 6411 nt, Artificial Sequence
  derived and/or modified sequence opt1 from TET1__Homo_sapiens__NP_085128
augagccgcagccggcacgcccgccccagccggcuggugcgcaaggaggacgugaacaagaagaagaagaacucccagcuccggaagaccaccaagggcgccaacaagaacguggccagcgugaagacccugucccccgggaagcugaagcagcucauccaggagcgcgacgugaagaagaagaccgagcccaagccgcccgugcccgugcggagccugcugacccgcgccggcgccgcccggaugaaccucgaccgcaccgagguccuguuccagaaccccgagucccugaccugcaacggguucaccauggcccuccggagcaccucccugagccgccggcugucccagccgccccuggugguggccaaguccaagaaggucccccuguccaagggccuggagaagcagcacgacugcgacuacaagauccuccccgcccugggggugaagcacagcgagaacgacuccgugcccaugcaggacacccagguccugcccgacaucgagacccucaucggcgugcagaaccccagccugcugaagggcaagucccaggagaccacccaguucuggagccagcgcguggaggacuccaagaucaacauccccacccacagcgggcccgccgccgagauccuccccggcccccuggaggggacccggugcggcgaggggcuguucagcgaggagacccucaacgacaccuccggcagccccaagauguucgcgcaggacaccgucugcgcccccuucccccagcgcgccacgcccaaggugaccucccagggcaaccccagcauccagcuggaggagcuggggucccggguggagagccucaagcuguccgacagcuaccuggaccccaucaaguccgagcacgacugcuaccccaccagcucccucaacaaggucauccccgaccugaaccugcgcaacugccucgcccugggcgggagcaccucccccacgagcgugaucaaguuccugcucgccggcuccaagcaggcgacccugggcgccaagcccgaccaccaggaggccuucgaggccaccgccaaccagcaggaggugagcgacaccacguccuuccuggggcaggcguucggcgccaucccccaccagugggagcucccgggggccgaccccguccacggcgaggcccugggggagacccccgaccugccggagauccccggcgccauccccgugcagggcgagguguucgggaccauccucgaccagcaggagacccugggcaugagcggguccgucgugcccgaccugccggucuuccuccccgugccgcccaacccgaucgcgacguucaacgcccccagcaaguggcccgagccccagagcaccguguccuacggccuggccguccagggggccauccagauccugccgcucggcagcggccacacgccccaguccagcuccaacagcgagaagaacucccugccgcccgugauggccaucagcaacguggagaacgagaagcagguccacaucuccuuccugccggcgaacacccagggguucccccuggcccccgagcggggccucuuccacgccagccuggggaucgcccagcugucccaggcgggccccagcaaguccgaccgcgggagcucccaggugagcgugacguccaccguccacguggugaacaccaccgucgugacgaugccggugcccauggucagcaccagcuccagcuccuacaccacccuccugcccacccuggagaagaagaagcggaagcgcugcggcgugugcgagcccugccagcagaagacgaacugcggcgagugcaccuacugcaagaaccgcaagaacagccaccagaucugcaagaagcggaagugcgaggagcucaagaagaagccguccguggucgugccccuggaggugaucaaggagaacaagcgcccccagcgggagaagaagccgaagguccugaaggccgacuucgacaacaagcccgugaacgggcccaagagcgaguccauggacuacagccgcugcggccacggggaggagcagaagcucgagcugaacccccacaccguggagaacgucaccaagaacgaggacuccaugacgggcaucgagguggagaaguggacccagaacaagaagucccagcugaccgaccacgugaagggcgacuucuccgccaacgucccggaggccgagaaguccaagaacuccgagguggacaagaagcggaccaagagccccaagcuguucgugcagacgguccgcaacgggaucaagcacgugcacugccugcccgccgagaccaacguguccuucaagaaguucaacaucgaggaguucggcaagacccuggagaacaacagcuacaaguuccucaaggacaccgcgaaccacaagaacgccauguccagcgucgccacggacauguccugcgaccaccugaaggggcggagcaacgugcugguguuccagcagcccggcuucaacugcagcuccaucccgcacagcucccacagcaucaucaaccaccacgccuccauccacaacgagggggaccagcccaagacccccgagaacauccccagcaaggagccgaaggacggcucccccguccagcccagccuccugucccugaugaaggaccgccggcucacccuggagcaggucguggccaucgaggcgcugacccagcucagcgaggcccccuccgagaacagcuccccgagcaaguccgagaaggacgaggagagcgagcagcgcacggccucccugcugaacagcugcaaggccauccucuacaccguccggaaggaccugcaggaccccaaccugcagggcgagccgcccaagcucaaccacugcccgucccuggagaagcagagcagcugcaacaccgugguguucaacgggcagaccacgacccuguccaacagccacaucaacuccgccaccaaccaggcgagcaccaagucccacgaguacagcaaggucacgaacucccucagccuguucauccccaaguccaacagcuccaagaucgacaccaacaagagcaucgcccagggcaucaucacccuggacaacugcuccaacgaccuccaccagcugccgccccgcaacaacgagguggaguacugcaaccagcugcucgacagcuccaagaagcuggacagcgacgaccuguccugccaggacgccacccacacgcagaucgaggaggacguggccacccagcucacccagcuggcgagcaucaucaagaucaacuacaucaagccggaggacaagaaggucgaguccacccccacgagccuggugaccugcaacgugcagcagaaguacaaccaggagaaggggaccauccagcagaagccgcccagcuccguccacaacaaccacggcagcucccucaccaagcagaagaacccgacgcagaagaagaccaagagcacccccucccgggaccgccggaagaagaagcccaccguggugagcuaccaggagaacgaccgccagaagugggagaagcuguccuacauguacgggaccaucugcgacaucuggaucgccagcaaguuccagaacuucggccaguucugcccgcacgacuuccccacggucuucggcaagaucuccagcuccaccaagaucuggaagccccuggcccagacccggagcaucaugcagcccaagaccguguucccgccccucacgcagaucaagcugcagcgcuaccccgaguccgccgaggagaaggucaagguggagccccuggacagccucucccuguuccaccugaagaccgagagcaacgggaaggccuucaccgacaaggcguacaacucccaggugcagcucaccgucaacgccaaccagaaggcccacccgcugacgcagcccagcuccccgcccaaccagugcgccaacgugauggccggcgacgaccagauccgguuccagcaggucgucaaggagcagcugaugcaccagcgccuccccacccugcccgggaucagccacgagacgccccuccccgagagcgcgcucacccugcgcaacgugaacguggucugcuccggcgggaucacgguggugagcaccaaguccgaggaggaggucugcagcuccagcuucggcaccuccgaguucagcaccguggacuccgcccagaagaacuucaacgacuacgccaugaacuucuucacgaacccgaccaagaaccuggugagcaucaccaaggacuccgagcucccgaccugcagcugccuggaccgggucauccagaaggacaagggccccuacuacacgcaccugggggccggccccuccguggccgcggugcgcgagaucauggagaaccgguacgggcagaagggcaacgccauccgcaucgagaucgucguguacaccgggaaggagggcaagagcucccacggcugccccaucgccaagugggugcuccggcgcagcuccgacgaggagaagguccugugccuggugcggcagcgcaccgggcaccacugccccaccgccgugauggucgugcucaucauggugugggacggcaucccccugcccauggcggaccggcuguacacggagcucaccgagaaccucaagagcuacaacgggcacccgaccgaccgccggugcacccugaacgagaaccgcacgugcacgugccagggcaucgaccccgagaccugcggcgccuccuucagcuucgggugcagcugguccauguacuucaacggcugcaaguucgggcggagccccagcccccgccgguuccgcaucgacccgagcagcccccugcacgagaagaaccuggaggacaaccugcagagccucgccacccggcuggcccccaucuacaagcaguacgccccggucgcguaccagaaccagguggaguacgagaacguggcccgcgagugccggcugggcuccaaggaggggcgccccuucagcggcgucacggccugccucgacuucugcgcccacccccaccgggacauccacaacaugaacaacggcuccaccguggugugcacccugacccgcgaggacaaccgcagccugggggucaucccccaggacgagcagcuccacgugcugccgcuguacaagcucuccgacacggacgaguucggcagcaaggaggggauggaggccaagaucaaguccggcgcgaucgaggugcuggcgccccggcgcaagaagcggaccugcuucacccagcccgucccccgcagcgggaagaagcgggccgccaugaugaccgaggugcuggcccacaagauccgcgcgguggagaagaagccgaucccccggaucaagcgcaagaacaacuccaccacgaccaacaacagcaagcccuccagccuccccacccugggcagcaacaccgagacgguccagccggaggugaaguccgagaccgagccccacuucauccucaagagcuccgacaacaccaagaccuacagccucaugcccuccgcgccccacccggugaaggaggccagccccggcuucuccuggagccccaagacggccuccgccacccccgcgccgcugaagaacgacgccaccgccagcugcggguucuccgagcggagcuccacgccccacugcacgaugcccagcggccgccuguccggggccaacgcggccgccgccgacggccccgggaucagccagcugggcgaggucgccccgcuccccacccuguccgcgcccgugauggagccgcugaucaacagcgagcccuccaccggcgugaccgagccccucacgccccaccagccgaaccaccagcccagcuuccugaccagcccccaggaccuggccuccagccccauggaggaggacgagcagcacuccgaggccgacgagccgcccagcgacgagccccucuccgacgacccccugagcccggccgaggagaagcugccccacaucgacgaguacugguccgacagcgagcacaucuuccucgacgccaacaucgggggcgucgcgaucgcccccgcccacggguccgugcugaucgagugcgcccggcgcgagcugcacgccaccacccccguggagcacccgaaccggaaccaccccacgcgccucagccuggucuucuaccagcacaagaaccugaacaagccccagcacggcuucgagcucaacaagaucaaguucgaggcgaaggaggccaagaacaagaagaugaaggccuccgagcagaaggaccaggccgcgaacgagggccccgagcagagcuccgaggugaacgagcugaaccagaucccgagccacaaggcccugacccucacccacgacaacguggucaccgugucccccuacgcccugacgcacgucgccgggcccuacaaccacuggguguga

SEQ ID NO: 37576 - RNA, 6009 nt, Artificial Sequence
  derived and/or modified sequence opt1 from TET2__Homo_sapiens__NP_001120680
auggagcaggaccgcaccaaccacguggagggcaaccgccugagccccuuccugauccccagcccgcccaucugccagaccgagccccuggccaccaagcugcagaacgggagcccccugcccgagcgcgcccaccccgaggucaacggcgacaccaaguggcacuccuucaagagcuacuacgggauccccugcaugaagggcucccagaacagccgggugagccccgacuucacccaggagagccgcggguacuccaagugccugcagaacggcggcaucaagcggaccgugagcgagcccucccugagcgggcugcugcagaucaagaagcugaagcaggaccagaaggccaacggcgagcgccggaacuucggggucucccaggagcgcaaccccggcgagagcucccagcccaacgugagcgaccuguccgacaagaaggagagcguguccagcgucgcccaggagaacgccgugaaggacuucaccagcuucuccacccacaacugcagcgggcccgagaaccccgagcugcagauccugaacgagcaggagggcaaguccgccaacuaccacgacaagaacaucgugcuccugaagaacaaggccguccugaugcccaacggcgcgaccgugagcgccuccagcguggagcacacccacggggagcuccuggagaagacgcugucccaguacuaccccgacugcgucagcaucgccgugcagaagaccaccucccacaucaacgccaucaacagccaggcgaccaacgagcucuccugcgagaucacgcaccccagccacaccuccggccagaucaacagcgcccagaccuccaacagcgagcugccgcccaagcccgccgccguggucuccgaggccugcgacgcggacgacgccgacaacgccagcaagcuggccgccaugcucaacacgugcuccuuccagaagccggagcagcugcagcagcagaaguccguguucgagaucugccccagccccgcggagaacaacauccaggggacgaccaagcuggccuccggcgaggaguucugcagcggcuccagcuccaaccuccaggcccccgggggcagcuccgagcgguaccugaagcagaacgagaugaacggggccuacuucaagcagagcuccguguucaccaaggacagcuucuccgccaccacgaccccgccgccgcccagccagcugcuccuguccccgccgccgccccugccccaggucccccagcuccccagcgagggcaaguccacccugaacgggggcgugcuggaggagcaccaccacuaccccaaccagagcaacaccacgcuccugcgcgaggugaagaucgagggcaagcccgaggcgccgcccucccagagcccgaaccccagcacccacgucugcucccccagccccaugcuguccgagcggccgcagaacaacugcgugaaccgcaacgacauccagaccgccgggaccaugacggugccccucugcagcgagaagacccggcccauguccgagcaccugaagcacaacccgcccaucuucggcagcuccggggagcugcaggacaacugccagcagcucaugcgcaacaaggagcaggagauccugaagggccgggacaaggagcagacccgcgaccuggugccgcccacccagcacuaccucaagcccggguggaucgagcugaaggccccgcgguuccaccaggccgagagccaccugaagcgcaacgaggccucccuccccagcauccugcaguaccagcccaaccuguccaaccagaugacgagcaagcaguacaccggcaacuccaacaugcccggcgggcucccgcggcaggcguacacccagaagaccacgcagcuggagcacaagagccagauguaccagguggagaugaaccagggccagucccaggggaccgucgaccagcaccuccaguuccagaagcccagccaccaggugcacuucuccaagaccgaccaccuccccaaggcccacgugcagagccucugcggcacccgcuuccacuuccagcagcgggccgacucccagaccgagaagcugaugagccccguccugaagcagcaccucaaccagcaggccagcgagacggagcccuucuccaacagccaccuccugcagcacaagccccacaagcaggcggcccagacccagcccucccagagcucccaccucccgcagaaccagcagcagcagcagaagcugcagaucaagaacaaggaggagauccugcagaccuucccccacccccagagcaacaacgaccagcagcgcgagggguccuucuucggccagaccaagguggaggagugcuuccacggcgagaaccaguacagcaaguccagcgaguucgagacgcacaacgugcagauggggcucgaggagguccagaacaucaaccgccggaacucccccuacagccagaccaugaaguccagcgccugcaagauccagguguccugcagcaacaacacccaccugguguccgagaacaaggagcagaccacgcacccggagcuguucgccggcaacaagacccagaaccuccaccacaugcaguacuuccccaacaacgucauccccaagcaggaccugcugcaccgcugcuuccaggagcaggagcagaagucccagcaggccuccgugcuccagggguacaagaaccggaaccaggacaugagcggccagcaggcggcccagcuggcccagcagcgcuaccugauccacaaccacgccaacguguuccccgucccggaccagggcgggagccacacccagaccccgccccagaaggacacgcagaagcacgccgcgcuccgguggcaccuccugcagaagcaggagcagcagcagacccagcagccccagaccgaguccugccacagccagaugcaccgccccaucaagguggagcccggcugcaagccccacgccugcaugcacaccgcgccgcccgagaacaagacguggaagaaggugaccaagcaggagaacccgcccgccuccugcgacaacguccagcagaaguccaucaucgagaccauggagcagcaccucaagcaguuccacgccaagucccuguucgaccacaaggcgcugacccucaagagccagaagcaggucaagguggagauguccgggcccgucacggugcugacccggcagaccaccgccgccgagcuggacagccacacgcccgcccucgagcagcagaccaccuccagcgagaagacccccacgaagcgcaccgcggccuccgugcugaacaacuucaucgagagccccuccaagcugcucgacacccccaucaagaaccugcuggacaccccggucaagacgcaguacgacuuccccagcugccggugcguggagcagaucaucgagaaggacgagggccccuucuacacccaccucggggccggcccgaacguggccgccauccgcgagaucauggaggagcgguucggccagaaggggaaggcgauccgcaucgagcgggucaucuacaccggcaaggaggggaaguccagccagggcugccccaucgccaaguggguggugcgccgguccagcuccgaggagaagcugcugugccucguccgcgagcgggccgggcacacgugcgaggccgccgugaucgugauccugauccuggucugggagggcaucccccucagccuggcggacaagcuguacagcgagcucaccgagacccugcgcaaguacggcacccugaccaaccggcgcugcgcccucaacgaggagcggaccugcgccugccaggggcuggaccccgagacgugcggcgccuccuucagcuucgggugcuccuggagcauguacuacaacggcugcaaguucgcccgguccaagaucccgcgcaaguucaagcugcucggggacgaccccaaggaggaggagaagcuggagagccaccuccagaaccucuccacccugauggcgcccaccuacaagaagcuggcccccgacgccuacaacaaccagaucgaguacgagcaccgggccccggagugccgccucggccugaaggagggccggcccuucagcggggugaccgcgugccuggacuucugcgcccacgcccaccgcgaccuccacaacaugcagaacggcuccacgcuggugugcacccugacccgggaggacaaccgcgaguucgggggcaagcccgaggacgagcagcuccacguccugccccuguacaaggugagcgacguggacgaguucggguccgucgaggcccaggaggagaagaagcggagcggcgccauccaggugcucuccagcuuccgccggaaggugcgcaugcuggcggagccggucaagaccugccggcagcgcaagcuggaggccaagaaggccgccgccgagaagcucuccagccuggagaacuccagcaacaagaacgagaaggagaaguccgcgcccagccggacgaagcagaccgagaacgccagccaggccaagcagcuggccgagcuccugcgccuguccggccccgugaugcagcagagccagcagccccagccgcuccagaagcagccgccccagccccagcagcagcagcggccgcagcagcagcagccccaccacccccagaccgaguccgugaacagcuacuccgccagcggguccaccaaccccuacaugcgccggccgaaccccgucagccccuaccccaacuccagccacacguccgacaucuacggcagcaccuccccgaugaacuucuacagcaccuccagccaggcggccggguccuaccugaacagcuccaaccccaugaaccccuacccgggccugcucaaccagaacacccaguaccccagcuaccagugcaacggcaaccugagcguggacaacugcucccccuaccuggggagcuacagcccccagagccagccgauggaccucuaccgcuaccccucccaggacccccugagcaagcugucccugccgcccauccacacgcuguaccagccccgguucggcaacagccaguccuucaccagcaaguaccugggguacggcaaccagaacaugcagggggacggcuucuccagcugcaccauccgccccaacgugcaccacgucggcaagcugccgcccuaccccacccacgagauggacgggcacuucaugggcgccacgucccgccugccgcccaaccugagcaaccccaacauggacuacaagaacggggagcaccacucccccagccacaucauccacaacuacuccgccgcccccggcauguucaacagcagccuccacgcgcugcaccuccagaacaaggagaacgacaugcucucccacaccgccaacgggcugagcaagaugcugcccgcccucaaccacgaccggaccgccugcgugcagggcggccugcacaagcuguccgacgcgaacgggcaggagaagcagccccuggcccucgugcagggcgucgccagcggggccgaggacaacgacgaggugugguccgacagcgagcaguccuuccuggaccccgacaucggcgggguggccgucgcgcccacccacggcagcauccugaucgagugcgccaagcgcgagcuccacgccacgacgccccugaagaacccgaaccggaaccaccccacccgcaucucccugguguucuaccagcacaagagcaugaacgagcccaagcacggccucgcccugugggaggccaagauggcggagaaggcccgggagaaggaggaggagugcgagaaguacgggccggacuacgucccccagaagucccacggcaagaaggugaagcgcgagcccgccgagccccacgagaccagcgagccgacguaccugcgguucaucaagucccucgccgagcgcaccaugagcgugaccaccgacuccacggucaccaccagccccuacgccuucacccgggugacggggcccuacaaccgcuacaucuga

SEQ ID NO: 37577 - RNA, 5388 nt, Artificial Sequence
  derived and/or modified sequence opt1 from TET3__Homo_sapiens__XP_005264244
augagccaguuccaggugccccuggccgugcagcccgaccuccccggccuguacgacuucccccagcgccaggugauggugggguccuuccccggcuccgggcuguccauggccggcagcgagucccagcuccggggcggcggggacgggcgcaagaagcggaagcggugcgggaccugcgagcccugccggcgccuggagaacugcggggccugcaccagcugcaccaaccggcgcacccaccagaucugcaagcugcggaagugcgagguccucaagaagaagguggggcugcugaaggagguggagaucaaggccggggagggcgccggccccugggggcagggcgccgccgucaagaccggguccgagcucagccccguggacggccccgugccgggccagauggacuccgggcccgucuaccacggcgacagccgccagcuguccgccagcggggugcccgugaacggcgcccgggagcccgccgggcccucccugcucggcaccggcgggcccuggcgcgucgaccagaagcccgacugggaggccgcgcccggccccgcccacaccgcccggcuggaggacgcccacgaccugguggccuucagcgcgguggccgaggccgucuccagcuacggggcccucuccacccgccuguacgagaccuucaaccgggagaugagccgcgaggccggcaacaacucccgggggccccgccccggccccgagggcugcagcgcggggagcgaggaccuggacacccuccagaccgcccuggcccuggcccggcacggcaugaagccgcccaacugcaacugcgacgggcccgagugccccgacuaccucgaguggcuggagggcaagaucaaguccguggugauggagggcggcgaggagcgcccgcggcugcccggcccccugccgcccggggaggccggccugcccgcgcccagcacccgcccccugcucuccagcgaggucccccagaucagcccccaggaggggcugccccugagccaguccgcccucagcaucgccaaggagaagaacaucucccugcagaccgccaucgccaucgaggcgcugacccagcucagcuccgcccugccgcagcccagccacuccacgccccaggccagcugcccccugccggaggcccucagcccgcccgcgcccuuccgcagcccgcaguccuaccugcgggcccccagcuggcccguggugcccccggaggagcacuccagcuucgcccccgacagcuccgccuucccgcccgccaccccgcgcaccgaguuccccgaggcguggggcaccgacacgccgcccgccaccccgcggagcuccuggcccaugccccgcccgagccccgaccccauggccgagcuggagcagcuccugggcuccgccagcgacuacauccaguccgucuucaagcggcccgaggcccugccgaccaagcccaaggugaagguggaggcgcccagcuccagccccgccccggcccccucccccguccuccagcgcgaggcccccaccccgagcuccgagcccgacacgcaccagaaggcccagaccgcgcugcagcagcaccuccaccacaagcggagccucuuccuggagcagguccacgacaccuccuuccccgcccccagcgagccguccgcccccgggugguggccgccgcccagcagccccgucccccgccugcccgaccggccgcccaaggagaagaagaagaagcuccccacccccgccggcgggcccgugggcacggagaaggcggcccccgggaucaagcccuccgugcgcaagccgauccagaucaagaagucccggccccgcgaggcccagccccuguucccgcccguccggcagaucgugcuggagggccugcgcucccccgccagccaggaggugcaggcccacccgcccgcgccccuccccgccucccagggcagcgccgucccccugcccccggagcccucccuggcccucuucgcccccagccccucccgggacagccugcugccgcccacccaggagaugcgcucccccagccccaugaccgcgcuccagccgggguccaccggcccccugccgcccgccgacgacaagcuggaggagcucauccggcaguucgaggccgaguucggggacagcuucggccugccggggccgcccuccgugcccauccaggacccggagaaccagcagacgugccugcccgcccccgagagcccguucgccacccgcucccccaagcagaucaagaucgagagcuccggcgcggugaccguccucagcaccacgugcuuccacagcgaggagggcgggcaggaggccacccccaccaaggccgagaacccccugaccccgacgcuguccggcuuccucgagagcccccugaaguaccuggacacccccaccaagucccuccuggacacccccgccaagcgggcgcaggccgaguucccgaccugcgacugcguggagcagaucguggagaaggacgaggggcccuacuacacgcaccugggcagcgggcccaccgucgccuccauccgcgagcucauggaggagcgcuacggcgagaagggcaaggccauccggaucgagaaggugaucuacaccgggaaggagggcaagagcucccgcgggugccccaucgccaagugggugauccggcgccacacccuggaggagaagcugcucugccugguccggcaccgcgcgggccaccacugccagaacgccgugaucgugauccugauccucgccugggaggggaucccgcggagccugggcgacacgcuguaccaggagcucaccgacacccugcgcaaguacggcaaccccaccucccggcgcugcgggcugaacgacgaccggacgugcgccugccagggcaaggaccccaacacgugcggggccagcuucuccuucggcugcagcugguccauguacuucaacggcugcaaguacgcgcgcagcaagacgccccgcaaguuccgccucgccggggacaacccgaaggaggaggagguccugcggaaguccuuccaggaccuggccaccgagguggcgccccucuacaagcgccuggcgccccaggcguaccagaaccaggugaccaacgaggagaucgccaucgacugccggcugggccucaaggaggggcgccccuucgccggcgucaccgccugcauggacuucugcgcccacgcgcacaaggaccagcacaaccuguacaacgggugcaccguggugugcacccugacgaaggaggacaaccggugcgucggcaagaucccggaggacgagcagcuccacgugcugccccuguacaagauggccaacaccgacgaguucggcagcgaggagaaccagaacgccaaggugggguccggcgccauccagguccucaccgcguucccccgcgaggugcggcgccugcccgagccggccaagagcugccgccagcggcagcuggaggcccgcaaggccgccgcggagaagaagaagauccagaaggagaagcucuccacccccgagaagaucaagcaggaggcccuggagcuggccgggaucacgagcgaccccggccucagccugaagggcggccugucccagcagggccucaagccgagccugaagguggagccccagaaccacuucuccagcuucaaguacuccgggaacgccgucguggagagcuacuccgugcugggcaacugccggcccagcgaccccuacuccaugaacagcgucuacuccuaccacagcuacuacgcccagccgucccucaccagcgugaacggguuccacuccaaguacgcgcugcccagcuucuccuacuacggcuuccccagcuccaaccccguguucccgagccaguuccuggggcccggcgccuggggccacagcggguccagcggcuccuucgagaagaagcccgaccuccacgcccugcacaacagccugucccccgccuacgggggcgccgaguucgcggagcucccgagccaggccguccccaccgacgcccaccaccccacgccccaccaccagcagccggccuaccccggccccaaggaguaccugcugcccaaggcgccgcuccugcacuccgugagccgcgaccccucccccuucgcccagagcuccaacugcuacaaccggagcaucaagcaggagcccguggacccgcugacgcaggccgagcccgucccccgcgacgccgggaagaugggcaagacgccccucuccgaggugagccagaacgggggcccgucccaccugugggggcaguacagcggcggccccuccaugagccccaagcggaccaacggggugggcggguccuggggcgucuucagcagcggggaguccccggccaucgugcccgacaagcugagcuccuucggcgcgagcugccucgcccccucccacuucaccgacggccagugggggcuguuccccggcgaggggcagcaggccgccagccacuccggcgggcgccugcggggcaagccguggagccccugcaaguucggcaacuccacgagcgcccucgcggggcccucccugaccgagaagcccugggcccugggcgccggggacuucaacagcgcccucaagggcuccccgggguuccaggacaagcuguggaaccccaugaagggcgaggagggccgcauccccgccgcgggggccagccagcuggaccgggccuggcaguccuucggccucccccuggggagcuccgagaagcuguucggcgcccucaagagcgaggagaagcugugggacccguucucccuggaggagggccccgcggaggagccgcccagcaagggggccgugaaggaggagaagggcgggggcggggccgaggaggaggaggaggagcucuggagcgacuccgagcacaacuuccuggacgagaacaucggcggcgucgccguggcccccgcgcacgggagcauccugaucgagugcgcccgccgggagcuccacgccaccacgccccugaagaagcccaaccgcugccaccccacccggaucucccugguguucuaccagcacaagaaccucaaccagccgaaccacggccuggcccugugggaggccaagaugaagcagcuggcggagcgcgcccgggcccgccaggaggaggccgcccggcucgggcugggccagcaggaggcgaagcuguacgggaagaagcgcaaguggggcggcaccgucguggccgagccccagcagaaggagaagaagggggugguccccacccgccaggcccucgccgugcccaccgacagcgccgucacgguguccagcuacgcguacaccaaggugaccggcccguacucccgguggaucuga

SEQ ID NO: 37578 - RNA, 750 nt, Artificial Sequence
  derived and/or modified sequence opt1 from TEX101__Homo_sapiens__NP_001123483
augggcacgccccgcauccagcaccuccugauccugcuggugcucggggccagccugcugaccuccggccucgagcuguacugccagaaggggcugagcaugaccgucgaggccgacccggccaacauguucaacuggaccaccgaggagguggagaccugcgacaagggcgcccucugccaggagacgauccugaucaucaaggccgggaccgagaccgccauccuggccaccaagggcugcauccccgagggcgaggaggcgaucacgaucgugcagcacuccagcccgcccgggcucaucgucaccuccuacagcaacuacugcgaggacuccuucugcaacgacaaggacagccugucccaguucugggaguucagcgagaccaccgccuccacggugagcaccacccugcacugcccgaccugcguggcccucggcacgugcuucuccgcccccagccugcccugccccaacgggaccacccggugcuaccagggcaagcuggagaucaccgggggcggcaucgaguccagcgucgaggugaaggggugcacggcgaugaucggcugccgccucauguccgggauccuggccgugggccccauguucguccgggaggccugcccccaccagcugcucacccagccccgcaagaccgagaacggcgcgaccugccugcccaucccggugugggggcugcagcuccugcugccccuccugcugcccagcuucauccacuucuccuga

SEQ ID NO: 37579 - RNA, 2823 nt, Artificial Sequence
  derived and/or modified sequence opt1 from TEX11__Homo_sapiens__NP_001003811
augaucagcgcccacugcaaccugcgccuccugugcuccagcgacuccagcgccuccgcgagccagguggccggcaccaccgaggucguggagaaccuggugacgaacgacaacucccccaacaucccggaggccaucgaccgccucuucagcgacaucgccaacaucaaccgggaguccauggccgagaucaccgacauccagaucgaggagauggcggucaaccuguggaacugggcccugaccaucgggggcggguggcucgugaacgaggagcagaagauccggcugcacuacguggccugcaagcugcucagcaugugcgaggccuccuucgcgagcgagcaguccauccagcgccugaucaugaugaacaugcggaucggcaaggaguggcuggacgccgggaacuuccucaucgccgacgagugcuuccaggccgccgucgcgagccuggagcagcuguacgugaagcucauccagcgcuccagccccgaggccgaccugaccauggagaagaucacgguggaguccgaccacuuccggguccugagcuaccaggccgaguccgccguggcccagggcgacuuccagcgcgcgagcaugugcgugcuccagugcaaggacaugcugaugcggcugccccagaugaccagcucccuccaccaccugugcuacaacuucggcgucgagacccagaagaacaacaaguacgaggagagcuccuucuggcugagccaguccuacgacaucgggaagauggacaagaaguccaccggccccgagaugcucgccaaggugcugcgccugcucgccacgaacuaccuggacugggacgacaccaaguacuacgacaaggcccugaacgccgugaaccucgcgaacaaggagcaccugagcagcccggggcuguuccucaagaugaagauccugcugaagggcgagaccuccaacgaggagcuccuggaggccgucauggagauccugcaccucgacaugccccuggacuucugccugaacaucgccaagcuccugauggaccacgagcgggagagcgugggguuccacuuccugaccaucauccacgagcgcuucaaguccagcgagaacaucggcaaggugcucauccugcacacggacaugcugcuccagcggaaggaggagcugcuggccaaggagaagaucgaggagaucuuccuggcccaccagaccggccgccagcucaccgcggaguccaugaacuggcugcacaacauccuguggcggcaggccgccagcuccuucgagguccagaacuacaccgacgcccuccagugguacuacuacagccugcgcuucuacuccacggacgagauggaccuggacuucaccaagcuccagcggaacauggcgugcugcuaccugaaccugcagcagcucgacaaggccaaggaggccguggccgaggccgagcgccacgacccccggaacguguucacccaguucuacaucuucaagaucgcggucaucgaggggaacagcgagcgcgcccugcaggccaucaucacccuggagaacauccucacggacgaggaguccgaggacaacgaccugguggccgagcggggcagccccaccaugcugcucagccuggccgcgcaguucgcccuggagaacgggcagcagaucguggccgagaaggcccucgaguaccuggcccagcacuccgaggaccaggagcagguccugaccgcggugaagugccuccugcgcuuccugcucccgaagaucgccgagaugcccgagagcgaggacaagaagaaggagauggaccgccugcugaccugccucaaccgggccuucgucaagcugucccagcccuucggcgaggaggcccugagccucgagucccgcgcgaacgaggcccagugguuccggaagacggccuggaaccuggccgugcagugcgacaaggaccccgugaugaugcgcgaguucuucauccugagcuacaagaugucccaguucugcccgagcgaccaggucauccucaucgcccggaagaccugccugcugauggcgguggccguggaccucgagcagggccgcaaggccuccaccgccuucgagcagaccauguuccugagccgggcccuggaggagauccagacgugcaacgacauccacaacuuccucaagcagaccgggaccuucuccaacgacagcugcgagaagcugcugcuccuguacgaguucgagguccgcgcgaagcugaacgacccccuccuggaguccuuccuggagagcgugugggagcucccccaccuggagaccaagacguucgagaccaucgccaucaucgccauggagaagcccgcccacuacccgcugaucgcccucaaggcgcugaagaaggcccugcuccuguacaagaaggaggagcccaucgacaucucccaguacagcaagugcaugcacaaccuggugaaccucuccguccccgacggcgccagcaacguggagcugugcccccuggaggagguguggggguacuucgaggacgcccucagccacaucucccggaccaaggacuacccggagauggagauccuguggcugauggucaagagcuggaacaccggcgugcucauguucucccgcagcaaguacgcguccgccgagaaguggugcgggcuggcccugcgguuccucaaccaccugacgagcuucaaggaguccuacgagacccagaugaacaugcuguacagccagcucguggaggcccuguccaacaacaagggccccgucuuccacgagcacggcuacuggagcaaguccgacuga

SEQ ID NO: 37580 - RNA, 4494 nt, Artificial Sequence
  derived and/or modified sequence opt1 from TEX14__Homo_sapiens__NP_001188386
augagccgcgccgugcggcugcccgucccgugccccgugcagcucggcacccugcgcaacgacucccuggaggcccagcuccacgaguacgugaagcaggggaacuacgucaaggugaagaagauccugaagaagggcaucuacguggacgcggucaacagccuggggcagaccgcccucuucguggccgcccugcugggccuccggaaguucguggacguccugguggacuacggguccgaccccaaccaccgcugcuucgacggcagcacgcccgugcacgccgcggccuucuccggcaaccaguggauccugagcaagcuccuggacgccgggggcgaccugcggcuccacgacgagcgcgggcagaacccgaagaccugggcccugaccgcgggcaaggagcgguccacccagaucgucgaguucaugcagcgcugcgccagccacaugcaggccaucauccagggguucuccuacgaccugcucaagaagaucgacagcccccagcggcugguguacucccccagcuggugcggcggccuggugcaggggaaccccaacggcuccccgaaccgccuccugaaggccggggucaucagcgcccagaacaucuacuccuucggcuucggcaaggcgaugcccugguuccaguucuaccugacgggggccacccagauggccuaccucggcagccugcccgugaucggggagaaggaggugauccaggccgacgacgagcccaccuucuccuucuucagcggcccguacauggucaugaccaaccugguguggaacgggucccgggugacggucaaggagcucaaccugcccacccacccccacugcagccgccugcggcucgccgaccugcugaucgcggagcaggagcacagcuccaagcuccgccaccccuaccugcugcagcucauggccgugugccugagccaggaccuggagaagacccggcucguguacgagcgcaucaccaucggcacgcuguucuccguccugcacgagcggcgcagccaguucccggugcuccacauggaggucaucgugcaccuccugcuccagaucuccgacgcccugcgguaccugcacuuccagggcuucauccaccgcagccucuccagcuacgccgugcacaucaucucccccggggaggcccggcugaccaaccuggaguacaugcuggagagcgaggaccgcggcguccagcgcgaccucacccgggugccccugcccacccagcuguacaacugggcggccccggaggugauccuccagaaggccgccacggucaaguccgacaucuacagcuucuccaugaucaugcaggagauccugaccgacgacauccccuggaaggggcuggacggcagcguggugaagaaggccgucguguccgggaacuaccucgaggcggacgugcgccugcccaagcccuacuacgacaucgucaagagcggcauccacgugaagcagaaggaccggaccaugaaccugcaggacauccgcuacauccucaagaacgaccugaaggacuucaccggcgcccagcggacgcagccgaccgagagcccccgcgugcagcgguacgggcugcaccccgacgucaacguguaccucggccugaccuccgagcacccccgcgagaccccggacauggagaucaucgagcugaaggagauggggucccagccccacagcccccgggugcacagccucuucacggagggcacccuggacccgcaggcccccgaccccugccugauggcccgcgagacccagaaccaggacgcgcccugcccggcccccuucauggccgaggaggccuccagccccuccaccgggcagcccagccucugcuccuucgagaucaacgagaucuacagcggcugccugauccuggaggacgacaucgaggagccgcccggcgccgcguccagccucgaggccgacgggcccaaccaggucgacgagcugaaguccauggaggaggagcuggacaagauggagcgggaggccugcugcuucggcagcgaggacgaguccagcuccaaggccgagacggaguacagcuucgacgacugggacuggcagaacgggucccucagcucccugagccugcccgagagcacccgcgaggccaaguccaaccucaacaacaugagcaccaccgaggaguaccugaucuccaagugcgugcuggaccucaagaucaugcagacgaucaugcacgagaacgacgaccggcugcgcaacaucgagcagauccuggacgagguggagaugaagcagaaggagcaggaggagcggaugagccucugggcgaccucccgcgaguucaccaacgccuacaagcugccgcuggccgucggcccgcccagccucaacuacaucccgcccgugcugcagcuguccggcgggcagaagcccgacaccagcggcaacuaccccacgcucccccgguucccccgcaugcugcccacccugugcgaccccgggaagcagaacaccgacgagcaguuccagugcacccagggcgccaaggacucccucgagaccagccggauccagaacacguccagccaggggcgcccccgcgaguccaccgcccaggcgaaggccacccaguucaacagcgcccuguucacccuguccagccaccggcagggcccguccgccagccccuccugccacugggacagcacgcgcaugagcguggagcccgucuccagcgagaucuacaacgcggagucccggaacaaggacgacggcaaggugcaccucaaguggaagauggaggugaaggagauggccaagaaggccgccaccgggcagcugaccgucccgcccuggcacccccagagcucccugacccucgagagcgaggccgagaacgagcccgacgcgcugcugcagccgcccauccgcucccccgagaacacggacuggcagcgggugaucgaguaccaccgcgagaacgacgagccccggggcaacgggaaguucgacaagaccggcaacaacgacugcgacagcgaccagcacgggcgccagccgcggcucggcuccuucaccagcauccgccaccccagcccccggcagaaggagcagcccgagcacuccgaggccuuccaggccuccagcgacacccugguggccgucgagaaguccuacagccaccaguccaugcagagcacgugcuccccggagagcagcgaggacaucaccgacgaguuccugacccccgacggcgaguacuucuacuccagcaccgcccaggagaaccucgcgcuggagacguccagccccaucgaggaggacuucgaggggauccagggcgccuucgcccagccccagguguccggggaggagaaguuccagaugcgcaagauccugggcaagaacgccgagauccucccgcggagccaguuccagcccgugcgcuccaccgaggacgagcaggaggagaccagcaaggagucccccaaggagcugaaggagaaggacaucagccugaccgacauccaggaccucuccagcaucuccuacgagcccgacagcuccuucaaggaggccagcugcaagacgccgaagaucaaccacgcgcccaccuccgucagcacgccccugucccccgggagcgugagcuccgccgccagccaguacaaggacugccuggaguccaucaccuuccaggugaagaccgaguucgccagcugcuggaacucccaggaguucauccagacccucagcgacgacuucaucuccguccgggagcgcgcgaagaagcuggacagccugcucaccuccagcgagaccccgcccucccggcugacgggccugaagcgccucagcuccuucaucggcgccgggagccccucccuggugaaggccugcgacagcuccccgccccacgccacccagcggcgcagccugcccaagguggaggccuucucccagcaccacaucgacgagcugcccccgcccagccaggagcugcuggacgacaucgagcuccugaagcagcagcagggcagcuccaccguccugcacgagaacaccgcgagcgacgggggcgggacggccaacgaccagcggcaccucgaggagcaggagaccgacuccaagaaggaggacagcuccaugcugcugagcaaggagaccgaggaccucggcgaggacaccgagcgcgcccacuccacgcuggacgaggaccuggagcgcuggcuccagccgcccgaggagagcguggagcugcaggaccugcccaagggcuccgagcgggagaccaacaucaaggaccagaaggugggggaggagaagcgcaagcgggaggacagcaucacccccgagcgccggaaguccgagggcguccucgggaccagcgaggaggacgagcugaaguccugcuucuggaagcgccugggcuggagcgaguccagccggaucaucgugcucgaccaguccgaccugagcgacuga

SEQ ID NO: 37581 - RNA, 8370 nt, Artificial Sequence
  derived and/or modified sequence opt1 from TEX15__Homo_sapiens__NP_112561
augcccagcgacgccaaggacuccgugaacggcgaccugcuccugaacuggaccagccugaagaacauccucuccgggcugaacgccagcuucccgcugcacaacaacaccggcuccagcacggucaccaccuccaagagcaucaaggacccccgccucaugcggcgcgaggaguccaugggggagcagagcuccaccgcgggccugaacgaggugcugcaguucgagaagagcuccgacaacgugaacagcgagaucaaguccacgcccagcaacuccgccagcuccagcgaggucgugcccggggacugcgccgugcucaccaacggccuggacaccccgugcuucaagaccagcgucaacgacucccagagcugggcccacaacaugggcuccgaggacuacgacugcaucccccccaacaaggugacgauggccgggcagugcaaggaccagggcaacuucagcuuccccaucuccgugagcaacgucguguccgagguggagaaccagaaccacagcgaggagaaggcgcagcgggcccagcaggaguccgggaacgccuacaccaaggaguacagcucccacaucuuccaggacagccaguccagcgaccugaagaccaucuaccagaccggcugccagacguccaccgucuucccgcucaagaagaaggugagcaucgacgaguaccugcagaacaccgggaagaugaagaacuucgccgaccuggaggacuccagcaagcacgaggagaagcagaccuccuggaaggagaucgacaacgacuucacgaacgagaccaagaucagccccaucgacaacuacaucgugcuccaccaggaguacaaggagagcgagucccacaacagcuucggcaaguccugcgacaagauccugaucacccaggagcuggagaucaccaagagcuccacgagcaccaucaaggacaaggacgagcucgaccaccuggcgcuggaguggcagaucacccccuccuucgagagccucucccagaagcacccccagcacagcgucgaguacgagggcaacauccacaccucccuggccaucgcccagaagcugauggagcucaagcuggggaagaucaaccagaacuacgccagcaucaucacggaggccuucccgaagcccaaggacaucccccaggcgaaggagauguucaucgacaccgugaucuccagcuacaacaucgagaccgcccacgacuccagcaacugcuccaucacccgcgagcacaucugcgugcaccggaagaacgagaacgagcccgucagccuggagaacauccagcgcgacuacaaggagacggccuacguggaggaccggggccaggaccacaaccucuucugcaacagccagcuguccaacgacaucuggcugaacgugaacuucaagaagcagaccgaccgcgagaaccagaacgaggccaaggagaacagcgccuccugcgucgagaacaacaucgagaacaucuacggggacaagaagcaggacagccacaccaacgagaacuucuccaacaucgacgagaaggaggacaagaacuaccacaacaucgagauccucagcuccgaggaguucagcaccaaguucaaccugaucugccgggaggacaacgcgguguccgccgccacggcccugcucgagagcgaggaggacaccaucuccgccgugaagcagaaggacaccgagaacaccggccgcagcgucgagcaccuggcguccacgaccuucccgaagaccgccagcuccagcgugugcgucgccuccaacgccgccauccagaucgcgagcgccaccaugcccgcccugucccucaacaacgacgaccaccagaucuaccaguucaaggagaccugcagcagcgagucccccgacuucggccugcuggugaagcaccgggugagcgacugcgagaucgacacggacaagaacaagucccaggagagcuuccaccaguccaucaacgagaaccucguccugcagagcaucgagcuggaguccgagaucgagaucgagcucgaggacugcgacgacgccuucaucuuccagcaggacacccacagccacgagaacaugcugugcgaggaguucgugaccuccuacaaggcgcugaagagccgcaucuccugggaggggcuccuggcccuggacaacggcgagauggaggugcucgagagcaccacggggcgggagaacuccgaccagcacuacagcaaggaguccaacuacuucuacagcuccacccagaacaacgagaccgagcugaccagccccauccugcugccggaccuccagaucaagaucacgaacaucuuccgccccggcuucucccccaccgccgacagccuggcccugaaggacagcuucugcacccacgucaccgaggccacgaagcccgagaucaacaaggaggacggggagauccucggcuucgacaucuacucccagccguucggcgagaacgcggacuaccccugcgaggacaagguggacaacauccggcaggagagcgggcccguguccaacagcgagaucucccugagcuucgaccugucccgcaacaccgacgucaaccacaccagcgagaaccagaacuccgagagccucuucaccgagcccuccaacgugacgaccaucgacgacggcagccggugcuucuucaccaaguccaagaccgacuacaacgacacgaagaacaagaaggagguggagagccgcaucuccaagcggaagcugcacaucagcucccgcgaccagaacaucccgcacaaggaccugcggcgccacaagaucuacgggcgcaagcggcgccucaccagccaggacuccagcgagugcuucagcucccugagccagggccggaucaagaccuucucccagagcgagaagcacaucaaguccguccugaacauccucagcgacgaggccucccugugcaagagcaagugccugucccgcaagcucgacaaggccguggugcaccugaagaaggcccaccggcgcguccacaccagccugcagcucaucacgaaggugggggaggagcggaagggcccccugcccaaguccuacgccaucaucugcaacaacuucugggagagcugcgaccugcagggcuacuccagcgugucccagcgcaaguacuacagcaccaagcacuucuccagcaagcggaaguacgacaagcgccggaagaagcgcgcgccgaaggccgacaucuccaagagccucacccacgucagcaagcacaaguccuacaagaccagcggggagaagaagugccugucccggaagagcauggccuccagcguguccaagagccaccccacgaccucccacaugggcgaguucugcaaccaggagcaccccgagagccagcugcccguguccagcaccucccagagcaccucccagagcgucuacuacaacuccagcguguccaacccgagccucagcgaggagcaccagcccuucuccgggaagacggccuaccuguucagccccgaccacuccgacgagaagcugaucgagaaggagaaccagaucgacaccgccuuccucagcuccaccagcaaguacgagaagcuggagaagcacuccgcgaaccacaacgugaaggacgccaccaaggagaacagcugcgacgccaacgaggucaucaacgaguccaacagcgugucccugagcugcaucaaggagaacaucaacuccagcacgggcaacgacugcgacgccaccugcaucgggcacaccaaggcgaagaccgacgugcucaucuccguccuggacagcaacgugaagcacuuccugaacgaccucuaccagcagggcaaccugauccuguccgacugcaagcgcaaccucgaggugaaguggaccgaccccaucgagcggccgaagcagaacaucaucacgggcaacuuccugauggggccccugaaccucacccugaucgccagcaagaaguacagcaucccccagcuguccgccgccgccgucaccgacagcgagggcgaguccagcaaguccuaccucgacaagcagcgcauccugaccguggacagcuucgcggccuccagcacggugccccacugcgagcaguccugccgggagaaggagcugcucaagaccgagcagugcagcuccgggaacugccugcacaccgacggcaacgagaccaacgucacggagaacuacgagcuggacguggccagcggcaccgaggaggacaaguccuacggggagaacaucguggagcucagcuccagcgacuccagccugcugcucaaggacaacgucaagggcuccagcagcgagaccugcaucgugaagaaggacaccgaggaccgcaucacguggaaggugaagcaggccgagaaggccaaggacuccgucuacaagcggagcaugaccgagggguccaccgugaacaccgaguacaagaaccagaagaaccagaucagcgaggaguccugccugaacgagaagaucaucacgaccaaccugaucgacagccaccucuccaccaagaacaccacgaccgagagcgugccgcugaagaacaccgucuccaacccccugaacaagcgcgagaagaagggcgagaucaaggugagcaaggacucccagagcgaccucacccugcacuccgagaucgcguacaucagcaagcccgggauccugggcgugaaccacacgcccauccucccggcccacuccgagaccugcaagguccccacccugcugaagaagcccgccagcuacguguccgacuucaaggagaagcacugcagcgccaaccacaccgcccucaucgcgaaccugucccagauccugcagcgcgccgacgaggccagcagccuccagauccugcaggaggagacgaaggugugccugaacauccucccccuguucgucgaggccuucgagcggaagcaggagugcuccguggagcagauccugaucagccgcgagcuccugguggaccagaaccuguggaacaacugcaagcacacccucaagccgugcgcggucgacacccugguggagcugcagaugaugauggagaccauccaguucaucgagaacaagaagcggcaccucgagggcgagcccacgcugcgcucccugcucugguacgacgagacccuguacgccgagcugcucgggaagccccggggcuuccagcagcagagcaacuucuaccccggguuccagggccgccugaaguacaacgccuucugcgagcugcagaccuaccacgaccagcucgucgagcugcuggaggagaccaagcgggagaagaacuccuacuacguguuccucaaguacaagcgccaggugaacgagugcgaggccaucauggagcacugcagcgacugcuucgacuucucccugagcgucccguucacgugcggggugaacuucggcgacucccuggaggaccucgagauccugcggaagagcacccugaagcugaucaacgugugcggcgacucccccaagguccacagcuaccccgggaagcaggaccaccucuggaucaucaucgagaugaucuccagcaaggugaacuucaucaagaacaacgaggccgugcgcgucaagaucucccuguacggccuggagcacaucuucuucgacgcggccaagaaccucguguggaaggagcggacccagagcuucuccaagaaguacagccagaagaaggacgaggagcgccugcugcgggugaacaagugcgccuucuccaagcuccagaagaucuacgacacccugagcaaggaccugaacaacgagccgaucagccccaucgggcucgaggaggacaccaucaucgccucccgcaagagcgaccaccccaucaacgaggccacgaucuccaucgagaacagcaaguucaacuccaaccugcuggcgcaccccgacaucugcugcaucagcgagauccucgaccaggccgaguucgccgaccugaagaagcugcaggaccucacccugcggugcaccgaccaccuggagauccucaagaaguacuuccagaugcugcaggacaacaacauggacaacaucuucaucaccgaggagaacguccuggacguggugaucaaccacucccacgaggccaucauccucaagccggaggccaucgagauguacaucgagaucgucauggugagcgagacgauccacuuccugaagaacuccaucgcgaagaagcuggacaagcagcgcuuccggggcaugcucugguucgaccugagccugcuccccgagcuggugcagugccaggagaagauggccuccuucagcuuccugaaggacaacuccaccgacgucugccucuggaaggugaucgagaccgccgugagcgagcugaagaaggaccuggacaucaucugcaaguacaacgaggccgucaacugcuccuacgccauccaccuccugagccgcgagcugcaggagcucuccgagaucaagaagcugcugaagaagagcaaguacuucaucuccaccuacaucgacuucgugcccuacaucgcgagcaucaacuacgggagcacggugaccgagcucgaguacaacuacaaccaguucuccacccugcugaagaacgucaugagcgccccccggaaggaccucggcaagauggcccacauccgcaaggugaugaagaccaucgagcacaugaagaugaucugcacgaagaacgccgagcugaccaucuccuucuuccugugccagaugcucuacaaccggcgcaagauccugcagcugaagcgcaaggagaagaugaacauccacaucgugaagccgggcgagaacaacaacaaguucagcaucuccaccaugcucccccccgucagcgagugcaucaacaagaacaucuccaacagcuccaagaagcggcccagcaccguggacaagugcgaggacucccaggagcagcagcaggacacgaccgugagcuccugcaagaagcugaaggucgacaugaaggacgugaccaagaucaaccgcgagaaggcgaccuucaagcacccgcggacgaccgggagccaccccaaguccgagaacaagaucgugcccagcuccugcgacagccugaagcgcaaccaccucacccccaagaaggucgagaugcagcggucccugccgggcagccugcucccccuggagaaccccaaggacaccugcgccagcaaguccgagagcaagaucgaccugacgguguccagcgaccacuucuccgggcagcaggagaaccucaacagcaugaagaagcgcaacgugaacuucuccgccgccgagaccaagagcgacaagaaggacugcgccgcguucgccaucugcgaccagaaguccguccacggcaccuucagccccgaccacgggacccugcugcagaaguuccucaagaacuccccggaccccacgcagaagagcugccuguccgacaucaaccccgagaccgacgugagccuggugcccgacgccuccguccucagcaagccgaucuucugcuucgugaaggacgugcaccccgaccuggagaugaacgacaccgucuucgagcugcaggacaacgacaucgugaacuccagcaucaagaacagcuccugcaugaccagccccgagcccaucugcauccagaacaagaucccgacgcuccagaucaacaagcugcagcccaccgagaccgaguccgaggacaaguacaugaaggacacccugaaccccaacacggugcacaccuucggcgccagcggccacaucacccucaacgucaaccagggggccgaguacucccugagcgagcagcagaacgacaagaacuccaaggugcugaugcagaacgcggccaccuacuggaacgagcucccgcagagcgccugcaaccccacguacaacuccagcgagcaccuguucggcaccuccuaccccuacagcgccuggugcguguaccaguacuccaacagcaacgggaacgccaucacccagaccuaccagggcaucaccuccuacgagguccagcccagcccguccggccugcucacgaccguggcgagcaccgcccaggggacccacuccaaccugcuguacagccaguacuucacguacuucgccggcgagccccaggccaacggguucgugcccgucaacggcuacuuccagagccagauccccgcguccaacuuccggcagccgaucuucagccaguacgccucccaccagccccucccccaggccaccuaccccuaccugccgaaccgcuucgugccccccgagguccccuggguguacgccccguggcaccaggagagcuuccaccccgggcacuga

SEQ ID NO: 37582 - RNA, 942 nt, Artificial Sequence
  derived and/or modified sequence opt1 from TEX264__Homo_sapiens__NP_001230655
augagcgaccugcuccugcugggccucaucgggggccugacccugcuccugcugcucacccugcuggccuucgccggguacuccggccuccuggcggggguggaggucagcgccggcuccccgcccauccgcaacgugacgguggccuacaaguuccacaugggccuguacggggagaccggccgccucuucaccgagagcugcuccaucagccccaagcugcgguccaucgccgucuacuacgacaacccccacauggugcccccggacaagugccggugcgccguggggagcauccuguccgagggcgaggagagccccucccccgagcucaucgaccuguaccagaaguucggguucaaggucuucagcuuccccgcgccgucccacguggugaccgccacguuccccuacaccaccauccugagcaucuggcucgccacccgccggguccaccccgcccuggacacguacaucaaggagcgcaagcugugcgcguacccccggcucgagaucuaccaggaggaccagauccacuucaugugcccgcuggcccgccagggcgacuucuacgugcccgagaugaaggagaccgaguggaaguggcggggccugguggaggccaucgacacccaggucgacgggaccggcgccgacacgauguccgacaccagcuccgugagccucgaggugucccccgggagccgcgagaccagcgccgcgacccugucccccggcgccagcucccggggcugggacgacggggacacgcgcagcgagcacuccuacagcgaguccggcgccagcggguccagcuucgaggagcuggaccucgagggcgaggggccgcugggcgagucccggcuggaccccggcaccgagccccucgggaccaccaaguggcugugggagcccacggccccggagaagggcaaggaguga

SEQ ID NO: 37583 - RNA, 456 nt, Artificial Sequence
  derived and/or modified sequence opt1 from TEX29__Homo_sapiens__NP_689537
auggaguacgugcuggaggucaagaacagcccccgccaccuccugaagcaguucaccgugugcgacgugccgcuguacgacaucugcgacuacaacgucucccgggaccgcugccaggagcucggcugcugcuucuacgagggggugugcuacaagaaggccgugcccaucuacauccacgucuucagcgcccugaucgugaucaucgcgggcgccuucgugaucaccaucaucuaccgggucauccaggagucccgcaaggagaaggccauccccguggacguggcccugccccagaaguccagcgagaaggccgagcucgcgagcuccagcuccaagcuggggcugaagccggccagccccggcccgcccuccgccgggcccagcaugaaguccgacgaggacaaggacgacgucacgggcaccaucaccgaggccgaggagaccgaggacuga

SEQ ID NO: 37584 - RNA, 561 nt, Artificial Sequence
  derived and/or modified sequence opt1 from TEX30__Homo_sapiens__NP_001273705
augaaccugccccaccucaugagccuggccucccaccuggccagccacggcuucuucugccuccgcuucacgugcaaggggcugaacaucgugcaccggaucaaggcguacaaguccguccugaacuaccucaagaccagcggcgaguacaagcuggccgggguguuccugggcgggcgcuccaugggcagccgggccgccgccuccgugaugugccacaucgagccggacgacggcgacgacuucguccgcgggcucaucugcaucagcuacccccugcaccaccccaagcagcagcacaagcugcgggacgaggaccucuuccgccugaaggagcccgugcuguucguguccggcagcgcggacgagaugugcgagaagaaccuccuggagaaggucgcccagaagaugcaggccccgcacaagauccacuggaucgagaaggccaaccacuccauggcggugaaggggcggagcaccaacgacguguucaaggagaucaacacccagauccuguucuggauccaggagaucaccgagauggacaagaagugccacuga

SEQ ID NO: 37585 - RNA, 648 nt, Artificial Sequence
  derived and/or modified sequence opt1 from TEX35__Homo_sapiens__NP_001164193
augagcgccaagcgcgccgagcugaagaagacccaccucgugaaggagcggcacugcuggaccuccaagaacuacaaggcggucugccuggagcugaagcccgagccgacgaagaccuucgacuacaaggccgugaagcaggagggccgcuucaccaaggccggggugacccaggaccucaagaacgagcugcgggagguccgcgaggagcugaaggagaagauggaggagaucaagcagaucaaggaccucauggacaaggacuucgacaagcugcacgaguucguggagaucaugaaggagaugcagaaggacauggacgagaagauggacauccugaucaacacgcagaagaacuacaagcucccccugcggcgcgcccccaaggagcagcaggagcugcggcucaugggcaagacccaccgcgagccccagcugcggccgaagaagauggacggggccagcggcgugaacggggcgcccugcgcccugcacaagaagaccauggcgccccagaagaccaagcagggcucccucgacccccugcaccacugcggcacgugcugcgagaagugccugcucugcgcccugaagaacaacuacaaccgcgggaucuacgccgccgucggccugcucgaccugugguga

SEQ ID NO: 37586 - RNA, 603 nt, Artificial Sequence
  derived and/or modified sequence opt1 from TEX40__Homo_sapiens__NP_001034585
auggaggagaagcccagcaaggugucccucaagagcuccgaccgccagggcagcgacgaggaguccguccacagcgacacccgggaccuguggaccacgaccacccugucccaggcccagcugaacaugccgcucagcgaggugugcgagggguucgacgaggagggccgcaacaucuccaagacccggggguggcacagccccggccgcgggucccuggacgagggcuacaaggccagccacaagcccgaggagcuggacgagcacgcgcucguggagcuggagcugcaccggggcuccagcauggagaucaaccucggggagaaggacacggccucccagaucgaggccgagaaguccagcagcauguccagccugaacaucgccaagcacaugccccaccgcgccuacugggcggagcagcagagccggcugccgcucccccugauggagcugauggagaacgaggcccucgagauccugaccaaggcccugcgcuccuaccagcucggcaucgggcgggaccacuuccugaccaaggagcugcagcgcuacaucgagggccucaagaagcggcgcagcaagcggcuguacgucaacuga

SEQ ID NO: 37587 - RNA, 645 nt, Artificial Sequence
  derived and/or modified sequence opt1 from TFAM__Homo_sapiens__NP_001257711
auggccuuccugcgcagcauguggggcgugcucagcgcccuggggcggagcggcgcggagcugugcaccgggugcggcucccgccuccggagccccuucuccuucgucuaccugccgcgcugguucagcuccgugcuggccagcugccccaagaagcccguguccagcuaccuccgguucuccaaggagcagcugcccaucuucaaggcccagaacccggacgccaagaccacggagcugauccgccggaucgcccagcgcuggcgggagcuccccgacagcaagaagaagaucuaccaggacgcguaccgcgccgaguggcaggucuacaaggaggagaucucccgguucaaggagcagcugacccccagccagaucaugucccuggagaaggagaucauggacaagcaccucaagcgcaaggccaugaccaagaagaaggagaagcugaagaccgugaaggagaacuggaagaaccugagcgacuccgagaaggagcucuacauccagcacgccaaggaggacgagacgcgguaccacaacgagaugaaguccugggaggagcagaugaucgagguggggcgcaaggaccugcugcggcgcaccaucaagaagcagcggaaguacggcgcggaggagugcuga

SEQ ID NO: 37588 - RNA, 1296 nt, Artificial Sequence
  derived and/or modified sequence opt1 from TFAP2A__Homo_sapiens__NP_001027451
augcuggugcacagcuucuccgccauggaccgccacgacggcaccagcaacgggaccgcccggcucccccagcugggcacggucgggcaguccccguacaccagcgcgccgccccugucccacacccccaacgccgacuuccagccgcccuacuucccgccgcccuaccagcccaucuacccccagagccaggaccccuacucccacgugaacgaccccuacagccucaacccccugcacgcccagccccagccccagcaccccggcuggcccgggcagcgccagucccaggagagcggccugcuccacacccaccggggccugccccaccagcuguccgggcucgacccccgccgggacuaccgccggcacgaggaccugcugcacggcccgcacgcccucagcuccgggcugggcgaccugagcauccacucccucccccacgccaucgaggaggugccccacgucgaggaccccgggaucaacaucccggaccagacggugaucaagaagggccccgugagccuguccaagagcaacuccaacgcggucagcgccauccccaucaacaaggacaaccuguucggcgggguggugaaccccaacgaggucuucugcagcgugccgggccgccucucccugcugagcuccaccagcaaguacaaggugaccgucgccgaggugcagcggcgccucuccccgcccgagugccugaacgccagccugcucgggggcgugcugcggcgcgcgaaguccaagaacggcgggcggagccugcgcgagaagcucgacaagaucggccugaaccugcccgccgggcggcgcaaggccgccaacgucacccuccugacgucccugguggagggcgaggccgugcaccucgcgcgggacuucggguacgucugcgagaccgaguuccccgccaaggccguggccgaguuccugaaccgccagcacagcgaccccaacgagcaggucacccggaagaacaugcugcucgccaccaagcagaucugcaaggaguucacggaccugcuggcgcaggaccgcagcccccucggcaacucccggccgaaccccauccuggagcccggcauccaguccugccugacccacuucaaccucaucagccacggguucggcucccccgccgugugcgccgccgugaccgcccugcagaacuaccugaccgaggcgcucaaggccauggacaagauguaccugagcaacaacccgaacucccacacggacaacaacgccaagagcuccgacaaggaggagaagcaccgcaaguga

SEQ ID NO: 37589 - RNA, 1383 nt, Artificial Sequence
  derived and/or modified sequence opt1 from TFAP2B__Homo_sapiens__NP_003212
augcacagcccgccccgcgaccaggccgccaucaugcuguggaagcucguggagaacgucaaguacgaggacaucuacgaggaccggcacgacggcgugcccucccacagcucccgccugagccagcugggguccgugagccagggccccuacuccagcgcgcccccgcucucccacacccccagcuccgacuuccagccgcccuacuucccgccgcccuaccagccccugcccuaccaccagagccaggaccccuacucccacgucaacgaccccuacagccugaacccccuccaccagccccagcagcaccccugggggcagcggcagcgccaggaggugggcuccgaggccgggagccugcugccccagccccgggccgcccucccgcagcuguccggccuggacccccgccgggacuaccacagcgugcgccggcccgacguccuccugcacuccgcccaccacggccuggacgcggggaugggcgacagccucagccugcacgggcugggccaccccgggauggaggacgugcaguccguggaggacgccaacaacagcggcaugaaccuccuggaccaguccgucaucaagaaggugccggugccgcccaagagcgucaccucccugaugaugaacaaggacggcuuccucgggggcaugagcgugaacacgggggagguguucugcuccguccccggccgccugagccugcucuccagcaccuccaaguacaaggugaccgugggcgagguccagcggcgccugagcccgcccgagugccugaacgccucccuccucgggggcgugcugcggcgcgccaagagcaagaacgggggccggucccugcgcgagcggcuggagaagaucgggcugaaccuccccgcgggccgccggaaggccgccaacgugacccugcugacgagccucgucgagggcgaggccgugcaccuggcccgcgacuucggguacaucugcgagaccgaguuccccgcgaaggccguguccgaguaccugaaccggcagcacaccgaccccagcgaccuccacucccgcaagaacaugcugcuggccaccaagcagcucugcaaggaguucacggaccugcuggcccaggaccgcacccccaucggcaacagccggcccagcccgauccucgagcccgggauccaguccugccugacccacuucagccugaucacccacggcuucggggcccccgcgaucugcgccgcccucacggcccugcagaacuaccugaccgaggcccugaagggcauggacaagauguuccucaacaacaccaccacgaaccgccacaccuccggcgaggggcccggcagcaagaccggggacaaggaggagaagcaccggaaguga

SEQ ID NO: 37590 - RNA, 1353 nt, Artificial Sequence
  derived and/or modified sequence opt1 from TFAP2C__Homo_sapiens__NP_003213
augcuguggaagaucaccgacaacgugaaguacgaggaggacugcgaggaccgccacgacggcagcuccaacgggaacccccgggucccgcaccucagcuccgccggccagcaccuguacagccccgccccgccccugucccacaccgggguggcggaguaccagcccccgcccuacuucccgccgcccuaccagcagcucgccuacagccaguccgccgaccccuacagccaccugggcgaggccuacgccgcggccaucaacccccugcaccagcccgcccccacggggucccagcagcaggccuggcccggccgccagagccaggagggcgcggggcuccccucccaccacggccggcccgccgggcugcugccccaccucagcggccuggaggccggggccguguccgcccgccgggacgcguaccgccggagcgaccugcuccugccccacgcccacgcccuggacgccgccggccucgcggagaaccugggccugcacgacaugccccaccagauggacgagguccagaacguggacgaccagcaccuccugcugcacgaccagaccgugauccgcaaggggccgaucuccaugaccaagaacccccucaaccugcccugccagaaggagcuggucggcgccgugaugaaccccaccgagguguucugcagcgucccggggcggcucucccugcugagcuccacgagcaaguacaaggugaccguggccgagguccagcgccggcucagcccgcccgagugccugaacgccucccugcucggcggcgugcugcgccgggccaagagcaagaacgggggccgcucccugcgggagaagcucgacaagaucgggcugaaccugcccgcgggccgccggaaggccgcccacgugacccuccugaccagccuggucgagggggaggccgugcaccucgcccgcgacuucgcguacgugugcgaggccgaguuccccuccaagcccgucgccgaguaccugacgcggccccaccugggcggccgcaacgagauggccgcgcggaagaacaugcuccuggccgcccagcagcugugcaaggaguucaccgagcuccugagccaggaccgcaccccgcacgggaccucccgccuggcccccgugcucgagacgaacauccagaacugccugagccacuucucccugaucacccacggcuucgggagccaggccaucugcgcggccguguccgcccugcagaacuacaucaaggaggcccucaucgucaucgacaagagcuacaugaaccccggcgaccagucccccgccgacagcaacaagacccuggagaagauggagaagcaccggaaguga

SEQ ID NO: 37591 - RNA, 1017 nt, Artificial Sequence
  derived and/or modified sequence opt1 from TFAP4__Homo_sapiens__NP_003214
auggaguacuucauggugcccacccagaagguccccagccugcagcacuuccgcaagaccgagaaggaggugaucggcgggcucugcucccuggccaacaucccccugacgcccgagacccagcgggaccaggagcgccggauccgccgggagaucgccaacagcaacgagcgccggcgcaugcaguccaucaacgcgggcuuccagagccucaagacccugaucccccacaccgacggggagaagcuguccaaggccgccauccuccagcagacggccgaguacaucuucagccuggagcaggagaagacccggcugcuccagcagaacacccagcugaagcgcuucauccaggagcuguccggcagcuccccgaagcggcgccgggccgaggacaaggacgaggggaucggcagccccgacaucugggaggacgagaaggcggaggaccuccgccgggagaugaucgagcugcgccagcagcuggacaaggagcgguccgugcgcaugaugcucgaggagcagguccggagccuggaggcccacauguaccccgagaagcugaaggugaucgcccagcagguccagcuccagcagcagcaggagcagguccgccugcugcaccaggagaagcucgagcgggagcagcagcagcugcgcacccagcugcugcccccgcccgcccccacgcaccaccccaccgugaucgugccggcgcccccgccgccgcccucccaccacaucaacguggugaccaugggccccagcuccgugaucaacagcgucuccaccagccgccagaaccucgacacgaucgugcaggccauccagcacaucgaggggacccaggagaagcaggagcuggaggaggagcagcggcgcgccgugaucgucaagcccgugcgguccugccccgaggcccccaccagcgacaccgccagcgacuccgaggcgagcgacuccgacgccauggaccagagccgcgaggagcccuccggcgacggggagcuccccuga

SEQ ID NO: 37592 - RNA, 1041 nt, Artificial Sequence
  derived and/or modified sequence opt1 from TFB1M__Homo_sapiens__NP_057104
auggccgccagcggcaagcuguccacgugccgccugcccccgcuccccaccauccgggagaucaucaagcugcuccgccugcaggcggccaagcagcugagccagaacuuccuccuggaccugcggcucaccgacaagaucgugcgcaaggccgggaaccugaccaacgccuacgucuacgaggugggccccgggcccggcgggaucacccgguccauccugaacgccgacguggcggagcuccuggucguggagaaggacacccgcuucaucccgggccugcagaugcucagcgacgccgcccccggcaagcugcggaucgugcacggggacguccugacguucaagguggagaaggccuucuccgagagccucaagcgccccugggaggacgacccgcccaacgugcacaucaucggcaaccugcccuucuccgucagcacgccccugaucaucaaguggcucgagaacaucuccugccgggacgggcccuucguguacggccgcacccagaugacccugaccuuccagaaggagguggcggagcggcuggccgccaacaccgggagcaagcagcgcucccggcucagcgucauggcccaguaccugugcaacgugcgccacaucuucaccaucccgggccaggccuucgugcccaagcccgaggucgacgugggcgugguccacuucacgccccugauccagccgaagaucgagcagcccuucaagcucguggagaaggugguccagaacguguuccaguuccggcgcaaguacugccaccgggggcugcgcaugcuguuccccgaggcgcagcggcucgaguccaccggccgccugcuggagcucgccgacaucgaccccacccugcggccgcgccagcugagcaucucccacuucaagagccucugcgacguguaccgcaagaugugcgacgaggacccccagcuguucgccuacaacuuccgggaggagcugaagcgccggaaguccaagaacgaggagaaggaggaggacgacgccgagaacuaccgccucuga

SEQ ID NO: 37593 - RNA, 1191 nt, Artificial Sequence
  derived and/or modified sequence opt1 from TFB2M__Homo_sapiens__NP_071761
auguggauccccguggucggccugccgcgccggcuccgccugagcgcccuggccggggcgggccgguucugcauccucggguccgaggccgccacccgcaagcaccuccccgcccggaaccacugcggccugagcgacuccagcccccagcuguggcccgagccggacuuccgcaacccgccccggaaggccuccaaggcgagccuggacuucaagcgcuacgugaccgaccggcgccuggccgagacgcucgcccagaucuaccuggggaagcccucccggccgccccaccuccugcuggagugcaaccccggccccggcauccugacccaggcccuccuggaggcgggggccaagguggucgcccuggagagcgacaagaccuucaucccccaccucgagucccugggcaagaaccuggacgggaagcuccgcgugauccacugcgacuucuucaagcuggacccccggagcggcggggugaucaagccgcccgccauguccagccgcggccuguucaagaaccucggcaucgaggccguccccuggaccgcggacaucccccugaaggugguggggauguuccccucccggggcgagaagcgcgcccuguggaagcucgccuacgaccuguacagcugcacguccaucuacaaguucgggcggaucgaggucaacauguucaucggcgagaaggaguuccagaagcugauggccgaccccggcaacccggaccucuaccacgugcugagcgugaucuggcagcuggccugcgagaucaagguccuccacauggagcccugguccagcuucgacaucuacacccgcaaggggccccuggagaaccccaagcggcgcgagcugcucgaccagcugcagcagaagcuguaccucauccagaugaucccgcggcagaaccuguucaccaagaaccugacccccaugaacuacaacaucuucuuccaccuccugaagcacugcuucggccgccgcuccgcgacggugaucgaccaccuccggagccugacgccccuggacgcccgcgacauccugaugcagaucgggaagcaggaggacgagaagguggucaacaugcacccccaggacuucaagacccucuucgagaccaucgagcggagcaaggacugcgccuacaaguggcuguacgacgagacccuggaggaccgcuga

SEQ ID NO: 37594 - RNA, 1353 nt, Artificial Sequence
  derived and/or modified sequence opt1 from TFCP2__Homo_sapiens__NP_001166924
auggccugggcccugaagcucccccuggcggacgaggugaucgagagcggccugguccaggacuucgacgccucccucagcgggaucggccaggagcugggggccggcgccuacuccaugagcgacgugcuggcccucccgaucuucaagcaggaggaguccagccugccgcccgacaacgagaacaagauccugcccuuccaguacgugcucugcgcggccaccucccccgccgucaagcugcacgacgagacccugacguaccucaaccaggggcagagcuacgagauccgcaugcuggacaaccggaagcugggcgagcuccccgagaucaacggcaagcuggugaaguccaucuuccgcguggucuuccacgaccggcgccugcaguacaccgagcaccagcagcucgagggguggcgguggaaccgccccggcgaccggauccuggacaucgacauccccaugagcguggggaucaucgacccgcgcgccaaccccacccagcugaacaccguggaguuccucugggaccccgcgaagcggacguccgucuucauccagcccaagggcgccgaccgcaagcagaagaccgaccgggagaagauggagaagcgcaccccgcacgagaaggagaaguaccagcccagcuacgagaccacgauccugaccgagugcucccccuggcccgagaucaccuacgugaacaacagcccgucccccggguucaacagcucccacagcuccuucagccugggcgagggcaacgggagccccaaccaccagcccgagccgcccccgcccgugaccgacaaccuccugcccacgaccacgccccaggaggcccagcaguggcugcaccggaaccgcuucuccaccuucacccgccucuucaccaacuucagcggcgccgaccugcugaagcucacccgggacgacgucauccagaucugcgggcccgccgacggcauccggcuguucaacgcgcugaagggccgcauggugcggccccgccucaccaucuacgugugccaggagucccugcagcugcgggagcagcagcagcagcagcagcagcagcagcagaagcacgaggacggggacagcaacggcacguucuucgucuaccacgccaucuaccucgaggagcugaccgccguggagcugaccgagaagaucgcccagcuguucuccaucagcccgugccagaucucccagaucuacaagcaggggcccaccggcauccacgugcucaucagcgacgagaugauccagaacuuccaggaggaggccugcuucauccuggacacgaugaaggagaccaacgacuccuaccacaucauccucaaguga

SEQ ID NO: 37595 - RNA, 1233 nt, Artificial Sequence
  derived and/or modified sequence opt1 from TFDP1__Homo_sapiens__XP_005268384
auggccaaggacgccggccugaucgaggcgaacggggagcucaagguguucaucgaccagaaccugagccccggcaagggggucgugucccugguggccguccacccgagcaccgugaacccccucggcaagcagcugcugcccaagaccuucgggcaguccaacgugaacaucgcccagcaggucgugaucggcacgccccagcgcccggccgccagcaacacccucguggucggcagcccccacacccccuccacccacuucgcgucccagaaccagcccagcgacuccagcccgugguccgccgggaagcggaaccgcaagggcgagaagaacgggaagggccugcggcacuucagcaugaaggugugcgagaaggugcagcgcaaggggacgaccuccuacaacgaggucgccgacgagcugguggccgaguucagcgcggccgacaaccacauccuccccaacgaguccgccuacgaccagaagaacauccggcgccggguguacgacgcccugaacguccugauggccaugaacaucaucagcaaggagaagaaggagaucaaguggaucggccuccccaccaacuccgcgcaggagugccagaaccuggagguggagcgccagcggcgccuggagcggaucaagcagaagcagagccagcuccaggagcugauccugcagcagaucgccuucaagaaccucgugcagcgcaaccggcacgccgagcagcaggccucccggcccccgccgcccaacagcgucauccaccuccccuucaucaucgugaacaccagcaagaagacggugaucgacugcuccaucagcaacgacaaguucgaguaccuguucaacuucgacaacaccuucgagauccacgacgacaucgagguccugaagcgcaugggcauggccugcgggcuggaguccggcagcugcuccgcggaggaccugaagauggcccgcagccucgugcccaaggcccuggagcccuacgugaccgagauggcccaggggaccgucggcggcguguucaucacgaccgccggguccaccagcaacggcacccgguucuccgcgagcgaccugacgaacggggccgacggcaugcucgccaccuccagcaacgggucccaguacagcggcucccgcgucgagacccccgugagcuacgugggcgaggacgacgaggaggacgacgacuucaacgagaacgacgaggacgacuga

SEQ ID NO: 37596 - RNA, 1161 nt, Artificial Sequence
  derived and/or modified sequence opt1 from TFDP2__Homo_sapiens__NP_001171609
augaucaucagcacgccccagcgccugaccuccagcggcuccgugcucaucgggagcccguacacccccgcccccgccauggucacccagacccacaucgcggaggccaccggcugggugcccggggaccggaagcgcgcccggaaguucaucgacuccgacuucagcgaguccaagcgcagcaagaagggcgacaagaacgggaagggccugcggcacuucuccaugaaggugugcgagaagguccagcgcaagggcacgaccagcuacaacgagguggccgacgagcugguguccgaguucaccaacagcaacaaccaccucgccgcggacucccaggccuacgaccagaagaacauccggcgccgggucuacgacgcccugaacgugcugauggccaugaacaucaucagcaaggagaagaaggagaucaaguggaucgggcucccgaccaacuccgcgcaggagugccagaaccuggagaucgagaagcagcgccggaucgagcgcaucaagcagaagcgggcccagcugcaggagcuccugcugcagcagaucgccuucaagaaccucgugcagcgcaaccggcagaacgagcagcagaaccagggcccgcccgcccugaacagcacgauccagcugcccuucaucaucaucaacaccucccgcaagaccgucaucgacugcagcaucuccagcgacaaguucgaguaccucuucaacuucgacaacaccuucgagauccacgacgacaucgaggugcugaagcggauggggaugagcuucggccuggaguccgggaagugcagccucgaggaccugaagcuggccaagucccucgugcccaaggcgcuggagggcuacaucacggacaucagcaccggccccuccuggcugaaccaggggcuccugcugaacagcacccaguccgucagcaaccucgaccugaccacgggcgccacccugccccaguccagcgugaaccaggggcucugccuggacgccgagguggcccuggccaccggccaguuccucgcgcccaacucccaccagagcuccagcgccgccucccacugcagcgagucccgcggcgagaccccgugcagcuucaacgacgaggacgaggaggacgacgaggaggacuccagcagccccgaguga

SEQ ID NO: 37597 - RNA, 1218 nt, Artificial Sequence
  derived and/or modified sequence opt1 from TFDP3__Homo_sapiens__NP_057605
auggccaaguacgugagccugaccgaggccaacgaggagcucaagguccugauggacgagaaccagaccucccgccccguggcggugcacacgagcaccgucaacccgcugggcaagcagcuccugcccaagaccuucgggcaguccagcgugaacaucgaccagcaggucgugaucggcaugccccagcggcccgccgccuccaacaucccggugguggggagccccaacccgcccuccacccacuucgccagccagaaccagcacuccuacagcuccccgcccugggccggccagcacaaccgcaagggggagaagaacggcaugggccugugccggcucagcaugaaggucugggagacggugcagcgcaaggggaccaccuccugccaggagguggucggcgagcugguggcgaaguuccgggccgccagcaaccacgccucccccaacgagagcgcguacgacgugaagaacaucaagcgccggaccuacgacgcccugaacguccucauggccaugaacaucaucucccgcgagaagaagaagaucaaguggaucgggcugacgaccaacagcgcccagaacugccagaaccugcggguggagcgccagaagcggcucgagcgcaucaagcagaagcaguccgagcugcagcagcugauccuccagcagaucgccuucaagaaccuggugcugcggaaccaguacgucgaggagcaggucagccagcgcccccuccccaacagcgugauccacgugcccuucaucaucaucuccagcuccaagaagaccgugaucaacugcagcaucuccgacgacaagagcgaguaccuguucaaguucaacuccagcuucgagauccacgacgacaccgaggugcugauguggaugggcaugacguucgggcucgaguccggcagcugcuccgcggaggaccugaagauggcccggaaccugguccccaaggcccucgagcccuacgugaccgagauggcccagggcaccuucgggggcgucuucaccacggccgggagccgcuccaacggcaccuggcugagcgcguccgaccugaccaacaucgccaucggcaugcucgccaccagcuccgggggcagccaguacuccgggagccggguggagacgccggccguggaggaggaggaggaggaggacaacaacgacgacgaccugagcgagaacgacgaggacgacuga

SEQ ID NO: 37598 - RNA, 1728 nt, Artificial Sequence
  derived and/or modified sequence opt1 from TFE3__Homo_sapiens__NP_006512
augagccacgccgccgagcccgcgcgcgacggcguggaggccuccgccgaggggccgcgggccgucuucgugcugcucgaggagcgccggcccgccgacagcgcgcagcugcugucccucaacagccugcugcccgaguccggcaucguggccgacaucgagcucgagaacguccuggaccccgacagcuucuacgagcugaagucccagccgcucccccugcgcagcucccugcccaucagccuccaggccacccccgccaccccggcgacgcuguccgccagcuccagcgccgggggcucccggacccccgccaugagcuccagcuccagcagccgcgugcugcuccggcagcagcugaugcgcgcccaggcgcaggagcaggagcggcgcgagcggcgcgagcaggccgccgccgcccccuuccccuccccggcgcccgccagccccgccaucuccguggucggggugagcgccggcggccacacccugucccggcccccgcccgcccaggugccccgcgagguccucaaggugcagacccaccuggagaaccccacgcgguaccaccuccagcaggcgcgccggcagcaggucaagcaguaccugagcaccacccuggggccgaagcuggccucccaggcccucaccccgccgcccggccccgccagcgcccagccccugcccgcgcccgaggccgcccacacgaccgggcccaccggcuccgcccccaacagccccauggcgcugcucaccaucggguccagcuccgagaaggagaucgacgacgugaucgacgagaucaucagccuggaguccagcuacaacgacgagaugcuguccuaccucccgggcggcacgaccgggcugcagcugcccagcacccuccccguguccggcaaccugcuggacguguacagcagccagggggucgccacccccgccaucacgguguccaacagcugcccggccgagcuccccaacaucaagcgcgagaucuccgagaccgaggccaaggcgcugcugaaggagcggcagaagaaggacaaccacaaccucaucgagcgccggcgccgcuucaacaucaacgaccggaucaaggagcugggcacccugauccccaagagcuccgaccccgagaugcgcuggaacaagggcaccauccucaaggccagcguggacuacauccggaagcugcagaaggagcagcagcgcuccaaggaccuggagagccggcagcgcucccucgagcaggccaaccggagccugcagcugcgcauccaggagcucgagcugcaggcccagauccacgggcugccggucccgcccacgcccggccugcucucccuggccaccaccagcgcguccgacagccugaagcccgagcagcucgacaucgaggaggaggggcggcccggcgccgccaccuuccacgugggcgggggccccgcccagaacgcgccccaccagcagccgcccgccccgcccuccgacgcccugcuggaccuccacuuccccagcgaccaccugggggaccugggcgaccccuuccaccucgggcuggaggacauccugauggaggaggaggagggcguggucgggggccucuccggcggggcccugagcccccugcgcgccgcgagcgacccccuccuguccagcguguccccggccgugagcaaggccuccagccggcgcuccagcuucuccauggaggaggagagcuga

SEQ ID NO: 37599 - RNA, 1473 nt, Artificial Sequence
  derived and/or modified sequence opt1 from TFEB__Homo_sapiens__NP_001161299
augaccgccagcuccggcugggagcccgccccggcggccaccauggccagccgcaucgggcugcggaugcagcucaugcgcgagcaggcccagcaggaggagcagcgggagcgcaugcagcagcaggccgugaugcacuacaugcagcagcagcagcagcagcagcagcagcagcugggcgggccgcccacgcccgcgaucaacacccccguccacuuccaguccccgccgcccgugcccggcgaggugcugaagguccagagcuaccucgagaaccccaccuccuaccaccuccagcagagccagcaccagaaggugcgggaguaccuguccgagaccuacgggaacaaguucgccgcccacaucagccccgcccagggcucccccaagcccccgcccgcggccagccccggcgugcgcgccgggcacguccuguccagcuccgccggcaacagcgcccccaacucccccauggcgaugcugcacaucgggagcaaccccgagcgggagcuggacgacgugaucgacaacaucaugcgccucgacgacgugcugggcuacaucaaccccgagaugcagaugccgaacacgcugccccucuccagcucccaccugaacgucuacagcagcgacccccaggugaccgccucccuggugggggucaccagcuccagcugccccgccgaccucacccagaagcgggagcugacggacgccgagucccgcgcccuggcgaaggagcggcagaagaaggacaaccacaaccucaucgagcgccggcgccgguucaacaucaacgaccgcaucaaggagcugggcaugcugaucccgaaggccaacgaccucgacgugcgguggaacaagggcaccauccugaaggccagcguggacuacauccgccggaugcagaaggaccugcagaagucccgcgagcucgagaaccacagccggcgccuggagaugaccaacaagcagcuguggcuccgcauccaggagcuggagaugcaggcccggguccacgggcugcccaccacgucccccagcggcaugaacauggccgagcucgcgcagcaggucgugaagcaggagcugcccuccgaggaggggccgggcgaggcccugaugcucggcgccgaggugcccgaccccgagccgcugcccgcccugccgccccaggcgccccucccccugcccacccagcccccgagccccuuccaccaccuggacuucucccacagccucuccuucgggggccgcgaggacgaggggccgcccggcuaccccgagccccuggcccccgggcacggcagccccuucccgucccugagcaagaaggaccucgaccugaugcugcucgacgacucccugcugccccucgccagcgacccccugcugagcaccaugucccccgaggccagcaaggccuccagccggcgcuccagcuucuccauggaggagggcgacgugcuguga

SEQ ID NO: 37600 - RNA, 957 nt, Artificial Sequence
  derived and/or modified sequence opt1 from TFEC__Homo_sapiens__NP_001018068
augacccuggaccaccagaucaucaaccccacccucaaguggagccagccggccgugcccuccggcgggccccugguccagcacgcccacacgacccuggacagcgacgcgggccucaccgagaacccccugaccaagcugcucgccaucgggaaggaggacgacaacgcccaguggcaccuguccggcagcauccuggacguguacuccggggagcagggcaucagcccgaucaacaugggccucacguccgccagcugccccuccagccugcccaugaagcgcgagaucaccgagaccgacacccgggcccuggcgaaggagcgccagaagaaggacaaccacaaccucaucgagcggcgccggcgcuacaacaucaacuaccggaucaaggagcuggggacgcugauccccaaguccaacgacccggacaugcgcuggaacaagggcaccauccucaaggccagcguggaguacaucaaguggcugcagaaggagcagcagcgggcccgcgagcuggagcaccggcagaagaagcucgagcaggccaaccgccggcugcugcuccgcauccaggagcuggagauccaggcgcggacccacgggcugcccacccucgccucccugggcacggucgaccugggggcccacgugaccaagcagcagagccaccccgagcagaacuccguggacuacugccagcagcucaccgucagccagggccccuccccggagcugugcgaccaggccaucgccuucagcgacccccuguccuacuucaccgaccucagcuucagcgcggcccugaaggaggagcagcgccuggacggcaugcuccuggacgacacgaucucccccuucgggaccgacccccugcucagcgccaccuccccggccgugagcaaggaguccagccggcgcuccagcuucuccagcgacgacggcgacgagcuguga

SEQ ID NO: 37601 - RNA, 255 nt, Artificial Sequence
  derived and/or modified sequence opt1 from TFF1__Homo_sapiens__NP_003216
auggccaccauggagaacaaggugaucugcgcccugguccucgugagcaugcuggcccugggcacccucgccgaggcccagacggagaccugcaccguggcgccccgcgagcggcagaacugcggguucccgggcgucacccccucccagugcgccaacaaggggugcugcuucgacgacacggugcgcggcgugcccuggugcuucuaccccaacaccaucgacgucccgcccgaggaggagugcgaguucuga

SEQ ID NO: 37602 - RNA, 390 nt, Artificial Sequence
  derived and/or modified sequence opt1 from TFF2__Homo_sapiens__NP_005414
augggccgccgggacgcccagcugcucgccgcgcugcuggugcucgggcugugcgcccuggccggcagcgagaagcccuccccgugccagugcagccgccucagcccccacaaccggaccaacugcggguuccccggcaucaccuccgaccagugcuucgacaacgggugcugcuucgacuccagcgucacgggcgugcccuggugcuuccacccgcugcccaagcaggaguccgaccagugcgugauggaggucagcgaccgccggaacugcggcuaccccgggaucucccccgaggagugcgccagccgcaagugcugcuucuccaacuucaucuucgaggugccguggugcuucuuccccaagagcguggaggacugccacuacuga

SEQ ID NO: 37603 - RNA, 285 nt, Artificial Sequence
  derived and/or modified sequence opt1 from TFF3__Homo_sapiens__NP_003217
augaagcgcgugcugagcugcguccccgagccgaccguggugauggccgcccgggcgcucugcaugcugggccugguccucgcccugcuguccagcuccagcgccgaggaguacguggggcucuccgccaaccagugcgccgugcccgcgaaggaccgcgucgacugcggcuacccccacgugacccccaaggagugcaacaaccgggggugcugcuucgacagccgcaucccgggcgugcccuggugcuucaagccccugcaggaggccgagugcacguucuga

SEQ ID NO: 37604 - RNA, 1203 nt, Artificial Sequence
  derived and/or modified sequence opt1 from TFG__Homo_sapiens__NP_001007566
augaacggccagcuggaccucagcgggaagcugaucaucaaggcccagcugggcgaggacauccgccggauccccauccacaacgaggacaucaccuacgacgagcucgugcugaugaugcagcgcgucuuccgggggaagcugcucuccaacgacgaggugaccaucaaguacaaggacgaggacggcgaccugaucacgaucuucgacagcuccgaccugagcuucgccauccagugcucccgcauccucaagcugacccuguucgugaacgggcagccgcggccccucgagagcucccaggucaaguaccugcgccgggagcugaucgagcuccgcaacaaggugaaccggcugcuggacagccucgagccgcccggcgagcccggccccuccaccaacauccccgagaacgacaccguggacgggcgcgaggagaaguccgcgagcgacagcuccggcaagcagagcacgcaggucauggccgccuccaugagcgccuucgacccccugaagaaccaggacgagaucaacaagaacgugauguccgccuucgggcugaccgacgaccaggugagcggcccgcccuccgcgcccgccgaggaccggagcgggacccccgacagcaucgccuccagcuccagcgccgcgcacccgcccggcguccagccccagcagcccccguacaccggcgcccagacgcaggccgggcagaucgagggccagauguaccagcaguaccagcagcaggccggguacggcgcccagcagccccaggcgccgccccagcagccccagcaguacggcauccaguacuccgccagcuacucccagcagaccgggccccagcagccccagcaguuccagggcuacgggcagcagcccaccagccaggccccggcccccgccuucuccggccagccccagcagcuccccgcgcagccgccccagcaguaccaggccagcaacuaccccgcccagaccuacacggcccagaccucccagccgaccaacuacaccguggcccccgcgagccagcccgggauggcccccucccagccgggcgccuaccagccccgccccggcuucacgagccugcccggguccaccaugaccccgccgcccagcggccccaaccccuacgcccggaaccgcccgcccuucgggcagggcuacacccagcccgggcccggcuaccgguga

SEQ ID NO: 37605 - RNA, 2097 nt, Artificial Sequence
  derived and/or modified sequence opt1 from TF__Homo_sapiens__XP_011511402
augcgccuggccgugggcgcccuccuggucugcgcggugcuggggcucugccuggccgugcccgacaagaccguccgguggugcgccgugagcgagcacgaggccaccaagugccaguccuuccgcgaccacaugaaguccgugaucccguccgacggccccagcgucgccugcgugaagaaggcguccuaccuggacugcauccgggccaucgccgccaacgaggcggacgccgugacgcucgacgccgggcuggucuacgacgccuaccuggcccccaacaaccucaagcccgugguggcggaguucuacggcagcaaggaggacccgcagaccuucuacuacgccgucgccguggugaagaaggacuccggguuccagaugaaccagcugcgcggcaagaaguccugccacaccggccuggggcggagcgccggcuggaacauccccaucgggcuccuguacugcgaccugcccgagccccgcaagccgcucgagaaggccgucgcgaacuucuucagcggcuccugcgcccccugcgccgacgggaccgacuucccccagcugugccagcugugccccggcugcggcugcagcacgcucaaccaguacuucggguacuccggcgccuucaagugccugaaggacggggccggcgacguggcguucgugaagcacagcaccaucuucgagaaccuggccaacaaggccgaccgggaccaguacgagcuccugugccuggacaacacccgcaagccggucgacgaguacaaggacugccaccucgcccaggugcccucccacaccguggucgcccggagcaugggcgggaaggaggaccugaucugggagcugcucaaccaggcgcaggagcacuucggcaaggacaaguccaaggaguuccagcuguucagcagcccccacgggaaggaccuccuguucaaggacagcgcccacggcuuccugaaggugcccccgcgcauggacgccaagauguaccugggguacgaguacgugacggccauccggaaccuccgcgaggggaccugccccgaggcgcccaccgacgagugcaagcccgucaaguggugcgcccugagccaccacgagcggcugaagugcgacgagugguccgugaacagcgucggcaagaucgagugcguguccgccgagaccacggaggacugcaucgccaagaucaugaacggcgaggccgacgcgaugagccucgacggcggguucguguacaucgccggcaagugcgggcuggucccggugcuggccgagaacuacaacaaguccgacaacugcgaggacacccccgaggccggcuacuucgccaucgcgguggucaagaaguccgccagcgaccucaccugggacaaccugaagggcaagaaguccugccacaccgccguggggcgcacggccggcuggaacauccccauggggcugcucuacaacaagaucaaccacugccgguucgacgaguucuucagcgagggcugcgcccccgggagcaagaaggacuccagccugugcaagcugugcaugggcuccggccucaaccugugcgagccgaacaacaaggagggguacuacggcuacaccggggcguuccgcugccugguggagaagggcgacgucgccuucgugaagcaccagaccgugccccagaacaccggcgggaagaaccccgaccccugggccaagaaccucaacgagaaggacuacgagcugcugugccuggacggcacgcggaagccggucgaggaguacgccaacugccaccucgcgcgcgcccccaaccacgccguggugacccggaaggacaaggaggccugcguccacaagauccugcgccagcagcagcaccuguucgggagcaacgugaccgacugcuccggcaacuucugccucuuccggagcgagaccaaggaccugcuguuccgcgacgacacggugugccucgccaagcugcacgaccgcaacaccuacgagaaguaccugggggaggaguacgucaaggcggugggcaaccuccggaagugcuccaccagcucccugcuggaggccugcaccuuccgccggcccuga

SEQ ID NO: 37606 - RNA, 2514 nt, Artificial Sequence
  derived and/or modified sequence opt1 from TFIP11__Homo_sapiens__XP_011528381
augagccugucccaccucuaccgcgacggcgaggggcggaucgacgacgacgacgacgagcgcgagaacuucgagaucaccgacugggaccugcagaacgaguucaaccccaaccggcagcgccacuggcagaccaaggaggaggccacguacggcgugugggccgagcgggacagcgacgacgagcgcccguccuucgggggcaagcgggcgcgcgacuacagcgcccccgucaacuucaucuccgccgggcugaagaagggcgccgccgaggaggcggagcucgaggacagcgacgacgaggagaagcccgugaagcaggacgacuuccccaaggacuucggcccgcggaagcugaagaccgggggcaacuucaagcccucccagaagggguucgccggcgggaccaagagcuucauggacuucggcuccugggagcgccacaccaagggcaucgggcagaagcugcuccagaagaugggcuacgugcccgggcggggccugggcaagaacgcccaggggaucaucaaccccaucgaggccaagcagcgcaagggcaagggggcggucggcgccuacgggagcgagcggacgacccaguccaugcaggacuucccggugguggacagcgaggaggaggccgaggaggaguuccagaaggagcugucccaguggcgcaaggaccccagcggcuccaagaagaagcccaaguacagcuacaagaccgucgaggagcucaaggccaagggccggaucuccaagaagcugaccgcgccccagaaggagcugagccaggugaaggugaucgacaugacggggcgcgagcagaaggucuacuacuccuacagccagaucagccacaagcacaacgugccggacgacggccucccccugcagucccagcagcugccccagagcgggaaggaggccaaggcccccggcuucgcccucccggagcuggagcacaaccugcagcuccugaucgaccugaccgagcaggagaucauccagaacgaccggcagcuccaguacgagcgcgacaugguggucaaccuguuccacgagcuggagaagaugaccgaggugcucgaccacgaggagcgggugaucuccaaccugagcaagguccuggagaugguggaggagugcgagcgccggaugcagcccgacugcuccaacccccucacccuggacgagugcgcccgcaucuucgagacgcugcaggacaaguacuacgaggaguaccgcaugagcgaccggguggaccucgccgucgcgaucguguacccccugaugaaggaguacuucaaggagugggacccgcugaaggacugcaccuacgggaccgagaucaucuccaaguggaagucccuccuggagaacgaccagcugcucagccacggcggccaggaccugagcgccgacgccuuccaccgccugaucugggagguguggaugcccuucguccggaacaucgugacccaguggcagccccgcaacugcgaccccaugguggacuuccucgacuccuggguccacaucaucccgguguggauccuggacaacauccuggaccagcucaucuuccccaagcugcagaaggaggucgagaacuggaacccccugacggacaccgugcccauccacagcuggauccacccguggcucccccugaugcaggcccggcuggagccccucuacuccccgauccgcagcaagcuguccagcgcccugcagaaguggcaccccuccgacagcuccgcgaagcugauccuccagcccuggaaggacguguucacccccgggagcugggaggccuucauggucaagaacaucgugccgaagcugggcaugugccugggggagcucgugaucaacccccaccagcagcacauggacgccuucuacugggucaucgacugggagggcaugaucagcguguccagccugguggggcugcucgagaagcacuucuuccccaaguggcugcagguccugugcuccuggcucagcaacucccccaacuacgaggagaucaccaagugguaccugggcuggaaguccauguucagcgaccaggugcuggcccacccgagcgugaaggacaaguucaacgaggcccucgacaucaugaaccgggcggucuccagcaacgugggcgccuacaugcagcccggggcccgcgagaacaucgccuaccugacgcacaccgagcggcgcaaggacuuccaguacgaggcgaugcaggagcggcgcgaggccgagaacauggcccagcggggcaucgggguggccgccuccagcguccccaugaacuucaaggaccugaucgagaccaaggcggaggagcacaacaucguguucaugcccgugaucggcaagcgccacgagggcaagcagcucuacaccuucgggcggaucgucaucuacaucgaccgcggcgugguguucguccagggggagaagacgugggugccgaccucccugcagagccugaucgacauggccaaguga

SEQ ID NO: 37607 - RNA, 561 nt, Artificial Sequence
  derived and/or modified sequence opt1 from TFPI2__Homo_sapiens__NP_001257933
auggaccccgcccgcccgcugggccucagcauccugcugcuguuccugaccgaggccgcgcugggggacgccgcccaggagcccaccggcaacaacgccgagaucugccuccugccccuggacuacgggcccugccgggcccuccugcugcgcuacuacuacgaccgguacacgcaguccugccgccaguuccucuacggcgggugcgagggcaacgcgaacaacuucuacaccugggaggccugcgacgacgccugcuggcggaucgagaaggugccgaaggucugccgccuccaggugagcguggacgaccagugcgagggcuccaccgagaaguacuucuucaaccugagcuccaugaccugcgagaaguucuucagcgggggcugccaccggaaccgcaucgagaaccgguuccccgacgaggccacgugcaugggguucugcgcgcccaagaagaacaccgagcccgucaugcucuccccgauccuggccguggagggcaugaccaucacccugcucgccgggcgcaucgccaacgugcacguccagaagcuguga

SEQ ID NO: 37608 - RNA, 756 nt, Artificial Sequence
  derived and/or modified sequence opt1 from TFPI__Homo_sapiens__NP_001027452
augaucuacaccaugaagaaggugcacgcccugugggccagcgucugccuccugcugaaccucgcgcccgccccgcugaacgccgacuccgaggaggacgaggagcacaccaucaucacggacaccgagcugccgccccucaagcugaugcacagcuucugcgccuucaaggccgacgacggccccugcaaggcgaucaugaagcgcuucuucuucaacaucuucacccggcagugcgaggaguucaucuacgggggcugcgaggggaaccagaaccgcuucgagucccuggaggagugcaagaagaugugcacccgggacaacgccaaccgcaucaucaagacgacccuccagcaggagaagcccgacuucugcuuccuggaggaggaccccggcaucugccggggguacaucacccgcuacuucuacaacaaccagaccaagcagugcgagcgguucaaguacggcggcugccuggggaacaugaacaacuucgagacgcucgaggagugcaagaacaucugcgaggacggccccaacggguuccagguggacaacuacggcacccagcugaacgccgugaacaacagccugacgccccaguccaccaaggucccgagccucuucgugaccaaggaggggaccaacgacggcuggaagaacgccgcgcacaucuaccagguguuccugaacgccuucugcauccacgccuccauguucuuccugggccucgacagcaucuccugccugugcuga

SEQ ID NO: 37609 - RNA, 762 nt, Artificial Sequence
  derived and/or modified sequence opt1 from TFPT__Homo_sapiens__NP_037474
auggagcuggagcagcgcgagggcaccauggccgccgugggguucgaggaguucagcgcgcccccgggcuccgagcucgcccugccgccccuguucgggggccacauccucgagagcgagcuggagaccgaggucgaguucguguccgggggccugggcgggagcggccuccgggagcgcgacgaggaggaggaggccgcccgggggcgccggcgccggcagcgcgagcugaaccggcgcaaguaccaggcccugggccggcgcugccgggagaucgagcaggucaacgagcgcgugcucaaccggcugcaccaggugcagcgcaucacgcggcgccugcagcaggagcggcgcuuccucaugcgggugcuggacuccuacggggacgacuaccgcgcgagccaguucaccaucguccuggaggacgagggcucccagggcaccgacgcccccacccccgggaacgccgagaacgagccgcccgagaaggagacgcucagcccgccccgccggacccccgccccgcccgagcccggcucccccgcgcccggggagggccccagcggccgcaagcggcgccgggugccccgcgacgggcggcgcgccggcaacgcccugacccccgagcuggcccccgugcagaucaaggucgaggaggacuucggguucgaggccgacgaggcgcucgacuccagcugggugucccggggccccgacaagcugcugccguaccccacccucgccagccccgccuccgacuga

SEQ ID NO: 37610 - RNA, 1893 nt, Artificial Sequence
  derived and/or modified sequence opt1 from TFR2__Homo_sapiens__NP_001193784
auggccgcccugacccaggacauccgcgcggcccucagccggcagaagcuggaccacguguggaccgacacgcacuacgucggccugcaguuccccgacccggcccaccccaacacccuccacuggguggacgaggccgggaaggugggcgagcagcugccccuggaggaccccgacgucuacugcccguacuccgccaucgggaacgugaccggcgagcucguguacgcgcacuacgggcgccccgaggaccugcaggaccugcgggcccgcggcgucgaccccgugggccggcuccugcuggugcgcgucggggugaucagcuucgcccagaaggugaccaacgcccaggacuucggcgcgcaggggguccucaucuaccccgagccggccgacuucucccaggacccgcccaagcccagccuguccagccagcaggccguguacggccacgugcaccuggggacgggcgaccccuacacccccggcuuccccuccuucaaccagacccaguucccgcccgucgccagcuccgggcuccccagcauccccgcccagcccaucuccgcggacaucgccagccggcugcugcgcaagcucaagggcccgguggcgccccaggaguggcaggggucccugcugggcagccccuaccaccucggccccgggccgcggcugcgccugguggucaacaaccaccggaccuccacgcccaucaacaacaucuucggcugcaucgaggggcgcagcgagcccgaccacuacguggugaucggcgcccagcgggacgccugggggcccggcgccgccaaguccgccgucggcaccgccauccuccuggagcuggugcgcaccuucagcuccauggugagcaacggguuccggccgcgccggagccuccuguucaucuccugggacggcggggacuucggcagcgucggguccaccgaguggcuggagggcuaccucagcgugcugcaccugaaggccgucguguacgugucccucgacaacgcgguccugggcgacgacaaguuccacgccaagacgagcccccugcucaccucccugaucgagagcgugcugaagcaggucgacucccccaaccacagcgggcagacccucuacgagcaggucguguucaccaacccguccugggacgccgaggugauccgcccccugcccauggacagcuccgccuacagcuucacggccuucgugggcgugcccgcgguggaguucuccuucauggaggacgaccaggccuacccguuccugcacaccaaggaggacaccuacgagaaccuccacaagguccugcaggggcggcugcccgccguggcccaggcgguggcccagcucgccggccagcugcugauccgccucagccacgaccggcugcugccccuggacuucgggcgcuacggcgacgucgugcuccgccacaucggcaaccugaacgaguucuccggggaccugaaggcccggggccucacccugcaguggguguacagcgcccgcggggacuacauccgggcggccgagaagcugcgccaggagaucuacuccagcgaggagcgggacgagcgccucacgcggauguacaacguccgcaucaugcggguggaguucuacuuccugagccaguacgugucccccgccgacagcccguuccgccacaucuucaugggccggggcgaccacacccugggggcccuccuggaccaccuccgccugcugcgguccaacagcuccggcacccccggggccaccagcuccacgggcuuccaggagagccgcuuccggcgccagcuggcgcuccugaccuggacccugcagggggccgccaacgcccucuccggcgacgucuggaacaucgacaacaacuucuga

SEQ ID NO: 37611 - RNA, 2283 nt, Artificial Sequence
  derived and/or modified sequence opt1 from TFRC__Homo_sapiens__NP_003225
augauggaccaggcccgcagcgccuucuccaaccuguucggcggggagccccucagcuacacccgguucucccuggcgcgccagguggacggcgacaacagccacgucgagaugaagcuggccguggacgaggaggagaacgccgacaacaacaccaaggccaacgugacgaagccgaagcggugcuccgggagcaucugcuacggcaccaucgccgucaucguguucuuccucaucggguucaugaucggcuaccugggcuacugcaaggggguggagcccaagaccgagugcgagcgccuggcgggcaccgagucccccguccgggaggagcccggggaggacuucccggccgcccgccggcucuacugggacgaccugaagcgcaagcugagcgagaagcucgacuccacggacuucaccggcaccaucaagcugcugaacgagaacagcuacgugccccgggaggccgggucccagaaggacgagaaccucgcgcuguacguggagaaccaguuccgcgaguucaagcugagcaaggucuggcgggaccagcacuucgugaagauccaggugaaggacuccgcccagaacagcgucaucaucguggacaagaacggccgccucguguaccuggucgagaaccccggcggguacguggccuacuccaaggccgccaccgugacgggcaagcugguccacgcgaacuucgggaccaagaaggacuucgaggaccucuacacccccgugaacggcagcaucgugaucguccgggccggcaagaucaccuucgccgagaagguggccaacgccgagucccugaacgcgaucggggugcugaucuacauggaccagacgaaguucccgaucgucaacgccgagcucagcuucuucggccacgcccaccuggggaccggcgaccccuacacccccggguuccccuccuucaaccacacccaguucccgcccagccgcagcuccggccugcccaacauccccgugcagacgaucagccgggccgccgcggagaagcuguucggcaacauggagggggacugcccguccgacuggaagaccgacagcacgugccgcauggucaccuccgagagcaagaacgugaagcucaccguguccaacguccugaaggagaucaagauccucaacaucuucggcgugaucaagggguucguggagcccgaccacuacgucguggugggcgcccagcgggacgccugggggcccggcgccgccaagagcggcgucgggaccgcgcugcugcucaagcuggcccagauguucuccgacauggugcugaaggacggcuuccagcccagccgcuccaucaucuucgccagcugguccgccggggacuucggcagcgugggggcgaccgaguggcucgagggcuaccuguccagccugcaccucaaggccuucaccuacaucaaccuggacaaggccguccugggcacguccaacuucaaggugagcgccuccccgcuccuguacacccugaucgagaagaccaugcagaacgugaagcaccccgucaccgggcaguuccucuaccaggacagcaacugggccagcaagguggagaagcugacgcuggacaacgcggccuuccccuuccucgccuacuccggcauccccgccgugagcuucugcuucugcgaggacaccgacuacccguaccuggggaccaccauggacacguacaaggagcugaucgagcggauccccgagcucaacaaggucgcccgcgcggccgccgagguggccggccaguucgugaucaagcugacccacgacgucgagcugaaccuggacuacgagcgguacaacucccagcuccugagcuucgugcgcgaccugaaccaguaccgcgccgacaucaaggagaugggccucucccugcaguggcuguacagcgcgcgcggggacuucuuccgggccaccucccggcucaccacggacuucggcaacgccgagaagaccgaccgcuucgugaugaagaagcugaacgaccgggucaugcgcguggaguaccacuuccugagccccuacgugucccccaaggagagcccguuccggcacgucuucuggggguccggcagccacacccuccccgcccugcuggagaaccucaagcugcgcaagcagaacaacggggcguucaacgagacccuguuccggaaccagcucgcccuggccaccuggacgauccagggcgccgccaacgcgcuguccggcgacgugugggacaucgacaacgaguucuga

SEQ ID NO: 37612 - RNA, 480 nt, Artificial Sequence
  derived and/or modified sequence opt1 from TGFA__Homo_sapiens__NP_001093161
auggugcccagcgccggccagcuggcccucuucgcgcuggggaucguccuggccgccugccaggcccucgagaacuccaccagcccgcuguccgacccgcccguggccgcggccguggucagccacuucaacgacugccccgacucccacacccaguucugcuuccacggcacgugccgcuuccuggugcaggaggacaagcccgccugcgugugccacagcggguacgucggcgcccggugcgagcacgcggaccuccuggccgugguggccgccucccagaagaagcaggccaucaccgcgcuggucguggugagcaucgucgcccucgccgugcugaucaucacgugcgugcugauccacugcugccagguccgcaagcacugcgaguggugccgggcccucaucugccgccacgagaagcccuccgcccugcugaaggggcggaccgcgugcugccacagcgagaccgugguguga

SEQ ID NO: 37613 - RNA, 1173 nt, Artificial Sequence
  derived and/or modified sequence opt1 from TGFB1__Homo_sapiens__NP_000651
augcccccgagcggccugcgccuccugccccugcuccugccccugcucuggcugcuggugcucacccccgggcggccggccgccggccuguccacgugcaagaccaucgacauggagcuggucaagcgcaagcggaucgaggcgauccgcgggcagauccucagcaagcugcggcuggccuccccgcccagccagggcgaggugccgcccgggccccuccccgaggccgugcuggcccuguacaacuccacccgcgaccgggucgccggcgagagcgcggagcccgagcccgagcccgaggccgacuacuacgccaaggaggugacccgcgugcucauggucgagacccacaacgagaucuacgacaaguucaagcaguccacgcacagcaucuacauguucuucaacaccuccgagcugcgggaggccgugcccgagcccgugcugcucagccgcgcggagcugcggcugcuccgccugaagcugaaggucgagcagcacguggagcucuaccagaaguacuccaacaacagcuggcgguaccuguccaaccgccugcucgccccgagcgacucccccgaguggcugagcuucgacgugaccggcgucgugcggcaguggcugucccgcgggggcgagaucgagggguuccggcucagcgcccacugcuccugcgacagccgcgacaacacccuccagguggacaucaacggcuucacgaccgggcggcgcggcgaccuggccaccauccacggcaugaaccggcccuuccugcugcugauggccacgccccucgagcgcgcgcagcaccuccagagcucccgccaccggcgcgcccuggacaccaacuacugcuucagcuccaccgagaagaacugcugcguccggcagcuguacaucgacuuccgcaaggaccugggguggaaguggauccacgagccgaagggcuaccacgccaacuucugccuggggcccugccccuacaucuggagccucgacacccaguacuccaaggugcuggcccuguacaaccagcacaaccccggcgccagcgcggccccgugcugcgugccccaggcccucgagccccugcccaucgucuacuacgugggccggaagccgaagguggagcagcuguccaacaugaucguccgcagcugcaagugcuccuga

SEQ ID NO: 37614 - RNA, 1386 nt, Artificial Sequence
  derived and/or modified sequence opt1 from TGFB1I1__Homo_sapiens__NP_001035919
auggaggaccuggacgcccuccugagcgaccuggagaccaccacgucccacaugccccgcagcggcgccccgaaggagcggcccgccgagccccucacgcccccgcccuccuacgggcaccagccccagaccggcagcggggaguccagcggcgccuccggggacaaggaccaccuguacagcaccgugugcaagccccgcuccccgaagcccgccgcccccgccgcgcccccguucagcuccagcuccggcguccugggcaccgggcucugcgagcuggaccggcugcuccaggagcugaacgccacccaguucaacaucaccgacgagaucaugagccaguuccccuccagcaagguggccuccggcgagcagaaggaggaccagagcgaggacaagaagcgccccucccugcccagcagcccgucccccgggcuccccaaggccagcgcgaccuccgccacgcuggagcuggaccggcucauggccagccuguccgacuuccgcgugcagaaccaccuccccgccagcggcccgacccagccgcccgucguguccagcaccaacgaggggucccccagcccgcccgagcccaccggcaagggcucccucgacacgaugcuggggcugcuccagagcgaccugucccggcgcggcgugcccacccaggccaaggggcugugcggcagcugcaacaagcccaucgcgggccaggucgugaccgcccucgggcgggccuggcaccccgagcacuucgugugcggcgggugcuccaccgcccugggcgggagcuccuucuucgagaaggacggcgcccccuucugcccggagugcuacuucgagcgcuucagcccccggugcggcuucugcaaccagcccauccgccacaagauggucacggcgcuggggacccacuggcaccccgagcacuucugcugcguguccugcggcgagccguucggggacgagggcuuccacgagcgggaggggcgccccuacugccggcgcgacuuccuccagcuguucgcgccccggugccagggcugccagggccccauccuggacaacuacaucagcgcccucagcgcccuguggcacccggacugcuucgugugccgcgagugcuucgcccccuucuccgggggcagcuucuucgagcacgaggggcggccccugugcgagaaccacuuccacgcccgccggggcucccucugcgcgaccugcgggcugcccgucaccggccgcugcgugagcgcccugggccgccgguuccacccggaccacuucacgugcaccuucugccuccgcccccugaccaagggguccuuccaggagcgggccggcaagcccuacugccagcccugcuuccugaagcuguucggguga

SEQ ID NO: 37615 - RNA, 1329 nt, Artificial Sequence
  derived and/or modified sequence opt1 from TGFB2__Homo_sapiens__NP_001129071
augcacuacugcgugcugagcgccuuccucauccugcaccuggugaccguggcccucucccugagcacgugcuccacccuggacauggaccaguucaugcgcaagcggaucgaggcgauccgcggccagauccucagcaagcugaagcugaccuccccgcccgaggacuaccccgagcccgaggaggugcccccggaggucaucagcaucuacaacuccacccgggaccuccugcaggagaaggccagccgccgggccgccgccugcgagcgcgagcgguccgacgaggaguacuacgcgaaggagguguacaagaucgacaugccgcccuucuuccccagcgagaccgugugccccgucgugacgacccccuccgggagcgugggcucccugugcagccgccagucccagguccucugcggguaccuggacgccaucccgcccaccuucuaccggcccuacuuccgcaucgugcgguucgacgugagcgccauggagaagaacgccuccaaccuggucaaggcggaguuccgcguguuccggcuccagaaccccaaggcccgcgugcccgagcagcggaucgagcuguaccagauccucaagagcaaggaccugaccucccccacgcagcgcuacaucgacagcaaggucgugaagacccgggccgagggcgaguggcugagcuucgacgugaccgacgccguccacgaguggcugcaccacaaggaccgcaaccucggguucaagaucucccugcacugcccgugcugcaccuucgugcccagcaacaacuacaucauccccaacaaguccgaggagcuggaggcccgguucgcgggcaucgacggcacgagcaccuacaccuccggggaccagaagaccaucaagagcacgcgcaagaagaacuccggcaagacgccccaccuccugcugaugcuccugccgagcuaccggcuggagucccagcagaccaaccgccgcaagaagcgggcccucgacgccgccuacugcuuccgcaacgugcaggacaacugcugccugcggccccuguacaucgacuucaagcgcgaccucggguggaaguggauccacgagcccaagggcuacaacgccaacuucugcgcgggggccugccccuaccuguggagcuccgacacccagcacagccggguccugucccucuacaacaccaucaacccggaggccagcgccucccccugcugcgugagccaggaccuggagccccugaccauccucuacuacaucggcaagacccccaagaucgagcagcuguccaacaugaucgucaagagcugcaagugcuccuga

SEQ ID NO: 37616 - RNA, 1239 nt, Artificial Sequence
  derived and/or modified sequence opt1 from TGFB3__Homo_sapiens__NP_003230
augaagaugcaccuccagcgcgcccucguggugcuggcccugcucaacuucgcgaccgugagccugucccugagcacgugcaccacccucgacuucggccacaucaagaagaagcggguggaggccauccgcgggcagauccuguccaagcugcggcucaccagcccgcccgagcccaccgucaugacgcacgugcccuaccaggugcuggcccuguacaacuccacccgcgagcuccuggaggagaugcacggcgagcgggaggaggggugcacccaggagaacaccgagagcgaguacuacgccaaggagauccacaaguucgacaugauccagggccuggccgagcacaacgagcucgcggucugccccaaggggaucacguccaagguguuccgcuucaacgugagcuccgucgagaagaaccggaccaaccuguuccgcgccgaguuccgggugcugcgcgugccgaaccccagcuccaagcggaacgagcagcgcaucgagcuguuccagauccugcggcccgacgagcacaucgccaagcagcgcuacaucggcggcaagaaccugcccacccgggggaccgccgaguggcucagcuucgacgucacggacaccgugcgcgaguggcugcugcggcgcgaguccaaccucggccuggagaucagcauccacugcccgugccacaccuuccagcccaacggggacauccuggagaacauccacgaggugauggagaucaaguucaagggcgucgacaacgaggacgaccacgggcggggcgaccucggccgccugaagaagcagaaggaccaccacaacccccaccugauccucaugaugaucccgccccaccggcuggacaaccccgggcagggcgggcagcgcaagaagcgcgcgcuggacaccaacuacugcuuccggaaccucgaggagaacugcugcgugcgcccccuguacaucgacuuccggcaggaccugggcuggaagugggugcacgagcccaagggcuacuacgccaacuucugcuccgggccgugccccuaccuccgcagcgccgacacgacccacuccaccguccugggccuguacaacacccucaaccccgaggccagcgccucccccugcugcgugccgcaggaccuggagccccugacgauccucuacuacguggggcggacccccaaggucgagcagcugagcaacaugguggucaagagcugcaagugcuccuga

SEQ ID NO: 37617 - RNA, 2052 nt, Artificial Sequence
  derived and/or modified sequence opt1 from TGFBI__Homo_sapiens__NP_000349
auggcccuguucgugcgccuccuggcccuggcgcucgcccuggcccugggccccgccgccacccucgcggggcccgccaagagccccuaccagcugguccugcagcacucccggcuccgcggccggcagcacgggcccaacgugugcgccgugcagaaggucaucggcaccaaccgcaaguacuucacgaacugcaagcagugguaccagcggaagaucugcggcaagagcaccgugaucuccuacgagugcugccccggguacgagaaggugccgggcgagaaggggugccccgccgcgcugccccugagcaaccucuacgagacccugggcgucgugggguccaccacgacccagcuguacaccgaccgcaccgagaagcuccggcccgagauggagggcccggggagcuucacgaucuucgcccccuccaacgaggccugggccagccugcccgccgaggugcuggacucccucgucagcaacgugaacaucgagcugcugaacgcgcuccgcuaccacauggugggccggcgcguccugaccgacgagcugaagcacggcaugacccucaccuccauguaccagaacagcaacauccagauccaccacuaccccaacgggaucgugacggugaacugcgcccggcugcugaaggccgaccaccacgccaccaacggcgucgugcaccucaucgacaaggugaucuccaccaucaccaacaacauccagcagaucaucgagaucgaggacacguucgagacccugcgcgccgcggucgccgccagcgggcugaacaccaugcucgagggcaacggccaguacacccugcuggccccgacgaacgaggccuucgagaagauccccuccgagacccucaaccggauccugggggaccccgaggcgcugcgcgaccuccugaacaaccacauccucaagagcgccaugugcgccgaggccaucguggccggccuguccguggagacccuggaggggaccacgcuggaggucggcugcagcggggacaugcucaccaucaacggcaaggcgaucaucuccaacaaggacauccuggccaccaacggcgugauccacuacaucgacgagcugcucauccccgacagcgccaagacccuguucgagcuggccgcggagagcgacguguccacggccaucgaccucuuccggcaggccgggcugggcaaccaccugagcggguccgagcgccugacccuccuggccccgcugaacagcgucuucaaggacggcaccccgcccaucgacgcccacacccggaaccuccugcgcaaccacaucaucaaggaccagcuggcguccaaguaccucuaccacgggcagacgcuggagacccugggcggcaagaagcuccggguguucgucuaccgcaacagccugugcaucgagaacuccugcaucgccgcccacgacaagcgggggcgcuacggcacccuguucaccauggaccgcgugcucacgccgcccauggggaccgugauggacguccugaagggcgacaaccgguucagcaugcugguggccgccauccaguccgcggggcucaccgagacccugaaccgcgagggcguguacaccgucuucgcccccacgaacgaggccuuccgggcccugccgccccgcgagcggagccgccuccugggcgacgccaaggagcuggcgaacauccucaaguaccacaucggggacgagauccugguguccggcgggaucggcgcccuggugcggcucaagagccugcagggcgacaagcuggaggucucccucaagaacaacguggugagcgucaacaaggagcccguggccgagcccgacaucauggccaccaacggggugguccacgugaucaccaacgugcugcagccgcccgcgaaccgcccccaggagcggggcgacgagcuggccgacuccgcccucgagaucuucaagcaggccagcgccuucucccgcgcgagccagcgguccguccgccuggcccccguguaccagaagcugcucgagcggaugaagcacuga

SEQ ID NO: 37618 - RNA, 1281 nt, Artificial Sequence
  derived and/or modified sequence opt1 from TGFBR1__Homo_sapiens__NP_001124388
auggaggccgccguggcggcgccccgcccgcggcugcuccugcugguccucgccgccgccgccgccgccgccgcggcccugcugcccggcgccaccgcccuccagugcuucugccaccugugcaccaaggacaacuucacgugcgugaccgacgggcugugcuucgugagcgucaccgagaccacggacaaggugauccacaacuccaugugcaucgccgagaucgaccucaucccccgcgaccggcccuucgugugcgcgccgagcuccaagaccggcagcgucaccaccacguacugcugcaaccaggaccacugcaacaagaucgagcugcccaccaccgggcugccccuccuggugcagcgcaccaucgcccggacgaucgugcugcaggaguccaucggcaaggggcgcuucggcgaggucuggcggggcaaguggcgcggggaggagguggccgugaagaucuucagcucccgggaggagcgcagcugguuccgggaggccgagaucuaccagaccgucaugcuccgccacgagaacauccugggcuucaucgccgcggacaacaaggacaacgggaccuggacccagcuguggcucguguccgacuaccacgagcacggcagccuguucgacuaccugaaccgguacacggugaccgucgaggggaugaucaagcucgcccuguccaccgccagcggccuggcccaccuccacauggagaucgugggcacccaggggaagcccgccaucgcgcaccgcgaccugaaguccaagaacauccuggugaagaagaacggcacgugcugcaucgccgaccucgggcuggccguccggcacgacagcgccaccgacaccaucgacaucgccccgaaccaccgcgugggcaccaagcgguacauggcgcccgaggugcuggacgacuccaucaacaugaagcacuucgagagcuucaagcgcgccgacaucuacgccaugggccucgucuucugggagaucgcccggcgcugcuccaucgggggcauccacgaggacuaccagcugcccuacuacgaccuggugcccagcgacccguccguggaggagaugcggaaggucgugugcgagcagaagcuccgccccaacauccccaaccgcuggcagagcugcgaggcgcugcgggucauggccaagaucaugcgcgagugcugguacgccaacggggccgcccggcugacggcgcuccgcaucaagaagacccugagccagcugucccagcaggagggcaucaagauguga

SEQ ID NO: 37619 - RNA, 1779 nt, Artificial Sequence
  derived and/or modified sequence opt1 from TGFBR2__Homo_sapiens__NP_001020018
augggccgcgggcugcuccggggccuguggccccugcacaucgugcucuggacccgcaucgccagcaccaucccgccccacguccagaaguccgacguggagauggaggcccagaaggacgagaucaucugccccagcugcaaccggacggcgcacccccugcgccacaucaacaacgacaugaucgugaccgacaacaacggggccgucaaguucccgcagcugugcaaguucugcgacgugcgguucuccacgugcgacaaccagaaguccugcaugagcaacugcagcaucaccuccaucugcgagaagccccaggaggugugcgucgccguguggcgcaagaacgacgagaacaucacccucgagaccgugugccacgaccccaagcugcccuaccacgacuucauccuggaggacgccgccagcccgaagugcaucaugaaggagaagaagaagcccggcgagaccuucuucaugugcuccugcagcuccgacgagugcaacgacaacaucaucuucagcgaggaguacaacaccuccaaccccgaccuccugcuggucaucuuccaggugacggggaucagccuccugcccccgcugggcguggcgaucuccgucaucaucaucuucuacugcuaccgggugaaccgccagcagaagcucagcuccaccugggagaccggcaagacccggaagcugauggaguucagcgagcacugcgccaucauccuggaggacgaccgcuccgacaucagcagcacgugcgccaacaacaucaaccacaacaccgagcuccugcccaucgagcuggacacccucguggggaagggccgguucgccgaggucuacaaggcgaagcugaagcagaacaccuccgagcaguucgagacgguggccgugaagaucuuccccuacgaggaguacgccagcuggaagaccgagaaggacaucuucuccgacaucaaccugaagcacgagaacauccuccaguuccugaccgccgaggagcgcaagaccgagcuggggaagcaguacuggcucaucacggccuuccacgcgaagggcaaccugcaggaguaccugacccggcacgucaucagcugggaggaccuccgcaagcugggguccagccuggcccggggcaucgcccaccuccacuccgaccacacccccugcggccgcccgaagaugcccaucgugcaccgggaccucaagagcuccaacauccuggugaagaacgaccugaccugcugccugugcgacuucgggcugagccuccgccuggaccccacgcuguccgucgacgaccucgccaacagcggccagguggggaccgcccgguacauggcgcccgaggugcuggagucccgcaugaaccuggagaacgucgagagcuucaagcagaccgacguguacuccauggcccucguccugugggagaugaccagccggugcaacgccgugggcgaggugaaggacuacgagccgcccuucggcuccaagguccgcgagcaccccugcguggagagcaugaaggacaacgugcugcgcgaccgggggcgccccgagaucccguccuucuggcucaaccaccagggcauccagauggucugcgagacgcugaccgagugcugggaccacgaccccgaggcccggcugaccgcccagugcguggcggagcgcuucagcgagcuggagcaccucgaccggcugagcgggcgcuccugcagcgaggagaagauccccgaggacggcucccugaacaccacgaaguga

SEQ ID NO: 37620 - RNA, 2583 nt, Artificial Sequence
  derived and/or modified sequence opt1 from TGFBRAP1__Homo_sapiens__NP_001136093
augaugagcaucaaggccuucacccugguguccgccgucgagcgcgagcuccugaugggcgacaaggagcgggugaacaucgagugcguggagugcugcgggcgcgaccuguacgucggcaccaacgacugcuucguguaccacuuccuccuggaggagcggcccgugccggcggggcccgccacguucaccgccaccaagcagcugcagcgccaccucggcuucaagaagcccgucaacgagcugcgggccgccagcgcgcugaaccgccuccuggugcugugcgacaacuccaucagccucgugaacaugcugaaccuggagcccgucccguccggggcccggaucaagggcgccgccaccuucgcgcucaacgagaaccccgugagcggcgaccccuucugcguggaggucugcaucaucuccgugaagcgccggacgauccagauguuccugguguacgaggaccgcguccagaucgugaaggaggugagcaccgccgagcagccccuggccgucgccguggacgggcacuuccucugccuggcccugaccacccaguacaucauccacaacuacuccacgggcgugagccaggaccucuucccguacugcuccgaggagcggccgcccaucgucaagcgcaucgggcggcaggaguuccugcuggcgggccccgggggccucggcauguucgccaccguggccgggaucagccagcgcgcccccgugcacugguccgagaacgucaucggcgccgcggugagcuuccccuacgucaucgcccuggacgacgaguucaucaccgugcacuccaugcuggaccagcagcagaagcagacccuccccuucaaggaggggcacauccugcaggacuucgagggccgggugaucgucgccacgagcaagggcguguacauccuggugccccucccgcuggagaagcagauccaggaccugcucgccucccgccgggucgaggaggcccuggugcuggcgaagggggcccgccggaacauccccaaggagaaguuccaggugauguaccgccggauccuccagcaggccggcuucauccaguucgcccagcugcaguuccuggaggccaaggagcuguuccgcagcgggcagcucgacguccgcgagcugaucucccucuaccccuuccugcugcccaccagcagcuccuucacccggagccacccgccccuccacgaguacgcggaccugaaccagcugacccagggcgaccaggagaagauggccaagugcaagcgcuuccucauguccuaccugaacgaggugcggagcacggagguggccaacggguacaaggaggacaucgacaccgcccugcugaagcucuacgcggaggccgaccacgacucccugcuggaccuccuggucaccgagaacuucugccugcucaccgacagcgccgccuggcuggagaagcacaagaaguacuucgcccugggccuccuguaccacuacaacaaccaggacgcggccgccgugcagcugugggugaacaucgucaacggcgacgugcaggacuccacgcgcagcgaccucuacgaguacaucguggacuuccugaccuacugccuggacgaggagcucgucugggccuacgccgacugggugcugcagaaguccgaggagguggggguccagguguucaccaagcggccccuggacgagcagcagaagaacagcuucaaccccgacgacaucaucaacugccucaagaaguacccgaaggcgcuggugaaguaccuggagcaccucgucaucgacaagcgccugcagaaggaggaguaccacacccaccuggccgugcucuaccuggaggaggugcugcuccagcgggccuccgccagcggcaagggggccgaggcgacggagacccaggccaagcugcgccggcugcuccagaaguccgaccuguaccgcguccacuuccugcucgagcggcugcagggcgccgggcugcccauggagagcgccauccuccacggcaagcugggcgagcacgagaaggcgcugcacauccucgugcacgagcugcaggacuucgccgccgccgaggacuacugccuguggugcuccgaggggcgcgacccgccccaccggcagcagcuguuccacacccuccuggccaucuaccuccacgcgggccccaccgcccacgagcuggccguggccgccgucgaccugcucaaccgccacgcgacggaguucgacgccgcccaggugcugcagaugcugcccgacaccuggagcgugcagcuccugugccccuuccugaugggggccaugcgggacuccauccacgcccgccggaccaugcaggucgcgcucggccuggcccgcagcgagaaccugaucuacaccuacgacaagaugaagcucaagggguccagcauccagcugagcgacaagaagcugugccagaucugccagaacccguucugcgagcccguguucgugcgguaccccaacggcggccucguccacacgcacugcgccgccucccgccacaccaaccccagcuccagcuccccggggacccgcaccuga

SEQ ID NO: 37621 - RNA, 8307 nt, Artificial Sequence
  derived and/or modified sequence opt1 from TG__Homo_sapiens__NP_003226
auggcccuggugcucgagaucuucacccugcuggccagcaucugcugggugagcgccaacaucuucgaguaccagguggacgcccagccccuccggcccugcgagcugcagcgggagaccgccuuccugaagcaggccgacuacgugccccagugcgccgaggacggcagcuuccagaccguccagugccagaacgacgggcggagcugcuggugcgugggcgccaacgggagcgaggugcucggcucccggcagcccgggcgccccgucgccugccugagcuucugccagcugcagaagcagcagauccuccuguccggcuacaucaacagcaccgacaccuccuaccugccccagugccaggacagcggcgacuacgcccccgugcagugcgacgugcagcagguccagugcuggugcguggacgccgaggggauggagguguacggcacccggcagcucgggcgccccaagcggugcccccgcuccugcgagauccggaaccgccggcugcugcacggcgucggggacaagagcccgccccagugcuccgccgagggcgaguucaugcccgugcagugcaaguucgugaacaccaccgacaugaugaucuucgaccucguccacagcuacaaccgcuuccccgacgccuucgugaccuucuccagcuuccagcggcgcuuccccgagguguccggcuacugccacugcgccgacagccaggggcgggagcuggccgagaccggccuggagcuccugcuggacgagaucuacgacaccaucuucgccgggcucgaccugcccuccaccuucaccgagaccacccuguaccgcauccuccagcggcgcuuccuggcgguccagagcgugaucagcggccgguuccgcugccccaccaagugcgagguggagcgguucaccgccaccuccuucggccaccccuacguccccagcugccgccgcaacggggacuaccaggccgugcagugccagacggagggccccugcuggugcguggacgcccaggggaaggagaugcacggcacccggcagcagggggagccgcccuccugcgccgagggccagagcugcgcguccgagcgccagcaggcccugagccggcucuacuucggcaccuccggguacuucagccagcacgaccuguucuccagcccggagaagcgcugggccagcccccgggucgcccgcuucgccaccagcugcccgcccacgaucaaggagcuguucguggacuccggccuccugcggccgauggucgaggggcagagccagcaguucuccgugagcgagaaccugcucaaggaggcgauccgcgccaucuuccccucccggggccuggcccgccuggcccuccaguucaccaccaaccccaagcggcugcagcagaaccuguucgggggcaaguuccucgugaacgucggccaguucaaccugagcggggcccugggcacccgcgggacguucaacuucucccaguucuuccagcagcucggccuggcgagcuuccugaacgggggccggcaggaggaccucgccaagccccugagcgugggccuggacuccaacagcuccaccgggaccccggaggccgccaagaaggacggcaccaugaacaagcccacgguggggagcuucggcuucgagaucaaccuccaggagaaccagaacgcgcugaaguuccuggccucccugcucgagcugcccgaguuccuccuguuccugcagcacgccaucagcgucccggaggacguggcccgcgaccugggcgacgugauggagaccguccucuccagccagaccugcgagcagacccccgagcggcuguucgugcccuccugcacgaccgaggggagcuacgaggacgugcagugcuucuccggcgagugcuggugcgucaacagcugggggaaggagcugcccggcucccgcgugcgcggcgggcagccgcgcugccccaccgacugcgagaagcagcgggcccgcaugcagagccucauggggucccagcccgcggggagcacccuguucgugcccgccugcacguccgagggccacuuccugccgguccagugcuucaacagcgagugcuacugcguggacgccgaggggcaggccauccccggcacccgcagcgccaucgggaagcccaagaagugccccaccccgugccagcuccaguccgagcaggcguuccugcggaccgugcaggcccugcucagcaacuccagcaugcugcccacccuguccgacacguacaucccccagugcagcaccgacggccaguggcgccagguccagugcaacgggccgcccgagcaggucuucgagcucuaccagcggugggaggcccagaacaaggggcaggaccugacccccgccaagcugcucgugaagaucauguccuaccgcgaggccgcgagcggcaacuucucccuguucauccagagccuguacgaggccgggcagcaggacgucuuccccgugcucucccaguaccccagccugcaggacgugccccuggccgcccucgagggcaagcggccccagccccgcgagaacauccugcuggagcccuaccucuucuggcagauccugaacgggcagcugucccaguacccgggcagcuacuccgacuucagcacgccccuggcgcacuucgaccugcggaacugcuggugcgucgacgaggccggccaggagcuggaggggaugcgcuccgagcccagcaagcucccgacgugccccggcuccugcgaggaggccaagcugcgggugcugcaguucauccgcgagaccgaggagaucgugagcgccagcaacuccagccgguucccccucggggaguccuuccuggucgccaagggcauccgccugcggaacgaggaccucgggcugcccccgcuguucccgccccgcgaggcguucgccgagcaguuccuccggggcagcgacuacgccauccgccuggccgcccaguccacccugagcuucuaccagcggcgccgguucucccccgacgacagcgcgggcgccuccgcccuccugcgcagcgggccguacaugccccagugcgacgccuucggcuccugggagcccgugcagugccacgccgggaccggccacugcuggugcguggacgagaagggcggguucauccccggcagccugacggcgcggucccuccagaucccgcagugccccacgaccugcgagaagucccgcaccuccgggcugcugagcuccuggaagcaggcccgcagccaggagaaccccucccccaaggaccucuucgucccggccugccuggagacgggcgaguacgcccggcugcaggcgagcggggccggcaccuggugcguggaccccgccagcggcgaggagcuccgccccggguccagcuccagcgcccagugccccucccugugcaacgugcucaaguccggcguccucucccggcgcgugagcccgggguacgugcccgccugccgggcggaggacggcggguucucccccguccagugcgaccaggcccagggcagcugcuggugcgugauggacuccggcgaggaggugcccgggacccgcgucaccggcgggcagccggccugcgagagcccccggugcccccugcccuucaacgccuccgagguggugggcgggacgauccugugcgagaccaucagcggcccgaccggcuccgccaugcagcagugccagcuccugugccgccaggggagcugguccgucuucccgcccggcccgcugaucugcagccucgaguccgggcggugggagagccagcugccccagccccgcgcgugccagcggccccagcuguggcagaccauccagacgcagggccacuuccagcuccagcugccgcccggcaagaugugcagcgccgacuacgccgaccugcuccagaccuuccagguguucauccuggacgagcugaccgcccgcggguucugccagauccaggugaagaccuucggcacgcucgucuccauccccgugugcaacaacagcuccgugcaggucgggugccugacccgggagcgccugggcgugaacgugaccuggaagucccggcucgaggacauccccgucgccucccugccggaccugcacgacaucgagcgcgcgcucguggggaaggaccugcugggccgguucaccgaccucauccagagcggcuccuuccagcugcaccuggacagcaagacguuccccgccgagaccauccgcuuccuccagggggaccacuucggcaccagcccccggaccugguucgggugcagcgagggcuucuaccagguccugacguccgaggccagccaggacgggcugggcugcgugaagugccccgagggcuccuacagccaggacgaggagugcaucccgugccccgugggguucuaccaggagcaggccggcucccucgccugcguccccugccccguggggcgcaccaccaucagcgcgggcgccuucucccagacccacugcgugacggacugccagcgcaacgaggccgggcugcagugcgaccagaacggccaguaccgggccagccagaaggaccgcggcuccgggaaggcguucugcgucgacggcgaggggcggcgccugccguggugggagaccgaggcgccccucgaggacagccagugccugaugaugcagaaguucgagaaggugcccgagagcaaggugaucuucgacgccaacgcccccgucgccgugcgguccaaggugccggacagcgaguuccccgucaugcagugccugaccgacugcaccgaggacgaggcgugcuccuucuucaccgugagcacgaccgagcccgagaucuccugcgacuucuacgccuggaccagcgacaacguggccugcaugaccuccgaccagaagcgcgacgcccugggcaacagcaaggccacguccuucgggagccuccggugccaggucaaggugcgcucccacggccaggacagccccgcgguguaccugaagaagggccagggguccaccaccacccugcagaagcgguucgagccgacgggcuuccagaacaugcucagcgggcuguacaaccccaucgucuucuccgccagcggcgccaaccugaccgacgcccaccucuucugccugcuggccugcgaccgcgaccucugcugcgacggcuucgugcugacccaggugcagggcggcgcgaucaucugcgggcugcucuccagccccuccguccugcugugcaacgugaaggacuggauggaccccagcgaggccugggccaacgcgaccugcccgggcgugacguacgaccaggagagccaccaggucauccuccggcugggggaccaggaguucaucaagucccugacgccccucgagggcacccaggacaccuucacgaacuuccagcaggucuaccuguggaaggacagcgacaugggcucccgccccgagagcauggggugccggaaggacaccgugccgcgccccgcgucccccaccgaggccggccugaccacggagcuguucagccccgucgaccugaaccaggugaucgugaacgggaaccagucccugagcucccagaagcacuggcuguucaagcaccuguucagcgcccagcaggccaaccuguggugccucucccggugcguccaggagcacagcuucugccagcuggccgagaucaccgaguccgcgagccuguacuucacgugcacccucuacccggaggcccaggugugcgacgacaucauggaguccaacgcccagggcugccgccugauccugccccagaugcccaaggcccucuuccggaagaaggugauccuggaggacaaggucaagaacuucuacacgcgccugcccuuccagaagcucauggggaucagcauccggaacaaggugccgauguccgagaaguccaucagcaacggcuucuucgagugcgagcgccggugcgacgccgaccccugcugcaccggcuucggguuccugaacgugucccagcugaagggcggggaggugaccugccucacccugaacagccugggcauccagaugugcuccgaggagaacgggggcgcguggcgcauccucgacugcggcagccccgacaucgaggugcacacguaccccuucgggugguaccagaagccgaucgcccagaacaacgcccccuccuucugcccccuggugguccugcccagccucaccgagaaggugucccuggacagcuggcagucccuggcccucagcuccguggucguggacccgagcauccgccacuucgacguggcccacgucuccaccgcggccaccagcaacuucuccgccgugcgggaccugugccugagcgagugcucccagcacgaggccugccucaucacgacccugcagacccagcccggcgcggugcgcugcauguucuacgccgacacccagagcugcacgcacucccugcaggggcagaacugccggcuccugcugcgcgaggaggccacccacaucuaccggaagcccggcaucagccuccugagcuacgaggccuccguccccagcgugccgaucuccacccacgggcgccugcucggccggagccaggccauccaggugggcaccuccuggaagcaggucgaccaguuccugggggugcccuacgcggcgccgccccuggccgagcgccgguuccaggccccggagccccucaacuggaccggcagcugggacgccuccaagccccgcgcgagcugcuggcagccggggacgcggaccuccaccagccccggcgucuccgaggacugccuguaccugaacguguucaucccccagaacguggcccccaacgccagcguccucguguucuuccacaacaccauggaccgcgaggaguccgagggcuggccggccaucgacgggagcuuccuggccgcggugggcaaccugaucgucgugacggccuccuaccgggugggggucuucggcuuccucagcuccgggagcggcgagguguccggcaacugggggcugcuggaccagguggccgcccucaccuggguccagacccacauccgcggcuucgggggcgacccccggcgcgugagccuggccgcggaccgcgggggcgccgacguggccagcauccaccuccucaccgcccgcgcgacgaacucccagcuguuccggcgcgccguccugaugggcgggagcgcccucucccccgccgccgugaucagccacgagcgcgcgcagcagcaggccaucgcccuggccaaggagguguccugccccaugagcuccagccaggaggucguguccugccugcggcagaagccggccaacgugcucaacgacgcgcagaccaagcugcuggccgucagcggccccuuccacuacugggggcccgugaucgacggccacuuccuccgcgagcccccggcccgggcccugaagcgcucccuguggguggaggucgaccuccugaucgggagcucccaggacgacggccugaucaaccgggccaaggcggugaagcaguucgaggagagccgcggccggaccuccagcaagaccgccuucuaccaggcccuccagaacucccucgggggcgaggacagcgacgcccgcguggaggcggccgccacgugguacuacucccuggagcacagcaccgacgacuacgccagcuucucccgggcccucgagaacgcgacccgcgacuacuucaucaucugccccaucaucgacauggccagcgccugggccaagcgggcccgcgggaacgucuucauguaccacgcgcccgagaacuacggccacggcucccuggagcugcucgccgacgugcaguucgcccuggggcugcccuucuacccggccuacgagggccaguucagccucgaggagaagucccugagccugaagaucaugcaguacuucucccacuucauccggagcgggaaccccaacuaccccuacgaguucucccgcaaggugcccaccuucgccacgccguggcccgacuucgucccccgggcgggcggggagaacuacaaggaguucagcgagcugcuccccaaccgccagggccugaagaaggccgacugcuccuucuggagcaaguacaucuccagccugaagaccuccgccgacggcgccaagggcggccagagcgcggaguccgaggaggaggagcucaccgccgggagcggccugcgggaggaccugcucucccugcaggagccggggagcaagaccuacagcaaguga

SEQ ID NO: 37622 - RNA, 828 nt, Artificial Sequence
  derived and/or modified sequence opt1 from TGIF1__Homo_sapiens__NP_001265611
auggccgccgcgcacagcggccgcuccaucguggccgccagcggguccgagaccgaggacgaggacagcauggacaucccccuggaccucuccagcuccgccggcagcgggaagcggcgccggcgcggcaaccugcccaaggaguccguccagauccugcgggacuggcucuacgagcaccgcuacaacgccuaccccagcgagcaggagaaggcgcugcugucccagcagacccaccucagcacgcuccaggugugcaacugguucaucaacgcccggcgccggcugcugcccgacaugcugcgcaaggacgggaaggaccccaaccaguucaccaucucccggcgcggcgccaagaucagcgagaccuccagcguggaguccgucaugggcaucaagaacuucaugccggcccuggaggagacccccuuccacagcugcacggcggggcccaaccccacccucggccggccgcugucccccaagcccagcagccccggguccgugcuggcccgcccgagcgugaucugccacaccaccgucacggcccucaaggacgugcccuucucccugugccagagcgugggcgucgggcagaacaccgacauccagcagaucgccgccaagaacuucaccgacaccucccugauguaccccgaggacacgugcaagagcggccccuccaccaacacccagagcggccucuucaacaccccgccgcccacgccgcccgaccugaaccaggacuucuccggguuccagcugcucguggacguggcgcugaagcgggccgccgagauggagcugcaggccaagcucaccgccuga

SEQ ID NO: 37623 - RNA, 468 nt, Artificial Sequence
  derived and/or modified sequence opt1 from TGIF2-C20orf24__Homo_sapiens__NP_001186464
augagcgacuccgaccugggcgaggacgaggggcuccugagccuggccggcaagcgcaagcggcgcgggaaccuccccaaggaguccgugaagauccugcgggacuggcuguaccuccaccgcuacaacgccuacccgagcgagcaggagaagcugucccugagcggccagaccaaccucuccguccugcaggacgaguuccuggacgugaucuacugguuccggcagaucaucgcggugguccucggggugaucuggggcgugcugccccugcgcggcuuccucgggaucgccggcuucugccugaucaacgccgggguccuguaccucuacuucagcaacuaccugcagaucgacgaggaggaguacggcgggaccugggagcugacgaaggagggcuucaugaccuccuucgcccucuucauggugaucuggaucaucuucuacaccgccauccacuacgacuga

SEQ ID NO: 37624 - RNA, 714 nt, Artificial Sequence
  derived and/or modified sequence opt1 from TGIF2__Homo_sapiens__NP_001186444
augagcgacuccgaccugggggaggacgaggggcuccugagccuggccggcaagcgcaagcggcgcgggaaccuccccaaggaguccgugaagauccugcgggacuggcuguaccuccaccgcuacaacgccuacccgagcgagcaggagaagcugucccugagcggccagaccaaccucuccguccugcagaucugcaacugguucaucaacgcgcggcgccggcugcuccccgacaugcugcgcaaggacgggaaggaccccaaccaguucaccaucagccggcgcggcggcaaggccuccgacguggcccugccccgggggagcuccccgagcgugcucgccgucuccgugcccgcccccacgaacgugcugagccuguccgucugcagcaugccccuccacuccggccagggggagaagccggcggcccccuucccccgcggcgagcuggagagccccaagccgcuggugacccccggguccacccucacccugcugacgcgggccgaggccggcagccccaccggcggccucuucaacacgcccccgcccaccccgcccgagcaggacaaggaggacuucagcuccuuccagcugcugguggaggucgcgcuccagcgcgccgccgagauggagcugcagaagcagcaggaccccagccugccccuccugcacacccccaucccccugguguccgagaacccgcaguga

SEQ ID NO: 37625 - RNA, 726 nt, Artificial Sequence
  derived and/or modified sequence opt1 from TGIF2LX__Homo_sapiens__NP_620410
auggaggccgccgcggacggccccgccgagacccagagcccgguggagaaggacucccccgccaagacccagagccccgcccaggacacguccaucaugagccgcaacaacgccgacaccgggcggguccuggcgcuccccgagcacaagaagaagcgcaagggcaaccugccggccgaguccgugaagauccugcgggacuggauguacaagcaccgcuucaaggccuaccccagcgaggaggagaagcagaugcucuccgagaagaccaaccugagccugcuccagaucuccaacugguucaucaacgcccggcgccggauccugcccgacaugcugcagcagcgccggaacgaccccaucaucgggcacaagaccggcaaggacgcgcacgccacgcaccuccagagcaccgaggccuccgugccggccaagagcgggcccuccggccccgacaacguccagagccugccccuguggccgcuccccaagggccagaugucccgcgagaagcagcccgaccccgagagcgccccgucccagaagcugaccgggaucgcgcagcccaagaagaaggugaaggugagcgucaccucccccagcagccccgagcugguguccccggaggagcacgccgacuucagcuccuuccuccugcugguggacgccgccguccagcgggccgcggagcucgagcuggagaagaagcaggagcccaaccccuga

SEQ ID NO: 37626 - RNA, 2454 nt, Artificial Sequence
  derived and/or modified sequence opt1 from TGM1__Homo_sapiens__NP_000350
augauggacggcccccgcagcgacguggggcgguggggcgggaacccgcugcagccgcccaccacccccucccccgagcccgagcccgagcccgacggccgcagccggcgcgggggcggccgguccuucugggcccgcugcugcgggugcugcagcugccggaacgccgcggacgacgacuggggcccggagcccuccgacagccgcgggcggggcuccagcuccgggacgcgccggcccggcagccgcggcuccgacagccggcgccccgucucccgggggagcggcgugaacgccgccggggacggcaccauccgcgagggcaugcucguggucaacgggguggaccugcuguccagccgguccgaccagaaccgccgggagcaccacaccgacgaguacgaguacgacgagcucaucgugcgccggggccagccguuccacaugcugcugcuccugagccgcaccuacgaguccagcgaccgcaucacgcuggagcuccugaucgggaacaaccccgaggucggcaaggggacccacgugaucauccccgugggcaagggcgggagcggcggguggaaggcccaggucgugaaggccuccggccagaaccugaaccuccgggugcacaccagccccaacgcgaucaucgggaaguuccaguucaccguccgcacgcaguccgacgccggcgaguuccagcugccguucgacccccggaacgagaucuacauccuguucaaccccuggugccccgaggacaucguguacguggaccacgaggacuggcgccaggaguacguccucaacgagagcggccggaucuacuacgggaccgaggcccagaucggcgagcgcaccuggaacuacgggcaguucgaccacggcgugcuggacgccugccuguacauccucgaccggcgcgggaugccguacggcggccgcggggaccccgugaacgucucccgggugaucagcgcgauggugaacucccuggacgacaacggcguccugaucgggaacuggagcggcgacuacucccggggcaccaaccccagcgccugggugggguccguggagauccuccugagcuaccugcgcacgggcuacuccguccccuacgggcagugcuggguguucgccggcgucaccaccaccgugcuccggugccuggggcuggccacgcgcaccgugaccaacuucaacagcgcccacgacaccgacacgucccucaccauggacaucuacuucgacgagaacaugaagccgcuggagcaccugaaccacgacagcgucuggaacuuccacguguggaacgacugcuggaugaagcggcccgaccuccccuccggcuucgacggcuggcaggucguggacgcgacgccccaggagaccagcuccgggaucuucugcugcggcccgugcagcguggagagcaucaagaacgggcugguguacaugaaguacgacacccccuucaucuucgccgaggucaacuccgacaagguguacuggcagcgccaggacgacggcagcuucaagaucguguacgucgaggagaaggccaucgggacccugaucgugaccaaggccaucuccagcaacaugcgggaggacaucaccuaccucuacaagcaccccgagggcuccgacgccgagcgcaaggcgguggagacggccgccgcccacggcagcaagccgaacgucuacgccaaccggggguccgcggaggacguggccaugcaggucgaggcccaggacgccgugaugggccaggaccugauggugagcgugaugcugaucaaccacuccagcucccgccgcaccgucaagcuccaccuguaccugagcgugaccuucuacaccgggguguccggcacgaucuucaaggagaccaagaaggaggucgagcucgcccccggggcgagcgaccgggugaccaugcccguggccuacaaggaguaccgcccccaccuggucgaccagggcgccaugcugcucaacguguccggccacgugaaggagagcgggcagguccuggccaagcagcacaccuuccggcugcgcacgccggaccucucccugacccugcucggcgcggccgugguggggcaggagugcgagguccagaucguguucaagaacccccugcccgugacccugaccaacgucguguuccggcuggagggcagcgggcuccagcgccccaagauccugaacgugggcgacaucggcgggaacgagaccgucacgcugcggcagagcuucgugccggugcgccccggcccccggcagcucaucgccucccuggacagcccccagcugucccagguccacggggugauccagguggacgucgccccggcccccggcgacggcggguucuucagcgacgcgggcggggacucccaccucggcgagaccauccccauggccagccgcgggggcgccuga

SEQ ID NO: 37627 - RNA, 1647 nt, Artificial Sequence
  derived and/or modified sequence opt1 from TGM2__Homo_sapiens__NP_945189
auggccgaggagcuggugcucgagcgcugcgaccuggagcuggagaccaacggccgggaccaccacaccgccgaccucugccgcgagaagcuggucgugcggcgcgggcagcccuucuggcugacgcuccacuucgagggccggaacuacgaggcgagcguggacucccugaccuucagcgucgugaccgggccggcccccucccaggaggccggcaccaaggcccgcuucccccugcgggacgccguggaggagggggacuggacggcgaccgucguggaccagcaggacugcacccucagccugcagcugaccacgcccgccaacgccccgaucggccucuaccgccugucccuggaggccagcaccggcuaccagggguccagcuucgugcucggccacuucauccugcuguucaacgcguggugccccgccgacgccgucuaccucgacuccgaggaggagcggcaggaguacgugcugacccagcagggguucaucuaccagggcagcgccaaguucaucaagaacauccccuggaacuucgggcaguucgaggacggcauccuggacaucugccucauccugcuggacgugaaccccaaguuccucaagaacgccggccgcgacugcucccggcgcagcuccccggucuacguggggcggguggucagcggcauggugaacugcaacgacgaccagggggugcugcugggccgcugggacaacaacuacggcgacggggucucccccaugagcuggaucggcuccguggacauccuccggcgcuggaagaaccacgggugccagcgggugaaguacggccagugcugggucuucgcggccguggccugcaccgugcugcgcugccuggggauccccacgcgggucgugaccaacuacaacagcgcccacgaccagaacuccaaccuccugaucgaguacuuccgcaacgaguucggcgagauccagggcgacaagagcgagaugaucuggaacuuccacugcugggucgagagcuggaugacccggcccgaccugcagccgggguacgagggcuggcaggcccucgaccccacgccccaggagaaguccgaggggaccuacugcugcggccccgugccggugcgcgcgaucaaggagggggaccugagcaccaaguacgacgcccccuucgucuucgccgaggugaacgccgacguggucgacuggauccagcaggacgacggcuccgugcacaagagcaucaaccgcucccugaucgugggccucaagaucagcaccaaguccgucgggcgggacgagcgcgaggacaucacccacacguacaaguaccccgagggcagcuccgaggagcgggaggccuucacccgcgcgaaccaccugaacaagcuggccgagaaggaggagaccgggauggccaugcggauccgcgugggccagagcaugaacaugggguccgacuucgacguguucgcccacaucaccaacaacacggccgaggaguacgucugccggcuccugcugugcgcgcgcaccgugagcuacaacggcauccucggccccgagugcgggaccaaguaccugcugaaccucaaccuggagccguucuccggcaaggcccugugcagcugguccaucugcuga

SEQ ID NO: 37628 - RNA, 2082 nt, Artificial Sequence
  derived and/or modified sequence opt1 from TGM3__Homo_sapiens__NP_003236
auggccgcccugggcgugcagagcaucaacuggcagaccgcguucaaccgccaggcccaccacaccgacaaguucuccagccaggagcucauccugcggcgcgggcagaacuuccagguccugaugaucaugaacaagggccucggguccaacgagcggcuggaguucaucgugagcacgggccccuacccguccgagagcgccaugaccaaggccguguucccccuguccaacgggagcuccggcggcuggagcgccguccuccaggcguccaacgggaacacccugaccaucagcaucuccagccccgccuccgcccccaucggccgcuacacgauggcccugcagaucuucagccagggcgggaucuccagcgugaagcucgggaccuucauccugcuguucaacccguggcucaacguggacuccgucuucaugggcaaccacgcggagcgggaggaguacgugcaggaggacgccggcaucaucuucguggggagcaccaaccgcaucggcaugaucggguggaacuucggccaguucgaggaggacauccugagcaucugccuguccauccucgaccggagccugaacuuccgccgggacgccgccaccgacgucgccucccgcaacgaccccaaguacgugggccgggugcugagcgcgaugaucaacuccaacgacgacaacgggguccucgccggcaacuggagcgggacguacaccggcgggcgcgacccccgguccuggaacggcagcguggagauccugaagaacuggaagaaguccggcuucagccccgugcgcuacgggcagugcugggucuucgccggcacccugaacaccgcccuccggucccuggggaucccgagccgcgugaucacgaacuucaacuccgcccacgacaccgaccggaaccugagcguggacgucuacuacgaccccaugggcaacccccucgacaagggguccgacagcguguggaacuuccacguguggaacgagggcugguucguccgcuccgaccugggccccagcuacgggggcuggcagguccuggacgcgaccccgcaggagcggucccaggggguguuccagugcggccccgccagcgugaucggggugcgcgagggcgacguccagcucaacuucgacaugcccuucaucuucgccgaggugaacgccgaccggaucaccuggcuguacgacaacacgaccggcaagcaguggaagaacagcgugaacucccacaccaucgggcgcuacaucagcaccaaggccgucggcuccaacgcgcgcauggacgugacggacaaguacaaguaccccgaggggagcgaccaggagcgccagguguuccagaaggcccugggcaagcucaagccgaacacccccuucgccgccaccuccagcaugggccuggagaccgaggagcaggagcccuccaucaucgggaagcugaaggucgccggcaugcucgcgguggggaaggaggugaaccugguccugcuccugaagaaccugagccgggacacgaagaccgugaccgugaacaugaccgccuggacgaucaucuacaacggcacccucguccacgagguguggaaggacuccgccaccaugagccuggaccccgaggaggaggccgagcacccgaucaagaucuccuacgcgcaguacgagaaguaccucaagagcgacaacaugauccggaucaccgccgugugcaagguccccgacgaguccgaggugguggucgagcgcgacaucauccuggacaaccccacgcugacccuggaggugcucaacgaggcccgggugcgcaagcccgucaacgugcagaugcuguucagcaacccgcuggacgagcccgugcgggacugcguccucaugguggagggguccggccugcugcugggcaaccucaagaucgacgugcccacccuggggcccaaggagggcagccgcguccgguucgacauccugccgucccgcagcgggaccaagcagcuccuggccgacuucagcugcaacaaguuccccgccaucaaggcgaugcuguccaucgacguggccgaguga

SEQ ID NO: 37629 - RNA, 2055 nt, Artificial Sequence
  derived and/or modified sequence opt1 from TGM4__Homo_sapiens__NP_003232
augauggacgccagcaaggagcuccaggugcugcacaucgacuuccugaaccaggacaacgccgucucccaccacaccugggaguuccagaccagcucccccguguuccgccggggccagguguuccaccuccgccugguccugaaccagccgcugcagagcuaccaccagcucaagcuggaguucuccacggggcccaaccccagcaucgcgaagcacacccugguggugcucgacccccggaccccguccgaccacuacaacuggcaggccacccugcagaacgagagcggcaaggaggucacgguggccgugaccuccagccccaacgccauccuggggaaguaccagcucaacgucaagaccggcaaccacauccugaaguccgaggagaacauccuguaccuccuguucaaccccuggugcaaggaggacaugguguucaugcccgacgaggacgagcgcaaggaguacauccugaacgacaccgggugccacuacgugggcgccgcgcggagcaucaagugcaagccguggaacuucggccaguucgagaagaacguccucgacugcugcaucucccugcugacggagagcucccucaagcccaccgaccgccgggaccccgugcuggugugccgcgccaugugcgccaugaugagcuucgagaaggggcagggcguccugaucgggaacuggaccggcgacuacgagggcgggaccgcccccuacaaguggacgggcuccgcgccgauccuccagcaguacuacaacaccaagcaggccgugugcuucgggcagugcuggguguucgccggcauccugaccaccguccugcgggcccucgggauccccgcccgcagcgugacgggcuucgacuccgcgcacgacaccgagcggaaccugaccguggacaccuacgucaacgagaacggcgagaagaucacgagcaugacccacgacagcguguggaacuuccacguguggaccgacgccuggaugaagcgccccgaccugcccaagggguacgacggcuggcaggccgucgacgccaccccgcaggagcggucccaggggguguucugcugcggccccagcccccucacggccauccgcaagggggacaucuucaucgucuacgacacccgguucguguucuccgaggugaacggcgaccgccugaucuggcuggucaagauggugaacggccaggaggagcuccacgugaucagcauggagaccaccuccaucgggaagaacaucagcacgaaggcggucggccaggaccggcgccgggacaucaccuacgaguacaaguaccccgagggguccagcgaggagcgccaggugauggaccacgccuuccugcugcucuccagcgagcgggagcaccgccgcccggugaaggagaacuuccugcacauguccguccagagcgacgacgugcugcucggcaacuccgugaacuucaccgucauccugaagcggaagaccgccgcccugcagaacgugaacauccucgggagcuucgagcugcagcuguacacgggcaagaagauggccaagcucugcgaccugaacaagaccucccagauccagggccaggugagcgaggucacccugacccucgacuccaagacguacaucaacagccuggcgauccuggacgacgagcccgugauccgcggguucaucaucgccgagaucguggaguccaaggagaucauggccagcgaggucuucaccagcuuccaguaccccgaguucuccaucgagcugcccaacaccggccggaucgggcagcuccuggugugcaacugcaucuucaagaacacccuggccaucccgcucaccgacgugaaguucagccuggagucccugggcaucagcucccuccagacgagcgaccacgggaccguccagcccggcgagaccauccagucccagaucaagugcacccccaucaagacgggccccaagaaguucaucgugaagcugagcuccaagcaggucaaggagaucaacgcccagaagaucgugcugaucaccaaguga

SEQ ID NO: 37630 - RNA, 1917 nt, Artificial Sequence
  derived and/or modified sequence opt1 from TGM5__Homo_sapiens__NP_004236
auggcccagggccuggagguggcccucaccgaccugcagagcucccgcaacaacguccggcaccacaccgaggagaucacgguggaccaccuccuggugcgccgggggcaggcguucaaccugacccuguacuuccgcaaccggagcuuccagcccggccucgacaacaucaucuucgucguggagaccgaggacgccguguaccuggacuccgagccgcagcgccaggaguacgucaugaacgacuacggguucaucuaccagggcagcaagaacuggauccggcccugccccuggaacuacgggcaguucgaggacaagaucaucgacaucugccugaagcuccuggacaagucccugcacuuccagaccgaccccgccacggacugcgcccuccgcggcagcccgguguacgugucccgggucgugugcgccaugaucaacagcaacgacgacaacggcgugcugaacgggaacugguccgagaacuacaccgacggcgcgaaccccgccgaguggaccgggagcgucgccauccugaagcaguggaacgccaccggcugccagcccgugcgcuacgggcagugcuggguguucgcggccgucaugugcacggugaugcggugccucggcauccccacccgcgugaucaccaacuucgacuccggccacgacaccgacgggaaccugaucaucgacgaguacuacgacaacacgggccggauccuggggaacaagaagaaggacaccaucuggaacuuccacgucuggaacgagugcuggauggcccgcaaggaccucccgcccgccuacggcggcuggcagguccuggacgccacgccccaggagaugagcaacgggguguacugcugcggccccgcguccgugcgggccaucaaggagggggagguggaccugaacuacgacaccccguucguguucagcauggucaacgccgacugcauguccuggcucgugcagggcgggaaggagcagaagcugcaccaggacaccagcuccgucggcaacuucaucagcaccaaguccauccagagcgacgagcgcgacgacaucaccgagaacuacaaguacgaggagggcagccugcaggagcgccagguguuccucaaggcccugcagaagcugaaggcccgguccuuccacgggagccagcggggcgcggagcuccagcccucccgccccaccagccugucccaggacagcccccggucccugcacacgccgagccuccgccccuccgacgugguccaggugagccugaaguucaagcugcucgacccgcccaacauggggcaggacaucugcuucgugcugcuggcccucaacauguccagccaguucaaggaccugaaggucaaccuguccgcccagagccuccugcacgacggcagcccccugucccccuucuggcaggacaccgccuucaucacccucucccccaaggaggccaagaccuaccccugcaagaucagcuacucccaguacagccaguaccugagcacggacaagcugauccgcaucuccgcgcucggggaggagaaguccagcccggagaagauccuggugaacaagaucaucacccugagcuaccccuccaucaccaucaacgugcucggcgccgccgucgugaaccagccccugagcauccaggugaucuucuccaacccccugagcgagcaggucgaggacugcgugcugaccguggagggcuccggccucuucaagaagcagcagaaggucuuccugggggugcugaagccgcagcaccaggccagcaucauccucgagacggugcccuucaaguccgggcagcggcagauccaggccaacaugcgcagcaacaaguucaaggacaucaagggcuaccggaacgucuacguggacuucgcgcuguga

SEQ ID NO: 37631 - RNA, 1878 nt, Artificial Sequence
  derived and/or modified sequence opt1 from TGM6__Homo_sapiens__NP_001241663
auggccggcauccgcgugaccaaggucgacuggcagcggagccgcaacggggccgcgcaccacacccaggaguaccccugcccggagcugguggugcggcgcggccaguccuucagccucacgcuggagcugucccgggcccucgacugcgaggagauccugaucuucaccauggagaccgggccccgcgccagcgaggcccugcacaccaaggccgucuuccagacguccgagcucgagcggggcgagggguggaccgcggcccgcgaggcccagauggagaagacccugaccgugagccuggccuccccgcccagcgcggugaucggccgguaccuccuguccauccgccugagcucccaccggaagcacagcaaccgccggcucggcgaguucguccugcuguucaaccccuggugcgccgaggacgacguguuccucgccuccgaggaggagcgccaggaguacgugcugagcgacuccgggaucaucuuccggggcgucgagaagcacauccgcgcccagggguggaacuacggccaguucgaggaggacauccugaacaucugccucagcauccuggaccggucccccgggcaccagaacaaccccgccacggacgugagcugccgccacaaccccaucuacgugacccgggucaucuccgcgauggugaacagcaacaacgaccgcggcgugguccagggccaguggcaggggaaguacggcgggggcaccagcccgcugcacuggcggggcuccguggccauccuccagaaguggcugaaggggcgcuacaagcccgugaaguacggccagugcugggucuucgccggggugcugugcaccgugcuccgcugccugggcaucgccacgcgggucgugagcaacuucaacuccgcccacgacaccgaccagaaccugagcguggacaaguacgucgacuccuucgggcgcacccucgaggaccugaccgaggacagcauguggaacuuccacguguggaacgaguccugguucgcgcggcaggaccugggccccagcuacaacggcuggcagguccucgacgccacgccccaggaggaguccgaggggguguuccgcugcggcccggccagcgugaccgccauccgggagggggacguccaccuggcccacgacggccccuucguguucgcggaggugaacgccgacuacaucaccuggcuguggcacgaggacgagucccgcgagcgggucuacagcaacaccaagaagaucgggcgcugcaucuccacgaaggccgugggcagcgacucccggguggacaucaccgaccucuacaaguaccccgagggcagccgcaaggagcggcaggucuacuccaaggccgugaaccgccuguucgggguggaggccagcggccggcgcaucuggauccggcgcgccgggggccggugccuguggcgcgacgaccuccuggagcccgcgaccaagccguccaucgccgggaaguucaagguccuggagccgcccaugcucggccacgaccugcggcuggcccucugccuggcgaaccugaccagccgcgcccagcgcgugcgggugaaccucagcggcgccacgauccuguacacccgcaagcccgucgccgagauccugcacgagucccacgccgugcggcucgggccccaggaggagaagcgcauccccaucaccaucagcuacuccaaguacaaggaggaccugaccgaggacaagaagauccugcuggcggccaugugccucgugacgaagggcgagaagcugcuggucgagaaggacaucacccucgaggacuucaucaccaucaagcgggccuaccccggggccagcggcgagggccugucccccguguga

SEQ ID NO: 37632 - RNA, 2133 nt, Artificial Sequence
  derived and/or modified sequence opt1 from TGM7__Homo_sapiens__NP_443187
auggaccagguggccacccugcgccucgagagcgucgaccugcaguccagccggaacaacaaggagcaccacacccaggagaugggcgugaagcgccugacggugcggcgcgggcagcccuucuaccuccggcuguccuucagccgcccguuccagucccagaacgaccacaucaccuucgucgccgagaccggccccaagcccagcgagcugcucgggacccgggcgacguucuuccugacccgcgugcagcccggcaacgugugguccgccagcgacuucaccaucgacuccaacagccugcaggucucccucuucaccccggccaacgccgugaucgggcacuacacgcugaagaucgagaucagccagggccagggccacuccgugaccuacccccuggggaccuucauccuccuguucaaccccuggagccccgaggacgacgucuaccugccguccgagauccuccugcaggaguacaucaugcgggacuacggcuucguguacaaggggcacgagcgcuucaucaccagcuggcccuggaacuacggccaguucgaggaggacaucaucgacaucugcuucgagauccugaacaagucccucuaccaccugaagaaccccgccaaggacugcagccagcggaacgacguggucuacgugugccgcguggucuccgcgaugaucaacagcaacgacgacaacggggugcugcagggcaacuggggcgaggacuacagcaagggggugagcccccucgaguggaagggcuccgucgccauccugcagcagugguccgcccgcgggggccagccggugaaguacggccagugcuggguguucgccagcgucaugugcacggugaugcggugccugggggugcccacccgggucguguccaacuuccgcagcgcgcacaacgucgaccggaaccucaccaucgacaccuacuacgaccgcaacgccgagaugcuguccacgcagaagcgggacaagaucuggaacuuccacguguggaacgagugcuggaugauccgcaaggaccugccgcccggcuacaacggguggcagguccucgaccccacgccccagcagaccagcuccggccuguucugcugcgggcccgccagcgugaaggccauccgggagggcgacgugcaccuggccuacgacacccccuucguguacgcggaggucaacgccgacgaggugaucuggcuccugggcgacgggcaggcccaggagauccuggcccacaacaccuccagcaucggcaaggagaucuccaccaagaugguggggagcgaccagcgccaguccaucaccagcuccuacaaguacccggagggcagccccgaggagcgcgccgucuucaugaaggcgucccggaagaugcucgggccccagcgcgccagccugcccuuccuggaccuccuggagagcggcggccugcgggaccagccggcccagcuccagcugcaccuggcccgcauccccgagugggggcaggaccuccagcugcugcuccggauccagcgcgugcccgacuccacccacccccggggcccgaucgggcuggugguccgcuucugcgcccaggcgcugcuccacggcgggggcacgcagaagcccuucuggcggcacaccgugcgcaugaaccuggacuucggcaaggagacccaguggccccugcugcucccguacagcaacuaccggaacaagcugaccgacgagaagcugauccgcguguccgggaucgccgaggucgaggagacgggccggagcaugcucgugcugaaggacaucugccuggagccgccccaccucuccaucgaggugagcgagcgcgccgaggucgggaaggcccugcgggugcacgugacccugaccaacacccucauggucgcccuguccagcugcacgauggugcuggagggcuccggccucaucaacgggcagaucgcgaaggaccugggcacccugguggccgggcacacccuccagauccagcuggaccuguaccccaccaaggccggcccccgccagcuccagguccugaucagcuccaacgaggugaaggagaucaagggguacaaggacaucuucgugacggucgccggcgcgcccuga

SEQ ID NO: 37633 - RNA, 1362 nt, Artificial Sequence
  derived and/or modified sequence opt1 from TGOLN2__Homo_sapiens__NP_001193770
augcgcuucguggucgcccuggugcuccugaacguggccgcggccggcgccgucccccugcucgccaccgagagcgugaagcaggaggaggccggggugcggccguccgcgggcaacgucagcacccaccccucccugagccagcgccccgggggcuccacgaagucccaccccgagccgcagacccccaaggacucccccagcaaguccagcgccgaggcccagacccccgaggacaccccgaacaaguccggggccgaggcgaagacgcagaaggacagcuccaacaagagcggcgccgaggccaagacccagaagggcuccaccagcaaguccgggagcgaggcccagaccacgaaggacuccaccagcaagagccaccccgagcugcagacccccaaggacuccaccggcaagagcggggccgaggcgcagacgcccgaggacuccccgaaccggagcggcgccgaggccaagacccagaaggacucccccagcaaguccgggagcgaggcccagaccaccaaggacgugcccaacaaguccggcgccgacggccagacgcccaaggacgggagcuccaagagcggcgcggaggaccagaccccgaaggacgugcccaacaaguccggggccgagaagcagacccccaaggacggcagcaacaaguccggcgccgaggagcaggggcccaucgacggcccgagcaaguccggggccgaggagcagaccagcaaggacucccccaacaaggucgugcccgagcagcccagccgcaaggaccacagcaagccgaucuccaaccccagcgacaacaaggagcuccccaaggccgacacgaaccagcuggcggacaagggcaagcugagcccccacgccuucaagaccgagagcggggaggagaccgaccucaucuccccgccccaggaggaggucaagagcuccgagcccaccgaggacguggagccgaaggaggccgaggacgacgacacgggccccgaggagggcagcccgcccaaggaggagaaggagaagauguccgggagcgccuccagcgagaaccgggagggcacccuguccgacagcaccggguccgagaaggacgaccuguaccccaacggcagcgggaacggcuccgccgagagcagccacuucuucgcguaccucgugaccgccgccauccugguggccguccuguacaucgcgcaccacaacaagcgcaagaucaucgccuucgugcucgagggcaagcgguccaaggugacgcgccggcccaaggccagcgacuaccagcgccuggaccagaagaucuucuucccgcccucccccaaccggauggucuacagcuccgggaagcgcuga

SEQ ID NO: 37634 - RNA, 2562 nt, Artificial Sequence
  derived and/or modified sequence opt1 from TGS1__Homo_sapiens__NP_079107
augugcugcgagaaguggagccgcguggccgagauguuccuguucaucgaggagcgggaggacugcaagauccucugccugugcucccgcgccuucgucgaggaccggaagcuguacaaccucggccugaagggguacuacauccgcgacagcggcaacaacuccggggaccaggcgaccgaggaggaggagggcggguacagcugcggcaccgccgagucccacgacagcaagggcaucgggcuggacgaguccgagcucgacagcgaggccgagcugaugcgguccaugggccugccccuccaguucgggcgcaucacggcccacaaggacuucgaggugagcaugaacacccggaacaaggugaagaucaagaagaagaagcaccagaagaaguaccuggacgagaucguccaggaguccuggcgcaaggaguacgaggaggacgacauccuggccagcgacgacccguccagcaucgagcaguacgagaacacccggaccuacgagcuccaguccaagaaggacacggagaccgagaacccgcccguggagaacacccugagccccaagcuggagaucaccgagaagugggagaaguacuggaacgaguacggcgggggccuccuguggcaguccuggcaggagaagcacccgggccaggcgcugagcuccgagcccuggaacuuccccgacacgaaggaggagugggagcagcacuacagccagcucuacugguacuaccuggagcaguuccaguacugggaggcccagggguggaccuucgacgccagccaguccugcgacaccgacaccuacacgagcaagaccgaggccgacgacaagaacgacgagaagugcaugaagguggaccuggucuccuuccccagcuccccgaucaugguggacaacgacagcuccggcaccagcgacaaggaccacuccgagauccucgacgggaucagcaacaucaagcugaacuccgaggaggugacccagagccagcuggacuccugcacgagccacgacggccaccagcagcucuccgaggucagcuccaagcgcgagugccccgcgagcggccaguccgagccccggaacgggggcaccaacgaggagagcaacagcuccgggaacaccaacaccgacccgcccgccgaggacagccagaaguccagcggcgccaacacguccaaggaccgcccccacgccagcgggaccgacggcgacgaguccgaggaggacccgcccgagcacaagcccagcaagcugaagcggucccacgagcuggacaucgacgagaaccccgccagcgacuucgacgacuccggcagccuccugggguucaaguacggcuccgggcagaaguacggcgggauccccaacuucagccaccgccaggugcgguaccuggagaagaacgugaagcucaaguccaaguaccuggacaugcgccggcagaucaagaugaagaacaagcacaucuucuucaccaaggagagcgagaagcccuucuucaagaaguccaagauccugagcaaggucgagaaguuccucaccugggugaacaagccgauggacgaggaggcgagccaggaguccagcucccacgacaacgugcacgacgccagcacguccagcgacuccgaggagcaggacaugagcgucaagaagggcgacgaccugcuggagaccaacaaccccgagcccgagaagugccaguccgugagcuccgccggcgagcucgagaccgagaacuacgagcgcgacagccugcuggccaccgugcccgacgagcaggacugcgucacgcaggaggugccggacucccggcaggccgagaccgaggcggaggugaagaagaagaagaacaagaagaagaacaagaaggucaacgggcucccgcccgagaucgccgccgugcccgagcuggccaaguacugggcccagcgcuaccggcuguucagccgcuucgacgacggcaucaagcucgaccgcgaggggugguucuccgugacccccgagaagaucgcggagcacaucgccggccgggucagccaguccuucaagugcgacguggucguggacgccuucugcggggugggcggcaacaccauccaguucgcccugacggggaugcgcgucaucgccaucgacaucgaccccgugaagaucgcgcuggcccggaacaacgccgagguguacggcaucgccgacaagaucgaguucaucugcggggacuuccuccugcuggcgagcuuccucaaggccgacgucguguuccuguccccgcccuggggcggccccgacuacgccaccgccgagaccuucgacauccgcaccaugaugagccccgacggguucgagaucuuccggcugagcaagaagaucacgaacaacaucguguacuuccugccccgcaacgccgacaucgaccaggucgcgucccucgccggccccgggggccagguggagaucgagcagaacuuccugaacaacaagcugaagaccaucaccgccuacuucggggaccucauccggcgccccgccagcgagaccuga

SEQ ID NO: 37635 - RNA, 5862 nt, Artificial Sequence
  derived and/or modified sequence opt1 from THADA__Homo_sapiens__NP_001077422
augggcgugaagaagaagaaggagaugcaggucgccgcccugaccaucugccaccaggaccucgagacccucaagagcuucgcggacguggaggggaagaaccuggccagccuccugcugcacugcgugcagcucaccgacggcgugagccagauccacuacaucaagcagaucgugccccugcuggagaaggccgacaagaacgggaugugcgacccgaccauccaguccugccucgacauccuggccggcaucuaccugagccucucccugaagaacccccugaagaaggugcucgccagcucccugaacagccugcccgacuucuuccuccccgaggcgaugcaccgcuucaccucccggcugcaggaggagcugaacaccacggaccucuacagcuaccgcaaggugaccgacaacaucuccagcugcauggagaacuucaaccuggggcgggccuccgugaacaaccugcucaagaacgugcugcacuuccugcagaagucccucaucgagauccuggaggagaaccgcaagugcgccggcaaccacaucauccagacccagcugaugaacgaccuccuggugggcauccggguguccaugaugcuggugcagaagguccaggacuuccaggggaaccucuggaagaccagcgacucccccaucuggcagaacaugugcggccugcugagcaucuucacgaaggugcucuccgacgacgaccugcugcagaccgugcagagcaccagcgggcucgccaucauccuguucaucaagaccauguuccaccccuccgagaagaucccccaccugaucagcuccguccuccugcgcagcguggacugcacguccgugcccgagugguucaugagcuccugccggagccugugcugcggcgacaucucccagagcgcgguccucuuccugugccaggggacccuggccaugcucgacuggcagaacggcuccaugggccgcagcggggaggcccugcugcuggacaccgcccacguccuguucacccuguccagccagaucaaggagccgacgcuggagauguuccucucccggauccuggccagcuggaccaacuccgcgauccaggugcuggagagcuccagccccagccucaccgacucccugaacggcaacagcuccaucgucgggcgccugcucgaguacguguacacccacugggagcacccccuggacgcccugcggcaccagacgaagaucauguucaagaaccuccugcagaugcaccgccugaccguggagggcgccgacuucguccccgacccguucuucguggagcucaccgagagccugcugcggcucgaguggcacaucaagggcaaguacacgugccuggggugccuggucgagugcaucggcguggagcacauccucgccaucgacaagacgauccccucccagauccuggaggugaugggggaccagagccugguccccuacgccuccgaccuccuggagaccauguuccgcaaccacaagagccaccugaagucccagaccgcggagagcuccuggaucgaccaguggcacgagaccugggugagcccccuccuguucauccugugcgagggcaaccucgaccagaaguccuacgugaucgacuacuaccugccgaagcugcucagcuacucccccgagagccugcaguacauggucaagauccugcagacguccaucgacgccaagaccgggcaggagcagagcuuccccagccucggcuccugcaacagccggggcgcccugggggcccugauggccugccuccgcaucgcgcgggcccacggccaccuccaguccgccaccgacaccugggagaaccuggugagcgacgcccgcaucaagcaggggcucauccaccagcacugccaggugcggaucgacacgcugggccugcucugcgaguccaaccgcagcaccgagaucgucuccauggaggagaugcaguggauccaguucuucaucaccuacaaccugaacagccagucccccggggugcggcagcagaucugcagccugcucaagaagcuguucugccgcauccaggaguccagccaggugcuguacaagcucgagcaguccaagagcaagcgcgagccggagaacgagcugaccaagcagcaccccuccgucagccugcagcaguacaagaacuucauguccagcaucugcaacucccucuucgaggcccuguuccccggcagcagcuacuccacgcgguucagcgcgcugaccauccucggcuccaucgccgagguguuccacgugcccgaggggcgcaucuacaccgucuaccagcugagccacgacaucgacgugggccgguuccagacccugauggagugcuucaccuccacguucgaggacgugaagauccucgccuucgaccugcugaugaagcucagcaagaccgccguccacuuccaggacuccgggaagcugcagggccuguuccaggcggcccucgagcugagcaccuccaccaagccguacgacugcgugacggccagcuaccugcucaacuuccugaucuggcaggacgcccugcccuccagccucuccgccuaccugacccagcaggucgcgugcgacaacggggaccgccccgccgccgucguggagcggaacacccugauggugaucaagugccucauggagaaccuggaggaggaggucagccaggccgagaacucccugcuccaggccgcggccgccuuccccauguacggccgcgugcacugcaucaccggcgcccugcagaagcugagccucaacucccugcagcuggugagcgaguggcggccggucguggagaagcuccugcugauguccuaccgccucagcacgguggucagccccgugauccaguccagcucccccgaggggcugaucccgauggacaccgacagcgaguccgccagccggcugcagaugauccucaacgagauccagccccgcgacaccaacgacuacuucaaccaggcgaagauccugaaggagcacgacuccuucgacaugaaggaccugaacgccagcguggucaacaucgacaccuccacggagaucaagggcaaggaggugaagaccugcgacgugaccgcccagaugguccucgugugcugcuggcggagcaugaaggagguggcccugcugcuggggaugcucugccagcugcugcccaugcagcccgucccggaguccagcgacggccuccugaccguggagcaggucaaggagaucggcgacuacuucaagcagcaccuccugcagucccgccaccgcggggcguucgagcuggccuacacgggcuucgucaagcugaccgaggugcugaaccgcugccccaacgugagccugcagaagcugcccgagcaguggcucugguccguccuggaggagaucaagugcagcgaccccuccagcaagcugugcgccacccggcgcuccgccgggaucccguucuacauccaggcccuccuggcgagcgagcccaagaagggccggauggaccugcucaagaucaccaugaaggagcugaucagccuggccgggcccacggacgacauccaguccaccgugccccaggugcacgcccucaacauccugcgcgcccuguuccgggacacccgccucggcgagaacaucaucccguacgucgccgacggcgcgaaggccgccauccugggguucaccagccccgugugggccgugcgcaacuccagcacgcuccuguucuccgcccugaucacccggaucuucggcgucaagcgcgcgaaggacgagcacagcaagaccaaccggaugaccgggcgcgaguucuucucccgguuccccgagcuguaccccuuccuccugaagcagcuggagacgguggccaacaccgucgacagcgacaugggcgagccgaaccgccaccccuccauguuccuccugcugcucgugcuggagcggcuguacgccagccccauggacgggaccuccagcgcccucuccaugggccccuucgugccguucaucaugcgcugcggccacagccccgucuaccacucccgggagauggcggcccgcgcccuggugcccuucgugaugaucgaccacauccccaacaccauccggacgcugcucagcacccugccguccugcaccgaccagugcuuccgccagaaccacauccacgggacccugcuccaggucuuccaccuccugcaggccuacagcgacuccaagcacggcacgaacagcgacuuccagcacgagcucaccgacaucaccgugugcaccaaggccaagcuguggcuggcgaagcggcagaaccccugccucgugacccgcgccgucuacaucgacauccuguuccugcucacgugcugccugaaccggagcgccaaggacaaccagcccgugcuggagucccucggguucugggaggaggugcgcggcaucaucagcggguccgagcugaucaccggcuucccgugggccuucaagguccccggccugccccaguaccuccagagccugacccggcuggccaucgcggccgugugggccgccgccgcgaaguccggggagcgcgagaccaacgugcccaucagcuucucccagcuccuggagagcgccuucccggagguccggucccugacgcucgaggcccugcuggagaaguuccucgccgccgcgagcggccugggggagaagggcgugccgccccugcucugcaacaugggggagaaguuccugcugcucgccaugaaggagaaccaccccgagugcuucugcaagauccugaagauccugcacugcauggacccgggcgaguggcucccccagaccgagcacugcgugcaccugacccccaaggaguuccugaucuggaccauggacaucgccuccaacgagcgcagcgagauccaguccgucgcccuccggcuggcgagcaaggugaucucccaccacaugcagacgugcguggagaaccgcgagcugaucgccgccgagcucaagcaguggguccagcuggugauccugagcugcgaggaccaccuccccaccgagucccgccuggccguggucgaggugcugaccagcaccacgccccuguuccugaccaacccccaccccauccuggagcuccaggacacccuggcccuguggaagugcgugcucacccugcugcaguccgaggagcaggcgguccgggacgccgccacggagaccgugaccaccgccaugagccaggagaacacgugccagagcaccgaguucgccuucugccagguggacgcguccaucgcccucgcccuggcccuggccguccugugcgaccuccugcagcagugggaccagcuggcgcccggccucccgauccugcugggguggcuccugggcgagagcgacgaccugguggccugcguggaguccaugcaccaggucgaggaggacuaccucuucgagaaggccgaggugaacuucugggccgagacccugaucuucgugaaguaccugugcaagcaccucuucugccugcugagcaaguccggguggcggccgcccagccccgagaugcucugccaccuccagcggauggucuccgagcagugccaccuccugagccaguucuuccgcgagcugccgcccgcggccgaguucgugaagaccguggaguucacgcggcugcgcauccaggaggagcggacccuggccugccugcgccugcucgccuuccuggagggcaaggagggcgaggacacccugguccucuccgugugggacagcuacgccgagucccggcagcugacccugccccgcacggaggcggccugcuga

SEQ ID NO: 37636 - RNA, 774 nt, Artificial Sequence
  derived and/or modified sequence opt1 from THAP10__Homo_sapiens__NP_064532
augcccgcccgcugcguggccgcgcacugcggcaacaccaccaagagcgggaagucccuguuccgguucccgaaggaccgcgccguccggcuccugugggaccgcuucgugcggggcugccgcgccgacugguacgggggcaacgaccggagcgugaucugcuccgaccacuucgcccccgccugcuucgacgucagcuccgugauccagaagaaccugcgcuucagccagcggcuccgccugguggcgggggccguccccacgcugcaccgggugcccgccccggcccccaagcgcggcgaggagggcgaccaggcggggcggcucgacacccgcggcgagcugcaggccgcccggcacuccgaggccgcccccgggcccgugagcugcacccgcccgcgggcgggcaagcaggccgccgccucccagaucacgugcgagaacgagcugguccagacccagccccacgccgacaaccccagcaacaccgugaccuccgugcccacccacugcgaggaggggccgguccacaagagcacgcagaucucccucaagcgcccccggcaccgcagcgugggcauccaggcgaaggugaaggccuucggcaagcggcugugcaacgccaccacccagaccgaggagcuguggucccgcacgagcucccucuucgacaucuacagcuccgacagcgagaccgacaccgacugggacaucaagagcgagcaguccgaccugagcuacauggccguccaggugaaggaggagaccugcuga

SEQ ID NO: 37637 - RNA, 945 nt, Artificial Sequence
  derived and/or modified sequence opt1 from THAP11__Homo_sapiens__NP_065190
augcccggcuucacgugcugcgugccggggugcuacaacaacagccaccgcgacaaggcccugcacuucuacaccuuccccaaggacgccgagcuccggcgccuguggcugaagaacgucucccgggcgggcgugagcgggugcuucuccaccuuccagcccaccaccggccaccgccucugcagcgugcacuuccagggcgggcggaagaccuacacgguccgcgugcccaccaucuucccgcugcggggcgugaacgagcgcaaggucgcccggcgccccgccggggccgccgcggcccggcgccggcagcagcagcagcagcagcagcagcagcagcagcagcagcagcagcagcagcagcagcagcagcagcagcagcagcagcagcagcaguccagccccuccgccagcaccgcccagaccgcgcagcugcagcccaaccucguguccgccagcgccgccgugcugcugacgcuccaggccaccgucgacuccagccaggcgccgggcuccgugcagcccgcccccaucacccccaccggggaggacgugaagccgaucgaccugacgguccagguggaguucgccgccgccgagggcgcggccgccgccgccgcggccagcgagcugcaggccgccaccgccgggcucgaggcggccgagugccccaugggcccccagcugguggucgugggcgaggagggguuccccgacaccggcuccgaccacagcuacucccugagcuccgggaccacggaggaggagcuccugcgcaagcugaacgagcagcgggacauccucgcccugauggaggugaagaugaaggagaugaagggcagcauccgccaccuccggcugaccgaggccaagcugcgcgaggagcugcgggagaaggaccgccuccuggcgauggccgucauccggaagaagcacggcauguga

SEQ ID NO: 37638 - RNA, 642 nt, Artificial Sequence
  derived and/or modified sequence opt1 from THAP1__Homo_sapiens__NP_060575
auggugcagagcugcuccgccuacggcugcaagaaccgcuacgacaaggacaagcccgucagcuuccacaaguucccccugacccggcccucccucugcaaggagugggaggccgcggugcgccggaagaacuucaagcccaccaaguacagcuccaucugcagcgagcacuucacgcccgacugcuucaagcgcgagugcaacaacaagcugcugaaggagaacgccgugccgaccaucuuccucugcaccgagccccacgacaagaaggaggaccugcuggagccccaggagcagcucccgcccccgccccugcccccgcccgucucccagguggacgccgccaucgggcugcucaugccgccccugcagacccccgugaaccugagcgucuucugcgaccacaacuacacgguggaggacaccaugcaccagcggaagcgcauccaccagcucgagcagcaggucgagaagcugcggaagaagcugaagaccgcccagcagcgcugccggcgccaggagcggcagcucgagaagcugaaggagguggugcacuuccagaaggagaaggacgacguguccgagcgcggcuacgucauccugcccaacgacuacuucgagaucguggaggugcccgcguga

SEQ ID NO: 37639 - RNA, 687 nt, Artificial Sequence
  derived and/or modified sequence opt1 from THAP2__Homo_sapiens__NP_113623
augcccaccaacugcgccgccgcgggcugcgccaccacguacaacaagcacaucaacaucagcuuccaccgcuucccgcuggaccccaagcggcgcaaggagugggugcggcucguccgccggaagaacuucgugcccgggaagcacaccuuccugugcuccaagcacuucgaggccagcugcuucgaccugaccggccagacccgccggcucaagauggacgccgugcccacgaucuucgacuucugcacccacaucaaguccaugaagcucaagagccgcaaccugcugaagaagaacaacuccugcagcccggccgggcccuccaaccucaagagcaacaucuccagccagcagguccugcuggagcacuccuacgcguuccggaaccccauggaggccaagaagcgcaucaucaagcuggagaaggagaucgccagccugcggcgcaagaugaagaccugccuccagaaggagcggcgcgccacccggcgcuggaucaaggcgacgugccuggugaagaaccuggaggccaacuccgugcuccccaagggcaccagcgagcacaugcugccgaccgcccuguccagccucccccuggaggacuucaagauccuggagcaggaccagcaggacaagacccuccugucccugaaccucaagcagaccaagagcacguucaucuga

SEQ ID NO: 37640 - RNA, 669 nt, Artificial Sequence
  derived and/or modified sequence opt1 from THAP6__Homo_sapiens__NP_653322
auggugaagugcugcagcgccaucggcugcgccucccgcugccugcccaacagcaagcucaaggggcugaccuuccacgucuucccgaccgacgagaacaucaagcggaagugggugcuggcgaugaagcgccucgacgugaacgccgccggcaucugggagcccaagaagggggacguccugugcucccggcacuucaagaagacggacuucgaccgcagcgcccccaacaucaagcugaagcccggcgugaucccguccaucuucgacagccccuaccaccuccaggggaagcgggagaagcugcacugccgcaagaacuucacccugaagaccgugcccgccaccaacuacaaccaccaccucgucggcgcguccagcugcaucgaggaguuccagucccaguucaucuucgagcacagcuacuccgugauggacagccccaagaagcugaagcacaagcuggaccacgugaucggcgagcucgaggacacgaaggagucccugcggaacguccuggaccgcgagaagcgguuccagaagucccuccgcaagaccauccgggagcugaaggacgagugccugaucagccaggagaccgccaaccgccucgacaccuucugcugggacugcugccaggagagcaucgagcaggacuacaucuccuga

SEQ ID NO: 37641 - RNA, 1728 nt, Artificial Sequence
  derived and/or modified sequence opt1 from THBD__Homo_sapiens__NP_000352
augcugggcgugcucguccugggggcccuggcccucgcgggccugggguuccccgccccggccgagccccagcccggcgggagccagugcguggagcacgacugcuucgcccuguaccccggcccggccaccuuccucaacgcgucccagaucugcgacggccugcgcgggcaccugaugaccgugcggagcuccgucgccgccgacgugaucagccuccugcugaacggcgacgggggcguggggcgccggcgccucuggaucggccugcagcugccgcccggcugcggggaccccaagcggcucggcccccugcgcggguuccagugggucaccggcgacaacaacaccuccuacagccggugggcccgccuggaccucaacggcgcgccccugugcgggccccugugcguggccguguccgccgccgaggccaccguccccagcgagccgaucugggaggagcagcagugcgaggugaaggcggacggcuuccucugcgaguuccacuuccccgcgaccugccggccccuggccguggagcccggggccgccgccgccgccgucuccaucacguacggcaccccguucgccgcccgcggggcggacuuccaggcccugcccgugggcagcuccgccgccguggccccgcucggccugcagcugaugugcaccgcgccgcccggggccguccagggccacugggcccgggaggcccccggggcgugggacugcagcguggagaacggcgggugcgagcacgccugcaacgccauccccggcgcgccccgcugccagugccccgccggcgccgcccuccaggccgacgggcgguccugcaccgccagcgccacgcaguccugcaacgaccugugcgagcacuucugcgugcccaaccccgaccagcccggcagcuacuccugcaugugcgagaccggguaccgccuggcggccgaccagcaccggugcgaggacgucgacgacugcauccucgagccgagccccugcccccagcgcugcgugaacacccagggcggguucgagugccacugcuacccgaacuacgaccugguggacggcgagugcgucgagcccguggaccccugcuuccgggccaacugcgaguaccagugccagccccugaaccagaccuccuaccucugcgugugcgccgagggcuucgccccgaucccccacgagccccaccgcugccagauguucugcaaccagacggcgugccccgccgacugcgacccgaacacccaggccagcugcgagugccccgagggguacauccuggacgacggcuucaucugcaccgacaucgacgagugcgagaacgggggcuucugcagcggcgucugccacaaccugcccgggaccuucgagugcaucugcggccccgacuccgcccucgcgcggcacaucgggacggacugcgacagcggcaagguggacgggggcgacuccggcagcggggagccgccgcccucccccacccccggcagcacccugaccccgcccgccgucgggcuggugcacuccggccuccugaucgggaucagcaucgccucccugugccucguggucgcccugcuggcccuccugugccaccuccgcaagaagcagggcgcggcccgggccaagauggaguacaagugcgccgcccccagcaaggagguggugcugcagcacguccgcacggagcgcacgccccagcggcuguga

SEQ ID NO: 37642 - RNA, 3513 nt, Artificial Sequence
  derived and/or modified sequence opt1 from THBS1__Homo_sapiens__NP_003237
augggccuggccugggggcucggcgugcuguuccugaugcacgucugcgggaccaaccgcauccccgagagcggcggggacaacuccguguucgacaucuucgagcucaccggcgccgcgcggaagggcagcgggcgccggcuggugaagggcccggaccccuccagccccgccuuccgcaucgaggacgccaaccugaucccgcccguccccgacgacaaguuccaggaccucguggacgccgugcgggccgagaagggguuccugcugcucgcgucccugcgccagaugaagaagacgcggggcacccugcucgcccuggagcgcaaggaccacagcgggcaggucuucuccguggugagcaacggcaaggccggcacccuggaccucucccugaccguccaggggaagcagcacguggugagcgucgaggaggcccugcucgcgacgggccaguggaaguccaucacccuguucgugcaggaggaccgggcccagcuguacaucgacugcgagaagauggagaacgccgagcucgacgugcccauccagagcgucuucacccgcgaccuggccuccaucgcccggcugcgcaucgcgaagggcggggugaacgacaacuuccagggcgugcuccagaacguccgguucguguucgggaccacgcccgaggacauccugcgcaacaagggcugcagcuccagcaccuccgugcugcucacccuggacaacaacgucgugaacgggagcuccccggccauccggaccaacuacaucggccacaagacgaaggaccugcaggccaucugcgggaucagcugcgacgagcucagcuccauggugcuggagcugcgcggccuccggaccaucgucaccacccugcaggacagcauccgcaaggugacggaggagaacaaggagcuggccaacgagcuccggcgcccgccccugugcuaccacaacggcguccaguaccggaacaacgaggaguggaccguggacuccugcaccgagugccacugccagaacagcgugaccaucugcaagaaggucuccugccccaucaugcccugcagcaacgccacggugcccgacggggagugcugcccccgcugcuggcccuccgacagcgcggacgacggcugguccccguggagcgaguggaccuccugcagcaccuccugcgggaacggcauccagcagcgcgggcggagcugcgacucccugaacaaccgcugcgagggcagcuccgugcagacccggacgugccacauccaggagugcgacaagcgcuucaagcaggacggcggguggagccacuggucccccuggagcagcugcuccgugaccugcggcgacggggugaucacccggauccgccucugcaacagccccagcccccagaugaacggcaagccgugcgagggggaggcccgggagaccaaggccugcaagaaggacgccugccccaucaacggcggcugggggcccuggucccccugggacaucugcuccgugacgugcggcgggggcguccagaagcgcagccggcugugcaacaacccgacgccccaguucggcgggaaggacugcgugggcgacgugaccgagaaccagaucugcaacaagcaggacugccccaucgacgggugccuguccaaccccugcuucgccggcgucaagugcaccagcuacccggacggguccuggaagugcggcgcgugcccgcccggcuacagcgggaacggcauccagugcaccgacguggacgagugcaaggaggugcccgacgccugcuucaaccacaacggggagcaccgcugcgagaacaccgaccccggcuacaacugccuccccugcccgccccgguucaccgggucccagcccuucggccagggcgucgagcacgccaccgccaacaagcaggucugcaagccccgcaaccccugcacggacgggacccacgacugcaacaagaacgccaagugcaacuaccugggccacuacagcgacccgauguaccggugcgagugcaagcccggguacgcgggcaacgggaucaucugcggcgaggacaccgaccuggacggcuggcccaacgagaaccucgugugcgucgccaacgccaccuaccacugcaagaaggacaacugccccaaccugccgaacuccgggcaggaggacuacgacaaggacggcaucggggacgccugcgacgacgacgacgacaacgacaagauccccgacgaccgcgacaacugccccuuccacuacaaccccgcgcaguacgacuacgaccgggacgacgugggcgaccgcugcgacaacugcccguacaaccacaaccccgaccaggccgacaccgacaacaacggggagggcgacgccugcgccgccgacaucgacggcgacgggauccugaacgagcgggacaacugccaguacguguacaacgucgaccagcgcgacacggacauggacggcgugggggaccagugcgacaacugcccccucgagcacaaccccgaccagcuggacagcgacuccgaccggaucggcgacacgugcgacaacaaccaggacaucgacgaggacggccaccagaacaaccuggacaacugcccguacgugcccaacgcgaaccaggccgaccacgacaaggacgggaagggcgacgccugcgaccacgacgacgacaacgacgggauccccgacgacaaggacaacugccgccugguccccaacccggaccagaaggacagcgacggcgacgggcgcggcgacgccugcaaggacgacuucgaccacgacuccgugcccgacaucgacgacaucugccccgagaacguggacaucagcgagaccgacuuccggcgcuuccagaugaucccgcucgaccccaagggcaccagccagaacgaccccaacugggucgugcggcaccaggggaaggagcuggugcagaccgucaacugcgaccccggccuggccgugggguacgacgaguucaacgcgguggacuucuccggcaccuucuucaucaacaccgagcgcgacgacgacuacgccggguucgucuucggcuaccagagcuccagccgguucuacguggugauguggaagcaggucacccaguccuacugggacacgaacccgacccgcgcccagggcuacagcgggcucuccgugaagguggucaacagcaccaccggccccggggagcaccuccggaacgcccuguggcacacgggcaacacccccggccaggugcgcacccuguggcacgacccccggcacaucggguggaaggacuucaccgccuaccgcuggcggcugucccaccgcccgaagacgggcuucauccggguggucauguacgaggggaagaagaucauggcggacagcggccccaucuacgacaagaccuacgccgggggccgccugggccucuucguguucucccaggagaugguguucuucagcgaccugaaguacgagugccgggaccccuga

SEQ ID NO: 37643 - RNA, 3519 nt, Artificial Sequence
  derived and/or modified sequence opt1 from THBS2__Homo_sapiens__NP_003238
augguguggcgccugguccuccuggcccuguggguguggcccagcacccaggccggccaccaggacaaggacaccacguucgaccucuucuccaucagcaacaucaaccggaagaccaucggggcgaagcaguuccgcggcccggaccccggggugcccgccuaccgguucguccgcuucgacuacaucccgcccgugaacgccgacgaccuguccaagaucaccaagaucaugcggcagaaggagggcuucuuccugaccgcccagcucaagcaggacggcaagagccgcgggacgcugcuggcccucgagggccccgggcugucccagcggcaguucgagaucgugagcaacggccccgcggacacccuggaccucaccuacuggaucgacgggacccgccacgucgugucccuggaggacgugggccuggccgacagccaguggaagaacgucacgguccagguggccggggagaccuacucccuccacgugggcugcgaccugaucgacagcuucgcccuggacgagcccuucuacgagcaccuccaggcggagaagucccggauguacguggccaagggcagcgcccgcgagucccacuuccgggggcugcugcagaacgugcaccucgucuucgagaacagcguggaggacauccuguccaagaagggcugccagcaggggcagggcgccgagaucaacgccaucagcgagaacaccgagacccugcgccucggcccgcacgugacgaccgaguacgucgggcccuccagcgagcggcgccccgaggugugcgagcgguccugcgaggagcugggcaacauggugcaggagcugagcgggcuccacguccuggugaaccagcugagcgagaaccucaagcgcguguccaacgacaaccaguuccugugggagcugaucggcgggcccccgaagacccggaacaugagcgcgugcuggcaggacggccgcuucuucgccgagaacgagaccugggucguggacuccugcacgaccugcacgugcaagaaguucaagaccaucugccaccagaucacgugcccgcccgcgaccugcgccagccccuccuucgucgagggcgagugcugccccagcugccuccacuccguggacggggaggagggcuggagccccugggccgaguggacccagugcuccgugaccugcgggagcggcacccagcagcgggggcgcuccugcgacgucaccagcaacacgugccugggccccuccauccagacccgggcgugcagccuguccaagugcgacacccgcauccgccaggacggcggguggagccacuggucccccuggagcuccugcagcgugaccugcggcguggggaacaucacccggauccgccucugcaacagcccggucccccagaugggcgggaagaacugcaagggcuccggccgggagaccaaggccugccagggggcccccugccccaucgacggccgcuggagcccguggucccccuggagcgccugcacggugaccugcgccgggggcauccgggagcgcacccgggugugcaacucccccgagccccaguacggcgggaaggcgugcgucggcgacgugcaggagcgccagaugugcaacaagcggagcugcccgguggacgggugccuguccaaccccugcuuccccggcgcccagugcagcuccuucccggacgggagcugguccugcggcagcugccccgucggcuuccuggggaacggcacccacugcgaggaccucgacgagugcgcccuggugcccgacaucugcuucuccacgagcaaggugccccgcugcgucaacacccagccgggguuccacugccugcccugcccgccccgguaccgcggcaaccagcccgugggggugggccucgaggccgccaagaccgagaagcaggucugcgagcccgagaaccccugcaaggacaagacccacaacugccacaagcacgcggagugcaucuaccugggccacuucuccgaccccauguacaagugcgagugccagaccggguacgccggcgacgggcugaucugcggcgaggacagcgaccucgacggguggccgaaccugaaccuggugugcgccacgaacgccaccuaccacugcaucaaggacaacugcccccaccuccccaacuccggccaggaggacuucgacaaggacggcaucggggacgcgugcgacgacgacgacgacaacgacggcgugaccgacgagaaggacaacugccagcugcuguucaacccccggcaggccgacuacgacaaggacgaggucggggaccgcugcgacaacugcccguacgugcacaaccccgcccagaucgacaccgacaacaacggcgagggggacgccugcagcguggacaucgacggcgacgacgucuucaacgagcgggacaacugccccuacguguacaacacggaccagcgcgacaccgacggcgacggggugggcgaccacugcgacaacugcccccugguccacaacccggaccagaccgacguggacaacgaccucgugggggaccagugcgacaacaacgaggacaucgacgacgacggccaccagaacaaccaggacaacugccccuacaucagcaacgccaaccaggcggaccacgaccgggacggccagggggacgccugcgaccccgacgacgacaacgacggcguccccgacgaccgcgacaacugccggcugguguucaacccggaccaggaggaccuggacggggacggccgcggggacaucugcaaggacgacuucgacaacgacaacauccccgacaucgacgacgugugccccgagaacaacgccaucuccgagaccgacuuccgcaacuuccagauggucccgcucgaccccaagggcacgacccagaucgaccccaacugggugauccggcaccagggcaaggagcuggugcagaccgccaacagcgaccccgggaucgccgucggcuucgacgaguucggguccguggacuucagcggcaccuucuacgugaacacggaccgcgacgacgacuacgcgggguucgucuucggcuaccaguccagcucccgguucuacguggugauguggaagcaggucacccagaccuacugggaggaccagccgacccgcgccuacggcuacagcggggugucccugaagguggucaacagcacgaccggcaccggggagcaccuccggaacgcccuguggcacaccggcaacacgcccggccaggugcgcacccuguggcacgacccccggaacaucggguggaaggacuacaccgccuaccgcuggcaccucacccaccggcccaagacgggcuacauccgcgugcugguccacgaggggaagcaggucauggccgacuccggcccgaucuacgaccagaccuacgccgggggccggcugggccucuucguguucagccaggagaugguguacuucuccgaccugaaguacgagugccgcgacaucuga

SEQ ID NO: 37644 - RNA, 2511 nt, Artificial Sequence
  derived and/or modified sequence opt1 from THBS3__Homo_sapiens__NP_001239537
auggagacccaggagcugcgcggcgcccucgcccugcugcuccugugcuucuucaccagcgcgucccaggaccuccaggugaucgaccuccugacggucggggagagccggcagaugguggccguggccgagaagauccgcaccgcccugcucaccgccggcgacaucuaccugcuguccaccuuccggcugcccccgaagcagggcgggguccuguucgggcuguacagccgccaggacaacacgcgguggcucgaggcguccguggugggcaagaucaacaaggucaccaacgcccugcacagcauccugggcgagcagaccaaggcccucgugacccagcugacgcuguucaaccagauccucguggagcugcgcgacgacauccgggaccaggucaaggagaugucccugauccgcaacaccaucauggagugccaggugugcggguuccacgagcagcggagccacugcucccccaaccccugcuuccgcggcguggacugcauggaggucuacgaguaccccggguaccggugcggcccgugcccgcccgggcuccagggcaacggcacccacugcagcgacaucaacgagugcgcccacgcggaccccugcuuccccggguccagcugcaucaacaccaugcccggcuuccacugcgaggccugcccccgcggguacaagggcacccagguguccggcguggggaucgacuacgcccgggccagcaagcaggucugcaacgacaucgacgagugcaacgacggcaacaacgggggcugcgaccccaacuccaucugcacgaacaccguggggagcuucaagugcggcccgugccgccugggcuuccuggggaaccagucccagggcugccuccccgcccggaccugccacagccccgcgcacucccccugccacauccacgcccacugccuguucgagcgcaacggggccgugagcugccagugcaacgucggcugggccgggaacggcaacgugugcggcacggacaccgacaucgacggguacccggaccaggcccugcccugcauggacaacaacaagcacugcaagcaggacaacugccuccugacccccaacagcggccaggaggacgcggacaacgacggggugggcgaccagugcgacgacgacgccgacggggacggcaucaagaacgucgaggacaacugccggcuguuccccaacaaggaccagcagaacuccgacaccgacagcuucggcgacgccugcgacaacugcccgaacgugcccaacaacgaccagaaggacacggacgggaacggcgagggggacgccugcgacaacgacguggacggcgacggcauccccaacgggcucgacaacugccccaaggucccgaacccccugcagaccgaccgcgacgaggacggcgugggggacgccugcgacuccugccccgagaugagcaaccccacccagaccgacgcggacuccgaccuggucggcgacgugugcgacacgaacgaggacagcgacggggacggccaccaggacaccaaggacaacugcccgcagcuccccaacuccagccagcuggacuccgacaacgacggccugggggacgagugcgacggcgacgacgacaacgacgggauccccgacuacgugccgcccggccccgacaacugccggcucguccccaacccgaaccagaaggacagcgacgggaacggcgugggcgacgugugcgaggacgacuucgacaacgacgccgucguggacccccuggacgugugccccgaguccgccgaggucacccugaccgacuuccgcgccuaccagacgguggugcucgaccccgagggggacgcccagaucgacccgaacugggucgugcugaaccagggcauggagaucgugcagaccaugaacagcgaccccgggcuggcggucggcuacaccgccuucaacgggguggacuucgagggcaccuuccacgugaacacggucaccgacgacgacuacgccggcuuccucuucuccuaccaggacagcgggcgguucuacguggugauguggaagcagaccgagcagaccuacuggcaggccacgcccuuccgcgcggucgcccagcccggccugcagcugaaggccgugaccuccgugagcgggccgggcgagcaccuccgcaacgcccuguggcacaccgggcacacccccgaccagguccggcugcuguggaccgacccccgcaacgugggcuggcgggacaagacguccuaccgcuggcagcuccugcaccggccccaggugggcuacauccgcgucaagcuguacgaggggccgcagcucguggccgacagcggcgugaucaucgacaccuccaugcgcgggggccggcugggcgucuucugcuucagccaggagaacaucaucuggagcaaccugcaguaccggugcaacgacaccgugcccgaggacuucgagcccuuccgccggcagcuccugcaggggcgcguguga

SEQ ID NO: 37645 - RNA, 2886 nt, Artificial Sequence
  derived and/or modified sequence opt1 from THBS4__Homo_sapiens__NP_003239
augcuggcgccccgcggcgccgccgugcuccugcugcaccucguccugcagcgguggcuggccgccggggcccaggccacgccccagguguucgaccuccugcccagcuccagccagcgccugaaccccggcgcgcuccugcccgugcugaccgacccggcccucaacgaccuguacgucaucuccaccuucaagcugcagaccaagagcuccgccaccaucuucgggcucuacagcuccaccgacaacagcaaguacuucgaguucacggugaugggccggcugaacaaggccauccugcgcuaccucaagaacgacgggaaggugcaccuggucguguucaacaaccugcagcucgcggacggccggcgccaccggauccugcugcgccucuccaaccugcagcggggcgccgggagccuggagcucuaccuggacugcauccagguggacuccguccacaaccugccccgcgccuucgccggccccagccagaagcccgagaccaucgagcuccggaccuuccagcgcaagccgcaggacuuccuggaggagcugaagcucguggugcgggggucccuguuccaggucgccagccugcaggacugcuuccuccagcaguccgagccccuggcggccaccggcacgggggacuucaaccgccaguuccugggccagaugacccagcucaaccagcugcugggcgaggugaaggaccuccugcggcagcaggucaaggagaccagcuuccugcgcaacaccaucgccgagugccaggccugcgggccccucaaguuccagucccccacgccgagcaccguggugccgcccgcgcccccggccccgcccacccggcccccgcgccggugcgacuccaaccccugcuuccgcggcgugcagugcaccgacagccgggacggguuccagugcggccccugccccgagggcuacacggggaacggcaucacgugcaucgacgucgacgagugcaaguaccacccgugcuaccccggggugcacugcaucaaccugagccccggcuuccgcugcgacgccugccccgugggguucaccggcccgaugguccagggcguggggaucuccuucgccaagagcaacaagcaggucugcaccgacaucgacgagugccgcaacggcgccugcgugcccaacuccaucugcgugaacacccuggggagcuaccggugcggccccugcaagccgggguacaccggcgaccagauccgcggcugcaaggccgagcggaacugccgcaaccccgagcucaaccccugcuccgucaacgcgcagugcaucgaggagcggcagggggacgugaccugcgugugcggcgucgggugggccggcgacggguacaucugcggcaaggacguggacaucgacagcuaccccgacgaggagcugccgugcuccgcccgcaacugcaagaaggacaacugcaaguacgugcccaacagcggccaggaggacgccgaccgggacgggaucggcgacgccugcgacgaggacgcggacggggacggcauccugaacgagcaggacaacugcguccugauccacaacguggaccagcgcaacuccgacaaggacaucuucggcgacgccugcgacaacugccucagcgugcugaacaacgaccagaaggacaccgacggggacggccgcggggacgccugcgacgacgacauggacggcgacgggaucaagaacauccuggacaacugccccaaguuccccaaccgggaccagcgggacaaggacggcgacggcgucggggacgccugcgacuccugcccggacgugagcaaccccaaccaguccgacguggacaacgaccucgucggcgacagcugcgacacgaaccaggacuccgacggggacggccaccaggacagcaccgacaacugccccaccgugaucaacuccgcgcagcuggacaccgacaaggacgggaucggcgacgagugcgacgacgacgacgacaacgacggcauccccgaccuggugccgcccgggcccgacaacugccgccucguccccaacccggcccaggaggacagcaacuccgacggcgugggggacaucugcgagagcgacuucgaccaggaccaggugaucgaccggaucgacgucugccccgagaacgccgaggugacgcugaccgacuuccgcgccuaccagaccgugguccuggaccccgagggcgacgcccagaucgaccccaacuggguggugcucaaccaggggauggagaucguccagaccaugaacagcgacccgggccuggcggugggcuacacggccuucaacgggguggacuucgagggcaccuuccacgucaacacccagaccgacgacgacuacgccggguucaucuucggcuaccaggacuccagcuccuucuacguggugauguggaagcagacggagcagaccuacuggcaggccacccccuuccgggccgucgcggagcccgggauccagcugaaggccgucaagagcaagaccggccccggcgagcaccuccgcaacucccuguggcacaccggggacacgagcgaccaggugcggcugcucuggaaggacucccgcaacgugggcuggaaggacaaggugagcuaccggugguuccugcagcaccgcccccaggugggguacauccgcguccgguucuacgagggcuccgagcugguggccgacagcggcgugaccaucgacaccaccaugcgcgggggccggcucggggucuucugcuucucccaggagaacaucaucuggagcaaccugaaguaccgcugcaacgacacgauccccgaggacuuccaggaguuccagacccagaacuucgaccgguucgacaacuga

SEQ ID NO: 37646 - RNA, 1140 nt, Artificial Sequence
  derived and/or modified sequence opt1 from THEG__Homo_sapiens__NP_057669
augggcgacagccgccggcgcucccuggggaaccagcccagcuccgaggccgccggccggagcgagcgcgagcaggacggggacccgcggggccuccaguccagcguguacgagucccgccgggucaccgaccccgagcgccaggaccuggacaacgcggagcuggggcccgaggaccccgaggaggagcucccgcccgaggagguggccggcgaggaguuccccgagacccuggaccccaaggaggcccugagcgagcucgagcgggugcuggacaaggaccuggaggaggacaucccggagaucucccgccucagcaucucccagaagcugcccagcacgaccaugaccaaggcccggaagcgccggcgccggcgccggcugauggagcucgccgagcccaagaucaacuggcagguccugaaggaccgcaagggccggugcgggaagggcuacgcguggaucucccccugcaagaugagccugcacuucugccucugcuggccguccguguacuggaccgagcgcuuccuggaggacacgacccugaccaucaccgugcccgccgucagccggcgcguggaggagcucucccgccccaagcgguucuaccuggaguacuacaacaacaaccgcacgacccccguguggccgaucccccggagcucccuggaguaccgcgccagcagccggcucaaggagcuggccgcgcccaagauccgcgacaacuucugguccaugcccaugagcgaggucucccaggugagccgggccgcccagauggccgugccguccagccgcauccugcagcucuccaagcccaaggcccccgcgacccugcuggaggagugggaccccgucccgaagcccaagccccacgugagcgaccacaaccggcuccugcaccuggcccgccccaaggcccaguccgacaagugcgugccggaccgggacccccgcugggagguccucgacgugaccaagaagguggucgccagcccccggaucaucucccuggccaagccgaaggugcgcaaggggcugaacgagggcuacgaccggcgcccccucgcgagcaugucccugcccccgcccaaggccagccccgagaagugcgaccagccccggcccgggcuguga

SEQ ID NO: 37647 - RNA, 723 nt, Artificial Sequence
  derived and/or modified sequence opt1 from THEM4__Homo_sapiens__NP_444283
augcugcgcagcugcgccgcccggcuccgcacccugggcgcgcugugccugcccccgguggggcggcgccugcccggcuccgagccccggcccgagcugcgcagcuucuccagcgaggaggucauccucaaggacugcuccgugccgaaccccagcuggaacaaggaccugcggcuccucuucgaccaguucaugaagaagugcgaggacggguccuggaagcgccugcccagcuacaagcggacccccacggaguggauccaggacuucaagacccacuuccuggacccgaagcucaugaaggaggagcagaugucccaggcccagcuguucacccgcagcuucgacgacggccugggguucgaguacgugauguucuacaacgacaucgagaagcggauggucugccucuuccagggcggccccuaccuggaggggccgcccggcuucauccacgggggcgccaucgccaccaugaucgacgccacgguggggaugugcgcgaugauggccggcggcaucgugaugaccgccaaccugaacaucaacuacaagcgccccaucccccucugcuccgucgugaugaucaacagccagcuggacaagguggaggggcggaaguucuucgucuccugcaacgugcagagcguggacgagaagacccuguacuccgaggccaccagccucuucaucaagcugaaccccgcgaagucccugacguga

SEQ ID NO: 37648 - RNA, 744 nt, Artificial Sequence
  derived and/or modified sequence opt1 from THEM5__Homo_sapiens__NP_872384
augauccgccggugcuuccagguggccgcccgccugggccaccaccgggggcuccuggaggcgccccgcauccugccgcggcucaaccccgccagcgccuucggcuccagcaccgacuccauguucagccgcuuccugcccgagaagaccgaccugaaggacuacgcccuccccaacgccuccuggugcagcgacaugcugucccuguaccaggaguuccucgagaagaccaagagcuccggguggaucaagcugccgagcuucaaguccaaccgggaccacauccgcggccugaagcuccccagcgggcuggcggucuccagcgacaagggcgacugccggaucuucacgcgcugcauccagguggagggccagggguucgaguacgugaucuucuuccagcccacccagaagaaguccgucugccuguuccagcccggcagcuaccucgaggggccgcccggcuucgcccacgggggcucccuggccgccaugauggacgagaccuucagcaagacggcguuccuggccggcgagggccucuucacccugucccugaacauccgguucaagaaccucauccccguggacagccugguggucauggacguggagguggacaagaucgaggaccagaagcuguacaugagcugcaucgcccacucccgcgaccagcagaccgucuacgccaagagcuccgggguguuccuccagcugcagcuggaggaggagagcccccaguga

SEQ ID NO: 37649 - RNA, 627 nt, Artificial Sequence
  derived and/or modified sequence opt1 from THEM6__Homo_sapiens__NP_057731
augcugggccuccugguggcccugcucgcccuggggcuggcggucuucgcccuccuggacgugugguaccuggugcgccuccccugcgccguccugcgggcccgccugcuccagccccgggugcgcgaccugcuggccgagcagcgguuccccggccgcgugcuccccagcgaccuggaccugcuccugcacaugaacaacgcgcgguaccugcgcgaggccgacuucgcccgggucgcccaccucacccgcugcggggugcugggcgcgcugcgggagcuccgcgcccacaccgugcuggccgccuccugcgcccggcaccgccggagccugcgccuccuggagcccuucgagguccggacgcgccugcucgggugggacgaccgggcguucuaccuggaggcccgcuucgugucccugcgggacggcuucgugugcgcccuccugcgcuuccgccagcaccuccugggcaccagcccggagcgggucgugcagcaccugugccagcgccggguggagccgcccgagcugcccgccgaccuccagcacuggaucuccuacaacgaggccagcucccagcugcugcgcauggagagcgggcucuccgacgucaccaaggaccaguga

SEQ ID NO: 37650 - RNA, 1791 nt, Artificial Sequence
  derived and/or modified sequence opt1 from THEMIS2__Homo_sapiens__XP_011540747
auggagcccgugccgcugcaggacuucguccgcgcccucgaccccgccagccugccccgggugcugcgcgugugcuccggcgucuacuucgagggguacuucacgccccucaacaccccgcagagcuacgagacccuggaggagcugguguccgcgaccacccagagcuccaagcagcucccgaccugcuucaugagcacgcaccggaucgugaccgagggccgcgucgugaccgaggaccagcugcugaugcucgaggccguggucaugcaccuggggauccgguccgcccgcugcgugcugggcauggaggggcagcaggucauccuccaccucccccugagccagaagggccccuucuggaccugggagccguccgcgccccggacgcuccugcagguccugcaggaccccgcccucaaggaccuggugcugaccugccccacccucccguggcacagccugauccugcgcccccaguacgagauccaggccaucaugcacaugcggcgcaccaucgugaagauccccuccacgcucgaggucgacguggaggacgugaccgccagcucccggcacguccacuucaucaagccccugcugcugagcgaggugcuggccugggagggccccuucccccuguccauggagauccucgaggugcccgaggggcgccccaucuuccugagcccgugggugggcucccugcagaaggggcagcggcucugcguguacggccuggccagcccgcccuggcgcgugcuggcguccagcaaggggcggaaggucccccgccacuuccucgugagcggcggcuaccaggggaagcugcggcgccggccccgcgaguuccccaccgccuacgaccugcucggcgccuuccagcccgggcggccccugcgcgucguggccaccaaggacugcgagggcgagcgcgaggagaacccggaguucacgucccuggccgugggcgaccggcucgagguccuggggcccggccaggcgcacggggcccagggcagcgacguggacgugcuggucugccagcgccucuccgaccaggccggggaggacgaggaggaggagugcaaggaggaggccgagagccccgagcgggugcugcugccguuccacuuccccggcuccuucguggaggagaugagcgacucccgccgguacagccucgccgaccugaccgcgcaguucucccugcccugcgaggucaaggugguggccaaggacaccagccaccccaccgacccgcugacguccuuccucggccugcgccuggaggagaagaucaccgagcccuuccucgucgugagccuggacuccgagcccgggaugugcuucgagaucccgccccgguggcuggaccucaccguggucaaggccaagggccagcccgaccugcccgaggggagccugcccaucgccaccguggaggagcucacggacaccuucuacuaccgccugcggaagcugccggccugcgagauccaggcgcccccgccccggccgcccaagaaccagggccucuccaagcagcgccgccacagcuccgagggcggggucaagagcucccaggugcugggccugcagcagcacgcccggcuccccaagcccaaggccaagacccugcccgaguucaucaaggacgggagcagcaccuacuccaagauccccgcccaccgcaagggccaccggcccgccaagccccagcgccaggaccuggacgacgacgagcacgacuacgaggagauccucgagcaguuccagaagacgaucuga

SEQ ID NO: 37651 - RNA, 1926 nt, Artificial Sequence
  derived and/or modified sequence opt1 from THEMIS__Homo_sapiens__NP_001010923
auggcccugagccucgaggaguucgugcacucccuggaccugcgcacccucccccggguccuggagauccaggccggcaucuaccuggaggggagcaucuacgagauguucggcaacgagugcugcuucuccaccggggaggugaucaagaucacgggccucaaggugaagaagaucaucgcggagaucugcgagcagaucgaggggugcgagagccugcagcccuucgagcugcccaugaacuuccccggccucuucaagaucgucgccgacaagacccccuaccugaccauggaggagaucacccgcacgauccacaucggcccgucccggcuggggcaccccugcuucuaccaccagaaggacaucaagcucgagaaccugaucaucaagcagggcgagcagaucaugcugaacagcguggaggagaucgacggggagaucaugguguccugcgccgucgcccgcaaccaccagacccacagcuucaaccucccccugucccaggagggcgaguucuacgagugcgaggacgagcggaucuacacccugaaggagaucguggaguggaagauccccaagaaccgcacccggacggugaaccucaccgacuucagcaacaagugggacuccaccaacccguuccccaaggacuucuacgggacccugauccugaagcccgucuacgagauccagggcgugaugaaguuccgcaaggacaucauccggauccuccccagccuggacguggaggucaaggacaucacggacuccuacgacgccaacugguuccugcagcuccugagcaccgaggaccuguucgagaugaccuccaaggaguucccgaucgugaccgaggugaucgaggcgcccgagggcaaccaccucccccagagcauccugcagcccgggaagacgaucgucauccacaagaaguaccaggccucccgcauccuggccagcgagauccgguccaacuucccgaagcgccacuuccucauccccaccagcuacaagggcaaguucaagcggcgcccccgggaguuccccaccgccuacgaccuggagaucgccaagagcgagaaggagccgcugcacgugguggcgaccaaggccuuccacagcccccacgacaagcucagcuccgucagcgugggggaccaguuccuggugcaccaguccgagacgaccgagguccugugcgagggcaucaagaagguggugaacguccucgccugcgagaagauccugaagaaguccuacgaggccgcgcugcucccccuguacauggagggcggguucguggaggucauccacgacaagaagcaguaccccaucuccgagcugugcaagcaguuccgccucccguucaacgugaaggugagcguccgggaccuguccaucgaggaggacgugcuggccgccacccccggccuccagcuggaggaggacaucaccgacagcuaccugcucaucuccgacuucgccaaccccacggagugcugggagauccccguggggcgccugaacaugaccguccagcuggugagcaacuucucccgggacgccgagccguuccuggugcgcacccucgucgaggagaucaccgaggagcaguacuacaugaugcggcgcuacgagagcuccgcgagccacccgcccccgcgcccgcccaagcaccccuccguggaggagacgaagcugacccugcucacccuggccgaggagcggaccguggaccugcccaagagccccaagcgccaccacgucgacaucacgaagaagcuccaccccaaccaggccggccuggacuccaaggugcugaucgggagccagaacgaccucguggacgaggagaaggagcggagcaaccgcggcgccaccgccaucgcggagaccuucaagaacgagaagcaccagaaguga

SEQ ID NO: 37652 - RNA, 897 nt, Artificial Sequence
  derived and/or modified sequence opt1 from THG1L__Homo_sapiens__NP_060342
auguggggcgccugcaaggugaagguccacgacagccuggccaccaucuccaucacccuccgccgguaccugcgccugggggcgacgauggccaagagcaaguucgaguacgugcgggacuucgaggccgacgacacgugccucgcccacugcuggguggucgugcgccuggacggccggaacuuccaccgcuucgccgagaagcacaacuucgcgaagcccaacgacucccgggcccugcagcucaugaccaagugcgcccagaccgugauggaggagcuggaggacaucgucaucgccuacgggcagagcgacgaguacuccuucguguucaagcgcaagaccaacugguucaagcggcgcgcgagcaaguucaugacccacguggccucccaguucgccagcuccuacgucuucuacuggcgggacuacuucgaggaccagccgcugcucuacccgcccggcuucgacgggcgcgugguggucuaccccagcaaccagacccugaaggacuaccuguccuggcggcaggccgacugccacaucaacaaccucuacaacaccguguucugggcccugauccagcagagcggccugacgcccgugcaggcgcagggccgccuccaggggacccuggccgccgacaagaacgagauccuguucuccgaguucaacaucaacuacaacaacgagcuccccauguaccggaagggcaccguccugaucuggcagaagguggacgaggugaugaccaaggagaucaagcugcccacggagauggaggggaagaagauggccgucacccgcacccggaccaagcccgugccgcuccacugcgacaucaucggcgacgccuucuggaaggagcaccccgagauccuggacgaggacagcuga

SEQ ID NO: 37653 - RNA, 1494 nt, Artificial Sequence
  derived and/or modified sequence opt1 from TH__Homo_sapiens__NP_000351
augcccaccccggacgccaccacgccccaggccaagggcuuccgccgggcggugagcgagcuggacgccaagcaggccgaggccaucaugagcccccgcuucaucgggcggcgccagucccucaucgaggacgcccggaaggagcgcgaggcggccgucgccgccgcggccgccgccgugcccuccgagccgggcgacccccuggaggccguggcguucgaggagaaggaggggaaggccguccugaaccuccuguucagcccccgggccaccaagcccuccgcccugagccgcgccgugaagguguucgagaccuucgaggcgaagauccaccaccucgagacccggccggcccagcgcccccgggccggcgggccccaccuggaguacuucguccgccuggaggugcggcgcggcgaccucgccgcccugcuguccggcgugcggcaggucagcgaggacgugcgcucccccgcggggccgaaggugcccugguucccccggaaggucagcgagcucgacaagugccaccaccuggugacgaaguucgaccccgaccuggaccucgaccacccgggcuucuccgaccagguguaccgccagcggcgcaagcugaucgccgagaucgccuuccaguaccggcacggggaccccaucccccgcgucgaguacaccgccgaggagaucgccaccuggaaggagguguacaccacgcugaagggccucuacgcgacccacgccugcggggagcaccuggaggccuucgcccugcucgagcgcuucagcggcuaccgggaggacaacaucccccagcuggaggacgugucccgcuuccugaaggagcggaccggcuuccagcuccgcccggucgcggggcugcugagcgcccgggacuuccucgccucccuggccuuccgcguguuccagugcacccaguacauccggcacgccagcucccccaugcacagccccgagcccgacugcugccacgagcugcucggccacgugccgaugcuggcggaccgcacguucgcccaguucucccaggacaucgggcuggccagccucggcgccagcgacgaggagaucgagaagcuguccacccuguacugguucaccgucgaguucggccucugcaagcagaacggggaggugaaggccuacggcgcggggcugcugagcuccuacggcgagcuccugcacugccugagcgaggagcccgagauccgggccuucgaccccgaggccgccgccgugcagcccuaccaggaccagaccuaccaguccgucuacuucgugagcgaguccuucagcgacgcgaaggacaagcuccgcuccuacgccagccggauccagcgcccguucuccgucaaguucgaccccuacacgcuggccaucgacgugcuggacagcccccaggccgugcggcgcucccucgaggggguccaggacgagcuggacacccuggcgcacgcccucagcgccaucggcuga

SEQ ID NO: 37654 - RNA, 2232 nt, Artificial Sequence
  derived and/or modified sequence opt1 from THNSL1__Homo_sapiens__NP_079114
augcugcacuucaaccgcugccaccaccucaagaagaucacccagaagugcuucagcuccauccacgugaagaccgacaagcacgcccagcgguuccugagccgcacguucgcccuggcggagcuccggaaguccugguacagcacccacucccuggucggcgacaagaacaucauccugauggggcccccgggcgccgggaagaccaccgugggccgcaucaucgggcagaagcucggcugcugcgugaucgacgucgacgacgacauccuggagaagacguggaacaugagcguguccgagaagcugcaggacgugggcaacgagcaguuccucgaggaggaggggaaggccguccugaacuucagcgccuccggcagcgugaucucccugaccgggagcaaccccaugcacgacgccuccauguggcaccucaagaagaacggcaucaucguguaccuggacgucccccugcucgaccugaucugccggcugaagcucaugaagaccgaccgcaucguggggcagaacagcggcaccuccaugaaggaccugcugaaguuccggcgccaguacuacaagaagugguacgacgcgcggguguucugcgagagcggcgccucccccgaggaggucgccgacaaggugcucaacgccaucaagcgcuaccaggacguggacagcgagacguucaucuccacccggcacgucuggccggaggacugcgagcagaaggugagcgcgaaguucuucagcgaggccgugaucgaggggcuggccuccgacggcgggcuguucguccccgccaaggaguuccccaagcucagcugcggcgaguggaagucccuggugggcgccaccuacguggagcgcgcgcagauccugcucgagcggugcauccaccccgccgacaucccggccgcccgccugggggagaugaucgagaccgccuacggcgagaacuucgcgugcagcaagaucgcccccguccggcaccuguccgggaaccaguucauccucgagcuguuccacggccccacggggagcuucaaggaccugucccuccagcugaugccccacaucuucgcccacugcaucccgcccagcugcaacuacaugauccugguggccaccuccggcgacaccggcagcgccgugcucaacggguucucccgccugaacaagaacgacaagcagcggaucgcggucguggccuucuuccccgagaacggcgucagcgacuuccagaaggcccagaucaucgggucccagcgcgagaacggcugggccguggggguggagagcgacuucgacuucugccagaccgccaucaagcggaucuucaacgacuccgacuucacgggcuuccugaccgucgaguacggcaccauccucagcuccgcgaacagcaucaacugggggcgccugcugccccaggugguguaccacgccuccgccuaccucgaccuggucagccagggcuucaucagcuucggguccccgguggacgugugcauccccaccggcaacuucgggaacauccuggccgcggucuacgccaagaugaugggcauccccauccggaaguucaucugcgccagcaaccagaaccacgugcucacggacuucaucaagaccggccacuacgaccugcgcgagcgcaagcuggcccagaccuucucccccagcaucgacauccucaaguccagcaaccuggagcggcaccuccaccugauggccaacaaggacgggcagcugaugaccgagcuguucaaccgccuggagucccagcaccacuuccagaucgagaaggcgcucguggagaagcugcagcaggacuucgucgccgacuggugcagcgagggcgagugccuggccgccaucaacuccacguacaacaccagcggguacauccucgacccgcacaccgccguggcgaagguggucgccgaccgggugcaggacaagaccugccccgugaucaucuccagcacggcccacuacuccaaguucgcccccgccaucaugcaggcgcugaagaucaaggagaucaacgagaccagcuccagccagcuguaccuccugggcuccuacaacgcccugcccccgcuccacgaggcccugcuggagcgcaccaagcagcaggagaagauggaguaccaggucugcgccgcggacaugaacgugcucaagagccacguggagcagcugguccagaaccaguucaucuga

SEQ ID NO: 37655 - RNA, 1218 nt, Artificial Sequence
  derived and/or modified sequence opt1 from THNSL2__Homo_sapiens__NP_001231605
augugguacgugagcacccgcggcgucgcgccccgggugaacuucgagggggcccuguucuccggcuacgccccggacgggggccucuucaugcccgaggagcugccccagcuggaccgcgggacccucugccaguggagcacgcuguccuaccccggccuggugaaggagcucugcgcccuguucaucggcagcgagcugcucccgaaggacgagcugaacgaccugaucgaccgggccuucucccgcuuccggcaccgcgaggucgugcaccucagccggcugcgcaacgggcugaacgugcucgagcuguggcacggcgucaccuacgccuucaaggaccugucccucagcugcaccacccaguuccugcaguacuuccuggagaagcgggagaagcacgugacgguggucguggggaccuccggcgacaccgggagcgccgcgaucgaguccgugcagggcgccaagaacauggacaucaucguccuccugcccaagggccacugcaccaagauccaggagcugcagaugacgaccgugcucaagcagaacgugcacgucuucgggguggagggcaacagcgacgagcuggacgagcccaucaagaccguguucgccgacgucgccuucgugaagaagcacaaccugaugucccucaacagcaucaacuggucccgcgugcugguccagauggcgcaccacuucuucgccuacuuccagugcacccccagccuggacacgcacccgcucccccugguggagguggucgugcccaccggggccgccggcaaccuggccgcgggcuacaucgcccagaagaucgggcuccccauccggcuggucguggccgugaaccgcaacgacaucauccaccggaccguccagcagggcgacuucucccugagcgaggccgugaaguccacccucgccagcgcgauggacauccaggugccguacaacauggagcgcgucuucuggcugcugagcggguccgacagccaggugacgcgggcccucauggagcaguucgagcgcacccaguccgugaaccugcccaaggagcugcacagcaagugggagcggcaggacuacgagaagauggccgucauggagugcgacggcugcugcguggagcucugccuggggaacugcggcccccgccggggcuccgugaccgacauccccgggaccgccaugguccgcggcgggggcuga

SEQ ID NO: 37656 - RNA, 1974 nt, Artificial Sequence
  derived and/or modified sequence opt1 from THOC1__Homo_sapiens__NP_005122
augagccccaccccgccccuguucucccuccccgaggcccgcacccgguucaccaagagcacgcgcgaggcccugaacaacaagaacaucaagccccugcucuccaccuucagccaggugccgggcuccgagaacgagaagaagugcacccuggaccaggcguuccgggggauccuggaggaggagaucaucaaccacagcuccugcgagaacguccucgccaucaucagccuggccaucggcggggugacggagggcaucugcaccgccuccacccccuucgugcugcucggggacguccuggacugccugccccucgaccagugcgacaccaucuucacguucguggagaagaacguggccaccuggaaguccaacaccuucuacagcgcgggcaagaacuaccugcugcgcaugugcaacgaccuccugcggcgccugagcaagucccagaacaccgucuucugcggccggauccagcuguuccucgcccgccuguucccccucagcgagaaguccgggcugaaccugcagagccaguucaaccucgagaacgugacgguguucaacaccaacgagcaggaguccacccugggccagaagcacaccgaggaccgggaggaggggauggacgucgaggagggcgagaugggggacgaggaggccccgacgaccugcagcauccccaucgacuacaaccuguaccgcaaguucuggucccuccaggacuacuuccggaaccccgugcagugcuacgagaagaucagcuggaagaccuuccugaaguacagcgaggaggugcuggccgucuucaaguccuacaagcucgacgacacccaggcgagccgcaagaagauggaggagcugaagacgggcggcgagcacguguacuucgccaaguuccugaccuccgagaagcucauggaccugcagcugagcgacuccaacuuccggcgccacauccuccugcaguaccugauccucuuccaguaccugaagggccaggugaaguucaagagcuccaacuacguccugaccgacgagcagagccucuggaucgaggacaccacgaaguccguguaccagcugcugagcgagaacccgcccgacggggagcgguucuccaagaugguggagcacauccucaacaccgaggagaacuggaacagcuggaagaacgaggggugccccuccuucgucaaggagcgcaccagcgacaccaagcccacgcggaucauccgcaagcggaccgcccccgaggacuuccugggcaagggcccgaccaagaagauccugauggggaacgaggagcucacccgccuguggaaccugugccccgacaacauggaggccugcaaguccgagacgcgggagcacaugcccacccuggaggaguucuucgaggaggccaucgagcaggcggaccccgagaacaugguggagaacgaguacaaggccgugaacaacagcaacuacggcuggcgcgcccuccgccugcuggcccggcgcuccccgcacuucuuccagcccaccaaccagcaguucaagagccuccccgaguaccuggagaacauggucaucaagcuggccaaggagcugcccccgcccuccgaggagaucaagaccggggaggacgaggacgaggaggacaacgacgcgcuccugaaggagaacgagagccccgacgugcggcgcgacaagcccgugacgggcgagcagaucgaggucuucgccaacaagcucggggagcaguggaagauccuggccccguaccuggagaugaaggacagcgagauccggcagaucgagugcgacuccgaggacaugaagaugcgcgccaagcagcuccugguggccuggcaggaccaggagggcguccacgcgacccccgagaaccugaucaacgcccucaacaagagcggccuguccgaccuggccgagagccucaccaacgacaacgagaccaacuccuga

SEQ ID NO: 37657 - RNA, 4782 nt, Artificial Sequence
  derived and/or modified sequence opt1 from THOC2__Homo_sapiens__NP_001075019
auggccgccgcggccguggucgugcccgccgaguggaucaagaacugggagaagagcggccgcggggaguuccugcaccucugccggauccuguccgagaacaagagccacgacuccagcaccuaccgcgacuuccagcaggcccuguacgagcucuccuaccacgugaucaagggcaaccugaagcacgagcaggccagcaacguccuguccgacaucagcgaguuccgggaggacaugccguccauccucgcggacguguucugcauccuggacaucgagaccaacugccuggaggagaagagcaagcgcgacuacuucacgcagcucgugcuggccugccuguaccucgucuccgacaccgugcugaaggagcggcuggaccccgagacccucgagagccuggggcugaucaagcagucccagcaguucaaccagaagagcgugaagaucaagaccaagcucuucuacaagcagcagaaguucaaccugcugcgcgaggagaacgagggcuacgccaagcucaucgccgagcuggggcaggaccuguccggcagcaucacguccgaccucauccuggagaacaucaagagccugaucggcugcuucaaccucgaccccaaccggguccuggacgugauccuggagguguucgagugccgccccgagcacgacgacuucuucaucucccuccuggagagcuacaugagcaugugcgagccgcagacccugugccacauccucggguucaaguucaaguucuaccaggagcccaacggcgagacccccuccagccuguaccgggucgcggccgugcugcuccaguucaaccugaucgaccuggacgaccucuacgugcaccugcugcccgccgacaacugcaucauggacgagcacaagcgcgagaucgccgaggccaagcagaucguccggaagcucaccaugguggugcuguccagcgagaagauggacgagcgcgagaaggagaaggagaaggaggaggagaaggucgagaagccgcccgacaaccagaagcuggggcuccuggaggcgcugcucaagaucggcgacuggcagcacgcccagaacaucauggaccagaugccccccuacuacgccgccucccacaagcugaucgcccuggcgaucugcaagcugauccacaucacgaucgagccgcucuaccggcgcgugggggugcccaagggcgccaagggcagccccgucaacgcccugcagaacaagcgggcccccaagcaggccgaguccuucgaggaccugcgccgggacguguucaacauguucugcuaccucgggccgcaccugagccacgaccccauccuguucgcgaaggugguccgcaucggcaaguccuucaugaaggaguuccagagcgacggguccaagcaggaggacaaggagaagaccgaggugauccucagcugccugcuguccaucaccgaccagguccuccugcccagccugucccucauggacugcaacgccugcaugagcgaggagcuguggggcauguucaagaccuuccccuaccagcaccgguaccgccuguacggccaguggaagaacgagacguacaacucccacccgcuccuggugaaggugaaggcccagaccaucgaccgggccaaguacaucaugaagcgccugaccaaggagaacgucaagcccagcgggcgccagaucggcaagcucucccacagcaaccccaccauccuguucgacuacauccugagccagauccagaaguacgacaaccucaucacgcccgugguggacucccugaaguaccugaccagccucaacuacgacguccuggccuacugcaucaucgaggcgcuggccaacccggagaaggagcggaugaagcacgacgacaccaccaucuccagcuggcuccagucccuggccagcuucugcggggccguguuccgcaaguaccccaucgaccuggcgggccuccugcaguacguggccaaccagcugaaggccgggaaguccuucgaccuccugauccugaaggaggucgugcagaagauggccggcaucgagaucacggaggagaugaccauggagcagcucgaggccaugaccggcggggagcagcugaaggcggagggcggguacuucggccagauccggaacaccaagaagagcucccagcgccugaaggacgcccuccuggaccacgaccuggcccucccccugugccugcucauggcccagcagcggaacggggugaucuuccaggagggcggcgagaagcaccugaagcuggucgggaagcucuacgaccagugccacgacacgcuggugcaguucggcggguuccuggccagcaaccucuccaccgaggacuacaucaagcgcgugcccagcaucgacguccugugcaacgaguuccacaccccgcacgacgcggccuucuuccugucccggcccauguacgcccaccacaucagcuccaaguacgacgagcucaagaagagcgagaagggcuccaagcagcagcacaaggugcacaaguacaucaccagcugcgagauggugauggcccccguccacgaggccguggugagccugcacgucuccaaggugugggacgacaucagcccgcaguucuacgcgacguucuggucccugaccauguacgaccucgccgugccccacaccagcuacgagcgcgaggucaacaagcugaaggugcagaugaaggccaucgacgacaaccaggagaugccccccaacaagaagaagaaggagaaggagcggugcaccgcccugcaggacaagcuccuggaggaggagaagaagcagauggagcacgugcagcgcguccugcagcggcucaagcuggagaaggacaacuggcugcucgcgaaguccacgaagaacgagaccaucaccaaguuccugcagcugugcaucuucccgcgcugcaucuucagcgccaucgacgccguguacugcgcccgguucguggagcucguccaccagcagaagacccccaacuucuccacgcugcugugcuacgaccgcguguucagcgacaucaucuacaccguggccuccugcaccgagaacgaggcgagccgguacgggcgcuuccucugcugcaugcuggagaccgucacccgguggcacuccgaccgcgccacguacgagaaggagugcggcaacuaccccggcuuccugaccauccuccgggccaccggguucgacggcgggaacaaggccgaccagcuggacuacgagaacuuccgccacguggugcacaaguggcacuacaagcugaccaaggccagcguccacugccucgagacgggcgaguacacccacauccgcaacauccugaucgugcugaccaagauccuccccugguacccgaaggugcugaaccugggccaggcgcucgagcggcgcguccacaagaucugccaggaggagaaggagaagcggcccgaccuguacgcccuggccaugggguacuccggccagcucaagagccgcaaguccuacaugauccccgagaacgaguuccaccacaaggaccccccgccccggaacgccguggccagcgugcagaacgggcccggcgggggccccuccagcuccagcaucggcagcgcguccaagagcgacgaguccagcaccgaggagacggacaagucccgcgagcggagccagugcggggucaaggccgugaacaaggccuccagcaccaccccgaagggcaacuccagcaacgggaacuccggcagcaacuccaacaaggccgugaaggagaacgacaaggagaaggggaaggagaaggagaaggagaagaaggagaagacccccgcgacgacccccgaggcccgcguccugggcaaggacggcaaggagaagcccaaggaggagcggccgaacaaggacgagaaggcccgcgagaccaaggagcggacccccaagagcgacaaggagaaggagaaguucaagaaggaggagaaggccaaggacgagaaguucaagacgaccgugcccaacgccgaguccaagagcacccaggagcgcgagcgggagaaggagcccucccgcgagcgggacaucgcgaaggagaugaagagcaaggagaacgugaaggggggcgagaagaccccggucuccgggagccugaagagccccgugccccgcuccgacaucccggagcccgagcgggagcagaagcgccggaagaucgacacgcaccccagccccucccacagcuccaccgugaaggacagccucaucgagcugaaggaguccagcgccaagcuguacaucaaccacaccccgcccccccucuccaagagcaaggagcgcgagauggacaagaaggaccuggacaagucccgggagcgcagccgcgagcgggagaagaaggacgagaaggaccgcaaggagcggaagcgcgaccacuccaacaacgaccgggagguccccccggaccugaccaagcgccggaaggaggagaacggcacgaugggggugagcaagcacaaguccgagagccccugcgagucccccuaccccaacgagaaggacaaggagaagaacaagagcaaguccagcggcaaggagaagggcagcgacuccuucaagagcgagaagauggacaagaucuccagcgggggcaagaaggagucccgccacgacaaggagaagaucgagaagaaggagaagcgggacagcuccgggggcaaggaggagaagaagcaccacaagagcuccgacaagcaccgcuga

SEQ ID NO: 37658 - RNA, 2052 nt, Artificial Sequence
  derived and/or modified sequence opt1 from THOC5__Homo_sapiens__NP_001002878
augagcuccgagagcuccaagaagcgcaagcccaaggugauccggagcgacggcgccccggccgaggggaagcgcaaccgguccgacaccgagcaggagggcaaguacuacagcgaggaggcggaggucgaccugcgcgaccccgggcgggacuacgagcucuacaaguacacgugccaggagcugcagcgccugauggccgagauccaggaccucaagucccggggcgggaaggacguggccaucgagaucgaggagcgccggauccagagcugcgugcacuucaugacccugaagaagcugaaccgccucgcccacauccggcugaagaagggccgcgaccagacccacgaggccaagcagaaggucgacgcguaccaccuccagcugcagaaccugcuguacgaggugaugcaccuccagaaggagaucaccaagugccuggaguucaaguccaagcacgaggagaucgaccuggugagccucgaggaguucuacaaggaggccccgcccgacaucuccaaggccgaggucaccaugggcgacccccaccagcagacgcuggcccggcuggacugggagcucgagcagcgcaagcggcuggcggagaaguaccgcgagugccugagcaacaaggagaagauccucaaggagaucgaggugaagaaggaguaccuguccagccugcagccccggcucaacuccaucaugcaggccagccugcccgugcaggaguaccuguucaugcccuucgaccaggcccacaagcaguacgagaccgcccgccaccucccgccgccccuguacguccuguucgugcaggccaccgcguacgggcaggccugcgacaagacccucuccguggccaucgagggcagcgucgacgaggccaaggcccuguucaagccgcccgaggacucccaggacgacgagagcgacagcgacgcggaggaggagcagacgaccaagcggcgccggcccacccugggggugcagcucgacgacaagcgcaaggagaugcugaagcgccacccccuguccgugaugcucgaccugaagugcaaggacgacagcguccugcaccucaccuucuacuaccugaugaaccugaacaucaugacggugaaggccaaggugaccaccgccauggagcucaucacccccaucuccgccggcgaccugcugagccccgacuccguccucagcugccuguaccccggggaccacggcaagaagacgcccaaccccgccaaccaguaccaguucgacaaggugggcauccugacccucuccgacuacgugcuggagcuggggcacccguaccuguggguccagaagcucggcgggcugcacuuccccaaggagcagccccagcagaccgugaucgcggaccacagccuguccgccagccacauggagaccacgaugaagcuccugaagacccgggugcagucccgccuggcccuccacaagcaguucgccagccuggagcacggcaucguccccgugaccuccgacugccaguaccuguucccggccaaggucgugagccggcucgugaagugggucaccguggcgcacgaggacuacauggagcugcacuucacgaaggacaucguggacgccggccuggccggggacaccaaccucuacuacauggcccugaucgagcgcggcaccgcgaagcugcaggccgccgucgugcucaaccccggguacuccagcaucccgcccguguuccagcugugccugaacuggaagggcgagaagaccaacuccaacgacgacaacauccgggccauggagggggaggucaacgugugcuacaaggagcucugcggccccuggcccagccaccagcugcugacgaaccagcuccagcgccugugcgugcugcucgacgucuaccuggagaccgagucccacgacgacagcguggagggccccaaggaguucccgcaggagaagaugugccugcgccucuuccgggggcccagccggaugaagcccuucaaguacaaccacccccagggcuucuucucccaccgcuga

SEQ ID NO: 37659 - RNA, 891 nt, Artificial Sequence
  derived and/or modified sequence opt1 from THOC6__Homo_sapiens__NP_001135822
auggagcgcgccgugccccuggccgucccgcucggccagaccgagguguuccaggcgcugcagcggcugcacaugaccaucuucagccaguccgugagccccugcgggaaguuccucgccgccggcaacaacuacgggcagaucgccaucuucucccugagcuccgcccugagcuccgaggcgaaggaggagagcaagaagcccgucgugacguuccaggcccacgacggccccguguacuccauggucagcaccgaccgccaccuccuguccgccggggacggcgaggugaaggccuggcugugggcggagaugcucaagaagggcugcaaggagcuguggcggcgccagccgcccuaccggaccagccuggaggugcccgagaucaacgcccuccugcugguccccaaggagaacucccucauccuggccgggggcgacugccagcugcacaccauggaccucgagacggggaccuucacccgcgugcugcggggccacaccgacuacauccacugccuggcccuccgcgagcggagcccggaggugcuguccgggggcgaggacggcgccguccgccugugggaccuccggacggcgaaggaggugcagaccaucgagguguacaagcacgaggagugcagccgcccccacaacgggcgguggaucggcugccuggccaccgacuccgacuggauggucugcgggggcggccccgcccugacccucuggcaccuccgcagcuccacgcccaccaccaucuucccgauccgggcgccccagaagcacgugaccuucuaccaggaccuggugcugacggccgccgggaacagcugccgcgucgacguguucaccaaccugggcuaccgggccuucagccuguccuucuga

SEQ ID NO: 37660 - RNA, 1134 nt, Artificial Sequence
  derived and/or modified sequence opt1 from T__Homo_sapiens__NP_001257413
augagcucccccggcaccgagagcgccgggaagucccugcaguaccgcguggaccaccuccugagcgccgucgagaacgagcugcaggcgggcuccgagaagggggacccgaccgagcgggagcuccgcgugggccuggaggagagcgagcuguggcuccgguucaaggagcugacgaacgagaugaucgugaccaagaacgggcgccggauguuccccguccugaaggugaacguguccggccucgaccccaacgccauguacagcuuccugcuggacuucgucgccgccgacaaccaccgcuggaaguacgugaacggcgagugggugcccgggggcaagccggagccccaggcccccuccugcgucuacauccaccccgacagcccgaacuucggggcgcacuggaugaaggcccccguguccuucagcaaggugaagcucaccaacaagcugaacggcgggggccagaucaugcugaacucccuccacaaguacgagccccggauccacaucguccgcgugggcgggccccagcggaugaucaccagccacugcuucccggagacgcaguucaucgccgugaccgccuaccagaacgaggagaucaccgcgcugaagaucaaguacaaccccuucgccaaggccuuccuggacgccaaggagcgcuccgaccacaaggagaugauggaggagcccggcgacagccagcagcccggguacucccagagcuacuccgacaacagcccggccugccucagcaugcugcagucccacgacaacuggagcucccugggcaugcccgcgcaccccagcaugcuccccgucucccacaacgccagcccgcccaccuccagcucccaguaccccagccugugguccgugagcaacggcgccgugacgcccgggucccaggccgccgcggucagcaacggccugggggcccaguucuuccggggcuccccggcccacuacacgccccucacccaccccgugagcgcccccuccagcuccgggagcccgcuguacgagggcgccgcggccgccaccgacaucguggacagccaguacgacgccgccgcgcagggccgccugaucgccuccuggacccccgucagcccgcccuccauguga

SEQ ID NO: 37661 - RNA, 2070 nt, Artificial Sequence
  derived and/or modified sequence opt1 from THOP1__Homo_sapiens__NP_003240
augaagcccccggccgccugcgcgggcgacauggccgacgccgccagccccugcuccguggucaacgaccugcgcugggaccugagcgcccagcagaucgaggagcggacccgcgagcugaucgagcagaccaagcggguguacgaccagguggggacgcaggaguucgaggacgucuccuacgagagcacccugaaggcgcucgccgacguggaggugaccuacaccguccagcgcaacauccuggacuucccccagcacgugucccccagcaaggacauccggacggccuccaccgaggccgacaagaagcugagcgaguucgacguggagauguccaugcgcgaggacgucuaccagcggaucguguggcuccaggagaaggugcagaaggacagccugcgcccggaggcggcccgguaccuggagcgccucaucaagcugggccggcgcaacgggcugcaccucccccgggagacccaggagaacaucaagcgcaucaagaagaagcugucccugcucugcaucgacuucaacaagaaccugaacgaggacaccacguuccugcccuucacccuccaggagcugggcgggcugcccgaggacuuccucaacagccuggagaagauggaggacggcaagcugaaggucacccucaaguacccgcacuacuucccccugcugaagaagugccacgugcccgagacccggcgcaagguggaggaggccuucaacugccggugcaaggaggagaacugcgccauccucaaggagcuggucacgcugcgcgcccagaagucccggcuccugggcuuccacacccacgcggacuacgugcuggagaugaacauggccaagaccagccagaccguggccacguuccucgacgagcuggcccagaagcugaagccccucggggagcaggagcgcgccgucauccuggagcugaagcgggcggagugcgagcgccgcggccucccguucgacgggcggauccgcgccugggacaugcgguacuacaugaaccagguggaggagacccgcuacugcguggaccagaaccugcugaaggaguacuuccccguccagguggugacccacggccuccuggggaucuaccaggagcugcucggccuggccuuccaccacgaggagggcgccuccgccuggcacgaggacguccggcuguacaccgcgcgcgacgccgccagcggggagguggucggcaaguucuaccucgaccuguacccccgggaggggaaguacggccacgccgccugcuucggccugcagcccgggugccugcgccaggacggcucccggcagaucgcgaucgccgccaugguggccaacuucacgaagccgaccgcggacgcccccagccuccugcagcacgacgagguggagaccuacuuccacgaguucgggcacgucaugcaccagcugugcucccaggccgaguucgccauguucagcggcacccacguggagcgcgacuucguggaggcccccagccagaugcucgagaacugggucugggagcaggagccccugcugcggaugucccgccacuaccggacggggagcgcggugccgcgcgagcuccuggagaagcugaucgagucccggcaggccaacaccggccucuucaaccugcgccagaucgugcuggccaaggucgaccaggcccuccacacccagaccgacgccgaccccgcggaggaguacgcccggcugugccaggagauccugggcgugcccgccacgcccgggaccaacaugccggccaccuucggccaccucgccgggggcuacgacgcgcaguacuacggguaccuguggagcgagguguacuccauggacauguuccacacccgcuucaagcaggagggcguccugaacagcaaggugggcauggacuaccgguccugcauccuccgccccgggggcagcgaggacgccuccgccaugcugcgccgguuccuggggcgcgaccccaagcaggacgccuuccuccugagcaagggccuccaggugggcgggugcgagcccgagccgcaggucugcuga

SEQ ID NO: 37662 - RNA, 1482 nt, Artificial Sequence
  derived and/or modified sequence opt1 from THPO__Homo_sapiens__NP_001276932
auggaccccccgauccagaucuucagcguggucugcgugggcgggggcguggaccccgggcccggccgcgggucccgggaggagaaggccagccugcccggcgccuucaccuccgucugguggcucccgagccugaucggccagaaguggccccgccaggcguacgaccugcuccuguggcgggggugcgccccccccccgcacguguuccugcccaucugcucccccgagggcugccuccugugcaccugggugcuggagcccuucagcacgcgcaucgacuccagcccgcucgcccggcugugccccacccugcucugccccgagguccaggagcccaagccgccccccuggccccaggagggguuccgcggcgaggccccgaaccgggagccccgccagcccgacacccccgcccggauggagcugaccgagcugcuccugguggugaugcugcuccugacggcgcgccugacccucuccagcccggccccccccgccugcgaccugcggguccuguccaagcuccugcgcgacagccacgugcugcacucccggcucagccagugccccgaggugcacccgcugcccacccccguccugcucccggccguggacuucucccugggggaguggaagacccagauggaggagacgaaggcgcaggacauccugggcgccgugacccuccugcuggagggcgucauggccgcccgcgggcagcucggccccaccugccugagcucccugcucgggcagcugagcggccaggugcggcugcuccugggcgcccugcagucccuccuggggacccagcugcccccccagggccgcacgaccgcgcacaaggacccgaacgccaucuuccucagcuuccagcaccugcugcgggggaaggugcgcuuccugaugcucgucggcgggagcacccugugcgugcggcgcgccccccccaccacggccgugcccucccggaccagccugguccucacccugaacgagcugccgaaccgcaccuccggccuccuggagacgaacuucaccgccagcgcgcgcaccaccggcuccgggcugcucaaguggcagcagggcuuccgggccaagauccccgggcugcugaaccagacgagccgcucccucgaccagauccccggcuaccugaaccggauccacgagcugcucaacgggacccgcggccuguuccccggcccgagccggcgcacccugggggcccccgacaucuccagcggcaccuccgacacggggagccucccccccaaccugcagccgggcuacucccccagccccacccaccccccgaccgggcaguacacccuguucccccucccccccacgcugccgacccccguggugcagcugcacccccuccugccggaccccuccgcccccacccccaccccgacgagcccccugcucaacaccuccuacacccacagccagaaccugucccaggagggcuga

SEQ ID NO: 37663 - RNA, 1356 nt, Artificial Sequence
  derived and/or modified sequence opt1 from THRA__Homo_sapiens__NP_001177847
auggagcagaagcccagcaagguggagugcggcuccgacccggaggagaacagcgcccgcucccccgacgggaagcggaagcgcaagaacggccagugcagccugaagaccuccaugagcggguacauccccuccuaccucgacaaggacgagcagugcgucgugugcggcgacaaggccaccggguaccacuaccggugcaucacgugcgagggcugcaagggcuucuuccgccggaccauccagaagaaccugcaccccaccuacagcugcaaguacgacuccugcugcgugaucgacaagaucacccgcaaccagugccagcugugccgguucaagaagugcaucgcggucgggauggccauggaccucgugcuggacgacagcaagcgcguggccaagcggaagcugaucgagcagaaccgcgagcggcgccggaaggaggagaugauccgcucccuccagcagcggccggagcccacgcccgaggagugggaccugauccacaucgccaccgaggcccaccgcagcaccaacgcgcagggcucccacuggaagcagcggcgcaaguuccugcccgacgacaucgggcagagcccgaucgucuccaugcccgacggcgacaagguggaccucgaggccuucagcgaguucaccaagaucaucacgcccgccaucacccggguggucgacuucgccaagaagcugcccauguucuccgagcugccgugcgaggaccagaucauccuccugaaggggugcugcauggagaucaugagccugcgcgcggccgugcgguacgaccccgaguccgacacccucacccugagcggcgagauggccgugaagcgcgagcagcugaagaacggcgggcucggcgucgugagcgacgccaucuucgagcuggggaagucccugagcgccuucaaccucgacgacacggagguggcgcugcugcaggccguccuccugauguccaccgaccgcagcggccugcucugcguggacaagaucgagaagucccaggaggccuaccugcuggccuucgagcacuacgugaaccaccggaagcacaacaucccccacuucuggcccaagcuccugaugaagggcccgcagguccgccagcuggagcagcagcucggggaggccggcagccugcaggggcccgugcugcagcaccagucccccaagagcccccagcagcggcuccuggagcugcuccaccgcuccggcauccugcacgcgcgggccgugugcggggaggacgacagcuccgaggccgacagcccguccagcuccgaggaggagcccgaggucugcgaggaccuggccggcaacgccgcgagccccuga

SEQ ID NO: 37664 - RNA, 1386 nt, Artificial Sequence
  derived and/or modified sequence opt1 from THRB__Homo_sapiens__NP_001239563
augacccccaacagcaugaccgagaacggccugacggccugggacaagcccaagcacugccccgaccgcgagcacgacuggaagcucguggggauguccgaggccugccugcaccgcaagagccacuccgagcggcggagcacccugaagaacgagcaguccagcccccaccucauccagaccaccuggacguccagcaucuuccaccuggaccacgacgacgucaacgaccaguccgugagcuccgcgcagaccuuccagaccgaggagaagaagugcaagggcuacauccccagcuaccuggacaaggacgagcucugcguggucugcggggacaaggccaccggcuaccacuaccgcugcaucacgugcgaggggugcaagggcuucuuccggcgcaccauccagaagaaccugcacccguccuacagcugcaaguacgagggcaagugcgugaucgacaaggugacccggaaccagugccaggagugccgcuucaagaagugcaucuacgucgggauggccaccgaccuggugcucgacgacuccaagcggcuggccaagcgcaagcugaucgaggagaaccgggagaagcgccggcgcgaggagcuccagaaguccaucggccacaagcccgagcccacggacgaggagugggagcugaucaagaccgugaccgaggcccacgucgcgaccaacgcccaggggagccacuggaagcagaagcggaaguuccugcccgaggacaucggccaggccccgaucgugaacgcccccgagggcgggaagguggaccucgaggcguucagccacuucacgaagaucaucacccccgccaucacccgcgucguggacuucgccaagaagcugcccauguucugcgagcugccgugcgaggaccagaucauccuccugaagggcugcugcauggagaucaugucccugcgggccgccgugcgcuacgaccccgagagcgagacccucacgcugaacggggagauggcggucacccggggccagcugaagaacgggggccucggcguggugagcgacgccaucuucgaccuggggaugucccugagcuccuucaaccucgacgacaccgaggucgcccugcugcaggccgugcuccugaugagcuccgaccgccccggccuggccugcguggagcggaucgagaaguaccaggacagcuuccuccuggcguucgagcacuacaucaacuaccgcaagcaccacgucacccacuucuggcccaagcugcucaugaaggugacggaccugcgcaugaucggggccugccacgccucccgguuccugcacaugaagguggagugcccgaccgagcuguucccgccccucuuccuggaggucuucgaggacuga

SEQ ID NO: 37665 - RNA, 441 nt, Artificial Sequence
  derived and/or modified sequence opt1 from THRSP__Homo_sapiens__NP_003242
augcagguccugaccaagcgcuaccccaagaacugccuccugaccgugauggaccgguacgccgccgaggugcacaacauggagcaggucgugaugaucccgagccugcuccgcgacgugcagcuguccggccccgggggccaggcgcaggccgaggcccccgaccuguacacguacuucaccaugcucaaggccaucugcguggacgucgaccacgggcugcugccccgggaggaguggcaggccaagguggcgggcagcgaggagaacgggaccgccgagaccgaggagguggaggacgaguccgccagcggcgagcucgaccuggaggcccaguuccaccuccacuucuccagccugcaccacauccugaugcaccugacggagaaggcgcaggaggucacccgcaaguaccaggagaugaccggccaggugugguga

SEQ ID NO: 37666 - RNA, 2559 nt, Artificial Sequence
  derived and/or modified sequence opt1 from THSD1__Homo_sapiens__NP_061146
augaagcccaugcugaaggacuucagcaaccuccugcuggugguccucugcgacuacgugcugggcgaggccgaguaccugcuccugcgcgagccggggcacguggcccuguccaacgacaccgucuacguggacuuccaguacuucgacggcgcgaacgggacccuccggaacgugagcguccugcugcucgaggccaacacgaaccagaccgugaccaccaaguaccugcugacgaaccagucccagggcacccucaaguucgagugcuucuacuucaaggaggccggggacuacugguucaccaugacccccgaggccacggacaacagcacccccuuccccuggugggagaaguccgccuuccugaagguggaguggccggucuuccacguggaccugaaccgcagcgcgaaggccgccgagggcaccuuccaggugggccucuucaccucccagccccugugccccuuccccgucgacaagccgaacaucgugguggacgucaucuucacgaacagccugcccgaggcccggcgcaacucccggcagccccucgagauccgcaccagcaagcggaccgagcuggcgcaggggcaguggguggaguucggcugcgcgccccuggggccggaggccuacgugaccgucgugcucaagcugcugggccgcgacuccgugaucacgagcaccgggcccaucgaccucgcccagaaguucggcuacaagcuggucauggugcccgagcugaccugcgaguccggcguggaggucaccgugcugcccccgcccugcacguucguccaggggguggugaccgucuucaaggaggcgccccgguaccccggcaagcgcaccauccaccucgccgagaacagccugccgcucggggagcggcgcaccaucuucaacugcacgcuguucgacaugggcaagaacaaguacugcuucgacuucggcaucuccagccggucccacuucagcgccaaggaggagugcaugcugauccagcgcaacaccgagaccugggggcucuggcagcccuggucccagugcagcgcgaccugcggcgacggggugcgggagcgccggcgcgugugccugacgagcuuccccuccagccccgucugcccgggcaugucccuggaggccagccucugcucccuggaggagugcgccgccuuccagcccagcucccccagcccccugcagccgcaggggcccgugaaguccaacaacaucgugaccgucaccggcaucagccucugccuguucaucaucaucgccaccgugcugaucacgcucuggcggcgcuucggccggcccgccaagugcuccaccccggcccgccacaacagcauccacucccccagcuuccgcaagaacuccgacgaggagaacaucugcgagcugagcgagcagcggggguccuucagcgacggcggggacggccccaccgggucccccggcgacaccggcaucccgcugacguaccgccggagcgggcccgugccgcccgaggacgacgccagcggcuccgagagcuuccaguccaacgcccagaagaucaucccgccccucuucagcuaccgccuggcccagcagcagcugaaggagaugaagaagaaggggcugaccgagaccaccaaggucuaccacgugucccagagcccccucaccgacacggccaucgacgccgcccccuccgcgccccuggaccuggagagccccgaggaggccgccgccaacaaguuccggaucaagucccccuuccccgagcagccggcggugagcgccggcgagcgcccgcccucccggcucgaccugaacgucacccaggccagcugcgccaucucccccagccagacccugauccgcaagucccaggcccggcacguggggagccgcggcggccccuccgagcggagccacgcgcgcaacgcccacuuccggcgcaccgccagcuuccacgaggcccggcaggcccgccccuuccgggagcgcuccaugagcacgcucacgccccggcaggcgcccgccuacuccagccgcacccggaccugcgagcaggccgaggaccgguuccgcccgcagucccgcggggcccaccuguuccccgagaagcuggagcacuuccaggaggccagcggcacccgcgggccccucaacccgcugcccaaguccuacacccugggccagccccuccggaagcccgaccugggcgaccaccaggcggggcugguggccggcaucgagcgcaccgagccgcaccgggcccgccgggggcccagccccucccacaagagcgucucccgcaagcagagcucccccaucagcccgaaggacaacuaccagcggguguccagccucucccccagccagugccgcaaggacaagugccaguccuuccccacccaccccgaguucgccuucuacgacaacacgagcuucggccugaccgaggcggagcagcggaugcuggaccucccgggguacuucggcagcaacgaggaggacgagaccaccuccacgcugagcguggagaagcuggucaucuga

SEQ ID NO: 37667 - RNA, 1977 nt, Artificial Sequence
  derived and/or modified sequence opt1 from THSD4__Homo_sapiens__NP_001273358
auguucgugagcuaccugauccucacccugcugcacguccagaccgccgugcucgcccgccccggcggggaguccaucggcugcgacgacuaccuggggagcgacaagguggucgacaagugcggcgugugcgggggcgacaacacgggcugccagguggucuccgggguguucaagcacgcgcugaccagccucggcuaccaccggguggucgagaucccggagggggccaccaagaucaacaucaccgagauguacaaguccaacaacuaccuggcccugcgcagccgguccggccgcagcaucaucaacgggaacugggccaucgaccggcccggcaaguacgagggcgggggcacgauguucaccuacaagcgccccaacgagaucuccagcaccgccggggaguccuuccucgcggagggccccaccaacgagauccuggacguguacaugauccaccagcagccgaaccccggcgugcacuacgaguacgucaucauggggacgaacgccaucagcccccaggugcccccgcaccggcgccccggcgagcccuucaacgggcagauggugaccgagggccggucccaggaggagggggagcagaagggccgcaacgaggagaaggaggaccugcggggcgaggcccccgagauguucaccagcgaguccgcccagaccuucccgguccgccaccccgaccgguucagcccccaccgccccgacaaccucgugccgcccgcgccccagcccccgcggcgcucccgggaccacaacuggaagcagcuggggacgaccgagugcagcacgaccugcggcaaggggucccaguaccccaucuuccgcugcgugcaccggagcacccacgaggaggcccccgagagcuacugcgacuccagcaugaagcccaccccggaggaggagcccugcaacaucuuccccugccccgccuucugggacaucggcgagugguccgagugcagcaagaccugcgggcugggcaugcagcaccgccagguccucugccgccagguguacgccaaccggucccugaccgugcagccguaccgcugccagcaccuggagaagcccgagacgaccagcacgugccagcucaagaucugcuccgaguggcagauccggaccgacuggaccagcugcuccguccccugcggcguggggcagcgcacccgggacgugaagugcgucagcaacaucggcgacguggucgacgacgaggagugcaacaugaagcugcgcccgaacgacaucgagaacugcgacauggggcccugcgccaaguccugguuccugaccgaguggagcgagcggugcuccgcggagugcggcgccggggugcgcacccggagcguggucugcaugacgaaccacguguccagccucccccuggagggcugcggcaacaaccgccccgccgaggccaccccgugcgacaacgggcccugcaccggcaagguggagugguucgccggguccuggagccagugcuccaucgagugcggcagcggcacccagcagcgggaggucaucugcgugcgcaagaacgcggacacguucgaggugcuggaccccagcgagugcuccuuccucgagaagcccccgagccagcaguccugccaccugaagcccugcggggccaagugguucagcaccgagugguccaugugcagcaaguccugccagggcggguuccggguccgcgaggugcggugccugagcgacgacaugacccucuccaaccugugcgacccccagcugaagcccgaggagcgcgagagcugcaacccgcaggacugcgugcccgaggucgacgagaacugcaaggacaaguacuacaacugcaacguggugguccaggcccggcucugcguguacaacuacuacaagaccgccugcugcgccuccugcacgcgcguggcgaaccggcagaccggcuuccuggggagccgcuga

SEQ ID NO: 37668 - RNA, 4974 nt, Artificial Sequence
  derived and/or modified sequence opt1 from THSD7A__Homo_sapiens__NP_056019
augggccugcaggcccgccggugggccagcgggucccgcggcgcggccgggccccggcgcggcgugcuccagcugcugccgcucccccugccccugccccuccugcugcuccugcugcuccggccgggggccggccgcgccgccgcgcagggcgaggccgaggcccccacccuguaccuguggaagaccgggcccuggggccggugcaugggggacgagugcggccccgggggcauccagacgcgcgccgucuggugcgcgcacguggagggcuggaccacccuccacaccaacugcaagcaggccgagcggccgaacaaccagcagaacugcuucaaggugugcgacuggcacaaggagcuguacgacuggcgccuggggcccuggaaccagugccagcccgucaucagcaagucccucgagaagccccuggagugcaucaagggcgaggaggggauccaggugcgggagaucgccugcauccagaaggacaaggacaucccggccgaggacaucaucugcgaguacuucgagcccaagccccugcucgagcaggccugccugauccccugccagcaggacugcaucgugagcgaguucuccgcguggagcgagugcuccaagacgugcggcagcggccugcagcaccgcacccggcacgucguggccccgccccaguucgggggcuccgggugccccaaccucaccgaguuccaggugugccagagcucccccugcgaggccgaggagcugcgcuacagccugcacgucggcccgugguccacgugcagcaugccccacucccgccaggugcggcaggcccggcgccgggggaagaacaaggagcgcgagaaggaccggagcaagggcgugaaggaccccgaggcccgcgagcucaucaagaagaagcgcaaccggaaccgccagaaccggcaggagaacaaguacugggacauccagaucggcuaccagacccgcgaggucaugugcaucaacaagaccgggaaggcggccgaccuguccuucugccagcaggagaagcugcccaugaccuuccagagcugcgugaucaccaaggagugccagguguccgaguggagcgaguggagcccgugcuccaagacgugccacgacauggucagccccgccggcacccgggugcgcacccggaccauccgccaguuccccaucggguccgagaaggagugccccgaguucgaggagaaggagccgugccucagccagggcgacggggugguccccugcgccacguacggcuggcggaccaccgaguggaccgagugccgcguggacccccugcugucccagcaggacaagcggcgcggcaaccagacggcccucugcgggggcgggauccagacccgggagguguacugcguccaggcgaacgagaaccugcugagccagcucuccacccacaagaacaaggaggccagcaagccgauggaccugaagcugugcaccggccccauccccaacacgacccagcucugccacauccccugcccgaccgagugcgaggugucccccuggagcgccugggggcccugcaccuacgagaacugcaacgaccagcagggcaagaagggcuucaagcugcgcaagcggcgcaucacgaacgagcccaccgggggcuccggggugaccggcaacugcccgcaccuccucgaggccauccccugcgaggagcccgccugcuacgacuggaaggcgguccggcugggcaacugcgagcccgacaacgggaaggagugcggcccggggacccaggugcaggaggucgugugcaucaacagcgacggcgaggagguggaccgccagcugugccgggacgccaucuuccccauccccgucgccugcgacgcccccugcccgaaggacugcgugcucuccacguggagcaccugguccagcugcucccacacgugcagcgggaagaccaccgagggcaagcagauccgcgcgcgcuccauccuggccuacgccggcgaggagggcgggauccggugccccaacagcagcgcccugcaggaggugcgcuccugcaacgagcaccccugcaccgucuaccacuggcagaccgggcccuggggccagugcaucgaggacaccagcguguccagcuucaacaccacgaccaccuggaacggggaggccuccugcagcgugggcaugcagacccggaaggucaucugcgugcgcgugaacgucggccagguggggccgaagaagugccccgagucccuccggcccgagacggugcgccccugccugcugccgugcaagaaggacugcaucgucacccccuacagcgacuggaccuccugccccagcuccugcaaggagggcgacagcuccauccggaagcagagccgccaccgggugaucauccagcugccggcgaacgggggccgcgacugcaccgacccccucuacgaggagaaggccugcgaggcgccccaggccugccaguccuaccgguggaagacgcacaaguggcgccggugccagcuggugcccuggagcguccagcaggacuccccgggggcccaggagggcugcggccccgggcgccaggcccgggccaucacgugccgcaagcaggacggcgggcaggccggcauccacgagugccugcaguacgccgggcccgugcccgcccucacccaggcgugccagaucccgugccaggacgacugccagcugaccagcuggagcaaguucuccagcugcaacggcgacugcggcgccgugcggacccgcaagcggacccuggucgggaaguccaagaagaaggagaagugcaagaacagccaccucuacccccugaucgagacccaguacugccccugcgacaaguacaacgcccagcccgugggcaacugguccgacugcauccugccggaggggaagguggagguccuccugggcaugaaggugcagggcgacaucaaggagugcgggcagggcuaccgcuaccaggccauggcgugcuacgaccagaacgggcggcugguggagaccagccgcugcaacucccacggcuacaucgaggaggccugcaucauccccugccccagcgacugcaagcucuccgaguggagcaacuggucccgcugcagcaaguccugcgggagcggcgucaaggugcgguccaaguggcugcgcgagaagcccuacaacggcgggcggccgugccccaagcuggaccacgugaaccaggcccaggucuacgagguggugcccugccacagcgacugcaaccaguaccucugggucacggagcccugguccaucugcaaggugaccuucgugaacaugcgcgagaacugcggcgaggggguccagacccggaaggugcgcugcaugcagaacaccgccgacggcccgagcgagcacguggaggacuaccugugcgaccccgaggagaugccccuggggucccgggucugcaagcuccccugcccggaggacugcgugaucagcgaguggggccccuggacgcagugcgugcugcccugcaaccagagcuccuuccgccagcggagcgccgaccccauccgccagccggcggacgagggccgguccugccccaacgccgucgagaaggagcccugcaaccugaacaagaacugcuaccacuacgacuacaacgugaccgacuggagcacgugccagcucuccgagaaggccgugugcgggaacggcaucaagacccgcaugcuggacugcguccggagcgacgggaaguccguggaccugaaguacugcgaggcccucggccuggagaagaacuggcagaugaacaccagcugcaugguggagugcccggucaacugccagcuguccgacuggagccccugguccgagugcagccagaccugcgggcucaccggcaagaugauccgccggcgcaccgugacgcagcccuuccagggcgacgggcggcccugcccgucccugauggaccagagcaagcccugccccgugaagcccugcuaccgcuggcaguacggccagugguccccgugccagguccaggaggcccagugcggggagggcacccggacccgcaacaucagcugcguggucuccgacggcagcgcggacgacuucuccaaggugguggacgaggaguucugcgccgacaucgagcugaucaucgacgggaacaagaacaugguccucgaggagagcugcagccagcccugccccggcgacugcuaccugaaggacugguccagcuggucccugugccagcugaccugcgugaacggggaggaccugggcuucgggggcauccaggugcgcagccggcccgucaucauccaggagcuggagaaccagcaccucugcccggagcagaugcuggagacgaaguccugcuacgacggccagugcuacgaguacaaguggauggccagcgccuggaagggguccagccgcaccguguggugccagcgguccgacggcaucaacgugaccgggggcugccuggucaugagccagcccgacgccgaccgcuccugcaacccgcccugcagccagccccacuccuacugcagcgagaccaagacgugccacugcgaggagggguacaccgaggugauguccagcaacuccacccucgagcagugcacccugauccccguggucgugcugcccaccauggaggacaagcggggcgacgugaagacgagccgcgcgguccaccccacccagccguccagcaaccccgccggccgggggcgcaccugguuccuccagcccuucggccccgacgggcggcugaagaccuggguguacggcguggccgccggggcguucguccugcucaucuucaucgugagcaugaucuaccuggccugcaagaagccgaagaagccccagcgccggcagaacaaccgccugaagccccucacgcuggccuacgacggcgacgccgacauguga

SEQ ID NO: 37669 - RNA, 501 nt, Artificial Sequence
  derived and/or modified sequence opt1 from THYN1__Homo_sapiens__NP_001032381
augagccgcccccggaagcgccuggccggcaccagcgggagcgacaagggccucuccgggaagcggaccaagacggagaacagcggcgaggcccuggcgaagguggaggacuccaacccgcagaagaccagcgccaccaagaacugccugaagaaccucuccagccacuggcugaugaaguccgagcccgagagccgccuggagaagggggucgacgugaaguucuccaucgaggaccucaaggcccagcccaagcagaccacgugcugggacggcgugcggaacuaccaggcccgcaacuuccugcgggccaugaagcugggcgaggaggcguucuucuaccacagcaacugcaaggagcccgggaucgccggccucaugaagaucgucaaggaggccuacccggaccacacccaguucgagaagaacaacccccacuacgaccccuccagcaaggaggacaaccccaagugguccaugaagucccugauccuguucuga

SEQ ID NO: 37670 - RNA, 1128 nt, Artificial Sequence
  derived and/or modified sequence opt1 from TIA1__Homo_sapiens__NP_071320
auggaggacgagaugcccaagacccuguacgugggcaaccucagccgcgacgucaccgaggcccugauccugcagcuguucucccagaucgggccgugcaagaacugcaagaugaucauggacacggccggcaacgaccccuacugcuucguggaguuccacgagcaccggcacgcggccgccgcccucgccgcgaugaacgggcgcaagaucaugggcaaggaggugaaggucaacugggccaccacccccagcucccagaagaaggacaccagcaaccacuuccacguguucgugggggaccugucccccgagaucacgaccgaggacaucaaggccgccuucgcgccguucggccggaucagcgacgcccgcgucgugaaggacauggccaccggcaaguccaagggguacggcuucgugagcuucuucaacaagugggacgccgagaacgccauccagcagaugggcgggcaguggcucgggggccggcagauccgcaccaacugggcgacgcggaagccgcccgcccccaaguccaccuacgagagcaacaccaagcagcuguccuacgacgaggucgugaaccagagcucccccagcaacugcaccguguacugcggcggggucacguccggccugaccgagcagcucaugcgccagaccuucagccccuucgggcagaucauggagauccggguguuccccgacaagggcuacuccuucgugcgcuucaacagccacgaguccgccgcccacgccaucgucagcgugaacggcaccacgaucgaggggcacguggucaagugcuacuggggcaaggagacccuggacaugaucaaccccgugcagcagcagaaccagaucggguacccgcagcccuacggccagugggggcagugguacggcaacgcgcagcagaucggccaguacaugcccaacggguggcagguccccgccuacggcauguacgggcaggccuggaaccagcagggcuucaaccagacccagagcuccgccccguggauggggcccaacuacggcgugcagccgccccagggccagaacgggagcaugcugcccaaccagcccuccggcuaccggguggccggguacgagacccaguga

SEQ ID NO: 37671 - RNA, 348 nt, Artificial Sequence
  derived and/or modified sequence opt1 from TIAF1__Homo_sapiens__NP_004731
augagcucccccagcuccccguuccgcgagcagagcuuccugugcgccgccggcgacgcgggggaggagucccgggugcagguccucaagaacgaggugcgccggggcagccccgugcugcuggggugggucgagcaggccuacgccgacaagugcgugugcggccccuccgcgcccccggcccccaccccgcccagccucucccagcgcgugaugugcaacgaccuguucaaggucaaccccuuccagcugcagcaguuccgggccgaccccagcaccgccucccuccugcugugccccgggggccucgaccacaagcugaaccugcgcggcaaggccuggggguga

SEQ ID NO: 37672 - RNA, 1179 nt, Artificial Sequence
  derived and/or modified sequence opt1 from TIAL1__Homo_sapiens__NP_001029097
augauggaggacgacggccagccccgcacccuguacguggggaaccucagccgggacgucaccgaggugcugauccugcagcuguucucccagaucggccccugcaagagcugcaagaugaucacggagcagcccgacucccgccgggugaacagcuccgucggguucagcgugcuccagcacaccuccaacgaccccuacugcuucguggaguucuacgagcaccgcgacgccgccgccgcccuggccgccaugaacggccggaagauccucgggaaggaggucaaggugaacugggccaccacccccagcucccagaagaaggacacgagcaaccacuuccacguguucgucggcgaccugucccccgagaucaccaccgaggacaucaagagcgcguucgcccccuucggcaagaucuccgacgcccgcguggugaaggacauggccaccggcaagagcaagggguacggguucgucuccuucuacaacaagcuggacgcggagaacgccaucgugcacaugggcgggcaguggcucggcggccggcagauccgcacgaacugggccacccggaagccgcccgcccccaagagcacccaggagaacaacaccaagcagcugcgcuucgaggacguggucaaccaguccagccccaagaacugcacgguguacugcgggggcaucgccuccgggcugaccgaccagcucaugcggcagaccuucagccccuucggccagaucauggagauccgcguguuccccgagaagggcuacagcuucguccgguucuccacccacgagagcgcggcccacgccaucguguccgugaacgggacgaccaucgagggccacgucgugaagugcuacugggggaaggagagcccggacaugaccaagaacuuccagcaggucgacuacucccaguggggccaguggagccagguguacgggaacccccagcaguacggccaguacauggccaacggcuggcaggucccgcccuacgggguguacggccagcccuggaaccagcagggguucggcguggaccagucccccagcgccgcguggaugggcggguucggcgcccagccgccccaggggcaggcgcccccgcccgugaucccgccgcccaaccaggccggcuacgggauggccuccuaccagacccaguga

SEQ ID NO: 37673 - RNA, 4776 nt, Artificial Sequence
  derived and/or modified sequence opt1 from TIAM1__Homo_sapiens__XP_005261095
augggcaacgccgagagccagcacguggagcacgaguucuacggggagaagcacgccucccugggccgcaagcacaccagccggucccuccgccugagccacaagacccggcgcacgcggcacgcguccagcgggaaggucauccaccgcaacuccgaggugagcacccgguccagcuccacccccagcaucccgcagucccuggccgagaacggccucgagcccuucagccaggacgggacccuggaggacuucggcucccccaucuggguggaccgcgucgacaugggccugcggcccgugagcuacacggacuccagcgugaccccguccgucgacagcagcaucgugcucaccgccgccuccgugcagagcaugcccgacaccgaggagucccgccuguacggggacgacgccacguaccuggcggagggcgggcggcgccagcacagcuacaccuccaacggccccaccuucauggagaccgccagcuucaagaagaagcgguccaagagcgccgacaucuggcgcgaggacucccucgaguucagccuguccgaccugagccaggagcaccucacguccaacgaggagauccuggggagcgccgaggagaaggacugcgaggaggcgcggggcauggagacccgcgccagcccccggcagcuguccacgugccagcgcgccaacucccucggcgaccuguacgcccagaagaacagcggggucaccgccaacggcgggccgggcuccaaguucgcgggcuacugccggaaccuggugagcgacauccccaaccucgccaaccacaagaugccgcccgccgccgccgaggagaccccgcccuacagcaacuacaacacccugcccugccgcaagucccacugccugagcgagggggcgaccaacccccagaucucccacagcaacuccaugcagggccggcgcgccaagaccacgcaggacgugaacgccggggagggcagcgaguucgccgacuccgggaucgagggcgccaccaccgacaccgaccuccugagccgccgguccaacgcgacgaacagcuccuacagccccaccaccggccgcgccuucgucggguccgacagcggcuccagcuccaccggggacgccgcccggcagggcguguacgagaacuuccgccgggagcuggagaugagcacgaccaacagcgagucccucgaggaggccgggagcgcgcacuccgacgagcagagcuccggcacccugagcucccccggccagagcgacauccugcucaccgccgcccaggggacggugcgcaaggccggcgcgcuggccgucaagaacuuccuggugcacaagaagaacaagaagguggaguccgccacccggcgcaaguggaagcacuacugggucagccucaaggggugcacccuguucuucuacgaguccgacggccggagcgggaucgaccacaacuccauccccaagcacgccguguggguggagaacagcaucguccaggccgugcccgagcacccgaagaaggacuucguguucugccuguccaacagccucggcgacgcguuccuguuccagaccacgucccagaccgagcuggagaacuggaucaccgccauccacagcgccugcgccaccgccgucgcgcgccaccaccacaaggaggacacccuccggcugcugaaguccgagaucaagaagcucgagcagaagaucgacauggacgagaagaugaagaagaugggcgagaugcagcugagcagcgugacggacuccaagaagaagaagaccauccuggaccagaucuucgucugggagcagaaccucgagcaguuccagauggaccuguuccgcuuccggugcuaccuggccagccuccagggcggggagcugcccaaccccaagcgccugcucgccuucgccucccggcccaccaagguggccauggggcgccugggcaucuucagcguguccagcuuccacgcgcuggucgccgcccggaccggcgagacgggggugcgccggcgcacccaggccaugucccgcagcgcguccaagcggcgcagccgguucuccagccuguggggccucgacaccaccuccaagaagaagcaggggcgcccgagcaucaaccagguguucggcgaggggacggaggccgucaagaagucccuggagggcaucuucgacgacaucgugcccgacggcaagcgggagaaggaggugguccugcccaacgugcaccagcacaaccccgacugcgacaucugggugcacgaguacuucaccccgagcugguucugccuccccaacaaccagcccgcccugaccgucgugcgcccgggggacaccgcccgggacacgcuggagcucaucugcaagacccaccagcuggaccacuccgcccacuaccugcgccucaaguuccugaucgagaacaagaugcagcuguacgugccccagcccgaggaggacaucuacgagcuccuguacaaggagaucgagaucugccccaaggucacccagagcauccacaucgagaaguccgacaccgcggccgacacguacggcuucagccugagcuccguggaggaggacgggauccggcgccucuacgugaacagcgucaaggagaccggccuggccuccaagaaggggcugaaggccggcgacgagauccucgagaucaacaaccgggccgcggacgcccugaacagcuccaugcugaaggacuuccucagccagccgucccugggccugcucgugcgcaccuaccccgagcuggaggaggggguggagcugcucgagagcccgccccaccgggucgacggccccgccgaccugggggagagcccccuggccuuccucaccuccaaccccggccacucccugugcagcgagcagggguccagcgccgagacggcgcccgaggagaccgagggcccggaccuggaguccagcgacgagaccgaccacuccagcaaguccaccgagcaggucgccgccuucugccgcagccuccacgagaugaaccccagcgaccagucccccagcccccaggacuccacgggcccgcagcuggccaccaugcggcagcugagcgacgcggacaagcuccgcaaggugaucugcgagcugcuggagaccgagcggaccuacgugaaggaccucaacugccugauggagcgcuaccugaagccccuccagaaggagacguuccugacccaggacgagcuggacguccucuucgggaaccugaccgagaugguggaguuccagguggaguuccugaagacccucgaggacggcgugcggcuggugcccgaccuggagaagcucgagaaggucgaccaguucaagaaggugcuguucucccucgggggcagcuuccuguacuacgccgaccgcuucaagcuguacuccgccuucugcgccagccacacgaaggugcccaagguccuggugaaggccaagaccgacaccgcguucaaggccuuccucgacgcccagaacccgaagcagcagcacuccagcacccuggaguccuaccugaucaagcccauccagcggauccucaaguacccccugcugcuccgcgagcuguucgcccugacggacgccgagagcgaggagcacuaccaccucgacguggcgaucaagaccaugaacaaggucgccucccacaucaacgagaugcagaagauccacgaggaguucggggccguguucgaccagcugaucgccgagcagaccggcgagaagaaggagguggccgaccugagcaugggcgaccuccugcugcacaccaccgucaucuggcucaacccgcccgcgucccuggggaaguggaagaaggagcccgagcuggccgccuucguguucaagacggccgugguccucguguacaaggacggcagcaagcagaagaagaagcugguggggucccaccgccugagcaucuacgaggacugggaccccuuccgguuccgccacaugaucccgaccgaggcccuccagguccgggcgcuggccuccgccgacgccgaggcgaacgccgugugcgagaucgugcacgucaagagcgagagcgagggccgccccgagcggguguuccaccugugcugcuccagccccgagucccgcaaggacuuccucaaggccgugcacagcauccugcgggacaagcaccgccggcagcugcucaagaccgagucccugcccagcucccagcaguacgucccguucggcgggaagcgccugugcgcccucaagggcgcccggcccgcgaugagccgcgccguguccgcccccagcaagucccuggggcggcgccggcgccggcuggcccgcaaccgguucaccaucgacagcgacgccgucuccgcgagcucccccgagaaggagagccagcagccgcccggcgggggcgacacggaccgcuggguggaggagcaguucgaccucgcccaguacgaggagcaggacgacaucaaggagaccgacauccuguccgacgacgacgaguucugcgagagcgugaagggcgccuccgucgaccgcgaccugcaggagcggcuccaggccaccagcaucagccagcgcgagcgggggcgcaagacccuggacucccacgccagccggauggcgcagcugaagaagcaggccgcccuguccggcaucaacgggggccucgagagcgccuccgaggaggugaucugggugcgccgggaggacuucgcgcccagccgcaagcugaacacggagaucuga

SEQ ID NO: 37674 - RNA, 5106 nt, Artificial Sequence
  derived and/or modified sequence opt1 from TIAM2__Homo_sapiens__NP_036586
augggcaacagcgacagccaguacacccugcaggggagcaagaaccacuccaacaccaucaccggcgccaagcagauccccugcagccucaagauccgcgggauccacgccaaggaggagaagucccugcacggcugggggcacggcagcaacggcgccggguacaagucccggagccuggcccgcuccugccucagccacuucaaguccaaccagcccuacgccagccggcugggcgggccgaccugcaaggugucccgcggcguggccuacagcacccaccggaccaacgcccccgggaaggacuuccagggcaucuccgcggccuucagcacggagaacggcuuccacuccguggggcacgagcuggccgacaaccacaucaccagccgcgacugcaacggccaccuccugaacugcuacgggcggaacgaguccaucgccagcacgccgcccggcgaggaccgcaagagcccccgggugcugaucaagacccucggcaagcuggacgggugccugcgcgucgaguuccacaacggcgggaaccccuccaaggugcccgcggaggacugcagcgagcccgugcagcuccugcgguacucccccacgcuggccagcgagaccucccccguccccgaggcccgccggggcagcuccgccgacagccuccccucccaccgccccagccccaccgacucccggcugcgcagcuccaaggggagcucccugagcuccgagagcuccugguacgacagccccuggggcaacgccggcgagcucagcgaggcggagggguccuuccuggcccccggcaugcccgaccccagccugcacgccuccuucccgcccggggacgccaagaagcccuucaaccagagcuccagccucuccagccugcgggagcuguacaaggacgccaaccucggcucccugagccccuccgggauccgccugagcgacgaguacaugggcacccacgcgucccucagcaaccggguguccuucgccagcgacaucgacgugcccucccgcgucgcccacggcgacccgauccaguacagcagcuucacgcugcccugccggaagcccaaggccuucguggaggacaccgccaagaaggacucccugaaggcgcgcaugcgccggaucagcgacuggaccgggucccucagccgcaagaagcggaagcugcaggagccccgcuccaaggagggcagcgacuacuucgacucccggagcgacgggcugaacaccgacgugcagggcuccagccaggccuccgccuuccucuggagcgggggcuccacgcagauccugagccagcgcuccgagagcacccacgccaucggcuccgacccgcugcggcagaacaucuacgagaacuucaugcgcgagcucgagaugagccggaccaacaccgagaacaucgagacguccaccgagaccgccgagagcagcuccgagagccuguccagccuggagcagcucgaccugcuguucgagaaggagcagggggucgugcgcaaggcgggcuggcuguucuucaagccccuggugaccguccagaaggagcggaagcuggagcucguggcccgccggaaguggaagcaguacugggugacgcugaaggggugcacccuccuguucuacgagaccuacggcaagaacuccauggaccagagcuccgcgccccgcugcgcccuguucgcggaggacagcaucguccaguccgugcccgagcaccccaagaaggagaacguguucugccugagcaacuccuucggcgacgucuaccuguuccaggccaccagccagacggaccucgagaacugggugaccgccgugcacuccgccugcgccagccuguucgcgaagaagcacgggaaggaggacacccugcggcuccugaagaaccagaccaagaaccugcuccagaagaucgacauggacuccaagaugaagaagauggccgagcugcagcugagcgucguguccgaccccaagaaccgcaaggccaucgagaaccagauccagcagugggagcagaaccucgagaaguuccacauggaccuguuccggaugcgcugcuaccuggccagccuccagggcggggagcugcccaacccgaagucccugcucgccgcggccagccggcccagcaagcuggcccugggccgccucgggauccuguccgucagcuccuuccacgcccuggugugcagccgcgacgacuccgcccuccggaagcgcacgcugagccugacccagcggggccgcaacaagaagggcaucuucuccagccucaaggggcuggacacccuggcgcggaagggcaaggagaagcgccccuccaucacccagguggacgagcuccugcacaucuacgggagcacggucgacggcgugccccgggacaacgccugggagauccagaccuacgugcacuuccaggacaaccacggggucaccgugggcaucaagccggagcaccgcguggaggacauccugacccucgccugcaagaugcggcagcuggagcccucccacuacggccugcagcuccgcaagcuggucgacgacaacguggaguacugcauccccgcccccuacgaguacaugcagcagcaggucuacgacgagaucgaggucuucccgcugaacguguacgacgugcagcucaccaagacggggagcgucugcgacuucggcuucgcggugaccgcccagguggacgagcggcagcaccugucccgcaucuucaucagcgacguccugcccgacgggcucgccuacggcgaggggcugcggaagggcaacgagaucaugacccugaacggcgaggccguguccgaccucgaccugaagcagauggaggcccuguucagcgagaaguccguggggcucacccugaucgcgcggccgcccgacacgaaggccacccugugcaccagcugguccgacagcgaccucuucagccgggaccagaagucccugcugccgccgcccaaccagagccagcuccuggaggaguuccuggacaacuucaagaagaacaccgccaacgacuucuccaacguccccgacaucacgaccggccucaagcgcagccagaccgacgggacccuggaccaggugucccaccgggagaagauggagcagacguuccgcagcgccgagcagaucaccgcccugugccgguccuucaacgacagccaggcgaacggcauggaggggccgcgcgagaaccaggacccgccgccccgcccgcucgcccgccaccuguccgacgccgaccgccugcggaaggugauccaggagcucgucgacaccgagaaguccuacgugaaggaccuguccugccuguucgagcucuaccuggagccccugcagaacgagaccuuccucacgcaggacgagauggagagccuguucggcucccugcccgagaugcucgaguuccagaagguguuccuggagacccuggaggacggcaucagcgccuccagcgacuucaacacccucgagaccccgucccaguuccgcaagcugcuguucagccucgggggcuccuuccuguacuacgccgaccacuucaagcuguacagcggguucugcgcgaaccacaucaagguccagaaggugcucgagcgggccaagacggacaaggccuucaaggccuuccuggacgcgcgcaaccccaccaagcagcacagcuccacccuggagagcuaccucaucaagcccgugcagcggguccugaaguacccccugcuccugaaggagcuggugucccucaccgaccaggagagcgaggagcacuaccaccugacggaggcccugaaggccauggagaagguggccucccacaucaacgagaugcagaagaucuacgaggacuacggcaccgucuucgaccagcucguggccgagcagagcggcaccgagaaggaggugaccgagcuguccaugggggagcugcucaugcacagcacggucuccuggcugaacccguuccugagccugggcaaggcgcgcaaggaccucgagcugaccguguucguguucaagcgggccgucauccugguguacaaggagaacugcaagcucaagaagaagcugcccuccaacagccgccccgcccacaacuccaccgaccuggaccccuucaaguuccgguggcucaucccgaucagcgcccuccaggugcgccuggggaaccccgccggcaccgagaacaacuccaucugggagcucauccacaccaagagcgagaucgaggggcggcccgagacgaucuuccagcugugcugcuccgacagcgaguccaagaccaacaucgucaaggugauccgcagcauccugcgggagaacuuccgccggcacaucaagugcgagcucccccuggagaagaccugcaaggaccgccuggugccgcucaagaaccggguccccgugagcgcgaagcuggccuccagccgcucccugaaggugcucaagaacagcuccagcaacgaguggacgggcgagaccggcaaggggacccugcuggacuccgacgagggcagccucuccagcgggacccaguccagcggcugccccaccgccgaggggcggcaggacuccaagagcacgucccccggcaaguacccgcaccccggccuggccgacuucgccgacaaccugaucaaggagagcgacauccucuccgacgaggacgacgaccaccgccagaccgucaagcaggggagccccaccaaggacaucgagauccaguuccagcgccugcggaucagcgaggaccccgacgugcacccggaggcggagcagcagcccggccccgaguccggggagggccagaagggcggggagcagcccaagcuggugcgcggccacuucugcccgaucaagcggaaggccaacagcaccaagcgcgaccgggggacgcuccugaaggcccagauccgccaccagucccuggacagccaguccgagaacgccaccaucgaccucaacagcguccuggagcgggaguucuccgugcagagccugaccuccgucgugagcgaggagugcuucuacgagaccgagucccacggcaagagcuga

SEQ ID NO: 37675 - RNA, 2139 nt, Artificial Sequence
  derived and/or modified sequence opt1 from TICAM1__Homo_sapiens__NP_891549
auggccugcaccggccccagccugccguccgccuucgacauccucggggcggccggccaggacaagcugcuguaccucaagcacaagcugaagacgccccgccccgggugccagggccaggaccugcuccacgccauggugcugcugaagcucgggcaggagaccgaggcccggaucagccuggaggcccugaaggcggacgccgucgcccgccucguggcccggcagugggcgggcguggacuccaccgaggaccccgaggagccgcccgacgucagcugggccguggcccgccuguaccaccuccucgccgaggagaagcugugccccgccucccugcgggacguggcguaccaggaggccguccgcacccucagcucccgggacgaccaccgccugggcgagcugcaggacgaggcccggaaccgcugcgggugggacaucgccggcgaccccgggagcauccggacccuccaguccaaccugggcugccugccgcccagcuccgcccuccccagcgggacgcgcucccugccccggccgaucgacggcgugagcgacuggucccagggcugcagccugcgcuccaccgggagccccgcgucccucgccagcaaccuggagaucagccagucccccaccaugcccuuccugagccuccaccgguccccgcacggccccagcaagcugugcgacgacccccaggccucccuggugcccgagccgguccccgggggcugccaggagcccgaggagaugagcuggcccccguccggcgagaucgccagcccgcccgagcugcccuccagcccgccgcccgggcugcccgagguggcccccgacgcgaccuccacgggccugcccgacacccccgccgcccccgagaccagcaccaacuaccccguggagugcacggagggguccgccggcccccagagccucccccugccgauccuggagcccgucaagaaccccugcuccgugaaggaccagacgccccuccagcugagcguggaggacaccaccuccccgaacaccaagcccugcccgcccacccccaccacccccgagacgagcccgccgcccccgccgccgccgcccuccagcacccccugcagcgcccaccugacccccuccagccucuuccccuccagccuggaguccagcuccgagcagaaguucuacaacuucgucauccugcacgcgcgcgccgacgagcacaucgcccuccgggugcgcgagaagcuggaggcccugggggugcccgacggcgcgaccuucugcgaggacuuccagguccccggccgcggggagcucagcugccugcaggacgccaucgaccacuccgccuucaucauccugcugcucacgagcaacuucgacugccggcugucccugcaccaggugaaccaggccaugaugagcaaccucacccggcagggcucccccgacugcgugauccccuuccugccccuggagagcucccccgcccagcucagcuccgacaccgcgagccugcugagcgggcucguccgccuggacgagcacucccagaucuucgcccgcaagguggccaacaccuucaagccccaccggcugcaggcccgcaaggccauguggcggaaggagcaggacacgcgcgcgcuccgggagcagagccagcaccuggacggcgagcgcaugcaggccgccgcccugaacgccgcguacuccgccuaccuccagagcuaccuguccuaccaggcccagauggagcagcuccagguggccuucgggagccacauguccuucggcaccggcgcgcccuacggggcccggaugcccuucggcgggcaggucccccugggcgcgcccccgcccuuccccaccuggcccgggugcccccagccgccgccccugcacgccuggcaggccggcacgccgcccccgcccagcccccagcccgccgccuucccccagucccugcccuucccccagagccccgccuuccccaccgccucccccgccccgccccagagccccggccuccagccccugaucauccaccacgcgcagauggugcagcuggggcucaacaaccacauguggaaccagcgcggcucccaggcccccgaggacaagacccaggaggccgaguga

SEQ ID NO: 37676 - RNA, 708 nt, Artificial Sequence
  derived and/or modified sequence opt1 from TICAM2__Homo_sapiens__NP_067681
augggcaucggcaagagcaagaucaacuccugcccccugagccucuccugggggaagcgccacagcguggacaccuccccgggguaccacgagagcgacuccaagaaguccgaggaccugagccugugcaacgucgccgagcacagcaacaccacggagggccccaccgggaagcaggagggcgcccaguccguggaggagauguucgaggaggaggcggaggaggagguguuccucaaguucgucauccugcacgccgaggacgacaccgacgaggcccugcgggugcagaaccuccugcaggacgacuucggcaucaagcccgggaucaucuucgccgagaugcccugcggccgccagcaccuccagaaccuggacgacgccgugaacgggagcgcguggaccauccugcugcucacggagaacuuccugcgggacaccuggugcaacuuccaguucuacaccucccugaugaacagcgucaaccgccagcacaaguacaacuccgugaucccgaugcggccccucaacaacccccugccccgcgagcggaccccguucgcccugcagacgaucaacgcccucgaggaggagagccgcggcuuccccacccagguggagcggaucuuccaggaguccgucuacaagacccagcagaccaucuggaaggagacgcgcaacauggugcagcggcaguucaucgccuga

SEQ ID NO: 37677 - RNA, 5733 nt, Artificial Sequence
  derived and/or modified sequence opt1 from TICRR__Homo_sapiens__NP_689472
auggccugcugccacaaggugaugcugcuccuggacaccgccggcggggccgcccgccacagccgggugcgccgggccgcccugcgccuccugaccuaccuguccugccgguucggccucgcccgcgugcacugggcguucaaguucuucgacagccagggggcccggucccgccccagccggguguccgacuuccgcgagcugggcagccgguccugggaggacuucgaggaggagcuggaggcccgccucgaggaccgggcccaccuccccgggcccgcgccccgcgccacccacacccacggcgcccugauggagacccuccuggacuaccagugggaccggcccgagaucaccagccccaccaagcccauccugcgcuccagcggccggcgccuccuggacgucgaguccgaggccaaggaggccgaggcggcccucgggggccucgugaacgccguguuccugcuggcccccugcccccacagccagcgggagcuccugcaguucgucuccgggugcgaggcccaggcgcagcgccugccgcccacccccaagcaggucauggagaagcuccugcccaagcgggugcgcgaggucaugguggcccgcaagaucaccuucuacuggguggacaccaccgaguggagcaagcugugggagucccccgaccaccucggcuacuggaccgucugcgagcugcugcaccacgggggcggcaccgugcuccccagcgaguccuucagcugggacuucgcccaggccggggagaugcugcugcgguccggcaucaagcucagcagcgagccccaccugucccccuggaucagcaugcugccgaccgacgccacgcucaaccgccugcuguacaacucccccgaguacgaggcgagcuucccccggauggaggggaugcuguuccugcccguggaggccggcaaggagauccaggagaccuggaccgucacccuggagccgcucgccaugcaccagcgccacuuccagaagcccgugcggaucuuccugaagggcuccguggcccaguggagccugcccacguccagcacccucgggaccgacuccuggaugcugggcagccccgaggaguccaccgccacgcagcgccuccuguuccagcagcuggucagccggcugaccgcggaggagcugcaccucguggccgacguggacccgggggagggccggccgcccaucaccggggucaucagcccccugagcgccuccgccaugauccugaccgugugccggacgaaggaggcggaguuccagcgccacgugcuccagaccgccgucgccgacagcccgcgggacaccgccucccuguucagcgacguggucgacuccauccugaaccagacccacgacagccucgccgacacggcgagcgccgccucccccgugcccgagugggcccagcaggagcugggccacaccaccccguggagccccgccguggucgagaagugguuccccuucugcaacaucuccggcgcgagcuccgaccugauggagagcuucgggcuccugcaggccgccuccgccaacaaggaggagagcuccaagaccgagggcgagcugauccacugccucgccgagcuguaccagcgcaagagccgggaggaguccacgaucgcgcaccaggaggacagcaagaagaagcgcggggugccccggaccccggugcgccagaagaugaacaccaugugccggucccugaagaugcucaacgucgcccgccugaacgugaaggcccagaagcugcaccccgacggcagccccgacguggccggggagaagggcauccagaagauccccuccggccggaccgucgacaagcucgaggaccgcgggcgcacgcugcggagcuccaagccgaaggacuucaagaccgaggaggagcugcucagcuacauccgcgagaacuaccagaagaccguggcgaccggcgagaucaugcuguacgccugcgcccggaacaugaucagcaccgugaagauguuccugaaguccaaggggacgaaggagcucgaggucaacugccugaaccaggugaaguccucccugcucaagaccagcaagucccugcgccagaaccugggcaagaagcucgacaaggaggacaaggugcgggagugccagcugcaggucuuccugcgccucgagaugugccugcagugccccagcaucaacgaguccaccgacgacauggagcaggucguggaggaggucaccgaccugcuccggauggugugccugacggaggacagcgccuaccuggccgaguuccucgaggagauccugcgccuguacaucgacuccauccccaagacccucgggaaccuguacaacagccugggcuucgugaucccccagaagcucgcgggcguccugccgaccgacuucuucuccgacgacagcaugacccaggagaacaagagcccccugcucagcgugcccuuccuguccagcgcccggcgcuccgugagcgggucccccgagagcgacgagcugcaggagcuccggacgcgcagcgccaagaagcggcgcaagaacgcccugauccggcacaaguccaucgccgaggucagccagaaccugcgccagaucgagaucccgaagguguccaagcgggcgaccaagaaggagaacagccaccccgcgccccagcagcccucccagccggugaaggacaccguccaggaggugaccaaggugcgccggaaccucuucaaccaggagcugcugagccccuccaagcgcagccucaagcggggccugccccgcucccacagcgucuccgccguggacgggcuggaggacaagcucgacaacuucaagaagaacaagggcuaccacaagcugcugaccaaguccguggccgagacccccguccacaagcagaucuccaagcgccuccugcaccggcagaucaagggccgcagcuccgacccggggcccgacaucggcgugguggaggagagccccgagaagggggacgagaucucccugcggcgcagcccgcggaucaagcagcucuccuucagccgcacccacagcgccuccuucuacagcgucucccagcccaagagccgguccgugcagcgcgugcacagcuuccagcaggacaaguccgaccagcgggagaacagccccguccaguccauccgcagccccaagucccugcuguucggcgcgaugagcgagaugaucuccccgagcgagaagggguccgcccggaugaagaagcgcagccggaacacccucgacuccgaggugcccgccgccuaccagacgcccaagaagucccaccagaagucccugagcuucagcaagaccacgccccgccggaucucccacaccccgcagacgccccuguacacccccgagcgccuccagaagucccccgcgaagaugaccccgaccaagcaggccgccuucaaggagucccugaaggacagcuccagccccggccacgacagcccccuggacagcaagaucacgccccagaagcggcacacccaggccggcgaggggaccucccucgagaccaagacgccgcgcacccccaagcggcagggcacccagccgcccggguuccugcccaacugcaccuggccccacagcgugaacuccagccccgagucccccagcugcccggccccgcccacguccagcaccgcgcagccccgccgcgagugccugacccccauccgggacccccuccgcacgccgccccgggccgccgccuucaugggcacgccccagaaccagacccaccagcagccccacguccugcgcgccgcgcgggccgaggagcccgcccagaagcugaaggacaaggccaucaagacccccaagcgccccgggaacuccaccgugaccagcagcccgcccgugacgccgaagaagcuguucaccagcccccugugcgacgucagcaagaagucccccuuccgcaaguccaagaucgagugccccuccccgggcgagcuggaccagaaggagccccagaugagccccuccguggccgcgagccucuccugccccgugccgagcacgccgcccgagcugucccagcgcgccacccuggacacggugcccccgcccccgcccagcaaggugggcaagcggugccgcaagaccuccgacccgcggcgcagcaucguggagugccagcccgacgccuccgccacccccggggucggcaccgccgacagccccgcggccccgacggacucccgggacgaccagaaggggcucagccugagcccccaguccccgcccgagcgccggggcuaccccgggcccggccugcgcuccgacuggcacgccagcagcccccuccugaucaccuccgacaccgagcacgugacccugcucagcgaggccgagcaccacggcaucggggaccugaaguccaacguccugagcguggaggagggcgaggggcugcggacggcggacgccgagaaguccagccucucccaccccggcaucccgcccuccccgcccuccugcgggcccggcagcccccugaugcccucccgcgacgugcacugcaccaccgacggccggcagugccaggccagcgcccagcuggacaaccuccccgccuccgcguggcacagcaccgacuccgccagcccccagacguacgaggucgagcuggagaugcaggccuccgggcugcccaagcuccgcaucaagaagaucgaccccagcagcucccuggaggccgagccgcugagcaaggaggaguccagccucggcgaggaguccuuccugcccgcccugagcaugccccgggcgucccgcagccucuccaagcccgagccgaccuacguguccccgcccugcccccgccugucccacagcaccccggggaagucccggggccagaccuacaucugccaggccugcacgcccacccacggccccagcuccaccccgagccccuuccagaccgacggggugcccuggacgcccuccccgaagcacagcggcaagaccacccccgacaucaucaaggacuggccccgccggaagcgcgccgucgggugcggcgccggguccagcagcggccggggcgaggugggggccgaccugcccggcucccucagccugcuggaguccgaggggaaggaccacggccucgagcugagcauccaccgcaccccgauccuggaggacuucgagcucgagggggugugccagcugcccgaccagagcccgccccggaacagcaugccgaaggcggaggaggccuccagcuggggccaguucggccuguccagccgcaagcggguccuccuggccaaggaggaggccgaccgcggggcgaagcggaucugcgaccugcgcgaggacuccgaggugagcaaguccaaggagggcagccccuccuggagcgccuggcagcuccccuccacgggggacgaggagguguucgucagcggcuccacgcccccgcccagcugcgccgugcggagcugccuguccgccagcgcccugcaggcgcucacccagagcccccugcuguuccaggggaagacccccagcucccagagcaaggacccccgcgacgaggacguggacguccuccccuccacgguggaggacagccccuucucccgggccuucagccgccggcgccccaucucccggaccuacacccgcaagaagcugaugggcaccuggcuggaggaccucuga

SEQ ID NO: 37678 - RNA, 555 nt, Artificial Sequence
  derived and/or modified sequence opt1 from TIFA__Homo_sapiens__NP_443096
augaccagcuucgaggacgccgacaccgaggagacggugaccugccugcagaugaccgucuaccaccccggccagcuccagugcgggaucuuccaguccaucagcuucaaccgcgagaagcugccguccagcgagguggugaaguucggccggaacuccaacaucugccacuacaccuuccaggacaagcaggucagccgcgugcaguucucccugcagcuguucaagaaguucaacagcuccgugcucagcuucgagaucaagaacauguccaagaagacgaaccugaucgucgacagccgggagcucggguaccugaacaagauggaccugcccuaccgcugcauggugcgguucggcgaguaccaguuccucauggagaaggaggacggggagucccuggaguucuucgagacccaguucauccugagcccccgcucccuccugcaggagaacaacuggcccccgcaccggcccauccccgaguacggcaccuacagccugugcuccagccaguccagcagccccaccgagauggacgagaacgaguccuga

SEQ ID NO: 37679 - RNA, 1578 nt, Artificial Sequence
  derived and/or modified sequence opt1 from TIGD2__Homo_sapiens__NP_663761
augcugggcaagcgcaagcgggugguccucaccaucaaggacaagcuggacaucaucaagaagcuggaggaggggaucagcuucaagaagcucuccgugguguacggcaucggggagagcaccguccgcgacaucaagaagaacaaggagcggaucaucaacuacgccaacuccagcgaccccacguccggcgugagcaagcgcaaguccaugaaguccagcaccuacgaggagcuggaccgggugaugaucgagugguucaaccagcagaagaccgacgggaucccggucagcggcaccaucugcgccaagcaggcgaaguucuucuucgacgcccugggcauggagggggacuucaacgccuccagcggcuggcucacgcgcuucaagcagcggcacgggauccccaaggccgccggcaaggggaccaagcugaagggcgacgagaccgcggcccgcgaguucugcggcuccuuccaggaguucguggagaaggagaaccugcagcccgagcagaucuacggggccgaccagaccggccucuucuggaagugccugcccagccggacgcugacccucgagaccgaccaguccaccagcgggugccgcuccagccgggagcgcaucaucaucaugugcugcgccaacgcgacgggccugcacaagcugaaccucugcguggucggcaaggccaagaagccgcgggccuucaaggggaccgaccuguccaaccugcccgugaccuacuacagccagaagggcgccuggaucgagcagagcguguuccgccagugguucgagaaguacuucgucccccaggugcagaagcaccucaaguccaaggggcugcuggagaaggccgugcuccugcuggacuucccgcccgcgcggcccaacgaggagaugcucagcuccgacgacggccgcaucaucgucaaguaccugccgcccaacgugaccagccugauccagcccaugucccagggggugcucgccacggucaagcgguacuaccgcgccggccugcugcagaaguacauggacgagggcaacgaccccaagaucuucuggaagaaccucaccgugcuggacgccaucuacgaggugagccgggccuggaacauggucaaguccagcaccaucaccaaggcguggaagaagcuguuccccgggaacgaggagaacuccggcaugaacaucgacgagggggccauccucgccgccaaccuggccacggugcugcagaacaccgaggagugcgagcacguggacaucgagaacaucgaccagugguucgacagccgcuccagcgacuccagcugccagguccucaccgacuccgagagcgcggaggaccagaccaaggccgccgagcagaagcccuccagcaagucccggaagacggagcugaacccggagaagcacaucagccacaaggccgcccuggaguggaccgagaaccuccuggacuaccuggagcagcaggacgacaugcuccugagcgacaagcuggugcuccgccgccugcggaccaucauccgcaagaagcagaagauccagaacaacaagaaccacuga

SEQ ID NO: 37680 - RNA, 735 nt, Artificial Sequence
  derived and/or modified sequence opt1 from TIGIT__Homo_sapiens__NP_776160
augcgcuggugccugcuccugaucugggcccagggccugcggcaggcgccccucgccagcgggaugaugaccggcaccaucgagacgaccgggaacaucuccgccgagaagggcgggagcaucauccugcagugccaccuguccagcaccaccgcccaggugacgcaggucaacugggagcagcaggaccagcuccuggccaucugcaacgccgaccugggcuggcacaucuccccgagcuucaaggaccgcguggcgcccggccccgggcucggccugacccugcagucccucaccgugaacgacaccggggaguacuucugcaucuaccacacguaccccgacggcaccuacaccgggcggaucuuccuggagguccuggagagcuccguggccgagcacggcgcccgcuuccagaucccgcuccugggcgccauggcggccacccugguggucaucugcacggccgugaucguggucguggcccucacccggaagaagaaggcccugcgcauccacagcguggagggggaccugcggcgcaaguccgcgggccaggaggaguggagccccuccgcccccagcccgcccggguccugcguccaggccgaggccgcccccgcgggccucugcggcgagcagcgcggggaggacugcgccgagcugcacgacuacuucaacgugcugagcuaccggucccucggcaacugcagcuucuucaccgagaccggguga

SEQ ID NO: 37681 - RNA, 1053 nt, Artificial Sequence
  derived and/or modified sequence opt1 from TIMD4__Homo_sapiens__NP_001140198
augagcaaggagccccugauccucuggcugaugaucgaguucugguggcuguaccucaccccggugaccuccgagacggucgugaccgaggugcugggccaccgcgucacccugcccugccucuacagcuccuggagccacaacuccaacagcaugugcugggggaaggaccagugccccuacuccggcugcaaggaggcccugauccggaccgacgggaugcgcgugacgagccggaaguccgccaaguaccgccugcagggcaccaucccccgcggggacgugagccucaccauccugaacccguccgagagcgacuccggcgucuacugcugccggaucgaggugcccggcugguucaacgacgugaagaucaacguccggcugaaccuccagcgcgcgagcaccacgacccaccggaccgccaccacgaccacccgccggaccacgaccaccucccccaccacgacccgccagaugaccaccacgcccgccgcccugccgaccaccguggugaccacgcccgaccugaccaccgggacgccccuccagaugaccaccaucgccgucuucaccaccgcgaacacgugccugagccugacccccuccacccucccggaggaggccaccggccugcugacccccgagcccagcaaggaggggcccauccucacggccgaguccgagaccgugcugccgagcgacagcugguccagcguggaguccaccagcgccgacaccguccugcucacguccaaggcgagcgacaccgccgugcccgagcagaacaagaccaccaagacgggccagauggacgggauccccauguccaugaagaacgagaugcccaucagccagcugcugaugaucaucgccccgucccucggcuucgugcuguucgcccuguucgucgccuuccuccugcggggcaagcugauggagaccuacugcagccagaagcacacccgccucgacuacaucggggacuccaagaacgugcugaacgacgugcagcacggccgggaggacgaggacgggcuguucacccucuga

SEQ ID NO: 37682 - RNA, 3627 nt, Artificial Sequence
  derived and/or modified sequence opt1 from TIMELESS__Homo_sapiens__NP_003911
auggaccugcacaugaugaacugcgagcuccuggcgaccugcagcgcccugggcuaccucgagggggacaccuaccacaaggagcccgacugccuggaguccgugaaggaccugauccgcuaccuccggcacgaggacgagacgcgcgacguccggcagcagcugggcgccgcccagauccugcagagcgaccuccugccgauccugacccagcaccaccaggacaagccccucuucgacgccgugauccgccugauggugaaccugacccagcccgcccuccugugcuucgggaaccugcccaaggagccguccuuccggcaccacuuccuccagguccugaccuaccugcaggccuacaaggaggcguucgccagcgagaaggccuucggcgugcucuccgagacgcuguacgagcugcuccagcuggggugggaggagcgccaggaggaggacaaccugcucaucgagcggauccugcugcucgugcgcaacauccugcacguccccgccgaccuggaccaggagaagaagaucgacgacgacgcgagcgcccacgaccagcuccugugggccauccaccuguccggccucgacgaccugcugcuguuccuggccagcuccagcgccgaggagcaguggucccugcacgugcucgagaucgugagccugauguuccgggaccagaaccccgagcagcuggcgggcgucgggcagggccgccucgcccaggagcgguccgccgacuucgccgagcuggaggugcugcgccagcgggagauggccgagaagaagacccgcgcgcuccagcgggggaaccgccacagccgguucggcggguccuacaucgugcagggccucaagagcaucggcgagcgcgaccugaucuuccacaaggggcugcacaaccuccggaacuacuccagcgaccugggcaagcagcccaagaaggucccgaagcgccggcaggccgcccgcgagcuguccauccagcgccggagcgcccucaacgugcgccuguuccugcgggacuucugcagcgaguuccucgagaacugcuacaaccgccugaugggguccgugaaggaccaccuccuccgggagaaggcccagcagcacgacgagaccuacuacaugugggcgcuggccuucuucauggccuucaaccgcgccgccagcuuccggcccggccuggucuccgagacccucagcgugcgcacguuccacuucaucgagcagaaccugaccaacuacuacgagaugaugcugaccgaccggaaggaggcggccuccugggcccgccggaugcaccucgcccugaaggcguaccaggagcugcucgccaccgugaacgagauggacaucagccccgacgaggccguccgcgaguccagccggaucaucaagaacaacaucuucuacgugauggaguaccgcgagcuguuccuggcccucuuccggaaguucgacgagcgcugccagccccgguccuuccugcgcgaccugguggagacgacccaccucuuccugaagaugcuggagcgguucugccgcagccgcggcaaccucgucgugcagaacaagcagaagaagcggcgcaagaagaagaagaaggugcuggaccaggccaucgucuccgggaacgugccgagcucccccgaggaggucgaggcgguguggcccgcccuggccgagcagcuccagugcugcgcccagaacagcgagcuguccauggacagcgugguccccuucgacgccgcguccgaggugccgguggaggagcagcgggccgaggccaugguccgcauccaggacugccugcucgccggccaggcgccccaggcccugacccugcuccggagcgcccgcgagguguggcccgagggggacguguucggcucccaggacaucagccccgaggaggagauccagcugcugaagcagauccucagcgccccgcugccccggcagcaggggcccgaggagcgcggcgccgaggaggaggaggaggaggaggaggaggaggaggaggagcugcaggucguccagguguccgagaaggaguucaacuuccucgacuaccugaagcgguucgcgugcagcaccguggugcgcgccuacgugcugcuccugcgguccuaccagcagaacagcgcccacacgaaccacugcaucgucaagaugcugcaccgccucgcccacgaccugaagauggaggcccugcuguuccagcuguccguguucugccuguucaaccggcuccugagcgaccccgcggccggcgccuacaaggagcuggugaccuucgccaaguacauccucgggaaguucuucgcccuggcggccgucaaccagaaggccuucguggagcugcuguucuggaagaacaccgccgugguccgcgagaugaccgagggcuacgggucccuggacgaccggagcuccagccgccgggccccgacguggucccccgaggaggaggcgcaccuccgcgagcucuaccuggccaacaaggacguggagggccaggacguggucgaggccauccuggcccaccucaacaccgugccccggacccgcaagcagaucauccaccaccuggugcagauggggcuggcggacagcgucaaggacuuccagcggaagggcacccacaucgugcucuggacgggcgaccaggagcuggagcugcagcgccucuucgaggaguuccgcgacuccgacgacgugcuggggcacaucaugaagaacaucaccgccaagcggagccgcgcccggaucgucgacaagcugcucgcccugggccugguggccgagcgccgggagcucuacaagaagcgccagaagaagcuggcguccagcauccugcccaacggggccgagucccucaaggacuucugccaggaggaccuggaggaggaggagaaccugccggaggaggacagcgaggaggaggaggagggcgggagcgaggccgagcagguccagggcucccucgugcugagcaacgagaaccugggccagucccuccaccaggagggguucagcaucccccugcuguggcuccagaacugccugauccgggccgccgacgaccgcgaggaggacggcugcucccaggcggugccccuggugccgcucaccgaggagaacgaggaggccauggagaacgagcaguuccagcagcugcugcggaagcuggggguccgcccgcccgccagcggccaggagaccuucuggcggauccccgccaagcucucccccacgcagcugcgccgggccgcggccagccugucccagcccgaggaggagcagaagcuccagcccgagcugcagcccaaggugccgggcgagcaggggagcgacgaggagcacugcaaggagcaccgcgcccaggcccugcgggcccuccugcuggcgcacaagaagaaggccggccucgccucccccgaggaggaggacgccguggggaaggagccccugaaggcggcccccaagaagcgccagcugcucgacagcgacgaggagcaggaggaggacgagggccggaaccgcgccccggagcugggggcccccggcauccagaagaagaagcgguaccagaucgaggacgacgaggacgacuga

SEQ ID NO: 37683 - RNA, 273 nt, Artificial Sequence
  derived and/or modified sequence opt1 from TIMM10__Homo_sapiens__NP_036588
auggacccccugcgcgcccagcagcucgccgcggagcuggagguggagaugauggccgacauguacaaccggaugaccagcgccugccaccgcaagugcgucccgccccacuacaaggaggccgagcuguccaagggcgagagcgugugccucgaccggugcguguccaaguaccuggacauccacgagcgcauggggaagaagcugaccgagcucagcaugcaggacgaggagcugaugaagcggguccagcaguccagcggccccgccuga

SEQ ID NO: 37684 - RNA, 516 nt, Artificial Sequence
  derived and/or modified sequence opt1 from TIMM17A__Homo_sapiens__NP_006326
auggaggaguacgcccgcgagcccugcccguggcggaucguggacgacugcggcggggccuucaccaugggcaccaucgggggcgggaucuuccaggcgaucaagggcuuccgcaacagccccgucggcgugaaccaccggcugcgcgggucccucacggccaucaagacccgggcgccccagcugggcgggagcuucgccguguggggcgggcuguucuccaugaucgacugcagcaugguccaggugcgcggcaaggaggaccccuggaacuccaucaccagcggcgcccucaccggggccauccuggccgcccggaacggcccgguggccauggucggguccgcggccaugggcggcauccugcucgcccugaucgagggggccggcauccugcucacgcgcuucgccagcgcgcaguuccccaacgggccccaguucgccgaggaccccucccagcugccgagcacccagcugcccuccagccccuucggcgacuaccggcaguaccaguga

SEQ ID NO: 37685 - RNA, 747 nt, Artificial Sequence
  derived and/or modified sequence opt1 from TIMM21__Homo_sapiens__NP_054896
augaucugcaccuuccugcgcgcggugcaguacaccgagaagcuccaccggagcuccgccaagcgccugcugcuccccuacaucguccugaacaaggcgugccugaagacggagccgagccuccggugcggccugcaguaccagaagaagacccugcgcccccggugcauccucggggugacccagaagaccaucuggacgcagggccccagcccccgcaaggccaaggaggacggguccaagcaggucuccgugcaccggagccagcgcggcgggaccgccgugccgaccucccagaaggugaaggaggccggccgggacuucaccuaccugaucgucgugcuguucggcaucagcaucaccgggggccucuucuacacgaucuucaaggagcuguucuccagcuccagccccuccaagaucuacgggcgcgcccuggagaagugccggagccaccccgaggugaucggcgucuucggggaguccgugaagggcuacggcgaggugacccgccgggggcgccggcagcacguccgcuucaccgaguacgugaaggacggccucaagcacacgugcgugaaguucuacaucgaggggagcgagcccggcaagcagggcaccgucuacgcccaggugaaggagaacccgggguccggcgaguacgacuuccgguacaucuucguggagaucgagagcuacccccgccggaccaucaucaucgaggacaaccgcucccaggacgacuga

SEQ ID NO: 37686 - RNA, 585 nt, Artificial Sequence
  derived and/or modified sequence opt1 from TIMM22__Homo_sapiens__NP_037469
auggccgccgcggcccccaacgccggcgggagcgccccggagaccgccggcuccgcggaggcgccccugcaguacagccuccugcugcaguaccucgugggggacaagcgccagccccggcugcuggagcccggcucccucgggggcaucccgagccccgccaaguccgaggagcagaagaugaucgagaaggccauggagagcugcgccuucaaggccgcccuggccugcgucggcggguucgugcugggcggggccuucggcguguucaccgcggggaucgacacgaacgucggcuucgaccccaaggaccccuaccgcaccccgaccgccaaggaggugcucaaggacaugggccagcgggggauguccuacgccaagaacuucgccaucgugggcgccauguucagcugcaccgagugccugaucgaguccuaccgcgggacgagcgacuggaagaacuccgucaucagcggcugcaucaccggcggggcgaucggcuuccgggccgggcugaaggccggcgccaucgggugcggcggcuucgccgcguucuccgccgccaucgacuacuaccuccgcuga

SEQ ID NO: 37687 - RNA, 630 nt, Artificial Sequence
  derived and/or modified sequence opt1 from TIMM23__Homo_sapiens__NP_006318
auggagggcgggggcgggagcggcaacaagaccaccgggggccuggccggcuucuucggggccggcggggcgggcuacucccacgccgaccucgccggggugccccugacgggcaugaacccgcugagccccuaccucaacgucgacccccgcuaccuggugcaggacaccgacgaguucauccugcccaccggcgccaacaagacccgggggcgcuucgagcucgccuucuucacgaucggcgggugcugcaugaccggcgcggccuucggcgccaugaacgggcugcggcugggccucaaggagacccagaacauggccugguccaagccgcgcaacgugcagauccugaacauggucacccggcagggggcgcugugggccaacacgcucggcagccuggcccugcucuacuccgccuucggggugaucaucgagaagacccgcggcgccgaggacgaccugaacaccguggcggccggcaccaugacggggaugcuguacaagugcaccggcgggcuccggggcaucgcccgcgggggccugaccggccugacccucacgagccuguacgcccuguacaacaacugggagcacaugaaggggucccuccugcagcagagccuguga

SEQ ID NO: 37688 - RNA, 1359 nt, Artificial Sequence
  derived and/or modified sequence opt1 from TIMM44__Homo_sapiens__NP_006342
auggccgccgcggcccugcgcagcggcuggugccggugcccccgccggugccucggguccggcauccaguuccugagcucccacaaccugccgcacgggagcaccuaccagaugcgccggcccggcggggagcucccccuguccaagagcuacuccagcggcaaccgcaagggcuuccuguccgggcuccuggacaacgugaagcaggagcuggccaagaacaaggagaugaaggagagcaucaagaaguuccgggacgaggcccgccggcucgaggaguccgacguccugcaggaggcccgccggaaguacaagaccaucgagagcgagacggugcgcaccuccgaggugcugcggaagaagcucggcgagcugaccgggaccgucaaggagagccugcacgagguguccaagagcgaccucggccgcaagaucaaggaggggguggaggaggcggccaagacggccaagcaguccgccgagagcgucuccaagggcggcgagaagcuggggcggaccgcggccuuccgcgcccugagccagggcguggagagcgugaagaaggagaucgacgacuccguccucgggcagaccggccccuaccggcgcccgcagcggcugcgcaagcggaccgaguucgccggcgacaaguucaaggaggagaagguguucgagcccaacgaggaggcccugggggugguccuccacaaggacagcaagugguaccagcaguggaaggacuucaaggagaacaacgugguguucaaccgcuucuucgagaugaagaugaaguacgacgaguccgacaacgcguucauccgcgccagccgggcccugacggacaaggucaccgaccugcucggcgggcuguucuccaagaccgagaugagcgaggugcugaccgagauccuccgcguggaccccgccuucgacaaggaccgguuccugaagcagugcgagaacgacaucauccccaacguccuggaggccaugaucuccggcgagcucgacauccugaaggacuggugcuacgaggcgacguacagccagcuggcccacccgauccagcaggccaaggcccucgggcugcaguuccacucccgcauccuggacaucgacaacguggaccucgccaugggcaagaugauggagcagggccccgugcugaucaucaccuuccaggcgcagcuggucaugguggugcggaaccccaagggggaggucguggagggcgaccccgacaagguccuccgcaugcuguacgugugggcccugugccgggaccaggacgagcucaacccguacgccgccuggcgccugcuggacaucagcgccuccagcaccgagcagauccucuga

SEQ ID NO: 37689 - RNA, 1371 nt, Artificial Sequence
  derived and/or modified sequence opt1 from TIMM50__Homo_sapiens__NP_001001563
auggccagcgcccugucccucggcaacaagugcgaccccuuccugcgcugcgugcugugccgcgggggcggggcgcuccagggcccgcgggggcggggccccgacgacuucgagagccagcuguccccgcccggcagcgcccgccggcugguccgcuccaagcgggccugcgggaacccgcccgacgccuucggccucagccgcgccuccgugcacccgccccugccccgggugagcaucgggugcuccagcggccccgggcgcgcgaagcgggagcgcgucggcggcgccgccuggcggcagcgcaagauggccgcguccgccgccguguucagccggcugcgcuccgggcuccggcugggcagccgcgggcugugcacccggcucgccaccccgccccgccgggcccccgaccaggcggccgagaucggcucccgcggcagcacgaaggcccaggggccccagcagcagcccggcuccgaggggcccagcuacgccaagaagguggcccuguggcuggcgggccuccugggggccggcggcaccgucuccgugguguacaucuucgggaacaaccccgucgacgagaacggcgccaagauccccgacgaguucgacaacgaccccauccuggugcagcagcuccgccggaccuacaaguacuucaaggacuaccgccagaugaucaucgagcccaccagcccgugccugcugcccgacccccuccaggagcccuacuaccagccgcccuacacgcuggugcuggagcucaccgggguccugcugcaccccgaguggagccucgccaccggcuggcgguucaagaagcgccccgggaucgagacccuguuccagcagcuggccccgcucuacgagaucgugaucuucacguccgagaccggcaugaccgcguucccccugaucgacagcguggacccccacggcuucaucuccuaccggcuguuccgcgacgccacccgguacauggacgggcaccacgucaaggacaucagcugccucaaccgcgacccggcccgggugguggucguggacugcaagaaggaggccuuccgccugcagcccuacaacggcguggcccugcggcccugggacgggaacuccgacgaccgcguccuccuggaccugagcgcguuccucaagacgaucgcccugaacggcguggaggacgugcggaccguccuggagcacuacgcccucgaggacgacccccuggccgcguucaagcagcgccagucccggcuggagcaggaggagcagcagcgccucgccgagcugagcaaguccaacaagcagaaccuguuccucgggagccugaccucccggcuguggccgcgcagcaagcagcccuga

SEQ ID NO: 37690 - RNA, 294 nt, Artificial Sequence
  derived and/or modified sequence opt1 from TIMM8A__Homo_sapiens__NP_004076
auggacagcuccagcuccagcuccgccgccggccugggggcgguggacccccagcuccagcacuucaucgaggucgagacccagaagcagcgcuuccagcagcuggugcaccagaugaccgagcugugcugggagaagugcauggacaagccgggccccaagcucgacagccgggccgaggccugcuucgugaacugcgucgagcgcuucaucgacacgucccaguucauccugaaccggcuggagcagacccagaaguccaagcccguguucagcgagagccucuccgacuga

SEQ ID NO: 37691 - RNA, 297 nt, Artificial Sequence
  derived and/or modified sequence opt1 from TIMM8B__Homo_sapiens__NP_036591
augcgcaagcacagcugccggaagguggccucccugcgccggaccauggccgagcucggcgaggcggacgaggccgagcugcagcgccuggucgccgccgagcagcagaaggcccaguucaccgcccaggugcaccacuucauggagcucugcugggacaagugcguggagaagcccgggaaccggcuggacagccgcacggagaacugccuguccagcugcgucgaccgguucaucgacaccacccucgcgaucaccucccgcuucgcccagaucgugcagaagggcgggcaguga

SEQ ID NO: 37692 - RNA, 858 nt, Artificial Sequence
  derived and/or modified sequence opt1 from TIMMDC1__Homo_sapiens__NP_057673
auggaggugcccccgcccgcgccccgcagcuuccugugccgggcccucugccuguucccccgcgucuucgccgccgaggccgugaccgccgacuccgaggugcuggaggagcggcagaagcgccucccguacguccccgagcccuacuaccccgagagcggcugggaccggcugcgcgagcuguucgggaaggacgagcagcagcggaucuccaaggaccucgccaacaucugcaagaccgcggccacggccggcaucaucggguggguguacggcgggaucccggccuucauccacgcgaagcagcaguacaucgagcagagccaggccgagaucuaccacaaccgcuucgacgccgugcaguccgcccaccgggccgcgacccgcggcuucauccgguacggcuggcgcuggggguggcggaccgccgucuucgugaccaucuucaacacggugaacaccagccugaacgucuaccgcaacaaggacgcccugucccacuucgugaucgccggcgccgugaccgggagccucuuccggaucaacgucggccugcgcgggcugguggcgggcggcaucaucggggcccuccugggcacccccgucgggggccugcucauggccuuccagaaguacuccggcgagacggugcaggagcggaagcagaaggaccgcaaggcccugcacgagcugaagcucgaggaguggaaggggcggcuccaggugaccgagcaccuccccgagaagaucgagagcucccugcaggaggacgagcccgagaacgacgccaagaagaucgaggcgcugcugaaccugccgcgcaaccccagcgugaucgacaagcaggacaaggacuga

SEQ ID NO: 37693 - RNA, 624 nt, Artificial Sequence
  derived and/or modified sequence opt1 from TIMP1__Homo_sapiens__NP_003245
auggcccccuucgagccgcuggccagcggcauccuccugcugcucuggcugaucgcgcccucccgcgccugcacgugcgugccgccccacccccagaccgccuucugcaacagcgaccuggucauccgggccaaguucguggggacccccgaggugaaccagaccacccucuaccagcgcuacgagaucaagaugaccaagauguacaagggcuuccaggcccugggggacgcggccgacauccgguucgucuacacgcccgccauggaguccgugugcggcuacuuccaccgcagccacaaccgguccgaggaguuccugaucgccgggaagcuccaggacggccugcugcacaucacgaccugcagcuucguggcgcccuggaacucccucagccuggcccagcgccggggcuucaccaagaccuacaccgucgggugcgaggagugcaccguguucccgugccuguccauccccugcaagcuccagagcggcacccacugccuguggacggaccagcugcuccagggguccgagaagggcuuccagagccgccaccuggccugccugccccgggagcccgggcucugcaccuggcagucccugcgcagccagaucgccuga

SEQ ID NO: 37694 - RNA, 663 nt, Artificial Sequence
  derived and/or modified sequence opt1 from TIMP2__Homo_sapiens__NP_003246
augggcgccgccgcgcgcacccugcggcucgcccuggggcugcuccugcuggccacccuccugcgccccgccgacgccugcagcugcucccccgugcacccccagcaggcguucugcaacgccgacgucgugauccgggccaaggccgugagcgagaaggaggucgacuccggcaacgacaucuacgggaaccccaucaagcgcauccaguacgagaucaagcagaucaagauguucaagggccccgagaaggacaucgaguucaucuacacggcgccgagcuccgccgugugcggggugagccuggacgucggcggcaagaaggaguaccucaucgccgggaaggccgagggcgacgggaagaugcacaucacccugugcgacuucaucgugcccugggacacccuguccaccacgcagaagaagucccucaaccaccgguaccagaugggcugcgagugcaagaucacccgcugccccaugauccccugcuacaucagcagcccggacgagugccuguggauggacugggugaccgagaagaacaucaacgggcaccaggccaaguucuucgcgugcaucaagcgguccgacggcagcugcgccugguaccgcggcgccgccccgcccaagcaggaguuccuggacaucgaggaccccuga

SEQ ID NO: 37695 - RNA, 636 nt, Artificial Sequence
  derived and/or modified sequence opt1 from TIMP3__Homo_sapiens__NP_000353
augacccccuggcugggccucaucgugcugcuggggagcuggucccucggcgacuggggcgccgaggccugcacgugcagcccgucccacccccaggacgcguucugcaacagcgacaucgucauccgcgccaaggugguggggaagaagcuggucaaggaggggcccuucggcacccugguguacaccaucaagcagaugaagauguaccggggcuucaccaagaugccccacgugcaguacauccacaccgaggccuccgagagccucugcgggcugaagcuggaggucaacaaguaccaguaccuccugacgggccgcguguacgacgggaagauguacaccggccugugcaacuucguggagcggugggaccagcucacccugucccagcgcaaggggcugaacuaccgguaccaccucggcugcaacugcaagaucaagagcugcuacuaccugccgugcuucgucaccuccaagaacgagugccuguggacggacaugcucagcaacuucggcuaccccggguaccaguccaagcacuacgccugcauccgccagaagggcggguacugcagcugguaccggggcugggccccgcccgacaaguccaucaucaacgcgaccgaccccuga

SEQ ID NO: 37696 - RNA, 675 nt, Artificial Sequence
  derived and/or modified sequence opt1 from TIMP4__Homo_sapiens__NP_003247
augcccggcagcccgcgccccgcccccuccugggugcugcuccugcggcugcucgcccugcugcggcccccggggcucggcgaggcgugcagcugcgcccccgcccacccccagcagcacaucugccacuccgcccuggucauccgcgccaagaucagcuccgagaagguggugcccgcgagcgccgacccggccgacaccgagaagaugcugcgcuacgagaucaagcagaucaagauguucaagggguucgagaaggucaaggacgugcaguacaucuacacccccuucgacuccagccucugcggcgugaagcuggaggccaacucccagaagcaguaccugcucacggggcagguccugagcgacggcaagguguucauccaccugugcaacuacaucgagcccugggaggaccucucccuggugcagcgggagagccugaaccaccacuaccaccucaacugcggcugccagaucacgaccugcuacaccguccccugcaccaucuccgcgccgaacgagugccuguggaccgacuggcugcucgagcgcaagcuguacggguaccaggcccagcacuacgugugcaugaagcacguggacgggaccugcagcugguaccggggccaccucccccugcgcaaggaguucgucgacaucgugcagcccuga

SEQ ID NO: 37697 - RNA, 1431 nt, Artificial Sequence
  derived and/or modified sequence opt1 from TINAG__Homo_sapiens__NP_055279
auguggaccggcuacaagauccugaucuucagcuaccucaccacggagaucuggauggagaagcaguaccugucccagcgcgagguggaccuggaggccuacuucacccggaaccacaccguccuccaggggacccgcuucaagcgggccaucuuccagggccaguacugccgcaacuucgggugcugcgaggaccgggacgacggcugcgugacggaguucuacgcggccaacgcccugugcuacugcgacaaguucugcgaccgcgagaacagcgacugcugccccgacuacaaguccuucugccgggaggagaaggaguggccgccccacacccagcccugguaccccgaggggugcuucaaggacggccagcacuacgaggagggcagcgugaucaaggagaacugcaacuccugcacgugcagcgggcagcaguggaagugcucccagcacgucugccuggugcgcagcgagcucaucgagcaggucaacaagggcgacuacggguggaccgcccagaacuacucccaguucuggggcaugacccuggaggacggguucaaguuccggcugggcacccucccgcccagccccaugcugcuguccaugaacgagaugaccgccagccuccccgcgaccacggaccugccggaguucuucguggccuccuacaaguggcccggcuggacccacgggccccuggaccagaagaacugcgccgccagcugggcguucuccaccgccagcguggccgccgaccgcaucgccauccaguccaagggccgguacaccgcgaaccucagcccccagaaccugaucuccugcugcgccaagaaccgccacgggugcaacagcggcagcaucgaccgggccuggugguaccugcgcaagcggggccucgugucccacgccugcuacccgcuguucaaggaccagaacgccacgaacaacgggugcgcgauggccagccgcuccgacggccgggggaagcgccacgccaccaagcccugccccaacaacgucgagaaguccaaccggaucuaccagugcagcccgcccuaccgcgugagcuccaacgagaccgagaucaugaaggagaucaugcagaacggccccgugcaggccaucaugcagguccgggaggacuucuuccacuacaagaccgggaucuaccgccacgugacgagcaccaacaaggaguccgagaaguaccgcaagcugcagacccacgccgugaagcucaccggcuggggcacgcugcgcggggcgcagggccagaaggagaaguucuggaucgccgccaacagcugggggaaguccuggggcgagaacggguacuuccggauccugcggggcgucaacgagagcgacaucgagaagcucaucaucgccgccuggggccagcugaccuccagcgacgagcccuga

SEQ ID NO: 37698 - RNA, 1356 nt, Artificial Sequence
  derived and/or modified sequence opt1 from TINF2__Homo_sapiens__NP_001092744
auggccacgccccugguggccggccccgcggcccuccgcuucgccgccgccgcgagcuggcaggucgugcgggggcgcugcguggagcacuucccccggguccuggaguuccugcgcucccuccgggccguggcccccggccuggugcgcuaccggcaccacgagcgccugugcauggggcucaaggccaaggucgugguggagcugauccugcagggccggcccugggcgcagguccucaaggcccugaaccaccacuucccggagagcgggcccaucgugcgcgaccccaaggccaccaagcaggaccugcggaagauccucgaggcccaggagacguucuaccagcaggucaagcagcuguccgaggcccccguggaccuggcgagcaagcuccaggagcuggagcaggaguacggcgagccguuccuggccgccauggagaagcuccuguucgaguaccugugccagcucgagaaggcccugcccacgccccaggcccagcagcugcaggacgugcucuccuggaugcagcccggcgugagcaucaccuccagccuggcguggcgccaguacggggucgacaugggcuggcugcucccggagugcuccgugaccgacagcgugaaccuggccgagcccauggagcagaacccgccccagcagcagcggcuggcccuccacaacccccugcccaaggccaagcccgggacccaccucccccagggcccguccagccgcacccaccccgagccccucgccgggcggcacuucaaccuggcgccccugggccgccggcgcguccagucccagugggccagcacccggggcgggcacaaggagcgcccgaccgugaugcuguuccccuuccggaaccugggcucccccacccaggugaucagcaagcccgaguccaaggaggagcacgccaucuacaccgccgaccuggccauggggacccgcgcggccagcaccggcaaguccaagagcccgugccagacgcucggcgggcgcgcccugaaggagaaccccgucgaccugcccgccaccgagcagaaggagaacugccucgacugcuacauggacccgcugcggcugagccuccugccgccccgcgcgcggaagcccgugugcccgcccucccugugcagcuccgugaucaccaucggcgaccucguccuggacagcgacgaggaggagaacgggcagggcgaggggaaggagucccuggagaacuaccagaagaccaaguucgacacgcugauccccacccucugcgaguaccugccgcccagcggccacggcgccauccccguguccagcugcgacugccgcgacuccagccggccccuguga

SEQ ID NO: 37699 - RNA, 1974 nt, Artificial Sequence
  derived and/or modified sequence opt1 from TIPARP__Homo_sapiens__NP_001171646
auggagauggagaccaccgagcccgagccggacugcgugguccagccgcccagcccgcccgacgacuucuccugccagaugcgccugagcgagaagaucacgccccucaagaccugcuucaagaagaaggaccagaagcggcugggcaccgggacccugcgcucccuccggcccauccugaacacgcugcucgagagcggcucccuggacgggguguuccgcagccggaaccaguccaccgacgagaacagccugcacgagcccaugaugaagaaggccauggagaucaacuccagcugcccgcccgccgagaacaacauguccgugcucauccccgaccgcaccaacgucggcgaccagauccccgaggcgcacccgagcaccgaggcccccgagcggguggugcccauccaggaccacuccuuccccagcgagacgcuguccgggaccgucgccgacagcaccccggcccacuuccagaccgaccugcuccaccccguguccagcgacgugcccacgucccccgacugccuggacaaggucaucgacuacgugccgggcaucuuccaggagaacagcuucaccauccaguacauccuggacaccagcgacaagcucuccaccgagcuguuccaggacaagagcgaggaggccucccuggaccucguguucgagcuggucaaccagcugcaguaccacacgcaccaggagaacggcaucgagaucugcauggacuuccuccaggggaccugcaucuacggccgcgacugccugaagcaccacaccgugcugcccuaccacuggcagaucaagcggaccacgacccagaaguggcagagcguguucaacgacucccaggagcaccucgagcgcuucuacugcaaccccgagaacgaccggaugcgcaugaaguacgggggccaggaguucugggcggaccugaacgccaugaacgucuacgagaccaccgaguucgaccagcugcggcgccucagcacgcccccguccagcaacgugaacuccaucuaccacaccguguggaaguucuucugccgggaccacuucggguggcgcgaguaccccgagagcgucauccggcugaucgaggaggccaacucccgcggccugaaggaggugcgguucaugauguggaacaaccacuacauccuccacaacagcuucuuccgccgggagaucaagcgccgcccccuguuccgguccugcuucauccugcuccccuaccugcagacccugggcggggugccgacccaggcgcccccgccccucgaggccacgagcuccagccagaucaucugccccgacggcgucaccuccgccaacuucuaccccgagaccuggguguacaugcaccccagccaggacuucauccaggugcccgucuccgccgaggacaagagcuaccgcaucaucuacaaccuguuccacaagaccgugcccgaguucaaguaccggauccugcagauccuccgcguccagaaccaguuccugugggagaaguacaagcggaagaaggaguacaugaaccgcaagauguucgggcgggaccgcaucaucaacgagcggcaccuguuccacggcacgagccaggacgugguggacggcaucugcaagcacaacuucgacccccgcgucugcgggaagcacgccaccauguucggccagggguccuacuucgccaagaaggcgagcuacucccacaacuucagcaagaaguccagcaagggcgugcacuucauguuccucgccaaggugcugaccgggcgguacaccaugggcucccacggcaugcgccggcccccgcccgucaaccccgggagcgugacguccgaccuguacgacagcugcguggacaacuucuucgagccccagaucuucgucaucuucaacgacgaccaguccuacccguacuucgugauccaguacgaggaggugagcaacaccgucuccaucuga

SEQ ID NO: 37700 - RNA, 603 nt, Artificial Sequence
  derived and/or modified sequence opt1 from TIPIN__Homo_sapiens__NP_001276915
augcugauccgccacauggagcacugggcccaccgccucuuccccaagcugcaguucgaggacuucaucgaccggguggaguaccugggcagcaagaaggagguccagaccugccucaagcggauccgccuggaccugccgauccuccacgaggacuucguguccaacaacgacgagguggccgagaacaacgagcacgacgucaccagcacggagcuggaccccuuccugaccaaccucuccgagagcgagauguucgcguccgagcugagccggucccugaccgaggagcagcagcagcgcaucgagcggaacaagcagcucgcccuggagcgccggcaggccaagcugcucagcaacucccagacccuggggaacgacaugcugaugaacacgccccgcgcccacaccguggaggaggugaacaccgacgaggaccagaaggaggagagcaacggccucaacgaggacauccuggacaaccccugcaacgacgccaucgcgaacacccugaacgaggaggagacgcuccuggaccaguccuucaagaacguccagcagcagcuggacgccaccagccggaacaucaccgaggcccgcuga

SEQ ID NO: 37701 - RNA, 537 nt, Artificial Sequence
  derived and/or modified sequence opt1 from TIPRL__Homo_sapiens__NP_001026970
augaugauccacggcuuccagagcucccaccgcgacuucugcuucgggcccuggaagcugaccgccagcaagacccacaucaugaaguccgccgacguggagaagcucgcggacgagcugcacaugccgagccugcccgagaugauguucggcgacaacguccuccggauccagcacggguccggcuucgggaucgaguucaacgccacggacgcccugcgcugcgugaacaacuaccagggcaugcugaagguggccugcgccgaggaguggcaggagagccggaccgagggcgagcacuccaaggaggucaucaagcccuacgacuggaccuacaccacggacuacaaggggacccuccugggcgagagccugaagcucaagguggugcccaccaccgaccacaucgacacggagaagcugaaggcgcgcgagcagaucaaguucuucgaggagguccuccuguucgaggacgagcugcacgaccacgggguguccagccuguccgugaagaucccgggcgggggccaccucuga

SEQ ID NO: 37702 - RNA, 1035 nt, Artificial Sequence
  derived and/or modified sequence opt1 from TIRAP__Homo_sapiens__XP_005271456
augcagaagcccggcuggcaggggcugggcccgcaguggacccaggggcucccccgccccgccagccccgccgcgggccugugcccgcgggugucccgcgucuggaccgggcccggcggcgucgggggcgccgugcggcgcgccgcccugcccgagagcggggccugcgcgcuccuguuccccgccgagccggcccaguccgcccagcccagcucccagcugggcccccgggcgggguggcuccugcacgaggugaagacgggcagcccgcccuccagccccuucaccaacgccuggucccacggcgccagcuucgacccccacgccauggccuccagcaccucccugcccgcgccggggagccgccccaagaagccccucggcaagauggccgacugguuccggcagacccugcugaagaagcccaagaagcgcccgaacucccccgagagcacguccagcgacgccucccagcccaccagccaggacagcccccucccgcccucccugagcuccgugaccagccccucccugcccccgacccacgccagcgacuccgggagcucccgguggagcaaggacuacgacgugugcgucugccacuccgaggaggaccucguggccgcgcaggaccuggugagcuaccuggagggcuccacggccagccuccgcugcuuccugcagcugcgggacgccacccccggcggggccaucgucuccgagcucugccaggcccugagcuccagccacugccgcgugcugcucaucacccccggcuuccugcaggacccguggugcaaguaccagaugcugcaggcgcucaccgaggcccccggggccgagggcugcacgaucccccugcuguccgggcucagccgggccgccuacccgcccgagcugcgcuucauguacuacguggacggccggggccccgacgggggcuuccgccaggucaaggaggcggugaugcggugcaagcugcuccaggagggggagggcgagcgcgacagcgccaccguguccgaccugcuguga

SEQ ID NO: 37703 - RNA, 5247 nt, Artificial Sequence
  derived and/or modified sequence opt1 from TJP1__Homo_sapiens__NP_003248
augagcgcccgcgccgccgccgccaaguccaccgccauggaggagaccgccaucugggagcagcacacggugacccugcaccgggcgcccggcuucggguucggcaucgccaucagcgggggccgcgacaacccccacuuccaguccggggagaccagcaucgugaucuccgacgugcucaagggcggccccgccgaggggcagcugcaggagaacgaccggguggccauggugaacggcgugagcauggacaacguggagcacgcguucgccgugcagcagcugcgcaaguccgggaagaacgccaagaucaccauccggcgcaagaagaaggugcagauccccgugagccggcccgaccccgagcccgucuccgacaacgaggaggacagcuacgacgaggagauccacgacccccgcuccggccggagcgggguggugaaccgccgguccgagaagaucuggccccgcgaccggagcgccucccgcgagcggagccucagcccccgcuccgaccggcgcuccgucgccagcagccagcccgcgaagcccaccaaggugacccuggugaagucccggaagaacgaggaguacggccugcgccucgccagccacaucuucgucaaggagaucucccaggacagccuggccgcccgggacggcaacauccaggagggggacguggugcugaagaucaacggcaccgucaccgagaacaugucccucacggacgccaagacccugaucgagcgcagcaaggggaagcugaagaugguggugcagcgcgacgagcgggcgacccuccugaacguccccgaccuguccgacagcauccacuccgccaacgccagcgagcgcgacgacaucuccgagauccagagccucgccuccgaccacagcggccggucccacgaccgcccgccccggcgcagccggucccgcagccccgaccagcgguccgagcccagcgaccacagccgccacagcccccagcagcccuccaacggcucccugcggagccgcgacgaggagcggaucuccaagcccggggccgugagcacccccgugaagcacgcggacgaccacacgcccaagaccgucgaggaggugaccgucgagcgcaacgagaagcagacccccucccugcccgagcccaagcccguguacgcccaggugggccagcccgacgucgaccuccccgugagccccuccgacggggugcugcccaacagcacgcacgaggacggcauccugcggcccuccaugaagcucgucaaguuccgcaagggggacagcgugggccugcggcuggccggcgggaacgacgugggcaucuucgucgccggggugcucgaggacucccccgccgcgaaggagggccuggaggagggggaccagauccugcgcgugaacaacgucgacuucaccaacaucauccgggaggaggccguccucuuccugcuggaccuccccaagggcgaggaggugaccauccuggcccagaagaagaaggacgucuaccgccgcaucguggagagcgacgugggcgacuccuucuacauccggacccacuucgaguacgagaaggagagccccuacgggcuguccuucaacaagggcgaggucuuccgcgugguggacacgcucuacaacgggaagcugggcagcuggcuggccauccggaucgggaagaaccacaaggaggucgagcgcggcaucauccccaacaagaaccgggcggagcagcucgccagcgugcaguacacccugcccaagaccgccggcggggaccgcgccgacuucuggcgguuccgcggccugcgguccagcaagcgcaaccuccggaagucccgcgaggaccugagcgcccagcccgugcagaccaaguuccccgcguacgagcgggucgugcugcgcgaggccggguuccuccggcccgugacgaucuucggccccaucgccgacgucgcccgcgagaagcuggcccgggaggagccggacaucuaccagaucgcgaaguccgagccccgcgacgccggcaccgaccagcggagcuccgggaucauccgccugcacaccaucaagcagaucaucgaccaggacaagcacgcccuccuggacgugacccccaacgccguggaccggcugaacuacgcccagugguaccccaucgucguguuccucaacccggacagcaagcagggcgugaagacgaugcgcaugcgccugugccccgagucccgcaaguccgcgcgcaagcuguacgagcggucccacaagcugcgcaagaacaaccaccaccucuucaccaccaccaucaaccugaacagcaugaacgacgggugguacggcgcccugaaggaggccauccagcagcagcagaaccagcucgucuggguguccgaggggaaggccgacggcgcgacgagcgacgaccuggaccugcacgacgaccggcucuccuaccugagcgcccccggcuccgaguacagcauguacuccaccgacagccgccacaccagcgacuacgaggacaccgacacggagggcggggccuacaccgaccaggagcuggacgagacccucaacgacgagguggggacgccgcccgaguccgccaucacccggagcuccgagcccguccgcgaggacagcuccggcaugcaccacgagaaccagacguacccgcccuacagcccccaggcccagccccagcccauccaccggaucgacucccccggguucaagccggcgagccagcagaaggccgaggccuccagccccgugcccuaccuguccccggagaccaaccccgccagcuccaccagcgccgugaaccacaacgucaaccugaccaacgugcgccucgaggagcccacgcccgcgccguccaccagcuacagcccccaggccgacagccugcggacccccuccaccgaggccgcccacaucaugcugcgcgaccaggagcccagccucagcucccacguggacccgacgaaggucuaccggaaggaccccuaccccgaggagaugaugcgccagaaccacgugcugaagcagcccgccgugagccacccgggccaccggcccgacaaggagcccaaccugaccuacgagccccagcucccguacgucgagaagcaggcgucccgcgaccuggagcagcccaccuaccgguacgagagcuccagcuacaccgaccaguucucccgcaacuacgagcaccggcugcgcuacgaggaccgcgugcccauguacgaggagcaguggagcuacuacgacgacaagcagcccuacccgucccggccgcccuucgacaaccagcacagccaggaccucgacucccgccagcaccccgaggagagcuccgagcggggcuacuucccgcgcuucgaggagcccgcgccccugagcuacgacucccggccccgcuacgagcaggccccgcgggccagcgcgcugcgccacgaggagcagcccgcccccggguacgacacgcacggccggcuccgcccggaggcccagccccaccccuccgccgggcccaagccggccgagagcaagcaguacuucgagcaguacucccggagcuacgagcaggucccgccccagggcuucaccagccgcgcggggcacuucgagccccugcacggcgccgccgccgucccgccccugauccccuccagccagcacaagcccgaggcccucccguccaacaccaagccccugccgcccccgcccacccagacggaggaggaggaggaccccgcgaugaagccccagagcgugcugacccgggugaagauguucgagaacaagcgcuccgccagccucgagaccaagaaggacgucaacgacaccggcuccuucaagccgcccgagguggccagcaagcccuccggggcccccaucaucggccccaagcccacgagccagaaccaguucuccgagcacgacaagacccuguaccggauccccgagccccagaagccgcagcugaagccgcccgaggacaucguccgcagcaaccacuacgacccggaggaggacgaggaguacuaccggaagcagcucuccuacuucgaccgccggagcuucgagaacaagccgcccgcccacaucgcggccucccaccugagcgagcccgccaagccggcccacucccagaaccagagcaacuucuccagcuacagcuccaaggggaagccgcccgaggccgacggcguggaccgcagcuucggggagaagcgguacgagcccauccaggcgaccccgccgccgccgccccugcccucccaguacgcccagcccagccagcccgugaccuccgccagccuccacauccacuccaagggcgcccacggcgaggggaacagcgucucccuggacuuccagaacagccugguguccaagcccgacccgccgcccagccagaacaagccggcgacguuccggccgcccaaccgcgaggacaccgcccaggccgccuucuacccccagaaguccuucccggacaaggcccccgugaacggcaccgagcagacccagaagacggucacccccgcguacaaccgguucaccccgaagcccuacaccagcuccgcccgccccuucgagcggaaguucgagagccccaaguucaaccacaaccuccugccguccgagacggcccacaagcccgaccugagcuccaagacccccaccagccccaagacccucgucaagagccacucccuggcccagccgcccgaguucgacagcgggguggagacguucuccauccacgccgagaagcccaaguaccagaucaacaacaucagcaccguccccaaggcgaucccggugucccccagcgccguggaggaggacgaggacgaggacggccacaccgucguggccaccgcccgcggcaucuucaacuccaacgggggcgugcugagcuccaucgagaccggggucagcaucaucaucccccagggcgccauccccgaggggguggagcaggagaucuacuucaaggugugccgggacaacuccauccucccgccccuggacaaggagaagggcgagacgcugcucagcccccuggucaugugcggcccccacgggcugaaguuccucaagccgguggagcugcgccugccccacugcgaccccaagaccuggcagaacaagugccuccccggcgacccgaacuaccuggugggggcgaacugcgucuccgugcugaucgaccacuucuga

SEQ ID NO: 37704 - RNA, 3063 nt, Artificial Sequence
  derived and/or modified sequence opt1 from TJP2__Homo_sapiens__NP_001163885
auggaggagcugaucugggagcaguacaccgugacccuccagaaggacagcaagcgcggcuucgggaucgccgucuccggcgggcgggacaacccccacuucgagaacggcgagacgagcaucgugaucuccgacgugcugcccgggggccccgccgacggccugcuccaggagaacgaccgcgucgugauggugaacgggacccccauggaggacguccugcacagcuucgcggugcagcagcugcggaaguccggcaagguggccgccaucgucgugaagcgcccccggaaggugcaggucgccgcccuccaggcgagcccgccccuggaccaggacgaccgcgccuucgaggugauggacgaguucgacgggcgguccuuccgcagcggcuacuccgagcggagccgccugaacucccacgggggccggagccgcuccugggaggacagccccgagcggggccgcccccacgagcgggcccgcucccgggagcgcgaccucagccgggaccgcucccgggggcgcagccuggagcgcggccuggaccaggaccacgcccggacccgcgaccggucccgcgggcggagccucgagcgcggccuggaccacgacuucggcccgagccgggaccgcgaccgggaccgcucccgggggcgcagcaucgaccaggacuacgagcgggcguaccaccgcgccuacgaccccgacuacgagcgggccuacucccccgaguaccgccggggcgcccgccacgacgcccggagccgcgggccccgcucccggagccgcgagcacccgcacucccggagccccucccccgagccccgcggccggccggggcccaucggcgugcugcucaugaagucccgcgcgaacgaggaguacggccugcggcuggggagccagaucuucgucaaggagaugacccgcacgggccucgccaccaaggacgggaaccugcacgagggcgacaucauccugaagaucaacgggaccgugaccgagaacaugagccucacggacgcccggaagcugaucgagaagucccgcggcaagcugcagcucgugguccugcgggacagccagcagacccugaucaacauccccucccucaacgacagcgacuccgagaucgaggacaucagcgagaucgaguccaaccgcagcuucagccccgaggagcggcgccaccaguacuccgacuacgacuaccacagcuccagcgagaagcugaaggagcggccguccagccgcgaggacacccccucccggcugagccgcaugggcgccacccccacgcccuucaaguccaccggggacaucgccggcaccguggugccggagaccaacaaggagccccgguaccaggaggacccgcccgcgccgcagcccaaggccgcgccccgcacguuccuccggccgagccccgaggacgaggccaucuacgggcccaacaccaagaugguccgcuucaagaagggcgacuccguggggcugcgccuggccggcggcaacgacguggggaucuucgucgccggcauccaggaggggaccagcgccgagcaggagggccuccaggagggcgaccagauccugaaggugaacacccaggacuuccgggggcugguccgcgaggacgccgugcucuaccugcuggagauccccaagggcgagauggugacgauccucgcccagucccgggccgacgucuaccgcgacauccuggcgugcgggcggggcgacagcuucuucauccgcucccacuucgagugcgagaaggagaccccgcagagccuggccuucacccgcggggagguguuccggguggucgacacccucuacgacggcaagcugggcaacuggcuggccgugcggaucgggaacgagcucgagaagggccugauccccaacaagucccgcgccgagcagauggcgagcgugcagaacgcccagcgggacaacgccggggaccgcgccgacuucuggcggaugcgcggccagcggagcggggucaagaagaaccugcgcaagucccgggaggaccucacggccguggugagcgucuccaccaaguuccccgcguacgagcgcgugcugcugcgggaggccggcuucaagcgccccgugguccuguucggcccgaucgccgacaucgccauggagaagcucgccaacgagcugcccgacugguuccagaccgcgaagaccgagcccaaggacgccgggagcgagaaguccacgggcguggugcgccugaacaccguccggcagaucaucgagcaggacaagcacgcccuccuggacgugacccccaaggccguggaccugcucaacuacacccagugguucccgaucgucaucuucuucaaccccgacagccgccagggggugaagacgaugcggcagcgccugaaccccaccuccaacaagagcucccggaagcuguucgaccaggccaacaagcucaagaagaccugcgcgcaccuguucaccgccacgaucaaccugaacagcgccaacgacuccugguucggcagccucaaggacaccauccagcaccagcagggggaggccgugugggucuccgagggcaagauggagggcauggacgacgaccccgaggaccgcaugagcuaccugaccgcgaugggggccgacuaccuguccugcgacagccggcucaucuccgacuucgaggacaccgacggcgagggcggggccuacaccgacaacgagcuggacgagccggccgaggagccccuggugagcuccaucacgcgcagcagcgagcccgugcagcacgaggagaucgagaucgcccagaagcaccccgacaucuacgcggucccgaucaagacccacaagcccgaccccgggacgccccagcacaccuccagccggccgcccgagccccagaaggccccgucccgccccuaccaggacacccggggcagcuacggcuccgacgccgaggaggaggaguaccgccagcagcucagcgagcacuccaagcggggguacuacggccagagcgcccgcuaccgggacaccgagcuguga

SEQ ID NO: 37705 - RNA, 2760 nt, Artificial Sequence
  derived and/or modified sequence opt1 from TJP3__Homo_sapiens__NP_001254489
auggaggagcugaccaucugggagcagcacaccgccacgcucagcaaggacccccgccggggcuucgggaucgccaucuccggcgggcgcgaccggccgggcgggagcaugguggucuccgacguggugcccggcggccccgcggaggggcgccugcagaccggcgaccacaucgucauggugaacggggugagcauggagaacgccaccuccgccuucgccauccagauccugaagaccugcacgaagauggccaacaucaccgucaagcggccccgccggauccaccucccggcgaccaaggccagccccuccagccccggccgccaggacuccgacgaggacgacgggccccagcggguggaggagguggaccagggccgcggcuacgacggggacagcuccagcggcuccgggcggagcugggacgagcgcucccggcgcccgcggcccggccgccggggccgcgccgggagccacggccggcgcucccccgggggcgggagcgaggccaacggccuggcgcuggucuccggcuucaagcggcucccccgccaggacgugcagaugaagccggucaagagcgugcuggugaagcgccgggacagcgaggaguucggggugaagcugggcucccagaucuucaucaagcacaucaccgacagcgggcucgccgcccgccaccggggccugcaggagggggaccugauccuccagaucaacggcgucuccagccagaaccugucccugaacgacacgcgccggcucaucgagaaguccgagggcaagcugucccugcucgugcugcgcgaccgggggcaguuccuggugaacaucccgcccgccgucagcgacuccgacagcagcccccucgaggacaucagcgaccuggccuccgagcugagccaggcgccgcccucccacaucccgccgccgccccgccacgcccagcggagccccgaggccucccagaccgacagccccguggagagcccccgccuccggcgcgaguccagcguggacucccggaccaucagcgagcccgacgagcagcgcuccgagcugccccgggagagcuccuacgacaucuaccgcguccccagcucccagagcauggaggaccggggcuacucccccgacacccgcguggugcgguuccugaagggcaagagcaucgggcuccgccuggccgggggcaacgacgucggcaucuucguguccgggguccaggccggcagccccgcggacgggcagggcauccaggagggcgaccagauccuccaggugaacgacgugcccuuccagaaccugacgcgcgaggaggccguccaguuccugcuggggcucccgcccggcgaggagauggagcuggugacccagcggaagcaggacaucuucuggaagauggugcagucccgcgucggggacagcuucuacauccggacccacuucgagcuggagcccagcccgcccuccggccucggguucacccgcggcgacguguuccacgugcuggacacgcugcaccccggccccgggcagucccacgcccggggcgggcacuggcucgccguccgcaugggccgggaccugcgcgagcaggagcgggggaucauccccaaccagagccgcgccgagcagcuggcgagccucgaggccgcccagcgggccgugggcgugggccccggguccagcgccggcuccaacgcgcgcgccgaguucuggcggcugcgcgggcugcggcgcggcgccaagaagaccacccagcggagccgcgaggaccucuccgcccugacccggcaggggcgcuacccgcccuacgagcgggucgugcugcgcgaggcgagcuucaagcgccccguggucauccucggccccguggccgacaucgccaugcagaagcugacggccgagaugcccgaccaguucgagaucgccgagaccgugucccggaccgacagccccuccaagaucaucaagcuggacaccguccgcgugaucgcggagaaggacaagcacgcccugcucgacgugacgcccagcgccaucgagcggcugaacuacguccaguacuacccgaucgugguguucuucauccccgagucccgccccgcccugaaggcccuccggcaguggcuggcgcccgccagccgccgguccacccgccggcuguacgcccaggcccagaagcuccgcaagcacagcucccaccuguucaccgccaccaucccgcugaacggcacgagcgacaccugguaccaggagcucaaggcgaucauccgggagcagcagacccgccccaucuggaccgccgaggaccagcuggacgggucccuggaggacaaccucgaccugccccaccacggccuggccgacagcuccgccgaccucagcugcgacagccgggucaacuccgacuacgagacggacggggagggcggggcguacaccgacggcgagggcuacaccgacggggagggcgggcccuacaccgacguggacgacgagccgcccgcccccgcccuggcccgcagcuccgagccggugcaggccgacgagagccagagcccccgggaccgcggccggaucuccgcgcaccagggcgcccaggucgacucccgccacccccaggggcaguggcggcaggacagcaugcgcacguacgagcgcgaggcccugaagaagaaguucaugcgggugcacgacgccgaguccagcgacgaggacggcuacgacugggggcccgccaccgaccucuga

SEQ ID NO: 37706 - RNA, 705 nt, Artificial Sequence
  derived and/or modified sequence opt1 from TK1__Homo_sapiens__NP_003249
augagcugcaucaaccugcccaccgugcucccgggcucccccagcaagacccgcgggcagauccaggucauccugggccccauguucuccggcaagagcacggagcugaugcggcgcgugcggcgcuuccagaucgcccaguacaagugccucgugaucaaguacgccaaggacacccgguacuccagcuccuucugcacccacgaccgcaacaccauggaggcgcugcccgccugccugcuccgggacgucgcccaggaggcccuggggguggccgugaucgggaucgacgagggccaguucuucccggacaucgucgaguucugcgaggcgauggccaacgccggcaagacggugaucguggccgcgcuggacgggaccuuccagcgcaagcccuucggcgccauccucaaccuggucccccuggccgagagcguggugaagcucaccgccgucugcauggagugcuuccgggaggccgcguacaccaagcgccuggggacggagaaggagguggaggugaucggcggggccgacaaguaccacuccgucugccggcugugcuacuucaagaaggccagcggccagcccgccggcccggacaacaaggagaacugccccgugcccgggaagcccggcgaggccguggcggcccgcaagcuguucgccccgcagcagauccuccagugcucccccgccaacuga

SEQ ID NO: 37707 - RNA, 705 nt, Artificial Sequence
  derived and/or modified sequence opt1 from TK2__Homo_sapiens__NP_001166114
augggcgccuucugccagcgccccagcuccgacaaggagcaggagaaggagaagaaguccgugaucugcgucgaggggaacaucgccagcggcaagacgaccugccuggaguucuucagcaacgcgaccgacguggaggugcucaccgagccggucuccaaguggcggaacgugcgcgggcacaacccccugggccugauguaccacgacgccagccggugggggcucacccugcagaccuacgugcagcugacgaugcucgaccgccacacccggccccaggucuccagcgugcgccugauggagcgguccauccacagcgcccgcuacaucuucguggagaaccuguaccgguccggcaagaugcccgaggucgacuacguggugcucagcgagugguucgacuggauccugcgcaacauggacgucuccguggaccugaucguguaccuccggaccaacccggagaccugcuaccagcgccugaagaagcggugccgcgaggaggagaaggucaucccccuggaguaccucgaggccauccaccaccuccacgaggaguggcugaucaagggcagccucuuccccauggccgcgcccgugcuggugaucgaggccgaccaccacauggagcggaugcuggagcuguucgagcagaaccgcgaccggauccugacgccggagaaccgcaagcacugccccuga

SEQ ID NO: 37708 - RNA, 1872 nt, Artificial Sequence
  derived and/or modified sequence opt1 from TKT__Homo_sapiens__NP_001128527
auggagagcuaccacaagcccgaccagcagaagcugcaggcccucaaggacaccgccaaccgccugcggaucuccagcauccaggcgaccacggccgccggcuccgggcacccgaccagcugcugcuccgccgccgagaucauggcggugcuguucuuccacaccaugcgcuacaagagccaggacccccggaacccccacaacgaccgcuucguccucuccaagggccacgccgcccccauccuguacgccgugugggcggaggccggguuccuggccgaggccgagcuccugaaccugcggaagaucagcuccgaccucgacggccacccggugcccaagcaggccuucaccgacgucgcgacggggagccugggccagggccugggggccgccugcggcauggccuacaccgggaaguacuucgacaaggccuccuaccgcguguacugccuccugggcgacggggagcugagcgagggcuccgugugggaggcgauggccuucgccagcaucuacaagcucgacaaccuggucgccauccuggacaucaaccggcucggccaguccgaccccgcgccccugcagcaccagauggacaucuaccagaagcgcugcgaggccuucggguggcacgccaucaucguggacggccacagcguggaggagcugugcaaggccuucgggcaggccaagcaccagccgaccgccaucaucgcgaagaccuucaagggccggggcaucacgggggucgaggacaaggaguccuggcacggcaagccccuccccaagaacauggccgagcagaucauccaggagaucuacagccagauccaguccaagaagaagauccuggccacgcccccgcaggaggacgcccccagcguggacaucgcgaacauccgcaugcccagccugcccuccuacaaggugggggacaagaucgccacccggaaggccuacggccaggcccucgccaagcuggggcacgcgagcgaccgcaucaucgcccuggacggcgacaccaagaacuccaccuucagcgagaucuucaagaaggagcacccggaccgguucaucgagugcuacaucgccgagcagaacauggucuccaucgccgugggcugcgccacccgcaaccggaccgugcccuucugcagcaccuucgcggccuucuucacgcgcgccuucgaccagauccggauggccgccaucuccgagagcaacaucaaccucugcgggucccacugcggcgucagcaucggggaggacggccccucccagauggcgcuggaggaccuggccauguuccgcagcgugcccaccuccaccguguucuacccgagcgacggggucgccaccgagaaggccguggagcucgcggccaacacgaagggcaucugcuucauccggaccucccgccccgagaacgccaucaucuacaacaacaacgaggacuuccaggugggccaggccaaggucgugcucaagagcaaggacgaccaggugaccgucaucggggccggcgugacccugcacgaggcgcuggccgccgccgagcugcugaagaaggagaagaucaacauccggguccucgaccccuucacgaucaagccccuggaccgcaagcugauccucgacuccgcccgcgcgaccaaggggcggauccugaccguggaggaccacuacuacgagggcgggaucggcgaggccgugagcuccgccgucgugggcgagccggggaucaccgugacgcaccuggccgucaaccgcgugccccggagcggcaagcccgccgagcuccugaagauguucgggaucgaccgcgacgcgaucgcccaggccgugcggggccugaucaccaaggccuga

SEQ ID NO: 37709 - RNA, 1773 nt, Artificial Sequence
  derived and/or modified sequence opt1 from TKTL1__Homo_sapiens__NP_001139405
auggccgacgccgaggcgcgcgccgaguuccccgaggaggcccggccggaccgcggcacccuccaggugcugcaggacauggccagccggcugcgcauccacuccauccgggcgaccugcagcacguccagcggguccagcuccgagaucaugagcguccuguucuucuacaucaugcgcuacaagcaguccgaccccgagaaccccgacaacgaccgguucgugcucgccaagcgccugagcuucguggacgucgccaccggcuggcuggggcagggccucgggguggccugcggcauggccuacaccggcaaguacuucgaccgggcguccuaccgcguguucugccugaugagcgacggggaguccagcgagggcuccgucugggaggccauggccuucgccagcuacuacucccuggacaaccucguggccaucuucgacgugaaccggcuggggcacagcggcgcgcugcccgccgagcacugcaucaacaucuaccagcgccggugcgaggccuucggguggaacaccuacgucguggacggccgcgacguggaggcccucugccaggucuucuggcaggccucccaggugaagcacaagccgacggcgguggucgccaagaccuucaagggccgggggacccccagcaucgaggacgccgagagcuggcacgccaagcccaugccccgcgagcgggccgacgcgaucaucaagcugaucgagucccagauccagaccagccgcaaccuggacccgcagccgcccaucgaggacucccccgaggugaacaucacggacgugcggaugaccagcccgcccgacuaccgcgucggcgacaagaucgccacccggaaggccugcgggcucgcccuggccaagcugggcuacgcgaacaaccgcguggugguccucgacggcgacacccgcuacuccacguucagcgagaucuucaacaaggaguaccccgagcgguucaucgagugcuucauggccgagcagaacaugguguccguggcccuggggugcgccagccgcggccggaccaucgcguucgccuccaccuucgccgccuuccugacccgcgccuucgaccacauccggaucgggggccucgcggagagcaacaucaacaucaucgggucccacugcggcgucagcgugggcgacgacggggccucccagauggcccuggaggacaucgccauguuccgcacgauccccaagugcaccaucuucuaccccaccgacgccgucagcaccgagcacgcgguggcccuggccgccaacgccaagggcaugugcuucauccggacgacccgccccgagaccauggugaucuacacgccccaggagcgguucgagaucgggcaggcgaagguccuccgccacugcguguccgacaaggugaccgucaucggcgccgggaucaccguguacgaggcccuggccgcggccgacgagcugagcaagcaggacaucuucauccgggugaucgaccucuucaccaucaagccccuggacgucgccaccaucguguccagcgccaaggccacggagggccgcaucaucaccguggaggaccacuacccgcagggcgggaucggcgaggcggucugcgccgccguguccauggaccccgacauccaggugcacagccuggccgucagcggggugccccaguccggcaagagcgaggagcuccuggacauguacgggaucuccgcccggcacaucaucguggcggucaagugcaugcugcucaacuga

SEQ ID NO: 37710 - RNA, 1881 nt, Artificial Sequence
  derived and/or modified sequence opt1 from TKTL2__Homo_sapiens__NP_115512
augauggccaacgacgccaagcccgacgugaagaccguccaggugcugcgcgacaccgcgaaccggcuccgcauccacagcauccgggccacgugcgccuccggcagcgggcagcugaccuccugcugcagcgccgccgagguggucuccgugcuguucuuccacaccaugaaguacaagcagaccgacccggagcaccccgacaacgaccgcuucauccucagccggggccacgcggcccccauccuguacgccgccuggguggaggucggggacaucuccgagagcgaccugcucaaccugcgcaagcugcacuccgaccucgagcggcaccccacgccgcgccugcccuucguggacguggcgaccggcagccuggggcagggccucggcaccgccugcgggauggccuacaccggcaaguaccuggacaaggccuccuaccgggucuucugccugaugggggacggcgagagcuccgaggggagcgugugggaggccuucgcguucgccucccacuacaaccucgacaaccugguggccgucuucgacgugaaccgccugggccagagcggccccgcgccccucgagcacggggccgacaucuaccagaacugcugcgaggccuucggcuggaacacguaccugguggacgggcacgacgucgaggcccugugccaggccuucuggcaggccucccaggugaagaacaagccgaccgccaucguggcgaagaccuucaagggccggggcauccccaacaucgaggacgccgagaacuggcacgggaagcccguccccaaggagcgcgccgacgccaucgugaagcucaucgagagccagauccagaccaacgagaaccugaucccgaagucccccguggaggacagcccccagaucagcaucacggacaucaagaugaccuccccgcccgccuacaaggucggcgacaagaucgcgacccagaagaccuacgggcuggcccucgccaagcugggccgggccaacgagcgcgugaucgugcugagcggggacacgaugaacuccaccuucagcgagaucuuccggaaggagcaccccgagcgcuucaucgagugcaucaucgcggagcagaacauggucuccguggcccucggcugcgccacccggggccgcaccaucgccuucgccggggcguucgccgccuucuucacgcgggccuucgaccagcugcgcaugggcgccaucagccaggcgaacaucaaccugaucgggucccacugcggcgucagcaccggggaggacggcgugucccagauggcccucgaggaccuggccauguuccggagcauccccaacugcaccguguucuaccccuccgacgccaucagcaccgagcacgccaucuaccuggcggccaacacgaagggcaugugcuucauccgcaccucccagccggagaccgccgucaucuacacgccccaggagaacuucgagaucgggcaggccaagguggugcgccacggcgucaacgacaaggugaccgugaucggggcgggcgucacccuccacgaggcccuggaggccgccgaccaccugagccagcaggggaucuccgugcgggugaucgaccccuucaccaucaagccccucgacgccgcgaccaucaucagcuccgccaaggccacgggcggccgcgucaucaccguggaggaccacuaccgggagggcgggaucggggaggccgugugcgccgcggucagccgcgagccggacauccuggugcaccagcuggccguguccggcgucccccagcggggcaagaccagcgagcuccuggacauguucgggaucagcacccgccacaucaucgccgccgugacgcugacccucaugaaguga

SEQ ID NO: 37711 - RNA, 1485 nt, Artificial Sequence
  derived and/or modified sequence opt1 from TLDC1__Homo_sapiens__XP_005256131
augcugcccggcaaccgcgagggggccgcccucgagcggagcccgugggcggccggccccgaccgcaccgcccccgggucccccgccggcgaguucugccagaucagcgggcagaugggcaacucccggagccgcgugggccgguccuucugcagccaguuccugccggaggagcaggccgagaucgaccagcuguucgacgcgcucuccagcgacaagaacucccccaacgucagcuccaagagcuucucccugaaggcccugcagaaccacgugggggaggcccucccgcccgagauggugacccgccuguacgacggcaugcggcgcgucgaccugacggggaaggccaagggccccagcgagaacgugucccaggagcaguucaccgcgagcaugucccaccuccugaaggggaacagcgaggagaagucccugaugaucaugaagaugaucagcgccaccgagggccccgugaaggcccgggagguccagaaguucaccgaggaccucgugggcagcgugguccacgugcugucccaccgccaggagcugcggggguggacgggcaaggaggcccccgggcccaacccgcgcgugcagguccucgccgcgcagcugcugagcgacaugaagcuccaggacggcaagcggcugcugggcccccaguggcucgacuacgacugcgaccgcgccgugaucgaggacuggguguuccgggucccccacguggccaucuuccuguccguggucaucugcaagggguuccugauccucugcagcucccuggaccugaccacccucgugcccgagcgccagguggaccagggccggggguucgagagcauccuggacguccuguccgugauguacaucaacgcccagcucccgcgcgagcagcggcaccgcuggugccugcuguucagcuccgagcuccacggccacagcuucucccagcugugcgggcacaucacccaccggggccccugcguggccguccuggaggaccacgacaagcacguguucggcggguucgcgagcugcuccugggaggucaagccccaguuccagggcgacaaccgcugcuuccucuucagcaucugccccuccauggccguguacacgcacaccggguacaacgaccacuacauguaccugaaccacggccagcagaccaucccgaacgggcugggcaugggcgggcagcacaacuacuucggccucuggguggacgucgacuucgggaagggccacagccgcgccaagccgaccugcacgaccuacaacagcccccagcuguccgcccaggagaacuuccaguucgacaagauggaggugugggccgugggggaccccuccgaggagcagcuggcgaagggcaacaagagcauccucgacgccgaccccgaggcccaggcccugcuggagaucagcggccacucccggcacagcgaggggcuccgcgagguccccgacgacgaguga

SEQ ID NO: 37712 - RNA, 2343 nt, Artificial Sequence
  derived and/or modified sequence opt1 from TLE1__Homo_sapiens__NP_001290032
auguucccccagagccgccacccgacgccccaccaggccgccggccagcccuucaaguucaccauccccgagucccuggaccggaucaaggaggaguuccaguuccuccaggcgcaguaccacagccugaagcuggagugcgagaagcucgccuccgagaagaccgagaugcagcgccacuacgugauguacuacgagaugagcuacgggcugaacaucgagaugcacaagcagaccgagaucgccaagcggcugaacaccaucugcgcccaggucaucccguuccucucccaggagcaccagcagcaggucgcccaggcgguggagcgcgccaagcaggucaccauggccgagcugaacgccaucaucggcgugcgggggcugcccggccucccgcccacgcagcagcagcugcaggcgcagcaccugagccacgggcacggcccgcccgugccccucacgccccaccccuccggccugcagccgcccgggaucccgccccugggcgggagcgccggccuccuggcccuguccagcgcccucuccgggcagagccaccuggccaucaaggacgacaagaagcaccacgacgcggagcaccaccgcgaccgggagcccggcaccuccaacagccugcucguccccgacucccugcgcggcaccgacaagcggcgcaacgggcccgaguucagcaacgacaucaagaagcggaagguggacgacaaggacuccagccacuacgacuccgacggcgacaagagcgacgacaaccugguggucgacgugagcaacgaggaccccuccagcccccgcgccucccccgcccacagcccccgggagaacgggaucgacaagaaccgccuccugaagaaggacgccuccagcuccccggccagcaccgcguccagcgccuccagcaccucccucaagagcaaggagaugucccugcacgagaaggccagcacccccgugcugaaguccagcacccccacgccccgguccgacaugccgacccccggcaccagcgccacccccggccugcgcccggggcucggcaagccgcccgccaucgacccccuggugaaccaggcggccgccgggcugcggacgccccucgccgugcccggccccuaccccgccccguucgggauggugccccacgcgggcaugaacggcgagcugaccagccccggggccgccuacgccucccugcacaacaugagcccccagauguccgcggccgccgccgccgcggccgucguggccuacggccgcagcccgauggugggguucgacccgccgccccacaugcggguccccaccaucccgcccaaccucgccggcauccccgggggcaagcccgccuacuccuuccacgugaccgcggacggccagaugcagcccgugcccuucccgcccgacgcccugaucgggcccggcaucccccgccacgcccggcagaucaacacgcugaaccacggggaggucgugugcgccgugaccaucagcaaccccacccgccacgucuacaccggcgggaagggcugcgugaaggucugggacaucucccaccccggcaacaagagccccgugucccagcucgacugccugaaccgcgacaacuacauccggagcugcaagcugcuccccgacgggugcacgcugaucgugggcggggaggccuccacccugagcaucugggaccucgcggccccgacgccccgcaucaaggccgagcugaccuccagcgcccccgcgugcuacgcccuggccaucucccccgacagcaaggucugcuucuccugcugcagcgacggcaacaucgccgugugggaccuccacaaccagacccuggugcggcaguuccagggccacaccgacggggccagcugcaucgacaucuccaacgacggcaccaagcuguggaccgggggccuggacaacacgguccgcagcugggaccuccgggaggggcgccagcugcagcagcacgacuucaccucccagaucuucagccugggcuacugcccgaccggcgaguggcucgcgguggggauggaguccagcaacguggagguccugcacgugaacaagcccgacaaguaccagcugcaccuccacgaguccugcgugcugagccugaaguucgccuacugcggcaagugguucgucuccaccgggaaggacaaccuccugaacgccuggcggacgcccuacggcgccagcaucuuccaguccaaggagagcuccagcgugcuguccugcgacaucagcguggacgacaaguacaucgucaccggguccggcgacaagaaggccaccguguacgaggugaucuacuga

SEQ ID NO: 37713 - RNA, 2121 nt, Artificial Sequence
  derived and/or modified sequence opt1 from TLE2__Homo_sapiens__NP_001138233
auggugcagagccgccugaccgccaccuccgccagccaggacucccccgcgagcggccuccagacgccgcugcaguccgggcagcccuucaaguucagcauccuggagaucugcgaccggaucaaggaggaguuccaguuccuccaggcccaguaccacucccugaagcuggagugcgagaagcucgccagcgagaagaccgagaugcagcgccacuacgucauguacuacgagauguccuacggccugaacaucgagaugcacaagcaggccgagaucgugaagcggcugagcgggaucugcgcccagaucauccccuuccucacccaggagcaccagcagcagguccugcaggcgguggagcgcgccaagcaggucaccgugggcgagcugaacucccucaucgggcagcagcagcugcagccccugagccaccacgccccgcccgugccccucacgccccggccggccggccuggugggcggguccgcgaccggccugcucgcccugagcggggcccuggccgcccaggcgcagcucgccgccgccgugaaggaggaccgcgccggcgucgaggcggaggggucccggguggagcgcgcccccagccgguccgccagccccuccccgcccgagagccugguggaggaggagcgccccagcggccccggcgggggcgggaagcagcgggccgacgagaaggagcccuccggcccguacgagagcgacgaggacaaguccgacuacaaccuggucguggacgaggaccagcccagcgagccgcccucccccgccaccacccccugcggcaaggugcccaucugcauccccgcgcgccgggaccucgucgacagcccggccucccuggccagcucccuggggagcccccucccccgcgccaaggagcugauccugaacgaccuccccgccuccacgccggcgagcaaguccugcgacagcuccccgccccaggacgccagcacccccggccccuccagcgccucccaccugugccagcuggccgcgaagcccgcccccagcaccgacagcguggcccuccgguccccgcugacccugagcucccccuucacgaccagcuucucccucgggagccacuccacccugaacggcgaccugagcgugcccuccagcuacgucucccuccaccugagcccccagguguccagcuccguggucuacgggcgcagcccggugauggccuucgagucccacccccaccuccggggcagcagcguguccagcucccugcccagcauccccggcgggaagccggccuacuccuuccacgucagcgcggacggccagaugcagcccgugcccuuccccuccgacgcccuggucggggccggcaucccgcgccacgcccggcagcugcacacccucgcccacggggagguggugugcgcggucacgaucagcggcuccacccagcacguguacaccggcgggaagggcugcgugaaggucugggacguggggcagcccggcgccaagacccccguggcccagcuggacugccugaaccgcgacaacuacauccggagcugcaagcuccugcccgacgggcgcucccugaucgucggcggcgaggccagcacgcuguccaucugggaccucgccgcgccgacgccccgcaucaaggccgagcugaccagcuccgcccccgccugcuacgcgcuggccgugagccccgacgccaaggugugcuucuccugcugcagcgacgggaacaucgucgugugggaccuccagaaccagaccauggugcggcaguuccagggccacaccgacggggccuccugcaucgacaucagcgacuacggcacccgccuguggaccggcgggcuggacaacaccguccggugcugggaccuccgcgagggccggcagcugcagcagcacgacuucagcucccagaucuucagccuggggcacugcccgaaccaggacuggcucgccgugggcauggaguccagcaacguggagauccugcacguccgcaagcccgagaaguaccagcugcaccuccacgaguccugcgugcugagccugaaguucgcguccugcgugcagggggucgugcucagccccgagcuguga

SEQ ID NO: 37714 - RNA, 2310 nt, Artificial Sequence
  derived and/or modified sequence opt1 from TLE3__Homo_sapiens__NP_001098662
auguacccccagggccgccacccggccccccaccagcccgggcagcccggcuucaaguucaccguggccgagagcugcgaccggaucaaggacgaguuccaguuccugcaggcgcaguaccacucccucaaggucgaguacgacaagcuggccaacgagaagaccgagaugcagcgccacuacgugauguacuacgagaugagcuacgggcugaacaucgagaugcacaagcagacggagaucgccaagcggcucaacaccauccuggcccagaucaugccguuccugucccaggagcaccagcagcagguggcccaggcggucgagcgcgccaagcaggugaccaugaccgagcucaacgccaucaucggccagcagcagcugcaggcccagcaccugagccacgcgacgcacgggccccccgugcagcuccccccgcaccccuccggccugcagccccccggcaucccgcccgucaccgggagcuccagcggccugcucgcccugggggcccugggcucccaggcccaccucaccgugaaggacgagaagaaccaccacgagcuggaccaccgggagcgcgagagcuccgccaacaacagcgugucccccagcgagucccugcgggcgagcgagaagcaccgcggguccgccgacuacagcauggaggccaagaagcggaaggccgaggagaaggacucccucagccgcuacgacagcgacggcgacaaguccgacgaccuggucguggacgugagcaacgaggaccccgccaccccgcgggucucccccgcgcacagcccccccgagaacggccuggacaaggcccgcucccucaagaaggacgccccgacgagccccgccuccguggccagcuccagcuccacccccagcuccaagaccaaggaccuggggcacaacgacaagagcuccacccccggccugaagagcaacacgccgaccccccggaacgacgcgcccacccccgggaccuccacgaccccgggccuccgcagcaugcccggcaagcccccggggauggaccccaucgccuccgcccugcggacccccaucagcaucaccagcuccuacgccgcccccuucgcgaugaugagccaccacgagaugaacggcucccugacgagcccgggggccuacgccggccuccacaacauccccccccagauguccgccgcggccgccgccgccgcggccgccuacgggcgcagccccaugguguccuucggcgccgucggcuucgacccgcacccccccaugcgggccaccgggcugcccagcucccuggcgagcaucccgggcgggaagcccgccuacuccuuccacgugagcgccgacggccagaugcagcccgugcccuucccgcacgacgcccucgccgggcccggcaucccccgccacgcgcggcagaucaacacccugucccacggcgaggucgugugcgccgugaccaucagcaaccccacgcgccacgucuacaccgggggcaaggggugcgugaagaucugggacaucucccagccgggcagcaagucccccaucagccagcuggacugccucaaccgggacaacuacauccgcagcugcaagcugcugcccgacgggcgcacccucaucgugggcggcgaggccuccacccugacgaucugggaccuggccagccccaccccgcggaucaaggcggagcucaccuccagcgcccccgccugcuacgcccuggccaucucccccgacgcgaaggucugcuucagcugcugcuccgacgggaacaucgccgugugggaccugcacaaccagacccucguccgccaguuccagggccacacggacggggccagcugcaucgacaucucccacgacggcaccaagcuguggaccggcgggcuggacaacaccgugcggagcugggaccuccgcgagggccggcagcugcagcagcacgacuucacgucccagaucuucagccugggguacugcccgaccggcgaguggcucgccguggggauggaguccagcaacgucgaggugcugcaccacaccaagcccgacaaguaccagcugcaccugcacgaguccugcgugcucagccugaaguucgccuacugcggcaagugguucgucuccaccggcaaggacaaccugcucaacgcguggcgcacccccuacggggccagcaucuuccaguccaaggagagcagcuccgugcugagcugcgacaucuccgccgacgacaaguacaucgugacgggcagcggggacaagaaggccaccgucuacgaggugaucuacuga

SEQ ID NO: 37715 - RNA, 2418 nt, Artificial Sequence
  derived and/or modified sequence opt1 from TLE4__Homo_sapiens__NP_001269677
augauccgcgaccugagcaagauguacccccagacccggcacccggccccccaccagcccgcccagcccuucaaguucaccaucuccgagagcugcgaccgcaucaaggaggaguuccaguuccuccaggcgcaguaccacucccugaagcuggagugcgagaagcucgccagcgagaagacggagaugcagcggcacuacgugauguacuacgagauguccuacggccugaacaucgagaugcacaagcaggccgagaucgucaagcgccugaacgccaucugcgcccaggugaucccguuccucagccaggagcaccagcagcaggugguccaggcgguggagcgggccaagcaggugaccauggccgagcugaacgccaucaucgggcagcagcugcaggcgcagcaccucucccacggccacgggcugcccgucccccugaccccccacccgagcggccuccagccccccgccauccccccgaucggguccagcgccggccugcuggcccucuccagcgcccugggcgggcagucccaccugcccaucaaggacgagaagaagcaccacgacaacgaccaccagcgcgaccgggacagcaucaaguccagcuccgugagccccuccgcgagcuuccgcggcgccgagaagcaccggaacagcgccgacuacuccagcgaguccaagaagcagaagaccgaggagaaggagaucgccgcccgcuacgacagcgacggggagaaguccgacgacaaccucguggucgacgugagcaacgaggaccccuccagcccgcggggcucccccgcgcacagcccccgcgagaacgggcuggacaagacgcggcugcucaagaaggacgcccccaucuccccggccagcaucgccuccagcuccagcacccccuccagcaaguccaaggagcugagccugaagcgcgacaugggcaagcucagcgagacccggcuguccgaggacgagcagugcacccugggccuccagcgcugguucugccggcugugguucaugaacgagaagagcacgacccccguguccaagagcaacacccccaccccgcgcacggacgcccccacccccggguccaacagcacccccggccugcggccgguccccgggaagcccccgggcguggacccccucgcguccagccugcgcacccccauggccgugcccugcccguaccccacgcccuucggcaucgucccccacgccgggaugaacggcgagcugaccuccccgggggccgccuacgcgggccuccacaacaucagcccccagauguccgccgccgccgcggccgccgccgccgcggccgccuacgggcggagccccguggugggcuucgacccccaccaccacaugcgcgucccggccaucccccccaaccugaccggcauccccgggggcaagccggccuacuccuuccacgugagcgcggacgggcagaugcagcccgugcccuuccccccggacgcccugaucggccccgggaucccccgccacgcccggcagaucaacacccucaaccacggcgaggucgugugcgccgugacgaucuccaaccccacccgccacgucuacaccggcgggaagggcugcgugaaggucugggacaucagccacccggggaacaagucccccgugagccagcuggacugccugaaccgggacaacuacauccgcagcugccggcuccugcccgacggccgcacccugaucguggggggcgaggccuccacgcucagcaucugggaccuggcggccccgaccccccggaucaaggccgagcugaccuccagcgcccccgcgugcuacgcccucgccaucucccccgacagcaaggucugcuucuccugcugcagcgacggcaacaucgccgugugggaccugcacaaccagacccuggugcgccaguuccaggggcacacggacggcgccuccugcaucgacaucagcaacgacgggaccaagcucuggaccggcggccuggacaacaccguccgguccugggaccugcgcgaggggcggcagcugcagcagcacgacuucacgagccagaucuucucccucggcuacugcccgaccggggaguggcuggcggugggcauggagaacagcaacguggagguccugcacgugaccaagcccgacaaguaccagcuccaccugcacgaguccugcgugcugagccucaaguucgcccacugcgggaagugguucgucuccaccggcaaggacaaccugcugaacgccuggcgcacgcccuacggcgccagcaucuuccaguccaaggagagcagcuccgugcucagcugcgacaucuccguggacgacaaguacaucgucaccgggagcggcgacaagaaggccaccguguacgaggugaucuacuga

SEQ ID NO: 37716 - RNA, 1719 nt, Artificial Sequence
  derived and/or modified sequence opt1 from TLE6__Homo_sapiens__NP_001137458
augaccagccgcgaccagccccggccgaagggcccgcccaaguccaccagccccugccccgggaucuccaacagcgaguccagccccacgcugaacuaccagggcauccucaaccgccugaagcaguucccccgguucagcccccacuucgccgccgagcuggaguccaucuacuacucccuccacaagauccagcaggacguggcggagcaccacaagcagaucgggaacguccugcagaucguggagagcugcucccagcugcagggcuuccagagcgaggagguguccccggccgagcccgccagccccgggacgccccagcaggucaaggacaagacccuccaggaguccagcuucgaggacaucauggccacccgcuccagcgacuggcugcggcgcccgcugggcgaggacaaccagcccgagacccagcuguucugggacaaggagcccugguucuggcacgacacccucaccgagcagcuguggcggaucuucgccggcgugcacgacgagaaggcgaagccccgcgaccggcagcaggccccggggcucggccaggaguccaaggcccccgggagcugcgaccccggcaccgaccccugcccggaggacgccagcacgccccgcccgcccgaggcguccagcuccccgcccgaggggagccaggaccggaacaccuccuggggcgugguccaggagccgcccggccgcgccagccgguuccugcaguccaucagcugggaccccgaggacuucgaggacgccuggaagcgccccgacgcccugcccgggcaguccaagcggcucgccgugcccugcaagcuggagaagaugcgcauccuggcgcacggcgagcucgugcuggccaccgccaucagcuccuucacccggcacgucuucacgugcgggcgccggggcaucaagguguggagccugaccggccagguggccgaggaccgcuuccccgagucccaccuccccauccagacccccggggccuuccugcggaccugccugcucagcuccaacagccgcucccugcugacgggcggguacaaccucgcgagcgucuccgugugggaccuggccgccccgagccugcacgugaaggagcagcuccccugcgccggccugaacugccaggcccuggacgcgaaccucgacgccaaccuggccuucgccagcuucaccuccggggucgugcgcaucugggaccugcgggaccagagcgugguccgcgaccucaagggcuaccccgacggcgugaaguccaucguggucaagggguacaacaucuggaccggcgggcccgacgccugccugcggugcugggaccagcgcaccaucaugaagccgcuggaguaccaguucaagagccagaucaugucccucagccacagcccccaggaggacugggugcugcugggcauggcgaacgggcagcaguggcuccaguccacguccggcagccagcggcacauggugggccagaaggacuccgucauccugagcgugaaguucucccccuucgggcaguggugggccagcgucggcauggacgacuuccuggggguguacuccaugcccgccggcaccaagguguucgaggucccggagaugagccccgugaccugcugcgacguguccagcaacaaccgccucgucgugaccgggagcggcgagcacgccuccguguaccagaucacguacuga

SEQ ID NO: 37717 - RNA, 2157 nt, Artificial Sequence
  derived and/or modified sequence opt1 from TLK1__Homo_sapiens__NP_001130026
auggacgagcugcacagccucgacccccgccggcaggagcugcuggaggcccgcuucaccggcguggccuccgggagcaccggcuccacggggagcugcuccgucggcgcgaaggccagcaccaacaacgaguccagcaaccacuccuucgggagccucggcucccugagcgacaaggaguccgagacccccgagaagaagcagagcgaguccagccggggccgcaagcggaaggccgagaaccagaacgaguccagccaggggaaguccaucggcgggcgcggccacaagaucagcgacuacuucgaguaccagggcgggaacggcagcucccccgugcgggggaucccgcccgccauccgcagcccccagaacucccacagccacuccacccccagcuccagcgugcggcccaacucccccagcccgacggcccuggcguucggcgaccaccccaucguccagcccaagcagcucuccuucaagaucauccagaccgaccugaccaugcugaagcucgccgcccuggagagcaacaagauccaggaccuggagaagaaggaggggcgcaucgacgaccuccugcgggccaacugcgaccugcgccggcagaucgacgagcagcagaagcuccuggagaaguacaaggagcgccugaacaagugcaucuccaugagcaagaagcuccugaucgagaaguccacccaggagaagcugagcucccgggagaaguccaugcaggaccgccuccggcugggccacuucacgaccgugcgccacggcgcgagcuucaccgagcaguggaccgacggguucgccuuccagaaccuggugaagcagcaggagugggucaaccagcagcgggaggacaucgagcgccagcggaagcuccuggccaagcgcaagcccccgacggccaacaacagccaggcccccagcaccaacuccgagcccaagcagcgcaagaacaaggcggugaacggcgccgagaacgaccccuucgugcggccgaaccugccccagcuccugacccuggccgaguaccacgagcaggaggagaucuucaagcuccgccuggggcaccugaagaaggaggaggccgagauccaggccgagcucgagcggcuggagcgcguccggaaccugcacauccgcgagcucaagcggaucaacaacgaggacaacagccaguucaaggaccaccccacccugaacgagcgcuaccugcuccugcaccuccugggccgcgggggcuucuccgagguguacaaggcguucgaccuguacgagcagcgguacgccgccgugaagauccaccagcugaacaagagcuggcgggacgagaagaaggagaacuaccacaagcacgccugccgcgaguaccggauccacaaggagcucgaccacccccgcaucgucaagcuguacgacuacuucucccuggacacggacaccuucugcaccgugcucgaguacugcgagggcaacgaccuggacuucuaccugaagcagcacaagcugaugagcgagaaggaggcccgguccaucgugaugcagaucgucaacgcgcuccgcuaccugaacgagaucaagccgcccaucauccacuacgaccugaagcccgggaacauccuccugguggacggcaccgccugcggggagaucaagaucacggacuucggccugagcaagaucauggacgacgacuccuacgggguggacggcauggaccucaccagccagggcgccgggaccuacugguaccugcccccggagugcuucgucgugggcaaggagccgcccaagaucuccaacaagguggacgucuggagcgugggggugaucuucuuccagugccuguacggccggaagcccuucgggcacaaccagucccagcaggacauccuccaggagaacaccauccugaaggccacggagguccaguuccccgugaagcccgucgugagcuccgaggccaaggcguucauccgccggugccuggccuaccgcaaggaggaccgcuucgacgugcaccagcucgccaacgaccccuaccugcugccgcacaugcggcgcagcaacuccagcggcaaccuccacauggccggccugaccgcgagccccaccccgcccuccagcuccaucaucaccuacuga

SEQ ID NO: 37718 - RNA, 2319 nt, Artificial Sequence
  derived and/or modified sequence opt1 from TLK2__Homo_sapiens__NP_001271262
augauggaggagcugcacagccucgacccccgccggcaggagcugcuggaggcccgcuucaccggcgugggggucuccaagggcccgcucaacagcgaguccagcaaccagucccugugcagcguggggucccugagcgacaaggagguggagacccccgagaagaagcagaacgaccagcggaaccgcaagcggaaggccgagcccuacgagacgucccagggcaaggggacgccccgcggccacaagaucagcgacuacuucgaguucgcgggcggguccgccccgggcaccagccccgggcgguccgucccgcccguggcccgcagcagcccccagcacucccucuccaacccccugccccggcgcguggagcagccccuguacggccucgacgggagcgccgccaaggaggcgaccgaggagcaguccgcccugccgacccugaugagcgucaugcucgccaagccccggcuggacaccgagcagcuggcccagcgcggcgcgggccucugcuucaccuucgugagcgcccagcagaacucccccagcuccaccgggagcggcaacacggagcacuccugcagcucccagaagcagaucagcauccagcaccggcagacccaguccgaccugaccaucgagaagaucagcgcccuggagaacuccaagaacagcgaccucgagaagaaggaggggcgcaucgacgaccugcugcgggccaacugcgaccuccgccggcagaucgacgagcagcagaagaugcuggagaaguacaaggagcgccugaaccggugcgugaccauguccaagaagcuccugaucgagaaguccaagcaggagaagauggccugccgcgacaagagcaugcaggaccggcugcgccucggccacuucacgaccguccgccacggcgcgagcuucaccgagcaguggaccgacggguacgccuuccagaaccugaucaagcagcaggagcggaucaacucccagcgcgaggagaucgagcggcagcgcaagaugcuggccaagcggaagcccccggccaugggccaggccccgcccgcgacgaacgagcagaagcagcgcaagagcaagaccaacggggccgagaacgagacccccuccagcggcaacaccgagcucaaggacacggcccccgcccugggggcccacagccugcuccggcugacccuggcggaguaccacgagcaggaggagaucuucaagcuccgccugggccaccugaagaaggaggaggccgagauccaggccgagcucgagcggcuggagcgcgugcggaaccugcacauccgcgagcucaagcggauccacaacgaggacaacucccaguucaaggaccaccccacccugaacgaccgcuaccugcuccugcaccuccugggccgcgggggcuucagcgagguguacaaggccuucgaccugaccgagcagcgguacgucgccgugaagauccaccagcugaacaagaacuggcgggacgagaagaaggagaacuaccacaagcacgcgugccgcgaguaccggauccacaaggagcuggaccacccccgcaucgugaagcucuacgacuacuucucccuggacacggacagcuucugcaccguccuggaguacugcgaggggaacgaccucgacuucuaccugaagcagcacaagcugauguccgagaaggaggcccgcagcaucaucaugcagaucgugaacgcccucaaguaccugaacgagaucaagcccccgaucauccacuacgaccugaagcccggcaacauccuccuggugaacgggaccgccugcggcgagaucaagaucaccgacuucggccuguccaagaucauggacgacgacagcuacaacuccgucgacgggauggagcucacgagccagggcgcggggaccuacugguaccugccgcccgagugcuucguggugggcaaggagccgcccaagaucuccaacaaggucgacguguggagcgugggggucaucuucuaccagugccuguacggccggaagcccuucggccacaaccagucccagcaggacauccuccaggagaacaccauccugaaggccaccgaggugcaguucccgcccaagcccgucgugacgcccgaggccaaggccuucauccgccggugccuggccuaccgcaaggaggaccggaucgacgugcagcagcucgcgugcgaccccuaccugcugccccacauccgcaagagcgucuccaccagcucccccgccggggccgccaucgccagcaccagcggcgcguccaacaacagcuccagcaacuga

SEQ ID NO: 37719 - RNA, 1179 nt, Artificial Sequence
  derived and/or modified sequence opt1 from TLL1__Homo_sapiens__NP_001191689
augggccuggggacccucagcccccgcaugcugguguggcuggucgccuccggcaucguguucuacggggagcucugggugugcgccggccuggacuacgacuacaccuucgacgggaacgaggaggacaagacggagaccaucgacuacaaggacccgugcaaggcggccgucuucuggggcgacaucgcccuggacgacgaggaccucaacaucuuccagaucgaccggaccaucgaccugacccagaaccccuucggcaaccuggggcacacgaccggcgggcucggcgaccacgccaugagcaagaagcgcggggcccuguaccagcugaucgaccggauccgccggaucggcuucggccucgagcagaacaacaccgugaaggggaaggugccccugcaguucuccggccagaacgagaagaaccgcgucccccgggcggccaccagccgcacggagcggaucuggcccgggggcgugaucccguacgugaucggcgggaacuucaccggcucccagcgcgccauguucaagcaggccaugcggcacugggagaagcacacgugcgucaccuucaucgagcgcagcgacgaggaguccuacaucguguucaccuaccggcccugcgggugcugcagcuacgugggccgccgggggaacggcccccaggcgaucuccaucggcaagaacugcgacaaguucgggaucgucgugcacgagcugggccacgugaucggguucuggcacgagcacacccgcccggaccgggacaaccacgucaccaucauccgcgagaacauccagcccggccaggaguacaacuuccucaagauggagcccggggaggugaacagccugggcgagcgguacgacuucgacuccaucaugcacuacgcccgcaacaccuucagccggggcauguuccuggacacgauccuccccucccgcgacgacaacgggauccgcccggccaucggccagcggacccgccugagcaagggggacaucgcccaggcccggaagcuguaccgcugccccgcgugcggcgagacccuccaggaguccaacgggaaccugagcucccccggcuuccccaacggcuacccgagcuacacccacugcaucuggcggguguccgucacgcccggggagaaggugguguucagccugugcuga

SEQ ID NO: 37720 - RNA, 3048 nt, Artificial Sequence
  derived and/or modified sequence opt1 from TLL2__Homo_sapiens__NP_036597
augccccgcgccaccgcccugggcgcgcucgugagccugcugcuccugcugccgcucccccgcggggccggcgggcugggcgagcggcccgacgccaccgccgacuacuccgagcuggacggggaggagggcacggagcagcagcucgagcacuaccacgaccccugcaaggccgcggucuucuggggcgacaucgcccuggacgaggacgaccugaagcuguuccacaucgacaaggcccgggacuggaccaagcagaccgugggggccaccggccacagcaccgggggccucgaggagcaggcguccgagagcuccccggacaccaccgccauggacaccgggacgaaggaggccggcaaggacggccgcgagaacaccacccugcuccacagccccgggacccugcacgccgccgcgaagacguucagcccccgggugcgccgggccaccaccagccgcaccgagcggaucuggcccggcggggucaucccguacgugaucggcggcaacuucacggggucccagcgcgccaucuucaagcaggccaugcggcacugggagaagcacacgugcgugaccuucaucgagcgcaccgacgaggagagcuucaucgucuucuccuaccggacgugcggcugcugcagcuacguggggcgccggggcgggggcccccaggccaucuccaucggcaagaacugcgacaaguucgggaucguggcgcacgagcugggccacgucgugggguucuggcacgagcacacccgccccgaccgggaccagcacgugaccaucauccgcgagaacauccagcccggccaggaguacaacuuccucaagauggaggccggggaggucagcucccugggcgagaccuacgacuucgacagcaucaugcacuacgcccggaacacguucucccgcggcguguuccuggacaccauccucccgcggcaggacgacaacggggugcgccccaccaucggccagcgcguccggcugagccagggggacaucgcccaggcccgcaagcuguacaagugccccgcgugcggcgagacccuccaggacacgaccgggaacuucuccgcccccggcuucccgaacggcuaccccagcuacagccacugcguguggcggaucuccgugacccccggggagaagaucguccugaacuucaccagcauggaccuguucaagucccgccucugcugguacgacuacguggaggugcgggacggcuacuggcgcaaggccccgcugcuggggcgguucugcggcgacaagauccccgagccccucgucagcacggacucccgccuguggguggaguuccggagcuccagcaacauccugggcaagggguucuucgccgccuacgaggcgaccugcggcggggacaugaacaaggacgccggccagauccagucccccaacuaccccgacgacuaccgcccgagcaaggagugcguguggcggaucaccgucuccgagggguuccacgugggccucaccuuccaggccuucgagaucgagcgccacgacagcugcgccuacgacuaccuggagguccgggacggccccacggaggaguccgcgcugaucgggcacuucugcggcuacgagaagcccgaggacgugaaguccuccagcaaccgccucuggaugaaguucguguccgacgggagcaucaacaaggccggcuucgccgccaacuucuucaaggaggucgacgagugcuccuggcccgaccacgggggcugcgagcaccggugcgugaacacccugggcagcuacaagugcgccugcgacccgggguacgagcuggcggccgacaagaagaugugcgagguggccugcggcggguucaucaccaagcucaacggcaccaucaccagccccggguggcccaaggaguacccgacgaacaagaacugcgucuggcaggucguggcccccgcccaguaccgcaucucccugcaguucgagguguucgagcuggagggcaacgacgugugcaaguacgacuucguggagguccggagcggccucucccccgacgcgaagcugcacgggcgcuucugcggcagcgagacccccgaggugaucaccucccagagcaacaacaugcggguggaguucaaguccgacaacaccgucagcaagcgcggguuccgcgcccacuucuucuccgacaaggacgagugcgccaaggacaacggcgggugccagcacgagugcgugaacacguucggcagcuaccugugccggugccgcaacggcuacuggcuccacgagaacgggcacgacugcaaggaggccggcugcgcccacaagaucuccagcguggaggggacccuggcguccccgaacuggcccgacaaguaccccagccggcgcgagugcaccuggaacaucuccagcaccgccggccaccgggucaagcugacguucaacgaguucgagaucgagcagcaccaggagugcgccuacgaccaccucgagauguacgacggccccgacucccuggccccgauccuggggcgcuucugcggcagcaagaagcccgaccccaccguggcgagcggguccagcauguuccugcgguucuacuccgacgccagcgugcagcgcaagggcuuccaggccguccacuccaccgagugcgggggccggcucaaggccgaggugcagaccaaggagcuguacagccacgcccaguucggcgacaacaacuaccccuccgaggcgcgcugcgacugggugaucgucgccgaggacggguacggcguggagcugacguuccggaccuucgagguggaggaggaggccgacugcggguacgacuacauggaggccuacgacggcuacgacagcuccgccccgcgccucgggcgguucugcggcagcggcccccuggaggagaucuacuccgcgggggacagccugaugauccgcuuccggaccgacgacaccaucaacaagaagggcuuccacgcccgcuacacguccaccaaguuccaggacgcccuccacaugaagaaguga

SEQ ID NO: 37721 - RNA, 7626 nt, Artificial Sequence
  derived and/or modified sequence opt1 from TLN1__Homo_sapiens__NP_006280
augguggcccugagccugaagaucagcaucggcaacguggugaagaccaugcaguucgagcccagcaccaugguguacgacgccugccgcaucauccgggagcgcauccccgaggcccccgccgggccgcccuccgacuucggccuguuccugagcgacgacgaccccaagaaggggaucuggcucgaggccggcaaggcccuggacuacuacaugcugcggaacggggacacgauggaguaccgcaagaagcagcggccccucaagauccgcaugcuggacggcaccgugaagaccaucaugguggacgacuccaagaccgugacggacaugcugaugaccaucugcgcccggaucggcaucaccaaccacgacgaguacagccucguccgcgagcugauggaggagaagaaggaggagaucaccgggacgcugcggaaggacaagacccuccugcgcgacgagaagaagauggagaagcugaagcagaagcuccacaccgacgacgagcugaacuggcuggaccacggccggacccuccgcgagcaggggguggaggagcacgagacgcugcugcuccggcgcaaguucuucuacuccgaccagaacguggacagccgggaccccguccagcugaaccugcucuacgugcaggcgcgcgacgacauccugaacggcucccaccccgugagcuucgacaaggccugcgaguucgccggguuccagugccagauccaguucggcccgcacaacgagcagaagcacaaggccggcuuccuggaccucaaggacuuccugcccaaggaguacgucaagcagaagggggagcggaagaucuuccaggcgcacaagaacugcggccagauguccgagaucgaggccaaggugcgcuacgugaagcuggcccggagccucaagaccuacggggucuccuucuuccuggugaaggagaagaugaagggcaagaacaagcuggugccccgccuccugggcaucaccaaggagugcgucaugcggguggacgagaagaccaaggaggugauccaggaguggaaccugacgaacaucaagcgcugggccgccagccccaaguccuucacccucgacuucggggacuaccaggacggcuacuacagcguccagaccaccgagggggagcagaucgcgcagcugaucgccggcuacaucgacaucauccugaagaagaagaaguccaaggaccacuucgggcucgagggcgacgaggagagcacgaugcuggaggacuccgugagcccgaagaaguccaccgugcugcagcagcaguacaaccgcgucggcaagguggagcacggguccgucgcccuccccgccaucaugcggagcggcgccuccgggcccgagaacuuccaggugggcagcaugcccccggcgcagcagcagaucaccuccgggcagaugcaccgcggccacaugccgccccugaccagcgcccagcaggcccugacgggcaccaucaacuccagcaugcaggccgugcaggccgcgcaggccacccucgacgacuucgacacccugcccccgcuggggcaggacgccgccuccaaggccuggcggaagaacaagauggacgagagcaagcacgagauccacucccaggucgacgcgaucacggccggcaccgccagcguggugaaccucaccgccggggaccccgcggagaccgacuacacggccgucggcugcgccgugaccaccaucuccagcaaccugaccgagaugucccgcggggugaagcugcuggccgcccuccuggaggacgagggcggcagcgggcggccccugcuccaggcggccaagggccuggccggggccgucuccgagcugcuccgcagcgcccagcccgcguccgccgagccgcggcagaaccugcugcaggccgccggcaacgugggccaggccagcggggagcuccugcagcagaucggcgagagcgacacggacccccacuuccaggacgcgcugaugcagcucgccaaggccguggccuccgcggccgccgcccugguccugaaggccaagagcguggcgcagcgcaccgaggacuccgggcuccagacccaggugaucgccgccgccacccagugcgcccugagcaccucccagcuggucgcgugcacgaaggugguggcccccaccaucagcucccccgucugccaggagcagcucguggaggccggccggcugguggccaaggccgucgaggggugcgugagcgcgucccaggccgccaccgaggacggccagcugcuccgcggcgugggggccgcggccaccgccgucacgcaggcccugaacgagcugcuccagcacgugaaggcccacgcgaccggcgccgggccggccggccgguacgaccaggccaccgacaccauccugacggugaccgagaacaucuucagcuccaugggggacgccggcgagaugguccgccaggcgcggauccuggcccaggccaccagcgaccucgugaacgccaucaaggccgacgcggagggcgaguccgaccuggagaacagccgcaagcugcucuccgccgccaagauccuggccgacgccaccgcgaagaugguggaggccgccaagggggccgcggcccaccccgacagcgaggagcagcagcagcggcugcgcgaggccgccgagggccuccggauggccacgaacgcggccgcccagaacgccaucaagaagaagcugguccagcgccuggagcacgccgcgaagcaggccgccgccuccgccacccagaccaucgcggccgcccagcacgccgcgagcacccccaaggccagcgccgggccgcagccccuccuggugcaguccugcaaggccguggccgagcagaucccccugcucguccagggcgugcgggggagccaggcgcagcccgacuccccgagcgcccagcuggcccugaucgccgccucccagagcuuccuccagcccggcggcaagaugguggcggccgccaaggccuccguccccacgauccaggaccaggccagcgcgaugcagcugucccagugcgccaagaaccuggggaccgcccucgccgagcugcgcaccgcggcccagaaggcccaggaggccugcggcccccuggagauggacagcgcccucuccguggugcagaaccuggagaaggaccugcaggaggucaaggcggccgcccgcgacgggaagcucaagccgcugcccggcgagaccauggagaagugcacgcaggaccuggggaacagcaccaaggccguguccagcgccaucgcgcagcuccugggcgagguggcccagggcaacgagaacuacgccgggaucgccgcccgggacgucgcgggcgggcugcgcucccucgcccaggccgcccggggcguggccgcgcugaccagcgaccccgccgugcaggccaucguccuggacaccgccuccgacgugcucgacaaggcgagcucccugaucgaggaggccaagaaggccgccggccaccccggggacccggagagccagcagcgccuggcccagguggcgaaggccgucacgcaggcccucaaccggugcgugagcugccugcccggccagcgcgacguggacaacgcccugcgggccgucggggacgcguccaagcgccuccugagcgacucccugccgcccagcaccggcaccuuccaggaggcccagucccggcucaacgaggccgccgccgggcugaaccaggcggccaccgagcuggugcaggccagccgcggcacgccgcaggaccucgcccgggcguccggccgcuucgggcaggacuucagcaccuuccuggaggccggcgucgagauggccgggcaggcccccucccaggaggaccgggcccagguggugagcaaccugaagggcaucuccaugagcuccagcaagcuccugcuggcggccaaggcccucuccaccgaccccgccgcccccaaccucaagagccagcuggcggccgccgcccgcgccgucaccgacuccaucaaccagcucaucacgaugugcacccagcaggcgccggggcagaaggagugcgacaacgcccugcgggagcuggagaccgugcgcgagcuccuggagaaccccgugcagcccaucaacgacaugagcuacuucggcugccuggacuccgucauggagaacagcaaggugcucggcgaggccaugaccgggaucagccagaacgccaagaacggcaaccugcccgaguucggggacgcgaucuccacggccagcaaggcccugugcggcuucaccgaggccgccgcgcaggccgccuaccucgugggggucuccgacccgaacagccaggccggccagcagggccugguggagcccacccaguucgcccgggcgaaccaggccauccagauggccugccagucccugggggagcccggcugcacccaggcccaggugcucagcgccgcgaccaucgucgccaagcacacguccgcccugugcaacagcugccgccuggccuccgcccggaccaccaacccgaccgcgaagcgccaguucgugcagagcgccaaggagguggccaacuccacggccaaccuggucaagaccaucaaggcgcucgacggggccuucaccgaggagaaccgggcccagugccgcgccgccaccgcgccccugcuggaggccguggacaaccucagcgccuucgccuccaaccccgaguucagcuccauccccgcccagaucagcccggagggccgcgcggccauggagcccaucgugaucuccgccaagacgaugcuggagagcgccggcgggcugauccagaccgcccgggcgcucgccgucaacccccgcgacccgcccuccuggagcgugcuggccggccacagccggaccguguccgacagcaucaagaagcugaucaccuccaugcgcgacaaggcccccgggcagcucgagugcgagacggcgaucgccgcccugaacagcugccugcgggaccucgaccaggccucccuggccgcggucagccagcagcuggcgccccgcgagggcaucucccaggaggcccuccacacccagaugcugaccgccgugcaggagaucagccaccugaucgagccccucgccaacgcggcccgggccgaggccucccagcuggggcacaaggugagccagauggcccaguacuucgagccccugacccucgcggccgucggcgccgccuccaagacgcugagccacccccagcagauggcccugcucgaccagaccaagacccuggcggaguccgcccugcagcuccuguacaccgccaaggaggccggcgggaaccccaagcaggcggcccacacgcaggaggcccuggaggaggccgugcagaugaugaccgaggccguggaggaccucaccaccacgcugaacgaggcggccagcgccgccggcgucgucgggggcaugguggacuccaucacccaggccaucaaccagcuggacgaggggcccaugggcgagccggagggcagcuucgucgacuaccagaccaccauggugcgcacggcgaaggccaucgccgugaccguccaggagauggugaccaaguccaacaccagccccgaggagcucgggccccuggccaaccagcugacguccgacuacggccggcucgccagcgaggcgaagcccgccgccguggccgcggagaacgaggagaucgggagccacaucaagcaccgcguccaggagcugggccacgggugcgccgcccuggugaccaaggccggcgcccuccagugcuccccgagcgacgcguacaccaagaaggagcugaucgagugcgcccggcgcguguccgagaaggucagccacgugcuggccgcccuccaggccggcaaccgggggacccaggcgugcaucacggccgccuccgccgugagcggcaucaucgccgaccuggacaccaccaucauguucgcgaccgccgggacccugaaccgcgagggcacggagaccuucgccgaccaccgggaggggauccucaagaccgccaagguccugguggaggacaccaaggugcugguccagaacgcggccggcucccaggagaagcucgcccaggccgcccagagcuccguggcgacgaucacccgccuggccgacguggucaagcugggcgccgccagccucggggccgaggaccccgagacccagguggugcugaucaacgcggucaaggacguggccaaggcccugggcgaccucaucuccgccaccaaggccgcggccgggaaggucggcgacgaccccgccguguggcagcugaagaacagcgccaaggugauggucacgaacgugaccucccugcucaagaccgugaaggccgucgaggacgaggcgaccaagggcacgcgggcccuggaggccaccaccgagcacauccgccaggagcuggccguguucugcagccccgagccgcccgcgaagaccuccacgcccgaggacuucauccggaugaccaaggggaucaccauggccaccgccaaggccguggccgcgggcaacagcugccgccaggaggacgucaucgccacggccaaccucucccgccgggccaucgccgacaugcugcgcgcgugcaaggaggccgccuaccaccccgagguggccccggacgugcggcugcgcgcccuccacuacgggcgggagugcgcgaacggcuaccuggagcugcucgaccacguccugcugacccuccagaagcccagccccgagcugaagcagcagcugaccgggcacuccaagcgcguggccggcagcgugaccgagcucauccaggccgccgaggcgaugaagggcacggagugggucgacccggaggaccccaccgugaucgccgagaacgagcugcugggggccgccgccgcgaucgaggccgccgccaagaagcucgagcagcugaagccccgggccaagcccaaggaggcggacgagagccugaacuucgaggagcagauccucgaggccgccaaguccaucgccgccgcgaccagcgcccuggugaaggccgccuccgcggcccagcgcgagcuggucgcccagggcaaggugggggccaucccggccaacgcgcucgacgacggccaguggagccaggggcugaucuccgccgcccggaugguggccgccgcgaccaacaaccugugcgaggccgccaacgccgccguccagggccacgcgagccaggagaagcucaucuccagcgccaagcaggucgccgccuccacggcccagcugcugguggcgugcaaggucaaggccgaccaggacagcgaggccaugaagcgccuccaggccgcgggcaacgccgugaagcgggccuccgacaaccuggugaaggccgcccagaaggcggccgccuucgaggagcaggagaacgagaccgucguggugaaggagaagauggucgggggcaucgcccagaucaucgccgcgcaggaggagaugcugcgcaaggagcgggagcucgaggaggcccgcaagaagcuggcccagauccggcagcagcaguacaaguuccugcccagcgagcuccgcgacgagcacuga

SEQ ID NO: 37722 - RNA, 7629 nt, Artificial Sequence
  derived and/or modified sequence opt1 from TLN2__Homo_sapiens__XP_011520408
augguggcccugagccucaagaucugcguccgccacugcaacguggugaagaccaugcaguucgagcccuccaccgccgucuacgacgcgugccgggugauccgcgagcgggugccggaggcccagacgggccaggccagcgacuacgggcuguuccuguccgacgaggacccccgcaagggcaucuggcucgaggccgggcggacccuggacuacuacaugcugcgcaacggcgacauccucgaguacaagaagaagcagcggccccagaagauccgcaugcuggacgggagcgucaagaccgugaugguggacgacuccaagaccgucggcgagcugcucgugacgaucugcagccggaucggcaucaccaacuacgaggaguacucccugauccaggagaccaucgaggagaagaaggaggaggggaccggcacgcugaagaaggaccgcacccuccugcgggacgagcgcaagauggagaagcugaaggccaagcuccacaccgacgacgaccugaacuggcuggaccacagccggaccuuccgcgagcaggggguggacgagaacgagacgcuccugcugcggcgcaaguucuucuacuccgaccagaacgucgacagccgggaccccgugcagcucaaccugcuguacgugcaggcgcgcgacgacauccucaacggcucccacccggucagcuucgagaaggccugcgaguucgggggcuuccaggcccagauccaguucggcccccacguggagcacaagcacaagcccggguuccuggaccugaaggaguuccuccccaaggaguacaucaagcagcggggcgccgagaagcgcaucuuccaggagcacaagaacugcggggagauguccgagaucgaggcgaaggugaaguacgucaagcuggcccggagccugcgcaccuacggcguguccuucuuccucgugaaggagaagaugaagggcaagaacaagcuggucccgcgccugcucgggaucaccaaggacagcgugaugcggguggacgagaagaccaaggagguccugcaggaguggccccugacgaccgugaagcgcugggccgccucccccaagagcuucacccucgacuucggcgaguaccaggaguccuacuacagcguccagaccacggagggggagcagaucagccagcugaucgccggcuacaucgacaucauccugaagaagaagcaguccaaggaccgguucgggcucgagggcgacgaggagagcaccaugcuggaggaguccgugagccccaagaaguccaccauccugcagcagcaguucaaccgcaccggcaaggcggagcacgggagcguggcccucccggccgucaugcgguccggcagcuccgggcccgagacguucaacgugggcagcaugcccuccccccagcagcaggugauggucgggcagaugcaccgcggccacaugccgccccugaccagcgcccagcaggcccugaugggcaccaucaacaccuccaugcacgcggugcagcaggcccaggacgaccucagcgagcuggacucccugcccccccucgggcaggacauggccagccggguguggguccagaacaagguggacgaguccaagcacgagauccacagccagguggacgccaucacggccggcaccgcguccgucgugaaccugaccgccggggacccggccgacaccgacuacacggccgugggcugcgccaucaccaccaucagcagcaaccugaccgagauguccaagggggucaagcugcucgcggcccugauggacgacgaggugggcagcggcgaggaccugcuccgcgccgcccggacgcuggcgggggccguguccgaccugcucaaggccguccagcccaccagcggcgagccccgccagaccgugcugaccgccgccggguccaucggccaggcgagcggcgaccugcuccggcagaucggggagaacgagaccgacgagcgcuuccaggacgugcugaugucccuggccaaggccgucgccaacgccgcggccaugcucgugcugaaggccaagaacguggcccaggucgccgaggacacggugcugcagaaccgggugaucgcggccgccacccagugcgcccucagcaccucccagcuggucgcgugcgccaagguggugagccccaccaucuccagcccggucugccaggagcagcugaucgaggccggcaagcucguggaccgcuccguggagaacugcguccgggccugccaggccgcgacgaccgacagcgagcugcugaagcagguguccgccgccgccagcguggucucccaggcccuccacgaccugcugcagcacgugcgccaguucgcgagccggggggagcccaucggccgcuacgaccaggccaccgacaccaucaugugcgugacggagagcaucuucuccagcaugggggacgccggcgagaugguccggcaggcccgcgugcucgcccaggcgaccuccgaccuggugaacgccaugcgcagcgacgccgaggccgagaucgacauggagaacuccaagaagcugcucgcggccgccaagcugcuggccgacagcaccgcccggauggucgaggcggccaagggcgccgccgccaaccccgagaacgaggaccagcagcagcgccuccgggaggcggccgaggggcugcgcguggccaccaacgccgccgcgcagaacgccaucaagaagaagaucgugaaccggcuggaggucgccgccaagcaggccgcggccgccgccacgcagaccaucgcggccucccagaacgccgccgugagcaacaagaaccccgccgcgcagcagcagcucgugcaguccugcaaggccgucgccgaccacaucccgcagcuggugcagggcgugcgcgggagccaggcccaggccgaggaccuguccgcgcagcucgcccugaucaucagcucccagaacuuccugcagcccggcagcaagauggucuccagcgccaaggccgccgugcccaccgucuccgaccaggcggccgccaugcagcucagccagugcgccaagaaccuggcgaccucccuggccgagcuccggacggccagccagaaggcccacgaggccugcgggccgauggagaucgacagcgcgcugaacaccgugcagacccugaagaacgagcuccaggacgccaagauggccgccguggagucccagcugaagccccugcccggcgagacccucgagaagugcgcccaggaccugggcagcacguccaaggcggucgggagcuccauggcccagcugcucaccugcgccgcccagggcaacgagcacuacaccgggguggccgcgcgcgagaccgcccaggcccugaagacgcuggcccaggcggcccggggcguggccgccagcaccaccgaccccgccgcggcccacgccaugcucgacuccgcccgcgacgucauggaggggagcgccaugcugauccaggaggcgaagcaggcccugaucgccccgggcgacgccgagcggcagcagcgccucgcccagguggcgaaggccgugucccacagccugaacaacugcgucaacugccugcccggccagaaggacguggacguggcccucaaguccaucggggagagcuccaagaagcugcuggucgacagccucccccccuccaccaagccguuccaggaggcccagagcgagcugaaccaggccgcggccgaccugaaccaguccgccggcgagguggugcacgccacgcgggggcagagcggcgagcucgcggccgccuccgggaaguucagcgacgacuucgacgaguuccuggacgccggcaucgagauggccggccaggcgcagaccaaggaggaccagauccaggucaucgggaaccugaagaacaucagcauggccuccagcaagcuccugcuggccgccaagucccucagcguggaccccggcgcccccaacgcgaagaaccugcuggccgccgccgcccgcgcggugaccgaguccaucaaccagcucaucacccugugcacgcagcaggcccccgggcagaaggagugcgacaacgcccugcgggagcucgagaccgucaagggcaugcuggacaacccgaacgagcccgugagcgaccuguccuacuucgacugcaucgagagcgugauggagaacuccaagguccucggcgagagcauggccgggaucucccagaacgcgaagaccggcgaccugcccgccuucggggagugcgugggcaucgccagcaaggcccugugcgggcucaccgaggccgcggcccaggccgccuaccuggugggcaucuccgaccccaacagccaggccggccaccaggggcuggucgacccgauccaguucgcgcgcgccaaccaggccauccagauggccugccagaaccucguggaccccggcuccagccccucccaggugcugagcgccgcgacgaucgucgccaagcacaccuccgcccugugcaacgccugccggaucgcgagcagcaagaccgccaaccccguggccaagcgccacuucgugcaguccgccaaggaggucgccaacagcaccgcgaaccucgugaagaccaucaaggcccuggacggggacuucuccgaggacaaccggaacaagugccgcaucgccacggccccgcugaucgaggccguggagaaccucaccgcguucgccagcaaccccgaguucgucuccauccccgcccagaucagcuccgagggcagccaggcccaggagcccauccugguguccgccaagaccaugcuggagagcuccagcuaccugauccggaccgcgcgcucccucgccaucaacccgaaggacccccccacguggagcgugcuggccgggcacucccacaccgucagcgacuccaucaagagccugaucaccuccauccgcgacaaggccccgggccagcgggagugcgacuacagcaucgacggcaucaaccgcugcauccgggacaucgagcaggccagccucgcggccgugucccagagccuggccacccgcgacgacaucuccguggaggcccugcaggagcagcucacgagcgucgugcaggagaucgggcaccugaucgaccccaucgcgaccgccgcccggggcgaggccgcccagcuggggcacaaggugacccagcucgcguccuacuucgagccccugauccuggccgccgucggcguggccagcaagauccucgaccaccagcagcagaugaccgugcuggaccagacgaagacccuggccgaguccgcgcuccagaugcuguacgccgccaaggaggggggcggcaaccccaaggcccagcacacccacgacgccaucaccgaggcggcccagcugaugaaggaggccgucgacgacaucauggugacgcucaacgaggccgcgagcgagguggggcuggucggcgggaugguggacgccaucgccgaggccauguccaagcuggacgagggcaccccgcccgagcccaagggcaccuucguggacuaccagaccacggucgugaaguacagcaaggccaucgcggucaccgcccaggagaugaugaccaaguccgugaccaaccccgaggagcucgggggccuggccagccagaugacguccgacuacgggcaccuggccuuccagggccagauggccgcggccaccgccgagccggaggagaucggguuccagauccgcacccgggugcaggaccucggccacggcugcaucuuccugguccagaaggccggggcccugcaggugugccccaccgacagcuacacgaagcgcgagcucaucgagugcgcgcgggccgugaccgagaaggucucccuggugcugagcgcccuccaggccggcaacaaggggacccaggccugcaucaccgcggccacggccguguccggcaucaucgccgaccuggacaccaccaucauguucgcgaccgccgggacgcugaacgccgagaacagcgagaccuucgccgaccaccgcgagaacauccucaagaccgccaaggcgcuggucgaggacaccaagcugcucguguccggcgccgccagcacccccgacaagcuggcccaggccgcgcagagcuccgccgccacgaucacccagcuggccgagguggucaagcucggcgccgcgagccugggguccgacgaccccgagacccagguggugcugaucaacgccaucaaggacgucgccaaggcccucagcgaccugaucuccgcgaccaagggcgccgccagcaagccgguggacgaccccuccauguaccagcugaagggggccgccaaggugauggucacgaacgugaccagccuccugaagaccgugaaggcggucgaggacgaggccacccggggcacgcgcgcccuggaggccaccaucgagugcaucaagcaggagcucaccguguuccaguccaaggacgugcccgagaagaccagcucccccgaggagagcauccggaugacgaaggggaucaccauggccaccgcgaaggccgucgccgccggcaacuccugccgccaggaggacgugaucgccaccgcgaaccugagccggaaggccguguccgacaugcugacggccugcaagcaggccagcuuccacccggacgucuccgacgaggugcgcacccgggcgcuccgcuucggcaccgagugcacccugggguaccuggaccuccuggagcacgugcuggucauccuccagaagcccacgcccgaguucaagcagcagcuggccgccuucagcaagcggguggccggcgccgugaccgagcugauccaggcggccgaggccaugaaggggaccgagugggucgaccccgaggacccgaccgugaucgccgagacggagcuccugggcgccgcggccagcaucgaggccgccgccaagaagcuggagcagcucaagccccgcgcgaagcccaagcaggccgacgagacccuggacuucgaggagcagauccuggaggccgccaaguccaucgccgcggccaccagcgcccucgugaaguccgccagcgcggcccagcgcgagcuggucgcccaggggaaggugggcuccauccccgccaacgccgcggacgacggccaguggagccaggggcugaucuccgccgcccggaugguggccgccgcgaccagcucccucugcgaggccgccaacgccagcguccagggccacgccuccgaggagaagcugaucagcuccgcgaagcagguggccgccagcacggcccagcugcucguggcgugcaaggucaaggccgaccaggacuccgaggccaugcgccggcugcaggccgccgggaacgcggugaagcgcgccagcgacaaccuggugcgggccgcccagaaggccgcguucggcaaggccgacgacgacgacgucguggugaagaccaaguucgucggcgggaucgcccagaucaucgccgcccaggaggagaugcucaagaaggagcgcgagcuggaggaggcgcggaagaagcuggcccagauccgccagcagcaguacaaguuccucccgaccgagcugcgggaggacgagggcuga

SEQ ID NO: 37723 - RNA, 2436 nt, Artificial Sequence
  derived and/or modified sequence opt1 from TLR10__Homo_sapiens__XP_011512064
augcgccugauccggaacaucuacaucuucugcagcaucgugaugaccgccgagggcgacgcccccgagcucccggaggagcgcgagcugaugaccaacugcuccaacaugagccugcggaagguccccgcggaccucacgcccgccaccaccacccuggaccuguccuacaaccuccuguuccagcugcagagcuccgacuuccacagcguguccaagcuccgcgugcugauccugugccacaaccggauccagcagcucgaccugaagacguucgaguucaacaaggagcugcgcuaccucgaccugagcaacaaccggcugaaguccgucaccugguaccuccuggccgggcugcgcuaccucgaccugagcuucaacgacuucgacaccaugcccaucugcgaggaggccggcaacaugucccaccuggagauccucgggcugagcggcgccaagauccagaaguccgacuuccagaagaucgcgcaccuccaccucaacaccguguuccugggguuccggacgcugccgcacuacgaggagggcagccuccccauccugaacaccaccaagcugcacaucgugcuccccauggacaccaacuucuggguccugcugcgcgacggcaucaagacguccaagauccucgagaugaccaacaucgacgggaagucccaguucgugagcuacgagaugcagcggaaccugagccuggagaacgccaagaccuccgugcuccugcugaacaaggucgaccuccugugggacgaccuguuccucauccugcaguucguguggcacaccagcguggagcacuuccagauccgcaacgucacguucggcgggaaggccuaccuggaccacaacagcuucgacuacuccaacaccgugaugcggaccaucaagcucgagcacgugcacuuccgcgucuucuacauccagcaggacaagaucuaccugcugcugaccaagauggacaucgagaaccucacgaucagcaacgcccagaugccccacaugcuguucccgaacuaccccaccaaguuccaguaccugaacuucgcgaacaacauccucaccgacgagcuguucaagcggaccauccagcugccccaccucaagacgcugauccugaacggcaacaagcucgagacccugucccuggugagcugcuucgccaacaacacgccccucgagcaccuggaccugucccagaaccuccugcagcacaagaacgacgagaacugcagcuggccggagaccguggucaacaugaaccuguccuacaacaagcucagcgacuccguguuccgcugccugcccaagagcauccagauccuggaccucaacaacaaccagauccagaccgugcccaaggagaccauccaccugauggcccugcgggagcucaacaucgccuucaacuuccugaccgaccugcccgggugcucccacuucagccgccucuccguccugaacaucgagaugaacuucauccugagcccgucccucgacuucgugcagagcugccaggaggugaagacccugaacgccggccggaaccccuuccgcugcacgugcgagcugaagaacuucauccagcucgagaccuacuccgaggucaugauggugggcuggagcgacuccuacacgugcgaguacccccugaaccugcgggggacccgccucaaggacguccaccuccacgagcugagcugcaacaccgcgcugcugaucgugaccaucguggucaucaugcuggugcucggccuggccguggccuucugcugccugcacuucgaccuccccugguaccugcgcaugcuggggcagugcacccagaccuggcaccggguccgcaagaccacgcaggagcagcucaagcggaacgugcgcuuccacgccuucaucagcuacuccgagcacgacagccugugggugaagaacgagcugaucccgaaccucgagaaggaggacggcuccauccugaucugccuguacgagagcuacuucgaccccggcaaguccaucagcgagaacaucgucuccuucaucgagaaguccuacaagagcaucuucgugcucagccccaacuucgugcagaacgaguggugccacuacgaguucuacuucgcccaccacaaccuguuccacgagaacuccgaccacaucauccugauccuccuggagcccaucccguucuacugcauccccacccgguaccacaagcugaaggcgcuccuggagaagaaggccuaccuggaguggcccaaggaccgccggaagugcgggcuguucugggccaaccugcgcgccgccaucaacgucaacgugcuggcgacccgggagauguacgagcuccagaccuucacggagcugaacgaggagagccgcggcuccaccaucagccugaugcggaccgacugccucuga

SEQ ID NO: 37724 - RNA, 2361 nt, Artificial Sequence
  derived and/or modified sequence opt1 from TLR1__Homo_sapiens__NP_003254
augaccagcaucuuccacuucgccaucaucuucaugcugauccuccagauccgcauccagcuguccgaggagagcgaguuccugguggaccgguccaagaacggccucauccacguccccaaggaccugagccagaagaccaccauccugaacaucucccagaacuacaucagcgagcucuggaccuccgacauccugagccuguccaagcuccgcauccugaucaucagccacaaccggauccaguaccuggacaucuccguguucaaguucaaccaggagcucgaguaccuggaccugagccacaacaagcucgugaagaucuccugccacccgaccgucaaccugaagcaccuggaccucagcuucaacgccuucgacgcgcugcccaucugcaaggaguucgggaacaugucccagcugaaguuccucggccugagcaccacgcaccuggagaaguccagcgugcuccccaucgcccaccugaacaucuccaaggugcugcucguccugggggagaccuacggcgagaaggaggaccccgaggggcugcaggacuucaacaccgagagccuccacaucguguucccgaccaacaaggaguuccacuucauccuggacgugagcgucaagacgguggccaaccuggagcucuccaacaucaagugcgugcuggaggacaacaagugcagcuacuuccuguccauccucgccaagcugcagaccaaccccaagcugagcaaccucacccugaacaacaucgagaccacguggaacuccuucauccgcauccugcagcucgucuggcacaccaccgugugguacuucagcaucuccaacgugaagcugcagggccagcuggacuuccgggacuucgacuacagcggcaccucccucaaggcccugagcauccaccaggucguguccgacguguucggguucccccagagcuacaucuacgagaucuucuccaacaugaacaucaagaacuucacggucagcggcacccgcauggugcacaugcugugccccuccaagaucagcccguuccuccaccuggacuucuccaacaaccugcugaccgacaccguguucgagaacugcgggcaccucacggagcuggagacccugauccuccagaugaaccagcugaaggagcugagcaagaucgcggagaugaccacccagaugaagucccuccagcagcuggacaucagccagaacagcgucuccuacgacgagaagaagggcgacugcagcuggacgaagucccugcucagccugaacauguccagcaacauccugaccgacaccaucuuccggugccucccgccccgcaucaaggugcuggaccugcacuccaacaagaucaagagcauccccaagcaggucgugaagcucgaggcccugcaggagcugaacguggccuucaacucccucaccgaccugcccgggugcggcagcuucuccagccuguccguccucaucaucgaccacaacagcgugucccaccccagcgccgacuucuuccaguccugccagaagaugcggagcaucaaggcgggcgacaaccccuuccagugcacgugcgagcugggggaguucgugaagaacaucgaccaggucagcuccgaggugcuggagggcuggcccgacagcuacaagugcgacuacccggaguccuaccgcgggacccuccugaaggacuuccacaugagcgagcuguccugcaacaucacccuccugaucgugaccaucgucgccacgaugcuggugcucgccgugaccgucaccagccugugcuccuaccuggaccuccccugguaccugcggauggugugccaguggacccagacgcgccggcgcgcccggaacaucccccuggaggagcuccagcgcaaccugcaguuccacgccuucaucagcuacuccggccacgacagcuucugggugaagaacgagcugcuccccaaccuggagaaggagggcaugcagaucugccugcacgagcggaacuucgucccggggaaguccaucguggagaacaucaucacgugcaucgagaaguccuacaagagcaucuucgugcucagccccaacuucguccaguccgaguggugccacuacgagcuguacuucgcgcaccacaaccuguuccacgagggcagcaacucccucauccugauccugcucgagcccaucccccaguacagcaucccguccagcuaccacaagcucaagagccugauggcccgccggaccuaccuggaguggcccaaggagaaguccaagcgcgggcuguucugggccaaccugcgggccgccaucaacaucaagcucaccgagcaggcgaagaaguga

SEQ ID NO: 37725 - RNA, 2355 nt, Artificial Sequence
  derived and/or modified sequence opt1 from TLR2__Homo_sapiens__XP_011530518
augccccacacccuguggaugguguggguccucggcgugaucaucagccuguccaaggaggagagcuccaaccaggccagccuguccugcgaccgcaacgggaucugcaagggcagcuccgggagccucaacuccaucccgagcggccugaccgaggccgugaagucccuggaccucagcaacaaccggaucacguacaucuccaacagcgaccugcagcgcugcgucaaccugcaggcgcucgugcugaccuccaacgggaucaacaccaucgaggaggacagcuucuccagccugggcucccucgagcaccuggaccugagcuacaacuaccucagcaaccuguccagcuccugguucaagccccugagcucccucaccuuccugaaccugcucggcaaccccuacaagacgcugggggagaccagccuguucucccaccucaccaagcugcagauccugcgggugggcaacauggacaccuucacgaagauccagcgcaaggacuucgccgggcucaccuuccuggaggagcuggagaucgacgccagcgaccuccaguccuacgagcccaagagccugaaguccauccagaacgucagccaccugauccuccacaugaagcagcacauccugcugcucgagaucuucguggacgugaccuccagcgucgagugccuggagcugcgggacaccgaccucgacacguuccacuucuccgagcugagcaccggcgagaccaacucccugaucaagaaguucaccuuccgcaacgugaagaucacggacgagagccucuuccaggugaugaagcugcugaaccagaucuccgggcuccuggagcuggaguucgacgacugcacccucaacggcgucggcaacuuccgggccagcgacaacgaccgcgugaucgacccggggaagguggagacccugaccauccggcgccugcacaucccccgguucuaccuguucuacgaccucagcacgcuguacucccugaccgagcgcgucaagcggaucaccguggagaacagcaagguguuccucguccccugccugcugucccagcaccucaagagccuggaguaccuggaccucuccgagaaccugaugguggaggaguaccugaagaacagcgccugcgaggacgcguggcccucccuccagacccugauccugcgccagaaccaccucgccagccuggagaagacgggcgagacccugcucacccugaagaaccugaccaacaucgacaucuccaagaacagcuuccacuccaugccggagacgugccaguggcccgagaagaugaaguaccucaaccugagcuccacccggauccacagcgugaccgggugcauccccaagacccuggagauccucgacgucuccaacaacaaccugaaccuguucagccucaaccugccccagcugaaggagcucuacaucucccgcaacaagcugaugacgcugccggacgccagccuccugcccaugcugcucgugcugaagaucagccggaacgccaucaccaccuucuccaaggagcagcuggacagcuuccacacccucaagacgcuggaggcgggcggcaacaacuucaucugcuccugcgaguuccugagcuucacccaggagcagcaggcccucgccaaggugcugaucgacuggcccgccaacuaccugugcgacucccccagccacguccgcgggcagcagguccaggacgugcggcucuccgugagcgagugccaccgcaccgcccugguguccggcaugugcugcgcgcuguuccuccugauccugcucaccgggguccugugccaccgguuccacggccugugguacaugaagaugaugugggccuggcuccaggccaagcgcaagccgcgcaaggcccccagccggaacaucugcuacgacgccuucguguccuacagcgagcgcgacgcguacuggguggagaaccugaugguccaggagcuggagaacuucaacccgcccuucaagcucugccugcacaagcgggacuucauccccgggaaguggaucaucgacaacaucaucgacuccaucgagaagucccacaagaccguguucgugcugagcgagaacuucgucaagagcgaguggugcaaguacgagcucgacuucucccacuuccgccuguucgacgagaacaacgacgccgccauccugauccuccuggagcccaucgagaagaaggccaucccccagcgguucugcaagcugcgcaagaucaugaacacgaagaccuaccucgaguggcccauggacgaggcccagcgggagggcuucugggugaaccugcgcgcggccaucaagagcuga

SEQ ID NO: 37726 - RNA, 2715 nt, Artificial Sequence
  derived and/or modified sequence opt1 from TLR3__Homo_sapiens__NP_003256
augcgccagacccugcccugcaucuacuucuggggcgggcuccugccguucggcaugcugugcgccagcuccaccacgaagugcaccgugagccacgaggucgccgacugcucccaccucaagcugacccaggugcccgacgaccugcccaccaacaucacggugcucaaccugacccacaaccagcugcggcgccuccccgcggccaacuucacccgguacagccagcugaccucccuggacgucggguucaacacgaucagcaagcucgagccggagcugugccagaagcugcccaugcucaaggugcugaaccugcagcacaacgagcucucccagcugagcgacaagaccuucgccuucugcaccaaccugaccgagcuccaccugauguccaacagcauccagaagaucaagaacaaccccuucgugaagcagaagaaccugaucacgcucgaccugucccacaacggccugagcuccaccaagcucgggacccagguccagcuggagaaccugcaggagcuccugcugagcaacaacaagauccaggcccucaaguccgaggagcuggacaucuucgccaacagcucccugaagaagcucgagcugagcuccaaccagaucaaggaguucagccccggcugcuuccacgcgaucggccgccuguucggccucuuccugaacaacgugcagcuggggccgagccucaccgagaagcugugccuggagcucgccaacacguccauccggaaccugagccuguccaacagccagcucuccaccaccagcaacaccacguuccuggggcugaaguggaccaaccugaccaugcucgaccuguccuacaacaaccugaacguggucggcaacgacagcuucgccuggcucccccagcuggaguacuucuuccuggaguacaacaacauccagcaccucuucucccacagccugcacgggcuguucaacgugcgcuaccucaaccugaagcgguccuucaccaagcagagcaucucccuggccagccuccccaagaucgacgacuucuccuuccaguggcugaagugccuggagcaccucaacauggaggacaacgacauccccggcaucaagagcaacauguucacgggccugaucaaccugaaguaccucucccugagcaacuccuucaccagccugcgcacccucaccaacgagacguucgugagccuggcgcacuccccgcugcacauccucaaccugaccaagaacaagaucagcaagaucgaguccgacgccuucagcuggcuggggcaccucgagguccuggaccugggccucaacgagaucgggcaggagcugaccggccaggaguggcggggccuggagaacaucuucgagaucuaccucuccuacaacaaguaccugcagcugacccgcaacagcuucgcccucgugcccucccugcagcggcugaugcuccgccggguggcccugaagaacgucgacagcucccccagccccuuccagccgcugcgcaaccucacgauccuggaccuguccaacaacaacaucgccaacaucaacgacgacaugcucgaggggcuggagaagcuggagauccucgaccugcagcacaacaaccuggcgcggcucuggaagcacgccaaccccggcgggcccaucuacuuccugaagggccugagccaccuccacauccugaaccuggaguccaacggguucgacgagauccccguggagguguucaaggaccucuucgagcugaagaucaucgaccugggccucaacaaccugaacacccugccggccagcgucuucaacaaccaggugucccucaagagccugaaccugcagaagaaccucaucaccuccguggagaagaaggucuucggccccgccuuccgcaaccugaccgagcuggacaugcgguucaaccccuucgacugcacgugcgagagcaucgccugguucgugaacuggaucaacgagacccacaccaacauccccgagcucagcucccacuaccugugcaacaccccgccccacuaccacggguuccccgugcgccuguucgacaccagcuccugcaaggacagcgcgcccuucgagcuguucuucaugaucaacacguccauccugcugaucuucaucuucaucguccuccugauccacuucgagggcuggcggaucagcuucuacuggaacguguccguccaccgcgugcugggguucaaggagaucgaccggcagaccgagcaguucgaguacgccgccuacaucauccacgccuacaaggacaaggacugggugugggagcacuucagcuccauggagaaggaggaccagagccucaaguucugccuggaggagcgcgacuucgaggccggcgucuucgagcuggaggcgaucgugaacuccaucaagcgcagccggaagaucaucuucgugaucacccaccaccuccugaaggacccgcugugcaagcgcuucaagguccaccacgccgugcagcaggccaucgagcagaaccucgacuccaucauccugguguuccuggaggagauccccgacuacaagcucaaccacgcccugugccugcggcgcgggauguucaagagccacugcauccucaacuggcccguccagaaggagcggaucggcgccuuccgccacaagcuccagguggcgcugggcuccaagaacagcgugcacuga

SEQ ID NO: 37727 - RNA, 2400 nt, Artificial Sequence
  derived and/or modified sequence opt1 from TLR4__Homo_sapiens__NP_003257
auggagcugaacuucuacaagauccccgacaaccucccguucagcaccaagaaccuggaccuguccuucaacccccuccgccaccugggcagcuacuccuucuucagcuuccccgagcuccaggugcuggaccugucccggugcgagauccagaccaucgaggacggggccuaccagagccugucccaccucagcacgcugauccugaccggcaaccccauccagucccucgcccugggggcguucagcggccuguccagccuccagaagcuggucgccguggagaccaaccuggccucccucgagaacuucccgaucgggcaccugaagacccugaaggagcucaacguggcccacaaccugauccagagcuucaagcugcccgaguacuucuccaaccucacgaaccuggagcaccuggaccucagcuccaacaagauccagagcaucuacugcaccgaccugcgcguccugcaccagaugccccuccugaaccugucccucgaccugagccugaaccccaugaacuucauccagccgggcgccuucaaggagauccggcuccacaagcugacccugcgcaacaacuucgacagccucaacgugaugaagaccugcauccagggccuggcggggcuggaggugcaccggcucguccugggcgaguuccgcaacgaggggaaccuggagaaguucgacaaguccgcccucgagggccugugcaaccugacgaucgaggaguuccggcucgccuaccuggacuacuaccuggacgacaucaucgaccuguucaacugccucaccaacgugagcuccuucagccugguguccgucaccaucgagcgcgugaaggacuucagcuacaacuucggguggcagcaccuggagcucgugaacugcaaguucggccaguuccccacccugaagcugaagucccucaagcggcugacguucaccagcaacaagggcgggaacgccuucuccgaggucgaccugcccagccucgaguuccuggaccugucccgcaacggccucagcuucaaggggugcugcucccagagcgacuucggcaccaccucccugaaguaccuggaccucagcuucaacggcgugaucacgauguccagcaacuuccuggggcuggagcagcucgagcaccuggacuuccagcacuccaaccugaagcagaugagcgaguucagcguguuccucucccugcggaaccugaucuaccucgacaucagccacacccacacccgcgucgcguucaacggcaucuucaacgggcuguccagccuggaggugcucaagauggccggcaacuccuuccaggagaacuuccugcccgacaucuucaccgagcugcggaaccucacguuccuggaccugagccagugccagcucgagcagcuguccccgaccgccuucaacagccuguccagccuccaggugcugaacaugucccacaacaacuucuucagccuggacaccuuccccuacaagugccucaacucccugcagguccuggacuacagccucaaccacaucaugaccuccaagaagcaggagcugcagcacuuccccagcucccuggccuuccucaaccugacgcagaacgacuucgccugcacgugcgagcaccagagcuuccugcaguggaucaaggaccagcgccagcuccugguggagguggagcggauggagugcgcgacccccagcgacaagcaggggaugccgguccugucccucaacaucacgugccagaugaacaagaccaucaucggcgugagcgugcuguccguccugguggucagcgugguggccguccucguguacaaguucuacuuccaccugaugcugcucgccggcugcaucaaguacgggcgcggcgagaacaucuacgacgccuucgugaucuacuccagccaggacgaggacuggguccggaacgagcuggugaagaaccuggaggagggggugccgcccuuccagcucugccugcacuaccgcgacuucauccccggcgucgccaucgcggccaacaucauccacgagggguuccacaagucccggaaggugaucguggucgugagccagcacuucauccagucccgcuggugcaucuucgaguacgagaucgcccagaccuggcaguuccugagcucccgggccggcaucaucuucaucgugcuccagaaggucgagaagacccugcugcgccagcaggucgagcucuaccgccugcugagccggaacaccuaccucgagugggaggacuccgugcugggccgccacaucuucuggcggcgccugcggaaggcccuccuggacggcaagagcuggaaccccgaggggaccguggggaccggcugcaacuggcaggaggcgaccuccaucuga

SEQ ID NO: 37728 - RNA, 2577 nt, Artificial Sequence
  derived and/or modified sequence opt1 from TLR5__Homo_sapiens__XP_006711569
augggcgaccaccuggaccuccugcugggggugguccucauggccggccccguguucgggaucccgagcugcuccuucgacggccgcaucgccuucuaccgguucugcaaccugacccaggugccccagguccugaacaccacggagcgccuccugcugagcuucaacuacauccggaccgugaccgcguccagcuuccccuuccucgagcagcugcagcugcucgagcuggggucccaguacacgccccugaccaucgacaaggaggccuuccgcaaccucccgaaccugcggauccuggaccucggcagcuccaagaucuacuuccugcaccccgacgccuuccagggccuguuccaccucuucgagcugcgccuguacuucugcgggcucagcgacgccgugcugaaggacggcuacuuccggaaccugaaggcccucacccgccuggaccuguccaagaaccagauccggagccucuaccugcaccccuccuucgggaagcugaacagccucaaguccaucgacuucagcuccaaccagaucuuccuggucugcgagcacgagcuggagccccuccagggcaagacccugagcuucuucucccuggcggccaacagccucuacucccgcgugagcguggacugggggaagugcaugaacccguuccggaacaugguccuggagauccuggacgugagcggcaacggcuggaccguggacaucacggggaacuucuccaacgccaucagcaagucccaggccuucagccucauccuggcgcaccacaucaugggcgccggguucggcuuccacaacaucaaggaccccgaccagaacaccuucgccggccuggcccgcuccagcguccggcaccucgaccugucccacggguucguguucagccugaacucccgcguguucgagacccucaaggaccugaagguccugaaccuggccuacaacaagaucaacaagaucgcggacgaggccuucuacggccucgacaaccuccaggugcugaaccugagcuacaaccugcugggggagcucuacuccagcaacuucuacggccugcccaagguggccuacaucgaccugcagaagaaccacaucgccaucauccaggaccagaccuucaaguuccucgagaagcugcagacgcuggaccuccgggacaacgcccugaccaccauccacuucauccccuccaucccggacaucuuccugagcgggaacaagcucgucacccugcccaagaucaaccugacggcgaaccucauccaccuguccgagaaccgccuggagaaccucgacauccuguacuuccugcuccgggugccccaccuccagauccugauccugaaccagaaccgcuucagcuccugcagcggcgaccagacccccuccgagaacccgagccuggagcagcuguuccucggcgagaacaugcugcagcuggccugggagaccgagcucugcugggacguguucgaggggcugagccaccuccagguccuguaccugaaccacaacuaccugaacucccucccgcccggcguguucagccaccugaccgcccugcgggggcucucccugaacagcaaccgccugacggugcucucccacaacgaccugcccgccaaccuggagauccucgacaucagccggaaccagcugcuggcccccaaccccgacgucuucgugucccucagcguccuggacaucacccacaacaaguucaucugcgagugcgagcuguccaccuucaucaacuggcucaaccacaccaacgugacgaucgcgggcccgcccgccgacaucuacugcguguaccccgacagcuucuccggggucagccuguucucccugagcaccgagggcugcgacgaggaggaggugcucaagucccugaaguucagccuguucaucgugugcaccgucacccucacgcuguuccugaugaccauccucaccgugaccaaguuccgcggcuucugcuucaucugcuacaagacggcccagcgccugguguucaaggaccacccccaggggaccgagcccgacauguacaaguacgacgccuaccugugcuucuccagcaaggacuucaccuggguccagaacgcccuccugaagcaccuggacacccaguacagcgaccagaaccgguucaaccucugcuucgaggagcgcgacuucgugcccggcgagaaccggaucgcgaacauccaggacgccaucuggaacucccgcaagaucgugugccuggucagccggcacuuccugcgcgacggguggugccucgaggccuucuccuacgcccagggccggugccugagcgaccugaacuccgcgcucaucauggugguggucgggagccugucccaguaccagcugaugaagcaccagagcauccgcggcuucgugcagaagcagcaguaccuccgguggccggaggaccugcaggacgugggcugguuccugcacaagcucucccagcagauccugaagaaggagaaggagaagaagaaggacaacaacaucccccugcagacggucgccaccaucagcuga

SEQ ID NO: 37729 - RNA, 2391 nt, Artificial Sequence
  derived and/or modified sequence opt1 from TLR6__Homo_sapiens__NP_006059
augaccaaggacaaggagcccaucgucaagagcuuccacuucgugugccugaugaucaucaucgugggcacccgcauccaguucuccgacgggaacgaguucgccguggacaagagcaagcggggccucauccacgugccgaaggaccugccccugaagacgaaggugcucgacaugucccagaacuacaucgccgagcuccaggugagcgacauguccuuccugagcgagcugaccguccugcgccugucccacaaccggauccagcuccuggaccugagcguguucaaguucaaccaggaccucgaguaccuggaccugucccacaaccagcuccagaagaucagcugccaccccaucguguccuuccgccaccuggaccugagcuucaacgacuucaaggcgcuccccaucugcaaggaguucgggaaccugucccagcugaacuuccucggccugagcgccaugaagcugcagaagcucgaccugcugccgaucgcccaccuccaccuguccuacauccugcucgaccugcggaacuacuacaucaaggagaacgagaccgagagccugcagauccucaacgccaagacccugcaccuggucuuccaccccacgucccucuucgccauccaggugaacaucagcgugaacacccuggggugccugcagcucaccaacaucaagcugaacgacgacaacugccaggucuucaucaaguuccuguccgagcucacccgcggcagcacgcugcugaacuucacccucaaccacaucgagaccaccuggaagugccuggugcggguguuccaguuccuguggcccaagcccgucgaguaccucaacaucuacaaccugacgaucaucgagagcauccgcgaggaggacuucaccuacuccaagaccacccugaaggcgcugacgaucgagcacaucaccaaccagguguuccucuucagccagaccgcccuguacaccguguucuccgagaugaacaucaugaugcugacgaucagcgacaccccguucauccacaugcucugcccccacgcccccuccaccuucaaguuccugaacuucacccagaacgucuucacggacagcaucuucgagaagugcuccacccuggugaagcucgagacccugauccugcagaagaacggccucaaggaccuguucaagguggggcugaugaccaaggacaugcccagccucgagauccuggacgucuccuggaacagccuggaguccggccggcacaaggagaacugcacguggguggagagcaucgugguccucaaccuguccagcaacaugcugaccgacuccguguuccgcugccucccgccccggaucaagguccuggaccugcacagcaacaagaucaaguccgugcccaagcaggucgugaagcucgaggcccugcaggagcugaacguggcguucaacagccucaccgaccugcccgggugcggcuccuucagcagccuguccgugcucaucaucgaccacaacagcgucucccacccgagcgccgacuucuuccaguccugccagaagaugcgcagcaucaaggccggggacaaccccuuccagugcacgugcgagcugcgggaguucgugaagaacaucgaccagguguccagcgagguccuggagggcuggcccgacuccuacaagugcgacuaccccgagagcuaccgcggcuccccgcucaaggacuuccacaugagcgagcuguccugcaacaucacccugcucaucgugaccaucggggccaccaugcuggugcuggccgucaccgugacgagccucugcaucuaccuggaccugcccugguaccuccggauggugugccaguggacccagacccgccggcgcgcgcggaacaucccccuggaggagcugcagcgcaaccuccaguuccacgccuucaucuccuacagcgagcacgacuccgccugggucaagagcgagcuggugcccuaccuggagaaggaggacauccagaucugccuccacgagcggaacuucgugccgggcaagagcaucgucgagaacaucaucaacugcaucgagaaguccuacaagagcaucuucgugcugucccccaacuucgugcagagcgaguggugccacuacgagcuguacuucgcccaccacaaccucuuccacgagggguccaacaaccugauccugauccuccuggagcccaucccccagaacagcaucccgaacaaguaccacaagcugaaggcccucaugacccagcgcaccuaccugcaguggcccaaggagaaguccaagcgcggccuguucugggcgaacauccgggccgccuucaacaugaagcucacgcuggucaccgagaacaacgacgucaagagcuga

SEQ ID NO: 37730 - RNA, 3150 nt, Artificial Sequence
  derived and/or modified sequence opt1 from TLR7__Homo_sapiens__NP_057646
augguguuccccauguggacccugaagcgccagauccucauccuguucaacaucauccugaucagcaagcuccugggcgcccggugguucccgaagacccugcccugcgacgucacgcucgacgugcccaagaaccacgugaucgucgacugcaccgacaagcaccugaccgagauccccgggggcaucccgaccaacacgaccaaccugacccucaccaucaaccacauccccgacaucucccccgccagcuuccaccgccuggaccaccugguggagaucgacuuccggugcaacugcgugcccaucccgcucggguccaagaacaacaugugcaucaagcgccugcagaucaagccccggagcuucuccggccugacguaccucaagagccuguaccuggacgggaaccagcuccuggagaucccccagggccugcccccgucccuccagcugcugagccucgaggcgaacaacaucuucuccauccgcaaggagaaccugaccgagcuggccaacaucgagauccucuaccugggccagaacugcuacuaccggaaccccugcuacgucagcuacuccaucgagaaggacgccuuccugaaccucaccaagcugaaggugcugagccucaaggacaacaacgugaccgccguccccacggugcugcccuccacccugaccgagcucuaccuguacaacaacaugaucgccaagauccaggaggacgacuucaacaaccugaaccagcuccagauccuggaccugagcgggaacugcccgcgcugcuacaacgcgcccuuccccugcgcccccugcaagaacaacuccccgcuccagauccccgugaacgccuucgacgcccugaccgagcugaagguccuccggcugcacagcaacucccugcagcacgugccgccccgcugguucaagaacaucaacaagcuccaggagcuggaccugagccagaacuuccuggcgaaggagaucggcgacgccaaguuccuccacuuccugcccucccugauccagcucgaccugagcuucaacuucgagcuccagguguaccgggccagcaugaaccucucccaggccuucagcucccucaagagccugaagauccugcgcauccggggguacgucuucaaggagcugaaguccuucaaccugagcccccuccacaaccugcagaaccuggaggugcucgaccugggcacgaacuucaucaagaucgccaaccuguccauguucaagcaguucaagcgccucaaggugaucgaccugagcgucaacaagaucucccccagcggggacuccagcgaggugggcuucugcuccaacgcgcggaccagcguggaguccuacgagccccagguccuggagcagcuccacuacuuccgcuacgacaaguacgcccggagcugccgcuucaagaacaaggaggccuccuucaugagcgugaacgaguccugcuacaaguacggccagacccuggaccugagcaagaacagcaucuucuucgugaaguccagcgacuuccagcaccucuccuuccugaagugccugaaccucagcgggaaccugaucucccagacccugaacggcagcgaguuccagccgcucgccgagcugcgguaccuggacuucuccaacaaccgccucgaccugcugcacagcacggccuucgaggagcuccacaagcuggagguccuggacaucuccagcaacucccacuacuuccagagcgaggggaucacccacaugcucaacuucaccaagaaccugaaggugcugcagaagcucaugaugaacgacaacgacaucuccagcuccaccagccggacgauggaguccgagagccugcgcacccuggaguuccgcggcaaccaccucgacguccuguggcgggagggcgacaaccgcuaccugcagcuguucaagaaccugcugaagcucgaggagcuggacaucagcaagaacucccugagcuuccuccccuccgggguguucgacggcaugcccccgaaccugaagaaccugagccucgcgaagaacgggcugaaguccuucagcuggaagaagcugcagugccucaagaaccuggagacccuggaccucucccacaaccagcugaccacggugcccgagcggcugagcaacugcucccgcagccucaagaaccugauccugaagaacaaccagauccggucccucaccaaguacuuccugcaggacgccuuccagcugcgcuaccucgaccugagcuccaacaagauccagaugauccagaagaccagcuuccccgagaacguccugaacaaccucaagaugcugcugcuccaccacaaccgguuccugugcacgugcgacgccgugugguucguguggugggucaaccacaccgaggugaccauccccuaccuggccaccgacgugaccugcgucggcccgggggcccacaagggccaguccgugaucagccucgaccuguacacgugcgagcuggaccucaccaaccugauccuguucucccucagcaucuccgugagccuguuccugauggucaugaugaccgcgagccaccucuacuucugggacgugugguacaucuaccacuucugcaaggccaagaucaagggcuaccagcgccugaucucccccgacugcugcuacgacgccuucaucguguacgacaccaaggaccccgccgucaccgagugggugcuggccgagcucguggcgaagcuggaggacccccgggagaagcacuucaaccugugccuggaggagcgcgacuggcucccggggcagcccguccuggagaaccugagccaguccauccagcucagcaagaagacgguguucgugaugaccgacaaguacgccaagaccgagaacuucaagaucgccuucuaccugucccaccagcggcugauggacgagaaggucgacgugaucauccucaucuuccuggagaagcccuuccagaaguccaaguuccugcagcuccgcaagcggcugugcggcagcagcgugcuggaguggcccaccaacccgcaggcccaccccuacuucuggcagugccucaagaacgcgcuggccacggacaaccacgucgccuacucccagguguucaaggagaccguguga

SEQ ID NO: 37731 - RNA, 3126 nt, Artificial Sequence
  derived and/or modified sequence opt1 from TLR8__Homo_sapiens__NP_619542
auggagaacauguuccugcagagcuccaugcugaccugcaucuuccugcugaucagcggcuccugcgagcucugcgccgaggagaacuucagccgcuccuaccccugcgacgagaagaagcagaacgacagcgugaucgccgagugcuccaaccggcgccugcaggaggucccgcagaccguggggaaguacgugacggagcuggaccucagcgacaacuucaucacccacaucaccaacgaguccuuccagggccugcagaaccugaccaagaucaaccucaaccacaaccccaacguccagcaccagaacgggaaccccggcauccagagcaacgggcugaacaucacggacggcgcguuccugaaccucaagaaccugcgggagcugcuccuggaggacaaccagcugccccagaucccguccggccuccccgagagccugaccgagcugucccucauccagaacaacaucuacaacaucaccaaggaggggaucagccgccugaucaaccugaagaaccucuaccuggccuggaacugcuacuucaacaaggugugcgagaagaccaacaucgaggacggcguguucgagacgcugaccaaccucgagcugcugucccucagcuucaacucccugagccacgucccgcccaagcugcccuccagccuccggaagcuguuccugagcaacacccagaucaaguacaucuccgaggaggacuucaaggggcucaucaaccugacccugcucgaccugagcggcaacugcccccgcugcuucaacgcccccuuccccugcgugccgugcgacgggggcgccuccaucaacaucgaccgguucgccuuccagaaccugacgcagcuccgcuaccugaaccugagcuccaccagccuccggaagaucaacgcggccugguucaagaacaugccccaccugaaggugcuggaccucgaguucaacuaccuggucggcgagaucgccuccggggccuuccugaccaugcugccccgccucgagauccuggaccugagcuucaacuacaucaagggcuccuacccccagcacaucaacaucagccggaacuucuccaagcuccugagccugcgcgcgcuccaccuccggggguacguguuccaggagcugcgcgaggacgacuuccagccgcucaugcagcugcccaaccuguccaccaucaaccucggcaucaacuucaucaagcagaucgacuucaagcuguuccagaacuucagcaaccuggagaucaucuaccucuccgagaaccggaucagcccccuggugaaggacacgcgccaguccuacgccaacagcuccagcuuccagcggcacauccgcaagcggcgcagcaccgacuucgaguucgacccccacuccaacuucuaccacuucacccggccgcugaucaagccccagugcgccgccuacggcaaggcccucgaccugagccugaacuccaucuucuucaucgggcccaaccaguucgagaaccuccccgacaucgcgugccugaaccugagcgccaacuccaacgcccagguccucagcggcaccgaguucuccgccaucccgcacgugaaguaccuggaccugacgaacaaccgccucgacuucgacaacgccagcgcgcugaccgagcuguccgaccucgaggugcuggaccugagcuacaacucccacuacuuccgcaucgccggggucacccaccaccucgaguucauccagaacuucaccaaccugaaggugcugaaccucagccacaacaacaucuacacgcugaccgacaaguacaaccuggaguccaagagccucguggagcuggucuucuccggcaaccggcuggacauccucuggaacgacgacgacaaccgcuacaucagcaucuucaaggggcugaagaaccugacccggcucgaccugucccugaaccgccucaagcacauccccaacgaggccuuccugaaccugcccgccagccucaccgagcugcacaucaacgacaacaugcugaaguucuucaacuggacgcuccugcagcaguucccccggcuggagcuccuggaccugcgcggcaacaagcuccuguuccugaccgacagccucuccgacuucaccagcucccugcggacccugcuccugagccacaaccgcaucucccaccucccgagcggcuuccuguccgaggugagcucccugaagcaccuggaccucagcuccaaccugcugaagacgaucaacaagagcgcccucgagaccaagaccaccacgaagcuguccaugcuggagcuccacgggaaccccuucgagugcacgugcgacaucggcgacuuccggcgcuggauggacgagcaccugaacgugaagaucccccggcuggucgacgugaucugcgcgagcccgggggaccagcgcggcaaguccaucgugagccucgagcugacgaccugcgucuccgacgugaccgccgucauccuguucuucuucaccuucuucaucaccaccauggugaugcucgccgcccuggcccaccaccuguucuacugggacgugugguucaucuacaacgucugccucgcgaaggugaagggguaccggagccuguccaccagccagaccuucuacgacgccuacaucagcuacgacaccaaggacgccuccgugaccgacugggucaucaacgagcugcgcuaccaccucgaggagagccgggacaagaacgugcugcugugccucgaggagcgcgacugggaccccggccuggccaucaucgacaaccugaugcaguccaucaaccagagcaagaagaccguguucguccugacgaagaaguacgcgaaguccuggaacuucaagaccgccuucuaccucgcccugcagcggcugauggacgagaacauggacgugaucaucuucauccuccuggagcccgugcugcagcacagccaguaccuccgccugcggcagcgcaucugcaaguccagcauccugcaguggcccgacaacccgaaggccgagggccucuucuggcagacccugcgcaacgucgugcugaccgagaacgacucccgguacaacaacauguacguggacagcaucaagcaguacuga

SEQ ID NO: 37732 - RNA, 3099 nt, Artificial Sequence
  derived and/or modified sequence opt1 from TLR9__Homo_sapiens__NP_059138
augggcuucugccgcagcgcccugcacccccucucccugcuggugcaggccaucaugcucgcgaugacccuggcccuggggacccucccggccuuccugcccugcgagcugcagccccacggccucgucaacugcaacuggcuguuccugaaguccgugccccacuucagcauggccgccccgcgggggaacgugacgagccucucccugagcuccaaccgcauccaccaccuccacgacagcgacuucgcgcaccuccccucccugcggcaccugaaccucaaguggaacugcccgcccgucggccugagccccaugcacuuccccugccacaugaccaucgagcccuccaccuuccuggccgugcccacccucgaggagcugaaccugagcuacaacaacaucaugacggugccggcccuccccaagucccugaucagccugucccucagccacaccaacauccugaugcuggacuccgccagccucgcggggcugcacgcccugcgcuuccucuucauggacggcaacugcuacuacaagaaccccugccggcaggcccuggaggucgcccccggcgcccugcucgggcugggcaaccugacccaccucucccugaaguacaacaaccugaccguggugccgcgcaaccuccccagcagccuggaguaccugcuccuguccuacaaccggaucgucaagcuggcgcccgaggaccucgccaaccugacggcccugcgcgugcuggacgucgggggcaacugccggcgcugcgaccacgcccccaacccgugcauggagugcccccggcacuucccccagcuccaccccgacaccuucagccaccugucccgccuggaggggcucgugcugaaggacagcucccugagcuggcucaacgccuccugguuccggggccugggcaaccugcgcgugcucgaccugagcgagaacuuccuguacaagugcaucaccaagaccaaggcguuccaggggcucacgcagcugcggaagcugaaccucuccuucaacuaccagaagcgcgugagcuucgcccaccugucccuggccccgagcuucggcucccucgucgcccugaaggagcuggacaugcacgggaucuucuuccggagccucgacgagaccacccugcgcccccuggcccggcuccccaugcugcagacccugcgccuccagaugaacuucaucaaccaggcgcagcugggcaucuuccgggccuuccccggccugcgcuacguggaccucuccgacaaccgcaucagcggggccuccgagcugacggccaccaugggcgaggccgacgggggcgagaagguguggcugcagccgggggaccucgcgcccgcccccgucgacaccccgagcuccgaggacuuccggcccaacugcagcacccugaacuucacgcuggaccucagccgcaacaaccuggugaccgugcagcccgagauguucgcccagcugucccaccuccagugccugcggcugagccacaacugcaucucccaggccgucaacggcagccaguuccucccccugaccggccuccaggugcuggaccugucccacaacaagcuggaccucuaccacgagcacagcuucaccgagcugccgcgccuggaggcgcucgaccuguccuacaacagccagcccuucgggaugcagggcguggggcacaacuucuccuucgucgcccaccuccggacgcugcgccaccugagccuggcccacaacaacauccacucccaggugagccagcagcucugcuccaccagccugcgggcccuggacuucuccggcaacgcccucgggcacaugugggcggagggcgaccuguaccugcacuucuuccagggccucagcgggcugaucuggcuggaccucucccagaaccgccugcacacccugcucccccagacccugcggaaccugcccaagagccuccagguccugcgccugcgggacaacuaccucgccuucuucaagugguggagccugcacuuccugccgaagcucgaggugcuggaccuggccggcaaccagcucaaggcccugacgaacgggucccugcccgccggcacccgccuccggcgccuggacgugagcugcaacuccaucagcuucgucgcgcccggguucuucuccaaggccaaggagcugcgggagcucaaccugagcgccaacgcccugaagaccguggaccacuccugguucggcccccucgccagcgcgcugcagauccuggacguguccgccaacccgcuccacugcgccugcggcgccgcguucauggacuuccugcuggagguccaggccgccgugcccgggcugcccagccgcgugaagugcggcucccccgggcagcuccagggccugagcaucuucgcccaggaccugcggcucugccuggacgaggcccuguccugggacugcuucgcgcucagccugcuggccgucgcccucggccugggggugccgaugcugcaccaccucugcggcugggaccugugguacugcuuccaccugugccucgccuggcugcccuggcgcgggcggcaguccggccgcgacgaggacgcccugcccuacgacgcguucguggucuucgacaagacccagagcgccguggccgacuggguguacaacgagcuccgcgggcagcuggaggagugccggggccgcugggcccugcggcucugccuggaggagcgcgacuggcugcccggcaagacgcuguucgagaaccugugggccuccgucuacgggagccggaagacccuguucgugcucgcgcacaccgaccgcguguccggccugcugcgggccagcuuccuccuggcccagcagcgccugcucgaggaccggaaggacgucguggugcuggucauccugagcccggacgggcgccggucccgcuacgugcggcuccgccagcggcugugccgccagagcgugcugcucuggccccaccagcccuccggccagcggagcuucugggcccagcuggggauggcgcugacccgcgacaaccaccacuucuacaaccggaacuucugccagggccccacggccgaguga

SEQ ID NO: 37733 - RNA, 774 nt, Artificial Sequence
  derived and/or modified sequence opt1 from TLX1__Homo_sapiens__NP_001182446
auggagcaccugggcccccaccaccuccacccggggcacgccgagcccaucagcuucggcaucgaccagauccugaacucccccgaccagggcgggugcauggggcccgccagccgccugcaggacggcgaguacggccucgggugccuggugggcggggcguacaccuacggcgggggcggcuccgccgccgccaccggggccggcggggcgggcgccuacggcaccgggggcccgggcgggcccgggggccccgccggcgggggcggggccugcagcaugggcccccugacgggguccuacaacgucaacauggcgcucgccggcggcccggggcccggcgggggcgggggcagcuccggcggggccggcgcccugagcgccgcgggggugauccgggugcccgcccaccgcccccuggccggcgccgucgcccacccgcagccccucgcgaccggccugcccaccgugcccuccgugccggccaugcccggggucaacaaccugacgggccucaccuuccccuggauggagagcaaccggcgcuacaccaaggaccgguucaccgggcaccccuaccagaaccgcacgccgcccaagaagaagaagccccggaccuccuucacccgccugcagaucugcgagcuggagaagcgguuccaccgccagaaguaccucgccagcgccgagcgggccgcgcuggccaaggcccugaagaugaccgacgcccaggugaagacgugguuccagaaccgccggaccaaguggcgcuga

SEQ ID NO: 37734 - RNA, 855 nt, Artificial Sequence
  derived and/or modified sequence opt1 from TLX2__Homo_sapiens__NP_057254
auggagcccggcaugcuggggccgcacaaccucccccaccacgagcccaucagcuucggcaucgaccagauccuguccgggcccgagaccccgggcgggggccugggccucgggcgcggcgggcagggccacggggagaacggcgccuucagcggcggguaccacggcgccuccggguacggccccgcgggcagccuggcgccccugcccggguccagcggcguggggccgggcggggucauccgggugcccgcccaccgcccccuccccgugccgccgcccgccggcggcgcccccgccguccccgggcccuccggccucgggggcgccgggggccuggccggccucaccuuccccuggauggacagcgggcggcgcuucgccaaggaccggcugacggcggcccugucccccuucagcggcacccgccggaucgggcacccguaccagaaccgcaccccgcccaagcggaagaagccccgcaccuccuucagccggucccaggugcucgagcuggagcgccgguuccugcgccagaaguaccucgccagcgccgagcgggccgcgcuggccaaggcccugcgcaugacggacgcccaggugaagaccugguuccagaaccggcgcaccaaguggcggcgccagaccgccgaggagcgggaggcggagcgccaccgcgccggccggcuccugcugcaccuccagcaggacgcccugccccgcccccugcggccgccccugccgcccgacccccugugccugcacaacuccagccucuucgcccugcagaaccugcagcccugggccgaggacaacaaggucgcguccgugagcgggcucgccuccguggucuga

SEQ ID NO: 37735 - RNA, 876 nt, Artificial Sequence
  derived and/or modified sequence opt1 from TLX3__Homo_sapiens__NP_066305
auggaggcccccgccagcgcgcagaccccgcacccccacgagcccaucuccuucggcaucgaccagauccugaacagccccgaccaggacuccgccccggcgccccgcgggcccgacggcgccagcuaccucgggggcccgcccgggggccggcccggcgccaccuaccccucccugcccgcgagcuucgccgggcugggcgccccguucgaggacgccggguccuacagcgugaaccucucccuggcgcccgccggcgucauccgcgugcccgcccaccggccccugccgggggccgugcccccgccccuccccagcgcccugcccgcgaugcccuccguccccacggugagcucccugggcggccucaacuucccguggauggagagcucccgccgguucgugaaggaccgcuucaccgccgccgccgcccugacccccuucaccgucacgcggcgcaucgggcaccccuaccagaaccggacgcccccgaagcgcaagaagccccggaccagcuucucccgcgugcagaucugcgagcuggagaagcgguuccaccgccagaaguaccucgcgagcgccgagcgggccgcccuggccaagucccugaagaugaccgacgcccaggugaagaccugguuccagaaccgccggaccaaguggcgccggcagaccgccgaggagcgcgaggccgagcggcagcaggccagccgccucaugcugcagcugcagcacgacgccuuccagaagucccucaacgacagcauccagcccgacccgcugugccugcacaacagcucccucuucgcgcugcagaaccugcagcccugggaggaggacagcuccaagguccccgccgugaccagccucguguga

SEQ ID NO: 37736 - RNA, 609 nt, Artificial Sequence
  derived and/or modified sequence opt1 from TM4SF1__Homo_sapiens__NP_055035
augugcuacggcaagugcgcccgcugcaucgggcacagccuggugggccucgcccugcugugcaucgcggccaacauccuccuguacuuccccaacggggagaccaaguacgccuccgagaaccaccugagccgguucgucugguucuucuccggcaucgucgggggcggccuccugaugcugcucccggccuucguguucaucgggcuggagcaggacgacugcugcggcugcugcgggcacgagaacugcggcaagcgcugcgccaugcugagcuccgugcucgcggcccugaucgggaucgccggcagcggcuacugcgugaucguggccgcgcuggggcucgccgagggcccccugugccuggacucccucgggcaguggaacuacaccuucgccagcacggagggccaguaccugcuggacaccuccaccuggagcgagugcaccgagcccaagcacaucgucgaguggaacgugucccucuucagcauccugcuggcccucggcgggaucgaguucauccugugccugauccaggugaucaacggcguccucgggggcaucugcggguucugcugcucccaccagcagcaguacgacugcuga

SEQ ID NO: 37737 - RNA, 690 nt, Artificial Sequence
  derived and/or modified sequence opt1 from TM4SF20__Homo_sapiens__NP_079071
augaccugcugcgagggcuggaccagcugcaacggguucucccugcucgugcugcugcuccugggcgucgugcugaacgccaucccccucaucgugagccuggucgaggaggaccaguucucccagaacccgaucagcugcuucgaguggugguuccccgggaucaucggcgccgggcugauggcgauccccgccacgaccaugucccucaccgcccgcaagcgggccugcugcaacaaccgcaccggcauguuccugagcucccuguucagcgugaucacggugaucggcgcccucuacugcaugcugaucuccauccaggcgcugcucaaggggccccugaugugcaacagcccguccaacagcaacgccaacugcgaguucucccugaagaacaucagcgacauccaccccgaguccuucaaccuccagugguucuucaacgacagcugcgccccgcccaccggcuucaacaagcccaccuccaacgacaccauggccagcggguggcgggcguccagcuuccacuucgacagcgaggagaacaagcaccgccugauccacuucuccgucuuccugggccuccugcugguggggauccucgaggugcuguucggccugagccagaucgucaucggcuuccucgggugccugugcggcguguccaagcggcgcagccagaucguguga

SEQ ID NO: 37738 - RNA, 609 nt, Artificial Sequence
  derived and/or modified sequence opt1 from TM4SF4__Homo_sapiens__NP_004608
augugcaccggcgggugcgcccgcugccugggcgggacccucaucccccuggccuucuucggcuuccuggcgaacauccuccuguucuuccccgggggcaaggugaucgacgacaacgaccaccugagccaggagaucugguucuucggcgggauccucggcuccgggguccugaugaucuucccggcccugguguuccucggccugaagaacaacgacugcugcgggugcugcggcaacgagggcugcgggaagcgguucgccauguucacgagcaccaucuucgccguggucggcuuccugggggccggcuacuccuucaucaucagcgcgaucuccaucaacaagggccccaagugccucauggccaacagcaccuggggguaccccuuccacgacggcgacuaccugaacgacgaggcccuguggaacaagugccgcgagccgcucaacguggugcccuggaaccugacccuguucuccauccuccuggucgucgggggcauccagauggugcugugcgccauccagguggugaacgggcuccugggcacgcugugcggcgacugccagugcugcgggugcugcggcggggacggccccguguga

SEQ ID NO: 37739 - RNA, 594 nt, Artificial Sequence
  derived and/or modified sequence opt1 from TM4SF5__Homo_sapiens__NP_003954
augugcaccggcaagugcgcccgcugcguggggcugagccucaucacccugugccuggucugcaucguggccaacgcgcuccugcuggugcccaacggcgagaccuccuggaccaacaccaaccaccucagccugcaggucuggcugaugggcggguucaucgggggcggccucauggugcugugcccggggaucgccgccgugcgggccggcgggaagggcugcugcggggccggcugcugcggcaaccgcugccggaugcugcgcuccgucuucagcuccgcguucggggugcucggcgccaucuacugccugagcguguccggggccggccugcggaacggcccccgcugccucaugaacggggaguggggcuaccacuucgaggacaccgccggggcguaccugcugaaccggacgcucugggaccgcugcgaggccccgccccgggucgugcccuggaacgugacccuguucagccugcucgucgccgccuccugccuggagaucgugcugugcggcauccagcucgugaacgccaccaucggggucuucugcggcgacugccgcaagaagcaggacacgccccacuga

SEQ ID NO: 37740 - RNA, 1134 nt, Artificial Sequence
  derived and/or modified sequence opt1 from TM6SF2__Homo_sapiens__NP_001001524
auggacaucccgccccuggccggcaagaucgccgcgcucagccuguccgcccugcccgugagcuacgcccucaaccacgucuccgcccugagccacccccuguggguggcccucauguccgcgcugauccuggggcuccuguucguggccgucuacagccugucccacggcgaggugagcuacgacccccucuacgccguguucgccgucuucgcguucaccuccgugguggaccugaucaucgcccugcaggaggacagcuacgucgugggguucauggaguucuacaccaaggagggcgagccguaccuccgcacggcccacgggguguucaucugcuacugggacggcaccguccacuaccugcuguaccucgccauggccggcgcgaucugccggcgcaagcgguaccgcaacuucgggcuguacuggcugggcuccuucgccaugagcauccucguguuccugaccgggaacauccugggcaaguacuccagcgagauccggcccgccuucuuccucaccauccccuaccugcuggugcccugcugggccgggaugaaggucuucucccagccgcgcgcccucacgcggugcaccgcgaacauggugcaggaggagcagcgcaagggccugcugcagcggcccgccgaccucgcccuggugaucuaccugauccucgccggcuucuucacccuguuccgcgggcuggucgugcucgacugccccaccgacgccugcuucguguacaucuaccaguacgagcccuaccugcgggacccggucgcguaccccaaggugcagaugcugauguacauguucuacgugcuccccuucugcggccuggccgccuacgcccugacguuccccgggugcagcuggcucccggacugggcccuggucuucgcgggcggcaucgggcaggcccaguucucccacaugggcgccagcaugcaccuccgcacccccuucaccuaccgggugcccgaggacaccugggggugcuucuucgucugcaaccugcuguacgcccugggcccccaccuccuggcguaccgcugccugcaguggccggccuucuuccaccagcccccgcccuccgacccccuggcccuccacaagaagcagcacuga

SEQ ID NO: 37741 - RNA, 1176 nt, Artificial Sequence
  derived and/or modified sequence opt1 from TM7SF2__Homo_sapiens__NP_001264162
auggcccccacccagggcccgcgcgcgccccuggaguucgggggcccccucggggccgccgcccugcugcuccugcugcccgccaccauguuccaccuccugcuggccgcgcggagcggcccggcccgccuccuggggccgcccgccucccugcccggccucgaggugcuguggagcccccgggcccugcuccuguggcuggcguggcucggccugcaggccgcccuguaccuccugcccgcccgcaaggucgccgaggggcaggagcugaaggacaagucccggcuccgcuaccccaucaacggcuuccaggcgcuggugcugacggcccuccugguggggcugggcaugagcgccgggcucccccugggcgcccugccggagaugcuccugccccuggccuucgucgcgacccucaccgccuucaucuucucccuguuccuguacaugaaggcccagguggcccccgugagcgcccucgcgcccggcgggaacuccggcaacccgaucuacgacuucuuccuggggcgggagcugaacccccgcaucugcuucuucgacuucaaguacuucugcgagcuccggcccggccugaucggcuggguccugaucaaccucgcccugcugaugaaggaggccgagcuccgcgggagccccucccuggccauguggcuggugaacggcuuccagcugcucuacgugggggacgcccuguggcacgaggaggcgguccugaccacgauggacaucacccacgacggcuucggguucaugcucgccuucggcgacauggccugggugccguucaccuacagccugcaggcccaguuccugcuccaccacccccagccccugggccugcccauggcguccgugaucugccucaucaacgggcuggagaccaucagcacggccaccggccggaagcugcucgucuccgggugguggggcauggugcgccacccgaacuaccugggggaccugaucauggcccucgccuggagccugcccugcggcgugucccaccuccugcccuacuucuaccugcuguacuucaccgcccuccugguccaccgggaggcgcgcgacgagcggcagugccugcagaaguacggccucgccuggcaggaguacugccgccgggugcccuaccgcaucaugccguacaucuacuga

SEQ ID NO: 37742 - RNA, 1992 nt, Artificial Sequence
  derived and/or modified sequence opt1 from TM9SF2__Homo_sapiens__NP_004791
augagcgcccgccugcccgugcucuccccgccccgguggccccgccugcugcuccugagccugcuccugcugggcgccguccccgggccgcggcgcuccggcgcguucuaccuccccgggcuggcccccgugaacuucugcgacgaggagaagaaguccgacgagugcaaggccgagaucgagcuguucgugaaccggcucgacagcgucgagagcgugcugcccuacgaguacaccgccuucgacuucugccaggccuccgagggcaagcgcccgagcgagaaccuggggcagguccucuucggcgagcggaucgagcccucccccuacaaguucaccuucaacaagaaggagacgugcaagcuggugugcaccaagaccuaccacaccgagaaggcggaggacaagcagaagcuggaguuccucaagaaguccaugcugcugaacuaccagcaccacuggaucguggacaacaugcccgugacguggugcuacgacgucgaggacggccagcgcuucugcaacccgggguuccccaucggcugcuacaucaccgacaaggggcacgccaaggacgccugcgugaucagcagcgacuuccacgagcgggacaccuucuacaucuucaaccacguggacaucaagaucuacuaccacgucguggagaccggcuccaugggggcccgccucguggcggccaagcuggagcccaagagcuucaagcacacgcacaucgacaagcccgacugcuccggcccgcccauggacaucagcaacaaggccuccggcgagaucaagaucgccuacaccuacagcgucuccuucgaggaggacgacaagauccggugggccagccgcugggacuacauccuggagagcaugccccacacccacauccagugguucuccaucaugaacagccucgugaucgugcuguuccuguccgggauggucgcgaugaucaugcuccggacccugcacaaggacaucgcccgcuacaaccagauggacagcacggaggacgcccaggaggaguucggcuggaagcuggugcacggggacaucuuccggcccccgcgcaagggcaugcuccuguccguguuccugggcagcgggacccagauccucaucaugaccuucgucacccuguucuucgccugccugggcuuccucucccccgccaaccgcggggcgcugaugacgugcgccguggugcuguggguccuccugggcacccccgccggguacguggccgcccgguucuacaagagcuucggcggcgagaaguggaagaccaacguccugcucaccuccuuccugugccccgggaucguguucgcggacuucuucaucaugaaccugauccucuggggcgaggggagcuccgccgccaucccguucggcacgcugguggccauccuggcccucugguucugcaucagcgucccccugaccuucaucggggcguacuucggcuucaagaagaacgccaucgagcaccccgugcggaccaaccagaucccccgccagaucccggagcaguccuucuacaccaagccccugcccggcaucaucaugggcgggauccugccguucgggugcaucuucauccagcuguucuucauccucaacagcaucuggucccaccagauguacuacauguucggcuuccuguuccucguguucaucauccuggucaucacgugcagcgaggccaccauccugcucugcuacuuccaccugugcgccgaggacuaccacuggcaguggcgguccuuccugaccagcggguucaccgcgguguacuuccucaucuacgccgugcacuacuucuucuccaagcugcagaucacgggcaccgccagcaccauccuguacuucggcuacaccaugaucaugguccucaucuucuuccuguucacggggaccaucggcuucuucgccugcuucugguucgugaccaagaucuacagcguggucaagguggacuga

SEQ ID NO: 37743 - RNA, 1929 nt, Artificial Sequence
  derived and/or modified sequence opt1 from TM9SF4__Homo_sapiens__NP_055557
auggccaccgccauggacuggcugcccuggagccuccugcuguucucccucaugugcgagaccagcgcguucuacgugccgggcgucgcccccaucaacuuccaccagaacgaccccguggagaucaaggccgugaagcugacguccagccgcacccagcugcccuacgaguacuacucccucccguucugccagcccagcaagaucaccuacaaggccgagaaccugggggagguccugcggggcgaccgcaucgugaacacccccuuccaggugcucaugaacuccgagaagaagugcgagguccugugcagccaguccaacaagcccgugacgcugaccguggagcagagccggcucgucgccgagcgcaucaccgaggacuacuacgugcaccugaucgcggacaaccugccgguggccacccggcucgagcuguacuccaaccgcgacagcgacgacaagaagaaggagaaggacguccaguucgagcacggguaccggcugggcuucacggacgugaacaagaucuaccuccacaaccaccuguccuucauccuguacuaccaccgcgaggacauggaggaggaccaggagcacaccuaccgggugguccgcuucgaggugaucccccagagcauccggcucgaggaccugaaggccgacgagaaguccagcugcacccugcccgaggggaccaacuccagcccccaggagaucgacccgacgaaggagaaccagcucuacuucaccuacuccgugcacugggaggagagcgacaucaagugggccagccgcugggacaccuaccugaccauguccgacguccagauccacugguucagcaucaucaacuccgugguggucguguucuuccugagcggcauccucuccaugaucaucauccggacgcugcgcaaggacaucgcgaacuacaacaaggaggacgacaucgaggacaccauggaggagagcggcuggaagcuggugcacggggacgucuuccggccgccccaguaccccaugauccucuccagccugcugggcuccgggauccagcuguucugcaugauccucaucgugaucuucgucgccaugcugggcaugcucagccccuccagccgcggggcccugaugaccaccgccugcuuccuguucauguucaugggcguguucggcggguucuccgccggccggcucuaccgcacgcugaaggggcaccgguggaagaagggcgcguucugcaccgccacccuguaccccggcguggucuucgggaucugcuucgugcucaacugcuucaucuggggcaagcacagcuccggggccgugcccuuccccaccauggucgcccugcugugcaugugguucggcaucagccucccgcugguguaccugggguacuacuucggcuuccgcaagcagcccuacgacaaccccgugcggacgaaccagaucccccgccagaucccggagcagcgcugguacaugaaccgguucgucggcauccucauggccgggauccugcccuucggcgcgauguucaucgagcuguucuucaucuucuccgccaucugggagaaccaguucuacuaccuguucggguuccucuuccugguguucaucauccugguggucagcugcucccagaucagcaucgugaugguguacuuccagcucugcgccgaggacuaccgcuggugguggcggaacuuccuggucagcggcggguccgccuucuacgugcugguguacgccaucuucuacuucgucaacaagcucgacaucguggaguucauccccagccugcuguacuucggcuacaccgcgcucauggugcuguccuucuggcugcucaccggcaccaucggguucuacgccgccuacauguucguccgcaagaucuacgccgccgugaagaucgacuga

SEQ ID NO: 37744 - RNA, 858 nt, Artificial Sequence
  derived and/or modified sequence opt1 from TMBIM4__Homo_sapiens__NP_001269535
auggccgaccccgacccgcgcuacccccggagcuccaucgaggacgacuucaacuacggcagcuccguggccagcgcgaccguccacauccgcauggugcugcagcgggacugcaccuucuccaagcaguacaugcgcauccccagcgcccccuccgccacgcucaacaucauccgguucuuccaccuccgccagagcgggcgguccggcauggugaacaucuucuacaaggggccgaccuuccugcgcaaggucuacagcauccucucccuccaggugcugcugaccaccgugacgagcaccgucuuccuguacuucgaguccgugcggaccuucgugcacgagagccccgcccugauccuccuguucgcccugggcucccucgggcugaucuucgcgcugauccucaaccgccacaaguacccccugaaccuguaccuccuguucggcuucacccugcucgaggcccugacggucgccgugguggucaccuucuacgacguguacaucauccugcaggccuucauccucaccaccacgguguucuucggccugaccgucuacacccugcagagcaagaaggacuucuccaaguucggggcgggccucuucgcccugcuguggauccucugccugagcggguuccugaaguucuucuucuacuccgagaucauggagcucgugcuggccgccgccggcgcgcugcuguucugcggguucaucaucuacgacacccacagccugaugcacaagcugagccccgaggaguacgugcucgccgccaucucccuguaccuggacaucaucaaccucuuccugcaccuccugcgguuccuggaggccgucaacaagaaguga

SEQ ID NO: 37745 - RNA, 714 nt, Artificial Sequence
  derived and/or modified sequence opt1 from TMBIM6__Homo_sapiens__NP_003208
augaacaucuucgaccgcaagaucaacuucgacgcccugcucaaguucagccacaucacccccuccacccagcagcaccugaagaagguguacgccagcuucgcgcugugcauguucgucgccgccgccggcgccuacgugcacauggugacgcacuucauccaggcggggcuccuguccgcccugggcagccucauccugaugaucuggcugauggccaccccgcacucccacgagaccgagcagaagcggcucgggcugcuggccggcuucgcguuccucaccggggucggccugggccccgcccuggaguucugcaucgccgugaaccccagcauccuccccacggccuucauggggaccgccaugaucuucacgugcuucacccuguccgcgcuguacgcccgccggcgcagcuaccucuuccugggcgggauccugauguccgcccucagccugcugcuccuguccagccugggcaacguguucuucggguccaucuggcuguuccaggccaaccucuacgucggccugguggugaugugcggcuucguccucuucgacacccagcugaucaucgagaaggccgagcacggggaccaggacuacaucuggcacugcaucgaccuguuccucgacuucaucaccguguuccggaagcugaugaugauccuggcgaugaacgagaaggacaagaagaaggagaagaaguga

SEQ ID NO: 37746 - RNA, 2283 nt, Artificial Sequence
  derived and/or modified sequence opt1 from TMC1__Homo_sapiens__NP_619636
augagccccaagaaggugcagaucaaggucgaggagaaggaggacgagaccgaggaguccagcuccgaggaggaggaggagguggaggacaagcugccgcgccgggagagccuccgccccaagcggaagcgcacccgggacgugaucaacgaggacgaccccgagcccgagccggaggacgaggagacgcgcaaggcccgggagaaggagcgccggcgccggcugaagcgcggcgccgaggaggaggagaucgacgaggaggagcuggagcggcucaaggcggagcuggacgagaagcgccagaucaucgccaccgucaagugcaagcccuggaagauggagaagaagaucgaggugcugaaggaggccaagaaguucguguccgagaacgagggggcccucggcaaggggaagggcaagcggugguucgccuucaagaugaugauggcgaagaagugggccaaguuccugcgcgacuucgagaacuucaaggccgccugcguccccugggagaacaagaucaaggcgaucgagagccaguucggguccagcguggccuccuacuuccuguuccuccgguggauguacggcgugaacaugguccuguucauccugaccuucagccucaucaugcugcccgaguaccuguggggccucccguacgggucccugccccgcaagaccgugccccgggccgaggaggccagcgccgcgaacuucggcgugcuguacgacuucaacgggcucgcccaguacuccguccuguucuacggcuacuacgacaacaagcgcacgaucggguggaugaacuuccggcugccccucagcuacuuccuggugggcaucaugugcaucggcuacuccuuccuggugguccucaaggccaugaccaagaacaucggggacgacggcgggggcgacgacaacaccuucaacuucagcuggaagguguucaccuccugggacuaccugaucggcaacccggagacggccgacaacaaguucaacagcaucaccaugaacuucaaggaggccaucaccgaggagaaggcggcccagguggaggagaacguccaccugauccgcuuccuccgcuuccuggccaacuucuucguguuccugacccucgggggcuccggguaccugaucuucugggccgugaagcggagccaggaguucgcccagcaggaccccgacacgcugggcuggugggagaagaacgagaugaacauggucaugagccuccuggggauguucugccccacccuguucgaccucuucgcggagcuggaggacuaccacccccugaucgcccucaaguggcugcugggccgcaucuucgcccuccugcugggcaaccucuacguguucauccuggcccugauggacgagaucaacaacaagaucgaggaggagaagcucgugaaggccaacaucacccugugggaggcgaacaugaucaaggccuacaacgccuccuucagcgagaacuccaccgggccgcccuucuucguccaccccgccgacgugccccggggcccgugcugggagacgauggucgggcaggaguucgugcgccugaccgugagcgacguccugaccaccuacgugacgauccucaucggcgacuuccugcgggcgugcuucgugcgcuucugcaacuacugcuggugcugggaccuggaguacggguaccccuccuacaccgaguucgacaucagcggcaacguccucgcccugaucuucaaccagggcaugaucuggaugggguccuucuucgcccccagccugcccggcaucaacauccuccggcugcacaccuccauguacuuccagugcugggccgugaugugcugcaacgugccggaggcccgcgucuucaaggcgagccgguccaacaacuucuaccuggggaugcuccugcugauccucuuccugagcaccaugcccgugcuguacaugaucgugucccucccgcccagcuucgacugcggccccuucuccgggaagaaccgcauguucgaggucaucggcgagacgcuggagcacgacuuccccagcuggauggccaagauccugcggcagcucuccaaccccggccuggugaucgccgugauccuggucauggugcucgccaucuacuaccugaacgccaccgcgaaggggcagaaggccgccaaccuggaccucaagaagaagaugaagaugcaggcccuggagaacaagaugcgcaacaagaagauggccgcggcccgggccgccgcggccgccggccgccaguga

SEQ ID NO: 37747 - RNA, 2721 nt, Artificial Sequence
  derived and/or modified sequence opt1 from TMC2__Homo_sapiens__NP_542789
augagccaccaggugaagggccugaaggaggaggcccgcgggggcgucaaggggcgggugaaguccggcagcccccacaccggggaccgccucggccggcgcuccagcuccaagcgggcccugaaggcggagggcacccccgggcgccggggcgcccagcgcagccagaaggagcgggccgggggcucccccagccccgggagcccccgccggaagcagacgggccgccggcgccaccgggaggagcugggcgagcaggagcgcggggaggccgagcggaccugcgagggccgccggaagcgcgacgagcgggccagcuuccaggagcgcaccgcggccccgaagcgcgagaaggagaucccccggcgcgaggagaaguccaagcggcagaagaagccccgcagcuccagccucgccuccagcgccuccgggggcgagagccuguccgaggaggagcuggcgcagauccucgagcaggucgaggagaagaagaagcugaucgccaccaugcggagcaagcccuggccgauggccaagaagcugacggagcuccgcgaggcccaggaguucguggagaaguacgagggcgcccuggggaagggcaaggggaagcagcuguacgcguacaagaugcucauggccaagaagugggugaaguucaagcgggacuucgacaacuucaagacccagugcauccccugggagaugaagaucaaggacaucgagagccacuucggcuccagcguggccuccuacuucaucuuccugcgcuggauguacggggucaaccugguccucuucggccugaucuucggccuggugaucauccccgaggugcucauggggaugcccuacggcagcaucccgcggaagaccgugccccgcgccgaggaggagaaggccauggacuucuccgugcugugggacuucgagggguacaucaaguacagcgcgcuguucuacggcuacuacaacaaccagcggaccaucggguggcuccgcuaccggcugcccauggccuacuucauggucggcguguccguguucggcuacagccugaucaucgucauccgcuccauggccagcaacacgcagggguccaccggcgagggggagagcgacaacuucaccuucuccuucaagauguucaccagcugggacuaccucaucggcaacuccgagacggccgacaacaaguacgccagcaucaccaccuccuucaaggagagcaucguggacgagcaggaguccaacaaggaggagaacauccaccugacccgguuccugcgcgugcucgcgaacuuccugaucaucugcugccugugcgggagcggcuaccucaucuacuucgucgugaagcggagccagcaguucuccaagaugcagaacgugagcugguacgagcgcaacgaggucgagaucgugaugucccugcugggcauguucugcccgccccucuucgagacgaucgccgcccuggagaacuaccacccccggaccgggcugaaguggcagcucggccgcaucuucgcccuguuccuggggaaccucuacaccuuccugcuggcccucauggacgacgugcaccugaagcuggcgaacgaggagaccaucaagaacaucacgcacuggacccucuucaacuacuacaacagcuccggcuggaacgagagcgucccccggcccccgcugcaccccgccgacgugccccgcggcuccugcugggagaccgccgucgggaucgaguucaugcgccugaccgugagcgacaugcucgugacguacaucaccauccugcugggcgacuuccugcgggccugcuucguccgcuucaugaacuacugcuggugcugggaccucgaggcgggguuccccuccuacgccgaguucgacaucagcggcaacgugcuggggcugaucuucaaccagggcaugaucuggaugggcuccuucuacgccccggggcucgugggcaucaacguccugcggcugcucaccagcauguacuuccagugcugggccgugauguccagcaacgugccccacgagcgcgucuucaaggccucccggagcaacaacuucuacauggggcugcugcuccuggugcuguuccucucccugcugcccguggcguacaccaucaugagccugcccccgagcuucgacugcggccccuucuccgggaagaaccgcauguacgacguccuccaggagacgaucgagaacgacuuccccaccuuccugggcaagaucuucgccuuccucgccaacccgggccugaucauccccgccauccugcucauguuccuggccaucuacuaccugaacagcguguccaagagccucucccgggcgaacgcccagcugcgcaagaagauccaggugcugcgggaggucgagaagucccacaaguccgugaaggggaaggccaccgcccgcgacagcgaggacacccccaaguccagcuccaagaacgccacgcagcuccagcugaccaaggaggagaccacgcccccgagcgcgucccagagccaggccauggacaagaaggcccagggccccgggaccuccaacagcgccucccggaccacccugcccgcgagcggccaccuccccaucucccgcccgcccgggaucggccccgacagcggccacgcccccagccagacccacccguggcgguccgccagcgggaaguccgcccagcgcccgccccacuga

SEQ ID NO: 37748 - RNA, 3303 nt, Artificial Sequence
  derived and/or modified sequence opt1 from TMC3__Homo_sapiens__NP_001074001
augaagaccagcaaggccucccagcgcuaccggggcauccgccggaacgccagccagugcuaccuguaccaggagucccuccugcugagcaaccucgacgacuccuucagcgcggacgagaccggggacuccaacgaccccgagcagaucuuccagaacauccaguuccagaaggaccugauggccaacauccgcugccggccguggacgaugggccagaagcugcgcgcccuccggcaggccaagaacaucgugcugaaguucgaggggcgccugacccggacccgcggcuaccaggccgcgggggccgagcucuggcggaaguucgcccgccuggccugcaacuucgucgugaucuucauccccugggagaugcggaucaagaagaucgagagccacuucggcuccggcguggcgagcuacuucaucuuccugcgcuggcuguucgggaucaacaucguccugaccaucaugacgggcgccuucaucgugauccccgagcugaucgccgggcagcccuucggcuccaccgcccggaagaccaucccgaaggagcaggucagcuccgcccaggaccucgacaccguguggagccucgggggcuaccugcaguacuccgugcuguucuacggcuacuacgggcgcgagcggaagaucggccgcgcgggguaccggcugccccuggccuacuuccucgugggcauggccgucuucgccuacagcuucaucauccugcugaagaagauggccaagaacucccgcacgagccucgcguccgccagcaacgagaacuacaccuucugcuggcggguguucugcgccugggacuaccugaucggcaaccccgaggccgccgagagcaagaccgcggccaucgugaacuccauccgcgaggccauccuggaggagcaggagaagaagaaguccaagaaccucgccgucaccaucugccugcgcaucaucgccaacauccuggugcuccugucccuggcggggagcaucuaccucaucuacuucguggucgaccggucccagaagcuggagcagagcaagaaggagcugacgcucugggagaagaacgagguguccguggucgugagccuggugaccaugaucgcccccuccgccuucgaccugaucgccgcgcucgagauguaccacccgcgcaccacccugcgguuccagcuggcccgcguccucgugcuguaccugggcaaccucuacagccugaucaucgcccugcucgacaaggugaacuccaugagcaucgaggagauggccacgaagaacaacaccucccacuggaucgacagcaccaccuucuucgccacgcggaccgcgcccgaggaggagaagugguccaccagccgccccgggaugggccugcggcgcaacaacaccugggcccuggaggagacguccaucagcgccuacaccaugccccugaucaaggccaacaagaccucccuccacacccagagcccgcaggaccagugcugggagacguacgucgggcaggagaugcugaagcugagcaucaucgacaugcuguucaccguggccuccauccugcugaucgacuucuuccggggccucuucguccgcuaccugagcgacuacuggugcugggaccuggaguccaaguuccccgaguacggcgaguucaagaucgcggagaacgugcuccaccugguguacaaccaggggaugaucuggaugggcgccuucuucagccccugccugcccgccuucaacguccucaagcugaucgggcugauguaccuccgguccugggccgugcugaccugcaacgugccgcaccagcaggucuuccgcgccagccgguccaacaacuucuaccuggcgaugcuccuguucaugcuguuccucugcaugcugcccaccaucuucgccaucgugcgcuacaagcccagccugaacugcggccccuucuccgggcaggagaagaucuacgacaucgugagcgagacgaucgagaaggacuucccggucugguucggcuccguggugggccacaucagcucccccgucgugauccuccccgccgugcugcuccucuucaugcugaucuacuaccugcagagcaucgcccggucccucaagcugagcaaccaccagcugaagaugcagauccagaacgcgcgcuccgaggacaagaagaaggucgcccagaugguggaggcccggauccagacccaggaggagagcaccaagaagcuccccaacgacagcgaccugaccucccagcugagcuccgcccacagcgggacgccgcagaacaacggcaacguggcccacuucgacuccgggagcuccaagagcggccgcaucgagaccgucgcgcaguccaugccccagagcccccggcccggggaccgcgccccguccagcccccuccccggcgugccgaagucccgccuggagcacgagaccaaccgguaccugcacggccucugcgccagcaccuccgaccugcaccgcaaccggagccgcacccccaugacguucaccacccacaucgaggacgugcacuccgagccccuguuccggaaggacuuccagcagaucaacccgccccaccgcgggccccaggccagcacccuccuggcccagggcccccggccccacgcgccgcgcuacuacgucaucaacgagugcgacuccuacaagaagaagcaccugaacguguggcccgagcggcacuucaagaucgacgccagcggggacaucguggagcucuacccccgcaacguccggcaguacgccagccgcgugccccggcagccgcccagcccccagcugagcgaggaggaggaggagacgcccucccgcgacuggaucaagcggagccugccgccccgcucccucaucgaccugcggcgcgcgccccacuucuacaucggcgagcggagcgagucccagacccgcgaccccgagcaccagggccgggugcacuacaagagcuggaacgaggacuucgaggggcaccuggagcgcccggccuacgucccccgcaagccccggucccgcaacuuccaguacccccagccgccccucaagccccggggcaagccgcgcuucgagcccagccugaccgaguccgacagcguguccgccgccagcuccagcgaccagcagaacuccagcgccgaccaguaccuccaggugacccacucccaggggcgguucccccgcagcgucggccagcccagccggcgcaaggccaaguccgggcaggagcucacgguggaccuggacgaccugaucugcagcgacguguga

SEQ ID NO: 37749 - RNA, 3021 nt, Artificial Sequence
  derived and/or modified sequence opt1 from TMC5__Homo_sapiens__NP_001098718
augagcgccuacuaccgcaacaacugguccgaggaggaccccgacuacccggacuacagcggcucccagaaccggacccagggguaccugaagacccagggcuaccccgacgugcccgggccccucaacaacccggacuaccccggcacgcgcagcaaccccuacuccgucgccagccggacccgccccgacuacccggggucccuggcggagcccaacuacccccggagccuguccaaccccgacuacagcggcacccgcuccaacgccuacagcgccgccucccggaccagcccggaccaccccacgucccuccccgagcccgacuacagcgaguuccagucccacccguaccaccgcgccagcucccggcagcccgacuaccccggcagccagcgcaaccccgacuucgcggggagcuccagcuccggcaacuacgccgggagccggacccacccggaccacuucggcucccuggagcccgacuaccccggggcccagagcaacuccgaccaccccggcccgcgcgccaaccugaaccaccccggcagccggaagaaccucgagcacaccuccuuccgcaucaaccccuacgcggacagccuggggaagcccgacuacccgggcgccgacauccagcccaacuccccgccguucuucggggagcccgacuaccccagcgccgaggacaaccagaaccugcccuccaccuggcgggagccggacuacagcgacgccgagaacggccacgacuacggcuccagcgagacgcccaagaugacccgcggggugcucucccggaccagcuccauccagcccagcuuccgccaccggagcgacgaccccgugggcucccuguggggcgagaacgacuacccggaggggaucgagauggccagcauggagauggcgaacuccuacgggcacagccugcccggcgcccccggcuccggguacgucaaccccgccuacgugggcgagagcgggccggugcacgccuacggcaacccgccccucuccgagugcgacuggcacaagagcccccaggggcagaagcugaucgccucccugauccccaugaccagccgcgaccggaucaaggcgauccgcaaccagccccgcacgauggaggagaagcggaaccuccgcaagaucgucgacaaggagaaguccaagcagacccaccggauccugcagcugaacugcugcauccagugccucaacagcaucucccgcgccuaccggcgcagcaagaacucccugagcgagauccugaacuccaucagccucuggcagaagacccugaagaucaucggcggcaaguucgggaccagcgugcuguccuacuucaacuuccuccgguggcugcugaaguucaacaucuucagcuucauccucaacuucuccuucaucaucaucccccaguucacgguggccaagaagaacacccugcaguucaccggccuggaguucuucaccggggucggcuacuuccgcgacacggugauguacuacggguucuacaccaacagcaccauccagcacggcaacuccggcgccagcuacaacaugcagcucgccuacaucuucaccaucggggcgugccugacgaccugcuucuucucccuccuguucagcauggccaaguacuuccggaacaacuucaucaacccccacaucuacuccggcgggaucaccaagcugaucuucugcugggacuucaccgugacgcacgagaaggccgucaagcugaagcagaagaaccucagcaccgagauccgcgagaaccuguccgagcugcggcaggagaacagcaagcucaccuucaaccagcugcugacccgcuucuccgccuacaugguggccuggguggucagcacgggcguggcgaucgccugcugcgccgccguguacuaccucgcggaguacaaccuggaguuccugaagacccacuccaacccgggcgccguccuccugcugcccuucguggugagcugcaucaaccucgccguccccugcaucuacuccauguuccggcugguggagcgcuacgagaugccccggcacgagguguacguccugcugauccgcaacaucuuccucaagaucagcaucaucgggauccugugcuacuacuggcugaacaccguggcccucuccggcgaggagugcugggagacccugaucgggcaggacaucuaccggcugcuccugauggacuucgucuucagccuggugaacagcuuccucggcgaguuccugcgccggaucaucgggaugcagcugaucacgucccucggccugcaggaguucgacaucgcccgcaacgugcuggagcucaucuacgcgcagacccuggucuggaucggcaucuucuucugcccgcugcuccccuucauccagaugaucaugcuguucaucauguucuacagcaagaacaucucccugaugaugaacuuccagcccccgagcaaggccuggcgcgccucccagaugaugaccuucuucaucuuccuccuguucuuccccagcuucaccggggugcugugcacccucgccaucacgaucuggcggcugaagcccuccgccgacugcggccccuuccgcgggcugccccucuucauccacagcaucuacuccuggaucgacacccugagcacccggcccggcuaccuguggguggucuggaucuaccgcaaccucaucggguccgugcacuucuucuucauccugacccugaucgugcucaucaucacguaccuguacuggcagaucaccgagggccggaagaucaugauccgccugcuccacgagcagaucaucaacgagggcaaggacaagauguuccugaucgagaagcugaucaagcuccaggacauggagaagaaggcgaaccccagcucccugguccuggagcggcgcgagguggagcagcagggguuccuccaccugggcgagcacgacgggagccuggaccuccggucccgccggagcgugcaggagggcaacccccgcgccuga

SEQ ID NO: 37750 - RNA, 2418 nt, Artificial Sequence
  derived and/or modified sequence opt1 from TMC6__Homo_sapiens__NP_009198
auggcccagccccuggccuucauccucgacgugcccgagacccccggcgaccaggggcagggccccagccccuacgacgaguccgagguccacgacagcuuccagcagcugauccaggagcagucccagugcaccgcgcaggaggggcuggagcuccagcagcgcgagcgggaggugacgggcagcucccagcagacccuguggcgcccggaggggacccagagcaccgccacgcugcggauccucgccuccaugcccagccgcaccaucggccggucccgcggcgccaucaucagccaguacuacaaccggaccgugcagcugcgcugccgguccagccgcccccugcucgggaacuucguccgguccgccuggcccagccugcgccuguacgaccucgagcuggacccgaccgcgcuggaggaggaggagaagcagucccuccuggugaaggagcugcagagccucgccguggcccagcgggaccacaugcugcgcggcaugccccugucccucgccgagaagcggagccugcgcgagaagucccggacgccccgcgggaaguggcggggccagcccgggagcggcggcgucugcagcugcugcgggcgccugcgguacgcgugcgugcucgcccugcacucccugggccucgcccugcugagcgcccuccaggcccugaugccguggcgcuacgcgcugaagcgcaucgggggccaguucggcuccagcgugcucuccuacuuccuguuccugaagacccuccuggccuucaacgcccugcuccugcugcuccuggucgccuucaucauggggccccagguggccuucccgcccgcgcugcccggccccgcccccgugugcaccgggcucgagcugcugaccggcgccgggugcuucacgcacaccgucauguacuacggccacuacagcaacgccacccucaaccagcccugcggcuccccgcuggacgggagccagugcacgccccgggugggcgggcugcccuacaacaugccccuggccuaccucuccaccgugggcgucagcuucuucaucacgugcaucacccugguguacuccauggcgcacagcuucggggaguccuaccgcgugggcagcaccuccggcauccacgccaucaccgucuucugcagcugggacuacaaggugacccagaagcgggccucccgccugcagcaggacaacauccggacccgccucaaggagcugcuggccgaguggcagcuccggcacagcccgcgcuccgugugcgggcggcugcgccaggccgcgguccugggccucguguggcugcugugccucgggaccgcccugggcugcgccguggccguccacguguucagcgaguucaugauccagagccccgaggcggccgggcaggaggccguccugcucgugcugccccugguggucggccuccugaaccugggcgcccccuaccucugccgggugcuggccgcgcuggagccgcacgacucccccgugcucgaggucuacguggccaucugccgcaaccugauccugaagcucgccauccuggggacgcugugcuaccacuggcucggccggcgcguggggguccugcagggccagugcugggaggacuucgugggccaggagcuguaccgguuccucgugauggacuucguccugaugcugcucgacacccuguucggggagcugguguggcgcaucaucagcgagaagaagcucaagcggcgccggaagcccgaguucgacaucgcccgcaacgugcuggagcugaucuacggccagacccucaccuggcuggggguccuguucuccccgcuccugcccgccgugcagaucaucaagcugcuccugguguucuacgucaagaagacgagccugcucgcgaacugccaggcgccccgccggcccuggcuggccucccacaugagcaccguguuccugacccuccugugcuucccggccuuccugggcgccgccguguuccucugcuacgccgucuggcaggucaagcccuccagcacgugcgggcccuuccgcacccuggacaccauguacgaggccggccgggugugggugcgccaccuggaggccgcgggcccccggguguccuggcucccgugggugcaccgcuaccugauggagaacaccuucuucgucuuccuggugagcgcccuccugcuggccgugaucuaccucaacauccaggucgugcgggggcagcgcaaggugaucugccugcugaaggagcagaucuccaacgagggcgaggacaagaucuuccucaucaacaagcugcacagcaucuacgagcggaaggagcgcgaggagcggucccgcgucgggaccacggaggaggccgccgcgccgcccgcccugcucaccgacgagcaggacgccuga

SEQ ID NO: 37751 - RNA, 2181 nt, Artificial Sequence
  derived and/or modified sequence opt1 from TMC8__Homo_sapiens__NP_689681
augcugcucccccgcagcguguccagcgagcgggccccgggcguccccgagcccgaggagcugugggaggccgagauggagcgccugcggggguccggcacccccgugcgcgggcucccguacgcgaugauggacaagcggcugaucuggcagcugcgcgagcccgccggcgugcagacccuccgguggcagcgcuggcagcggcgccggcagacggucgagcgccggcugcgcgaggccgcccagcggcuggcccgcgggcucggccugugggagggcgcgcuguacgagaucgggggccucuucgggaccggcauccggagcuacuucaccuuccugcgcuuccugcuccugcugaaccuccugucccugcuccugaccgccagcuucgugcugcucccccugguguggcugcggcccccggaccccgggcccacgcucaaccugacccugcagugccccggcucccgccagagcccgcccggcguccuccgguuccacaaccagcuguggcacgugcugaccgggcgcgccuucaccaacacguaccucuucuacggcgccuaccgcguggggcccgaguccagcuccgucuacagcauccggcuggcguaccugcucagcccccuggccugccugcuccugugcuucugcggcacccugcgccggauggugaagggccucccgcagaagacccugcuggggcagggcuaccaggcgccccucuccgccaagguguucuccagcugggacuucugcauccgcguccaggaggccgccaccaucaagaagcacgagaucuccaacgaguucaagguggagcuggaggaggggcggcgcuuccagcugaugcagcagcagacgcgggcccagaccgccugccgccuccugagcuaccugcgggugaacguccugaacggccuccugguggugggggccaucuccgccaucuucugggcgaccaaguacagccaggacaacaaggaggagagccuguuccuccugcugcaguaccucccgcccggcgucaucgcccuggugaacuuccugggcccccuccuguucaccuuccuggugcagcucgagaacuacccgcccaacacggaggucaaccugacccugaucuggugcguggugcucaagcuggccucccuggggauguucagcgucucccucggccagaccauccugugcaucgggcgcgacaagagcuccugcgagagcuacggcuacaacgugugcgacuaccagugcugggagaacuccgucggggaggagcuguacaagcucagcaucuucaacuuccugcugaccguggccuucgccuuccucgugacgcugccccggcgccugcucgucgaccgguucuccggccgcuucugggcguggcuggagcgggaggaguuccuggugcccaagaacgugcucgacaucgucgccggccagaccgugaccuggauggggcuguucuacugcccccugcucccccugcugaacagcguguuccucuuccugaccuucuacaucaagaaguacacgcugcucaagaacucccgcgccagcucccggcccuuccgcgccagcuccagcaccuucuucuuccagcugguccugcuccugggccugcuccuggccgcggugccgcugggguacguggucuccagcauccacuccagcugggacugcggccucuucaccaacuacagcgcccccuggcaggucgugcccgagcugguggcccuggggcucccgcccaucggccagcgggcccugcacuaccugggcucccacgcguucagcuucccccuccugaucaugcugucccucgugcugaccgugugcgucagccagacgcaggccaacgcccgcgccauccaccgccugcggaagcagcucguguggcagguccaggagaaguggcaccugguggaggaccugucccgccuccugcccgagccggggcccagcgacucccccggccccaaguacccggccagccaggcgucccggccccagagcuucugccccgggugccccugcccgggcucccccggccaccaggcgccccgccccgggccgagcgugguggacgccgccggccugcggucccccugccccgggcagcacggcgcccccgccagcgcccgccgguuccgcuucccguccggggccgagcucuga

SEQ ID NO: 37752 - RNA, 1443 nt, Artificial Sequence
  derived and/or modified sequence opt1 from TMCC1__Homo_sapiens__XP_006713615
auguggugcggcugcacgugccuguucugcgagucccacuucuccgagaccgugaagaucgagcgccucgaggucagcucccuggcccagacgagcuccgccguggcgagcuccaccgacgggagcauccacaccgacuccguggacggcacccccgacccgcagcggacgaaggccgccaucgcccaccuccagcagaagauccucaagcugaccgagcagaucaagaucgcccagaccgcgcgcgacgacaacgucgccgaguaccugaagcucgccaacagcgccgacaagcagcaggcggcccggaucaagcaggucuucgagaagaagaaccagaaguccgcccagaccauccugcagcugcagaagaagcucgagcacuaccaccgcaagcugcgggagguggagcagaacgggaucccccgccagcccaaggacguguuccgggacaugcaccagggccugaaggacgugggggccaaggugacgggcuucagcgagggcgucguggacuccgugaagggcggguucagcuccuucagccaggccacccacuccgcggccggggccgucgugagcaagccccgcgagaucgccucccucauccggaacaaguucggcagcgccgacaacaucccgaaccugaaggacagccuggaggagggccagguggacgacgcggggaaggcccucggcgucaucuccaacuuccagagcucccccaaguacgggagcgaggaggacugcuccagcgccaccuccggcagcgugggggccaacuccaccacgggcggcaucgccgugggggcgagcuccagcaagaccaacacccuggacaugcaguccagcggcuucgacgcccugcuccacgagauccaggagauccgcgagacccaggcccggcuggaggaguccuucgagacgcugaaggagcacuaccagcgcgacuacagccucaucaugcagacccugcaggaggagcgguaccgcugcgagcggcuggaggagcagcucaacgaccugaccgagcugcaccagaacgagauccucaaccugaagcaggagcuggccuccauggaggagaagaucgccuaccagagcuacgagcgcgcgcgggacauccaggaggcccucgaggccugccagacccgcaucuccaagauggagcugcagcagcagcagcagcaggucgugcagcuggaggggcucgagaacgccacggcgcggaaccugcugggcaagcucaucaacauccugcuggccgugauggccguccuccugguguucgugagcaccgucgccaacugcguggucccccugaugaagacccgcaaccggaccuucagcacccucuuccuggugguguucaucgccuuccuguggaagcacugggacgcgcuguucuccuacgucgagcgcuucuucagcagcccccgcuga

SEQ ID NO: 37753 - RNA, 1896 nt, Artificial Sequence
  derived and/or modified sequence opt1 from TMCC2__Homo_sapiens__NP_001229854
auguucggccacgggcugaagcaccucuuccacagccgccggcgcucccgggagcgcgagcaccagaccagccaggacucccagcagcaccagcagcagcagggcaugagcgaccacgacucccccgacgagaaggagcggagcccggagaugcaccgcguguccuacgccaugagccugcacgaccugcccgcccggcccaccgcguucaaccgcguccuccagcagauccggucccgccccagcaucaagcgcggggccucccugcacagcuccagcggcgggggcuccagcggcuccagcucccggcggaccaagagcagcucccuggagccgcagcgcgggagcccccaccuccugcggaaggcgccccaggacuccagccuggccgccauccuccaccagcaccagugccgcccccgguccagcuccaccaccgacaccgcccugcugcucgccgacggcagcaacguguaccugcuggccgaggaggccgaggggaucggcgacaagguggacaagggggaccucgucgcgcugucccugccggccggccacggcgacacggacgggcccaucagccucgacgugcccgacggcgcccccgacccgcagcgcaccaaggccgccaucgaccaccuccaccagaagauccugaagaucaccgagcagaucaagaucgagcaggaggcgcgggacgacaacguggccgaguaccugaagcuggccaacaacgccgacaagcagcaggucucccgcaucaagcaggucuucgagaagaagaaccagaaguccgcccagaccaucgcgcagcugcacaagaagcucgagcacuaccggcgccgccugaaggagaucgagcagaacgggcccagccggcagcccaaggacgugcugcgcgacaugcagcagggccucaaggacgugggcgccaacgugcgggccgggaucagcggcuucgggggcgggguggucgagggcgugaagggcucccugagcgggcugucccaggccacgcacaccgccguggucagcaagccccgcgaguucgcgucccucauccggaacaaguucggcagcgccgacaacaucgcccaccugaaggacccgcuggaggacgggccgcccgaggaggccgcccgcgcgcucagcggcuccgccacccuggugagcucccccaaguacgggagcgacgacgagugcuccagcgccuccgccagcuccgcgggcgccggcagcaacuccggggccggccccgggggcgcccuggggagccccaaguccaacgcccucuacggcgcgcccggcaaccuggacgcccugcucgaggagcugcgggagaucaaggaggggcagagccaccuggaggacuccauggaggaccucaagacccagcugcagcgcgacuacacguacaugacccagugccugcaggaggagcgguaccgcuacgagcggcucgaggagcagcugaacgaccugaccgagcuccaccagaacgagaugaccaaccugaagcaggagcuggccagcauggaggagaagguggccuaccaguccuacgagcgcgcccgggacauccaggaggcggucgagagcugccugacgcgcgugaccaagcucgagcugcagcagcagcagcagcaggucgugcagcuggagggcguggagaacgccaacgcccgggcccuccuggggaaguucaucaacgugauccuggcccucauggcgguccugcugguguucgucagcaccaucgccaacuucaucacgccccucaugaagacgcgccugcggaucaccuccaccacccugcucgugcuggugcuguuccuccuguggaagcacugggacagccugacguaccuccuggagcacguccugcucccguccuga

SEQ ID NO: 37754 - RNA, 1434 nt, Artificial Sequence
  derived and/or modified sequence opt1 from TMCC3__Homo_sapiens__NP_065749
augcccggcagcgacaccgcccugaccguggaccgcacguacuccgacccggggcggcaccaccgcugcaagagccgggucgagcgccacgacaugaacacccucucccugccccugaacauccggcgcggcgggagcgacaccaaccucaacuucgacgugcccgacggcauccuggacuuccacaaggugaagcugaccgccgacucccucaagcagaagauccugaaggucacggagcagaucaagaucgagcagaccagccgggacgggaacguggcggaguaccugaagcucgugaacaacgccgacaagcagcaggccggccgcaucaagcaggucuucgagaagaagaaccagaaguccgcccacagcaucgcccagcugcagaagaagcuggagcaguaccaccggaagcuccgcgagaucgagcagaacggcgcgucccggagcuccaaggacaucagcaaggaccaccugaaggacauccaccgcucccugaaggacgcccacgucaagagccggaccgcgccccacugcauggaguccagcaaguccgggaugccgggcgugagccucaccccgcccguguucguguucaacaagucccgcgaguucgccaaccugauccggaacaaguucgggagcgccgacaacaucgcccaccugaagaacagccucgaggaguuccgccccgaggccuccgcccgggccuacggcgggagcgcgacgaucgugaacaagcccaaguacggcuccgacgacgagugcagcuccggcaccagcggguccgccgacagcaacggcaaccaguccuucggggccggcggcgccagcacccuggacucccaggggaagcuggccgucauccucgaggagcugcgcgagaucaaggacacccaggcgcagcuggccgaggacaucgaggcccucaaggugcaguucaagcgggaguacggcuucaucagccagacgcugcaggaggagcgcuaccgguacgagcgccuggaggaccagcuccacgaccugaccgaccugcaccagcacgagaccgccaaccucaagcaggagcuggccuccaucgaggagaagguggcguaccaggccuacgagcgcagccgggacauccaggaggcccuggaguccugccagacccgcaucagcaagcucgagcugcaccagcaggagcagcaggcccugcagacggacaccgucaacgccaaggugcuccuggggcggugcaucaacgugauccuggcguucaugaccgucauccucgugugcguguccaccaucgccaaguucgucagccccaugaugaagucccgcugccacauccugggcacguucuucgccgugacccugcucgccaucuucugcaagaacugggaccacauccugugcgcgaucgagcggaugaucaucccccgcuga

SEQ ID NO: 37755 - RNA, 720 nt, Artificial Sequence
  derived and/or modified sequence opt1 from TMCO1__Homo_sapiens__NP_061899
augccccgcaagcggaagugcgaccugcgcgccgugcgggucggccuccugcucgggggcgggggcguguacgggagccgcuuccgguucaccuuccccggcugccgcgcccugucccccuggcgggugcgcguccagcggcgccggugcgagaugagcaccauguucgcggacacgcugcugaucguguucaucuccgugugcaccgcccuccuggccgagggcaucaccuggguccugguguaccgcaccgacaaguacaagcggcucaaggccgagguggagaagcagagcaagaagcuggagaagaagaaggagacgaucaccgaguccgccgggcgccagcagaagaagaagaucgagcggcaggaggagaagcugaagaacaacaaccgcgaccucagcaugguccggaugaaguccauguucgcgaucggcuucugcuucaccgcccugauggggauguucaacagcaucuucgacggccgcgugguggccaagcugcccuucacgccccucuccuacauccaggggcugagccaccggaaccugcucggcgacgacaccaccgacugcuccuucaucuuccuguacauccugugcaccaugagcauccgccagaacauccagaagauccucggccuggccccgucccgggcggccaccaagcaggccgggggcuuccuggggcccccgccgcccagcggcaaguucuccuga

SEQ ID NO: 37756 - RNA, 1905 nt, Artificial Sequence
  derived and/or modified sequence opt1 from TMCO4__Homo_sapiens__XP_011539488
auggccauguggaaccgccccugccagcggcugccgcagcagccccucguggccgagcccaccgcggagggcgagccccaccucccgaccgggcgcgagcugacggaggccaaccgguucgccuacgccgcccugugcggcaucagccugucccagcuguuccccgagcccgagcacagcuccuucugcaccgaguucauggcggggcucguccaguggcuggagcugagcgaggccgugcuccccaccaugaccgccuucgccuccggccucgggggcgagggcgcggacguguucguccagauccugcugaaggacccgauccugaaggacgaccccacggugaucacccaggaccugcucagcuucucccugaaggacgggcacuacgacgcccgcgcccgggugcuggucugccacaugaccagccuccuccaggugccccuggaggagcuggacgugcuggaggagauguuccuggagucccucaaggagaucaaggaggaggagagcgagauggccgaggccucccgcaagaagaaggagaaccggcgcaaguggaagcgguaccugcugaucggccucgcgaccgucgggggcgggacggugaucggcgugaccggcgggcuggccgcgccccuggucgccgccggcgccgccaccaucaucgggagcgccggcgccgccgcgcucggcuccgccgccgggaucgccaucaugaccagccuguucggcgccgcgggggccggccugacgggguacaagaugaagaagcgcgugggcgccaucgaggaguucaccuuccucccgcugaccgagggccggcagcugcacaucaccaucgccgugacgggguggcucgcguccggcaaguaccgcaccuucagcgcccccugggccgcccuggcccacucccgggagcaguacugccuggcgugggaggccaaguaccucauggagcuggggaacgcccuggagaccauccucagcggccuggccaacauggucgcccaggaggcgcugaaguacaccgugcucuccgggaucguggccgcccugacguggcccgccagccugcucagcgucgccaacgugaucgacaaccccuggggcgugugccugcaccgcuccgcggaggucggcaagcaccuggcccacauccugcucagccggcagcaggggcgccggccggugacccugaucggcuucucccugggggcccgcgugaucuacuucugccuccaggagauggcccaggagaaggacugccagggcaucaucgaggacgucauccugcugggggcgcccguggagggcgaggccaagcacugggagcccuuccggaaggucgugagcggccgcaucaucaacggguacugccggggcgacuggcuccuguccuucguguaccgcaccagcuccguccagcugcgcguggccgggcuccagcccgugcugcugcaggaccggcgcgucgagaacguggaccucaccagcguggucuccggccaccuggacuacgccaagcagauggacgccauccugaaggcggugggcauccggacgaagccggggugggacgagaagggccuccugcuggcccccgggugccuccccagcgaggagccccgccaggccgccgccgcggccuccagcggcgagaccccgcaccagguggggcagacccagggccccaucuccggcgacaccagcaagcuggccauguccacggaccccagccaggcccagguccccguggggcuggaccaguccgagggcgccagccucccggcggccgccucccccgagcggcccccgaucugcagccacgggauggaccccaacccccugggcugccccgacugcgccugcaagacccaggggccgagcaccggccuggacuga

SEQ ID NO: 37757 - RNA, 867 nt, Artificial Sequence
  derived and/or modified sequence opt1 from TMCO5A__Homo_sapiens__XP_005254225
auggagaucagccgccuggcccaguccaagcggaacaucaucagccucaacauggaccuggagcgcgacacccagcggaucgacgaggccaaccagaagcugcuccugaagauccaggagcgcgaggacaagauccagcggcuggaguccgagaucauccagacccgcggccucguggaggacgaggagugggagaaggagaaccggacgaccauggagcgcgagcgggcgcugcaggagcuggaggaggagaccgcccgccucgagcggaagaacaagacccugguccacagcaucacggagcugcagcagaagcucacccgcaagucccagaagaucaccaacugcgagcagagcucccccgacggggcccuggaggagaccaaggugaagcugcagcagcucgaggccagcuacgccugccaggagaaggagcugcugaaggugaugaaggaguacgcguucgucacgcagcucugcgaggaccaggcccuguacaucaagaaguaccaggagacccugaagaagaucgaggaggagcucgaggcccuguuccuggagcgggagguguccaagcucgugagcaugaacccggucgagaaggagcacaccucccagaacaacgagggcacccccacgcagaagaccgcccgccuguucagcaagaagaucuucugcugccuguucuucaucacccucuucuucauccggcugcuguccuacauguucuuccacgugcgcuucaucaaccccgaccuccuggugaacguccugcccaaggugcucgggcggagcacccuguggaagcugcgcugcuucuucuucccgucccucacgcuggagaccgaggacaugcugccccacuga

SEQ ID NO: 37758 - RNA, 660 nt, Artificial Sequence
  derived and/or modified sequence opt1 from TMED10__Homo_sapiens__NP_006818
augagcggccuguccgggcccccggcccgccggggccccuucccccucgcccugcugcuccuguuccugcucgggccccgccuggugcuggcgaucagcuuccaccucccgaucaacucccggaagugccugcgcgaggagauccacaaggaccugcucgugaccggcgccuacgagaucagcgaccaguccgggggcgccggcgggcugcggagccaccugaagaucaccgacuccgccggccacauccucuacagcaaggaggacgccacgaaggggaaguucgcguucaccaccgaggacuacgacauguucgaggugugcuucgaguccaagggcaccgggcgcauccccgaccagcuggugauccuggacaugaagcacggcgucgaggccaagaacuacgaggagaucgccaagguggagaagcucaagccccuggagguggagcugcggcgccucgaggaccugagcgaguccaucgucaacgacuucgccuacaugaagaagcgggaggaggagaugcgcgacacgaacgagagcaccaacacccgggugcuguacuucuccaucuucagcauguucugccucaucggccuggcgaccuggcaggucuucuaccugcgccgguucuucaaggccaagaagcucaucgaguga

SEQ ID NO: 37759 - RNA, 684 nt, Artificial Sequence
  derived and/or modified sequence opt1 from TMED1__Homo_sapiens__NP_006849
augauggccgccggcgcggcccuggcccuggcccuguggcugcucaugcccccgguggaggucgggggcgccgggcccccgcccauccaggacggcgaguucaccuuccugcugcccgcggggcgcaagcagugcuucuaccagagcgcccccgccaacgccucccucgagaccgaguaccaggugaucggcggcgcggggcuggacguggacuucacgcuggagagcccccagggcguccuccugguguccgagagccggaaggccgacggggugcacaccgucgagcccaccgaggccggcgacuacaagcugugcuucgacaacuccuucagcaccaucuccgagaagcucguguucuucgagcugaucuucgacagccugcaggacgacgaggagguggaggggugggccgaggccgucgagccggaggagaugcucgacgugaagauggaggacaucaaggaguccaucgagacgaugcgcacccggcuggagcgcagcauccagaugcugacccuccugcgggcguucgaggcccgcgaccggaaccugcaggagggcaaccucgagcgcgugaacuucugguccgccgucaacguggccgugcugcugcucgucgccgugcuccaggugugcacccugaagcgguucuuccaggacaagcgccccguccccacguga

SEQ ID NO: 37760 - RNA, 606 nt, Artificial Sequence
  derived and/or modified sequence opt1 from TMED2__Homo_sapiens__NP_006806
auggugacccuggccgagcuccugguccugcucgccgcgcugcuggccaccgugagcggcuacuucguguccaucgacgcccacgccgaggagugcuucuucgagcgcgucacgagcgggaccaagaugggccucaucuucgagguggccgagggcggguuccuggacaucgacguggagaucaccgggcccgacaacaagggcaucuacaagggcgaccgggaguccagcgggaaguacaccuucgcggcccacauggacggcacguacaaguucugcuucuccaaccgcaugagcaccaugaccccgaagaucgucauguucaccaucgacaucggggaggcccccaagggccaggacauggagacggaggcccaccagaacaagcuggaggagaugaucaacgagcucgcgguggccaugaccgccgugaagcacgagcaggaguacauggagguccgggagcgcauccaccgggccaucaacgacaacaccaacucccgcguggugcuguggagcuucuucgaggcccugguccucguggcgaugacccuggggcagaucuacuaccugaagcgguucuucgaggugcgccgggucguguga

SEQ ID NO: 37761 - RNA, 468 nt, Artificial Sequence
  derived and/or modified sequence opt1 from TMED3__Homo_sapiens__NP_001288132
augggcagcaccgugccccgcuccgccagcguccugcuccugcugcuccugcugcggcgcgccgagcagcccugcggggcggagcucaccuucgagcugcccgacaacgccaagcagugcuuccacgaggagguggagcagggcgugaaguucucccuggacuaccaggucaucaccgggggccacuacgacguggacugcuacguggaggacccccaggggaacacgaucuaccgggagaccaagaagcaguacgacagcuucaccuaccgcgccgaggucaagggcguguaccaguucugcuucuccaacgaguucagcacguucucccacaagaccguguacuucgacuuccaggucggcgacgagcccccgauccuccccgacauggggaaccgggugaccgcccugacccagggccccagcgccucccccacgccgaccccgccccugcgcgugcccgucuga

SEQ ID NO: 37762 - RNA, 684 nt, Artificial Sequence
  derived and/or modified sequence opt1 from TMED4__Homo_sapiens__NP_872353
auggccggcgugggggccggcccccugcgcgcgauggggcggcaggcccuccugcugcucgcccugugcgccaccggcgcccaggggcuguacuuccacaucggcgagaccgagaagcgcugcuucaucgaggagaucccggacgagacgauggucaucggcaacuaccggacccagaugugggacaagcagaaggagguguuccuccccagcacccccgggcugggcaugcacguggaggucaaggaccccgacgggaagguggugcugucccgccaguacggcagcgaggggcgguucaccuucacgucccacaccccgggcgaccaccagaucugccuccacagcaacuccacccgcauggcgcuguucgccggcgggaagcugcggguccaccucgacauccaggugggcgagcacgccaacaacuaccccgagaucgccgcgaaggacaagcugaccgagcugcagcuccgcgcccggcagcugcuggaccagguggagcagauccagaaggagcaggacuaccagcgcuaccgggaggagcgcuuccggcucacgagcgaguccaccaaccagcgcguccugugguggagcaucgcccagaccgugauccugauccucaccgggaucuggcagaugcggcaccugaaguccuucuucgaggccaagaagcugguguga

SEQ ID NO: 37763 - RNA, 675 nt, Artificial Sequence
  derived and/or modified sequence opt1 from TMED7__Homo_sapiens__NP_861974
augccccgccccggcagcgcccagcggugggccgcgguggccgggcgcuggggcugccggcugcucgcccugcugcuccugguccccgggcccggcggggccuccgagaucaccuucgagcugcccgacaacgccaagcagugcuucuacgaggacaucgcgcagggcaccaagugcacgcucgaguuccaggugaucaccggcgggcacuacgacguggacugccgccuggaggacccggacggcaagguccuguacaaggagaugaagaagcaguacgacagcuucaccuucaccgccuccaagaacgggacguacaaguucugcuucagcaacgaguucuccaccuucacccacaagaccguguacuucgacuuccaggugggcgaggacccgccccucuuccccagcgagaaccgggucuccgcccugacgcagauggagagcgccugcguguccauccacgaggcgcucaagagcgugaucgacuaccagacccacuuccgccugcgggaggcccaggggcgcucccgggccgaggaccugaacacccgcgucgccuacuggagcgugggcgaggcccugauccuccugguggucuccaucggccagguguuccugcucaagagcuucuucuccgacaagcggaccacgaccacccgcguggggagcuga

SEQ ID NO: 37764 - RNA, 1215 nt, Artificial Sequence
  derived and/or modified sequence opt1 from TMED7-TICAM2__Homo_sapiens__NP_001157940
augccccgcccgggcagcgcccagcggugggccgcgguggccgggcgcuggggcugccggcugcucgcccugcugcuccugguccccgggcccggcggggccuccgagaucaccuucgagcugcccgacaacgccaagcagugcuucuacgaggacaucgcgcagggcaccaagugcacgcucgaguuccaggugaucaccggcgggcacuacgacguggacugccgccuggaggacccggacggcaagguccuguacaaggagaugaagaagcaguacgacagcuucaccuucaccgccuccaagaacgggacguacaaguucugcuucagcaacgaguucuccaccuucacccacaagaccguguacuucgacuuccaggugggcgaggacccgccccucuuccccagcgagaaccgggucuccgcccugacgcagauggagagcgccugcguguccauccacgaggcgcucaagagcgugaucgacuaccagacccacuuccgccugcgggaggcccaggggcgcucccgggccgaggaccugaacacccgcgucgccuacuggcacagcguggacaccucccccggcuaccacgagagcgacuccaagaaguccgaggaccugagccucugcaacguggccgagcacagcaacacgaccgagggccccaccgggaagcaggagggcgcgcaguccgucgaggagauguucgaggaggaggccgaggaggagguguuccugaaguucgugauccugcacgccgaggacgacaccgacgaggcccuccggguccagaaccugcugcaggacgacuucgggaucaagcccggcaucaucuucgccgagaugcccugcggccgccagcaccuccagaaccuggacgacgcggugaacgggagcgccuggacgauccugcuccugaccgagaacuuccugcgggacaccuggugcaacuuccaguucuacaccagccucaugaacuccgugaaccgccagcacaaguacaacagcgucaucccgaugcggccccugaacaacccccugccccgcgagcggacgccguucgcccuccagaccaucaacgcccuggaggaggagucccgcggcuuccccacccagguggagcggaucuuccaggagagcguguacaagacccagcagacgaucuggaaggagacccgcaacaugguccagcggcaguucaucgccuga

SEQ ID NO: 37765 - RNA, 708 nt, Artificial Sequence
  derived and/or modified sequence opt1 from TMED9__Homo_sapiens__NP_059980
auggccguggagcugggcguccuccuggugcgcccccggccggggaccggccuggggcgcgugaugcggacccuccugcugguccucuggcuggccacgcgcggcagcgcgcuguacuuccacaucggggagaccgagaagaagugcuucaucgaggagauccccgacgagaccauggugaucggcaacuaccggacccagcucuacgacaagcagcgcgaggaguaccagcccgccacgcccggccuggggauguucguggaggucaaggacccggaggacaaggugauccuggcccggcaguacggcuccgaggggcgcuucaccuucaccagccacacccccggcgagcaccagaucugccuccacuccaacagcacgaaguucucccuguucgccgggggcaugcugcgggugcaccucgacauccaggucggcgagcacgccaacgacuacgcggagaucgccgccaaggacaagcugagcgagcugcagcuccgcgugcggcagcugguggagcaggucgagcagauccagaaggagcagaacuaccagcgcuggcgggaggagcgcuuccggcagaccuccgagagcaccaaccagcgcgugcuguggugguccauccuccagacccugauccugguggccaucggggucuggcagaugcggcaccucaagagcuucuucgaggcgaagaagcugguguga

SEQ ID NO: 37766 - RNA, 1143 nt, Artificial Sequence
  derived and/or modified sequence opt1 from TMEFF1__Homo_sapiens__NP_003683
augggcgccgccgcggccgaggcgccccugcgccucccggccgccccgccccuggcguucugcugcuacaccagcgugcugcuccuguucgccuucucccugcccgggagccgggccuccaaccagccgcccggcgggggcgggggcagcggcggggacugccccggcgggaagggcaaguccaucaacugcagcgagcucaacguccgcgaguccgacgugcgggugugcgacgagagcuccugcaaguacgggggcgucugcaaggaggacggcgacgggcugaagugcgccugccaguuccagugccacaccaacuacauccccgugugcggcagcaacggggacacguaccagaacgagugcuuccugcgccgggcggccugcaagcaccagaaggagaucaccgugaucgcccgcggccccugcuacuccgacaacggcagcggguccggcgagggggaggaggagggcagcggggccgagguccaccggaagcacuccaagugcggccccugcaaguacaaggccgagugcgacgaggacgccgagaacgugggcugcgugugcaacaucgacugcagcggguacuccuucaaccccgucugcgccagcgacggcuccagcuacaacaaccccugcuucgugcgcgaggccagcugcaucaagcaggagcagaucgacauccggcaccucgggcacugcaccgacaccgacgacacgucccugcugggcaagaaggacgacgggcuccaguaccgcccggacgugaaggacgccagcgaccagcgggaggacgucuacaucggcaaccacaugcccugccccgagaaccugaacggcuacugcauccacgggaagugcgaguucaucuacuccacccagaaggccagcugccgcugcgaguccggcuacaccgggcagcacugcgagaagaccgacuucagcauccuguacguggugcccucccggcagaagcucacgcacguccugaucgcggccaucaucggcgccgugcagaucgccaucaucguggccaucgucaugugcaucacccgcaagugcccgaagaacaaccgggggcgccggcagaagcagaaccugggccacuucaccagcgacaccuccagccgcaugguguga

SEQ ID NO: 37767 - RNA, 1125 nt, Artificial Sequence
  derived and/or modified sequence opt1 from TMEFF2__Homo_sapiens__NP_057276
auggugcugugggagagcccccgccagugcuccagcuggacccucugcgagggcuucugcuggcugcugcuccugccggucaugcugcucaucguggcccggcccgugaagcuggccgcguuccccaccucccugagcgacugccagacgcccaccggguggaacugcuccggcuacgacgaccgcgagaacgaccucuuccugugcgacaccaacacgugcaaguucgacggggagugccugcggaucggcgacaccgugaccugcgucugccaguucaagugcaacaacgacuacgugccggucugcgggagcaacggcgaguccuaccagaacgagugcuaccuccgccaggccgccugcaagcagcagagcgagauccuggugguguccgagggcagcugcgccaccgacgccggguccggcagcggggacggcguccacgagggguccggcgagaccagccagaaggagacguccacgugcgacaucugccaguucggcgcggagugcgacgaggacgccgaggacguguggugcgugugcaacaucgacugcagccagaccaacuucaacccccugugcgccuccgacggcaagagcuacgacaacgccugccagaucaaggaggcguccugccagaagcaggagaagaucgaggucaugagccucgggcggugccaggacaacaccaccaccaccaccaagagcgaggacgggcacuacgcccgcacggacuacgccgagaacgccaacaagcuggaggaguccgcccgggagcaccacauccccugccccgagcacuacaacggcuucugcaugcacggcaagugcgagcacagcaucaacaugcaggagccguccugccgcugcgacgcgggguacaccggccagcacugcgagaagaaggacuacagcgugcuguacgugguccccgggcccgugcgguuccaguacgugcucaucgccgccgucaucggcaccauccagaucgccgugaucugcguggucgugcugugcaucacccgcaagugcccccgguccaaccgcauccaccggcagaagcagaacacggggcacuacagcuccgacaacaccacccgcgccagcacccggcugaucuga

SEQ ID NO: 37768 - RNA, 405 nt, Artificial Sequence
  derived and/or modified sequence opt1 from TMEM100__Homo_sapiens__NP_060756
augaccgaggagcccaucaaggagauccugggcgccccgaaggcccacauggcggccaccauggagaagucccccaagagcgagguggucaucacgaccgugccccucgugagcgagauccagcugauggccgccaccgggggcaccgagcuguccugcuaccgcugcaucauccccuucgccgucgugguguucaucgcggggaucgucgugacggccguggccuacagcuucaacucccacggcagcaucaucuccaucuucgggcucgucgugcugagcuccggccuguuccuccuggccagcuccgcgcugugcuggaaggugcggcagcgcagcaagaaggccaagcggcgcgagucccagaccgcccucgucgccaaccagcggagccuguucgccuga

SEQ ID NO: 37769 - RNA, 774 nt, Artificial Sequence
  derived and/or modified sequence opt1 from TMEM101__Homo_sapiens__XP_011523653
auggccagcaagaucggcucccgccgguggaugcugcagcucaucaugcagcuggggagcgugcugcucacccgcugccccuucuggggcugcuucucccagcugaugcuguacgccgagcgggcggaggcccgccggaagccggacauccccguccccuaccucuacuucgacaugggggccgccgugcugugcgccagcuucauguccuucggcgugaagcgccggugguucgcgcugggggccgcccuccagcuggccaucagcaccuacgcggccuacaucggcggcuacguccacuacggggacuggcugaaggugcgcauguacucccggacgguggccaucaucggcggguuccucguccuggccagcggcgccggggagcuguaccgccggaagccccgcucccggagccuccaguccaccggccagguguuccugggcaucuaccugaucugcguggcguacagccuccagcacuccaaggaggaccgccuggccuaccugaaccaccuccccgggggcgagcugaugauccagcuguucuucguccucuacgggauccuggcccuggccuuccucagcggcuacuacgugacccuggccgcgcagauccuggccgugcuccugccgcccgucaugcugcucaucgacggcaacguggccuacuggcacaacacccggcgcguggaguucuggaaccagaugaagcugcugggggaguccgucggcaucuucgggacggccgugauccucgccaccgacggcuga

SEQ ID NO: 37770 - RNA, 390 nt, Artificial Sequence
  derived and/or modified sequence opt1 from TMEM105__Homo_sapiens__NP_848615
augcugcucaaggugcgccgggccagccugaagcccccggccacgccccaccagggcgcguuccgcgccgggaacgucaucggccagcugaucuaccuccugaccuggucccuguucaccgccuggcuccggccgcccacccugcugcaggggccccgcaccagcccccagggcuccccgccccggagccccuggggcgacugcgccgagcccuccugccucugcgagaugaagauccgccggcgccggcacgaggggcccgccuggggccagagcggguuccuggcgggcgggcugcaccucgugcccuccagccugucccuggccgccugcggcgugguccgcaugaaggggcucuggggccggggcgccgggauccgcggccgguga

SEQ ID NO: 37771 - RNA, 825 nt, Artificial Sequence
  derived and/or modified sequence opt1 from TMEM106B__Homo_sapiens__XP_005249846
augggcaagagccugucccaccucccccugcacagcuccaaggaggacgccuacgacggggugaccagcgagaacaugcgcaacggccuggucaacuccgaggugcacaacgaggacgggcggaacggcgacgugagccaguucccguacgucgaguucaccgggcgcgacuccgugacgugcccgaccugccagggcaccggccggaucccccgcgggcaggagaaccagcucguggcccugauccccuacagcgaccagcggcugcgcccccggcgcaccaagcucuacgucauggcguccguguucgugugccugcugcucagcggccuggccgucuucuuccuguucccccgguccaucgacgugaaguacaucggggucaagagcgccuacguguccuacgacgugcagaagcgcacgaucuaccucaacaucaccaacacccugaacaucaccaacaacaacuacuacagcguggaggucgagaacaucacggcccaggugcaguucuccaagaccgugaucggcaaggcccggcugaacaacaucaccaucaucgggccccucgacaugaagcagaucgacuacaccguccccacggugaucgcggaggagaugagcuacauguacgacuucugcacccugaucuccaucaaggugcacaacaucguccugaugaugcaggucaccgugaccacgaccuacuucggccacagcgagcagaucucccaggagcgcuaccaguacguggacugcggccggaacaccaccuaccagcucgggcagagcgaguaccugaacgugcugcagccgcagcaguga

SEQ ID NO: 37772 - RNA, 318 nt, Artificial Sequence
  derived and/or modified sequence opt1 from TMEM108__Homo_sapiens__NP_001269794
augaagcgcagccugcaggcccucuacugccagcugcugaccgugcuccugaccgucugcugcaugaagcggaagaagaagacggccaaccccgagaacaaccuguccuacuggaacaacaccaucaccauggacuacuucaaccgccacgcgguggagcucccgcgggagauccagagccuggagaccuccgaggaccagcugagcgagccccgcucccccgccaacggcgacuaccgggacacggggauggugcucgucaaccccuucugccaggagacccuguucgugggcaacgaccaggugagcgagaucuga

SEQ ID NO: 37773 - RNA, 429 nt, Artificial Sequence
  derived and/or modified sequence opt1 from TMEM114__Homo_sapiens__NP_001277026
augaaccccuuccgccuggagaacgugaccgucagcgaguccagccggcagcuccugaccaugcacggcacguucgugauccugcucccgcugucccugauccucaugguguucgggggcaugaccggguuccugagcuuccugcuccaggccuaccugcugcuccugcugaccggcauccucuuccuguucggggccauggucacccuggcgggcaucuccguguacaucgccuacagcgccgccgccuuccgcgaggcgcucugccugcuggaggagaaggcccuccuggaccagguggacaucuccuucggcuggagccuggcccucggguggaucuccuucaucgccgagcugcugacgggcgcggccuuccucgccgccgcccgggagcugagccugcgccggcgccaggaccaggcgaucuga

SEQ ID NO: 37774 - RNA, 1056 nt, Artificial Sequence
  derived and/or modified sequence opt1 from TMEM115__Homo_sapiens__NP_008955
augcagcgcgcccugcccggcgcccggcagcaccucggggccauccuggccagcgccuccguggucgugaaggcccugugcgccgcgguccucuuccuguaccugcucagcuucgccguggacaccggcugccuggccgugaccccgggguaccuguucccgcccaacuucuggaucuggacgcucgccacccacggccugauggagcagcacgugugggacgucgcgaucucccugaccaccgugguggucgccgggcgccuccuggagccccuguggggcgcccucgagcugcugaucuucuucagcguggugaacgucuccgugggccuccugggggccuucgccuaccugcucacguacauggcgagcuucaaccugguguaccuguucaccguccggauccacggcgcccucggguuccugggcggggugcugguggcccucaagcagaccaugggcgacugcgucgugcugcgcgugccccagguccggguguccgugaugcccaugcugcuccuggcccugcuccugcugcuccgccuggccacccugcuccagagccccgcgcuggccuccuacggcuucgggcugcucagcuccugggucuaccugcgguucuaccagcgccacagccggggccgcggggacauggccgaccacuucgccuucgccacguucuuccccgagauccugcagccgguggucggccuccuggcgaaccuggugcacucccuccuggugaaggucaagaucugccagaagaccgugaagcgguacgacgugggcgcccccagcuccaucaccaucagccugcccgggaccgacccccaggacgccgagcgccggcgccagcuggcccucaaggcccugaacgagcggcugaagcgcgucgaggaccaguccaucuggccgagcauggacgacgacgaggaggaguccggcgcgaagguggacagcccccuccccagcgacaaggcccccacgccgcccgggaagggcgccgcccccgaguccagccugaucaccuucgaggcggcgcccccgacccuguga

SEQ ID NO: 37775 - RNA, 1233 nt, Artificial Sequence
  derived and/or modified sequence opt1 from TMEM117__Homo_sapiens__NP_001273141
auggcgaccugccacagccaccgcaccaacuccuggcagaucagcgugcccuccgccuucgucuggagcguggccccgaucaagaacgugucccggcgcagcugggucguggacgacaacgugcugcagcacaacucccucagccugcacaucuucucccacauccagcacgacagcuccaacggcugggagcacggggucacggacaugaugcugcaggacaagcccuaccccgacuggggcaagagcgcccgggccuucuggaagaaggggaacgugcgcaucacccucuucuggaccgugcuguucacccugacguccgucguggugcucgucaucaccaccgacuggaucagcugggacaagcugaaccggggcuuccugcccuccgacgaggugagccgcgccuuccucgccuccuucauccugguguucgaccugcucaucgucaugcaggacugggaguucccgcacuucaugggggacguggacgugaaccugcccggccugcacacgccccacaugcaguucaagauccccuucuuccagaagaucuucaaggaggaguaccggauccacaucaccggcaagugguucaacuacgggaucaucuuccucguccugauccuggaccucaacauguggaagaaccagaucuucuacaagccgcacgaguacggccaguacaucgggcccggccagaagaucuacaccgugaaggacagcgagucccugaaggaccugaaccgcaccaagcucagcugggaguggcggagcaaccacaccaacccccgcacgaacaagaccuacguggagggggacauguuccugcacucccgguucaucggcgcgagccuggacgucaagugccucgccuucgugcccucccugaucgccuucgugugguucggcuucuucaucugguucuucgggcgcuuccugaagaacgagccgcggauggagaaccaggacaagaccuacacccgcaugaagcgcaagagccccuccgagcacagcaaggacaugggcaucacgcgggagaacacccaggccuccgucgaggacccccucaacgaccccagccuggugugcauccgguccgacuucaacgagaucgucuacaagagcucccaccugaccagcgagaaccucuccagccagcugaacgaguccaccagcgcgacggaggccgaccaggacccgaccaccuccaagagcacccccacgaacuga

SEQ ID NO: 37776 - RNA, 579 nt, Artificial Sequence
  derived and/or modified sequence opt1 from TMEM11__Homo_sapiens__NP_003867
auggccgccuggggccgccggcgccuggggcccggcagcuccgggggcagcgcgcgggagcgcgugucccucagcgccaccgacugcuacaucguccacgagaucuacaacggggagaacgcccaggaccaguucgaguacgagcuggagcaggcccuggaggcccaguacaaguacaucgugaucgagccgacccggaucggcgacgagacggcgcgcuggaucaccgugggcaacugccuccacaagaccgccguccuggccgggaccgccugccuguucacgccccucgcgcugccccuggacuacucccacuacaucagccuccccgccggcgugcugucccuggccugcugcacccucuacgggaucagcuggcaguucgacccgugcugcaaguaccagguggaguacgacgccuacaagcugucccggcugccccuccacacccugaccagcuccacgcccgucgugcuggugcgcaaggacgaccuccaccggaagcgccugcacaacaccaucgcccuggcggcccucgucuacugcgugaagaagaucuacgagcuguacgccguguga

SEQ ID NO: 37777 - RNA, 378 nt, Artificial Sequence
  derived and/or modified sequence opt1 from TMEM126A__Homo_sapiens__NP_001231664
auggccggcauccccuuccugaccaccgaccucacguaccgcugcuucgugagcuucccgcugaacaccggggaccuggacugcgagaccugcaccaucacgcgguccggccucaccgggcuggucaucggcgggcuguaccccguguuccucgccauccccgugaacggcggccuggcggcccgcuaccagagcgcccugcucccccacaaggggaacauccuguccuacuggauccggaccagcaagccggucuuccgcaagaugcuguuccccauccuccugcagaccauguucuccgccuaccugggcagcgagcaguacaagcuccugaucaaggcccugcagcucuccgagcccgggaaggagauccacuga

SEQ ID NO: 37778 - RNA, 717 nt, Artificial Sequence
  derived and/or modified sequence opt1 from TMEM127__Homo_sapiens__NP_001180233
auguacgcccccggcggggccggccugcccgggggccgccggcgccggagccccgggggcuccgcgcuccccaagcagcccgagcgcagccuggccuccgcccugccgggcgcccucagcaucaccgcccugugcaccgcgcuggccgagcccgccuggcuccacauccacgggggcacgugcucccggcaggagcugggggugagcgacguccugggcuacgugcaccccgaccuccugaaggacuucugcaugaacccccagaccgugcugcuccugcgcgucaucgccgcguucugcuuccuggggauccucugcucccugagcgccuuccugcucgacguguucggcccgaagcaccccgcccugaagaucacccggcgcuacgccuucgcccacauccugaccgugcuccagugcgcgacggucaucggcuucuccuacugggccagcgagcugauccuggcccagcagcagcagcacaagaaguaccacgggucccagguguacgugaccuucgccgucagcuucuaccucguggccggcgccgggggcgcguccauccuggccaccgccgccaaccugcuccggcacuaccccaccgaggaggaggagcaggcgcuggagcugcucagcgagauggaggagaacgagcccuacccggccgaguacgaggugaucaaccaguuccagcccccgcccgccuacacgccguga

SEQ ID NO: 37779 - RNA, 498 nt, Artificial Sequence
  derived and/or modified sequence opt1 from TMEM128__Homo_sapiens__NP_001284480
auggacagcucccgcgcccggcagcagcugcgccggcgcuuccuccugcugcccgacgccgaggcgcagcucgaccgggagggcgacgccgggccggagaccagcaccgccguggagaagaaggagaagccccugccccgccugaacauccacuccggcuucuggauccucgccagcaucgucgugaccuacuacguggacuucuucaagacccugaaggagaacuuccacaccuccagcugguuccugugcggguccgcccuccugcuggucagccucuccaucgcguucuacugcaucguguaccuggagugguacugcggcaucggggaguacgacgugaaguaccccgcccugaucccgaucaccacggccagcuucaucgccgcgggcaucugcuucaacaucgcccucuggcacgucugguccuucuucacgccccugcuccuguucacccaguucaugggcguggugauguucaucacccugcugggguga

SEQ ID NO: 37780 - RNA, 3075 nt, Artificial Sequence
  derived and/or modified sequence opt1 from TMEM132A__Homo_sapiens__NP_060340
augugcgcccgcauggccggccggaccaccgcggccccccgcgggccguacggccccuggcugugccuccugguggcccuggcccucgacgucgugcggguggacugcgggcaggccccccuggaccccgucuaccugccggcggcccucgagcugcuggacgcccccgagcacuuccgcgugcagcaggugggccacuacccccccgccaacagcucccucagcucccggagcgagacguuccugcugcuccagccguggccccgcgcgcagccccugcugcgggccuccuaccccccguucgccacccagcaggucgugcccccccgcgugaccgagccccaccagcggccgguccccugggacgugcgcgccgugagcgucgaggccgcggugacccccgccgagcccuacgcccgggugcucuuccaccugaaggggcaggacuggccgcccggcuccggcagccugcccugcgcccgccuccacgccacgcaccccgcggggaccgcccaccaggccugccgguuccagccgucccugggcgccugcgucguggagcuggagcuccccagccacugguucucccaggccagcaccacccgcgcggagcuggccuacacgcuggagcccgccgccgaggggcccggcgggugcggcuccggcgaggagaacgacccgggggagcaggcccuccccgugggcggggucgagcugcggcccgcggacccgccccaguaccaggaggugccccuggacgaggccgugacccuccgcguccccgacaugccggugcggcccggccagcuguucagcgccacccugcuccugcgccacaacuucaccgccucccugcucacgcugcggaucaaggugaagaagggccugcacgucaccgcggcccgccccgcccagcccacccucuggaccgccaagcuggaccgguucaaggggagccgccaccacacgacccugaucaccugccaccgcgccggccucaccgagccggacuccagcuccccccuggagcugagcgaguuccucuggguggacuucgucguggagaacagcacggggggcgggguggcggucacccggcccgugaccuggcagcuggaguaccccggccaggccccggaggccgagaaggacaagauggugugggagauccuggucuccgagcgcgacauccgggcccucaucccccuggccaaggcggaggagcuggugaacaccgccccccucacgggcgugccccagcacgucccggugcgccuggugaccgucgacgggggcggggcccugguggaggugaccgagcacgucggcugcgagagcgccaacacccaggugcugcagguguccgaggccugcgacgcggucuucguggccgggaaggagagccggggcgcccgcggcgugcgggucgacuucugguggcgccggcuccgcgccucccugcggcugacggugugggcgccccuccugccccugcgcaucgagcucaccgacaccacccuggagcaggugcggggguggcgcguccccggcccggccgaggggcccgccgagcccgccgccgaggcgagcgacgaggccgagcggcgcgcccggggcugccaccugcaguaccagcgcgccggggugcgguuccucgcccccuucgcggcccacccgcuggacggcggccgccgccugacgcaccuccuggggcccgacuggcugcucgacgugucccaccuggucgccccccacgcccgggugcuggacagccgcguggccucccucgagggcgggcgggucguggugggccgcgagccgggcgucaccagcaucgaggugcgguccccccugagcgacuccauccugggggagcaggcgcucgccgugaccgacgacaaggucagcgugcuggagcugcgcgugcagcccgucaugggcaucucccucacccugagccgggggacggcccaccccggcgaggugaccgccaccugcugggcgcaguccgcccugccggcccccaagcaggagguggcccucagccuguggcuguccuucagcgaccacaccgucgcccccgcggagcucuacgaccgccgggaccuggggcugagcguguccgccgaggagcccggcgccauccucccggccgaggagcagggcgcccagcuggggguggucgugagcggcgcgggggccgagggccugccccuccacguggcccugcacccccccgagccgugccgccgggggcgccaccgggucccccuggccuccggcaccgccuggcucggccugccccccgcgagcacgccggcccccgcccugcccuccagccccgccugguccccgcccgccaccgaggcgaccauggggggcaagcgccagguggccgggagcgugggcgggaacaccggcguccggggcaaguucgagcgcgccgaggaggaggcccggaaggaggagacggaggcgcgcgaggaggaggaggaggaggaggaggagauggugcccgccccccagcacgucaccgagcucgagcuggggauguacgcccugcucggcguguucugcguggccaucuucaucuuccuggucaacggggugguguucguccugcgguaccagcgcaaggagccgcccgacuccgccaccgaccccaccagcccccagccgcacaacuggguguggcucggcacggaccaggaggagcugucccggcagcuggaccgccagagccccgggcccccgaagggcgagggcuccugccccugcgagagcgggggcgggggcgaggcgcccacccucgcccccggcccgcccgggggcaccaccuccagcuccagcacgcuggcccgcaaggaggccgggggccggcgcaagcggguggaguucgucaccuucgcccccgcgcccccggcccagagccccgaggagcccgugggggcccccgccgugcaguccauccuggucgccggcgaggaggacauccgcugggugugcgaggacaugggccucaaggacccggaggagcugcggaacuacauggagcgcauccgggggagcuccuga

SEQ ID NO: 37781 - RNA, 3237 nt, Artificial Sequence
  derived and/or modified sequence opt1 from TMEM132B__Homo_sapiens__NP_443139
auguucggcgccgccagccgcauggacaccaccgcggugugcaccgggggcgucaccgagucccgggggaucguggacagccugcagaaguucuccagccuccccgccuaccugccgaccaaccugcacaucuccaacgccgaggagagcuucuuccucaaggaggccaaccaggaccugacccgcaacuccagccugcaggcccggguggagcccuucuucaucuaccgcgcgcggacgccgcccaucaucaacgccuccuacggccccuucagcgucgagaagaucaucccccaggagcuccugcugaccuccaccgccuucgggaacauggacaaguuccccuucaacuggaagcucaagagccacauccuggacuccagcaucuacuccaaccgccccaaggugcagacccuguucuacgugacgggcaugggcugggacgacagcgaccucaccgaggaccugccgugcgucaagauguucgccuuccccgaggcgcgggagguggccgccuccugccgccugcagggggcccccggccucugcguggccgagcuggagcugcuccccgagugguucagcuccgggcuggaccuggagccggaggaggagauccccgcgcuccugggcgggaccaccauggagcuguucuucacgcucuaccccgccgacaaggccggccagugcccccuggaggaggagggcaagugggagaacaacauccacagcgggcuggagagcccgcagcaggccuuccccgcccgggagcgcaucggcuccgucgugguguaccccacccaggacgaccucaaguggagccuggucucccuggacgagaacguggugaucagcgucccccucaaccuggugcgggagggggacaccgcgaccuuccuggugucccucacgagcuccagcgucgccgaccaguucacccugcgcaucaaggccgccgccggcgugaagaucaccgcggugcgggucuccagcgaggaccagugggccgugcaggaggagaucgacaacggcuccacccagacgagcgccacccugaccugcauggggcaccgcccggacacccagucccgggugaacggcagcuucuacgagauccuccaggucgacuucgggaucgacaacuccagcgaccuggccggcgcccagcagaucacguggcaggucgaguaccccaucgaggacuccaugagcgagcuggugguguccgagaucuucgugagccagaccaccuucgucgggaucgugccccucgcgauggacaccgaggugcugaacacggccauccugaccggcaagcccgucagcgugccggugaaggucgugggcgugcaggaggacggguccgucguggacgugagcgaguccgucgagugcaagagcgccgacgaggacgugaucaagguguccaacaacugcgacagcaucuucgucaacggcaaggagaugaaguccaagguggacaccaucgugaacuucacccaccagcacuucacgagccaguucgaggucaccgugugggcgccccgccucccccugcagaucgagaucuccgacaccgagcugagccagaucaagggguggcggauccccguggccgccaaccgccggccgacccgcgaguccgacgacgaggacgacgaggagaagaagggccgggggugcagccuccaguaccagcacgccacgguccgcgugcugacccaguucguggccgagucccccgaccugggccagcucaccuacaugcugggccccgacuggcaguucgacaucaccgaccuggucaccgaguucaugaagguggaggagccgaagaucgcccagcugcaggacgggcgcacgcucgcgggccgggagcccgggaucaccaccgugcagguccugagcccccuguccgacagcauccucgccgagaagaccgugaucgugcuggacgaccgcgucacgaucgccgagcugggcgugcagcucguggccgggaugucccugagccugcagccccaccgggccgacaagcgcgcgaucgucagcaccgccgccgcccucgacgugcugcaguccccgcagcaggaggccaucgugagcuccuggauccuguucagcgacggcuccgucacgccccucgacaucuacgaccccaaggacuacagcgugaccguguccagccuggacgagauggucguguccgugcaggcgaaccuggagagcaaguggcccaucgucguggccgagggcgaggggcagggcccgcucaucaagcuggagaugaugaucuccgagcccugccagaagacgaagcgcaagagcgugcuggccgucgggaagggcaacgugaaggugaaguucgagcccuccagcgacgagcaccagggcggguccaacgacaucgagggcaucaaccgggaguacaaggaccaccucagcaacuccaucgagcgggaggggaaccaggagcgcgccguccaggagugguuccaccggggcacccccguggggcaggaggagagcaccaacaaguccaccacgccgcagagccccauggagggcaagaacaagcugcucaagagcggcgggcccgacgcguucaccuccuuccccacccagggcaagagcccggaccccaacaaccccuccgaccugaccgucacgagccgcgggcugaccgaccuggagaucggcauguacgcccuccugugcguguucugccuggccauccucguguuccugaucaacugcgucgccuucgccuggaaguaccggcacaagcgcuucgcgguguccgagcaggggaacaucccccacagccacgacuggguguggcugggcaacgaggucgagcuccuggagaacccgguggacaucacccugcccuccgaggagugcaccacgaugaucgaccggggccuccaguucgaggagcgcaacuuccugcugaacgggagcucccagaagaccuuccacagccagcuccugcggcccuccgacuacguguacgagaaggagaucaagaacgagcccaugaacagcuccggcccgaagcgcaagcgggucaaguucaccagcuacaccacgauccugcccgaggacgggggccccuacaccaacuccauccucuucgacagcgacgacaacaucaagugggugugccaggacauggggcugggcgacucccaggacuuccgcgacuacauggagagccugcaggaccagauguga

SEQ ID NO: 37782 - RNA, 3327 nt, Artificial Sequence
  derived and/or modified sequence opt1 from TMEM132C__Homo_sapiens__NP_001129575
augcgcagcgagggcgccgcccccgggccggcggcgccccugugcggcgcccucucccugcugcucggggcccugcugggcaaggugaucgaggggcacggcgucaccgacaacauccagcgguucagcucccucccgcccuaccugcccgugagcuaccacauccugcgcgccgagaccuccuucuuccucaaggaggcgaaccaggaccugcugcggaacagcucccuccaggcccgcguggagagcuucuucacguacaagacccggcagccgcccguccugaacgccuccuacggccccuucagcguggagaagguggucccccuggaccucaugcugaccuccaacuuccuggggcccaccaacaaguucagcuucgacuggaagcucaaggcccacauccugcgcgacaagguguaccugucccggcccaaggugcagguccucuuccacaucaugggccgcgacugggacgaccacggggcgggcgagaagcugcccugccugcggguguucgccuuccgcgagacgcgggaggugcgcgggagcugccggcucaagggcgaccugggccugugcgucgccgagcucgagcugcuguccagcugguucuccgccccgaccgugggggccggccgcaagaaguccauggaccagcccgaggggacccccguggagcucuacuacaccguccaccccggcaacgagcggggcgacugcgccgggggcgacuuccgcaaggggaacgccauccggccgggcaaggacgggcuggaggagacgaccucccaccuccagcgcaucggcaccgugggccucuaccgggcccaggacagcgcccagcugagcgagcugcgccucgacgggaacguggucaucuggcugcccucccggcccgugaagcagggcgagguggucaccgccuacgugacgaucagcuccaacagcuccguggaccuguucauccuccgcgcgaaggucaagaagggggugaacauccugagcgcccagacccgcgagccccggcaguggggcgucaagcaggaggugggguccggcggcaagcacgugaccgccaccgucgccugccagcgccuggggccgagcccccggaaccgcagcagcucccuguucaacgagguggugcagaugaacuucgagaucgccagcuucuccagccuguccggcacgcagcccaucaccuggcaggucgaguacccccggaaggggaccaccgacaucgcggugagcgagaucuucgugucccagaaggaccuggucggcaucgugccgcucgccauggacacggagauccugaacaccgccgugcugaccgggaagaccgucgccaugcccaucaagguggugagcgucgaggagaacuccgccgugauggacaucagcgagagcguggagugcaaguccacggacgaggacgucaucaaggugagcgagcgcugcgacuacaucuucgugaacggcaaggagaucaagggcaagauggacgcggucgugaacuucaccuaccaguaccucuccgcgccccugugcgugaccgucugggugccccggcugccgcugcagaucgaggugagcgacaccgagcucucccagaucaagggguggcgcguccccaucgugacgaacaagcggcccacccgcgagagcgaggacgaggacgaggaggagcggcgcggccgggggugcgcccugcaguaccagcacgccaccgugcgcguccugacccaguucguguccgagggcgccggcccgugggggcagcccaacuaccuccugagccccaacuggcaguucgacaucacgcaccugguggccgacuucaugaagcucgaggagccccacgucgccacccugcaggacucccgggugcuggugggccgcgaggucgggaugaccaccauccaggugcucagcccgcuguccgacagcauccuggccgagaagacgaucaccgugcucgacgacaaggucuccgugaccgaccuggccauccagcugguggcgggccucagcgucgcccuguaccccaacgccgagaacuccaaggccgugaccgccguggucaccgcggaggaggugcugcggacgcccaagcaggaggccguguucagcaccuggcuccaguucuccgacgggagcgucacgccccuggacaucuacgacaccaaggacuucagccuggccgccaccucccaggacgaggccguggugagcgucccgcagccccgcagcccccgguggcccguggucguggcggagggcgagggccaggggccgcucauccgcguggacaugaccaucgccgaggccugccagaaguccaagcgcaaguccauccuggccgucggcguggggaacgugcgggucaaguucggccagaacgacgcggacagcucccccgggggcgacuacgaggaggacgagaucaagaaccacgccagcgaccgccggcagaagggccagcaccacgagcgcaccgggcaggacggccaccuguacggguccagccccguggagcgggaggagggcgcccuccgccgggccaccacgaccgcccgcucccugcuggacaacaagguggucaagaacagccgggcggacgggggccgccucgccggcgaggggcagcugcagaacauccccaucgacuucaccaacuucccggcccacguggaccugcccaaggccggcuccgggcucgaggagaacgaccuggugcagacgccccggggccugagcgaccucgagaucgggauguacgcccugcugggcgucuucugccucgcgauccugguguuccugaucaacugcgccaccuucgcccucaaguaccgccacaagcaggucccccuggagggccaggccuccaugacccacagccacgacuggguguggcuggggaacgaggccgagcuccuggaguccaugggcgacgcgccgccgccccaggacgagcacaccaccaucaucgaccgggggcccggcgccugcgaggagagcaaccaccuccugcugaacggcgggucccacaagcacgugcagagccagauccaccgcagcgccgacuccggcgggcggcagggccgcgagcagaagcaggacccccugcacagccccacguccaagcggaagaaggugaaguucaccaccuucaccacgaucccgcccgacgacagcugccccaccgucaacuccaucgugagcuccaacgacgaggacaucaagugggugugccaggacgucgccgugggggcgcccaaggagcuccgcaacuaccuggagaagcugaaggacaaggccuga

SEQ ID NO: 37783 - RNA, 3300 nt, Artificial Sequence
  derived and/or modified sequence opt1 from TMEM132D__Homo_sapiens__NP_597705
augugccccagcgagaugggcacccuguggcaccacugguccccggugcucaucagccuggccgcccuguucuccaaggucaccgaggggcgcggcauccucgagagcauccagcgguucucccugcugcccacguaccuccccgugaccuaccacaucaacaacgcggacgugagcuucuuccugaaggaggccaaccaggacaucaugcgcaacuccagccugcagucccgggucgagagcuuccucaucuacaagucccgccggcugcccgugcugaacgccagcuacgggccguucuccaucgagcaggucgugccccaggaccucaugcugcccagcaaccccuucggcuucaccaacaaguucucccugaacuggaagcucaaggcccacauccugcgcgacaagguguaccugagccggccgaaggugcagguccucuuccacaucauggggcgcgacugggacgaccgguccgccggcgagaagcugcccugccugcgcguguucgcguuccgggagacccgcgaggugcggggcagcugccgccuccagggggaccugggccugugcgucgccgagcucgagcugcuguccagcugguucagcccgcccacggugguggccgggcggcgcaaguccgucgaccagcccgagggcacccccguggagcucuacuacaccgugcaccccgggggcgagcggggcgacugcguccgcgaggacgcccggcgcagcaacgggauccggaccggccacuccgacaucgacgagagcgggcccccgcugcagcgcaucggcuccaucuuccuguaccagacgcaccgcaagcccagccuccgggagcugcgccuggacaacuccguggcgauccacuacauccccaagaccgugcggaagggcgacguccucaccuuccccgugagcaucucccgcaacagcaccgaggaccgguucacgcugcgcgccaaggugaagaagggggucaacaucaucggcgugcgggccuccagcccguccaucugggacgucaaggagcgcaccgacuacaccgggaaguacgcccccgccgugaucgugugccagaagaaggcggccggcagcgagaacuccgccgacggggccagcuacgaggucaugcagaucgacguggagguggaggagcccggcgaccugcccgccacccagcucgucacguggcaggucgaguacccgggcgagaucaccuccgaccugggggugagcaagaucuacgugucccccaaggaccugaucggcguggugccccucgcgauggaggccgagauccugaacaccgccauccugaccgggaagacggucgccgugcccgugaaggucgugagcguggaggacgacggcaccgucaccgagcuccuggagagcguggagugccgguccagcgacgaggacgugaucaaggucuccgaccgcugcgacuacguguucgugaacgggaaggagaugaagggcaaggucaacgugguggucaacuucaccuaccagcaccugagcuccccgcucgagaugacggugugggugccccggcugccccugcagaucgaggucagcgacaccgagcucaaccagaucaagggcuggcgcgugccgaucguguccagccggcgccccgccggggacuccgaggaggaggaggacgacgagcggcgcggccgggggugcacccugcaguaccagcacgcgaugguccgcgugcugacccaguucguggccgaggccgccggccccgggggccaccuggcccaccuccugggcagcgacuggcaggucgacaucacggagcugaucaacgacuucaugcaggucgaggagccccggaucgcgaagcuccagggcgggcagauccugauggggcaggagcugggcaugaccaccauccagauccucuccccgcugagcgacaccauccuggccgagaagacgaucaccgugcucgacgagaaggugaccaucaccgaccugggcgugcagcuggugacggggcucucccugagccugcagcucucccccggcagcaaccgcgccaucuucgccaccgcggucgcccaggagcugcugcagcgccccaagcaggaggccgccaucuccugcugggugcaguucagcgacgggagcgugacgccccucgacaucuacgacggcaaggacuucucccugauggccaccagccuggacgagaaggucguguccauccaccaggacccgaaguucaaguggcccaucaucgcggccgagaccgaggggcagggcacccucgugaaggucgagauggugaucagcgaguccugccagaaguccaagcgcaagagcgugcuggccgucggcaccgccaacaucaaggugaaguucgggcagaacgacgccaaccccaacaccagcgacucccggcacaccggcgcggggguccacauggagaacaacgugagcgaccggcgccccaagaagccgucccaggaguggggcagccaggaggggcaguacuacggcuccagcuccaugggccugauggaggggcggggcacgaccaccgaccgcagcauccuccagaagaagaaggggcaggagucccugcuggacgacaacagccaccuccagaccauccccuccgaccugacgagcuuccccgcccagguggaccugccccggagcaacggcgagauggacgggaacgaccucaugcaggccuccaagggccugagcgaccuggagaucggcauguacgcccuccugggggucuucugccuggccauccucguguuccugaucaacugcgugaccuucgcgcugaaguaccgccacaagcaggucccguucgaggagcaggagggcaugucccacagccacgacuggguggggcucuccaaccggaccgagcugcuggagaaccacaucaacuucgccagcucccaggacgagcagaucaccgccaucgaccgcggcauggacuucgaggagagcaaguaccuccuguccacgaacagccagaaguccaucaacgggcagcuguucaagccccucggccccaucaucaucgacggcaaggaccagaaguccgagcccccgaccagccccaccagcaagcggaagcgcgugaaguucaccacguucaccgccgucuccagcgacgacgaguaccccacccggaacuccaucgugaugagcuccgaggacgacaucaagugggugugccaggaccuggaccccggggacugcaaggagcugcacaacuacauggagcgccuccacgagaacgucuga

SEQ ID NO: 37784 - RNA, 3225 nt, Artificial Sequence
  derived and/or modified sequence opt1 from TMEM132E__Homo_sapiens__NP_001291367
auggcccccggcaugagcgggcgcggcggggccgcgcugcucugccuguccgcccugcucgcccacgccagcggccggucccacccggccagccccuccccgcccgggccgcaggcgagccccgugcugcccgucuccuaccgccugagccacacccggcucgccuucuuccugcgcgaggcccggcccccgucccccgccguggcgaacagcucccugcagcgcagcgagcccuucguggucuuccagaccaaggagcuccccgugcugaacgugucccugggcccguucagcacgucccaggucguggcccgggagcuccugcagcccagcuccacccuggacauccccgagcgccucaccgugaacuggaagguccgggccuucaucgugcgcagccacgugcccgccucccagccggucguccaggugcuguucuacguggccggccgggacugggacgacuucggggugaccgagcgccugcccugcgugcggcuccacgcguuccgcgacgcccgggaggucaagagcagcugccgccuguccggcgggcuggccacgugccucgugcgggccgagcugccccuggccugguucgggcccccggcgcccgccgccccgcccaccgcccgccgcaagagccccgacggccucgagcccgaggccaccggcgagucccagcaggcggagcuguacuacacccugcacgcccccgacgccagcggcgggugcggcgggucccggcggggcgccggccccggggugggcgcccgcgcggagagcccgacgcagcacccccuccugcgcaucggguccaucagccuguuccggcccccgccccgccggacccuccaggagcaccgccuggacuccaaccugaugauccggcuccccgaccgcccccugaagccgggcgagguccugagcauccuccuguaccuggcccccaacuccagcucccccagcucccccagcguggagcacuucacccuccgggugaaggccaagaagggggucacccugcugggcacgaagucccgcagcggccaguggcacgugaccuccgagcuccugaccggggccaagcacagcaccgcgacggucgacguggccugggcccagagcaccccgcugccgccccgggagggccaggggccccucgagauccugcagcuggacuucgagauggagaacuucaccucccagagcgugaagcgccggaucauguggcacaucgacuaccgcggccacggggcccuccccgaccuggagcgggccgucaccgagcugacggugauccagcgcgacgugcaggcgauccugccccucgccauggacaccgagaucaucaacaccgccauccugaccggccggacggucgccauccccgugaaggugaucgccaucgaggucaacggccuggugcucgacaucuccgcgcugguggagugcgagagcgacaacgaggacaucaucaaggucuccagcuccugcgacuacguguucgugagcgggaaggagucccgcggcagcaugaacgcccgggucaccuuccgcuacgacgugcugaacgcgccccucgagaugaccgugugggucccgaagcugccccugcacaucgagcucuccgacgcccggcugagccaggugaagggguggcgcgugcccauccugcccgaccgccgguccguccgcgagagcgaggacgaggacgaggaggaggaggagcggcgccaguccgccagccggggcugcacccuccaguaccagcacgccacgcuccagguguucacccaguuccacaccaccuccagcgaggggacggaccagguggucaccaugcugggcccggacuggcugguggaggugaccgaccuggucagcgacuucaugcgcgugggcgacccccggguggcccacauggucgacuccagcacccuggccgggcucgagcccggcacgacccccuucaaggugguguccccgcugaccgaggccguccugggggagacccuccugaccgugacggaggagaaggugagcaucacccagcugcaggcgcaggucguggccucccucgcccugagccugcgccccucccccggcagcucccacaccauccucgccaccacggccgcgcagcagacccugagcuuccugaagcaggaggcccuccugucccuguggcucagcuacuccgacggcaccaccgccccgcugagccuguacagcccccgggacuacgggcuccugguguccucccuggacgagcacgucgccacggugacccaggaccgcgccuucccccucguggucgcggaggccgagggcagcggggagcugcugcgggccgagcucaccaucgccgaguccugccagaagaccaagcgcaagagcgugcuggccacgacccccgugggccugcggguccacuucgggcgcgacgaggaggacccgaccuacgacuaccccggccccagccagcccggccccgggggcggggaggacgaggcgcggggcgccgggccgcccggcuccgcccuccccgcccccgaggcgcccggccccgggaccgccagccccguggugccgcccacggaggacuuccugccccugcccaccggcuuccuccaggucccgcgcgggcugaccgaccuggagaucggcauguacgcccuccuggggguguucugccuggccauccucguguuccugaucaacugcaucgucuucgugcugcgguaccgccacaagcggaucccgcccgagggccagaccuccauggaccacagccaccacugggucuuccucggcaacgggcagccccugcgcgugcagggcgagcuguccccgcccgccgggaacccccucgagacggugcccgcguucugccacggcgaccaccacagcuccgggagcucccagaccagcguccagucccaggugcacggccggggcgacgggagcuccggcgggagcgcccgcgaccaggccgaggaccccgccuccagccccaccuccaagcgcaagcgggugaaguucaccacguucaccacccugcccagcgaggagcuggccuacgacuccgucccggcgggcgaggaggacgaggaggaggaggaggaccucggcugggggugccccgacguggccggccccacccgccccacggccccgcccgaccugcacaacuacaugcggcgcaucaaggagaucgccuga

SEQ ID NO: 37785 - RNA, 543 nt, Artificial Sequence
  derived and/or modified sequence opt1 from TMEM134__Homo_sapiens__NP_001072118
augagcgccgcccgcccccaguucuccaucgacgacgcguucgagcugagccucgaggacggcgggccgggccccgaguccagcgggguggcccgguucggcccccugcacuucgagcgccgggcccgcuucgaggucgccgacgaggacaagcagucccggcugcgcuaccagaaccucgagaacgacgaggacggggcccaggcgagccccgagccggacggcggcguggggacccgggacuccagccgcaccuccauccggagcucccaguggagcuucuccaccaucagcuccagcacccagcgcuccuacaacacgugcugcagcuggacccagcacccccugauccagaagaaccggcgcgugguccuggccuccuuccuccugcugcuccugggccugggggugagcagcgccaucuucuucgugcccggcuuccuccugcugguccccgggguguaccacgugaucuucaucuacugcgccgucaagggccaccggggcuuccaguucuucuaccucccguacuucgagaaguga

SEQ ID NO: 37786 - RNA, 1311 nt, Artificial Sequence
  derived and/or modified sequence opt1 from TMEM135__Homo_sapiens__NP_001162195
auggccgcccugagcaaguccaucccccacaacugcuacgagaucggccacaccuggcacccgagcugccgcguguccuuccuccagaucaccgggggcgcgcuggaggagagccugaagaucuacgcgccccucuaccugaucgccgccauccugcggaagcgcaagcucgacuacuaccugcacaagcugcuccccgagauccugcaguccgccagcuuccugacggccaacggggcccucuacauggccuucuucugcauccugcggaagauccugggcaaguucuacuccuggacccccggguucggcgccgcgcucccggccagcuacgucgccauccugaucgagcgcaagucccggcgcggccugcucaccaucuacauggccaaccuggugcuccuguucugcaucaccgccgcgauguacauguucuucuuccggugcaaggacgggcugaagggcuucacguucagcgcccugcgcuucaucguggggaaggaggagauccccacccacuccuucagccccgaggccgccuacgccaaggucgagcagaagcgggagcagcacgaggagaagcccggccgcaugaacaugaucgggcucgugcggaaguucguggacuccaucugcaagcacggcccgcgccaccggugcugcaagcacuacgaggacaacugcaucagcuacugcaucaagggcuucauccgcauguucuccgucggguaccugauccagugcugccugcggauccccagcgcguuccgccaccucuucacccagcccucccggcugcugagccucuucuacaacaaggagaacuuccagcugggcgccuuccugggguccuucgugagcaucuacaagggcaccagcugcuuccuccgcuggauccggaaccuggacgacgagcugcacgccaucaucgccggcuuccucgccgggaucuccaugauguucuacaagagcacgaccaucuccauguaccuggcgagcaagcugguggagaccauguacuucaagggcaucgaggccgggaagguccccuacuucccgcacgccgacaccaucaucuacuccaucagcacggccaucugcuuccaggccgcggugauggaggugcagacccuccgccccuccuacuggaaguuccugcugcggcucaccaagggcaaguucgccgucaugaaccgcaaggugcuggacguguucgggaccggcgccagcaagcacuuccaggacuucaucccccgccuggacccccgguacacgaccgucaccccggagcuccccaccgaguucuccuga

SEQ ID NO: 37787 - RNA, 489 nt, Artificial Sequence
  derived and/or modified sequence opt1 from TMEM138__Homo_sapiens__NP_057548
augcugcagaccagcaacuacucccucgugcugagccugcaguuccuccugcuguccuacgaccucuucgucaacagcuucuccgagcugcugcagaagacccccgugauccagcucgugcuguucaucauccaggacaucgccguccuguucaacaucaucaucaucuuccucauguucuucaacacguucguguuccaggccggccuggugaaccuccucuuccacaaguucaaggggaccaucauccugaccgcggucuacuucgcccugagcaucucccuccacgugugggugaugaaccugcgcuggaagaacagcaacuccuucaucuggaccgacggccugcagaugcuguucgucuuccagcggcuggccgccgugcuguacugcuacuucuacaagcgcacggccgugcggcucggggacccgcacuucuaccaggacagccuguggcugcgcaaggaguucaugcagguccggcgcuga

SEQ ID NO: 37788 - RNA, 702 nt, Artificial Sequence
  derived and/or modified sequence opt1 from TMEM150B__Homo_sapiens__XP_011525158
auguggggcuaccugagccucaugcccguguuccuggccgucugggccaucuccgggguguggaucguguucgcgaucgccgucaccaaccgcaccguggaccugagcaagggcuuccccuacaucuccaucugcgggagcuucccgccccaguccugcaucuucagccaggugcucaacaugggcgccgcccuggccgcguggaucugcaucguccgguaccaccagcugcgcgacuggggcgugcggcgcuggcccaaccagcucauccuguggacggggcugcucugcgcccugggcaccuccguggucgggaacuuccaggagaagaaccagcggcccacccaccuggccggcgccuuccucgcguucauccuggggaacguguacuucuggcugcagcuccugcuguggcgccucaagcggcugccccagcccggcgccgccuggaucgggccccugcgccucggccugugcagcgugugcaccauccugaucgucgccaugaucgugcuccacgccugcucccugcggagcguguccgcggccugcgagugggucguggccaugcuccuguucgcccuguucggccugcucgccguggacuucagcgcgcuggaguccugcacgcugugcguccagccguggcccagccucuccccgccgcccgccagccccaucucccugcccgugcagcuguga

SEQ ID NO: 37789 - RNA, 1407 nt, Artificial Sequence
  derived and/or modified sequence opt1 from TMEM151A__Homo_sapiens__NP_694998
augcccgaggacggcgccggggacggcggggaggugcccgcccugauccccgacggcgagccccuccgcgaggagcagcggccccugaagcagagccugggguccagccucugccgcgagucccacuggaagugccugcugcucacccugcugauccacgcgugcggcgccgucguggccuggugccggcucgccaccgugccgcgccugguccugggccccgaggccgcgcucgcccgcggggccggcgggcccccgcccacguaccccgccagccccugcuccgacggcuaccuguacaucccccuggcguucgugagccuccuguaccugcucuaccuggccgagugcuggcacugccacgugcgguccugccaggccccgcggaccgacgcccacaccguccuggcccucauccgccggcugcagcaggcgccgcccugcgugugguggaaggccaccagcuaccacuacgugcgccggacgcgccagaucacccgguaccgcaacggggacgccuacaccaccacgcaggucuaccacgagcgggccgacucccgcaccgcccggggcgaguucgacuacagcgcgcacggcgugcgcgacguguccaaggagcuggucgggcucgccgagcacgccgccacccggcugcgcuucaccaagugcuucagcuucggcuccgccgaggcggaggccagcuaccugacgcagcgggcccgcuucuucuccgccaacgaggggcucgacgacuaccuggaggcccgcgagggcaugcaccugaaggacguggacuuccgggagagccucaugguguucgcggacccccgcuccccgcccugguacgcccgggccugggucuucuggcuggugagcgccgcgacccuguccuggccccuccgcguggucgccgccuacggcaccgcccacgugcacuaccagguggagaagcuguucggggccagcagcccgccgcccggcgcgguccccuccgggccgccccugagccggguggccaccguggacuucacggagcucgaguggcacaucugcuccaaccgccagcugguccccagcuacuccgaggccguggucaugggcgccgggagcggcgccuaccugcggggcugccagcgcugccggcgcuccgugagcuccaacagccucccgcccgcgcggcccuccgggccccgccugcccuucagccggucccgccugagccucggcgccgggggccgggccacccccgggguguuccgcucccugagcggcggcccccuggggcggcgcggcgaggacaccgagccccucgaguccccgcccugcuacgaggacgcccuguacuuccccguccugaucgugcacggggacagcggcugccagggggacggccagggcgcccucuga

SEQ ID NO: 37790 - RNA, 1701 nt, Artificial Sequence
  derived and/or modified sequence opt1 from TMEM151B__Homo_sapiens__NP_001131032
augagcccgcccggcuccgccgccggggagagcgcggccggcgggggcgggggcggcgggggccccgggguguccgaggagcugaccgccgccgccgcggccgccgccgcggacgagggccccgcccgcgaggagcagcggcccauccagccgagcuucaccaagucccucugccgcgagagccacuggaagugccugcugcucucccugcugauguacgggugccucggcgccgucgccuggugccacgugacgaccgugacccggcugaccuucagcuccgccuaccagggcaacagccugauguaccacgacucccccugcagcaacggguacgucuacaucccccucgcguuccugcugaugcucuacgccguguaccugguggagugcuggcacugccaggcccgccacgagcugcagcaccgggucgacguguccagcgugcgcgagcgggucggccgcaugcagcaggccacgcccugcaucugguggaaggccaucuccuaccacuacgugcggcgcacccgccaggugacccgcuaccggaacggggacgcguacaccacgacccaggucuaccacgagcgcgugaacacccacguggccgaggccgaguucgacuacgcccggugcggcguccgcgacgugagcaagacccucgugggccuggagggggccccggcgacgcggcugcgcuucaccaagugcuucuccuucgccagcgucgaggccgagaacgccuaccucugccagcgggcccgcuucuucgcggagaacgagggccuggacgacuacauggaggcccgggaggggaugcaccugaagaacguggacuuccgcgaguucaugguggccuuccccgaccccgcccggcccccgugguacgcgugcuccagcgccuucugggccgccgcccuccugacccugagcuggccccuccggguccuggcggaguaccgcaccgccuacgcccacuaccacguggagaagcuguucggccucgaggggcccggcuccgccagcuccgccggcgggggccugagccccuccgacgagcugcucccgccccugacgcaccggcugccccgcgugaacaccgucgacagcaccgagcucgaguggcacauccgguccaaccagcagcuggugcccagcuacuccgaggcgguccugauggaccucgccgggcugggcacccgcugcgggggcgccggcgggggcuacgccccgagcugccgguacgggggcgugggcggccccggcgccgcggggguggcccccuaccgccgguccugcgagcacugccagcgcgccgucagcuccagcuccaucuucagccgguccgcccugagcaucugcgcgagcccccgcgccggcccggggcccggcggcggggccggcugcgggggcucccgguucagccucgggcgccuguacggcucccggcgcagcugccuguggcggucccgcagcggcuccgugaacgaggccagcugccccacggagcagacccggcucuccagccaggccuccaugggggacgacgaggacgacgacgaggaggaggcggggcccccgccgcccuaccacgacgcccuguacuuccccgugcugaucguccaccgccaggaggggugccucggccacagccaccgcccccugcaccggcacggguccugcguggagaccagccuguga

SEQ ID NO: 37791 - RNA, 552 nt, Artificial Sequence
  derived and/or modified sequence opt1 from TMEM154__Homo_sapiens__NP_689893
augcaggcgccccgcgccgcccugguguucgcccucgucaucgcccuggugccggugggccgggggaacuacgaggagcuggagaacagcggcgacaccaccgucgaguccgagcgccccaacaaggugacgauccccagcaccuucgccgccgugaccaucaaggagacccucaacgcgaacaucaacuccacgaacuucgcccccgacgagaaccagcuggaguucauccugaugguccucaucccgcugauccugcucgugcugcugcuccugagcguggucuuccuggccaccuacuacaagcggaagcgcaccaagcaggagcccuccagccaggggucccagagcgcccuccagaccuacgagcugggcuccgagaacgugaaggugcccaucuucgaggaggacacgcccagcgucauggagaucgagauggaggagcuggacaaguggaugaacuccaugaaccggaacgcggacuucgagugccucccgacccugaaggaggagaaggagagcaaccacaaccccuccgacagcgaguccuga

SEQ ID NO: 37792 - RNA, 903 nt, Artificial Sequence
  derived and/or modified sequence opt1 from TMEM158__Homo_sapiens__NP_056259
augcugccccuccuggccgcccugcucgcggccgccugcccgcugccgcccgugcgcggcggggccgccgacgcgcccggccugcucgggguccccagcaacgccuccgugaacgccagcuccgccgacgagcccaucgcgccccggcugcuggccagcgccgcccccggcccgcccgagcgccccgggcccgaggaggccgcggccgccgccgccccgugcaacaucuccgugcagcggcagaugcucagcucccugcugguccgcuggggccggccccgcggcuuccagugcgaccuccugcuguucagcaccaacgcgcacgggcgggccuucuucgccgccgccuuccaccgcgugggcccgccccuccugaucgagcaccuggggcucgcggccggcggggcccagcaggaccugcggcugugcgugggcugcggcuggguccgcgggcggcgcaccggccggcuccgccccgccgccgcgcccuccgccgccgccgcgacggccggggcccccaccgcccugcccgccuacccggcggccgagccgcccggcccccuguggcuccagggcgagccccugcacuucugcugccuggacuucagccucgaggagcugcagggggagcccggcuggcggcugaaccgcaagcccaucgaguccacccucguggccugcuucaugacccuggugaucgucguguggagcguggccgcccugaucuggcccgucccgaucaucgcgggguuccuccccaacggcauggagcagcggcgcacgaccgccuccaccaccgccgccacgcccgccgcggugccggccgggaccaccgccgccgcggccgccgccgccgcggccgccgccgccgcggccgugaccagcggcgucgccacgaaguga

SEQ ID NO: 37793 - RNA, 567 nt, Artificial Sequence
  derived and/or modified sequence opt1 from TMEM160__Homo_sapiens__NP_060324
augggcgggggcugguggugggcccgcgccgcgcggcuggcccgccuccgguuccgccggagccugcugcccccgcagcgcccccgguccgggggcgcccgcgggagcuucgcccccggccacggcccccgggccggggcguccccgccgcccgugagcgagcucgaccgcgccgacgccuggcugcugcggaaggcccacgagaccgcguuccucuccugguuccgcaacggccugcuggccagcgggaucggcgucaucuccuucaugcagagcgacauggggcgggaggccgccuacggcuucuuccuccugggcgggcugugcgugguguggggcuccgccagcuacgcggucgggcucgccgcccugcgcggccccaugcagcugacccucggcggggccgccgugggcgcgggggccgugcuggccgccucccugcucugggccugcgcggucggccuguacauggggcagcuggagcucgacguggagcuggugcccgaggacgacggcacggccagcgccgagggccccgacgaggccgggcggcccccgcccgaguga

SEQ ID NO: 37794 - RNA, 1464 nt, Artificial Sequence
  derived and/or modified sequence opt1 from TMEM161B__Homo_sapiens__NP_699185
augggggugaucgggauccagcuggucgugaccauggugauggccagcgucaugcagaagaucaucccccacuacucccucgcccgcuggcugcugugcaacggcagccuccggugguaccagcacccgaccgaggaggagcugcgcauccuggcggggaagcagcagaagggcaagacgaagaaggaccggaaguacaacgggcacaucgaguccaagccccucaccauccccaaggacaucgaccugcaccuggagaccaagagcgugaccgagguggacacgcucgcccugcacuacuuccccgaguaccaguggcuggucgacuucaccguggccgccaccguggucuaccucgugaccgagguguacuacaacuucaugaagccgacgcaggagaugaacaucucccuggucuggugccugcucgugcugagcuucgccaucaaggugcuguucucccucaccacccacuacuucaaggucgaggacggcggcgagcgcagcgugugcgugaccuucggguucuucuucuucgucaaggcgauggccgugcugaucgugacggagaacuaccuggaguucggccucgagaccggguucaccaacuucuccgacagcgccaugcaguuccuggagaagcagggccuggagucccagagccccgucuccaagcucaccuucaaguucuuccuggccaucuucugcagcuucaucggggcguuccugacguuccccggccuccggcuggcccagaugcaccuggacgcccucaaccuggccaccgagaagaucacccagacccugcuccacaucaacuuccuggcgccccuguucauggugcuccugugggugaagccgaucacgaaggacuacaucaugaacccgccccugggcaaggaguccaucccccucaugaccgaggccaccuucgacacccugcgccuguggcucaucauccugcugugcgcccuccggcuggccaugaugcgcagccaccuccaggccuaccugaaccuggcccagaagugcgucgaccagaugaagaaggaggcggggcggaucuccacgguggagcugcagaagauggucgcccgcguguucuacuaccugugcgugaucgcccuccaguacgucgcgccccuggugaugcugcuccacaccacccugcugcucaagacccugggcaaccacagcugggggaucuaccccgaguccaucagcacgcugcccguggacaacagccuccuguccaacagcgucuacuccgagcugcccagcgccgagggcaagaugaaggugaccgugacccagaucaccgucgcccucuccagccugaagaacaucuucacgccgcuccuguuccggggccugcuguccuuccucaccugguggaucgccgccugccuguucagcaccucccuguucggccucuucuaccaccaguaccugaccguggccuga

SEQ ID NO: 37795 - RNA, 870 nt, Artificial Sequence
  derived and/or modified sequence opt1 from TMEM163__Homo_sapiens__NP_112185
auggagcccgccgccggcauccagcgccggagcucccaggggcccaccgugcccccgccgccccgcggccacgcgccgcccgccgccgcccccgggcccgcgccccugagcucccccguccgggagccgccccagcucgaggaggagcgccaggugcggaucagcgaguccggccaguucagcgacgggcuggaggaccgcggccugcucgaguccagcacccggcugaagccccacgaggcccagaacuaccgcaagaaggcccuguggguguccugguucagcaucaucgucacgcucgcccuggccguggcggccuucaccguguccgucaugcgguacagcgccuccgccuucggcuucgccuucgacgcgauccuggacgugcucagcuccgccaucgugcuguggcgcuacagcaacgccgccgccguccacuccgcgcaccgggaguacaucgccugcgugauccugggggugaucuuccuccugagcuccaucugcaucgucgugaaggccauccacgaccugagcacccgccuccugcccgagguggacgacuuccuguucagcgucuccauccucagcggcauccugugcuccauccuggccgugcucaaguucaugcuggggaaggugcugaccagccgggcccucaucacggacggcuucaacucccuggucgggggcgugaugggcuucagcauccugcucuccgcggagguguucaagcacgacagcgccgucugguaccuggacggguccaucggcgugcugaucgggcucaccaucuucgccuacggcgugaagcugcugaucgacauggucccccgcgugcggcagacccgccacuacgagauguucgaguga

SEQ ID NO: 37796 - RNA, 975 nt, Artificial Sequence
  derived and/or modified sequence opt1 from TMEM165__Homo_sapiens__NP_060945
auggccgccgcggcccccggcaacgggcgcgccagcgccccgcggcugcuccugcuguuccucgugccccugcugugggcccccgcggccguccgcgccggccccgacgaggaccucucccaccggaacaaggagccgcccgcccccgcgcagcagcugcagccccagccgguggccgugcaggggcccgagcccgcccgcgucgagaagaucuucacccccgccgccccggugcacaccaacaaggaggaccccgcgacgcagaccaaccugggcuucauccacgccuucguggccgccaucagcgucaucaucguguccgagcucggggacaagaccuucuucaucgccgcgaucauggccaugcgguacaaccgccugaccgugcuggccggcgccaugcucgcccugggccugaugacgugccucagcguccuguucggguacgcgaccaccgugaucccccggguguacaccuacuacgucuccacggugcuguucgccaucuucggcauccgcaugcuccgggaggggcugaagaugagccccgacgagggccaggaggagcuggaggaggugcaggccgagcucaagaagaaggacgaggaguuccagcgcaccaagcugcugaacgggccgggcgacgucgagaccggcaccuccaucacggugccccagaagaaguggcuccacuucaucagccccaucuucgugcaggcccugacccugaccuuccucgccgaguggggcgaccggucccagcugaccacgaucguccuggcggcccgcgaggaccccuacgggguggccgucgggggcaccgugggccacugccucugcaccgggcuggccgugaucggcgggcggaugaucgcgcagaagaucagcgugcgcaccgucacgaucaucggcgggaucguguuccuggccuucgccuucuccgcccucuucaucagcccggacuccggcuucuga

SEQ ID NO: 37797 - RNA, 894 nt, Artificial Sequence
  derived and/or modified sequence opt1 from TMEM169__Homo_sapiens__NP_001135784
auggaggagcccaccgccguggagggccagguccagcugccgagcccccaccaggggucccuccgcaaggccguggcggccgcccuggcccuggacggcgagagcaccauggggcaccggaagaagaagcgcaaggagucccggcccgagagcaucaucaucuaccgcuccgacaacgagaagacggacgaggagcccggcgagagcgagggcggggaccagccgaaggaggaggagggcgacgacuuccucgacuaccccguggacgacgacauguggaaccugccccuggacucccgguacgucacccucaccgggaccaucacgcgcggcaagaagaaggggcagaugguggacauccacgugacccugaccgagaaggagcugcaggagcucaccaagcccaaggagagcucccgggagacgaccccggagggccgcauggccugccagaugggggcggaccggggcccccacgucgugcuguggacccugaucugccuccccguggucuucauccugagcuucgugguguccuucuacuacggcaccaucacgugguacaacaucuuccuggucuacaacgaggagcgcaccuucuggcacaagaucagcuacugccccugccucgugcuguucuacccggugcugaucauggccauggccuccagccucgggcuguacgccgcggucgugcagcuguccuggagcugggaggccugguggcaggccgcccgggacauggagaagggcuucugcggguggcucugcuccaagcugggccuggaggacugcagccccuacuccaucguggagcuccuggagagcgacaacaucagcuccacccugagcaacaaggaccccauccaggaggucgagaccuccacgguguga

SEQ ID NO: 37798 - RNA, 435 nt, Artificial Sequence
  derived and/or modified sequence opt1 from TMEM170A__Homo_sapiens__NP_660297
auggagcgcgagggcagcgggggcuccgggggcagcgccgggcugcuccagcagauccugucccugaagguggucccccgggugggcaacggcacccucugcccgaacagcaccucccugugcagcuuccccgagaugugguacgggguguuccugugggcccucgucuccagccuguucuuccacgugcccgcgggccugcucgcccuguucacgcugcgccaccacaaguacgggcgguucauguccgugagcauccuccugaugggcaucgucgggcccaucaccgccggcauccugaccuccgccgccaucgcgggcguguaccgcgccgccgggaaggagaugaucccguucgaggcccucacccugggcacggggcagaccuucugcgugcuggucgugagcuuccuccggauccuggcgacccuguga

SEQ ID NO: 37799 - RNA, 972 nt, Artificial Sequence
  derived and/or modified sequence opt1 from TMEM171__Homo_sapiens__NP_001154814
augagccccgccgccgcggccgagcccgacggcgaccagcaggaccgccacguguccaagcugaucuucugcuucuucgucuucggggccgugcuccugugcgugggcguccugcucagcaucuucggguuccaggccugccaguacaagccccugcccgacugccccauggugcugaagguggccggccccgcgugcgccgucguggggcucggcgccgugauccuggcccggucccgcgcgcagcugcagcuccgggccggccugcagcgcgggcagcagauggaccccgaccgggccuucaucugcggcgagagccgccaguucgcccagugccugaucuucggguuccucuuccugaccuccggcaugcugaucagcguccucgggaucugggugcccggcugcggcuccaacugggcccaggagccccugaacgagaccgacacgggggacagcgagccgcggaugugcggcuuccugucccuccagaucauggggccccugaucgugcuggucggccucugcuucuucgugguggcgcacgucaagaagcgcaacacccugaacgccggccaggacgccagcgagcgggaggaggggcagauccagaucauggagcccguccaggugaccgugggcgacuccgugaucaucuucccgcccccgccgccgcccuacuuccccgagagcuccgccagcgccguggcggagucccccgggaccaacagccugcuccccaacgagaacccgcccuccuacuacagcaucuucaacuacggcacgcccaccuccgagggggccgccagcgagcgcgacugcgagagcaucuacaccaucuccggcaccaacagcuccagcgaggccucccacacgccccaccuccccagcgagcugccgccccgguacgaggagaaggagaacgccgcggccaccuuccugccccuguccagcgagcccuccccgcccuga

SEQ ID NO: 37800 - RNA, 1140 nt, Artificial Sequence
  derived and/or modified sequence opt1 from TMEM173__Homo_sapiens__NP_938023
augccccacagcucccugcacccgagcauccccugcccccgcggccacggggcccagaaggccgcgcucgugcugcuguccgccugccucgucacccuguggggccugggggagcccccggagcacacccuccgguaccuggugcugcaccucgccagccugcagcugggccuccugcugaacggggugugcucccucgccgaggagcugcgccacauccacagccgguaccgcggcuccuacuggcggacgguccgcgccugccugggcugcccccuccggcgcggggcgcugcugcuccugagcaucuacuucuacuacucccugcccaacgccguggggcccccguucaccuggaugcucgcccugcugggccucagccaggcccugaacauccugcucggccugaaggggcuggcgcccgccgagaucuccgccgugugcgagaagggcaacuucaacgucgcccacggccucgccuggagcuacuacaucggguaccugcggcugauccuccccgagcugcaggcgcgcauccggaccuacaaccagcacuacaacaaccugcuccgcggcgccgugucccagcggcuguacauccugcucccccuggacugcggggugccggacaaccugagcauggccgaccccaacauccgcuuccucgacaagcugccccagcagaccggcgaccacgccggcaucaaggaccgggucuacuccaacagcaucuacgagcugcucgagaacgggcagcgcgccggcacgugcgugcuggaguacgcgacgccccugcagacccuguucgccaugucccaguacagccaggccggguucucccgggaggaccgccucgagcaggccaagcuguucugccggacccuggaggacauccucgccgacgcgccggagagccagaacaacugccgccugaucgccuaccaggagcccgccgacgacagcuccuucagccugucccaggaggugcuccggcaccuccgccaggaggagaaggaggaggucaccgugggcagccugaagaccuccgccgugcccagcaccuccaccaugagccaggagcccgagcugcugaucuccgggauggagaagccgcugccccuccgcacggacuucagcuga

SEQ ID NO: 37801 - RNA, 1269 nt, Artificial Sequence
  derived and/or modified sequence opt1 from TMEM175__Homo_sapiens__NP_001284354
augaccuuccugaucgugaccgucgccugggccgcgcacacgcgccucuuccagguggugggcaagaccgacgacacccuggcccugcucaaccuggccugcaugaugaccaucacguuccugcccuacaccuucagccucauggucaccuucccggacgugccccuggggaucuuccuguucugcgugugcgucaucgccaucggcguggugcaggcccucaucgucggguacgcguuccacuucccccaccuccugagcccccagauccagcgguccgcccaccgcgcccuguaccggcgccacgugcugggcaucgugcugcaggggccggcccucugcuucgcggccgccaucuucucccuguucuucgucccccugagcuaccuccugauggugaccgugauccugcuccccuacgucuccaaggugacgggcuggugccgggaccgccugcugggccaccgggagcccagcgcccacccgguggaggucuucuccuucgaccuccacgagccccugagcaaggagcgcguggaggccuucuccgacgggguguacgcgaucgucgccacccugcucauccuggacaucugcgaggacaacgugcccgaccccaaggacgugaaggagcgguucagcggcucccuggucgccgcccucagcgccaccgggccgcgcuuccuggcguacuucggcuccuucgccaccguggggcugcucugguucgcccaccacagccuguuccugcacguccggaaggccacgcgcgccaugggccuccugaacacccugucccucgcguucgugggcgggcugccccuggccuaccagcagaccagcgccuucgcccggcagccccgcgacgagcucgagcgggugcgcgucuccugcaccaucaucuuccuggccagcaucuuccagcuggcgauguggacgaccgcccuccugcaccaggccgagacccugcagcccuccgugugguucggcgggcgggagcacgugcucauguucgccaagcuggcgcuguacccgugcgccagccugcucgccuucgccagcacgugccugcugucccgcuucagcgucggcaucuuccaccucaugcagaucgccgugcccugcgcguuccugcugcuccggcugcuggugggccucgcccuggccacccugcgcguccuccgggggcuggcccgccccgagcacccgccgcccgcccccaccggccaggacgacccccagucccagcugcuccccgcgcccugcuga

SEQ ID NO: 37802 - RNA, 702 nt, Artificial Sequence
  derived and/or modified sequence opt1 from TMEM176B__Homo_sapiens__NP_001094784
augacccagaacaccgugaucgucaacggcguggccauggccagccgccccucccagccgacgcacgugaacguccacauccaccaggagagcgcgcugacccagcuccugaaggccgggggcucccugaagaaguuccucuuccaccccggggacaccgugcccagcaccgcccggaucggcuacgagcagcuggcccugggggugaucgccgcgggcgccggcgccaucguccacgagaagcaccccgggaagcucgccggcuacaucuccagccugcugacgcucgcgggguucgccaccgccauggccgccguggugcugugcgucaacuccuucaucuggcagaccgagccguuccuguacaucgacaccgugugcgaccgcagcgaccccguguuccccacgaccggcuaccgguggaugcgccggucccaggagaaccaguggcagaaggaggagugccgcgcguacaugcagaugcuccggaagcuguucaccgccauccgcgcccuguuccucgccgucugcgugcugaaggugaucgucagccuggugucccucggggugggccugcggaaccugugcggccagagcucccagccccucaacgaggaggggagcgagaagcgccugcugggcgagaacuccgucccgcccagccccucccgggagcagaccagcacggccaucgugcucuga

SEQ ID NO: 37803 - RNA, 894 nt, Artificial Sequence
  derived and/or modified sequence opt1 from TMEM178A__Homo_sapiens__NP_689603
auggagccccgcgcccuggugaccgcccucagccugggccugucccucugcagccuggggcugcucgucaccgcgaucuucacggaccacugguacgagaccgacccgcggcgccacaaggaguccugcgagcggagccgcgccggcgccgacccgcccgaccagaagaaccggcugaugccccugucccaccucccccugcgcgacagcccgccccuggggcggcgccuccugcccggcgggcccggccgggccgaccccgaguccuggcgcagccugcucggccugggcgggcuggacgccgagugcgggcggccccucuucgcgaccuacuccggccuguggcgcaagugcuacuuccuggggaucgaccgggacaucgacacccucauccugaagggcaucgcccagcgcugcacggccaucaaguaccacuucagccagcccauccggcugcgcaacaucccguucaaccucaccaagaccauccagcaggacgaguggcaccuccugcaccuccggcgcaucaccgccggcuuccuggggauggcgguggccgugcugcucugcggcugcaucgucgccacgguguccuucuucugggaggagagccugacccagcacguggccgggcugcuguuccugaugaccggcaucuucugcaccaucucccugugcacguacgccgcgagcaucuccuacgaccucaaccggcugcccaagcugaucuacagccuccccgccgacgucgagcacggcuacuccuggagcaucuucugcgccuggugcucccugggguucaucguggccgccggcgggcugugcaucgcguaccccuucaucagccgcaccaagaucgcccagcucaagagcggccgggacuccaccguguga

SEQ ID NO: 37804 - RNA, 690 nt, Artificial Sequence
  derived and/or modified sequence opt1 from TMEM182__Homo_sapiens__NP_653233
augcgccugaacaucgccaucuucuucggcgcccucuucggggcgcugggcgugcuccuguuccuggucgccuucgggagcgacuacuggcugcucgccaccgaggugggccggugcuccggggagaagaacaucgagaacgugaccuuccaccacgagggcuucuucuggcgcugcugguucaacggcaucgucgaggagaacgacagcaacaucuggaaguucugguacacgaaccagcccccguccaagaacugcacccacgccuaccugagccccuaccccuucaugcgcggggagcacaacuccaccagcuacgacuccgccgugaucuaccggggcuucugggcggugcugaugcuccugggggucguggccguggucaucgccagcuuccugaucaucugcgccgcgcccuucgccucccacuuccucuacaaggccggcgggggcagcuacaucgccgccggcauccuguucucccugguggugaugcucuacgucaucugggugcaggcgguggccgacauggagagcuaccggaacaugaagaugaaggacugccuggacuucaccccguccguccuguacggguggagcuucuuccucgcccccgccggcaucuucuucucccugcuggccgggcuccuguuccugguggugggccgccacauccagauccaccacuga

SEQ ID NO: 37805 - RNA, 1131 nt, Artificial Sequence
  derived and/or modified sequence opt1 from TMEM183A__Homo_sapiens__NP_612400
auggcccgcggccccgggccgcugggccggccccgccccgacaccguggccaugcccaagcgggggaagcgccucaaguuccgggcgcacgacgccugcagcggccgcgucaccguggccgacuacgccaacuccgacccggccgugguccggagcgggcgcgugaagaaggcgguggccaacgccguccagcaggaggugaagucccugugcggccuggaggccagccaggugcccgcggaggaggcccucuccggcgccggggagcccugcgacaucaucgacagcuccgacgagauggacgcccaggaggagagcauccacgagcggacggucucccgcaagaagaaguccaagcggcacaaggaggagcuggacggcgccgggggcgaggaguaccccauggacaucuggcugcuccuggcgagcuacauccgcccggaggacaucgugaacuucagccugaucugcaagaacgccuggaccgugaccugcaccgccgccuucuggacgcggcucuaccgccggcacuacacccuggacgccucccugccccuccgccugcggcccgagagcauggagaagcugcgcugccuccgggcgugcgucauccgcucccuguaccacauguacgagcccuucgccgcccggaucagcaagaacccggccauccccgaguccacccccagcacccugaagaacuccaagugccuccuguucuggugccgcaagaucguggggaaccgccaggagcccaugugggaguucaacuucaaguucaagaagcagagcccgcggcucaagagcaagugcacgggcggccugcagccgcccgugcaguacgaggacguccacaccaaccccgaccaggacugcugccugcuccaggugaccacccugaacuucaucuucauccccaucgugauggggaugaucuucacgcuguucaccaucaacgucuccaccgacaugcgccaccaccgggugcgccugguguuccaggacagccccguccacggcgggcggaagcuccgcuccgagcagggcguccaggugauccuggaccccgugcacagcgugcggcuguucgacugguggcacccccaguacccguucucccuccgcgccuga

SEQ ID NO: 37806 - RNA, 1317 nt, Artificial Sequence
  derived and/or modified sequence opt1 from TMEM184C__Homo_sapiens__NP_060711
augcccugcacgugcaccuggcgcaacuggcggcaguggauccgcccgcugguggccgucaucuaccucgugagcaucguggucgccgugccccugugcgugugggagcugcagaagcucgaggucggcauccacaccaaggcgugguucaucgccgggaucuuccugcugcucaccauccccaucucccugugggugauccugcagcaccucgugcacuacacccagcccgagcugcagaagccgaucauccggauccuguggaugguccccaucuacagccucgacuccuggaucgcccugaaguaccccggcaucgccaucuacguggacacgugccgcgagugcuacgaggccuacgugaucuacaacuucaugggguuccugaccaacuaccucaccaaccgguaccccaaccugguccugauccucgaggcgaaggaccagcagaagcacuucccgccccugugcugcugcccgcccugggccaugggcgaggugcuccuguuccgcugcaagcugggggugcugcaguacaccgucgugcggcccuucaccacgaucguggcccucaucugcgagcugcugggcaucuacgacgagggcaacuucagcuucuccaacgccuggaccuaccucgucaucaucaacaacaugagccagcuguucgcgauguacugccugcuccuguucuacaaggugcugaaggaggagcucucccccauccagcccguggggaaguuccugugcgucaagcuggugguguucgucagcuucuggcaggccguggucaucgcccuccuggugaaggugggcgucaucuccgagaagcacaccugggaguggcagaccguggaggccguggccacggggcugcaggacuucaucaucugcaucgagauguuccucgcggccaucgcccaccacuacaccuucagcuacaagcccuacguccaggaggccgaggagggcuccugcuucgacagcuuccuggccaugugggacguguccgacauccgcgacgacaucagcgagcagguccggcacguggggcgcaccgugcggggccacccgcgcaagaagcuguuccccgaggaccaggaccagaacgagcacaccucccuccugagcuccagcucccaggacgcgaucagcaucgccagcuccaugccgcccagccccaugggccacuaccagggguucggccacacggugacgccccagaccacccccaccaccgccaagaucuccgacgagauccugagcgacaccaucggggagaagaaggagcccuccgacaagagcgucgacuccuga

SEQ ID NO: 37807 - RNA, 876 nt, Artificial Sequence
  derived and/or modified sequence opt1 from TMEM185A__Homo_sapiens__NP_001167563
augaaccugcgcggccucuuccaggacuucaacccccgggccgagggggagaccugcguggaguucaaggccaugcugaucgcggucggcauccaccuccugcugcugauguucgaggugcucgugugcgaccgcaucgagcgggggagccacuucuggcugcuggucuucaugccccucuucuucgugucccccgugagcgucgccgccugcguguggggcuuccgccacgaccggucccuggagcuggagauccucugcagcgugaacauccugcaguucaucuucaucgcccugcgccucgacaagaucauccacuggcccuggcuggucgugugcgugccccuguggauccucauguccuuccugugccuggucgugcucuacuacaucguguggagcguccuguuccugcgguccauggacgugaucgccgagcagcgccggacccacaucacgauggcgcucagcuggaugaccaucguggucccgcugcugaccuucgagauccuccuggugcacaagcuggacgggcacaacgccuucuccugcauccccaucuucgugccccucuggcugagccugaucacccucauggccacgaccuucggccagaagggcgggaaccacuggugguucggcauccgcaaggacuucugccaguuccugcuggagaucuuccccuuccuccgggaguacgggaacaucuccuacgaccugcaccacgaggacaacgaggagaccgaggagaccccgguccccgagccgcccaagaucgccccgauguuccgcaagaaggcgcggguggugaucacgcagagccccggcaaguacguccugcccccgcccaagcucaacaucgagaugcccgacuga

SEQ ID NO: 37808 - RNA, 786 nt, Artificial Sequence
  derived and/or modified sequence opt1 from TMEM187__Homo_sapiens__XP_011529501
augaaccccgaguggggccaggccuucgugcacgucgccguggccgggggccugugcgcgguggccgucuucaccgggaucuucgacagcguguccgugcaggucggcuacgagcacuacgccgaggccccgguggcggggcuccccgccuuccuggccaugcccuucaacagccuggugaacauggccuacacccuccugggccuguccuggcuccaccgcggcggggcgaugggccuggggccccgguaccugaaggacgucuucgccgccauggcccuccuguacggcccggugcaguggcugcgccucuggacgcaguggcggcgcgccgcggugcuggaccaguggcugacccuccccaucuucgccuggcccgucgccuggugccuguaccuggaccggggguggcgccccuggcuguuccucagccuggagugcgugucccucgccagcuacggccuggcccugcuccacccgcagggcuucgagguggcgcugggggcccacgucguggccgccgugggccaggcccugcggacccaccgccacuacggguccaccacgagcgcgaccuaccucgcccugggcguccuguccugccucggcuucguggugcugaagcugugcgaccaccagcucgcccgguggcgccuguuccagugccugaccgggcacuucuggagcaaggucugcgacgugcuccaguuccacuucgccuuccuguuccugacccacuucaacacgcacccccgguuccaccccuccggcgggaagacccgcuga

SEQ ID NO: 37809 - RNA, 804 nt, Artificial Sequence
  derived and/or modified sequence opt1 from TMEM189__Homo_sapiens__NP_001155977
auggccggcgccgaggacuggcccgggcagcagcuggagcucgacgaggacgaggcgagcugcugccgcuggggcgcccagcacgccggggcccgggagcuggccgcgcuguacuccccgggcaagcgccuccaggaguggugcagcgugauccugugcuucucccugaucgcccacaaccucguccaccuccugcugcuggcccggugggaggacacgccccuggugauccucgggguggucgccggcgcgcugaucgccgacuuccugagcggccucgugcacuggggcgccgacaccuggggguccguggagcugcccaucgccuucauccgccccuuccgggagcaccacaucgacccgaccgccaucacccgccacgacuucaucgagaccaacggggacaacugccuggucacccuccugccccugcucaacauggcguacaaguuccggacgcacagccccgaggcccuggagcagcuguaccccugggagugcuucguguucugccucaucaucuucggcaccuucaccaaccagauccacaaguggucccacaccuacuucgggcugccgcgcugggugacgcugcuccaggacuggcacgucauccugccccggaagcaccaccgcauccaccacgugagcccccacgagaccuacuucugcaucaccaccggcuggcugaacuacccccucgagaagaucggcuucuggcggcgccuggaggaccugauccaggggcucacgggcgagaagccgcgggccgacgacaugaagugggcccagaagaucaaguga

SEQ ID NO: 37810 - RNA, 1113 nt, Artificial Sequence
  derived and/or modified sequence opt1 from TMEM189-UBE2V1__Homo_sapiens__NP_954673
auggccggcgccgaggacuggcccgggcagcagcuggagcucgacgaggacgaggcgagcugcugccgcuggggcgcccagcacgccggggcccgggagcuggccgcgcuguacuccccgggcaagcgccuccaggaguggugcagcgugauccugugcuucucccugaucgcccacaaccucguccaccuccugcugcuggcccggugggaggacacgccccuggugauccucgggguggucgccggcgcgcugaucgccgacuuccugagcggccucgugcacuggggcgccgacaccuggggguccguggagcugcccaucgucgggaaggccuucauccgccccuuccgggagcaccacaucgacccgaccgccaucacccgccacgacuucaucgagaccaacggcgacaacugccuggugacccuccugccccugcucaacauggcguacaaguuccggacgcacagccccgaggcccuggagcagcuguaccccugggagugcuucguguucugccucaucaucuucgggaccuucaccaaccagauccacaaguggucccacaccuacuucggccugccgcgcugggucacgcugcuccaggacuggcacgugauccugccccggaagcaccaccgcauccaccacgugagcccccacgagaccuacuucugcaucaccaccggcgucaaggugccccggaacuuccgccugcucgaggagcuggaggaggggcagaagggcgugggggacggcacggucuccuggggccuggaggacgacgaggacaugacccucacccgguggaccgggaugaucaucggcccgccccgcacgaucuacgagaaccggaucuacagccugaagaucgagugcgggcccaaguaccccgaggccccgcccuucgugcgcuucgugaccaagaucaacaugaacggcgucaacuccagcaacggggugguggacccccgggccaucuccguccuggccaaguggcagaacagcuacuccaucaagguggugcuccaggagcugcgccggcugaugaugagcaaggagaacaugaagcucccccagccgcccgagggccagugcuacuccaacuga

SEQ ID NO: 37811 - RNA, 423 nt, Artificial Sequence
  derived and/or modified sequence opt1 from TMEM18__Homo_sapiens__NP_690047
augcccagcgccuucuccgugagcuccuucccggucagcauccccgccgugcugacccagaccgacuggacggagcccuggcucaugggccuggccaccuuccacgcccugugcgugcuccugaccugccuguccagccgcuccuaccggcuccagaucgggcacuuccugugccuggucauccucguguacugcgccgaguacaucaacgaggccgccgcgaugaacuggcgccuguucagcaaguaccaguacuucgacucccggggcauguucaucagcaucguguucuccgcgccccugcucgucaacgccaugaucaucguggugaugugggucuggaagacccugaacgugaugacggaccugaagaacgcccaggagcgccggaaggagaagaagcgccggcgcaaggaggacuga

SEQ ID NO: 37812 - RNA, 627 nt, Artificial Sequence
  derived and/or modified sequence opt1 from TMEM199__Homo_sapiens__NP_689677
auggccagcucccugcucgccggcgagcgccuggugcgggcgcuggggcccggcggggagcucgagccggagcgccugccccggaagcugcgcgccgagcucgaggccgcccugggcaagaagcacaagggcggggacagcuccagcggcccccagcggcuggucuccuuccgccucauccgggaccugcaccagcaccuccgcgagcgggacagcaagcuguaccugcacgagcugcucgagggguccgagaucuaccugcccgagguggugaagccgccccgcaaccccgagcuggucgcccggcucgagaagaucaagauccagcuggcgaacgaggaguacaagcgcaucacccggaacgugaccugccaggacacgcgccacggcgggacccugagcgaccucggcaagcagguccggucccugaaggcccuggugaucaccaucuucaacuucaucgugaccguggucgccgccuucgugugcacguaccucgggagccaguacaucuucaccgagauggcgucccgcgugcuggccgcccugaucgucgccagcguggugggccucgccgagcuguacgucauggugcgggcgauggagggcgagcugggggagcucuga

SEQ ID NO: 37813 - RNA, 1476 nt, Artificial Sequence
  derived and/or modified sequence opt1 from TMEM200A__Homo_sapiens__NP_001245206
augaucgccaccggcggggugaucaccggccuggccgcgcucaagcgccaggacagcgcccggucccagcagcacgucaaccugagccccuccccggccacgcaggagaagaagcccauccgccggcgcccccgggccgacgugguggucgugcgcgggaagauccggcuguacagccccuccggcuucuuccucauccugggggugcugaucagcaucaucggcaucgccauggcgguccucggcuacuggccgcagaaggagcacuucaucgacgccgagaccacccuguccaccaacgagacccaggugauccgcaacgagggcgggguggucgugcgguucuucgagcagcaccuccacagcgacaagaugaagaugcuggggcccuucacgaugggcaucgggaucuucaucuucaucugcgccaacgccauccugcacgagaaccgcgacaaggagaccaagaucauccacaugcgggacaucuacuccaccgugaucgacauccacacgcugcgcaucaaggagcagcggcagaugaacggcauguacaccggccucaugggggagaccgaggucaagcagaacggcagcuccugcgcgagccgccuggccgccaacaccaucgccuccuucagcggguuccgguccagcuuccgcauggacuccagcguggaggaggacgagcugaugcucaacgagggcaaguccagcggccaccugaugccgccccugcucagcgacuccagcguguccgucuucgggcuguacccgccgcccagcaagacgaccgacgacaagaccuccggcagcaagaagugcgagaccaaguccaucgugagcuccagcaucuccgccuucacgcugcccgugaucaagcucaacaacugcgucaucgacgagcccagcaucgacaacaucaccgaggacgcggacaaccugaagucccggagccgcaaccuguccauggacagccucguggugccccugcccaacaccuccgagagcuuccagcccgucuccaccgugcugccccggaacaacagcaucggggagagccucuccagccaguacaaguccagcauggcccugggccccggggccggccagcugcucucccccggcgccgcccgccggcaguucgggagcaacacgucccugcaccuccugagcucccacagcaagucccuggaccuggaccgcggccccagcacccucaccgugcaggcggagcagcgcaagcacccguccuggccccggcuggaccgcaacaacagcaagggguacaugaagcuggagaacaaggaggaccccauggaccggcuccuggucccccagguggccaucaagaaggacuucaccaacaaggagaagcugcucaugaucucccgcagccacaacaaccuguccuucgagcacgacgaguuccugagcaacaaccucaagcggggcacgagcgagacccgcuucuga

SEQ ID NO: 37814 - RNA, 570 nt, Artificial Sequence
  derived and/or modified sequence opt1 from TMEM205__Homo_sapiens__NP_001138888
auggaggagggcgggaaccugggcgggcucaucaagauggugcaccuccugguccugagcggcgccugggggaugcagaugugggugaccuucguguccggcuuccugcuguuccgcagccucccccggcacaccuucggccugguccaguccaagcuguucccguucuacuuccacaucagcauggggugcgccuucaucaaccucugcauccuggcgucccagcacgccugggcccagcugacguucugggaggccagccagcucuaccugcuguuccucucccugacccuggccaccgugaacgcgcgcuggcucgagccccggaccacggccgccaugugggcccugcagaccguggagaaggagcgcggccucgggggcgagguccccgggagccaccagggccccgacccguaccggcagcugcgcgagaaggaccccaaguacuccgcgcugcggcagaacuucuuccgcuaccacggccugagcucccucugcaaccuggggugcgugcugagcaacggccucugccuggccgggcuggcccucgagauccggucccuguga

SEQ ID NO: 37815 - RNA, 441 nt, Artificial Sequence
  derived and/or modified sequence opt1 from TMEM207__Homo_sapiens__NP_997199
augagccgcucccggcuguucagcgugaccuccgccaucagcaccaucggcauccucugccugccccuguuccagcucguccuguccgaccugcccugcgaggaggacgagaugugcgugaacuacaacgaccagcaccccaacgggugguacaucuggauccuccugcugcucgugcuggucgccgcgcugcucugcggcgccguggugcugugccugcagugcuggcuccgccggccccgcaucgacagccaccggcgcacgauggccgucuucgccgugggggaccuggacuccaucuacggcaccgaggccgcggugagccccaccgucgggauccaccuccagacccagacgcccgaccuguaccccgugcccgcccccugcuucggcccgcugggcuccccgccgcccuacgaggagaucgugaagaccaccuga

SEQ ID NO: 37816 - RNA, 1560 nt, Artificial Sequence
  derived and/or modified sequence opt1 from TMEM209__Homo_sapiens__NP_001288092
augaugcagggcgaggcccaccccagcgccucccugaucgaccgcaccaucaagaugcggaaggagaccgaggcgcgcaaggugguccucgccugggggcugcugaacgugagcauggccggcaugaucuacacggagaugaccgggaagcucaucuccagcuacuacaacgugaccuacuggccgcugugguacaucgagcuggcccucgccucccuguucagccugaacgcccucuucgacuucuggcgguacuucaaguacaccgucgcccccacgucccugguggugagccccggccagcagacccugcucgggcugaagaccgccgucgugcagaccacgcccccgcacgaccuggccgcgacccagaucccgcccgcgccgcccucccccagcauccagggccaguccgugcucagcuacucccccagccgcucccccagcaccucccccaaguucaccacgagcugcaugaccggcuacagcccccagcugcaggggcuguccagcggcggguccggcagcuacucccccggggucaccuacagccccguguccggcuacaacaagcucgccagcuucuccccgagcccgcccucccccuaccccaccacggugggccccgucgagagcuccgggcugcggagccgcuaccgguccagccccaccguguacaacucccccaccgacaaggaggacuacaugaccgaccugcgcacgcucgacaccuuccugcggagcgaggaggagaagcagcaccgcgugaagcugggcuccccggacagcaccucccccagcagcucccccaccuucuggaacuacagccgguccaugggggacuacgcccagacgcucaagaaguuccaguaccagcuggccugccgcagccaggcgcccugcgccaacaaggacgaggccgaccuguccagcaagcaggccgccgaggaggucugggcgcggguggccaugaaccgccagcuccuggaccacauggacuccuggaccgccaaguuccggaacuggaucaacgagaccauccuggugccgcucguccaggagaucgagagcguguccacccagaugcgccggaugggcugccccgagcugcagaucggcgagcugagccagggcgggugcauguccagcuuccgcuggaaccgcgggggcgacuucaaggggcggaagugggacacggaccuccccaccgacuccgccaucaucaugcacguguucugcaccuaccuggacagccggcugccgccccaccccaaguaccccgacggcaagaccuucacgucccagcacuucguccagaccccgaacaagcccgacgugaccaacgagaacguguucugcaucuaccagagcgccaucaacccgccccacuacgagcucaucuaccagcgccacgucuacaaccugcccaagggccgcaacaacauguuccacacccugcucauguuccuguacaucaucaagacgaaggaguccgggaugcugggccgggugaaccucgggcugagcggcgucaacauccuguggaucuucggggaguga

SEQ ID NO: 37817 - RNA, 324 nt, Artificial Sequence
  derived and/or modified sequence opt1 from TMEM213__Homo_sapiens__NP_001078898
augcagcgccugcccgccgccacccgggcgacccucauccugagccuggccuucgccucccuccacagcgccugcuccgccgaggcgagcuccagcaacuccagcucccugacggcccaccacccggaccccggcacccuggagcagugccucaacguggacuucugcccccaggccgcccgcugcugccggaccggggucgacgaguacggcuggaucgcggccgccgugggguggagccugugguuccugacccucauccugcugugcguggacaagcucaugaagcugacgcccgacgagccgaaggaccugcaggccuga

SEQ ID NO: 37818 - RNA, 708 nt, Artificial Sequence
  derived and/or modified sequence opt1 from TMEM215__Homo_sapiens__NP_997723
augcgccccgacgacaucaacccgcggaccggccugguggucgcccucgugagcguguuccuggucuucggguucauguucaccguguccggcaugaagggggagacgcugggcaacaucccccuccuggccaucgggcccgcgaucugccugcccggcaucgccgccaucgcccucgcccgcaagaccgagggcugcaccaaguggccggagaacgagcugcugugggugcggaagcuccccugcuuccgcaagcccaaggacaaggaggucguggagcugcugcggacccccagcgaccucgaguccgggaagggcagcuccgacgagcuggcgaagaaggccgggcugcgcggcaagccgccgccccagagccagggggagguguccgucgccagcuccaucaacagccccacgcccaccgaggagggcgagugccagucccucgugcagaacggccaccaggaggagaccagccgguaccuggacggguacugccccuccggcagcucccugaccuacagcgcccucgacgugaagugcuccgcgcgcgaccggagcgagugccccgagcccgaggacuccaucuucuucgucccgcaggacagcaucaucgugugcagcuacaagcagaacucccccuacgaccgcuacugcugcuacaucaaccagauccaggggcggugggaccacgagacgaucguguga

SEQ ID NO: 37819 - RNA, 438 nt, Artificial Sequence
  derived and/or modified sequence opt1 from TMEM216__Homo_sapiens__NP_001167461
augcugccccgcggccucaagauggccccgcgggggaagcgccugagcuccacgccccuggagauccucuucuuccugaacggcugguacaacgccaccuacuuccugcucgagcuguucaucuuccuguacaagggggugcuccugcccuaccccaccgcgaaccugguccucgacguggugaugcugcugcucuaccugggcaucgaggucauccggcuguucuucgggaccaagggcaaccucugccagcgcaagaugccgcugagcaucuccguggcccugaccuuccccagcgccaugauggccuccuacuaccuccugcugcagaccuacgugcuccggcuggaggccaucaugaacggcauccuccuguucuucugcgggagcgagcugcugcucgagguccugacgcuggcggccuucucccgcaucuga

SEQ ID NO: 37820 - RNA, 636 nt, Artificial Sequence
  derived and/or modified sequence opt1 from TMEM217__Homo_sapiens__NP_001273330
augaagcagcagcaguggugcggcaugaccgccaagauggggaccgugcugagcggcgucuucacgaucauggccguggacauguaccucaucuucgagcagaagcaccuggggaacggcuccugcaccgagaucacccccaaguaccgcggggcgagcaacaucaucaacaacuucaucaucugcugguccuucaagaucgugcuguuccucagcuucaucaccauccugaucuccugcuuccugcucuacagcgucuacgcccagaucuuccggggccuggugaucuacaucguguggaucuucuucuacgagacggccaacgucgugauccagauccugaccaacaacgacuucgacaucaaggaggugcgcaucaugcggugguucggccucgucucccgcaccgugaugcacugcuucuggauguucuucgugaucaacuacgcccacaucaccuacaagaaccggagccaggggaacaucaucuccuacaagcgccggaucagcacggccgagauccugcacucccgcaacaagcggcugagcaucuccagcggcuucuccgggagccaccucgagucccaguacuucgagcgccagcggcgcugcagcggcaagaccuccaucaaguga

SEQ ID NO: 37821 - RNA, 723 nt, Artificial Sequence
  derived and/or modified sequence opt1 from TMEM219__Homo_sapiens__NP_001077082
augggcaacugccaggccgggcacaaccugcaccucugccuggcccaccacccgccccuggugugcgcgacccucauccugcugcuccugggccugagcgggcucggccugggguccuuccugcucacccaccgcacgggccugcggagccccgacaucccccaggacugggucuccuuccugcgcagcuucggccagcucacccugugcccccggaacgggaccgugaccggcaaguggcgcgggucccacguggucggccugcucacgacccugaacuucggggacggcccggaccggaacaagacccgcaccuuccaggccacggugcugggcagccagauggggcucaagggcuccagcgccgggcagcuggugcugaucaccgcccgggucaccaccgagcgcacggccgggaccugccucuacuucuccgcggugcccggcauccugcccagcucccagcccccgaucagcugcuccgaggagggcgccggcaacgccacccugagcccccggaugggggaggagugcguguccgucuggagccacgagggccucgugcugaccaagcugcucacguccgaggagcuggcccugugcgggagccgccuccuggugcugggcuccuuccuccugcuguucugcggccuccugugcugcgucaccgcgaugugcuuccacccccggcgcgagagccacuggagccggacccgccuguga

SEQ ID NO: 37822 - RNA, 483 nt, Artificial Sequence
  derived and/or modified sequence opt1 from TMEM220__Homo_sapiens__NP_001004313
auggcccccgcccuguggcgcgcgugcaacggccucauggccgccuucuucgcccuggccgcgcuggugcaggucaacgacccggacgccgagguguggguggucguguacaccauccccgccgugcucacccugcuggucgggcucaaccccgaggugacgggcaacgugaucuggaaguccaucagcgccauccacauccuguucugcaccgucugggcgguggggcuggccagcuaccuccugcaccggacccagcagaacauccugcacgaggaggagggccgcgagcucuccgggcuggugaucaucaccgccuggaucauccugugccacagcuccagcaagaaccccgucggcggccggauccagcucgccaucgccaucgugaucacgcuguucccguucaucuccuggguguacaucuacaucaacaaggagaugcgcagcuccuggcccacccacugcaagaccgucaucuga

SEQ ID NO: 37823 - RNA, 1143 nt, Artificial Sequence
  derived and/or modified sequence opt1 from TMEM229A__Homo_sapiens__NP_001129474
auggccggcagcgacguggacuccgaggggcccgcccgccggggcggggcggcccgccggccgggcgcccccgggggccccggcagcgaggccgccgcggggugccccgagccgcuguccaccgccgaggcccccgccgagagcgcgacccuccccgccuggaugcgccuguacuucuacggcaugcacgggaucacgcuggacguccucguguccagcgcccggcgcuucgcccggucccccgaccugcgcaugcugggcuucagcuccccguaccggugccuccugcacagccugacccacuucgcccucgagaagguguaccugcagcagcgccggugccccaacgcguucgucuucaacuuccugcucuaccccuccgcccacguggggcugcagacccuggccggccaggcccuccugcugagccucggcgggggcgccgggguggcggucgcccccggcgcccuggaccuggcccuccaguacgugcuggcccuguaccacugccagguguuccucaagcgcuuccugcggcugcgcuacggccggcagcgccggcgccagcagcagcagcagcagcagcagcagcagcagcagcggcgcggggcgcucccggucccgcccggcgcccgggugcccaccgccgccggggcccgccgccggcgcccccggggcccccgcggggcgggcggcgcccccucccaggggcugcccgaccugccgcgguuccucuucuucggcaugcacggguuccuggacgagaucuucuucacguucuucuucaacgugcugggccagggggacggcaccaccagcggccacaccucccucuggagcuucuucauguacggguccugcagcuucgucguggagaagcuguacuuccaccuccacuacucccgcggcugggggacguggaagcgggugcccaucuacgucaucuucaucuacgugugggagcugagcuggggccuggggcugcggaccugcggcgccugcagcugggacuacucccacuacccccucaacuucaugggccugaucacccugauguaccuccccggguggaucuuccugagcguguaccaggaccugaucuccaacguccucuggcgcgugcaguacgugccggccaacuga

SEQ ID NO: 37824 - RNA, 1110 nt, Artificial Sequence
  derived and/or modified sequence opt1 from TMEM231__Homo_sapiens__NP_001070884
auggccacccggcggagccagaccuggucccccggcagccgcuccgccugcgagcggugcagcuggcgcuccaugagcuccagccugacgcgguccagcgcggugaccgcccgcggguccgccccgaagccccggugcagcugcugcuggccccuccgcucccggaccagccgccggugcugguggcccuccggcgccaccgucagccugccgcgcccccugugccacgaggcgccccgggcccgcuccgcccgggccgggcuccccaaccgccugccgacggcccuguucaacagcggcuucuggcucaagcgguccagcuacgaggagcagcccaccgugcgcuuccagcaccaggugcugcuggucgcgcuccuggggcccgagagcgacggcuuccuggccugguccaccuuccccgccuucaaccggcuccagggcgaccgccugcgggugccgcuggugagcacccgcgaggaggaccgcaaccaggacgggaagacggacaugcuccacuucaagcuggagcugccccuccaguccaccgagcacguccugggcgugcagcugauccucaccuucagcuaccggcugcaccgcauggccacccuggugaugcaguccauggccuuccuccagagcuccuuccccguccccgggagccagcuguacgugaacggcgaccugcggcuccagcagaagcagccgcuguccugcgggggccuggacgcgcgcuacaacaucagcgugaucaacggcacgucccccuucgccuacgacuacgaccucacccacaucgucgccgccuaccaggagcggaacgugaccaccgugcugaacgaccccaaccccaucuggcuggucgggcgcgccgcggacgccccguucgugaucaacgccaucauccgguaccccguggaggucaucagcuaccagcccggcuucugggagauggugaaguucgccugggugcaguacgucuccauccuccugaucuuccuguggguguucgagcgcaucaagaucuucguguuccagaaccaggucgugacgaccauccccgucaccgugaccccgcgcggggaccucugcaaggagcaccugagcuga

SEQ ID NO: 37825 - RNA, 330 nt, Artificial Sequence
  derived and/or modified sequence opt1 from TMEM233__Homo_sapiens__NP_001130006
augagccaguacgcccccuccccggacuucaagcgcgcccuggacagcucccccgaggcgaacaccgaggacgacaagaccgaggaggacgugcccaugcccaagaacuaccucuggcugacgaucgucagcugcuucugcccggccuaccccaucaacaucguggcccugguguucuccaucaugagccucaacuccuacaacgacggcgacuacgagggggcccggcgccugggccggaacgccaagugggucgcgaucgccagcaucaucaucgggcugcucaucaucggcaucuccugcgccgugcacuucacccgcaacgccuga

SEQ ID NO: 37826 - RNA, 1227 nt, Artificial Sequence
  derived and/or modified sequence opt1 from TMEM237__Homo_sapiens__NP_001037850
augcgcaccgacagcggcgcccggcuggaggaggggcaccuccggcccccgcgcgcccugccgcccgugcccucccaggacgacaucccccugagccgccccaagaagaagaagccccggaccaagaacacgcccgcguccgccagccucgagggccuggcccagaccgccgggcgccggccguccgagggcaacgagcccagcaccaaggagcugaaggagcaccccgaggcccccguccagcgccggcagaagaagacccgccucccgcuggagcuggagacguccagcacccagaagaaguccagcuccagcucccuccugcggaacgagaacgggaucgacgcggagcccgccgaggaggccgugauccagaagccccgccggaagaccaagaagacccagcccgccgagcugcaguacgcgaacgagcucggcguggaggacgaggacaucaucacggacgagcagaccaccgucgagcagcagagcguguucaccgccccgacgggcaucucccagcccguggggaaggucuucguggagaagucccgccgguuccaggccgccgaccgcagcgagcugaucaagaccaccgagaacaucgacgugagcauggacgucaagcccuccuggaccacgcgggacguggcccugaccgugcaccgcgcguuccggaugaucggccucuucagccacggguuccuggccggcugcgccgucuggaacaucguggugaucuacguccuggccggggaccagcucagcaaccuguccaaccugcuccagcaguacaagacccuggccuaccccuuccagagccugcucuaccugcugcucgcgcuguccaccaucagcgccuucgaccgcaucgacuucgccaagaucuccguggccauccggaacuuccuggcccucgacccgacggcgcuggccagcuuccuguacuucaccgcccucauccugucccugagccagcagaugaccuccgaccgcauccaccucuacacccccagcuccgugaacggcagccugugggaggccggcaucgaggagcagauccugcagcccuggaucgucgugaaccucguggucgcccugcugguggggcucuccuggcuguuccugagcuaccgccccggcauggaccucuccgaggagcugauguucagcuccgagguggaggaguacccggacaaggagaaggagaucaaggcgagcuccuga

SEQ ID NO: 37827 - RNA, 891 nt, Artificial Sequence
  derived and/or modified sequence opt1 from TMEM241__Homo_sapiens__NP_116322
augugcgugcgccggagccuggucggccucaccuucugcacgugcuaccuggccuccuaccugaccaacaaguacgugcucagcgugcugaaguucaccuaccccacccuguuccagggguggcagacccucaucggcgggcugcugcuccacgucuccuggaagcugggcuggguggagaucaacagcuccagccgcucccacgugcuggucuggcucccggccagcgugcuguucguggggaucaucuacgcgggcucccgggcccugagccgccucgccauccccgucuuccugacgcugcacaacguggccgaggugaucaucugcggcuaccagaagugcuuccagaaggagaagaccucccccgccaagaucugcagcgcgcuccugcugcucgccgccgccgggugccugcccuucaacgacucccaguucaacccggacggcuacuucugggcgaucauccaccuccugugcgucggggccuacaagauccugcagaagucccagaagcccagcgcccugagcgacaucgaccagcaguaccucaacuacaucuucuccguggugcugcuggccuucgccagccaccccaccggcgaccucuucuccguccuggacuuccccuuccuguacuucuaccgguuccacgggagcugcugcgcgagcggcuuccucggcuucuuccugauguucuccaccgugaagcugaagaaccuccuggccccggggcagugcgccgccuggaucuucuucgccaagaucaucacggcgggccugagcauccuccuguucgacgccauccugaccuccgccaccaccgggugccuccugcugggcgcccucggcgaggcccugcugguguucagcgagcgcaaguccagcuga

SEQ ID NO: 37828 - RNA, 387 nt, Artificial Sequence
  derived and/or modified sequence opt1 from TMEM244__Homo_sapiens__NP_001010876
auggcccuccaggugcgcgucgcccccagcaagguggugcugcagaaguuccugcugugcgucauccucuucuacaccguguacuacgugucccugagcaugggcugcgucauguucgaggugcacgagcugaacgugcucgcgccguucgacuucaagaccaaccccuccuggcugaacaucaacuacaagguccugcucgugagcacggaggugaccuacuucgucugcgggcuguucuucgugcccguggucgaggagugggugugggacuacgccaucuccgugaccauccugcacgucgccaucaccagcacggugaugcucgaguucccccugaccucccacuggugggccgcccugggcaucagcaagcuccugguguga

SEQ ID NO: 37829 - RNA, 2640 nt, Artificial Sequence
  derived and/or modified sequence opt1 from TMEM245__Homo_sapiens__NP_114401
auggccgacggcgggggccccaaggacgccccgagccugcgcuccagccccgggcccgcgccccgggugccgcgcgccgucggccccuccgggggcggcggggagacgccccggaccgccgcccucgcccugcgcuucgacaagcccaucaagcaggcguucuacaacaccggcgccgugcuguucgugugccucugcugcggggccgccguccugguguacuucauccuggaggcguuccuccggccgcugcugugggccgugcucugcggcaccuuccugcaccccuucaagagcucccugacccgccucgggcggcacuggcugcagcgccugcaccgggcccacacccccaucguccucgccgcccugcugcucccccugugcuucguggacuacggcguggaggcgcugggcgagcaggcccuccgccggcgccggcugcugcuccugcugggggccggcgggccgcuccuguacggccuguacugccucggcagcuaccuggggguccaggugcugcucgugcacgccgccacgcugaucugccgcggccuggacuacuucuccagccucuggaucuggacccuggucgugggguacgugcugaccgucuccuucaaguggaacgcgagcaccgagcgguaccuccgcgccguguccauccccguguggaucauccugcuguuccaccucgccagccuggccggcuccuggcggauccccgucuuccuggugaucguguuccucaugagcgucgggacgcuguacgagaagcagaacggcaaggaguccagcggcgccgagcugcccggccaggugaucuccauggcggccagcacccucgccaaccuggccaucuccaucaccggguacgagagcagcuccgaggaccagccgagcacccagcccgccgaggcgguggaccgcggggaguccgcccccacgcugagcaccucccccagcccguccagccccucccccaccagccccuccccgacccugggccggcgccggcccgagaucgggacguuccuccgcaagaagaagaccagcgacaucuacuucgucucccuggugugggccaucgucgugaugcagaucuggcugaaccucuggaucgugcagcugcugcccguccccaucgccguguggauccucaagaagcuggugauccacuucggcgucguggacuuccuggagaagcgcuaccacgugugguggggcaucaucgagagcuuccucaaggagcggcagggggcgcuggccccguggcccaucgucggccuggggaaguuccuccugaagguggacuccaagcuguggcacuggcucaacaagaagaugaucaucuggcuggagaagaugcuggacaagaucaucagcaucuucaucaucuuccuccuggugaucggcacccugcuccuggcccugcuccugaccgccaagguccaccaggaguccgugcacaugaucgaggugacgagcaaccugaucaacgagacccucgccaaccaccccgagugggcgaacuggcugccggaggcccaggucgugcagcgcgcccugaacuccgccgccaacaacguguaccaguacgggcgggaguggaucacccacaagcuccacaagauccugggcgacaaggucaacaacaccgcggugaucgagaagcagguccuggagcucugggaccgccuguaccacagcugguucgugaagaacgugacgcacagcggccggcacaaggggcagaagcugcacgugucccgccagaacagcuggcucggcgacauccuggacuggcaggacaucgucuccuucgugcacgagaacaucgagaccuuccugagcauccucgagucccuguggaucgugaugagccggaacgucucccugcuguucaccaccgugacgacccugcugaccauccucuucuacagcgggaccgcccugcugaacuucgugcucucccugaucaucuuccugacgacccucuucuaccugcugagcuccagcgacgaguacuacaagcccgucaagugggugaucucccucacgccccugagccagcccggcccguccagcaacaucaucggccaguccguggaggaggccauccgcggggucuucgacgccagccugaagauggccggcuucuacgggcucuacaccuggcugacccacaccauguucggcaucaacaucguguucauccccagcgcgcuggccgccauccucggggccgugcccuuccugggcaccuacugggcggccguccccgccgugcuggaccucuggcugacccagggccuggggugcaaggccauccuccugcugaucuuccaccuccugccgaccuacuucguggacacggccaucuacuccgacaucagcggcgggggccaccccuaccugaccgggcucgcggucgccggcggcgccuacuaccuggggcuggagggcgccaucaucgggcccauccuccugugcauccuggugguggccuccaacaucuacagcgcgaugcucgucucccccaccaacagcgugccgacccccaaccagacgcccuggcccgcccagccgcagcggaccuuccgcgacaucuccgaggaccucaagagcuccgugggcuga

SEQ ID NO: 37830 - RNA, 1863 nt, Artificial Sequence
  derived and/or modified sequence opt1 from TMEM259__Homo_sapiens__NP_001028198
augagcgagcacguggagcccgccgccccgggccccgggcccaacggcgggggcgggggccccgcgccggcccgcggcccccggacccccaaccugaaccccaacccgcucaucaacguccgcgaccggcuguuccacgcccuguucuucaagauggccgugaccuacucccgccucuucccgcccgccuuccggcgccuguucgaguucuucgugcugcucaaggcgcuguucguccuguucgugcucgccuacauccacaucguguucagccggucccccaucaacugccuggagcacguccgcgacaaguggccccgggaggggauccugcgcguggaggugcggcacaacagcucccgcgcccccgucuuccuccaguucugcgacagcggcgggcggggcuccuuccccgggcuggccguggagcccggcagcaaccuggacauggaggacgaggaggaggaggagcucaccauggagauguucggcaacuccagcaucaaguucgagcuggacaucgagccgaagguguucaagccgcccuccagcaccgaggcgcugaacgacucccaggaguuccccuuccccgagacccccaccaaggucuggccccaggacgaguacaucguggaguacagccucgaguacggguuccugcgccugucccaggccacgcggcagcgccucagcauccccgugauggucgugacccuggacccgacccgggaccagugcuucggcgaccgcuucucccggcugcuccuggacgaguuccugggguacgacgacauccucaugagcuccgugaagggccuggccgagaacgaggagaacaagggcuuccugcgcaacgucgugagcggggagcacuaccgguucgugagcauguggauggcccgcaccuccuaccucgccgcguucgccaucauggucaucuucacgcugagcguguccaugcugcuccgcuacagccaccaccagaucuucguguucaucgucgaccugcugcagaugcucgagaugaacauggccaucgccuuccccgccgcgccccugcugaccgugauccucgcccuggucggcauggaggccaucauguccgaguucuucaacgacaccaccacggccuucuacaucauccugaucguguggcucgccgaccaguacgacgcgaucugcugccacaccagcaccuccaagcggcacuggcugcgcuucuucuaccuguaccacuucgccuucuacgccuaccacuaccgguucaacgggcaguacagcucccucgcccuggugaccagcuggcuguucauccagcacuccaugaucuacuucuuccaccacuacgagcuccccgccauccugcagcagguccgcauccaggagaugcugcugcaggcgccgccccucggccccgggacgccgaccgcccugcccgacgacaugaacaacaacagcggcgcccccgccaccgcgcccgacuccgccggccagccgcccgcccuggggcccgugagccccggcgccuccgggagcccgggccccguggccgcggcccccuccagccucgucgccgccgccgcguccguggccgccgccgccgggggcgaccugggcuggauggcggagaccgccgccaucaucacggacgccagcuuccugagcgggcucuccgcgagccugcuggagcggcgccccgccuccccgcucggccccgccgggggccugccccacgcgccccaggacagcgugccgcccuccgacagcgccgccuccgacaccacgccccugggggccgccgucggcggccccagcccggccuccauggcccccaccgaggcgcccagcgaggugggguccuga

SEQ ID NO: 37831 - RNA, 969 nt, Artificial Sequence
  derived and/or modified sequence opt1 from TMEM25__Homo_sapiens__NP_001137507
auggcccugcccccgggccccgccgcgcuccgccacacccugcugcuccugcccgcccugcucagcuccggguggggcgagcuggagccccagaucgacgggcagaccugggccgagcgggcccugcgcgagaacgagcggcacgccuucacgugccgcguggcgggcgggccgggcacgccccggcucgccugguaccuggacggccagcugcaggaggccagcaccucccgccuccugagcgucgggggcgaggccuucuccgggggcaccagcaccuucaccgugaccgcgcaccgggcccagcacgagcugaacugcucccuccaggacccccgcagcgggcgguccgccaacgccagcgugauccugaacguccaguucaagcccgagaucgcccaggugggcgcgaaguaccaggaggcccagggcccggggcugcucgugguccuguucgcccuggugcgcgccaacccgcccgccaacgugaccuggaucgaccaggacggccccgucacggugaacaccuccgacuuccucgugcuggacgcgcagaacuaccccuggcugaccaaccacaccguccagcuccagcugcggagccuggcccacaaccucuccgugguggccacgaacgacgucggggugaccagcgccucccugcccgcccccggccccagccgccacccgucccugaucagcuccgacagcaacaaccucaagcugaacaacgugcggcugccccgcgagaacaugagccuccccuccaaccugcagcugaacgaccucacccccgacagccgggcggucaagccggccgaccgccagauggcccagaacaacucccggcccgagcugcuggaccccgagcccggcgggcuccugaccagccagggcuucauccgccugccggugcucggguacaucuaccggguguccagcgucuccagcgacgagaucuggcuguga

SEQ ID NO: 37832 - RNA, 339 nt, Artificial Sequence
  derived and/or modified sequence opt1 from TMEM261__Homo_sapiens__NP_219500
augggcagccgccugucccagcccuucgagagcuacaucaccgccccgcccgggaccgccgcggcccccgccaagcccgccccgcccgccacgcccggcgcgcccaccuccccggccgagcaccggcuccugaagaccugcuggagcugccgcgugcuguccgggcucggccugaugggggccggcggcuacgucuacuggguggcccggaagcccaugaagaugggguacccgcccagccccuggaccaucacgcagauggugaucggccuguccaucgcgaccugggggaucgucgugauggccgaccccaagggcaaggccuaccgcguggucuga

SEQ ID NO: 37833 - RNA, 669 nt, Artificial Sequence
  derived and/or modified sequence opt1 from TMEM27__Homo_sapiens__NP_065716
augcuguggcuccuguucuuccuggugaccgccauccacgccgagcucugccagcccggcgcggagaacgccuucaagguccgccugagcauccggaccgcccugggggacaaggccuacgccugggacaccaacgaggaguaccucuucaaggcgaugguggccuucuccaugcgcaaggugccgaaccgggaggccaccgagaucagccacguccugcugugcaacgugacccagcgcguguccuucugguucgucgugaccgaccccagcaagaaccacacgcuccccgccguggagguccaguccgcgauccggaugaacaagaaccgcaucaacaacgccuucuuccugaacgaccagacccuggaguuccucaagauccccagcacccuggccccgcccauggaccccuccgugcccaucuggaucaucaucuucggcgugaucuucugcaucaucaucgucgccaucgcccugcucauccugagcgggaucuggcagcggcgccggaagaacaaggagccguccgagguggacgacgcggaggacaagugcgagaacaugaucaccaucgagaacggcauccccagcgacccccuggacaugaagggcgggcacaucaacgacgccuucaugacggaggacgagcgccucacgccccuguga

SEQ ID NO: 37834 - RNA, 3963 nt, Artificial Sequence
  derived and/or modified sequence opt1 from TMEM2__Homo_sapiens__NP_001129292
auguacgccaccgacagccgcggccacucccccgccuuccugcagccgcagaacgggaacagccggcaccccuccggcuacgugcccgggaaggucgugccccuccgcccgcccccgccgcccaagagccaggcguccgccaaguucaccagcauccggcgcgaggaccgggccacguucgccuucucccccgaggagcagcaggcccagcgcgagagccagaagcagaagcggcacaagaacaccuucaucugcuucgcgaucaccuccuucagcuucuucaucgcccuggccaucauccugggcaucuccagcaaguacgcccccgacgagaacugccccgaccagaacccccgccuccggaacugggaccccgggcaggacuccgcgaagcaggucgucaucaaggagggcgacaugcugcgccugaccagcgacgccacggugcacuccaucgugauccaggacggcgggcuccuggucuucggcgacaacaaggacgggagccggaacaucacccugcgcacccacuacauccucauccaggacggcggggcccugcacaucggcgccgagaagugccgguacaaguccaaggccaccaucacgcuguacggcaagagcgacgagggggaguccaugcccaccuucggcaagaaguucaucgggguggaggcgggcggcacccucgagcugcacggggcccgcaaggccagcuggacccugcucgcccggacgcugaacagcuccggccugcccuucgggagcuacaccuucgagaaggacuucucccgcggccucaacgugcgggucaucgaccaggacaccgccaagauccuggagagcgagcgcuucgacacccacgaguaccggaacgagucccgccggcugcaggaguuccuccgcuuccaggaccccgggcgcaucguggcgaucgccgugggcgacagcgccgccaagucccugcugcagggcacgauccagaugauccaggagcggcucgggagcgagcugauccagggccugggguaccgccaggccugggcgcucgucggcgugaucgacgggggcuccaccagcugcaacgaguccgugcggaacuacgagaaccacagcuccggcgggaaggcccuggcccagcgcgaguucuacaccgucgacggccagaaguucagcgugaccgccuacuccgaguggaucgaggagacgccccaguuccugcacaugggggagaucaucgacggcguggacaugcgggccgaggucgggauccucacccgcaacaucgugauccagggcgagguggaggacagcugcuacgcggagaaccagugccaguucuucgacuacgacaccuucggcgggcacaucaugaucaugaagaacuucaccuccgugcaccugagcuacguggagcugaagcacaugggccagcagcagauggggcgguacccggugcacuuccaccucugcggcgacgucgacuacaagggcggguaccgccacgccacguucguggacggccuguccauccaccacagcuucagccggugcaucaccguccacgggaccaacggccugcucaucaaggacaccaucggguucgacacgcugggccacugcuucuuccuggaggacggcaucgagcagcgcaacacccucuuccacaaccuggggcugcucaccaagcccggcacccugcugccgacggaccggaacaacuccaugugcaccaccaugcgcgacaagguguucgggaacuacauccccgugcccgccaccgacugcauggccgucagcacguucuggaucgcgcaccccaacaacaaccucaucaacaacgccgccgccggcucccaggacgccgggaucugguaccuguuccacaaggagccgaccggcgagagcuccggccugcagcuccuggcgaagcccgagcugacgccccuggggaucuucuacaacaaccgggugcacagcaacuucaaggccggccucuucaucgacaagggggugaagaccaccaacuccagcgccgccgacccccgcgaguaccugugccuggacaacuccgcccgguuccgcccgcaccaggacgcgaaccccgagaagccccgggucgccgcccucaucgaccgccugaucgccuucaagaacaacgacaacggcgccugggugcgcgggggcgacaucaucgugcagaacagcgcguucgccgacaacggcaucgggcugaccuucgccuccgacggcagcuucccguccgacgaggggagcucccaggaggucagcgagucccucuucgugggcgagagccggaacuacggguuccagggcggccagaacaaguacguggggaccggcgggaucgaccagaagccccgcacccugccccggaaccgcaccuuccccauccggggcuuccagaucuacgacggcccgauccaccugacgcgcagcaccuucaagaaguacguccccacccccgaccgguacuccagcgccaucggguuccucaugaagaacuccuggcagaucacgccccgcaacaacaucagccuggugaaguucggcccgcacgugucccugaacgucuucuucgggaagcccggccccugguucgaggacugcgagauggacggggacaagaacagcaucuuccacgacaucgacggcuccgugaccggcuacaaggacgcguacguggggcggauggacaacuaccucauccgccaccccagcugcgucaacguguccaaguggaacgccgugaucugcagcggcaccuacgcccaggucuacgugcagaccugguccacccagaaccugagcaugacgaucacccgggacgaguacccguccaaccccauggugcugcgcgggaucaaccagaaggccgccuucccccaguaccagcccgucgugaugcucgagaagggcuacaccauccacuggaacgggccggcgccccggaccacguuccuguaccuggugaacuucaacaagaacgacuggauccgcgucggccucugcuaccccagcaacaccuccuuccaggugaccuucggcuaccugcagcggcagaacgggagccuguccaagaucgaggaguacgagcccgugcacagccucgaggagcugcagcgcaagcaguccgagcggaaguucuacuucgacagcagcaccggccuccucuuccuguaccugaaggccaagucccaccgccacgggcacagcuacugcuccagccagggcugcgagcgggucaagauccaggccgccacggacuccaaggacaucagcaacugcauggccaaggcguacccgcaguacuaccgcaagcccuccguggugaagcggaugcccgccaugcucaccgggcugugccagggcugcggcacccgccaggucguguucaccagcgacccccacaaguccuaccugccggugcaguuccagagccccgacaaggccgagacgcagcgcggggaccccuccgucaucagcgugaacggcaccgacuucaccuuccgguccgccggggugcuccugcuggucguggacccgugcagcgugcccuuccgccucaccgagaagacggucuucccccuggccgacgugucccggaucgaggaguaccugaagaccggcaucccgccccgcagcaucgugcuccuguccacccggggcgagaucaagcagcugaacaucagccaccuccuggucccccuggggcucgcgaagcccgcccaccuguacgacaagggcuccaccaucuuccugggguucagcggcaacuucaagcccagcuggacgaagcuguucaccuccccggccgggcagggccugggcgugcuggagcaguucaucccccuccagcuggacgaguacgggugcccccgcgccaccaccgugcggcgccgggaccuggagcuccugaagcaggcgagcaaggcccacuga

SEQ ID NO: 37835 - RNA, 978 nt, Artificial Sequence
  derived and/or modified sequence opt1 from TMEM30A__Homo_sapiens__NP_001137430
auggccaugaacuacaacgccaaggacgagguggacggcgggcccccgugcgcgcccggcgggaccgccaagacccgccggcccgacaacacggccuucaagcagcagcgccugcccgccuggcagccgauccucaccgccggcaccguccugcccaucuucuucaucaucgggcugaucuucauccccaucggcaucggcaucuucgugaccagcaacaacauccgggagaucgaggggaacguguucauguacuacggccucuccaacuucuaccagaaccaccgccgguacgucaagagccgcgacgacucccagcugaacggggacagcuccgcgcugcucaaccccagcaaggagugcgagccguaccggcgcaacgaggacaagcccaucgcccccugcggcgccaucgccaacuccauguucaacgacacgcuggagcuguuccucaucgggaacgacagcuaccccaucccgaucgcgcugaagaagaagggcaucgccugguggaccgacaagaacgugaaguuccggaacccgcccggcggggacaaccuggaggagcgcuucaagggcaccaccaagcccgugaacuggcucaagcccgucuacaugcuggacuccgaccccgacaacaacggguucaucaacgaggacuucaucguguggaugcggacggccgcccugcccaccuuccgcaagcucuaccggcugaucgagcgcaagagcgaccugcaccccacccucccggccggccgguacucccugaacgugaccuacaacuaccccguccacuacuucgacggccgcaagcggaugauccugagcacgaucuccuggaugggcgggaagaaccccuuccucgggaucgcguacaucgccgugggcagcaucuccuuccugcugggggugguccuccuggugaucaaccacaaguaccgcaacagcuccaacaccgccgacaucaccaucuga

SEQ ID NO: 37836 - RNA, 1056 nt, Artificial Sequence
  derived and/or modified sequence opt1 from TMEM30B__Homo_sapiens__NP_001017970
augaccuggagcgccaccgcccgcggcgcgcaccagcccgacaacacggccuucacccagcagcggcugccggccuggcagccccuccuguccgccagcaucgcccugccccucuucuucugcgcggggcuggccuucaucggccuggggcucggccuguacuacuccagcaacgggaucaaggagcuggaguacgacuacaccggcgaccccggcaccgggaacugcuccgugugcgccgccgcgggccaggggcgcgcccucccgccgcccugcagcugcgccugguacuucucccugcccgagcuguuccagggccccgucuaccucuacuacgagcugacgaacuucuaccagaacaaccggcgcuacggggugagccgggacgacgcccagcuguccggccuccccagcgcccugcgccaccccgugaacgagugcgcgcccuaccagcgguccgccgccggccugccgaucgcccccugcggggccaucgcgaacagccucuucaacgacuccuucagccuguggcaccagcgccagcccggcgggcccuacgucgaggugccgcuggaccgguccggcaucgccugguggaccgacuaccacgugaaguuccgcaacccgccccucgucaacggcagccuggcccuggccuuccaggggaccgcgccgccgcccaacuggcggcgccccguguacgagcucucccccgaccccaacaacaccggcuucaucaaccaggacuucguggucuggaugcggacggccgcccugcccaccuuccgcaagcuguacgcccggauccgccaggggaacuacagcgccggccucccccgcggggccuaccgggugaacaucaccuacaacuaccccgugcgggcguucggcggccacaagcugcugaucuucuccagcaucagcuggaugggcgggaagaaccccuuccucgggaucgccuaccuggucgugggcucccugugcauccucaccggguucgugaugcuggucguguacauccgcuaccaggaccaggacgacgacgacgaggaguga

SEQ ID NO: 37837 - RNA, 573 nt, Artificial Sequence
  derived and/or modified sequence opt1 from TMEM37__Homo_sapiens__NP_899063
augaccgccgugggcguccaggcccagcgcccccuggggcagcggcagccgcgccggagcuucuucgaguccuucauccgcacccucaucaucacgugcguggcgcuggccgugguccugagcuccgugagcaucugcgacggccacuggcuccuggccgaggaccggcuguucgggcucuggcacuucugcaccaccaccaaccagacgaucugcuuccgcgaccugggccaggcccacgugcccgggcuggccgucggcaugggccucgugcgguccgugggggcgcuggccgucguggccgccaucuucggccuggaguuccucauggugagccagcugugcgaggacaagcacucccagugcaagugggucauggggagcauccugcuccugguguccuucgugcugagcuccggcgggcuccugggcuucgucauccugcuccgcaaccaggugacccugaucggcuucacccugauguucuggugcgaguucaccgcgagcuuccuccuguuccugaacgccaucuccgggcuccacaucaacagcaucacgcaccccugggaguga

SEQ ID NO: 37838 - RNA, 900 nt, Artificial Sequence
  derived and/or modified sequence opt1 from TMEM38A__Homo_sapiens__NP_076979
auggagcugcucagcgcccugucccugggcgagcucgcccugagcuucucccgcgugccccuguucccggucuucgaccucagcuacuucaucguguccauccuguaccugaaguacgagcccggggcgguggagcucagccggcgccaccccaucgccuccuggcugugcgccaugcugcacugcuucggcagcuacauccucgccgaccugcugcucggggagccccugaucgacuacuucuccaacaacagcuccauccugcucgccagcgcggucugguaccugaucuucuucugcccgcuggaccucuucuacaagugcgugugcuuccugcccgugaagcugaucuucgucgccaugaaggagguggugcggguccgcaagaucgccgugggcauccaccacgcccaccaccacuaccaccacgggugguucgugaugaucgcgaccggcugggucaagggcuccgggguggcccucaugagcaacuucgagcagcugcugcggggcguguggaagcccgagaccaacgagauccuccacauguccuuccccacgaaggccagccuguacggggccauccuguucacccuccagcagacccgcuggcugccggucuccaaggccagccugaucuucaucuucacccucuucaugguguccugcaagguguuccugacggcgacccacagccacagcucccccuucgacgcccuggagggcuacaucugccccguccucuucgggagcgccugcggcggcgaccaccaccacgacaaccacgggggcucccacagcgggggcggccccggggcccagcacuccgccaugccggccaagagcaaggaggagcuguccgagggcagccggaagaagaaggcgaagaaggccgacuga

SEQ ID NO: 37839 - RNA, 876 nt, Artificial Sequence
  derived and/or modified sequence opt1 from TMEM38B__Homo_sapiens__NP_060582
auggacagccccugggacgagcuggcccucgccuucucccgcaccagcauguucccguucuucgacaucgcgcacuaccugguguccgucauggccgugaagcggcagcccggcgccgccgcccuggcguggaagaaccccaucagcuccugguucaccgccaugcuccacugcuucgggggcgggauccugagcugccugcuccuggccgagcccccgcugaaguuccucgccaaccacacgaacauccugcuggcguccagcaucugguacaucaccuucuucugcccccacgaccucgugucccagggcuacagcuaccugcccguccagcugcucgccuccgggaugaaggaggugacccgcaccuggaagaucgugggcggcgucacgcacgccaacagcuacuacaagaacggguggaucgugaugaucgccaucggcugggcccgcggggcgggcgggaccaucaucaccaacuucgagcggcuggugaagggcgacuggaagcccgagggcgacgaguggcugaagauguccuacccggccaaggucacccuccuggggagcgugaucuucacguuccagcacacccagcaccuggccaucuccaagcacaaccucauguuccuguacaccaucuucaucguggccaccaagaucacgaugaugaccacccagaccagcacgaugaccuucgcccccuucgaggacacccuguccuggaugcuguucggcuggcagcagcccuucagcuccugcgagaagaaguccgaggccaagagccccagcaacggggucggcagccucgcguccaagccgguggacguggccagcgacaacgucaagaagaagcacaccaagaagaacgaguga

SEQ ID NO: 37840 - RNA, 1467 nt, Artificial Sequence
  derived and/or modified sequence opt1 from TMEM39A__Homo_sapiens__NP_060736
augcccggcgggcgccggggcccgagccgccagcagcugucccggagcgcccuccccucccugcagacccuggucgggggcgggugcggcaacggcaccgggcuccgcaaccggaacggcagcgccaucgggcugcccgugcccccgaucacggcgcugaucacccccggccccgugcgccacugccagauccccgaccucccgguggacgggucccugcuguucgaguuccucuucuucaucuaccugcuggucgcccucuucauccaguacaucaacaucuacaagaccguguggugguaccccuacaaccaccccgccagcugcaccucccugaacuuccaccugaucgacuaccaccucgccgccuucaucacggugaugcuggcgcggcgccuggucugggcccucaucagcgaggccaccaaggccggcgcggccuccaugauccacuacauggugcugaucagcgcccggcuggugcuccugacccugugcggcuggguccucugcuggacccuggugaaccuguuccgcucccacagcgugcucaaccugcuguuccucggguaccccuucggcgucuacgugccgcugugcugcuuccaccaggacucccgggcccaccuccugcugacggacuacaacuacgugguccagcacgaggccguggaggagagcgcguccaccgucgggggccuggccaagagcaaggacuuccucucccugcugcucgagagccugaaggagcaguucaacaacgccacccccauccccacccacuccugcccccugagcccggaccucauccgcaacgagguggagugccugaaggccgacuucaaccaccggaucaaggaggugcuguucaacagccucuucuccgccuacuacguggcguuccugccccugugcuucgucaagagcacgcaguacuacgacaugcgcugguccugcgagcaccucaucaugguguggaucaacgccuucgugaugcugaccacccagcugcugcccagcaaguacugcgaccuccugcacaaguccgccgcccaccugggcaaguggcagaagcucgagcacgggagcuacuccaacgcgccccagcacaucuggagcgagaacaccaucuggccgcagggcguccuggugcggcacucccgcugccuguaccgggccauggggcccuacaacgucgccgugcccagcgacgugucccacgcccgcuucuacuuccucuuccaccggccccugcgccugcucaaccugcugauccucaucgagggcagcgucguguucuaccagcuguacucccugcuccggagcgagaaguggaaccacacgcuguccauggcccugauccucuucugcaacuacuacgugcuguucaagcugcuccgcgaccgcaucguccuggggcgggccuacagcuacccgcugaacuccuacgagcucaaggcgaacuga

SEQ ID NO: 37841 - RNA, 750 nt, Artificial Sequence
  derived and/or modified sequence opt1 from TMEM40__Homo_sapiens__NP_001271335
auggccgaggccggcgcggggagccugucccuccccggcgggaaggccauggagaccagcgccuccagcucccagccgcaggacaacagccaggugcaccgcgagaccgaggacgucgacuacggcgagacggacuuccacaagcaggacgggaaggccggccuguucucccaggagcaguacgagcggaacaagagcuccagcuccagcuccagcuccagcuccagcuccagcagcuccagcuccagcuccagcuccgagagcaacgacgaggaccagcagccccgcgccaccggcaagcaccggcgcucccugggggcgggcuacccccacgggaacggcagccccgggccgggccacggcgagcccgacgugcucaaggacgagcugcagcuguacggggacgcccccggcgaggugguccccuccggggagagcggccuccggcgccggggcuccgacccggccagcggggagguggaggccucccagcugcgccggcugaacaucaagaaggacgacgaguucuuccacuucgugcuccugugcuucgcgaucggcgcccugcucgucugcuaccacuacuacgccgacugguucaugagccugggggugggccugcucaccuucgccucccuggagaccguggggaucuacuucggccuggucuaccgcauccacagcgugcuccagggcuucaucccccuguuccagaaguuccggcugacgggguuccgcaagaccgacuga

SEQ ID NO: 37842 - RNA, 1203 nt, Artificial Sequence
  derived and/or modified sequence opt1 from TMEM43__Homo_sapiens__NP_077310
auggccgccaacuacagcuccaccagcacccgccgggagcacgugaaggucaagacguccagccagcccggcuuccuggagcgccucuccgagaccagcgggggcauguucguggggcugauggcguuccugcucuccuucuaccugaucuucaccaacgagggccgggcccugaagaccgccacgagccucgccgaggggcugucccugguggucagcccggacuccauccacagcguggcccccgagaacgagggccgccucgugcacaucaucggcgcgcugcggaccuccaagcugcucagcgaccccaacuacgggguccaccuccccgccgugaagcugcgccggcacguggagauguaccagugggucgagaccgaggagucccgcgaguacaccgaggacggccaggugaagaaggagacgcgguacagcuacaacaccgaguggcgcuccgagaucaucaacagcaagaacuucgaccgggagaucgggcacaagaacccguccgccauggccguggagagcuucauggcgaccgcccccuucguccagaucggccgcuucuuccucagcuccgggcugaucgacaagguggacaacuucaagagccugucccucagcaagcuggaggacccccacguggacaucauccggcgcggcgacuucuucuaccacuccgagaaccccaaguacccggaggucggcgaccugcgggugagcuucuccuacgccgggcucagcggcgacgaccccgaccuggggcccgcccacguggucaccgugaucgcccgccagcggggcgaccagcuggugcccuucuccaccaagagcggcgacacgcuccugcugcuccaccacggggacuucuccgcggaggaggucuuccaccgcgagcugcggagcaacuccaugaagaccuggggccugcgcgccgccggguggauggccauguucaugggccucaaccugaugacccggauccuguacacgcucguggacugguucccgguguuccgcgaccuggucaacaucgggcugaaggccuucgcguucugcguggccaccagccucacccugcugaccgucgccgccggcuggcuguucuaccgcccccugugggcccugcucaucgcgggccuggcccuggugcccauccucguggcccggacgcgcguccccgccaagaagcuggaguga

SEQ ID NO: 37843 - RNA, 828 nt, Artificial Sequence
  derived and/or modified sequence opt1 from TMEM45A__Homo_sapiens__NP_060474
augggcaacuuccgcgggcacgcccugcccggcaccuucuucuucaucaucgggcucugguggugcaccaagagcauccugaaguacaucugcaagaagcagaagcggacgugcuaccugggcuccaagacccucuucuaccgccuggagauccuggaggggaucaccaucgugggcauggcccucaccggcauggcgggggagcaguucaucccgggcgggccccaccugaugcuguacgacuacaagcagggccacuggaaccagcuccugggguggcaccacuucacgauguacuucuucuucggccugcucggcgucgccgacauccugugcuucaccaucagcucccugcccgugagccucaccaagcugaugcuguccaacgcccucuucguggaggccuucaucuucuacaaccacacccacgggcgggagaugcuggacaucuucguccaccagcugcucgugcugguggucuuccugacgggccucguggccuuccuggaguuccuggugcgcaacaacguccuccuggagcugcuccggagcucccugauccugcuccaggggagcugguucuuccagaucggcuucgugcuguacccgcccuccggcgggcccgcgugggaccugauggaccacgagaacauccucuuccugaccaucugcuucugcuggcacuacgccgugaccaucgucaucgugggcaugaacuacgccuucaucaccuggcuggucaagagccgccucaagcggcugugcuccagcgagguggggcugcucaagaacgccgagcgcgagcaggaguccgaggaggagauguga

SEQ ID NO: 37844 - RNA, 546 nt, Artificial Sequence
  derived and/or modified sequence opt1 from TMEM47__Homo_sapiens__NP_113630
auggccagcgccggcuccgggauggaggaggugcgcgucagcgugcugaccccccucaagcuggugggccuggucugcaucuuccucgcgcugugccuggaccucggggccgugcuguccccggccugggugaccgccgaccaccaguacuaccugagccucugggaguccugccggaagcccgccagccuggacaucuggcacugcgaguccacgcugagcuccgacuggcagaucgcgacccucgcccugcugcucggcggggccgccaucauccugaucgcguuccuggucggccucaucagcaucugcgugggcucccgccggcgcuucuaccggcccguggccgucaugcuguucgccgccguggugcugcaggucugcagccucgugcuguaccccaucaaguucaucgagaccgugucccugaagaucuaccacgaguucaacuggggguacggccucgccuggggggcgaccaucuucagcuucggcggggccauccuguacugccugaacccgaagaacuacgaggacuacuacuga

SEQ ID NO: 37845 - RNA, 477 nt, Artificial Sequence
  derived and/or modified sequence opt1 from TMEM50B__Homo_sapiens__NP_006125
auggccggcuuccuggacaacuuccgcuggcccgagugcgagugcaucgacuggagcgagcggcgcaacgccguggcguccgucguggccgggauccucuucuucaccggcugguggaucaugaucgacgccgccguggucuacccgaagcccgagcagcugaaccacgccuuccacacgugcgggguguucagcacccuggcguucuucaugaucaacgccguguccaacgcccagguccggggcgacagcuacgaguccgggugccucggccgcaccggcgcccggguguggcuguucaucggguucaugcugauguucggcagccucaucgcguccauguggauccuguucggggccuacgugacccagaacaccgacgucuaccccggccuggccguguucuuccagaacgcccucaucuucuucagcacgcugaucuacaaguucgggcgcaccgaggagcuguggaccuga

SEQ ID NO: 37846 - RNA, 774 nt, Artificial Sequence
  derived and/or modified sequence opt1 from TMEM55A__Homo_sapiens__NP_061180
auggccgccgacggcguggacgagcgcagcccccugcucuccgcgagccacuccgggaacgucaccccgaccgccccgcccuaccugcaggagagcagcccccgggccgagcugcccccgcccuacacggccaucgccucccccgacgcguccggcauccccgugaucaacugccgcgugugccagagccucaucaaccuggacgggaagcugcaccagcacgucgugaagugcaccgugugcaacgaggccacccccaucaagaacccgcccaccggcaagaaguacguccggugccccugcaacugccuccugaucugcaaggacacgucccgccggaucgggugcccccgccccaacugccggcgcaucaucaaccugggccccgugaugcucaucagcgaggagcagccggcccagcccgcccugcccauccagcccgagggcacccggguggucugcgggcacugcggcaacaccuuccuguggauggagcuccgcuucaacacccuggcgaagugcccgcacugcaagaagaucuccagcgugggguccgcccugccccggcgccggugcugcgccuacaucacgaucggcaugaucugcaucuucaucggggugggccucaccgucggcacccccgacuucgcccgccgguuccgcgccaccuacgugagcugggcgaucgccuaccugcuggggcucaucugccugauccgggccugcuacuggggcgccauccgcguguccuaccccgagcacagcuucgccuga

SEQ ID NO: 37847 - RNA, 1464 nt, Artificial Sequence
  derived and/or modified sequence opt1 from TMEM57__Homo_sapiens__XP_011540006
augcgccugcggaagcagaaggaggugcagaaggagaacgaguucuacaugcagcuccugcagcaggcccugcccccggagcagcagaugcuccagaagcaggagaaggaggccgaggaggcggccaagggccugcccgacauggacagcuccauccugauccaccacaacgggggcauccccgccaacaagaagcucagcaccacccugcccgagaucgaguaccgcgagaaggggaaggagaaggacaaggacgccaagaagcacaaccugggcaucaacaacaacaacauccuccagccggucgacuccaagauccaggagaucgaguacauggagaaccacaucaacagcaagcggcugaacaacgaccuggugggguccacggagaaccuccugaaggaggacagcugcaccgccuccagcaagaacuacaagaacgcguccggcguggucaacagcagcccccgcucccacuccgccaccaacggcagcauccccuccagcuccagcaagaacgagaagaagcagaagugcaccuccaagagccccagcacgcacaaggaccugauggagaacugcaucccgaacaaccagcucuccaagcccgacgcccuggugcggcuggagcaggacaucaagaagcucaaggccgaccugcaggcgagccgccagguggagcaggagcugcggucccagaucagcucccucagcuccaccgagcgcgggauccggagcgagaugggccagcugcgccaggagaacgagcugcuccagaacaagcugcacaacgccguccagaugaagcagaaggacaagcagaacaucucccagcuggagaagaagcucaaggccgagcaggaggcccggagcuucguggagaagcagcugauggaggagaagaagcgcaagaagcuggaggaggccaccgcggcccgggccguggccuucgccgcggccucccgcggggagugcaccgagacgcuccggaaccgcauccgggagcuggaggccgagggcaagaagcugaccauggacaugaaggucaaggaggaccagauccgcgagcucgagcugaaggugcaggagcugcggaaguacaaggagaacgagaaggacaccgaggugcucaugagcgcccuguccgccaugcaggacaagacccagcaccuggagaacagccucuccgcggagacgcgcaucaagcuggaccuguucagcgcccucggggacgccaagcggcagcuggagaucgcccagggccagauccugcagaaggaccaggagaucaaggaccucaagcagaagaucgccgaggucauggcggugaugcccuccaucaccuacagcgccgccaccagcccccuguccccggugagcccccacuacuccagcaaguucgucgagaccucccccagcggccuggaccccaacgccuccguguaccagccgcucaagaaguga

SEQ ID NO: 37848 - RNA, 1332 nt, Artificial Sequence
  derived and/or modified sequence opt1 from TMEM5__Homo_sapiens__NP_055069
augcgccugacccggaagcgccucugcagcuuccugaucgcccuguacugccucuucucccuguacgccgccuaccacguguucuucggccggcgccggcaggcccccgccgggagcccgcgcggccugcggaagggggccgcccccgcgcgcgagcggcgcggccgggagcaguccacccucgagagcgaggaguggaaccccugggagggggacgagaagaacgagcagcagcaccgcuucaagacgucccugcagauccuggacaagagcaccaagggcaagaccgaccucuccguccagaucuggggcaaggccgccaucgggcuguaccugugggagcacaucuucgagggccuccuggaccccagcgacgugaccgcccaguggcgggaggggaaguccaucgugggccgcacgcaguacagcuucaucaccgggccggcggucauccccggcuacuucuccguggacgugaacaacgucgugcugauccucaacggccgggagaaggccaagaucuucuacgccacccaguggcugcuguacgcccagaaccucgugcagauccagaagcugcagcaccuggccgucgugcuccuggggaacgagcacugcgacaacgaguggaucaaccccuuccugaagcgcaacggcggguucguggagcuccuguucaucaucuacgacagccccuggaucaacgacgucgacguguuccaguggccgcugggcguggcgaccuaccggaacuuccccgucguggaggccuccuggagcaugcuccacgacgagcgccccuaccugugcaacuuccugggcacgaucuacgagaacuccagccggcaggcccucaugaacauccugaagaaggacgggaacgacaagcugugcuggguguccgcccgcgagcacuggcagccccaggagaccaacgagagccucaagaacuaccaggacgcccugcugcaguccgaccucacccugugcccggucggcgugaacaccgagugcuaccggaucuacgaggcgugcagcuacgggagcauccccguggucgaggacgugaugacggccggcaacugcgggaacaccuccgugcaccacggcgcgccccugcagcuccucaagagcaugggcgcccccuucaucuucaucaagaacuggaaggagcugccggccguccuggagaaggagaagaccaucauccugcaggagaagaucgagcgccgcaagaugcugcuccagugguaccagcacuucaagaccgagcugaagaugaaguucacgaacauccuggaguccagcuuccucaugaacaacaaguccuga

SEQ ID NO: 37849 - RNA, 402 nt, Artificial Sequence
  derived and/or modified sequence opt1 from TMEM60__Homo_sapiens__NP_116325
augcgcaugagccuggcccagcgggugcuccugaccuggcuguucacccuccuguuccugaucaugcucguccugaagcuggacgagaaggcccccuggaacugguuccucaucuucaucccgguguggaucuucgacacgauccugcuggugcuccugaucgucaagauggcgggccgcugcaaguccggguucgacccccggcacggcagccacaacaucaagaagaaggccugguaccugaucgccaugcuccugaagcuggccuucugccucgcccugugcgcgaagcuggagcaguucaccaccaugaaccucuccuacguguucaucccccugugggcccugcucgccggggcccugaccgagcugggcuacaacguguucuucguccgcgacuga

SEQ ID NO: 37850 - RNA, 1932 nt, Artificial Sequence
  derived and/or modified sequence opt1 from TMEM62__Homo_sapiens__NP_079232
auggccgccgugcuggcgcuccgcgucguggccggccuggccgccgccgcgcugguggccaugcuccuggagcacuacgggcuggccggccagcccagcccgcucccccggcccgcgcccccgcgccggccccaccccgcccccgggccgggcgacuccaacaucuucugggggcugcagaucagcgacauccaccugucccgcuuccgggaccccggccgcgccgucgaccucgagaaguucugcagcgagaccaucgacaucauccagcccgcccuggugcuggccaccggcgaccucacggacgccaagaccaaggagcagcuggggucccggcagcacgagguggaguggcagaccuaccagggcauccugaagaagacccgcgucauggagaagacgaaguggcucgacaucaaggggaaccacgacgcguucaacauccccagccuggacuccaucaagaacuacuaccggaaguacagcgccgugcgccgggacggcuccuuccacuacgugcacagcaccccguucgggaacuacuccuucaucugcgucgacgccaccgugaaccccggccccaagcgccccuacaacuucuucggcauccuggacaagaagaagauggaggagcuccugcugcucgccaaggagagcucccggagcaaccacaccaucugguucgggcacuucacgaccuccaccauccugagcccgucccccggcauccgcagcaucauguccagcgccaucgcguaccugugcgggcaccuccacacccugggcggccugaugcccgugcuccacacgcggcacuuccaggggacccuggagcuggaggucggcgacuggaaggacaaccgccgguaccgcaucuucgccuucgaccacgaccucuucagcuucgccgaccugaucuucgggaaguggcccguggugcugaucaccaacccgaagucccuccuguacagcugcggcgagcacgagccccuggagcggcuccugcacuccacccacauccgcguccuggccuucagccucuccagcaucacguccgugaccgugaagaucgacgggguccaccugggccaggccgugcacgugagcggccccaucuucguccugaaguggaacccccggaacuacuccagcgggacccacaacaucgaggugaucgugcaggacuccgcgggccgcagcaaguccguccaccacaucuucagcgugcaggagaacaaccaccucuccuucgacccgcuggccagcuucauccugcgcaccgaccacuacaucauggcccggguccucuucgugcugaucgugcugucccagcucacgauccugaucaucuuccgcuaccggggguaccccgagcugaaggagcccagcggcuucaucaaccugaccuccuucagccuccacguccugagcaagaucaacaucuucuacuacuccgugcugcuccugacccuguacaccgugcucgggcccugguucuucggcgagaucaucgacggcaaguucgggugcugcuucagcuucggcaucuucgucaacgggcacuuccugcagggcuccaucacguucaucaucgggauccugcagcucgccuucuucaacaucccgcugauggccuacaugugcuggagccugcuccagcgcugcuucggccacaacuuccggucccaccuccaccagcgcaaguaccugaagaucaugcccgugcaccuccugaugcugcugcuguacaucuggcaggucuacagcugcuacuuccuguacgcgaccuacggcacccucgccuuccuguucagcccccugcggaccuggcucacgcugcugaccccggugcucauccgcuacguguggacccugaacuccaccaaguucgggaucuucauggugcagcugaagucccaccucagcuccuga

SEQ ID NO: 37851 - RNA, 2424 nt, Artificial Sequence
  derived and/or modified sequence opt1 from TMEM63A__Homo_sapiens__NP_055513
augauggacagccccuuccuggagcucuggcaguccaaggccgugagcauccgcgagcagcugggccugggggaccggccgaacgacuccuacugcuacaacagcgccaagaacuccaccguccuccagggcgugaccuucgggggcauccccacggugcugcugaucgacgucagcugcuuccucuuccugauccugguguucuccaucauccgccggcgcuucugggacuacgggcggaucgcgcucgugagcgaggccgacuccgagagccgcuuccagcggcuguccagcaccuccagcuccggccagcaggacuucgagaacgagcugggcugcugccccuggcucaccgccaucuuccgccugcacgacgaccagauccuggaguggugcggggaggacgccauccacuaccucagcuuccagcggcacaucaucuuccugcuggucgugguguccuuccucagccugugcgucauccugcccgugaaccucuccggcgaccugcuggacaaggacccguacagcuucgggcgcaccacgaucgccaaccuccagaccgacaacgaccugcuguggcuccacaccaucuucgcggugaucuaccuguuccugaccgucggcuucaugcggcaccacacgcagagcaucaaguacaaggaggagaaccucgugcgccggacccuguucaucaccgggcugccccgcgacgcccggaaggagaccguggagucccacuuccgcgacgccuaccccacgugcgaggucguggacgugcagcucugcuacaacgucgccaagcugaucuaccugugcaaggagaagaagaagaccgagaagucccucaccuacuacaccaaccuccaggugaagacgggccagcggacccugaucaaccccaagccgugcggccaguucugcugcugcgaggugcucgggugcgagugggaggacgcgaucuccuacuacacccgcaugaaggaccggcugcuggagcgcaucaccgaggaggagcggcacguccaggaccagccccucggcauggccuucgugacguuccaggagaaguccauggccaccuacauccugaaggacuucaacgccugcaagugccagucccugcagugcaagggggagccccagcccagcucccacagccgcgagcucuacaccuccaaguggaccgugacguucgccgcggacccggaggacaucugcuggaagaaccugagcauccagggccugcgcugguggcuccaguggcugggcaucaacuucacccuguuccuggggcuguucuuccugaccacccccuccaucauccugagcacgauggacaaguucaacgucaccaagcccauccacgcccucaacaaccccaucaucucccaguucuucccgacccugcugcucuggagcuucuccgcccugcugcccagcaucguguacuacuccacccuccuggagagccacuggacgaaguccggcgagaaccagaucaugaugaccaaggucuacaucuuccugaucuucauggugcucauccugcccagccuggggcucaccagccuggacuucuucuuccgguggcuguucgacaagaccuccagcgaggccuccauccgccucgagugcguguuccugcccgaccagggcgccuucuucgucaacuacgugaucgcgagcgccuucaucgggaacggcauggagcugcuccggcugccgggccugauccucuacacguuccgcaugaucauggccaagaccgccgccgaccggcgcaacgugaagcagaaccaggcguuccaguacgaguucggggccauguacgccuggaugcugugcgucuucaccgugaucguggccuacuccaucacgugccccaucaucgcccccuucggccugaucuacauccuccugaagcacauggucgaccggcacaaccuguacuucguguaccuccccgcgaagcuggagaaggggauccacuucgccgccgugaaccaggcccuggcggccccgauccucugccuguucuggcuguacuucuucagcuuccuccgccugggcaugaaggcccccgccacccuguucaccuuccucguccugcugcucaccauccuggugugccuggcccacacgugcuucgggugcuucaagcaccucagcccccugaacuacaagaccgaggagcccgcgagcgacaagggcuccgaggccgaggcccacaugccgccgcccuucacccccuacgugccccggauccugaacggccucgccagcgagcgcaccgcccugagcccccagcagcagcagcagcagaccuacggggcgauccacaacaucagcggcaccauccccgggcagugccuggcccaguccgccacgggcagcgucgccgccgcgccgcaggaggccuga

SEQ ID NO: 37852 - RNA, 2745 nt, Artificial Sequence
  derived and/or modified sequence opt1 from TMEM67__Homo_sapiens__NP_001135773
augagccugucccacuggcccuacuuccgccucgugcugaacuuccggccgcaggucaucugccugccccagccgcccaaggugcucggcuaccgccuggagccgccccaccugacccucgccugcacccuggaggggauguacaacaucaucgaggagauccuggagcgggacaucaacggcacgcuccugagccaggcgaccugcgagcugugcgacgggaacgagaacuccuucaugguggucaacgcccucggcgaccgcugcgugcggugcgagcccaccuucgugaacaccagccgcuccugcgccugcagcgagcccaacauccugaccgggggccugugcuucuccagcacgggcaacuucccccuccggcgcaucuccgccgcccgguacggggaggucggcaugagccugaccuccgagugguucgccaaguaccugcagagcuccgcggccgccugcuggguguacgccaaccucaccagcugccaggcgcuggggaacaugugcgugaugaacaugaacuccuacgacuucgccacguucgacgccugcggccuguuccaguucaucuucgagaacaccgccgggcucagcaccguccacuccaucagcuucuggcgccagaaccugcccuggcuguucuacggcgaccagcucggccuggcgccccaggugcuguccagcaccagccuccccacgaacuucuccuucaagggggagaaccagaacaccaagcugaaguucguggccgccagcuacgacauccggggcaacuuccugaaguggcagacccucgagggcgggguccugcagcugugcccggacaccgagacgcgccucaacgccgccuacuccuucggcaccaccuaccagcagaacugcgagauccccaucagcaagauccugaucgacuuccccacccccaucuucuacgacguguaccuggaguacacggacgagaaccagcaccaguacauccucgccgugccgguccugaaccugaaccuccagcacaacaagaucuucgugaaccaggacuccaacagcgggaaguggcugcugacccggcgcaucuuccucguggacgcggucuccggccgggagaacgaccuggggacccagccccgcgugauccggguggccacccagaucagccuguccguccaccucgugcccaacacgaucaacggcaacaucuacccgccccugaucaccaucgccuacagcgacaucgacaucaaggacgccaacucccagagcgugaaggucuccuucagcgugaccuacgagauggaccacggggaggcccacguccagaccgacaucgcgcugggcgugcucggcgggcuggccgugcuggccucccugcucaagacggccggcuggaagcgccggaucgggagccccaugaucgaccugcagaccgucgugaaguuccugguguacuacgccggcgaccucgcgaacgucuucuucaucaucaccguggggaccggccuguacuggcugaucuucuucaaggcccagaaguccgugagcguccuccugcccaugcccauccaggaggagcgcuucgugacguacgugggcugcgccuucgcccugaaggcgcuccaguuccugcacaagcugaucucccagaucaccaucgacgucuucuucaucgacugggagcggccgaaggggaaggugcucaaggccguggagggcgagggcgggguccgcagcgccaccgugcccgugagcaucuggcgcaccuacuucgucgccaacgaguggaacgagauccagacggugcggaagaucaacucccuguuccaggugcugaccguccucuucuuccuggagguggugggguucaagaaccuggcccucauggacagcuccagcucccugagccgcaacccgcccuccuacaucgcgcccuacagcugcauccugcgguacgccgucuccgccgcccucuggcuggccaucggcaucauccaggugguguucuucgcggucuucuacgagcgcuucaucgaggacaagauccggcaguucguggaccugugcagcauguccaacaucagcguguuccuccugucccacaagugcuucggcuacuacauccacgggcgcagcguccacggccacgccgacaccaacauggaggagaugaacaugaaccugaagcgggaggccgagaaccucugcucccagcgcgggcuggugcccaacaccgacggccagaccuucgagaucgccaucagcaaccagaugcggcagcacuacgaccgcauccacgagacgcugauccggaagaacggccccgcccgccuccuguccagcagcgcguccaccuucgagcagagcaucaaggccuaccacaugaugaacaaguuccugggguccuucaucgaccacgugcacaaggagauggacuacuucaucaaggacaagcuccugcuggagcggauccucggcauggaguucauggagccgauggagaaguccaucuucuacaacgacgagggguacagcuucagcuccguccuguacuacggcaacgaggccacccugcucaucuucgaccugcuguucuucugcgugguggaccucgccugccagaacuucauccuggcgagcuuccugaccuaccuccagcaggagaucuuccgcuacauccggaacacggucgggcagaagaaccuggccuccaagacccugguggaccagcgcuuccucaucuga

SEQ ID NO: 37853 - RNA, 324 nt, Artificial Sequence
  derived and/or modified sequence opt1 from TMEM70__Homo_sapiens__NP_001035703
augcuguuccucgcccugggcagccccugggccguggagcugccgcucugcgggcgccggaccgcgcugugcgccgccgccgcccugcgcggcccccgggcguccgucagccgcgccuccagcuccagcgggcccuccggccccguggccggguggagcaccggcccguccggcgccgcgcggcuccugcgccggcccgggcgcgcccagauccccguguacugggagggcuacguccgguuccugaacacgcccagcgacaaguccgaggacgggcgccucaucuacaccggcaacauggcccgggccguguucgggaaguga

SEQ ID NO: 37854 - RNA, 771 nt, Artificial Sequence
  derived and/or modified sequence opt1 from TMEM74B__Homo_sapiens__NP_001291677
augcccccggcccagggcuacgaguucgccgcggccaaggggccccgcgacgagcugggccccagcuuccccauggccuccccgcccgggcucgagcugaagacccugagcaacggcccccaggcgccccggcgcuccgccccgcucgggcccguggcccccacccgggagggcgucgagaacgccugcuucagcuccgaggagcacgagacgcacuuccagaaccccggcaacacccgccuggggagcuccccgagcccgcccggcgggguguccagccugccccggucccagcgcgacgaccucagccugcacuccgaggagggccccgcccuggagcccgugagccggcccgucgacuacggguucguguccgcccucguguuccuggucagcggcauccugcucguggugaccgcguacgccaucccccgcgaggcccgggucaacccggacaccgugacggcccgcgagauggagcggcuggagauguacuacgcccgccugggcucccaccucgaccggugcaucaucgcggggcugggccugcucaccgucgggggcaugcugcugagcgugcuccugauggugucccugugcaagggcgagcucuaccgccggcgcaccuucgugcccgggaagggcagccggaagaccuacgggagcaucaaccugcgcaugcggcagcugaacggcgacgggggccaggcccucgucgagaacgagguggugcaggucuccgagacgagccacacccugcagcgcuccuga

SEQ ID NO: 37855 - RNA, 1185 nt, Artificial Sequence
  derived and/or modified sequence opt1 from TMEM79__Homo_sapiens__NP_115699
augaccgagcaggagacccuggcccuccuggaggugaagcgcagcgacucccccgagaaguccagcccgcaggcccugguccccaacggccggcagcccgagggggagggcggggcggagagccccggcgccgagucccuccgcguggggagcuccgccggcagcccgacggccaucgagggcgccgaggacgggcuggacuccaccgugagcgaggcggccacccugcccuggggcaccgggccccagcccuccgccccguuccccgacccgcccggcuggcgggacaucgagcccgagccgcccgagagcgagccccucacgaagcuggaggagcugcccgaggacgacgccaaccuccugcccgagaaggcggcccgcgccuucguccccaucgaccugcagugcaucgagcggcagccccaggaggaccucaucgugcgcugcgaggccggggagggcgagugccggaccuucaugccgccccgcgugacccaccccgaccccaccgagcggaagugggccgaggcggucgugcgcccgcccggcugcuccugcgggggcugcgggagcugcggcgaccgggaguggcugcgcgccguggccuccgucggcgccgcccugauccucuuccccugccugcuguacggggcguacgccuuccuccccuucgacgugccgcggcugcccacgaugagcucccgccugaucuacacccuccggugcggcguguucgccaccuuccccaucguccuggggauccugguguacggccucagccugcugugcuucuccgcccuccgcccguucggggagccccggcgcgagguggagauccaccggcgcuacgucgcccagagcgugcagcuguucauccuguacuucuucaaccucgcggugcugagcaccuaccugccccaggacacgcucaagcugcugccccuccugaccggccuguucgccgucucccggcucaucuacuggcugaccuucgccgugggccgcagcuuccgcggguucggcuacgggcugaccuuccucccgcugcuguccaugcucauguggaaccuguacuacauguucguggucgagcccgagcggaugcugacggccaccgagagccgccucgacuaccccgaccacgcccgguccgcgagcgacuaccgcccccggccguggggcuga

SEQ ID NO: 37856 - RNA, 546 nt, Artificial Sequence
  derived and/or modified sequence opt1 from TMEM87A__Homo_sapiens__NP_001103973
auggccgccgcggccuggcuccaggugcuccccgucauccugcugcuccugggcgcccacccgagcccccuguccuucuucagcgccgggcccgccaccguggcggccgccgaccgcuccaaguggcacauccccaucccgagcggcaagaacuacuucuccuucgggaagauccucuuccggaacaccacgaucuuccugaaguucgacggcgagcccugcgaccugagccucaacaucaccugguaccugaaguccgccgacugcuacaacgagaucuacaacuucaaggcggaggagguggagcuguaccucgagaagcugaaggagaagcgcgggcugagcggcaaguaccagaccuccagcaagcuguuccagaacugcuccgagcuguucaagacccagacguucagcggcgacuucaugcaccggcugccccuccugggggagaagcaggaggccaaggagaacggcaccaaccugaccuucaucggggacaagaccauccagaugcccuuccucaagaagcacuuccuggacugcuga

SEQ ID NO: 37857 - RNA, 480 nt, Artificial Sequence
  derived and/or modified sequence opt1 from TMEM88__Homo_sapiens__NP_981956
auggccgacgugcccggcgcccagcgcgcggucccgggggacggccccgagccccgggacccccuggacugcugggccugcgccgugcucgugaccgcccagaaccugcuggucgccgcguucaaccuccugcugcucgugcuggugcuggggaccauccuccugccggccgucacgaugcugggcuucggguuccucugccacagccaguuccugcgcucccaggccccgcccugcaccgcccaccuccgggaccccggcuucaccgcgcugcuggugaccggcuuccugcuccuggugccccugcucguccuggcccuggccagcuaccgccggcucugccugcgccugcggcucgccgacugccuggugcccuacucccgcgcccuguaccggcgccggcgcgcgccccagccccggcagauccgcgccagcccggggucccaggccgugcccacgagcggcaaggucuggguguga

SEQ ID NO: 37858 - RNA, 480 nt, Artificial Sequence
  derived and/or modified sequence opt1 from TMEM89__Homo_sapiens__NP_001008270
augcugcacgugcucgccagccugccccugcuccugcugcucgucaccuccgccagcacccacgcguggucccgcccgcugugguaccaggugggccuggaccuccagcccugggggugccagcccaagagcguggagggcugccgcgggggccuguccugccccggguacuggcugggcccgggcgccagccggaucuaccccgucgccgccgugaugaucacgaccaccaugcucaugaucugccggaagauccugcaggggcgccggcgcucccaggccaccaagggcgagcacccccaggugacgaccgagcccugcgggccguggaagcggcgcgcgcccaucagcgaccacacccugcuccggggcguccugcacaugcuggacgcccuccuggugcacaucgaggggcaccuccgccaccuggccacccagcggcagauccagaucaagggcacguccacccagagcggcuga

SEQ ID NO: 37859 - RNA, 1419 nt, Artificial Sequence
  derived and/or modified sequence opt1 from TMEM8B__Homo_sapiens__NP_001036055
augaacaugccccagagccugggcaaccagccgcucccgcccgagccgcccucccuggggacccccgccgagggccccgggaccacgagcccgcccgagcacugcuggcccgugcgccccacccugcggaacgagcucgacaccuucuccguccacuucuacaucuucuucggccccagcguggcccugccgcccgagcgccccgcgguguucgccaugcggcugcuccccguccuggacuccgggggcgugcugagccucgagcugcagcugaacgccuccagcgugcgccaggagaacgucaccguguucggcugccucacgcacgaggugccgcugucccugggggacgccgccgugaccugcagcaaggagucccucgcgggcuuccugcugagcguguccgccaccacccggguggcccgccuccggauccccuucccccagacggggaccugguuccuggcccugcgcagccucugcggcgucgggccccgguucgugcgcugccggaacgcgaccgccgaggugcgcaugcggaccuuccugucccccugcgucgacgacugcggccccuacggccagugcaagcugcuccgcacgcacaacuaccuguacgccgccugcgagugcaaggccggguggcggggcugggggugcaccgacagcgcggacgcccugaccuacggcuuccagcuccuguccacccugcuccugugccugagcaaccucauguuccugccgcccguggugcuggccauccgcucccgguacguccucgaggccgccguguacacguucaccauguucuucagcaccuucuaccacgcgugcgaccagcccggcaucguggucuucugcaucauggacuacgacgugcugcaguucugcgacuuccuggggagccucauguccgugugggucaccgugaucgccauggcccgccugcagcccgucgugaagcagguccuguaccuccugggcgccaugcugcucagcauggcccugcagcuggaccggcacgggcucuggaaccugcugggccccucccuguucgcgcucgggauccuggccacggccuggaccguccgcagcgugcggcgccgccacugcuacccgcccaccuggcggcgcuggcuguucuaccucugccccggcucccugaucgccggcagcgccgugcugcucuacgcguucgucgagacccgggacaacuacuucuacauccacuccaucuggcacaugcugaucgccgggagcgugggcuuccugcugcccccgcgcgccaagacggaccacggggugcccuccggcgcccgggcgcgcgggugcggcuaccagcucugcaucaacgagcaggaggagcugggccucgucgggcccggcggggccaccgugagcuccaucugcgccagcuga

SEQ ID NO: 37860 - RNA, 531 nt, Artificial Sequence
  derived and/or modified sequence opt1 from TMEM95__Homo_sapiens__NP_001307365
auguggcgccuggcgcucggcgggguguuccuggccgcggcccaggccugcgucuucugccggcugcccgcccacgaccucagcggccgccuggcccggcugugcucccagauggaggcgcgccagaaggagugcggggccagcccggacuucuccgccuucgcccucgacgaggugagcaugaacaaggugaccgagaagacccaccggguccugcgcgugauggagaucaaggaggcgguguccagccugcccuccuacuggagcuggcuccggaagacgaagcugcccgaguacacccgcgaggcccugugcccgcccgccugccggggcuccaccacccucuacaacugcagcacgugcaaggggaccgaggucuccugcuggccccgcaagcggugcuuccccggcagccaggaccugugggaggccaagauccugcuccuguccaucuucggcgccuuccugcuccugggggugcugagccuccugguggagucccaccaccuccaggccaagagcggccuguga

SEQ ID NO: 37861 - RNA, 531 nt, Artificial Sequence
  derived and/or modified sequence opt1 from TMEM97__Homo_sapiens__NP_055388
augggcgcccccgccacccgccggugcguggaguggcugcucgggcuguacuuccugagccacaucccgaucacccucuucauggaccugcaggcgguccugccccgcgagcucuaccccguggaguuccggaaccugcugaagugguacgccaaggaguucaaggacccccuccugcaggagccgcccgccugguucaaguccuuccuguucugcgagcucguguuccagcugcccuucuuccccaucgccacguacgccuuccugaagggcagcugcaaguggauccgcaccccggcgaucaucuacuccguccacaccaugaccacgcucauccccauccugagcaccuuccuguucgaggacuucuccaaggccagcggguucaagggccagcggcccgagacccuccacgagcgccugacccugguguccguguacgcccccuaccuccugaucccguucauccugcucaucuucaugcugcggagccccuacuacaaguacgaggagaagcgcaagaagaaguga

SEQ ID NO: 37862 - RNA, 681 nt, Artificial Sequence
  derived and/or modified sequence opt1 from TMEM98__Homo_sapiens__NP_001288675
auggagaccguggucaucguggccaucggcgugcuggccaccaucuuccucgcgagcuucgccgcccugguccuggugugccgccagcgguacugccgcccccgggaccuccugcagcgcuacgacuccaagccgaucguggaccugaucggggccauggagacgcagagcgagcccuccgagcucgagcuggacgacgucgugaucaccaacccccacaucgaggccauccuggagaacgaggacuggaucgaggacgcgagcggccucaugucccacugcaucgccauccugaagaucugccacacccugaccgagaagcucguggccaugacgauggggagcggcgccaagaugaagaccuccgcgagcgucuccgacaucaucgugguggccaagcggaucagcccccgcgucgacgacguggugaaguccauguacccgccccuggaccccaagcugcucgacgcccggaccaccgcccugcugcucagcgucucccaccuggugcuggugacgcgcaacgccugccaccucaccgggggccuggacuggaucgaccagagccuguccgcggccgaggagcaccucgagguccugcgggaggccgcccuggccagcgagcccgacaagggccucccggggcccgagggcuuccugcaggagcaguccgcgaucuga

SEQ ID NO: 37863 - RNA, 3282 nt, Artificial Sequence
  derived and/or modified sequence opt1 from TMF1__Homo_sapiens__NP_009045
augagcugguucaacgccucccagcugagcuccuucgccaagcaggcgcucagccaggcccagaaguccaucgaccgcgugcuggacauccaggaggaggagcccagcaucugggccgagaccaucccguacggcgagcccgggaucuccagccccgucuccggcgggugggacaccagcacguggggccugaaguccaacaccgagccccagagcccgcccaucgccucccccaaggccaucaccaagcccgugcggcgcaccguggucgacgagagcgagaacuucuucuccgcguuccucagcccgacggacgugcagaccauccagaagucccccguggucagcaagccgcccgccaagucccagcggcccgaggaggaggucaagagcagccugcacgagucccugcacaucgggcagagccgcacccccgagaccacggagucccaggugaaggacagcucccucugcgugagcggcgagacccuggccgccggcaccuccagccccaagaccgaggggaagcacgaggagacggugaacaaggaguccgacaugaaggugcccaccgucagccugaagguguccgagagcgugaucgacgucaagaccaccauggaguccaucagcaacacguccacccagagccucaccgcggagaccaaggacaucgcccuggagccgaaggagcagaagcacgaggaccggcaguccaacacgcccagcccgcccguguccaccuucagcagcggcaccuccaccacgagcgacaucgaggugcuggaccacgaguccgucaucagcgaguccagcgccuccagccgccaggagaccaccgacuccaagagcucccuccaccugaugcagaccagcuuccagcugcucuccgccagcgccugccccgaguacaaccggcuggacgacuuccagaagcugacggaguccugcugcagcuccgacgcguucgagcgcaucgacagcuucagcgugcagucccucgacagccgguccgugagcgagaucaacuccgacgacgagcugagcgggaagggcuacgcccugguccccaucaucgugaacuccagcacccccaaguccaagaccguggagagcgccgaggggaaguccgaggaggucaacgagacccucgugauccccacggaggaggccgagauggaggagagcggccgcuccgccaccccggucaacugcgagcagcccgacauccuggugagcuccacccccaucaacgagggccagaccgugcuggacaaggucgcggagcagugcgagcccgccgagagccagccggaggcccucuccgagaaggaggacgugugcaagacgguggaguuccugaacgagaagcuggagaagcgggaggcccagcuccugagccuguccaaggagaaggcccuccuggaggaggcguucgacaaccugaaggacgagauguuccgcgucaaggaggagagcagcuccaucagcucccucaaggacgaguucacccagcggaucgccgaggccgagaagaaggugcagcuggccugcaaggagcgcgacgccgcgaagaaggagaucaagaacaucaaggaggagcuggccacccggcucaacagcuccgagaccgccgaccugcugaaggagaaggacgagcagauccgcgggcucauggaggagggcgagaagcugagcaagcagcagcugcacaacuccaacaucaucaagaagcuccgggccaaggacaaggagaacgagaacaugguggcgaagcugaacaagaaggucaaggagcuggaggaggagcuccagcaccugaagcagguccuggacgggaaggaggagguggagaagcagcaccgcgagaacaucaagaagcucaacagcaugguggagcggcaggagaaggaccugggccgccuccagguggacauggacgagcuggaggagaagaaccgguccauccaggccgcccuggacagcgccuacaaggagcugaccgaccugcacaaggccaacgcggccaaggacuccgaggcccaggaggccgcccucagccgcgagaugaaggcgaaggaggagcuguccgccgcccuggagaaggcccaggaggaggcccgccagcagcaggagacgcucgcgauccaggugggcgaccugcggcuggcccuccagcgcaccgagcaggccgccgcgcggaaggaggacuaccugcgccacgagaucggggagcugcagcagcggcuccaggaggccgagaaccgcaaccaggagcugagccaguccgucagcuccaccacccggccccugcuccgccagaucgagaaccugcaggccacgcugggcagccagaccuccagcugggagaagcucgagaagaaccugagcgaccggcugggggagucccagacccuccuggccgccgcgguggagcgcgagcgggccgccaccgaggagcugcucgccaacaagauccagaugagcuccauggagagccagaacucccugcugcgccaggagaacagccgguuccaggcccagcucgaguccgagaagaaccgccugugcaagcuggaggacgagaacaaccgguaccagguggagcucgagaaccugaaggacgaguacguccgcacgcuggaggagacccggaaggagaagacccuccugaacagccagcuggagauggagcgcaugaagguggagcaggagcggaagaaggcgaucuucacccaggagacgaucaaggagaaggagcgcaagcccuucuccgugagcuccaccccgaccaugagccgcuccagcuccaucagcggcgucgacauggccgggcuccagaccuccuuccugagccaggacgagucccacgaccacagcuucggccccaugcccaucagcgccaacggcuccaaccuguacgacgccgugcggaugggggccggcagcuccaucaucgagaaccuccagagccagcugaagcugcgcgagggggagaucacgcaccuccagcuggagaucggcaaccuggagaagacccgguccaucauggcggaggagcucgugaagcugaccaaccagaacgacgagcuggaggagaaggucaaggagauccccaagcuccgcacccagcugcgggaccuggaccagcgcuacaacacgauccuccagauguacggggagaaggccgaggaggccgaggagcugcggcuggaccucgaggacgugaagaacauguacaagacccagaucgacgagcugcugcgccagagccucuccuga

SEQ ID NO: 37864 - RNA, 471 nt, Artificial Sequence
  derived and/or modified sequence opt1 from TMIE__Homo_sapiens__NP_671729
auggccggcuggcccggggccggcccccugugcgugcucgggggcgcggcccugggggucugccuggccggcguggccggccagcucguggagcccagcaccgccccgcccaagcccaagcccccgccccugaccaaggagacggucguguucugggacaugcgccuguggcacguggucgggaucuucucccucuucgugcugagcaucaucaucacccugugcugcguguucaacugccgggucccccgcacccggaaggagaucgaggcgcgcuaccuccagcggaaggccgccaagauguacaccgacaagcuggagacggugccgccccugaacgagcucaccgaggugcccggcgaggacaagaagaagaagaagaagaagaagaaggacuccgucgacaccguggccaucaagguggaggaggacgagaagaacgaggcgaagaagaagaagggggagaaguga

SEQ ID NO: 37865 - RNA, 849 nt, Artificial Sequence
  derived and/or modified sequence opt1 from TMIGD2__Homo_sapiens__NP_653216
augggcagccccgggauggugcugggccuccugguccagaucugggcccugcaggaggccuccagccucuccgugcagcaggggccgaaccugcuccaggugcgccagggcagccaggccacccuggucugccagguggaccaggccaccgccugggagcggcugcgcgugaaguggacgaaggacggggccauccugugccagcccuacaucaccaacggcucccucagccugggcgucugcgggccccagggccggcuguccuggcaggcccccagccaccucacccugcagcuggacccggugucccucaaccacagcggggcguacgugugcugggccgccgucgagauccccgagcuggaggaggccgagggcaacaucacccgccuguucguggaccccgacgaccccacgcagaaccggaaccgcaucgcguccuucccgggguuccucuucgugcugcugggcgucggcagcauggggguggccgccaucguguggggcgccugguucugggggcggcgcuccugccagcagcgggacagcggcaacucccccggcaacgccuucuacagcaacguccucuaccgcccccgcggggcgcccaagaaguccgaggacugcagcggcgaggggaaggaccagcggggccaguccaucuacagcaccagcuucccgcagcccgcgccccggcagccccaccuggccucccgcccgugccccagcccccggcccugcccgagcccccgccccgggcaccccguguccauggugcgggucuccccgcgccccagccccacccagcagccccggccgaagggcuuccccaaggugggcgaggaguga

SEQ ID NO: 37866 - RNA, 537 nt, Artificial Sequence
  derived and/or modified sequence opt1 from TMIGD3__Homo_sapiens__NP_001289609
auggagggcagccccgccgggccgaucgagcagaaggaggcccgcugggaguccagcugggaggagcagcccgacuggacccugggcugccucucccccgagagccacaccaaccacguggcgcugcgggacacggggaaccagcugaucgucaccauguccugccucaccaaggaggacaccggcugguacuggugcgggauccagcgcgacuucgcccgggacgacauggacuucacggagcugaucgugaccgacgacaagggcacccuggccaacgacuucuggagcggcaaggaccucuccgggaacaagacccgcagcugcaaggcccccaaggugguccggaaggccgaccgcucccggacgagcauccugaucaucugcauccugaucaccggccucgggaucaucuccgugaucagccaccugaccaagcgccggcgcucccagcggaaccgccgggugggcaacacccugaagccguucagccgcguccucacgcccaaggagauggcgcccaccgagcagauguga

SEQ ID NO: 37867 - RNA, 1131 nt, Artificial Sequence
  derived and/or modified sequence opt1 from TMLHE__Homo_sapiens__NP_001171726
augugguaccaccgccugagccaccuccacucccggcugcaggaccugcucaagggcggggugaucuaccccgcccugccgcagcccaacuucaagagccugcucccccuggccguccacuggcaccacaccgcguccaagagccugaccugcgccuggcagcagcacgaggaccacuucgagcucaaguacgccaacacggugaugcgcuucgacuacguguggcugcgggaccacugccgcuccgccagcugcuacaacuccaagacccaccagcggagccuggacaccgccuccgucgaccucugcaucaagcccaagaccauccgccuggacgagacgacccuguucuucaccuggccggacggccacgugaccaaguacgaccucaacuggcuggugaagaacagcuacgaggggcagaagcagaaggucauccagccccggauccuguggaacgcggagaucuaccagcaggcccaggugcccuccguggacugccagagcuuccucgagacgaacgagggccugaagaaguuccugcagaacuuccuccuguacgggaucgccuucgucgagaacgugcccccgacccaggagcacaccgagaagcuggccgagcgcaucucccucauccgggagaccaucuacggccgcaugugguacuucacgagcgacuucucccggggcgacaccgcguacaccaagcuggcccuggaccgccacaccgacacgaccuacuuccaggagcccugcgggauccagguguuccacugccucaagcacgagggcaccgggggccggacccugcuggucgacggguucuacgccgccgagcagguccuccagaaggcccccgaggaguucgagcugcugagcaaggugccccucaagcacgaguacaucgaggacgugggcgagugccacaaccacaugaucggcaucgggccggugcugaacaucuaccccuggaacaaggagcuguaccucauccgccuguucaaggagaagcagaacacggugaaccggcaguggaacuccagccugcagugcgacauccccgagcgcauccucaccuaccggcacuucgucuccggcaccagcaucgagcaccgcgggagccugaucuga

SEQ ID NO: 37868 - RNA, 1080 nt, Artificial Sequence
  derived and/or modified sequence opt1 from TMOD1__Homo_sapiens__NP_001159588
augagcuaccgccgggagcuggagaaguaccgcgaccucgacgaggacgagauccugggcgcccugaccgaggaggagcuccggacccuggagaacgagcuggacgagcucgaccccgacaacgcccugcugccggcggggcuccgccagaaggaccagacgaccaaggcccccaccggccccuucaagcgggaggagcugcuggaccaccucgagaagcaggccaaggaguucaaggaccgcgaggaccuggugcccuacaccggggagaagcggggcaaggucugggugccgaagcagaagccccuggaccccgugcucgaguccgucacgcuggagcccgagcuggaggaggcccucgccaacgcgagcgacgccgagcugugcgacaucgccgccauccuggggaugcacacccucauguccaaccagcaguacuaccaggcgcugagcuccagcuccaucaugaacaaggagggccugaacagcgugaucaagccgacccaguacaagcccgugcccgacgaggagcccaacuccaccgacgucgaggagacgcucgagcgcaucaagaacaacgacccgaagcuggaggaggugaaccugaacaacauccggaacauccccauccccacccucaaggccuacgccgaggcccugaaggagaacagcuacgugaagaaguucuccaucgucggcacccgcagcaacgaccccguggccuacgcgcuggccgagaugcucaaggagaacaaggugcugaagacccugaacgucgaguccaacuucaucagcggggccggcauccuccggcugguggaggcccugccguacaacacgucccucguggagaugaagaucgacaaccagagccagccccuggggaacaaggucgagauggagaucguguccaugcuggagaagaacgccacccuccugaaguucggcuaccacuucacccagcaggggccccgccugcgggcgagcaacgccaugaugaacaacaacgaccucgugcgcaagcggcgccuggccgaccugaccggccccaucaucccgaagugccgguccggcgucuga

SEQ ID NO: 37869 - RNA, 948 nt, Artificial Sequence
  derived and/or modified sequence opt1 from TMOD2__Homo_sapiens__NP_001136357
auggcccugcccuuccagaaggagcucgagaaguacaagaacaucgacgaggacgagcugcugggcaagcucagcgaggaggagcugaagcagcuggagaacgugcucgacgaccuggacccggaguccgccaugcugcccgcgggguuccgccagaaggaccagacccagaaggccgccaccggccccuucgaccgggagcaccuccugauguaccuggagaaggaggcccucgagcagaaggaccgcgaggacuucguccccuucacgggggagaagaagggccggguguucaucccgaaggagaagcccaucgagacccgcaaggaggagaaggugacccuggaccccgagcuggaggaggcccucgcgagcgccuccgacaccgagcuguacgaccuggccgccguccucggggugcacaaccugcugaacaaccccaaguucgacgaggagacggcgaacaacaagggcggcaaggggccggugcggaacgucgugaagggcgagaaggugaagcccgucuucgaggagccgcccaaccccaccaacguggagaucagccuccagcagaugaaggccaacgaccccucccugcaggaggugaaccugaacaacaucaaggccuucgccgacaugcucaaggucaacaagacccugaccagccugaacaucgaguccaacuucaucacggggaccggcauccucgcccugguggaggcgcugaaggagaacgacacccucaccgagaucaagaucgacaaccagcgccagcagcuggggacggccguggagauggagaucgcccagaugcuggaggagaacagccggauccucaaguucggcuaccaguucaccaagcagggcccccgcacccgggucgccgccgcgaucaccaagaacaacgaccuggugcgcaagaagcggguggaggccgaccgccgguga

SEQ ID NO: 37870 - RNA, 1059 nt, Artificial Sequence
  derived and/or modified sequence opt1 from TMOD3__Homo_sapiens__NP_055362
auggcccugcccuuccgcaaggaccucgagaaguacaaggaccuggacgaggacgagcugcucggcaaccugagcgagaccgagcugaagcagcucgagaccgugcuggacgaccuggacccggagaacgcccuccugcccgcgggguuccggcagaagaaccagacguccaagagcaccaccggccccuucgaccgcgagcaccuccuguccuaccuggagaaggaggcccuggagcacaaggaccgggaggacuacguccccuacaccggggagaagaagggcaagaucuucaucccgaagcagaagcccgugcagacguucaccgaggagaaggugagccucgaccccgagcuggaggaggcccugaccuccgccagcgacaccgagcucugcgaccuggccgcgauccuggggaugcacaaccucaucacgaacaccaaguucugcaacaucaugggcuccagcaacggcgucgaccaggagcacuucuccaacguggugaagggggagaagauccugcccgucuucgacgagccgcccaaccccaccaacguggaggagagccugaagcgcaccaaggagaacgacgcccaccucguggaggucaaccugaacaacaucaagaacauccccaucccgacgcugaaggacuucgccaaggcccucgagaccaacacccacgugaagugcuucucccuggcggccacccggagcaacgaccccguggccacggccuucgccgagaugcugaaggucaacaagacccucaagucccugaacguggagagcaacuucaucaccggcguggggauccuggcgcucaucgacgcccugcgcgacaacgagacccuggccgagcucaagaucgacaaccagcggcagcagcugggcacggccgucgagcuggagauggccaagaugcucgaggagaacaccaacauccugaaguucggguaccaguucacccagcagggcccccgcacccgggcggccaacgccaucacgaagaacaacgaccuggugcgcaagcggcgcguggagggcgaccaccaguga

SEQ ID NO: 37871 - RNA, 1038 nt, Artificial Sequence
  derived and/or modified sequence opt1 from TMOD4__Homo_sapiens__NP_037485
augagcuccuaccagaaggagcuggagaaguaccgcgacaucgacgaggacgagauccuccggacccugagccccgaggagcuggagcagcucgacugcgagcugcaggagauggacccggagaacaugcugcuccccgccggccugcgccagcgggaccagaccaagaagucccccacggggccccuggaccgcgaggcccuccugcaguaccuggagcagcaggcgcucgaggugaaggagcgggacgaccuggucccguucaccggcgagaagaaggggaagcccuacauccagcccaagcgcgagauccccgccgaggagcagaucacccuggagccggagcucgaggaggcccuggcccacgccaccgacgcggagaugugcgacaucgccgccauccuggacauguacacgcucaugagcaacaagcaguacuacgacgcccugugcuccggcgagaucugcaacaccgaggggaucagcuccguggugcagcccgacaaguacaagcccguccccgacgagccgcccaaccccaccaacaucgaggagauccugaagcgggugcgcagcaacgacaaggagcucgaggaggugaaccugaacaacauccaggacauccccaucccgaugcuguccgagcucugcgaggcgaugaaggccaacaccuacguccggagcuucucccugguggccacgcgcagcggcgaccccaucgccaacgccguggcggacaugcugcgggagaaccgcucccuccagagccugaacaucgaguccaacuucaucagcuccaccggccugauggccguccucaaggccgugcgggagaacgccacccugaccgagcugcgcguggacaaccagcggcaguggcccggggacgccgucgagauggagauggcgacggugcucgagcagugccccagcaucgugcgcuucggcuaccacuucacccagcaggggccgcgggcccgcgccgcccaggccaugacccggaacaacgagcugcgccggcagcagaagaagcgcuga

SEQ ID NO: 37872 - RNA, 1365 nt, Artificial Sequence
  derived and/or modified sequence opt1 from TMPO__Homo_sapiens__NP_001027454
augcccgaguuccuggaggacccgagcgugcucaccaaggacaagcugaaguccgagcuggucgccaacaacgugacccuccccgccggcgagcagcggaaggacguguacguccagcuguaccugcagcaccucacggcgcggaaccgcccgccccugcccgccgggaccaacagcaagggcccgcccgacuucuccagcgacgaggagcgggagcccacccccgugcugggguccggcgccgccgccgcggggcgcagccgggccgccgugggccgcaaggccaccaagaagacggacaagccccggcaggaggacaaggacgaccucgacgucaccgagcugaccaacgaggaccugcucgaccagcuggugaaguacggcgugaaccccgggcccaucgucggcaccacgcgcaagcuguacgagaagaagcuccugaagcugcgggagcaggggaccgagucccgcagcuccaccccgcuccccaccaucagcuccagcgcggagaacacgcggcagaacggcuccaacgacagcgaccgcuacuccgacaacgaggaggacagcaagaucgagcugaagcuggagaagcgggagccccucaaggggcgcgccaagacccccgugacccugaagcagcggcgcguggagcacaaccaguccuacagccaggccggcaucaccgagacggaguggaccuccggcagcagcaagggcgggccgcugcaggcccucacccgggaguccacccgcgggagccggcgcacgccccggaagcgcgucgagaccuccgagcacuuccgcaucgacggccccgugaucagcgaguccacccccaucgccgagaccaucauggcgagcuccaacgagagccugguggucaaccgggugacgggcaacuucaagcacgccuccccgauccugcccaucaccgaguucagcgacaucccccgccgggcccccaagaagccgcucacccgcgccgaggugggggagaagaccgaggagcggcgcgucgagcgggacauccugaaggagauguuccccuacgaggccuccacgcccaccggcaucagcgcguccugccgccggcccaucaagggggccgccggccgcccgcuggagcucagcgacuuccggauggaggaguccuucagcuccaaguacgugcccaaguacgugccccuggccgacgucaagagcgagaagaccaagaaggggcgcuccaucccgguguggaucaagauccuccuguucguggucguggccgucuuccuguuccugguguaccaggcgauggagaccaaccaggugaaccccuucagcaacuuccuccacgucgacccccgcaagagcaacuga

SEQ ID NO: 37873 - RNA, 1257 nt, Artificial Sequence
  derived and/or modified sequence opt1 from TMPRSS11A__Homo_sapiens__NP_001107859
augauguaccgcaccgugggcuucgggacccggagccgcaaccugaagcccuggaugaucgccguccucaucgugcugucccugacgguggucgccgugaccaucggccuccuggugcacuuccuggucuucgaccagaagaaggaguacuaccacgggagcuucaagauccucgacccgcagaucaacaacaacuucggccaguccaacaccuaccagcugaaggaccugcgggagaccacggagaaccucguggacgagaucuucaucgacagcgcguggaagaagaacuacaucaagaaccaggugguccgccugacccccgaggaggacggggugaagguggacgucaucaugguguuccaguuccccuccaccgagcagcgggccgugcgcgagaagaagauccagagcauccugaaccagaagauccggaaccuccgcgcccugcccaucaacgccuccagcguccaggugaacgccauguccagcuccaccggcgagcugacggugcaggcgagcugcggcaagcgggucgugccgcucaacgugaaccgcaucgccuccggggucaucgcccccaaggccgcguggcccuggcaggccagccugcaguacgacaacauccaccagugcggcgccacccugaucuccaacaccuggcucgugaccgccgcccacugcuuccagaaguacaagaacccccaccaguggacggugagcuucgggaccaagaucaacccgccccugaugaagcggaacguccgccgguucaucauccacgagaaguaccgcuccgcggcccgggaguacgacaucgccgugguccaggugagcucccgcgugaccuucagcgacgacauccggcagaucugccugcccgaggccagcgccuccuuccagcccaaccucaccguccacaucacgggcuucggggcgcuguacuacggcggcgagagccagaacgaccugcgcgaggcccgggugaagaucaucuccgacgacgugugcaagcagccgcaggucuacgggaacgacaucaagcccggcauguucugcgccggguacauggagggcaucuacgacgccugccgcggcgacagcgggggcccccucgugacccgggaccugaaggacaccugguaccugaucgggaucguguccuggggcgacaacugcgggcagaaggacaagcccggcgucuacacccaggugacguacuaccgcaacuggaucgccagcaagaccggcaucuga

SEQ ID NO: 37874 - RNA, 1251 nt, Artificial Sequence
  derived and/or modified sequence opt1 from TMPRSS11B__Homo_sapiens__NP_872308
auguaccgccacggcaucagcucccagcggagcuggccccuguggaccaccaucuucaucuuccucgggguggccgccauccugggcgucacgaucgggcugcucgugcacuuccuggcgguggagaagaccuacuacuaccagggcgacuuccacaucuccggggucaccuacaacgacaacugcgagaacgccgccagccaggccuccaccaaccugagcaaggacaucgagacgaagaugcucaacgccuuccagaacuccagcaucuacaaggaguacgugaaguccgaggugaucaagcugcugccgaacgcgaacggcagcaacguccagcuccagcugaaguucaaguucccgcccgccgagggcguguccaugcgcaccaagaucaaggccaagcugcaccagaugcucaagaacaacauggccagcuggaacgcggugcccgccuccaucaagcugauggagaucagcaaggccgccuccgagaugcugaccaacaacugcugcgggcggcaggucgccaacagcaucaucaccggcaacaagaucgugaacgggaaguccagccucgagggcgcguggcccuggcaggccuccaugcaguggaaggggcgccacuacugcggcgccagccugaucagcucccgguggcugcucagcgccgcccacugcuucgcgaagaagaacaacuccaaggacuggacggugaacuucggcaucgucgugaacaagcccuacaugacccgcaaggugcagaacaucaucuuccacgagaacuacagcucccccgggcugcacgacgacaucgcccugguccagcucgccgaggaggugagcuucaccgaguacauccggaagaucugccugcccgaggccaagaugaagcuguccgagaacgacaacguggucgugaccggcugggggacgcucuacaugaacggcagcuucccggugauccugcaggaggacuuccugaagaucaucgacaacaagaucugcaacgccuccuacgcguacagcggcuucgucaccgacaccaugcucugcgccggguucauguccggcgaggccgacgccugccagaacgacagcgggggcccccuggccuaccccgacucccgcaacaucuggcaccugguggggaucgugagcuggggcgacggcugcgggaagaagaacaagcccggcgucuacacccgggugacguccuaccgcaacuggaucaccagcaagaccgggcucuga

SEQ ID NO: 37875 - RNA, 1257 nt, Artificial Sequence
  derived and/or modified sequence opt1 from TMPRSS11D__Homo_sapiens__NP_004253
auguaccgccccgcccgggugaccagcaccucccgcuuccugaacccguacgucgugugcuucaucguggucgccggcguggugauccucgcggucacgaucgcccugcugguguacuuccucgccuucgaccagaaguccuacuucuaccggagcagcuuccagcugcugaacguggaguacaacucccagcucaacagccccgccacccaggaguaccgcacccuguccgggcggaucgagagccugaucaccaagacguucaaggaguccaaccuccgcaaccaguucauccgggcccacgucgcgaagcugcgccaggacggcagcggggugcgggccgacguggucaugaaguuccaguucacccgcaacaacaacggcgccuccaugaagucccggaucgagagcgugcugcgccagaugcucaacaacagcgggaaccuggagaucaaccccuccaccgagaucaccagccugacggaccaggccgcggccaacuggcucaucaacgagugcggcgccggccccgaccugaucacccuguccgagcagcggauccucgggggcaccgaggccgaggaggggagcuggccguggcaggucucccugcgccugaacaacgcccaccacugcggcgggagccucaucaacaacauguggauccugaccgcggcccacugcuuccggagcaacuccaacccccgcgacuggaucgccacgagcggcaucuccaccaccuuccccaagcugcggaugcgcgugcggaacauccucauccacaacaacuacaagagcgccacccacgagaacgacaucgcccuggugcgccuggagaacuccgugacguucaccaaggacauccacagcgucugccuccccgcggccacccagaacaucccgcccggcuccaccgccuacgugacgggguggggcgcccaggaguacgccgggcacaccgugcccgagcugcggcagggccagguccgcaucaucagcaacgacgugugcaacgcgccccacuccuacaacggcgccauccugagcgggaugcucugcgccggcgugccgcagggcggggucgacgccugccagggggacuccggcggcccccuggugcaggaggacagccgccggcugugguucaucgucgggaucguguccuggggcgaccagugcgggcuccccgacaagcccggcguguacacccgcgucaccgccuaccuggacuggauccggcagcagacggggaucuga

SEQ ID NO: 37876 - RNA, 1272 nt, Artificial Sequence
  derived and/or modified sequence opt1 from TMPRSS11E__Homo_sapiens__NP_054777
augauguaccgccccgacgugguccgggcccgcaagcgggugugcugggagccgugggugaucggccuggucaucuucaucagccucaucgugcuggccgugugcaucgggcugaccguccacuacgugcgcuacaaccagaagaagaccuacaacuacuacuccacgcucagcuucaccaccgacaagcuguacgcggaguucggccgggaggccuccaacaacuucaccgagaugagccagcgccuggaguccauggugaagaacgccuucuacaagagcccccuccgggaggaguucgucaagucccaggugaucaaguucagccagcagaagcacggggugcuggcccacaugcugcucaucugccgcuuccacuccacggaggaccccgagaccgucgacaagaucgugcagcuggugcugcacgagaagcuccaggacgccgucgggcccccgaagguggacccccacagcgugaagaucaagaagaucaacaagaccgagaccgacuccuaccugaaccacugcugcgggacgcggcgcagcaagacccugggccagucccuccggaucgucggcgggaccgagguggaggagggcgaguggcccuggcaggcgagccugcagugggacgggucccaccgcugcggcgccacccugaucaacgccacguggcucgugagcgccgcgcacugcuucaccaccuacaagaaccccgcccgguggaccgccuccuucggggucacgaucaagccgagcaagaugaagcgcggccugcggcgcaucaucgugcacgagaaguacaagcaccccucccacgacuacgacaucagccuggccgagcucagcucccccgugcccuacaccaacgccguccaccgggugugccugccggacgcgagcuacgaguuccagcccggcgacgucauguucgugaccggguucggcgcccugaagaacgacggguacucccagaaccaccuccgccaggcccaggugacccugaucgacgccacgaccugcaacgagccccaggccuacaacgacgcgaucacgccccggaugcugugcgccggcagccucgagggcaagaccgacgccugccagggggacuccggcgggccgcuggucagcuccgacgcccgcgacaucugguaccuggccggcaucgugagcuggggcgacgagugcgcgaagcccaacaagcccggcguguacacccgggucaccgcccuccgcgacuggaucaccuccaagaccggcaucuga

SEQ ID NO: 37877 - RNA, 1704 nt, Artificial Sequence
  derived and/or modified sequence opt1 from TMPRSS13__Homo_sapiens__NP_001070731
auggagcgggacagccacggcaacgccucccccgcccggaccccgagcgcgggggccucccccgcccaggccagccccgccggcacgcccccggggcgcgcgucccccgcccaggccagccccgcccaggcgucccccgccggcaccccgcccgggcgggccagccccgcccaggccucccccgcgggcaccccgcccggccgcgccagccccgggcgggccucccccgcccaggccagcccggcgcaggccucccccgcccgcgccagccccgcccuggcgucccucagccgguccagcuccggccgcagcagcuccgcccggagcgccuccgugaccaccagccccacgcgcgucuaccuggugcgggccaccccggugggggccguccccauccgcuccagccccgcgcgguccgcccccgccacccgcgccacccgggagagcccgggcacgucccugcccaaguucaccuggcgcgaggggcagaagcagcucccccugaucggcugcgugcugcuccugaucgcgcugguggucagccucaucauccuguuccaguucuggcagggccacaccgggauccgguacaaggagcagcgcgaguccugccccaagcacgccgugcggugcgacggcguggucgacugcaagcucaagagcgacgagcuggggugcgugcgcuucgacugggacaagucccugcugaagaucuacagcggcuccagccaccaguggcucccgaucugcuccagcaacuggaacgacuccuacagcgagaagaccugccagcagcugggcuucgagagcgcccaccggacgaccgagguggcccaccgcgacuucgccaacuccuucagcauccugcgcuacaacuccaccauccaggagagccuccaccgguccgagugccccagccagcgcuacaucucccugcagugcagccacugcgggcugcgggcgaugaccggccgcaucgucgggggcgcccucgccuccgacagcaaguggcccuggcaggucucccugcacuucgggacgacccacaucugcggcggcacccugaucgacgcccagugggugcucaccgccgcgcacugcuucuucgugacgcgggagaaggugcuggagggguggaagguguacgccggcaccagcaaccugcaccagcucccggaggccgccuccaucgccgagaucaucaucaacagcaacuacaccgacgaggaggacgacuacgacaucgcgcugaugcgccuguccaagccccucacccugagcgcccacauccaccccgccugccugcccaugcacgggcagacguucucccucaacgagaccugcuggaucaccggcuucgggaagacccgggagacggacgacaagaccagcccguuccugcgcgagguccaggugaaccugaucgacuucaagaagugcaacgacuaccucguguacgacagcuaccugacgccccggaugaugugcgccggcgaccugcgcggcgggcgggacuccugccagggcgacagcgggggcccccucgucugcgagcagaacaaccgcugguaccuggcgggggugaccuccuggggcaccggcugcgggcagcggaacaagcccggcguguacaccaaggucaccgaggugcugccguggaucuacagcaagauggaguccgagguccgcuuccgcaagagcuga

SEQ ID NO: 37878 - RNA, 3060 nt, Artificial Sequence
  derived and/or modified sequence opt1 from TMPRSS15__Homo_sapiens__NP_002763
augggcagcaagcgcgggaucuccagccggcaccacucccugagcuccuacgagaucauguucgccgcccucuucgcgauccuggugguccugugcgccggccucaucgccgugagcugccugaccaucaaggagucccagcgcggggccgcccugggccagagccacgaggcgcgggccaccuucaagaucacguccggggugaccuacaaccccaaccuccaggacaagcugagcgucgacuucaaggugcuggccuucgaccuccagcagaugaucgacgagaucuuccuguccagcaaccugaagaacgaguacaagaacucccgcgugcuccaguucgagaacggcagcaucaucgucguguucgaccuguucuucgcccaguggguguccgacgagaacgucaaggaggagcugauccagggccucgaggcgaacaagagcucccagcuggugaccuuccacaucgaccugaacagcguggacauccucgacaagcugaccacgaccucccaccuggccaccccggggaacgucagcaucgagugccuccccggcagcucccccugcaccgacgcccugacgugcaucaaggccgaccuguucugcgacggggaggugaacugccccgacggcagcgacgaggacaacaagaugugcgccaccgugugcgacgggcgguuccuccugaccggcuccagcggcuccuuccaggcgacccacuacccgaagcccagcgagacguccgucgugugccaguggaucauccgcgugaaccaggggcugagcaucaagcucuccuucgacgacuucaacaccuacuacaccgacauccuggacaucuacgagggcgucgggagcuccaagauccugcgggccagcaucugggagaccaaccccggcacgauccgcaucuucuccaaccaggugaccgccaccuuccucaucgagagcgacgaguccgacuacgugggcuucaacgccaccuacacggccuucaacagcuccgagcugaacaacuacgagaagaucaacugcaacuucgaggacggguucugcuucuggguccaggaccugaacgacgacaacgagugggagcggauccagggcagcaccuucucccccuucaccgggccgaacuucgaccacaccuucggcaacgcgagcggguucuacaucagcacgcccaccggccccggcgggcgccaggagcgggugggccuccugucccugccccucgacccgacccuggagcccgccugccugagcuucugguaccacauguacggggagaacgugcacaagcucuccaucaacaucagcaacgaccagaacauggagaagaccgucuuccagaaggagggcaacuacggggacaacuggaacuacggccaggugacgcugaacgagaccgucaaguucaagguggccuucaacgccuucaagaacaagauccuguccgacaucgcccucgacgacaucagccugaccuacggcaucugcaacgggucccuguaccccgagcccacccucgugccgacgcccccgcccgagcugcccaccgacugcggcgggcccuucgagcugugggagcccaacaccaccuucagcuccacgaacuuccccaacagcuacccgaaccucgcguucugcgucuggauccugaacgcccagaagggcaagaacauccagcugcacuuccaggaguucgaccuggagaacaucaacgacgugguggagauccgcgacggggaggaggccgacucccuccugcuggccgucuacaccggccccggccccgugaaggacguguucagcaccaccaaccggaugaccguccuccugaucacgaacgacgugcuggcccgcgggggcuucaaggcgaacuucaccaccggguaccaccucggcauccccgagccgugcaaggccgaccacuuccagugcaagaacggcgagugcgugccccuggucaaccugugcgacgggcaccuccacugcgaggacggcuccgacgaggccgacugcgugcgguucuucaacgggaccacgaacaacaacggccuggugcgcuuccggauccagagcaucuggcacaccgccugcgcggagaacuggaccacccagaucuccaacgacgucugccagcugcucgggcugggcagcggcaacuccagcaagcccaucuucagcacggacgggggcccguucgugaagcugaacaccgcccccgacgggcaccucauccugacccccucccagcagugccugcaggacagccucauccgccugcagugcaaccacaaguccugcggcaagaagcuggccgcccaggacaucacccccaagaucgucgggggcagcaacgccaaggagggcgcguggccgugggugguggggcucuacuacggcgggcggcugcugugcggcgccucccucgugagcuccgacuggcuggucagcgccgcccacugcguguacgggcgcaaccuggagcccuccaaguggacggccauccucggccugcacaugaaguccaaccugaccagcccccagaccgugccccggcucaucgacgagaucgucaucaacccgcacuacaaccgccgccggaaggacaacgacaucgcgaugaugcaccuggaguucaaggugaacuacaccgacuacauccagcccaucugccugcccgaggagaaccagguguucccgcccggccgcaacugcagcaucgccggguggggcacggucguguaccaggggaccaccgccaacauccuccaggaggccgacgugccccugcuguccaacgagcggugccagcagcagaugcccgaguacaacaucaccgagaacaugaucugcgccggcuacgaggagggcgggaucgacagcugccagggcgacuccgggggcccccucaugugccaggagaacaaccgcugguuccuggcgggggucacgagcuucggcuacaagugcgcccugccgaaccggcccggcguguacgcccgcgugucccgguucaccgaguggauccagagcuuccuccacuga

SEQ ID NO: 37879 - RNA, 1590 nt, Artificial Sequence
  derived and/or modified sequence opt1 from TMPRSS2__Homo_sapiens__NP_001128571
augcccccggccccgcccggcggggagagcggcugcgaggagcgcggggccgcgggccacaucgagcacucccgguaccugagccuccuggacgccguggacaacuccaagauggcccugaacagcggguccccgcccgccaucggccccuacuacgagaaccacggcuaccagcccgagaaccccuaccccgcccagcccaccgucgugcccaccguguacgagguccaccccgcgcaguacuacccgagccccgugccccaguacgcgccccgcgugcucacgcaggccuccaacccggucgugugcacccagcccaagagccccuccgggaccgugugcaccagcaagacgaagaaggcccugugcaucacccugacccucggcaccuuccuggucggggccgcccuggccgccggccuccuguggaaguucaugggguccaagugcagcaacuccggcaucgagugcgacagcuccggcacgugcaucaaccccagcaacuggugcgacggggugucccacugcccgggcggggaggacgagaaccggugcgugcgccuguacggccccaacuucauccuccaggucuacagcucccagcgcaagagcuggcaccccgugugccaggacgacuggaacgagaacuacggccgggccgcgugccgggacaugggguacaagaacaacuucuacagcucccagggcaucguggacgacagcggguccaccagcuucaugaagcugaacaccuccgccggcaacgucgacaucuacaagaagcuguaccacagcgacgccugcuccagcaaggccguggugucccuccgcugcaucgccugcggggucaaccugaacagcucccggcagagccgcaucgugggcggcgaguccgcgcugcccggggccuggccguggcaggucagccuccacgugcagaacgugcacgugugcggcggguccaucaucacccccgaguggaucgucacggccgcccacugcguggagaagccccugaacaaccccuggcacuggaccgccuucgcgggcauccugcggcagagcuucauguucuacggggccggcuaccaggucgagaaggugaucucccacccgaacuacgacagcaagaccaagaacaacgacaucgcccucaugaagcugcagaagccccugaccuucaacgaccucgugaagcccgucugccugccgaaccccggcaugaugcugcagcccgagcagcucugcuggaucuccggguggggcgccacggaggagaaggggaagaccagcgaggugcugaacgccgcgaaggugcugcucaucgagacccagcgcugcaacagccgguacgucuacgacaaccugaucacccccgccaugaucugcgccggcuuccugcaggggaacguggacuccugccagggcgacagcggcgggccgcucgugacguccaagaacaacaucugguggcugaucggcgacaccagcuggggguccggcugcgccaaggcguaccgccccggcgucuacgggaacgugaugguguucaccgacuggaucuaccggcagaugcgcgccgacggcuga

SEQ ID NO: 37880 - RNA, 1362 nt, Artificial Sequence
  derived and/or modified sequence opt1 from TMPRSS3__Homo_sapiens__NP_001243246
augggcgagaacgaccccccggccguggaggcccccuucagcuuccgcucccuguucgggcucgacgaccugaagaucagccccgucgcgcccgacgccgacgccguggccgcccagauccugucccuccugccgcugaaguucuuccccaucaucgugaucggcaucaucgcgcucauccuggcccuggccaucgggcucggcauccacuucgacugcagcgggaaguaccggugccgcuccagcuucaagugcaucgagcugaucgcccggugcgacggcgucuccgacugcaaggacggcgaggacgaguaccgcugcgugcggguggggggccagaacgcgguccugcagguguucaccgccgccagcuggaagaccaugugcuccgacgacuggaaggggcacuacgccaacguggccugcgcgcagcucggcuuccccagcuacgucuccagcgacaaccugcgcguguccagccuggaggggcaguuccgggaggaguucguguccaucgaccaccuccugcccgacgacaaggucacggcccugcaccacagcguguacgugcgcgagggcugcgccuccggccacgucgugacccuccagugcaccgccugcgggcaccggcgcggcuacagcucccggaucguggggggcaacaugagccugcugagccaguggccguggcaggccucccuccaguuccagggcuaccaccugugcgggggcagcgucaucaccccccuguggaucaucacggcggcccacugcguguacgaccucuaccugcccaaguccuggaccauccagguggggcuggucagccuccuggacaaccccgccccgucccaccugguggagaagaucguguaccacagcaaguacaagcccaagcgccucggcaacgacaucgcccugaugaagcuggccgggccccucaccuucaacgagaugauccagcccgucugccugccgaacuccgaggagaacuuccccgacggcaaggugugcuggaccagcggcuggggggcgacggaggacggcggggacgccucccccguccugaaccacgccgccgugccccucaucagcaacaagaucugcaaccaccgggacguguacggcgggaucaucuccccgagcaugcugugcgccggcuaccugaccggcggggucgacuccugccagggcgacagcgggggcccccucgugugccaggagcgccggcuguggaagcuggugggggcgaccuccuucggcaucggcugcgccgaggucaacaagcccgggguguacacccgcgugacgagcuuccucgacuggauccacgagcagauggagcgggaccugaagaccuga

SEQ ID NO: 37881 - RNA, 1299 nt, Artificial Sequence
  derived and/or modified sequence opt1 from TMPRSS4__Homo_sapiens__NP_001077416
augcugcaggaccccgacagcgaccagccgcucaacucccuggacgugaagccccugcgcaagccccggauccccauggagaccuuccgcaaggucggcaucccgaucaucaucgcccuccugagccuggccuccaucaucaucguggugguccucaucaaggugauccuggacaaguacuacuuccugugcgggcagccccuccacuucaucccccggaagcagcugugcgacggcgagcuggacugcccccucggggaggacgaggagcacugcgucaagagcuucccggagggccccgcgguggccgugcgccuguccaaggaccggagcacccuccaggugcuggacuccgccacggggaacugguucagcgccugcuucgacaacuucaccgaggcccuggcggagaccgccugccgccagaugggcuacucccgggccgucgagaucggccccgaccaggaccuggacgugguggagaucaccgagaacagccaggagcuccgcaugcggaacuccagcgggcccugccuguccggcagccuggucucccuccacugccuggccugcgggaagucccugaagacgccgcgcguggugggcggggaggaggcgagcgucgacagcuggcccuggcaggucuccauccaguacgacaagcagcacgugugcggcggcagcauccucgacccccacugggugcugaccgccgcccacugcuuccggaagcacaccgacguguucaacuggaaggugcgcgccgggagcgacaagcugggcuccuuccccagccucgccgucgcgaagaucaucaucaucgaguucaacccgauguaccccaaggacaacgacaucgcccugaugaagcugcaguucccccucaccuucuccgggacggugcggcccaucugccugccguucuucgacgaggagcugacccccgccacgccccucuggaucaucggcuggggcuucaccaagcagaacgggggcaagaugagcgacauccugcugcaggccuccgugcaggucaucgacagcacccgcugcaacgccgacgacgcguaccagggggaggugaccgagaagaugaugugcgccggcauccccgagggcggggucgacacgugccagggcgacuccgggggcccgcucauguaccagagcgaccaguggcacgugguggggaucgucuccuggggcuacgggugcggcggccccagcacccccgggguguacaccaagguguccgccuaccugaacuggaucuacaacgucuggaaggccgagcuguga

SEQ ID NO: 37882 - RNA, 2436 nt, Artificial Sequence
  derived and/or modified sequence opt1 from TMPRSS6__Homo_sapiens__NP_705837
augcugcuccuguuccacagcaagcgcaugcccguggccgaggccccgcaggucgcgggcgggcagggcgacgggggcgacggggaggaggccgagcccgagggcauguucaaggccugcgaggacuccaagcggaaggcccgcggcuaccugcggcucgugccccuguucgugcugcucgcccugcugguccucgcgagcgccggggugcugcugugguacuuccucggcuacaaggccgaggugauggucucccagguguacagcgggucccugcgcgugcugaaccggcacuucagccaggaccucacccgccgggaguccagcgccuuccgcuccgagaccgcgaaggcccagaagaugcugaaggagcugaucacgagcacccggcucggcaccuacuacaacuccagcuccgucuacagcuucggggagggcccccugaccugcuucuucugguucauccugcagaucccggagcaccgccggcucaugcugucccccgagguggugcaggcccugcucgucgaggagcugcugagcacggugaacuccagcgccgccgugcccuaccgcgcggaguacgaggucgaccccgagggccucgugauccuggaggccuccgugaaggacaucgccgcccugaacagcacccucgggugcuaccgguacagcuacgucggccagggccaggugcugcgccugaaggggccggaccaccucgccuccagcugccuguggcaccuccagggccccaaggaccugaugcugaagcugcggcucgaguggacccuggcggagugccgcgaccggcuggccauguacgacguggccgggccccucgagaagcgccugaucaccuccgucuacggcugcagccggcaggagcccgugguggagguccuggccuccggggccaucauggcgguggucuggaagaagggccuccacagcuacuacgacccguucgugcuguccgugcagcccgucguguuccaggccugcgaggugaaccugacgcucgacaaccgccuggacagccaggggguccuguccacccccuacuuccccagcuacuacuccccgcagacccacugcagcuggcaccugaccgugcccucccucgacuacggccuggcccugugguucgacgccuacgcccuccggcgccagaaguacgaccugcccugcacgcagggccaguggaccauccagaaccgccggcugugcgggcuccgcauccugcagcccuacgcggagcggaucccgguggucgccaccgccggcaucaccaucaacuucacgagccagaucucccugaccgggcccggcgugcgcgugcacuacgggcucuacaaccagagcgaccccugccccggcgaguuccugugcuccgucaacggccugugcgugccggccugcgacggggugaaggacugccccaacggccucgacgagcggaacugcgucugccgcgcgaccuuccagugcaaggaggacagcacgugcaucucccugcccaaggugugcgacgggcagcccgacugccugaacggcagcgacgaggagcagugccaggagggggugccgugcggcaccuucaccuuccagugcgaggaccggagcugcgucaagaagcccaacccccagugcgacggccgcccggacugccgggacggguccgacgaggagcacugcgacugcggccuccaggggcccagcucccgcaucgugggcggcgccgugagcuccgagggggaguggcccuggcaggccagccugcagguccggggccgccacaucugcgggggcgcccugaucgccgaccggugggugaucaccgcggcccacugcuuccaggaggacuccauggccagcaccgugcucuggacggucuuccuggggaagguguggcagaacucccgcuggcccggcgaggugagcuucaaggucucccggcugcuccugcacccguaccacgaggaggacagccacgacuacgacguggcccugcuccagcuggaccaccccgugguccgcuccgccgcggugcggcccgugugccugcccgcccgcagccacuucuucgagccgggccuccacugcuggaucaccggguggggcgcccugcgggagggcgggcccaucuccaacgcccugcagaaggucgacgugcagcucaucccccaggaccugugcagcgagguguaccgcuaccaggucacgccccgcaugcugugcgccggguaccggaagggcaagaaggacgcgugccagggcgacuccgggggcccgcucgugugcaaggcccugagcgggcgcugguuccuggccggccucgugagcugggggcugggcugcggccggcccaacuacuucggggucuacacccgcaucaccggcgugaucuccuggauccagcaggucgugaccuga

SEQ ID NO: 37883 - RNA, 2154 nt, Artificial Sequence
  derived and/or modified sequence opt1 from TMPRSS7__Homo_sapiens__NP_001036040
auguuccgcaucaccaacaucgaguuccugcccgaguaccggcagaaggagagccgcgaguuccucuccgugagccggaccguccagcaggucaucaaccugguguacacgaccuccgccuucagcaaguucuacgagcaguccgugguggccgacgugagcaacaacaagggcgggcugcucguccacuucuggaucguguucgugaugccgcgcgcgaagggccacaucuucugcgaggacugcgucgccgccauccugaaggacuccauccagaccagcaucaucaaccggaccuccguggggagccugcagggccucgccguggacauggacuccgucgugcugaacgacaaggggugcagccaguacuucuacgccgagcaccugucccuccacuacccccuggagaucagcgcggccuccggccgccugaugugccacuucaagcucguggccaucgucggcuaccugauccggcugagcaucaaguccauccagaucgaggccgacaacugcgugacggacagccucaccaucuacgacucccugcugcccauccgcagcagcauccucuaccggaucugcgagcccacccgcacccugauguccuucgugagcacgaacaaccugaugcucgucaccuucaaguccccgcacauccggcgccugagcgggauccgggcguacuucgaggugauccccgagcagaagugcgagaacaccgugcuggucaaggacaucaccggcuucgaggggaagaucuccagccccuacuaccccuccuacuacccgcccaagugcaagugcacguggaaguuccagaccagccucuccacccugggcaucgcccugaaguucuacaacuacagcaucaccaagaaguccaugaaggggugcgagcacggcuggugggagaucaacgagcacauguacugcggcagcuacauggaccaccagacgaucuuccgcgugcccagcccccucgugcacauccagcugcagugcagcucccggcugagcgacaagccgcuccuggccgaguacggguccuacaacaucagccagcccugccccgucggcuccuuccgcugcagcagcgggcugugcgugccccaggcccagcggugcgacggcgucaacgacugcuucgacgaguccgacgagcuguucugcgugagcccgcagcccgccugcaacaccuccagcuuccgccagcacggcccccucaucugcgacggguuccgggacugcgagaacggccgcgacgagcagaacugcacccaguccauccccugcaacaaccggaccuucaagugcgggaacgacaucugcuuccgcaagcagaacgcgaagugcgacggcacgguggacugcccggacgggagcgacgaggagggcugcacgugcucccgcagcuccagcgcccugcaccggaucaucggcgggaccgacacccucgagggcggguggcccuggcaggucucccugcacuucgugggcagcgccuacugcggggccuccgugaucagccgcgaguggcugcucuccgccgcgcacugcuuccacggcaaccggcugagcgaccccacccccuggaccgcccaccugggcauguacguccaggggaacgccaaguucguguccccggugcgccggaucgucgugcacgaguacuacaacagccagaccuucgacuacgacaucgcccuccugcagcugagcaucgccuggcccgagacccucaagcagcugauccagcccaucugcaucccgcccacgggccagcgcgugcgguccggggagaagugcugggucaccggcugggggcgccggcacgaggcggacaacaagggcagccuggugcuccagcaggccgagguggagcugaucgaccagacccugugcgucuccaccuacggcaucaucacgagccgcaugcugugcgccgggaucauguccggcaagcgggacgccugcaagggggacagcggcggcccccucuccugccgccggaaguccgacgggaaguggauccugaccggcaucguguccugggggcacggcagcgggcgccccaacuucccgggcguguacacccgggucuccaacuucgugcccuggauccacaaguacgugcccagccugcucuga

SEQ ID NO: 37884 - RNA, 3180 nt, Artificial Sequence
  derived and/or modified sequence opt1 from TMPRSS9__Homo_sapiens__NP_892018
auggagcccaccguggccgacguccaccuggugccgcgcaccacgaaggaggugcccgcccucgacgcggccugcugccgggccgccagcaucggcgucguggccaccucccuggugguccugacccucggggugcugcuggcguuccucagcacccagggcuuccacguggaccacacggccgagcugcgcgggauccgguggaccuccagccugcgccgggagaccuccgacuaccaccgcacccucacgcccacccuggaggcccugcuccacuuccugcugcggccccuccagacccugagccugggccucgaggaggagcugcugcagcgcgggauccgggcccgccuccgggagcacggcaucucccuggcggccuacggcaccaucgucagcgccgagcugacggggcgccacaagggcccgcucgccgagcgggacuucaaguccgggcgcugccccggcaacagcuucuccugcgggaacagccagugcgugaccaaggugaaccccgagugcgacgaccaggaggacugcuccgacggcagcgacgaggcccacugcgagugcggccugcagcccgcguggcggauggccgggcgcaucgucggcgggauggaggccuccccgggcgaguuccccuggcaggccagccugcgggagaacaaggagcacuucugcggcgccgcgaucaucaacgcccgcuggcucguguccgccgcccacugcuucaacgaguuccaggaccccaccaaguggguggccuacgucggggcgaccuaccugagcggcuccgaggccagcacggugcgggcccaggugguccagaucgugaagcacccccuguacaacgccgacaccgccgacuucgacguggcgguccucgagcugaccagcccgcugcccuucgggcgccacauccagcccgugugccuccccgccgccacccacaucuucccgcccuccaagaagugccugaucagcggcuggggguaccugaaggaggacuuccucgugaagcccgagguccugcagaaggccacgguggagcugcucgaccaggcgcugugcgccucccuguacggccacagccucaccgaccggauggucugcgccggcuaccuggacgggaagguggacuccugccagggcgacagcgggggcccccuggugugcgaggagccguccgggcgcuucuuccucgccggcaucgucagcuggggcaucgggugcgccgaggcgcgccggcccggcguguacgcccgcgugacccggcugcgcgacuggauccuggaggccaccacgaaggccuccaugccccucgcccccaccauggcgccggcccccgccgcccccagcaccgccuggcccaccuccccggagagccccgucguguccacgcccaccaagagcaugcaggcgcuguccaccgugccgcuggacugggucaccgugcccaagcugcaggagugcggggcccggcccgccauggagaagcccacgcgcguggucggcggguucggcgccgcgagcggcgaggugccguggcaggucucccucaaggaggggagccggcacuucugcggcgccaccguggugggggaccgcuggcugcuguccgccgcccacugcuucaaccacaccaagguggagcagguccgggcccaccucggcaccgcgagccugcugggccucgggggcagccccgugaagaucgggcugcgccgggugguccugcacccccucuacaaccccggcauccuggacuucgaccuggccgugcucgagcuggccuccccgcuggccuucaacaaguacauccagcccgugugccucccccuggccauccagaaguuccccgucgggcgcaagugcaugaucagcggcuggggcaacacgcaggaggggaacgcgaccaagccggagcugcuccagaaggccuccgugggcaucaucgaccagaagaccugcagcgugcuguacaacuucucccugaccgaccggaugaucugcgccggguuccucgagggcaaggucgacagcugccagggggacuccggcggcccccuggccugcgaggaggcccccgggguguucuaccuggcgggcaucgugagcugggggaucggcugcgcccaggucaagaagcccgggguguacacccgcaucacgcggcucaagggcuggauccuggagaucauguccagccagccgcugcccauguccccgcccagcaccacccgcaugcucgccaccacgagcccccggaccaccgccggccugaccgugcccggggcgacgcccucccgccccaccccgggcgccgccucccgggucaccgggcagcccgccaacagcacccuguccgccgugagcacgaccgcgcgcggccagacccccuucccggacgcccccgaggccaccacgcacacccagcuccccgacugcgggcuggcccccgccgcgcugacccgcaucgugggcggcagcgccgccgggcggggcgaguggccguggcaggucucccucuggcugcgccggcgcgagcaccggugcggggccgugcugguggccgagcgcuggcuccugagcgcggcccacugcuucgacgucuacggcgaccccaagcagugggccgccuuccugggcacccccuuccucuccggggccgagggccagcuggagcggguggcgcgcaucuacaagcaccccuucuacaaccuguacacgcucgacuacgacguggcccugcuggagcucgccgggccgguccggcgcagccggcuggugcgccccaucugccugcccgagcccgccccgcggccgcccgacggcacccgcugcgugaucaccggguggggcuccguccgggagggcgggagcauggcgcgccagcuccagaaggccgccgugcggcugcuguccgagcagaccugccgccgguucuaccccgugcagaucagcucccgcaugcucugcgccggcuucccccagggcggggucgacagcugcuccggggacgccggcggcccccuggcgugccgggagcccagcgggcgcugggugcugacgggcgugaccuccuggggguacggcugcgggcgcccccacuucccgggcgucuacacccggguggccgccguccgcggcuggaucgggcagcacauccaggaguga

SEQ ID NO: 37885 - RNA, 135 nt, Artificial Sequence
  derived and/or modified sequence opt1 from TMSB10__Homo_sapiens__NP_066926
auggccgacaagcccgacaugggcgagaucgccagcuucgacaaggcgaagcugaagaagaccgagacccaggagaagaacacgcucccgaccaaggagaccaucgagcaggagaagcgcuccgagaucagcuga

SEQ ID NO: 37886 - RNA, 138 nt, Artificial Sequence
  derived and/or modified sequence opt1 from TMSB15B__Homo_sapiens__NP_919305
augagcgacaagcccgaccuguccgagguggagaaguucgaccgcagcaagcucaagaagaccaacaccgaggagaagaacacgcugccguccaaggagaccauccagcaggagaaggagugcguccagaccagcuga

SEQ ID NO: 37887 - RNA, 135 nt, Artificial Sequence
  derived and/or modified sequence opt1 from TMSB4X__Homo_sapiens__NP_066932
augagcgacaagcccgacauggccgagaucgagaaguucgacaaguccaagcugaagaagaccgagacccaggagaagaacccgcuccccagcaaggagacgaucgagcaggagaagcaggccggcgaguccuga

SEQ ID NO: 37888 - RNA, 2649 nt, Artificial Sequence
  derived and/or modified sequence opt1 from TMTC1__Homo_sapiens__NP_001180380
augguggucaccaccagcgcccgcggcgggggcggggaccggacgcccucccgccggcgcggcugcgggcuggccccggcgggcgccgccgcccuccuggccggcgcgagcugccugugcuacgggcggucccuccagggcgaguucgugcacgacgacgugugggccaucgucaacaaccccgacgugcgccccggggccccccugcgguggggcaucuucaccaacgacuucugggggaagggcauggccgagaacaccagccacaaguccuaccgcccgcugugcgugcucaccuucaagcugaacaucuuccugacgggcaugaaccccuucuacuuccacgcggucaacaucauccuccacugccuggugacccuggugcucauguacaccugcgacaagaccgucuucaagaaccgggggcuggccuucgugacggcccugcucuucgccgugcaccccauccacaccgaggccgucgcgggcaucguggggcgcgccgacgugcuggccugccugcucuuccugcuggccuuccucagcuacaaccggucccuggaccagggcugcgucggcgggagcuuccccuccaccgugagcccguucuuccugcuccugucccuguuccucggcaccugcgccaugcuggugaaggagacggggaucaccgucuucggcgugugccugguguacgaccucuucagccuguccaacaagcaggacaagagcuccaacggggcgcugugcccccgcagcccccagcagcccggcuccccgcagcccagcucccuccccggccacccccaccgggagaacgggaagcagcagcgcuucccgcacaagggcgccugggggggcugccacagcccccugccccccgagccgaagagcuccggguuccccgucagcccccgggccgugugguccaugaugcgcuuccugaccuacagcuaccuccuggccuucaacguguggcugcuccuggcccccgucacccugugcuacgacuggcaggugggcuccaucccgcucgucgagacgaucugggacaugcggaaccuggcgaccaucuuccuggccguggugauggcccuccugagccugcacugccucgccgccuucaagcgccuggagcacaaggagguccuggugggccugcucuuccugguguuccccuucauccccgcguccaaccuguucuuccgggucggguucgugguggccgagcgcguccucuacaugcccagcaugggcuacugcauccuguucgugcacgggcuguccaagcucugcaccuggcugaaccggugcggcgccaccacgcugaucgugagcaccguccuccugcugcuccuguucuccuggaagaccgugaagcagaacgagaucuggcugagccgcgagucccucuuccgcagcggggugcagacccugccgcacaacgccaagguccacuacaacuacgcgaacuuccugaaggaccagggccggaacaaggaggccaucuaccacuaccgcacggcccucaagcuguacccccggcacgccuccgcccugaacaaccucggcacccugacccgcgacaccgcggaggccaagauguacuaccagcgggcccugcagcuccacccccagcacaaccgcgcccuguucaaccuggggaaccuccugaagagccaggagaagaaggaggaggccaucacgcugcucaaggacuccaucaaguacggcccggaguucgcggacgccuacagcucccuggccagccugcucgccgagcaggagcgguucaaggaggccgaggagaucuaccagaccgggaucaagaacugccccgacagcuccgaccugcacaacaacuacggcguguuccugguggacaccggccuccccgagaaggcggucgcccacuaccagcaggccaucaagcugagccccucccaccacguggccauggugaaccuggggcgccucuaccggagccugggcgagaacuccauggcggaggagugguacaagcgcgcccugcaggucgcccacaaggccgagauccucagcccgcugggggcccuguacuacaacaccggccgguacgaggaggcgcuccagaucuaccaggaggccgccgcccugcagcccucccagcgcgagcugcggcucgcccuggcgcaggugcuggccgugauggggcagacgaaggaggccgagaagaugaccaaccacaucgucagcgaggagaccggcugccucgagugcuaccgccugcuguccgccaucuacagcaagcaggagaaccacgacaaggcccucgacgcgaucgacaaggcccugcagcugaagcccaaggaccccaaggugaucuccgagcucuucuucaccaagggcaaccagcugcgggagcagaaccugcucgacaaggccuucgagagcuaccgcguggccguccagcugaacccggaccaggcgcaggccuggaugaacauggggggcauccagcacaucaaggggaaguacguguccgcccgggccuacuacgagcgcgcccugcagcucgugcccgacagcaagcugcugaaggagaaccucgcgaagcuggaccggcuggagaagcgccuccaggagguccgcgagaaggaccagacguga

SEQ ID NO: 37889 - RNA, 2511 nt, Artificial Sequence
  derived and/or modified sequence opt1 from TMTC2__Homo_sapiens__NP_689801
augaucgccgagcuggugagcuccgcccucggccuggcgcuguaccucaacacccugagcgccgacuucugcuacgacgacucccgcgccaucaagaccaaccaggaccugcuccccgagacgccguggacccacaucuucuacaacgacuucugggggacccugcugacccacagcggcucccacaagagcuaccggccccucugcacgcuguccuuccgccugaaccacgccaucgggggccucaaccccuggagcuaccaccuggucaacgugcugcuccacgccgcggugaccgggcuguucaccuccuucagcaagauccugcucggcgacggcuacuggaccuucauggccgggcugauguucgccucccaccccauccacacggaggccgucgcgggcaucguggggcgggccgacgugggcgccagccuguucuuccuccugucccugcucugcuacaucaagcacugcagcacccgcggguacuccgcccggaccuggggcugguuccugggcagcgggcugugcgccggcugcuccaugcucuggaaggagcagggggucaccgugcuggcggugagcgccgucuacgacguguucguguuccaccgccugaagaucaagcagauccucccgacgaucuacaagcggaagaaccugucccuguuccucagcaucagccugcugaucuucuggggcuccagccuccugggcgcccgccuguacuggauggggaacaagccgcccuccuucagcaacuccgacaaccccgccgccgacagcgacucccuccugacccggacccugaccuucuucuaccuccccacgaagaaccuguggcugcuccugugccccgacacccugagcuucgacugguccauggacgcggucccccuccugaagaccgugugcgacuggcgcaaccugcacaccguggccuucuacacgggccugcuccugcuggccuacuacgggcucaagagccccuccgucgaccgggagugcaacggcaagaccgugaccaacgggaagcagaacgccaacggccacagcugccuguccgacguggaguaccagaacagcgagaccaaguccagcuucgccuccaaggucgagaacggcaucaagaacgacgugagccagcgcacgcagcugccguccaccgagaacaucgugguccucagccugagccugcucaucauccccuucgugcccgcgaccaaccuguucuucuacgugggguucgucaucgccgagcgggugcuguacauccccuccaugggcuucugccuccugaucaccgucggggcccgcgcccuguacgugaaggugcagaagcgguuccucaagagccugaucuucuacgccacggcgacccugaucgucuucuacggccucaagaccgccauccgcaacggggacuggcagaacgaggagaugcuguaccgguccggcaucaaggugaacccggccaaggccuggggcaaccuggggaacgugcucaagagccaguccaagaucagcgaggcggaguccgccuaccgcaacgcccuguacuaccggagcaacauggccgacaugcuguacaaccucggccugcugcuccaggagaacucccgcuucgccgaggcgcugcacuacuacaagcuggccaucgggagccggcccacccucgccuccgccuaccugaacacgggcaucauccugaugaaccaggggcgcaccgaggaggcccgccggaccuuccucaagugcagcgagauccccgacgagaaccugaaggacccccacgcgcacaaguccagcgucaccuccugccuguacaaccucggcaagcuguaccacgagcagggccacuacgaggaggcccugagcguguacaaggaggccauccagaagaugccgcgccaguucgcgccccagucccucuacaacaugaugggggaggccuacaugcggcugagcaagcugcccgaggccgagcacugguacauggagagccuccgcuccaagacggaccacauccccgcccaccugaccuacggcaagcugcucgcccugaccgggcgcaagagcgaggccgagaagcuguuccucaaggcgaucgagcuggacccgaccaagggcaacugcuacaugcacuacggccaguuccugcucgaggaggcccggcugaucgaggccgccgagauggccaagaaggcggccgagcuggacuccaccgaguucgacguggucuucaacgccgcccacaugcuccggcaggccagccugaacgaggcggccgagaaguacuacgaccuggccgcccgccuccggcccaacuaccccgccgcgcugaugaaccugggggccauccuccaccugaacggccgccugcagaaggccgaggccaacuaccuccgggcgcugcagcugaagcccgacgacgugaucacgcaguccaaccuccgcaagcuguggaacaucauggagaagcaggggcugaagaccagcaagaccuga

SEQ ID NO: 37890 - RNA, 2745 nt, Artificial Sequence
  derived and/or modified sequence opt1 from TMTC3__Homo_sapiens__NP_861448
auggccaacaucaaccugaaggagaucacccucaucgugggcgucgugaccgccugcuacuggaacagccuguucugcggguucguguucgacgacgucuccgcgauccuggacaacaaggaccuccaccccagcacgccgcugaagacccuguuccagaacgacuucuggggcacccccauguccgaggagcgcagccacaaguccuaccggccccucaccgugcugacguuccgccugaacuaccuccugagcgagcugaagcccauguccuaccaccuccugaacaugaucuuccacgccguggucagcgugaucuuccugaaggugugcaagcuguuccuggacaacaaguccagcgucaucgccucccuccucuucgccgugcacccgauccacaccgaggccgugaccggggucgugggccgggcggagcugcugagcuccaucuucuuccucgccgccuuccugagcuacacccgcuccaaggggcccgacaacagcaucaucuggacgcccaucgcccugaccguguuccucgucgcgguggccacccugugcaaggagcagggcaucaccguggucggcaucugcugcguguacgagguguucaucgcccagggguacacgcugccccuccugugcaccaccgccggccaguuccugcgggggaagggcuccaucccguucagcaugcuccagacccuggucaagcugaucgugcucauguucuccacgcugcugcucguggucauccgcgugcaggucauccagagccagcugcccguguucacccgguucgacaaccccgccgcggugagccccaccccgacccgccagcugacguucaacuaccuccugcccgucaacgccuggcugcuccugaaccccuccgagcugugcugcgacuggaccauggggaccaucccccucaucgagagccugcuggacauccggaaccucgccaccuucacguucuucugcuuccugggcaugcugggcguguucuccauccgcuacagcggggacuccagcaagaccgugcugauggcccucugccugauggcccugccguucauccccgcguccaaccucuucuuccccgucggcuucgugguggccgagcggguccuguacgugcccagcaugggguucugcauccugguggcccacggcuggcagaagaucuccaccaagagcgucuucaagaagcucuccuggaucugccugagcauggugauccugacccacucccucaagacguuccaccgcaacugggacugggagagcgaguacacccuguucauguccgcccugaaggugaacaagaacaacgccaagcucuggaacaacgucggccacgcgcuggagaacgagaagaacuucgagcgggcccugaaguacuuccuccaggccacccacgugcagccggacgacaucggggcccacaugaacgugggccgcaccuacaagaaccugaaccggacgaaggaggccgaggagagcuacaugauggcgaagucccugaugccccagaucauccccgggaagaaguacgccgcccgcaucgcccccaaccaccucaacgucuacaucaaccuggcgaaccugauccgggccaacgagagccgccucgaggaggccgaccagcuguaccggcaggccaucuccaugcgcccggacuucaagcaggccuacaucagccggggcgagcugcuccugaagaugaacaagccccugaaggcgaaggaggccuaccucaaggcccuggagcuggaccgcaacaacgccgaccucugguacaaccuggccaucgugcacaucgagcugaaggagcccaacgaggcgcucaagaacuucaaccgcgcccuggagcugaaccccaagcacaagcucgcccuguucaacagcgccaucgugaugcaggaguccggggaggucaagcugcggccggaggcccgcaagcggcuccugagcuacaucaacgaggagccccuggacgcgaacggcuacuucaaccucggcaugcuggccauggacgacaagaaggacaacgaggccgagaucuggaugaagaaggccaucaagcugcaggcggacuuccgcuccgcccucuucaaccuggcccugcucuacagccagaccgccaaggagcugaaggcccugcccauccucgaggagcugcugcgguacuacccggaccacaucaaggggcucauccugaagggcgacauccugaugaaccagaagaaggacauccucggggcgaagaagugcuucgagcgcauccuggagauggaccccuccaacgugcagggcaagcacaaccugugcguggucuacuucgaggagaaggaccuccugaaggccgagcggugccugcucgagacccuggcccuggcgccccacgaggaguacauccagcgccaccucaacaucgugcgggacaagaucagcuccagcuccuucaucgagcccaucuucccgaccagcaagaucuccagcguggaggggaagaagauccccacggaguccgucaaggagauccgcggcgagagccggcagacccagaucgugaagaccuccgacaacaagagccaguccaagagcaacaagcagcugggcaagaacggggacgaggagacgccccacaagaccaccaaggacaucaaggagaucgagaagaagcgcguggccgcccugaagcggcucgaggagaucgagcgcauccugaacggcgaguga

SEQ ID NO: 37891 - RNA, 843 nt, Artificial Sequence
  derived and/or modified sequence opt1 from TMX1__Homo_sapiens__NP_110382
auggcccccagcggcucccuggccgugccgcucgcgguccuggugcugcuccuguggggcgcccccuggacccacgggcgccggagcaacgugcgcgucaucaccgacgagaacuggcgggagcugcucgagggggacuggaugaucgaguucuacgcccccuggugccccgccugccagaaccugcagccggagugggaguccuucgccgaguggggcgaggaccuggaggugaacaucgcgaagguggacgucacggagcagcccgggcucagcggccgcuucaucaucaccgcccugcccaccaucuaccacugcaaggacggcgaguuccggcgcuaccaggggccccggaccaagaaggacuucaucaacuucaucuccgacaaggaguggaaguccaucgagccggugagcagcugguucggccccggguccgugcugaugagcuccaugagcgcccucuuccagcuguccauguggauccgcacgugccacaacuacuucaucgaggaccugggccuccccgucugggggagcuacaccguguucgcccuggcgacccuguucuccggccuccugcugggccucugcaugaucuucguggccgacugccugugccccagcaagcggcgccggccgcagcccuaccccuaccccuccaagaagcugcucagcgaguccgcccagccgcugaagaaggucgaggaggagcaggaggccgacgaggaggacgugagcgaggaggaggccgagagcaaggaggggaccaacaaggacuucccccagaacgcgauccgccagcggucccugggccccagccucgccacggacaaguccuga

SEQ ID NO: 37892 - RNA, 777 nt, Artificial Sequence
  derived and/or modified sequence opt1 from TMX2__Homo_sapiens__NP_001137484
auggccgugcuggcgccccucaucgcccuggucuacagcgugccgcgccugucccgguggcucgcccagcccuacuaccugcugagcgcccuccuguccgccgccuuccugcucgugcgcaagcugccgccccugugccacggccuccccacccagcgggaggacgggaaccccugcgacuucgacuggcgcgaggucgagauccugauguuccugagcgcgaucgugaugaugaagaaccggcgcuccauguuccucaugaccugcaagccgccccuguacaugggccccgaguacaucaaguacuucaacgacaagacgaucgacgaggagcuggagcgggacaagcgcgugaccuggaucgucgaguucuucgccaacuggagcaacgacugccaguccuucgcccccaucuacgccgaccucagccugaaguacaacugcaccgggcugaacuucggcaagguggacguggggcgguacaccgacgucuccacgcgcuacaaggugagcaccagcccccucaccaagcagcugcccacccugauccucuuccagggcggcaaggaggcgaugcggcgcccgcagaucgacaagaaggggcgggccguguccuggacguucuccgaggagaacgucauccgcgaguucaaccugaacgagcuguaccagcgggccaagaagcucagcaaggccggcgacaacauccccgaggagcagcccguggccuccacccccaccaccgugagcgacggggagaacaagaaggacaaguga

SEQ ID NO: 37893 - RNA, 1365 nt, Artificial Sequence
  derived and/or modified sequence opt1 from TMX3__Homo_sapiens__NP_061895
auggccgccuggaaguccuggaccgcgcugcgccucugcgccaccguggucgugcuggacaugguggucugcaagggcuucguggaggaccuggacgagagcuucaaggagaaccggaacgacgacaucuggcucguggacuucuacgcccccuggugcgggcacugcaagaagcuggagccgaucuggaacgaggucggccuggagaugaaguccaucgggagccccgugaaggugggcaagauggacgccacgagcuacuccagcaucgccuccgaguucgggguccgcggcuaccccaccaucaagcuccugaagggcgaccuggcguacaacuaccgggggccccgcaccaaggacgacaucaucgaguucgcccaccgggugagcggcgcccucauccgcccgcugcccucccagcagauguucgagcacaugcagaagcggcaccgcguguucuucgucuacgucgggggcgagagcccccugaaggagaaguacaucgacgccgcguccgagcucaucguguacaccuacuucuucagcgccuccgaggagguggugcccgaguacgugacgcugaaggagaugccggccguccugguguucaaggacgagaccuacuucguguacgacgaguacgaggacggggaccucagcuccuggaucaaccgggagcgcuuccagaacuaccuggccauggacggcuuccugcucuacgagcugggcgacaccgggaagcuggucgcccucgcggugaucgacgagaagaacaccagcguggagcacacgcggcugaaguccaucauccaggaggucgcccgcgacuaccgggaccuguuccaccgcgacuuccaguucggccacauggacgggaacgacuacaucaacacccuccugauggacgagcugaccgugcccaccgucguggugcucaacacgagcaaccagcaguacuuccugcuggaccggcagaucaagaacgucgaggacauggugcaguucaucaacaacauccucgacggcaccguggaggcccagggcggggacuccauccugcagcgccugaagcggaucgucuucgacgccaagagcaccaucgugagcaucuucaaguccagcccccucaugggcugcuuccuguucgggcugccccucggcgugaucuccaucaugugcuacgggaucuacaccgccgacacggacggcggcuacaucgaggagcgcuacgaggucagcaaguccgagaacgagaaccaggagcagaucgaggagagcaaggagcagcaggagccguccagcgggggcuccguggugcccaccguccaggagcccaaggacgugcuggagaagaagaaggacuga

SEQ ID NO: 37894 - RNA, 6606 nt, Artificial Sequence
  derived and/or modified sequence opt1 from TNC__Homo_sapiens__NP_002151
augggcgccaugacccagcugcucgccgggguguuccuggcguuccuggcccucgccaccgagggcgggguccugaagaaggugauccgccacaagcggcagagcggcgugaacgccacccugcccgaggagaaccagcccgucguguucaaccacguguacaacaucaagcuccccgucgggagccagugcagcguggaccuggagagcgccagcggcgagaaggaccuggcgccgcccuccgagcccagcgaguccuuccaggagcacaccguggacggcgagaaccagaucgucuucacccaccgcaucaacaucccccggcgcgccugcgggugcgccgccgcgcccgacgugaaggagcuccugagccggcuggaggagcucgagaaccugguguccagccugcgcgagcagugcaccgccggcgccgggugcugccuccagcccgccacgggccggcuggacacccgccccuucugcuccgggcggggcaacuucagcaccgagggcugcgggugcgucugcgagcccggcuggaaggggcccaacugcuccgagcccgagugcccgggcaacugccaccuccgcggccggugcaucgacgggcagugcaucugcgacgacggcuucaccggggaggacugcagccagcucgccugccccuccgacugcaacgaccagggcaagugcgugaacggggugugcaucugcuucgagggcuacgcgggcgccgacugcagccgcgagaucugccccguccccugcuccgaggagcacgggacgugcguggacggccugugcgugugccacgacggguucgccggcgacgacugcaacaagccccugugccucaacaacugcuacaaccgggggcgcugcgucgagaacgagugcgugugcgacgagggcuucaccggcgaggacugcagcgagcugaucugccccaacgacugcuucgaccgggggcgcugcaucaacgggaccugcuacugcgaggagggguucaccggcgaggacugcgggaagcccacgugcccccacgccugccacacccagggccggugcgaggagggccagugcgugugcgacgagggguucgccggcgucgacugcuccgagaagcgcugcccggcggacugccacaaccgggggcgcugcguggacggccggugcgagugcgacgacggcuucaccggggccgacugcggcgagcugaagugccccaacgggugcagcggccacgggcgcugcgugaacggccagugcgucugcgacgagggcuacaccggggaggacugcagccagcuccgcugccccaacgacugccacucccggggccgcugcguggaggggaagugcgucugcgagcagggcuucaagggguacgacugcagcgacauguccugccccaacgacugccaccagcacggccggugcgugaacggcaugugcgugugcgacgacggguacacgggcgaggacugccgcgaccggcagugcccgcgcgacugcagcaaccgggggcugugcgucgacggccagugcgugugcgaggacggguucaccggccccgacugcgccgagcuguccugccccaacgacugccacggccaggggcgcugcgugaacggccagugcgucugccacgagggguucaugggcaaggacugcaaggagcagcggugccccagcgacugccacgggcagggccgcugcguggacggccagugcaucugccacgagggguucaccggccucgacugcgggcagcacuccugcccgagcgacugcaacaaccugggccagugcguguccggccggugcaucugcaacgagggguacagcggcgaggacugcuccgaggucuccccgcccaaggaccugguggugaccgaggucacggaggagaccgugaaccucgccugggacaacgagaugcgcgugaccgaguaccuggucguguacaccccgacgcacgagggcggccuggagaugcaguuccgggugcccggggaccagaccuccaccaucauccaggagcucgagcccggcgucgaguacuucauccgcguguucgccauccuggagaacaagaaguccauccccguguccgcgcgggucgccaccuaccugccggcccccgagggccucaaguucaagagcaucaaggagacguccguggagguggagugggacccccuggacaucgccuucgagaccugggagaucaucuuccgcaacaugaacaaggaggacgagggggagaucaccaagagccugcggcgccccgagaccuccuaccggcagacgggccucgccccggggcaggaguacgagaucagccugcacaucgucaagaacaacacccgcggccccgggcugaagcgcgugaccaccacgcggcucgacgcgcccagccagaucgaggugaaggacgucaccgacaccaccgcccugaucaccugguucaagccccuggccgagaucgacggcaucgagcucacguacggcaucaaggacgugccgggggaccgcaccaccaucgaccugaccgaggacgagaaccaguacuccaucggcaaccugaagcccgacacggaguacgaggugagccucaucucccggcgcggggacaugagcuccaaccccgccaaggagaccuucaccaccggccuggacgcgccccggaaccugcgccgggucagccagacggacaacuccaucacccuggaguggcgcaacgggaaggccgccaucgacagcuaccggaucaaguacgccccgaucuccggcggcgaccacgccgagguggacgugcccaagagccagcaggcgaccaccaagacgacccucaccgggcugcgccccggcaccgaguacgggaucggcgucuccgccgugaaggaggacaaggagagcaaccccgccacgaucaacgccgccaccgagcuggacaccccgaaggaccuccagguguccgagaccgcggagacgagccugacccugcucuggaagacgccccuggccaaguucgaccgguaccgccugaacuacucccuccccaccggccagugggucggggugcagcugccccggaacacgaccagcuacgugcugcgcggccucgagccggggcaggaguacaacguccugcugaccgccgagaagggccggcacaaguccaagcccgcccgcgugaaggccagcaccgagcaggcgcccgagcucgagaaccugacggugaccgaggucgggugggacggccugcggcucaacuggaccgccgccgaccaggccuacgagcacuucaucauccaggugcaggaggcgaacaagguggaggccgcccgcaaccugaccgucccgggcagccugcgggccguggacauccccgggcucaaggccgcgacgcccuacaccguguccaucuacggcgucauccagggguaccgcacccccgugcugagcgccgaggccuccaccggcgagacgccgaaccugggggagguggucguggccgaggucggcugggacgcccucaagcugaacuggaccgcgcccgagggcgccuacgaguacuucuucauccaggugcaggaggccgacaccguggaggccgcccagaaccugaccguccccgggggccuccggagcaccgaccugcccgggcugaaggcggccacgcacuacaccaucaccauccgcggcgugacccaggacuucuccacgaccccgcucagcguggagguccugaccgaggaggugcccgacauggggaaccugaccgugacggaggucuccugggacgcccuccgccugaacuggaccacccccgacggcaccuacgaccaguucacgauccaggugcaggaggccgaccagguggaggaggcgcacaaccugaccguccccggcagccuccgguccauggagaucccggggcugcgcgccggcacccccuacaccgugacgcugcacggggaggugcggggccacagcacccgcccccucgccgucgagguggugaccgaggaccugccccagcugggggaccucgccgucuccgaggugggcugggacggccugcggcugaacuggaccgccgcggacaacgccuacgagcacuucgugauccagguccaggaggugaacaagguggaggccgcccagaaccucacgcugccggggagccugcgcgccgucgacauccccggccucgaggcggccacccccuaccggguguccaucuacggggugauccgcggcuaccggacccccguccugagcgccgaggccuccaccgccaaggagccggagaucggcaaccugaacgugagcgacaucacgcccgaguccuucaaccucagcuggauggcgaccgacgggaucuucgagaccuucaccaucgagaucaucgacuccaaccgccugcuggagacgguggaguacaacaucagcggcgccgagcggaccgcccacaucagcgggcugccgcccuccaccgacuucaucgucuaccugagcggccuggccccguccauccgcaccaagacgaucagcgccaccgcgaccaccgaggcccucccccugcuggagaaccucacgaucuccgacaucaaccccuacggguucaccgugagcuggauggccuccgagaacgccuucgacagcuuccuggugaccgucguggacuccggcaagcugcucgacccccaggaguucacccugagcggcacccagcggaagcuggagcuccgcgggcugaucacgggcaucggguacgaggugauggucuccggcuucacccaggggcaccagaccaagccgcugcgggcggagaucgugaccgaggccgagcccgagguggacaaccuccuggucagcgacgccacgcccgacggcuuccgccuguccuggaccgccgacgagggcguguucgacaacuucgugcucaagauccgggacaccaagaagcagagcgagccgcuggagaucacccugcucgcccccgagcgcacgcgggacaucaccgggcugcgcgaggcgaccgaguacgagaucgagcuguacggcaucuccaaggggcgccggagccagaccgucuccgccaucgccacgaccgccaugggcagccccaaggaggugaucuucuccgacaucaccgagaacagcgccaccgugagcuggcgcgcgcccacggcccaggucgaguccuuccggaucaccuacgugccgaucaccgggggcacccccagcauggugacggucgacggcaccaagacccagacccgccucgugaagcugauccccgggguggaguaccuggucuccaucaucgccaugaagggcuucgaggagagcgagcccguguccgggagcuucacgaccgcccucgacggcccguccgggcuggucaccgccaacaucaccgacagcgaggcgcuggcccgguggcagcccgccaucgccacgguggacuccuacgugaucagcuacaccggcgagaagguccccgagaucacccgcaccguguccggcaacacgguggaguacgcgcucaccgaccuggagcccgccaccgaguacacccugcggaucuucgccgagaaggggccgcagaaguccagcacgaucaccgccaaguucaccaccgaccucgacagcccccgcgaccugacggccaccgagguccaguccgagaccgcgcugcucaccuggcggccgccccgcgccagcgugaccggcuaccugcugguguacgaguccgucgacgggacggugaaggaggugaucgucggcccggacaccaccagcuacucccucgccgaccugagccccagcacccacuacacggccaagauccaggcccugaacggcccccugcgguccaacaugauccagaccaucuucaccaccaucgggcuccuguaccccuucccgaaggacugcagccaggcgaugcugaacggcgacacgaccuccgggcucuacaccaucuaccugaacggcgacaaggccgaggcccuggagguguucugcgacaugaccagcgacgggggcggcuggaucguguuccuccgccggaagaacgggcgcgagaacuucuaccagaacuggaaggccuacgccgcgggcuucggggaccggcgcgaggaguucuggcugggccuggacaaccucaacaagaucacggcccaggggcaguacgagcugcgggucgaccugcgcgaccacggcgagaccgccuucgccguguacgacaaguucuccgugggcgacgcgaagacccgguacaagcucaaggucgagggguacagcggcaccgccggggacuccauggccuaccacaacggccgcagcuucuccacguucgacaaggacaccgacagcgccaucaccaacugcgcccuguccuacaagggggcguucugguaccggaacugccaccgcgugaaccugaugggccgcuacggcgacaacaaccacagccagggggugaacugguuccacuggaagggccacgagcacuccauccaguucgccgagaugaagcuccggcccagcaacuuccgcaaccuggaggggcggcgcaagcgggccuga

SEQ ID NO: 37895 - RNA, 951 nt, Artificial Sequence
  derived and/or modified sequence opt1 from TNFAIP1__Homo_sapiens__NP_066960
augagcggcgacacgugccugugccccgccuccggggccaagccgaagcucagcggcuucaagggcggcgggcuggggaacaaguacgugcagcugaacgucggcgggucccucuacuacaccaccgugcgcgcgcugacccggcacgacaccaugcugaaggccauguucagcggccgcauggaggugcucaccgacaaggagggguggauccugaucgaccggugcggcaagcacuucgggacgauccugaacuaccuccgcgacgacaccaucacccugccccagaaccggcaggagaucaaggagcugauggccgaggccaaguacuaccucauccagggccuggucaacaugugccaguccgcccugcaggacaagaaggacagcuaccagcccgugugcaacauccccaucaucaccucccucaaggaggaggagcgccugaucgagagcuccacgaagccgguggucaagcugcucuacaaccggagcaacaacaaguacuccuacaccagcaacuccgacgaccaccuccugaagaacaucgagcuguucgacaagcugagccugcgcuucaacggccggguccucuucaucaaggacgugaucggggacgagaucugcugcugguccuucuacggccaggggcgcaagcuggcggaggugugcugcaccagcaucguguacgccaccgagaagaagcagacgaagguggaguuccccgaggcccggaucuacgaggagacccugaacguccuccuguacgagacgccccgcgugcccgacaacucccugcucgaggccaccagccggucccgcagccaggcgagcccguccgaggacgaggagaccuucgagcugcgggaccgcgugcggcgcauccacgucaagcgguacagcaccuacgacgaccgccagcugggccaccaguccacccaccgggacuga

SEQ ID NO: 37896 - RNA, 1965 nt, Artificial Sequence
  derived and/or modified sequence opt1 from TNFAIP2__Homo_sapiens__NP_006282
augagcgaggccuccagcgaggaccuggugcccccgcucgaggccggcgcggcccccuaccgcgaggaggaggaggccgccaagaagaagaaggagaagaagaagaaguccaaggggcuggccaacgucuucugcguguucaccaagggcaagaagaagaaggggcagcccagcuccgcggagcccgaggacgccgccggcagccggcaggggcuggacggcccgccgcccaccguggaggagcucaaggccgcgcuggagcgcggccagcuggaggccgcccggccccuccuggcccuggagcgcgagcucgccgcggccgccgccgccgggggcgucuccgaggaggagcuggugcggcgccagagcaagguggaggcgcuguacgagcuccugcgggaccagguccugggggugcuccgccggccccuggaggccccgcccgagcgccugcggcaggcccucgccguggucgccgagcaggagcgcgaggaccggcaggcggccgccgccggccccgggacguccggccuggccgcgacccgcccccggcgcuggcugcagcucuggcggcgcggcguggccgaggccgccgaggagcggauggggcagcgccccgcggccggcgccgaggugcccgagagcgucuuccugcaccuggggcggaccaugaaggaggaccucgaggccgugguggagcgccugaagccccuguucccggccgaguucggcgucguggcggccuacgccgaguccuaccaccagcacuucgccgcccaccucgcggccguggcccaguucgagcugugcgagcgcgacaccuacaugcugcuccuguggguccagaaccuguaccccaacgacaucaucaacagccccaagcucgugggcgagcugcaggggaugggccuggggucccuccugcccccgcggcagauccgccugcucgaggccacguuccugagcuccgaggccgcgaacgugcgggagcugauggaccgcgcccucgagcuggaggcccggcgcugggccgaggacgucccgccccagcggcuggacggccacugccacagcgagcucgcgaucgacaucauccagaucaccucccaggcccaggccaaggccgagagcaucacccuggaccuggggucccagaucaagcgcgugcuccugguggagcugcccgccuuccugcggagcuaccagcgcgcguucaacgaguuccucgagcggggcaagcagcugaccaacuaccgcgccaacgucaucgccaacaucaacaacugccugagcuuccggauguccauggagcagaacuggcaggucccccaggacacgcucagccugcugcucggcccccugggggagcugaagucccacggcuucgacacccuccugcagaaccugcacgaggaccucaagccccuguucaagcgcuucacccacacccggugggccgcccccguggagacgcuggagaacaucaucgcgaccguggacacccgccucccggaguucagcgagcugcaggggugcuuccgggaggagcugauggaggcccuccaccuccaccuggugaaggaguacaucauccagcuguccaagggccgccugguccugaagaccgccgagcagcagcagcagcucgccggguacauccuggccaacgcggacacgauccagcacuucugcacccagcacggcagccccgccaccuggcugcagcccgcccucccgacccuggccgagaucauccggcugcaggaccccuccgcgaucaagaucgagguggccacguacgcgaccugcuaccccgacuucagcaagggccaccucuccgccauccuggccaucaaggggaaccugagcaacuccgaggugaagcgcauccgcagcauccucgacgucuccaugggcgcccaggagcccagccggccgcuguucucccugaucaaggugggguga

SEQ ID NO: 37897 - RNA, 2373 nt, Artificial Sequence
  derived and/or modified sequence opt1 from TNFAIP3__Homo_sapiens__NP_006281
auggccgagcagguccugccccaggcccucuaccugagcaacaugcgcaaggcggugaagauccgggagcgcacccccgaggacaucuucaagcccaccaacggcaucauccaccacuucaagacgaugcaccgguacacccuggagauguuccggaccugccaguucugcccccaguuccgggagaucauccacaaggcccucaucgaccgcaacauccaggccacccuggagucccagaagaagcugaacuggugccgggaggugcgcaagcucguggcccugaagacgaacggggacggcaacugccugaugcacgccaccagccaguacauguggggcguccaggacaccgaccucgugcugcggaaggcgcuguucuccacccucaaggagacggacacccgcaacuucaaguuccgguggcagcuggagagccugaagucccaggaguucguggagaccgggcucugcuacgacacccgcaacuggaacgacgagugggacaaccugaucaagauggccagcacggacacccccauggcccgguccgggcugcaguacaacagccucgaggagauccacaucuucguccugugcaacauccugcgccggccgaucaucgugaucuccgacaagaugcuccgcagccuggaguccggcagcaacuucgcgccccugaaggugggcgggaucuaccucccccugcacuggcccgcccaggagugcuaccgguacccgaucguccugggcuacgacucccaccacuucgugccccucgugacccugaaggacagcgggcccgagauccgcgccgucccccuggugaaccgggaccgcggccgguucgaggaccucaaggugcacuuccugaccgacccggagaacgagaugaaggagaagcugcucaaggaguaccugauggucaucgagauccccgugcaggggugggaccacggcacgacccaccugaucaacgccgccaagcucgacgaggccaaccugcccaaggagaucaaccugguggacgacuacuucgagcucguccagcacgaguacaagaaguggcaggagaacuccgagcagggccgccgcgaggggcacgcgcagaaccccauggagccgagcgugccccagcugucccugauggacgugaagugcgagacccccaacugccccuucuucaugagcgucaacacccagccgcucugccacgagugcuccgagcggcgccagaagaaccagaacaagcugcccaagcugaacagcaagcccggccccgaggggcucccgggcauggcccugggcgccagccgcggggaggccuacgagccccuggccuggaaccccgaggaguccacgggcgggccccacagcgcgccgcccaccgcccccuccccguuccucuucagcgagaccaccgccaugaagugccgcucccccggcugccccuucacgcugaacgugcagcacaacggguucugcgagcggugccacaacgcccgccagcugcacgccagccacgcgcccgaccacacccggcaccuggacccgggcaagugccaggccugccuccaggacgugacccgcaccuucaacggcaucugcuccacgugcuucaagcggaccaccgccgaggccagcuccagccuguccaccagccugccgcccuccugccaccagcgcagcaaguccgaccccagccggcucguccgcucccccagcccccacuccugccaccgggccgggaacgacgcgcccgccggcugccugagccaggccgcccgcacgcccggggaccggaccggcaccagcaagugccgcaaggcggggugcguguacuucggcaccccggagaacaagggcuucugcacgcugugcuucaucgaguaccgggagaacaagcacuucgccgccgccuccgggaaggucagccccaccgccucccgcuuccagaacaccauccccugccucggccgggagugcgggacccugggcagcaccauguucgagggguacugccagaagugcuucaucgaggcgcagaaccagcgcuuccacgaggccaagcgcacggaggagcagcugcgguccagccagcgccgggacgugccccgcaccacccaguccaccagccggccgaagugcgcccgcgccuccugcaagaacauccucgccugccggagcgaggagcugugcauggagugccagcaccccaaccagcgcaugggccccggcgcgcaccgcggggagcccgccccggaggacccgcccaagcagcggugccgggcccccgccugcgaccacuucggcaacgccaagugcaacggguacugcaacgagugcuuccaguucaagcagauguacggcuga

SEQ ID NO: 37898 - RNA, 834 nt, Artificial Sequence
  derived and/or modified sequence opt1 from TNFAIP6__Homo_sapiens__NP_009046
augaucauccugaucuaccucuuccugcugcucugggaggacacccagggcuggggguucaaggacggcaucuuccacaacagcaucuggcuggagcgcgccgccgggguguaccaccgggaggcgcgcuccggcaaguacaagcugaccuacgccgaggccaaggccgucugcgaguucgagggcgggcaccucgccacguacaagcagcuggaggcggcccggaagaucggcuuccacgugugcgccgccggguggauggcgaagggccgcgugggguaccccaucgucaagccgggccccaacugcggguucggcaagaccggcaucaucgacuacgggauccggcugaaccgcagcgagcggugggacgccuacugcuacaacccccacgccaaggagugcggcgggguguucaccgaccccaagcagaucuucaaguccccgggcuuccccaacgaguacgaggacaaccagaucugcuacuggcacauccgccucaaguacggccagcggauccaccugagcuuccuggacuucgaccucgaggacgaccccgggugccuggccgacuacguggagaucuacgacuccuacgacgacguccacggcuucguggggcgcuacugcggcgacgagcugcccgacgacaucaucagcaccgggaacgugaugacgcucaaguuccuguccgacgccagcgucaccgcgggcggcuuccagaucaaguacguggccauggacccgguguccaagagcucccaggggaagaacaccagcaccacguccaccggcaacaagaacuuccuggccgggcgguucagccaccucuga

SEQ ID NO: 37899 - RNA, 567 nt, Artificial Sequence
  derived and/or modified sequence opt1 from TNFAIP8__Homo_sapiens__NP_001071122
auggccaccgacguguucaacagcaagaaccuggccguccaggcgcagaagaagauccucggcaagaugguguccaagagcaucgccaccacgcugaucgacgacaccuccagcgaggugcuggacgagcucuaccgcgucacccgggaguacacccagaacaagaaggaggccgagaagaucaucaagaaccugaucaagacggugaucaagcuggccauccucuaccgcaacaaccaguucaaccaggacgagcuggcccugauggagaaguucaagaagaaggugcaccagcucgcgaugaccgucguguccuuccaccagguggacuacaccuucgaccggaacguccugagccgccugcucaacgagugccgggagaugcugcaccagaucauccagcgccaccugaccgccaagucccacgggcgggugaacaacguguucgaccacuucagcgacugcgaguuccucgccgcccuguacaaccccuucggcaacuucaagccgcaccuccagaagcugugcgacgggaucaacaagaugcuggacgaggagaacaucuga

SEQ ID NO: 37900 - RNA, 555 nt, Artificial Sequence
  derived and/or modified sequence opt1 from TNFAIP8L2__Homo_sapiens__NP_078851
auggagagcuucuccagcaagucccuggcccuccaggccgagaagaagcugcugagcaagauggcgggccgcuccguggcccaccucuucaucgacgagaccagcuccgagguccuggacgagcuguaccgggugagcaaggaguacacccacucccgcccccaggcccagcgggugaucaaggaccucaucaaggucgccaucaagguggccgugcugcaccgcaacgggagcuucggcccguccgagcuggcgcucgccacgcgguuccgccagaagcugcggcagggggccaugaccgcccugagcuucggcgaggucgacuucaccuucgaggcggccgugcucgccgggcugcugaccgagugccgcgacgugcuccuggagcuggucgagcaccaccucacgcccaagucccacggccggauccgccacguguucgaccacuucagcgaccccggccugcugaccgcccucuacgggcccgacuucacccagcaccugggcaagaucugcgacgggcugcggaagcuccuggacgagggcaagcuguga

SEQ ID NO: 37901 - RNA, 879 nt, Artificial Sequence
  derived and/or modified sequence opt1 from TNFAIP8L3__Homo_sapiens__NP_997264
augggcaagccccgccagaacccgagcacccugguguccacccucugcgaggccgagcccaaggggaagcugugggucaacggcuacgccgggacgcagggcacccgggacgcgacccugcagacccgccucaucccccugagcuuccaccuccagcgggggaagggccuggccgcgccccuguccgcccugagcgccccgcgccuccccgagcggcccgccgacggccgcguggccguggacgcccagcccgccgcgcgguccauggacagcgacuccggggagcagagcgagggcgagccggucacggccgccgggcccgacguguucuccagcaagucccuggcccugcaggcccagaagaagauccucagcaagaucgcguccaagaccguggccaacaugcugaucgacgacaccagcuccgagaucuucgacgagcuguacaaggucaccaaggagcacacgcacaacaagaaggaggcccacaagaucaugaaggaccucaucaagguggccaucaagaucggcauccuguaccgcaacaaccaguucagccaggaggagcuggugaucgucgagaaguuccggaagaagcucaaccagaccgccaugaccaucguguccuucuacgagguggaguacaccuucgaccgcaacguccugagcaaccugcuccacgagugcaaggaccuggugcacgagcuggugcagcggcaccucacgccccgcacccacgggcggaucaaccacgucuucaaccacuucgcggacguggaguuccuguccacccuguacagccucgacggcgacugccgccccaaccugaagcggaucugcgagggcaucaacaagcugcucgacgagaaggugcuguga

SEQ ID NO: 37902 - RNA, 702 nt, Artificial Sequence
  derived and/or modified sequence opt1 from TNF__Homo_sapiens__NP_000585
augagcaccgaguccaugauccgcgacguggagcuggccgaggaggcccuccccaagaagaccggcgggccgcagggcagccggcgcugccuguuccugucccucuucagcuuccugaucgucgcgggggccacgacccuguucugccuccugcacuucggcgugaucgggccccagcgggaggaguucccccgcgaccugucccucaucagcccccuggcccaggccgugcgguccagcucccgcaccccgagcgacaagcccgucgcccacgugguggcgaacccccaggccgagggccagcugcaguggcucaaccggcgcgccaacgcccugcuggcgaacggcgucgagcuccgggacaaccagcugguggugcccuccgaggggcuguaccucaucuacagccagguccuguucaagggccaggggugcccguccacccacgugcugcucacgcacaccaucagccgcaucgccguguccuaccagaccaaggucaaccugcugagcgccaucaagucccccugccagcgggagacccccgagggcgccgaggccaagcccugguacgagccgaucuaccucgggggcguguuccagcuggagaagggcgaccgccugagcgcggagaucaaccggcccgacuaccucgacuucgccgaguccggccagguguacuucgggaucaucgcccuguga

SEQ ID NO: 37903 - RNA, 1407 nt, Artificial Sequence
  derived and/or modified sequence opt1 from TNFRSF10A__Homo_sapiens__NP_003835
auggcgcccccgcccgcccgcgugcaccugggcgccuuccucgccgucacccccaaccccgggagcgccgccuccggcaccgaggccgcggccgccacgccgagcaagguguggggguccagcgccggccggaucgagccccgcgggggcggccgcggggcgcugcccaccuccaugggccagcacgggcccagcgcccgggcccgggccggccgcgccccggggccccggcccgcgcgcgaggccagcccccggcugcgcgugcacaagaccuucaaguucgucguggugggcguccuccuccagguggugccguccuccgccgccaccaucaagcugcacgaccagagcaucggcacgcagcagugggagcacagcccccucggggagcugugcccgcccggcucccaccgguccgagcaccccggggccugcaaccgcugcaccgagggcgucggcuacaccaacgcgagcaacaaccuguucgccugccuccccugcaccgccugcaaguccgacgaggaggagcggagccccugcacgaccacccgcaacaccgccugccagugcaagcccgggacguuccggaacgacaacuccgccgagaugugccgcaagugcagccggggcugcccgcgcgggauggugaaggugaaggacugcacccccugguccgacaucgagugcguccacaaggagagcggcaacgggcacaacaucugggugauccugguggucacccugguggugccccuccugcuggucgcggugcucaucgugugcugcugcaucggcagcggcugcgggggcgaccccaagugcauggaccgggucugcuucuggcgccuggggcugcuccggggcccgggggccgaggacaacgcccacaacgagauccuguccaacgccgacagccuguccaccuucgugagcgagcagcagauggagucccaggagcccgccgaccucacgggcgugaccguccagagccccggcgaggcgcagugccugcuggggcccgccgaggccgagggcucccagcgccgccggcuccuggugccggccaacggggcggaccccaccgagacccugaugcuguucuucgacaaguucgccaacaucguccccuucgacagcugggaccagcugaugcgccagcuggaccucacgaagaacgagaucgacguggugcgggccggcaccgccgggccgggcgacgcccuguacgcgaugcugaugaagugggucaacaagaccggccgcaacgccuccauccacacccuccuggacgcccuggagcggauggaggagcgccacgcccgggagaagauccaggaccuccugguggacagcgggaaguucaucuaccuggaggacggcacgggguccgccgugagccucgaguga

SEQ ID NO: 37904 - RNA, 1323 nt, Artificial Sequence
  derived and/or modified sequence opt1 from TNFRSF10B__Homo_sapiens__NP_003833
auggagcagcgcggccagaacgcccccgccgcgagcggggcccggaagcgccacggcccggggccccgggaggcccgcggcgcccggcccgggccccgcgugccgaagacccugguccucgugguggccgcgguccugcugcucguguccgccgagagcgcccugaucacccagcaggaccuggcgccccagcagcgggccgcgccccagcagaagcgcuccagccccuccgagggccucugcccgcccggccaccacaucagcgaggacgggcgggacugcaucuccugcaaguacggccaggacuacagcacgcacuggaacgaccugcuguucugccuccgcugcacccggugcgacuccggggagguggagcugagccccugcaccaccacgcgcaacaccgucugccagugcgaggagggcaccuuccgggaggaggacucccccgagaugugccgcaagugccggaccgggugcccgcgcggcauggugaaggugggcgacugcacgcccuggagcgacaucgagugcguccacaaggaguccgggaccaagcacagcggcgaggugcccgccguggaggagaccgucaccuccagccccgggacgccggccucccccugcagccuguccggcaucaucaucggcgugaccguggccgccgucgugcucaucguggccgucuucgugugcaagagccugcuguggaagaaggugcuccccuaccugaaggggaucugcagcggcgggggcggggaccccgagcgggucgaccgcuccagccagcggccgggcgccgaggacaacgugcugaacgagaucguguccauccuccagcccacccagguccccgagcaggagauggaggugcaggagcccgccgagccgaccggcgucaacaugcugagccccggggaguccgagcaccuccuggagcccgccgaggcggagcgcagccagcggcgccgccugcuggugcccgccaacgagggcgacccgacggagacccuccggcagugcuucgacgacuucgccgaccuggugcccuucgacuccugggagccccugaugcgcaagcucgggcugauggacaacgagaucaaggucgccaaggccgaggcggccggccaccgggacacccuguacaccaugcucaucaagugggugaacaagacggggcgcgacgccagcgugcacacccugcuggacgcccucgagacccugggcgagcggcuggccaagcagaagaucgaggaccaccuccuguccagcggcaaguucauguaccuggaggggaacgcggacuccgccaugagcuga

SEQ ID NO: 37905 - RNA, 780 nt, Artificial Sequence
  derived and/or modified sequence opt1 from TNFRSF10C__Homo_sapiens__NP_003832
auggcccgcauccccaagacccugaaguucguggucgugaucguggccguccuccugccggugcuggcguacagcgccaccacggcccggcaggaggaggugccccagcagaccgucgcgccccagcagcagcgccacuccuucaagggcgaggagugccccgccgggagccaccgguccgagcacaccggcgccugcaacccgugcaccgaggggguggacuacacgaacgccagcaacaacgagcccuccugcuuccccugcaccgugugcaagagcgaccagaagcacaaguccagcugcaccaugacccgcgacacggucugccagugcaaggagggcaccuuccggaacgagaacucccccgagaugugccgcaagugcagccggugcccguccggggagguccaggugagcaacugcaccuccugggacgacauccagugcguggaggaguucggcgccaacgccaccguggagacgcccgcggccgaggagaccaugaacaccagccccggcacccccgccccggccgccgaggagacgaugaacaccucccccgggacccccgcgcccgccgccgaggagaccaugacgaccagcccgggcacccccgcccccgccgcggaggagaccaugacgaccucccccgggaccccggcccccgccgccgaggagaccaugacgaccagccccggcacccccgccuccagccacuaccucagcugcaccaucguggggaucaucguccugaucgugcugcucaucguguucgucuga

SEQ ID NO: 37906 - RNA, 1161 nt, Artificial Sequence
  derived and/or modified sequence opt1 from TNFRSF10D__Homo_sapiens__NP_003831
augggccugugggggcagagcgugcccaccgccuccagcgcccgcgcgggccgguacccgggggcccgcaccgccuccggcacgcggcccuggcuccuggaccccaagauccugaaguucgucguguucaucguggccguccuccugcccgugcgcguggacagcgccaccaucccgcggcaggacgaggucccccagcagaccguggcgccccagcagcagcgccggucccugaaggaggaggagugccccgccgggagccaccgcuccgaguacaccggcgccugcaacccgugcacggagggcguggacuacaccaucgccagcaacaaccuccccuccugccugcugugcaccgucugcaagagcgggcagaccaacaaguccagcugcacgaccacccgggacaccgugugccagugcgagaagggcuccuuccaggacaagaacagccccgagaugugccgcacgugccggaccgggugcccccgcggcauggugaaggucuccaacugcaccccgcggagcgacaucaagugcaagaacgaguccgcggccagcuccaccgggaagacgcccgccgccgaggagaccgugaccaccauccucggcaugcuggccagccccuaccacuaccugaucaucaucgugguccucgugaucauccuggcgguggucguggugggcuucagcugccgcaagaaguucaucuccuaccugaaggggaucugcagcggcgggggcggcgggcccgagcggguccaccgcguccucuuccggcgccgguccugcccgagccgcgugcccggcgccgaggacaacgcccggaacgagacgcuguccaaccgcuaccugcagcccacccaggugagcgagcaggagauccaggggcaggagcucgccgagcugaccggcgugaccgucgagcugcccgaggagccgcagcgccuccuggagcaggccgaggcggaggggugccagcggcgccggcugcucgugcccgugaacgacgccgacuccgccgacaucagcacgcugcuggacgccuccgccacccucgaggagggccacgcgaaggagaccauccaggaccagcuggucggcagcgagaagcuguucuacgaggaggacgaggccggguccgccaccagcugccucuga

SEQ ID NO: 37907 - RNA, 900 nt, Artificial Sequence
  derived and/or modified sequence opt1 from TNFRSF11A__Homo_sapiens__NP_001257880
auggcgccccgcgcccggcgccggcgcccgcuguucgcccuccugcugcucugcgcccugcuggcccggcuccagguggcccugcagaucgccccgcccugcaccagcgagaagcacuacgagcaccugggccgcugcugcaacaagugcgagcccgggaaguacauguccagcaagugcaccacgaccuccgacagcgucugccuccccugcggccccgacgaguaccuggacuccuggaacgaggaggacaagugccugcuccacaaggugugcgacaccgggaaggcgcugguggccgucguggccggcaacagcaccacgccccggcgcugcgccugcaccgcgggguaccacuggucccaggacugcgagugcugccggcgcaacaccgagugcgcccccggccugggcgcccagcacccgcuccagcugaacaaggacaccgugugcaagcccugccuggccggguacuucagcgacgccuucuccagcacggacaagugccggcccuggaccaacugcaccuuccucggcaagcgcgucgagcaccacgggaccgagaaguccgacgcggugugcagcuccagccugcccgcccggaagccgcccaacggcaacgugacggggaacuccaacagcaccuucaucuccagcggccaggucaugaacuucaagggcgacaucaucgugguguacgucucccagaccagccaggagggggccgccgccgcggccgagcccaugggccgccccgugcaggaggagacccuggcccggcgcgacagcuucgccgggaacggcccgcgguuccccgaccccugcggcgggcccgagggccuccgcgagccggagaaggccucccggcccgugcaggagcagggcggggcgaaggccuga

SEQ ID NO: 37908 - RNA, 1206 nt, Artificial Sequence
  derived and/or modified sequence opt1 from TNFRSF11B__Homo_sapiens__NP_002537
augaacaaccugcucugcugcgcccugguguuccuggacaucagcaucaaguggaccacccaggagacguucccgcccaaguaccuccacuacgacgaggagaccucccaccagcugcugugcgacaagugcccgcccggcaccuaccucaagcagcacugcaccgccaaguggaagacggucugcgcgcccugccccgaccacuacuacaccgacagcuggcacaccuccgacgagugccuguacugcagccccgugugcaaggagcugcaguacgugaagcaggagugcaaccgcacccacaaccgggucugcgagugcaaggaggggcgcuaccucgagaucgaguucugccugaagcaccgguccugcccgcccggcuucgggguggugcaggccggcacgcccgagcgcaacaccgucugcaagcggugccccgacggguucuucagcaacgagaccuccagcaaggcccccugccgcaagcacaccaacugcuccguguucggccugcuccugacgcagaagggcaacgccacccacgacaacaucugcagcgggaacuccgagagcacccagaagugcggcaucgacgugacccugugcgaggaggccuucuuccgguucgcgguccccacgaaguucaccccgaacuggcucuccgugcugguggacaaccugcccgggaccaaggucaacgccgagagcguggagcgcaucaagcggcagcacuccagccaggagcagaccuuccagcuccugaagcuguggaagcaccagaacaaggaccaggacaucgugaagaagaucauccaggacaucgaccucugcgagaacuccguccagcgccacaucggccacgccaaccugacguucgagcagcugcggagccucauggagucccugcccgggaagaaggugggcgccgaggacaucgagaagaccaucaaggcgugcaagcccagcgaccagauccugaagcuccugagccuguggcgcaucaagaacggcgaccaggacacccucaaggggcugaugcacgcccugaagcacuccaagaccuaccacuucccgaagacggugacccagagccucaagaagaccauccgguuccugcacuccuucaccauguacaagcuguaccagaagcuguuccucgagaugaucggcaaccagguccagagcgugaagaucuccugccuguga

SEQ ID NO: 37909 - RNA, 390 nt, Artificial Sequence
  derived and/or modified sequence opt1 from TNFRSF12A__Homo_sapiens__NP_057723
auggcccgcggcagccugcggcgccuccugcggcugcucgugcuggggcuguggcucgcccugcugcgcuccgucgcgggcgagcaggcccccgggaccgccccgugcagccggggcuccagcugguccgccgaccucgacaagugcauggacugcgccagcugccgcgcgcggccccacuccgacuucugccuggggugcgccgccgccccgcccgcgcccuuccgccugcucuggcccauccugggcggcgcccugagccucaccuucgugcuggggcugcucuccggcuuccugguguggcggcgcugccggcgccgggagaaguucacgacccccaucgaggagaccgggggcgaggggugccccgccgucgcccugauccaguga

SEQ ID NO: 37910 - RNA, 882 nt, Artificial Sequence
  derived and/or modified sequence opt1 from TNFRSF13B__Homo_sapiens__NP_036584
augagcggccuggggcgcucccggcgcggcgggcggagccgcguggaccaggaggagcgguucccccagggccucuggaccggggucgccaugcgcuccugcccggaggagcaguacugggacccccugcuggggaccugcaugagcugcaagacgaucugcaaccaccagucccagcggaccugcgccgcguucugccgcagccucuccugccggaaggagcagggcaaguucuacgaccaccuccugcgcgacugcaucagcugcgccuccaucugcgggcagcaccccaagcagugcgccuacuucugcgagaacaagcugcggagccccgugaaccugccgcccgagcugcgccggcagcgcuccggcgagguggagaacaacagcgacaacuccgggcgguaccagggccucgagcaccgcgggagcgaggccucccccgcccugcccggccugaagcucagcgcggaccaggucgcccugguguacuccacccugggccucugccugugcgccgugcugugcugcuuccucgucgccguggcgugcuuccugaagaagcgcggggacccgugcagcugccagccccggucccggccccgccagagccccgccaagagcucccaggaccacgccauggaggccggcagcccgguguccaccagccccgagcccgucgagacgugcuccuucugcuuccccgagugccgggccccgacccaggagagcgcggugacccccgggacccccgaccccacgugcgccggccgcuggggcugccacacccgcaccaccgugcugcagccgugcccccacauccccgacuccgggcucggcaucgucugcgugcccgcccaggagggcggcccgggggccuga

SEQ ID NO: 37911 - RNA, 555 nt, Artificial Sequence
  derived and/or modified sequence opt1 from TNFRSF13C__Homo_sapiens__NP_443177
augcgccggggcccccgcagccugcgggggcgcgacgccccggcccccacccccugcgugcccgcggagugcuucgaccuccugguccggcacugcguggccugcggccugcuccgcaccccgcggcccaagcccgccggggccuccagccccgccccgcgcacggcgcugcagccccaggaguccgugggcgccggggccggcgaggccgcgcugccccuccccggccugcuguucggggccccggcccuccugggccuggcccucguccuggcccuggugcucguggggcuggucagcuggcggcgccggcagcgccggcugcgcggcgcguccagcgccgaggcccccgacggggacaaggacgcccccgagccccucgacaaggugaucauccuguccccgggcaucagcgacgccaccgcgcccgccuggcccccgcccggcgaggaccccgggaccaccccgcccggccacuccgugcccguccccgccacggagcuggggagcaccgagcucgugaccaccaagacggccggccccgagcagcaguga

SEQ ID NO: 37912 - RNA, 555 nt, Artificial Sequence
  derived and/or modified sequence opt1 from TNFRSF14__Homo_sapiens__NP_001284534
auggagccgcccggcgacugggggcccccgcccuggcgcagcacccccaagaccgacgugcugcggcucguccuguaccugacguuccucggcgcccccugcuacgcccccgcgcugcccuccugcaaggaggacgaguaccccguggggagcgagugcugccccaagugcucccccggcuaccgcgugaaggaggccugcggggagcugaccggcaccgucugcgagcccugcccgcccggcaccuacaucgcccaccucaacgggcugagcaagugccugcagugccagaugugcgaccccgccaugggccuccgggccucccgcaacugcagccggacggagaacgcggugugcgggugcucccccggccacuucugcaucgugcaggacggggaccacugcgccgccugccgcgccuacgcgaccagcuccccgggccagcggguccagaagggcgggaccgagagccaggacacccugugccagaacugcccgcccggcacguucucccccaacgggacccuggaggagugccagcaccagaccaaguga

SEQ ID NO: 37913 - RNA, 858 nt, Artificial Sequence
  derived and/or modified sequence opt1 from TNFRSF19__Homo_sapiens__NP_001191388
auggagugcgugcccugcggcgacccgcccccgcccuacgagccccacugcgccagcaaggucaaccuggugaagaucgccuccaccgcgagcagcccccgcgacaccgcccucgccgccgugaucugcuccgcccuggcgacgguccugcucgcccugcugauccucugcgugaucuacugcaagcggcaguucauggagaagaagcccuccuggagccugcgcucccaggacauccaguacaacgggagcgagcuguccugcuucgaccggccccagcuccacgaguacgcccaccgcgccugcugccagugccggcgcgacagcgugcagaccugcggcccgguccggcugcugcccuccaugugcugcgaggaggcgugcagccccaaccccgccacccucgggugcggcgugcacuccgccgccagccugcaggcccgcaacgcggggccggccggcgagauggugcccaccuucuucggcucccugacgcagagcaucugcggggaguucuccgacgccuggccccucaugcagaaccccaugggcggggacaacaucagcuucugcgacuccuacccggagcugaccggcgaggacauccacagccugaaccccgagcucgagagcuccaccagccuggacuccaacagcucccaggaccuggucgggggcgccgugcccgugcagagccacuccgagaacuucaccgccgcgacggaccucagccgguacaacaacacccuggucgaguccgccagcacccaggacgcccugaccaugcgcucccagcucgaccaggagagcggcgccgugauccaccccgccacgcagaccucccugcaggaggcguga

SEQ ID NO: 37914 - RNA, 1368 nt, Artificial Sequence
  derived and/or modified sequence opt1 from TNFRSF1A__Homo_sapiens__NP_001056
augggccugagcaccgugcccgaccuccugcugccgcucguccugcuggagcuccugguggggaucuaccccuccggcgugaucgggcuggucccccaccucggcgaccgcgagaagcgggacagcgugugcccccaggggaaguacauccacccgcagaacaacuccaucugcugcaccaagugccacaagggcacguaccuguacaacgacugccccggccccgggcaggacaccgacugccgcgagugcgagagcggcuccuucaccgccagcgagaaccaccuccggcacugccuguccugcagcaagugccgcaaggagaugggccagguggagaucuccagcugcaccgucgaccgggacacggugugcgggugccgcaagaaccaguaccggcacuacugguccgagaaccuguuccagugcuucaacugcagccugugccucaacgggaccgugcaccuguccugccaggagaagcagaacaccgucugcacgugccacgccggcuucuuccugcgcgagaacgagugcgugagcugcuccaacugcaagaagucccucgagugcaccaagcugugccugccccagaucgagaacgugaagggcaccgaggacagcgggaccaccguccuccugccgcuggugaucuucuucggccucugccugcugagccuccuguucaucgggcugauguaccgguaccagcgcuggaaguccaagcucuacagcaucgugugcggcaagagcacgcccgagaaggagggcgagcuggaggggaccaccaccaagccccuggcgcccaacccguccuucagccccacgcccggcuucacccccacccucggguucuccccgguccccagcuccaccuucacgagcuccagcaccuacacccccggcgacugccccaacuucgccgccccgcggcgcgagguggccccgcccuaccagggggccgaccccauccuggcgaccgcccuggccuccgaccccauccccaacccccuccagaagugggaggacagcgcccacaagccccagucccuggacacggacgacccggcgacccuguacgccguggucgagaacgugccgccccuccgguggaaggaguucgugcgccggcugggccugagcgaccacgagaucgaccgccucgagcugcagaacggccggugccugcgcgaggcccaguacuccaugcucgccaccuggcggcgccggacgccccgccgcgaggccacccuggagcugcucgggcggguccugcgcgacauggaccugcugggcugccucgaggacaucgaggaggcgcugugcgggcccgccgcccugccgcccgcccccagccuccugcgguga

SEQ ID NO: 37915 - RNA, 1389 nt, Artificial Sequence
  derived and/or modified sequence opt1 from TNFRSF1B__Homo_sapiens__XP_011540365
auggcccccguggccgucugggcggcccuggccgugggccucgagcugugggccgccgcgcacgcccugccggcccagguggccuucacccccuacgcgcccgagcccgggagcacgugccgccuccgggaguacuacgaccagaccgcccagaugugcugcuccaagugcagcccgggccagcacgccaaggucuucugcaccaagaccuccgacaccgugugcgacagcugcgaggacuccacguacacccagcuguggaacugggugcccgagugccugagcugcgggucccgcugcagcuccgaccaggucgagacccaggccugcacccgggagcagaaccgcaucugcacgugccggcccggcugguacugcgcccucagcaagcaggaggggugccgccugugcgcgccccugcggaagugccgcccgggcuucggcguggcccggcccgggaccgagaccuccgacguggucugcaagcccugcgcccccggcaccuucagcaacacgaccuccagcaccgacaucugccgcccgcaccagaucugcaacgugguggccauccccgggaacgccuccauggacgcggucugcaccagcacgucccccacccggagcauggcccccggcgccgugcaccucccgcagcccguguccacccgcagccagcacacccagcccacgcccgagccgagcaccgcccccuccaccagcuuccugcugcccauggggcccuccccgcccgccgagggcagcaccggcgacuucgcgcuccccgucgggcugaucgugggcgugacggcccuggggcuccugaucaucggcgucgugaacugcgugaucaugacccaggucaagaagaagccccugugccuccagcgggaggccaaggugccgcaccuccccgccgacaaggcccgcggcacccaggggcccgagcagcagcaccuccugaucaccgcgccguccagcuccagcuccagccuggaguccagcgccuccgcccuggaccggcgcgcccccacgcggaaccagccccaggcgcccggcguggaggccagcggggccggcgaggcccgcgccuccaccgggagcuccgcggacagcuccccgggcggccacgggacccaggucaacgugaccugcaucgucaacgugugcagcagcuccgaccacagcucccagugcagcucccaggccagcuccacgaugggcgacaccgacagcucccccagcgagucccccaaggacgagcagguccccuucagcaaggaggagugcgccuuccggucccagcuggagaccccggagacccugcuggggagcacggaggagaagccccucccccugggcgugcccgacgccgggaugaagccguccuga

SEQ ID NO: 37916 - RNA, 1968 nt, Artificial Sequence
  derived and/or modified sequence opt1 from TNFRSF21__Homo_sapiens__NP_055267
augggcaccagccccuccagcuccaccgcccuggccagcugcucccgcaucgcgcggcgcgccacggccaccaugaucgccgggagccuccugcugcucggcuuccuguccaccaccacggcccagccggagcagaaggcgagcaaccugaucgggaccuaccggcacguggaccgcgccaccggccagguccugaccugcgacaagugccccgccgggacguacguguccgagcacugcaccaacaccagccugcgggugugcuccagcugccccgucggcaccuucacgcgccacgagaacggcaucgagaagugccacgacugcucccagcccugcccguggcccaugaucgagaagcugcccugcgccgcgcucaccgaccgggagugcacgugcccgcccgggauguuccagagcaacgcgaccugcgcgccccacacggugugccccgugggcuggggcguccgcaagaaggggaccgagaccgaggacgugcggugcaagcagugcgcccgcgggaccuucuccgacgugcccagcuccgucaugaagugcaaggccuacacggacugccugagccagaaccugguggugaucaagccgggcaccaaggagaccgacaacgucugcggcacccuccccuccuucagcagcuccacgagccccucccccgggaccgccaucuucccgcggcccgagcacauggagacccacgaggugcccagcuccaccuacgugcccaagggcaugaacagcacggaguccaacagcuccgccagcguccgcccgaaggugcuguccagcauccaggaggggaccgugcccgacaacaccuccagcgcccggggcaaggaggacgucaacaagacccugcccaaccuccagguggugaaccaccagcagggcccccaccaccgccacauccugaagcugcucccguccauggaggccaccgggggcgagaaguccuccacccccaucaaggggcccaagcggggccacccccgccagaaccugcacaagcacuucgacaucaacgagcaccucccguggaugaucguccucuuccugcugcucgugcugguggucaucguggucugcagcauccggaaguccagccgcacccugaagaaggggccccggcaggaccccagcgccaucguggagaaggccggccucaagaaguccaugaccccgacgcagaaccgcgagaaguggaucuacuacugcaacggccacgggaucgacauccugaagcugguggccgcccaggucggcagccaguggaaggacaucuaccaguuccucugcaacgccuccgagcgggagguggccgcguucagcaacggguacaccgccgaccacgagcgcgccuacgccgcccugcagcacuggaccauccgcggccccgaggcgucccuggcccagcucaucagcgcccugcggcagcaccgccggaacgacguggucgagaagauccgcgggcugauggaggacaccacccagcucgagacggacaagcuggcccugcccaugucccccagcccgcucucccccagccccauccccuccccgaacgcgaagcuggagaacagcgcccugcucaccguggagcccagcccccaggacaagaacaagggcuucuucguggacgagagcgagccccugcugcggugcgacuccaccagcuccggcagcagcgcccucucccgcaacgggagcuucaucaccaaggagaagaaggacacgguccugcgccaggugcggcuggacccgugcgaccuccagcccaucuucgacgacaugcugcacuuccugaaccccgaggagcugcgggugaucgaggagaucccccaggccgaggacaagcucgaccgccuguucgagaucaucggcgucaagucccaggaggccagccagacccugcucgacuccguguacagccaccucccggaccugcuguga

SEQ ID NO: 37917 - RNA, 903 nt, Artificial Sequence
  derived and/or modified sequence opt1 from TNFRSF6B__Homo_sapiens__NP_003814
augcgcgcccuggagggccccgggcucagccugcugugccucgugcuggcccugccggcgcuccugcccguccccgccgugcggggcguggccgagacccccaccuacccguggcgcgacgccgagacgggggagcggcuggucugcgcccagugcccgcccggcaccuucgugcagcgccccugccggcgcgacucccccacgaccugcgggcccugcccgccccggcacuacacccaguucuggaacuaccucgagcgcugccgguacugcaacgugcugugcggcgagcgcgaggaggaggcgcgggccugccacgccacccacaaccgcgccugccggugccgcaccggcuucuucgcgcacgccggguucugccuggagcacgccagcugcccgcccggcgccggggucaucgcccccggcacccccucccagaacacgcagugccagcccugcccgcccgggaccuucagcgcguccagcuccagcuccgagcagugccagccccaccggaacugcaccgcccucggccuggcccugaacgugcccggcagcuccagccacgacacccucugcacguccugcaccggguucccccugagcacccgcgugcccggcgccgaggagugcgagcgggccgucaucgacuucguggcguuccaggacaucuccaucaagcgccugcagcggcuccugcaggcccuggaggcccccgagggguggggcccgacgccccgcgccggccgggccgcgcuccagcugaagcugcgccgccggcucaccgagcugcugggggcccaggacggcgcccuccuggugcgccugcuccaggcccugcgggucgcccgcaugcccgggcuggagcggagcgugcgcgagcgguuccuccccgugcacuga

SEQ ID NO: 37918 - RNA, 1785 nt, Artificial Sequence
  derived and/or modified sequence opt1 from TNFRSF8__Homo_sapiens__XP_011540743
augcgcgugcugcucgccgcccugggccuccucuuccugggggcgcugcgggccuucccccaggaccgcccguucgaggacacgugccacggcaaccccagccacuacuacgacaaggccguccggcgcugcugcuaccggugccccauggggcuguuccccacccagcagugcccgcagcgccccaccgacugccggaagcagugcgagcccgacuacuaccuggacgaggccgaccgcugcaccgccugcgugaccugcucccgggacgaccugguggagaagacccccugcgcguggaacagcucccgcgucugcgagugccggccgggcauguucugcagcaccuccgccgugaacagcugcgcccgcugcuucuuccacuccgugugccccgccgggaugaucgucaaguuccccggcaccgcgcagaagaacaccgugugcgagcccgccagcccgggcgugucccccgccugcgccagccccgagaacugcaaggagcccuccagcgggaccaucccgcaggccaagcccacgcccgucucccccgcgaccagcuccgccagcaccaugccggugcggggcgggacccgccucgcccaggaggccgccuccaagcugacgcgggcgcccgacagccccuccagcgugggccgccccagcuccgacccggggcugagccccacccagcccugccccgagggcuccggcgacugccggaagcagugcgagccggacuacuaccucgacgaggccgggcgcugcaccgccugcgucagcugcucccgggacgaccugguggagaagacccccugcgccuggaacagcucccgcacgugcgagugccggcccggcaugaucugcgccaccagcgcgaccaacuccugcgcccgcugcgugccguaccccaucugcgccgccgagaccgucacgaagccccaggacauggccgagaaggacaccaccuucgaggcgcccccgcuggggacccagcccgacugcaaccccacgcccgagaacggcgaggccccggccagcaccucccccacccagagccuccugguggacucccaggccagcaagacccugcccauccccacguccgcgccgguggcccucagcuccaccggcaagcccguccuggacgccgggcccgugcuguucugggugauccucguccuggugguggucgugggcagcuccgccuuccugcucugccaccgccgggccugccgcaagcggauccgccagaagcugcaccugugcuaccccguccagaccagccagccgaagcucgagcugguggacagccggccccgccgguccagcacccugcgcuccggggcgagcgugacggagcccgucgccgaggagcggggccucaugucccagccccugauggagaccugccacagcgugggggccgccuaccuggagucccucccgcugcaggacgccagccccgcgggcggccccuccagcccccgcgaccugccggagccccggguguccaccgagcacaccaacaacaagaucgagaagaucuacaucaugaaggccgacacggucaucguggggaccgugaaggccgagcuccccgagggccgcgggcuggccggcccggccgagcccgagcuggaggaggagcucgaggcggaccacacgccccacuaccccgagcaggagaccgagccgccccuggggagcugcuccgacgucaugcugagcguggaggaggagggcaaggaggacccccuccccaccgccgccuccggcaaguga

SEQ ID NO: 37919 - RNA, 306 nt, Artificial Sequence
  derived and/or modified sequence opt1 from TNFSF10__Homo_sapiens__NP_001177871
auggccaugauggaggugcagggcgggcccagccugggccagaccugcguccucaucgugaucuucaccgugcugcugcagucccucugcgucgccgugaccuacguguacuucaccaacgagcugaagcagaugcaggacaaguacagcaaguccgggaucgcgugcuuccugaaggaggacgacagcuacugggacccgaacgacgaggaguccaugaacagccccugcuggcaggucaaguggcagcuccgccagcuggugcggaagacgccccgcaugaagcggcugugggccgccaaguga

SEQ ID NO: 37920 - RNA, 954 nt, Artificial Sequence
  derived and/or modified sequence opt1 from TNFSF11__Homo_sapiens__NP_003692
augcgccgggccagccgcgacuacaccaaguaccugcggggcuccgaggagaugggcggcgggcccggcgccccgcacgaggggccccuccacgcgcccccgccgcccgcgccccaccagcccccggccgccagccgcuccauguucguggcccugcugggccucggccuggggcaggucgugugcagcguggcccuguucuucuacuuccgggcccagauggaccccaaccgcaucuccgaggacggcacccacugcaucuaccggauccuccgccugcacgagaacgccgacuuccaggacacgacccuggagagccaggacaccaagcucauccccgacuccugccggcgcaucaagcaggccuuccagggggcgguccagaaggagcugcagcacaucguggggagccagcacauccgggccgagaaggccaugguggacggguccuggcuggaccucgccaagcgcagcaagcuggaggcccagcccuucgcgcaccugaccaucaacgccacggacauccccuccggcagccacaaggucucccucagcuccugguaccacgaccggggcugggccaagaucagcaacaugaccuucuccaacgggaagcugaucgugaaccaggacggcuucuacuaccuguacgccaacaucugcuuccgccaccacgagaccagcggggaccucgccaccgaguaccugcagcugaugguguacgucacgaagaccuccaucaagauccccagcagccacacccucaugaagggcggcuccaccaaguacuggagcgggaacuccgaguuccacuucuacagcaucaacgugggcggguucuucaagcugcgguccggcgaggagaucagcaucgagguguccaaccccagccugcucgaccccgaccaggacgcgacguacuucggggccuucaagguccgcgacaucgacuga

SEQ ID NO: 37921 - RNA, 750 nt, Artificial Sequence
  derived and/or modified sequence opt1 from TNFSF12__Homo_sapiens__NP_003800
auggccgcccgccggagccagcgccggcgcgggcggcgcggggagcccggcaccgcgcugcucgugccgcuggcccuggggcucggccuggcccuggccugccucgggcugcugcucgccgucgugucccugggcagccgggcgucccugagcgcccaggagcccgcccaggaggagcucguggccgaggaggaccaggaccccuccgagcugaacccccagaccgaggagagccaggacccggcgcccuuccugaaccgccucguccggccccgccgguccgcccccaagggccgcaagacgcgggcccgccgggccaucgccgcgcacuacgaggugcacccgcgccccgggcaggacggcgcccaggccgggguggacggcaccgucagcgggugggaggaggcccggaucaacuccagcagcccccugcgcuacaaccggcagaucggcgaguucaucgugacccgcgccggccuguacuaccucuacugccaggugcacuucgacgaggggaaggcggucuaccugaagcuggaccuccugguggacggcgugcuggcccuccggugccuggaggaguucuccgccaccgccgccuccagccuggggccccagcuccgccugugccaggucuccggccugcucgcgcugcgcccgggcagcucccugcggauccgcacgcuccccugggcccaccugaaggccgcccccuuccugaccuacuucggccucuuccaggugcacuga

SEQ ID NO: 37922 - RNA, 993 nt, Artificial Sequence
  derived and/or modified sequence opt1 from TNFSF12-TNFSF13__Homo_sapiens__NP_742086
auggccgcccgccggagccagcgccggcgcggccggcgcggggagcccggcaccgcgcugcucgugccgcuggcccuggggcucggccuggcccuggccugccucgggcugcugcucgccgucgugucccugggcagccgggcgucccugagcgcccaggagcccgcccaggaggagcucguggccgaggaggaccaggaccccuccgagcugaacccccagaccgaggagagccaggacccggcgcccuuccugaaccgccucguccggccccgccgguccgcccccaagggccgcaagacgcgggcccgccgggccaucgccgcgcacuacgaggugcacccgcgccccgggcaggacggcgcccaggccgggguggacggcaccgucagcgggugggaggaggcccggaucaacuccagcagcccccugcgcuacaaccggcagaucggcgaguucaucgugacccgcgccggccuguacuaccucuacugccaguccuccgacgcgcuggaggccugggagaacggggagcggagccgcaagcgccgggccgugcugacccagaagcagaagaagcagcacuccguccuccaccuggugcccaucaacgccacgagcaaggacgacuccgacgugaccgaggucauguggcagccggcccugcgccggggccgcgggcuccaggcgcagggcuacggcgugcggauccaggacgccgggguguaccugcuguacagccagguccucuuccaggacgugaccuucaccaugggccagguggucucccgcgaggggcagggccggcaggagacgcuguuccgcugcauccggagcaugcccagccaccccgaccgcgccuacaacuccugcuacagcgccgggguguuccaccuccaccagggcgacauccuguccgugaucaucccccgggcccgcgcgaagcugaaccugagcccgcacggcaccuuccucggguucgucaagcuguga

SEQ ID NO: 37923 - RNA, 801 nt, Artificial Sequence
  derived and/or modified sequence opt1 from TNFSF13B__Homo_sapiens__NP_001139117
auggacgacagcaccgagcgcgagcagucccggcugaccagcugccucaagaagcgcgaggagaugaagcugaaggagugcguguccauccugccccggaaggagagcccguccguccgcagcuccaaggacggcaagcuccuggccgccacgcugcuccuggcgcugcucagcugcugccugaccgugguguccuucuaccaggucgccgcccugcagggggaccucgccagccugcgggccgagcugcagggccaccacgcggagaagcuccccgccggggccggcgcccccaaggcggggcuggaggaggcccccgccgugaccgccggccugaagaucuucgagccgcccgcccccggcgaggggaacuccagccagaacucccgcaacaagcgggcggugcagggccccgaggagaccgggagcuacacguucgucccguggcuccuguccuucaagcgcggcagcgcccuggaggagaaggagaacaagauccucgugaaggagaccggguacuucuucaucuacggccaggugcuguacaccgacaagaccuacgccaugggccaccugauccagcggaagaagguccacguguucggggacgagcucucccuggugacgcuguuccgcugcauccagaacaugcccgagacccuccccaacaacagcugcuacuccgccggcaucgccaagcuggaggagggggacgagcugcagcucgcgaucccccgggagaacgcccagaucagccuggacggcgacgucaccuucuucggcgcccugaagcuccuguga

SEQ ID NO: 37924 - RNA, 669 nt, Artificial Sequence
  derived and/or modified sequence opt1 from TNFSF13__Homo_sapiens__NP_001185552
augcccgccagcuccccguuccugcucgcccccaagggcccgcccgggaacaugggcgggcccgugcgcgagcccgcgcugagcgucgcccuguggcucuccuggggcgccgcccugggggccguggcgugcgccauggcccugcucacccagcagaccgagcugcagagccugcggcgcgaggugucccggcuccagggcacgggcgggcccagccagaacggcgagggguaccccuggcagucccugccggagcagcacagcguccugcaccucgugcccaucaacgccaccuccaaggacgacagcgacgugaccgaggucauguggcagcccgcgcugcgccggggccgcgggcugcaggcccagggcuacggcgugcggauccaggacgccgggguguaccuccuguacucccagguccuguuccaggacgugaccuucacgaugggccagguggucagccgcgaggggcagggccggcaggagacccucuuccgcugcauccgguccaugcccagccacccggaccgcgccuacaacuccugcuacagcgccggcguguuccaccuccaccagggggacauccuguccgugaucaucccccgggcgcgcgccaagcugaaccugagcccccacggcaccuuccugggguucgucaagcucuga

SEQ ID NO: 37925 - RNA, 723 nt, Artificial Sequence
  derived and/or modified sequence opt1 from TNFSF14__Homo_sapiens__NP_003798
auggaggagagcgugguccgccccuccguguucguggucgacggccagaccgacaucccguucacccggcuggggcgcagccaccggcgccaguccugcagcguggcccgggugggccucgggcugcugcuccugcugaugggcgccgggcucgcgguccagggcugguuccugcugcagcuccacuggcgccugggcgagauggugacgcggcugcccgacgggcccgccggcuccugggagcagcucauccaggagcgccggagccacgaggugaaccccgccgcccaccugaccggggccaacuccagccugaccggcuccgggggcccgcuccugugggagacccagcugggccucgcguuccugcgcgggcugagcuaccacgacggcgcccucgucgugacgaaggccggguacuacuacaucuacuccaaggugcagcugggcggcgucgggugcccccugggccucgccagcaccaucacccacgggcuguacaagcggacgccccgcuaccccgaggagcuggagcuccuggugucccagcagagcccgugcggccgggcgaccuccagcucccgcguguggugggacagcuccuuccucgggggcgucgugcaccuggaggccggcgagaagguggucgugcgggugcuggacgagcgccugguccggcuccgcgacgggacccggagcuacuucggcgccuucaugguguga

SEQ ID NO: 37926 - RNA, 579 nt, Artificial Sequence
  derived and/or modified sequence opt1 from TNFSF15__Homo_sapiens__NP_001191273
augcagcugaccaagggccgccuccacuucagccacccccugucccacaccaagcacaucagcccguucgugacggacgcgccccugcgggccgacggggacaagccccgcgcccaccucaccgucgugcggcagacccccacccagcacuucaagaaccaguucccggcccugcacugggagcacgagcugggccucgccuucacgaagaaccgcaugaacuacaccaacaaguuccugcugauccccgaguccggggacuacuucaucuacagccaggugaccuuccggggcaugaccuccgagugcagcgagauccgccaggccgggcggcccaacaagcccgacuccaucacggucgugaucaccaaggugaccgacagcuacccggagcccacccagcuccugaugggcacgaaguccgucugcgaggugggcagcaacugguuccagcccaucuaccugggggccauguucucccuccaggagggcgacaagcugauggugaacgucagcgacaucucccugguggacuacaccaaggaggacaagaccuucuucggggcguuccuccuguga

SEQ ID NO: 37927 - RNA, 600 nt, Artificial Sequence
  derived and/or modified sequence opt1 from TNFSF18__Homo_sapiens__NP_005083
augacccugcaccccagcccgaucacgugcgaguuccucuucuccaccgcccugaucagccccaagaugugccugucccaccucgagaacaugccccugagccacucccgcacccagggcgcccagcggagcuccuggaagcuguggcuguucugcagcaucgugaugcuccuguuccucugcuccuucagcuggcugaucuucaucuuccugcagcucgagaccgcgaaggagcccugcauggccaaguucgggccgcugcccuccaaguggcagauggccagcuccgagccgcccugcgucaacaaggugagcgacuggaagcuggagauccuccagaacggccuguaccugaucuacgggcaggucgcccccaacgccaacuacaacgacguggcgcccuucgaggugcgccucuacaagaacaaggacaugauccagacccugacgaacaaguccaagauccagaacgugggcgggaccuacgagcugcacgucggcgacaccaucgaccucaucuucaacagcgagcaccaggugcugaagaacaacaccuacuggggcaucauccugcucgccaacccccaguucaucuccuga

SEQ ID NO: 37928 - RNA, 402 nt, Artificial Sequence
  derived and/or modified sequence opt1 from TNFSF4__Homo_sapiens__NP_001284491
auggugagccaccgcuacccccggauccaguccaucaagguccaguucaccgaguacaagaaggagaagggcuucauccugaccagccagaaggaggacgagaucaugaaggugcagaacaacuccgugaucaucaacugcgacggguucuaccucaucagccugaagggcuacuucucccaggaggucaacaucagccugcacuaccagaaggacgaggagccccucuuccagcugaagaaggugcgcuccgugaacagccugauggucgccucccucacguacaaggacaagguguaccugaacgugaccaccgacaacaccagccuggacgacuuccacgucaacgggggcgagcucauccugauccaccagaacccgggggaguucugcgugcuguga

SEQ ID NO: 37929 - RNA, 705 nt, Artificial Sequence
  derived and/or modified sequence opt1 from TNFSF8__Homo_sapiens__NP_001235
auggaccccggccugcagcaggcccucaacgggauggccccgcccggcgacaccgcgaugcacgugcccgccgggagcgucgccucccaccugggcaccacgagccgcuccuacuucuaccugaccaccgccacccucgcccugugccugguguucacgguggcgaccaucaugguccucguggugcagcggaccgacagcauccccaacuccccggacaacgucccccugaagggcgggaacugcagcgaggaccugcucugcauccugaagcgcgcccccuucaagaaguccugggccuaccuccagguggccaagcaccugaacaagaccaagcugagcuggaacaaggacggcauccugcacggggugcgguaccaggacggcaaccucgucauccaguuccccgggcuguacuucaucaucugccagcugcaguuccucgugcagugcccgaacaacuccguggaccugaagcuggagcuccugaucaacaagcacaucaagaagcaggcgcuggucacggugugcgagagcggcaugcagaccaagcacguguaccagaaccucucccaguuccugcuggacuaccuccaggucaacaccaccaucagcgugaacguggacacguuccaguacaucgacaccuccaccuucccccuggagaacguccugagcaucuuccucuacuccaacagcgacuga

SEQ ID NO: 37930 - RNA, 765 nt, Artificial Sequence
  derived and/or modified sequence opt1 from TNFSF9__Homo_sapiens__NP_003802
auggaguacgccagcgacgccucccuggaccccgaggcgccguggccgcccgcgccccgcgcccgggccugccgcgugcuccccugggcccuggucgccggccugcuccugcugcuccugcuggccgccgccugcgcgguguuccucgccugccccugggccgugagcggggcccgggccucccccggcagcgcggccagcccccgccugcgggaggggccggagcugucccccgacgaccccgccggccuccuggaccugcgccaggggauguucgcccagcucgucgcccagaacgugcugcugaucgacggcccccucuccugguacagcgacccgggccuggcgggggugucccugaccggcgggcucagcuacaaggaggacaccaaggagcuggucguggccaaggccggcguguacuacgucuucuuccagcuggagcuccggcgcgugguggccggggagggcuccggcagcgucucccuggcccugcaccuccagccccugcggagcgcggccggggccgccgcccuggcgcucacgguggaccugccgcccgccuccagcgaggcccgcaacuccgccuucggcuuccaggggcggcugcuccaccugagcgcgggccagcgccugggcgugcaccuccacaccgaggcccgggcccgccacgccuggcagcugacccagggggccaccguccugggccucuuccgggugacgcccgagauccccgcggggcugcccagcccccgcuccgaguga

SEQ ID NO: 37931 - RNA, 4059 nt, Artificial Sequence
  derived and/or modified sequence opt1 from TNIK__Homo_sapiens__NP_001155032
auggccagcgacucccccgcccgcagccuggacgagaucgaccucuccgcgcugcgggacccggccggcaucuucgagcugguggagcucgucgggaacggcaccuacggccagguguacaaggggcgccacgugaagaccgggcagcuggccgccaucaaggucauggacgugacgggcgacgaggaggaggagaucaagcaggagaucaacaugcugaagaaguacagccaccaccggaacaucgccaccuacuacggcgcguucaucaagaagaacccgcccgggauggacgaccagcucuggcuggugauggaguucugcggcgccggguccgucaccgaccugaucaagaacaccaagggcaacacgcucaaggaggaguggaucgccuacaucugccgcgagauccugcgggggcugagccaccuccaccagcacaaggugauccaccgcgacaucaagggccagaacgugcugcugaccgagaacgccgaggucaagcucguggacuucggcguguccgcgcagcuggaccggaccgucgggcgccggaacaccuucaucggcacgcccuacuggauggcccccgaggugaucgccugcgacgagaaccccgacgccaccuacgacuucaagagcgaccuguggucccucgggaucaccgccaucgagauggcggagggcgccccgccccugugcgacaugcaccccaugcgcgcccuguuccucaucccccggaaccccgcgccccgccucaagagcaagaagugguccaagaaguuccagagcuucaucgaguccugccuggugaagaaccacagccagcggccggccaccgagcagcugaugaagcaccccuucauccgcgaccagcccaacgagcggcagguccgcauccagcugaaggaccacaucgaccggacgaagaagaagcgcggcgagaaggacgagaccgaguacgaguacuccgggagcgaggaggaggaggaggagaacgacuccggcgagcccagcuccauccugaaccucccgggggagagcacccugcggcgcgacuuccugcggcuccagcuggccaacaaggagcgcagcgaggcccugcgccggcagcagcucgagcagcagcagcgcgagaacgaggagcacaagcggcagcugcuggccgagcgccagaagcggaucgaggagcagaaggagcagcgccggcgccucgaggagcagcagcggcgcgagaaggagcugcggaagcagcaggagcgcgagcagcggcgccacuacgaggagcagaugcggcgcgaggaggagcggcgccgggccgagcacgagcaggaguacauccgccgccagcuggaggaggagcagcggcagcucgagauccugcagcagcagcugcuccacgagcaggcccugcugcucgaguacaagcgcaagcagcuggaggagcagcggcaggcggagcgccugcagcggcagcucaagcaggagcgcgacuaccuggugucccugcagcaccagcggcaggagcagcgccccguggagaagaagccccuguaccacuacaaggagggcaugagccccuccgagaagccggccugggccaaggaggucgaggagcggagccgccucaaccggcaguccagccccgccaugccccacaagguggccaaccgcaucuccgaccccaaccugccgccccggagcgaguccuucagcaucuccggggugcagcccgcgcgcacgcccccgaugcugcggcccgucgacccccagaucccgcaccucguggccgucaagagccagggccccgcccugaccgccucccagagcgugcacgagcagcccaccaagggccuguccggguuccaggaggcgcucaacgugaccagccaccgcgucgagaugccccggcagaacuccgacccgaccagcgagaacccgccccugcccacgcgcaucgagaaguucgaccgguccagcuggcugcgccaggaggaggacaucccgcccaaggugccccagcggaccaccagcaucucccccgcccucgcccgcaagaacagccccggcaacggguccgcccugggcccccgccuggggagccagcccauccgggccuccaaccccgaccuccgccggaccgagccgauccuggagagcccccugcagcgcacguccagcggcuccagcuccagcuccagcacccccuccagccagcccuccagccagggcgggagccagccgggcucccaggcggggagcuccgagcggacccgcgugcgggccaacagcaaguccgagggcagccccguccucccccacgagcccgccaaggugaagccggaggagucccgcgacaucacccggcccagccgccccgccgaccugacggcccuggcgaaggagcuccgggagcugcgcaucgaggagaccaaccggccgaugaagaaggugaccgacuacuccagcuccagcgaggaguccgagagcuccgaggaggaggaggaggacggggagagcgagacccacgacggcacggucgccguguccgacaucccccgccugauccccaccggcgcccccgggagcaacgagcaguacaacgugggcauggucgggacccacggccucgagaccucccacgccgacagcuucagcggcuccaucagccgggaggggacgcugaugauccgcgagaccuccggcgagaagaagcggagcgggcacuccgacagcaacggcuucgccgggcacaucaaccugccggaccucgugcagcagucccacagccccgcgggcacccccaccgagggccuggggcgcguguccacccacagccaggagauggacuccggcacggaguacgggaugggcagcuccaccaaggccagcuucacccccuucgucgacccgcggguguaccagaccucccccacggacgaggacgaggaggacgaggagagcuccgccgccgcgcuguucaccagcgagcuccugcgccaggagcaggccaagcugaacgaggcccgcaagaucuccguggucaacgugaaccccaccaacauccggccccacagcgacaccccggagauccgcaaguacaagaagcgguucaacagcgagauccucugcgccgcccuguggggcgugaaccugcucgucgggacggagaacggccugaugcugcucgaccgcuccgggcagggcaagguguacaaccugaucaaccggcgccgguuccagcagauggacgugcuggaggggcucaacguccuggugaccaucagcggcaagaagaacaagcugcgcguguacuaccucuccuggcugcggaaccgcauccugcacaacgaccccgaggucgagaagaagcagggguggaucaccgugggcgaccucgagggcugcauccacuacaagguggucaaguacgagcggaucaaguuccuggugaucgcgcugaagaacgccguggagaucuacgccugggcccccaagcccuaccacaaguucauggccuucaagagcuucgcggaccuccagcacaagccgcugcuggucgaccucaccguggaggaggggcagcgccugaaggugaucuucggcucccacacgggguuccacgucaucgacguggacagcggcaacuccuacgacaucuacauccccagccacauccaggggaacaucacgccccacgccaucgugauccugcccaagaccgacggcauggagaugcucgucugcuacgaggacgagggcguguacgugaacaccuacgggcggaucaccaaggacgucgugcugcaguggggcgagaugccgaccuccguggccuacauccacagcaaccagaucaugggguggggcgagaaggccaucgagauccgcuccgucgagaccggccaccuggacgggguguucaugcacaagcgggcccagcgccucaaguuccugugcgagcggaacgacaagguguucuucgcgagcguccgcuccggcgggagcucccagguguucuucaugacccugaaccggaacagcaugaugaacugguga

SEQ ID NO: 37932 - RNA, 1752 nt, Artificial Sequence
  derived and/or modified sequence opt1 from TNIP1__Homo_sapiens__NP_001239315
auggaggccacccgccugcggcagaaggccgaggagcucgugaaggacaacgagcugcugcccccgcccagccccucccucggcagcuucgacccccuggcggagcugaccgggaaggacuccaacgucacggccagcccgaccgcccccgccugccccuccgacaagcccgccccggugcagaagccccccagcuccggcaccagcuccgaguucgagguggucacccccgaggagcagaacagcccggaguccagcucccacgcgaacgccauggcccucgggccccugccccgcgaggacggcaaccugaugcuccaccugcagcggcuggagacgacccucagcgugugcgccgaggagcccgaccacgggcagcuguucacccaccugggccgcauggcgcucgaguucaaccggcuggccuccaaggugcacaagaacgagcagcgcaccagcauccugcagacgcucugcgagcagcugcggaaggagaacgaggcccugaaggccaagcucgacaagggccuggagcagcgcgaccaggccgcggagcggcugcgcgaggagaaccucgagcugaagaagcugcucauguccaacgggaacaaggagggcgccagcgggcggccgggcucccccaagauggaggggaccggcaagaaggccgucgccggccagcagcaggccagcgugaccgcggggaaggugcccgaggucguggcccugggcgccgccgagaagaaggugaagaugcuggagcagcagcgcagcgagcuccuggaggucaacaagcagugggaccagcacuuccgguccaugaagcagcaguacgagcagaagaucaccgagcugcgccagaagcucgccgaccugcagaagcaggugacggaccuggaggcggagcgggagcagaagcagcgcgacuucgaccggaagcuccugcuggccaagagcaagaucgagauggaggagaccgacaaggagcagcucaccgccgaggccaaggagcugcgccagaaggugaaguaccugcaggaccagcucuccccccugacccggcagcgcgaguaccaggagaaggagauccagcggcugaacaaggcccucgaggaggcgcugagcauccagacgccgcccuccagcccccccaccgccuucggguccccggagggcgccggcgcccugcuccgcaagcaggagcuggucacccagaacgagcugcugaagcagcaggugaagaucuucgaggaggacuuccagcgcgagcggagcgaccgcgagcggaugaacgaggagaaggaggagcucaagaagcagguggagaagcugcaggcgcaggucacccuguccaacgcccagcucaaggccuucaaggacgaggagaaggcccgcgaggcccugcggcagcagaagcgcaaggcgaaggccagcggggagcgguaccacguggagccccaccccgagcaccugugcggcgccuaccccuacgccuacccgcccaugcccgccauggugccgcaccacggguucgaggacuggucccagauccgcuaccccccccccccgauggcgauggagcacccccccccccucccgaacagccggcuguuccaccugcccgaguacacguggcgccuccccugcggcgggguccggaaccccaaccaguccagccaggugauggacccgcccaccgcccgccccaccgagcccgaguccccgaagaacgaccgggagggcccccaguga

SEQ ID NO: 37933 - RNA, 969 nt, Artificial Sequence
  derived and/or modified sequence opt1 from TNIP2__Homo_sapiens__NP_001154999
augcagcagcugcucagccagccccagcacgagcgcgagaaggaggugguccugcugcggcgcuccauggccgagggcgagcgggcccgcgcggccagcgacgugcucugccggucccuggccaacgagacccaccagcugcgccggacccucacggccaccgcccacaugugccagcaccuggcgaagugccuggacgagcgccagcacgcccagcggaacgugggggagcgcagcccggaccaguccgagcacaccgacggccacaccagcguccaguccgugaucgagaagcuccaggaggagaaccggcugcugaagcagaaggugacgcacgucgaggaccucaacgccaaguggcagcgcuacaacgccagccgggacgaguacgugcgcgggcugcacgcgcagcugcggggccuccagaucccccacgagcccgagcugaugcgcaaggagaucucccggcugaaccgccagcucgaggagaagaucaacgacugcgccgaggugaagcaggagcuggccgccagccggaccgcccgcgacgcggcccuggagcggguccagaugcucgagcagcagauccuggccuacaaggacgacuucauguccgagcgcgccgaccgcgagcgggcccagagccgcauccaggagcuggaggagaagguggcgucccuccugcaccaggugagcuggcggcaggacucccgcgagcccgacgccgggcggauccacgccggcagcaagaccgccaaguaccuggccgcggacgcccucgagcugauggucccgggcggguggcgccccggcaccgggucccagcagcccgagcccccggccgagggcgggcaccccggcgccgcccagcggggccagggggaccugcagugcccccacugccuccagugcuucagcgacgagcagggcgaggagcugcugcgccacguggcggagugcugccaguga

SEQ ID NO: 37934 - RNA, 1110 nt, Artificial Sequence
  derived and/or modified sequence opt1 from TNIP3__Homo_sapiens__NP_001122315
augaacaagaacgagaagcacgacgacaagcuggugauguucaccaaccagagcgaggacuccgagcgcugcgagagcauggagcucgacaagaagauccaggaccugaucgagcggaacgccagcccccacccgaagcgcuucacccccgaggccaugcccacgcaccggaaccugugcucccucaagacccccggcaagaccgcguccauggcccacuucguccaggggaccagccgcaugaucgccgccgaguccagcacggagcacaaggagugcgccgagccguccacccggaagaaccugaugaacagccuggagcagaagauccgcugccucgagaagcagcggaaggagcugcuggaggugaaccagcagugggaccagcaguuccgcuccaugaaggagcucuacgagcggaagguggcggagcugaagaccaagcuggacgccgccgagcgcuuccucagcacccgggagaaggacccccaccagcgccagcggaaggacgaccgccagcgggaggacgaccgccagcgggaccugacgcgcgaccggcugcagcgcgaggagaaggagaaggagcggcucaacgaggagcugcacgagcugaaggaggagaacaagcuccugaagggcaagaacacccuggccaacaaggagaaggagcacuacgagugcgagaucaagcgccucaacaaggcgcugcaggacgcccugaacaucaagugcuccuucagcgaggacugccuccgcaagucccgggucgaguucugccacgaggagaugcgcaccgagauggaggugcugaagcagcagguccagaucuacgaggaggacuucaagaaggagcggagcgaccgcgagcggcugaaccaggagaaggaggagcuccagcagaucaacgagaccucccagagccagcugaaccgccugaacucccagaucaaggccugccagauggagaaggagaagcucgagaagcagcugaagcagauguacugcccgcccugcaacugcgggcugguguuccaccuccaggaccccugggugcccacgggccccggggccgugcagaagcagcgggagcaccccgucuacccgcaguga

SEQ ID NO: 37935 - RNA, 1986 nt, Artificial Sequence
  derived and/or modified sequence opt1 from TNK1__Homo_sapiens__XP_011522347
augcugcccgaggccggcagccucuggcugcugaagcuccugcgcgacauccagcuggcccaguucuacuggccgauccucgaggagcugaacgugacccggcccgagcacuucgacuucgucaagcccgaggaccuggacgggaucggcauggggcgccccgcgcagcggcgccucuccgaggcccugaagcggcugcgcagcggcccgaaguccaagaacuggguguacaagauccucgggggcuucgcccccgagcacaaggagcccacccugcccagcgacuccccgcggcaccuccccgagcccgagggcgggcucaagugccugauccccgagggcgccgugugccgcggggagcugcucggcagcgggugcuucggcgucgugcaccggggccuguggacgcugccguccggcaagagcgugcccgucgccgugaagucccuccgcgugggccccgaggggcccaugggcaccgagcugggcgacuuccugcgggaggucagcgugaugaugaaccucgagcacccgcacgugcugcgccugcacgggcucguccugggccagccccugcagauggugauggagcucgcgccccuggggucccugcacgcccggcucaccgcccccgccccgaccccgccccugcugguggcgcuccugugccuguuccugcgccagcuggccggggccauggccuaccugggggcccggggccucguccaccgcgaccuggcgacgcggaaccugcuccuggccagcccccgcaccaucaagguggccgacuucggccuggugcggccccucgggggcgcccgcgggcgguacgucaugggcgggccccgccccauccccuacgccuggugcgcgccggagucccugcgccacggcgccuucagcuccgccagcgacguguggauguucggcgugacccugugggagauguucuccgggggcgaggagcccugggccggggugcccccguaccugauccuccagcggcuggaggaccgcgcccggcugccccgcccgccccucugcagccgggcgcuguacucccuggcccuccgcugcugggcgccccaccccgccgaccggcccagcuucagccaccuggagggccugcuccaggaggccgggcccuccgaggccugcugcguccgcgacgugaccgagccgggcgcccugcggauggagacgggcgaccccaucaccgucaucgaggggagccccgacuccaccaucuggaagggccagaacgggcgcaccuucaaggugggcagcuuccccgccuccgccgucacgcuggcggacgccggcgggcucccggccacccggcccgugcaccgcggcacccccgcccgcggggaccagcaccccggcagcaucgacggggaccggaagaaggccaaccugugggacgcgccgcccgcccggggccagcgccggaacaugccccuggagcgcaugaagggcaucucccggagccucgaguccgugcugagccuggggccccgcccgaccggcgggggcuccagcccgcccgagauccgccaggcccgggccgucccccaggggccgcccggccugccgccccggccgccccucuccagcuccagcccccagcccucccagcccagccgcgagcgccugcccuggcccaagcggaagccgccccacaaccaccccaugggcaugcccggggcccgcaaggcggccgcccucuccggcgggcugcugagcgaccccgagcuccagcggaagaucauggagguggagcugagcgugcacggcgucacgcaccaggagugccagaccgcccugggggccaccggcggcgacgugguguccgcgauccgcaaccucaaggucgaccagcuguuccaccugagcucccggagccgcgccgacugcuggcggauccucgagcacuaccagugggaccuguccgccgccagccgcuacgugcuggcgcggcccuga

SEQ ID NO: 37936 - RNA, 3261 nt, Artificial Sequence
  derived and/or modified sequence opt1 from TNK2__Homo_sapiens__NP_001010938
augcuggaggcccggcccccgcggacccagggcagcgacgccgcgggggccgccgccggccgcgggcuccgggcccugcugcucucccugaccgcggccgccggcaucuggggguccaugggcgagcgcuccgccuaccagcggcuggccggcggggaggagggcccccagcgccucgggggcgggcggaugcagcccgaggagggcaccggcuggcugcuggagcuccugagcgaggugcagcugcagcaguacuuccuccgccugcgggacgaccugaacgucacccgccucucccacuucgaguacgugaagaacgaggaccuggagaagaucgggaugggccggcccgggcagcgccggcugugggaggccgugaagcgccggaaggcccucugcaagcgcaagagcuggauguccaaggucuucagcggcaagcggcuggaggccgaguucccgccccaccacucccagagcaccuuccgcaagaccucccccgcccccggcgggcccgcgggcgaggggccccugcagagccugaccugccucaucggcgagaaggaccugcggcuccuggagaagcugggggacggcuccuucggcguggugcgccgcggggagugggacgcccccagcggcaagaccgucuccguggccgugaagugccucaagcccgacguccugagccagcccgaggccauggacgacuucauccgcgaggugaacgccaugcacucccuggaccaccgcaaccucauccggcuguacggggugguccugacgccgcccaugaagauggugaccgagcucgcgccccugggcagccugcucgaccgccugcggaagcaccaggggcacuuccugcucggcacccugucccgcuacgccgugcaggucgccgagggcaugggguaccuggagagcaagcgguucauccaccgcgaccucgccgcccggaaccugcugcucgcgacccgcgaccuggugaagaucggcgacuucgggcugaugcgggcccucccccagaacgacgaccacuacgugaugcaggagcaccgcaagguccccuucgccuggugcgcccccgagagccugaagacccggaccuucucccacgccagcgacacguggauguucggcgugacccugugggagauguucaccuacgggcaggagcccuggaucggccugaacggcucccagauccuccacaagaucgacaaggagggggagcgccugccccggcccgaggacugcccccaggacaucuacaacgugaugguccagugcugggcgcacaagcccgaggaccgccccaccuucguggcccugcgggacuuccuccuggaggcccagcccacggacaugcgcgcccugcaggacuucgaggagcccgacaagcuccacauccagaugaacgacgugaucaccgucaucgagggccgggcggagaacuacugguggcgcgggcagaacacccggacccugugcgugggccccuucccccgcaacgucgugacgagcguggccggccuguccgcccaggacaucagccagccccuccagaacuccuucauccacaccgggcacggcgacagcgacccccgccacugcuggggguuccccgaccggaucgacgagcuguaccugggcaaccccauggacccgcccgaccuccuguccgucgagcugagcaccucccgcccgccccagcaccucgggggcgugaagcgggagcccccgccccggccgccccagcccgccuucuucacccagaagcccacguacgaccccgugagcgaggaccaggacccccuguccagcgacuucaagcggcugggccuccgcaagcccgggcugccccggggccuguggcucgccaagcccuccgcgcgcguccccgggaccaaggccagccggggcuccggggccgaggugacccugaucgacuucggcgaggagcccguggucccggcccugcgccccugcgcccccagccucgcgcagcuggccauggacgccugcucccugcucgacgagacgccgccccagagccccacgcgggcccugccccgcccccugcaccccacccccgugguggacugggacgcccggccccucccgccgccgcccgcguacgacgacgucgcccaggacgaggacgacuucgagaucugcagcaucaacuccacccuggugggcgccggggugccggccggccccagccaggggcagaccaacuacgcguucguccccgagcaggcccggcccccgccgccccuggaggacaaccucuuccugccgccccagggcgggggcaagccgcccuccagcgcccagacggccgagaucuuccaggcccugcagcaggagugcaugcgccagcuccaggcgcccgccggcucccccgcccccagccccucccccgggggcgacgacaagccccaggugccgccccgcgugcccaucccgccccggcccacccgcccccacguccagcugagccccgcgccgcccggggaggaggagaccucccaguggccgggccccgccuccccgccccgcgugccgccccgcgagccccugagcccccaggggagccggaccccgagcccccuggugccgcccggcagcuccccgcugccgccccgccugagcuccagccccggcaagacgaugccgaccacccagagcuucgcguccgaccccaaguacgccacgccccaggucauccaggcccccgggccgcgcgccggccccugcauccuccccaucgugcgggacgggaagaaggugagcuccacccacuacuaccugcugcccgagcgcccgagcuaccucgagcgguaccagcgcuuccugcgggaggcccagucccccgaggagcccacgccgcugcccgucccccuccugcugcccccgcccagcacccccgcgcccgccgccccgaccgccaccgugcgccccaugccccaggcggcccucgaccccaaggccaacuucuccacgaacaacagcaacccgggcgcccggccgccgccgccccgcgccaccgcgcggcugccccagcgcggcugccccggggacggccccgaggccgggcggcccgccgacaagauccagaugguggagcagcuguucggccucgggcugcgcccccggggcgagugccacaagguccuggagauguucgacuggaaccucgagcaggccggcugccaccuccugggguccuggggccccgcccaccacaagcgcuga

SEQ ID NO: 37937 - RNA, 3501 nt, Artificial Sequence
  derived and/or modified sequence opt1 from TNKS2__Homo_sapiens__NP_079511
augagcggccgccggugcgccgggggcggggccgcgugcgccuccgccgccgccgaggcgguggagcccgccgcccgcgagcuguucgaggccugccggaacggcgacgucgagcgcgugaagcggcucgugaccccggagaaggucaacagccgcgacaccgcggggcggaaguccacgccccugcacuucgccgccggcuucggccgcaaggacgugguggaguaccugcuccagaacggggccaacguccaggcccgggacgacggcgggcugaucccccugcacaacgcgugcagcuucggccacgccgagguggugaaccuccugcugcgccacggggccgaccccaacgcccgggacaacuggaacuacaccccgcuccacgaggccgcgaucaagggcaagaucgacgucugcaucgugcugcugcagcacggcgccgagcccaccauccgcaacaccgacgggcggacggcccucgaccuggccgaccccuccgccaaggcggugcugaccggcgaguacaagaaggacgagcuccuggagagcgcccgcuccgggaacgaggagaagaugauggcccugcucacgccccugaacgucaacugccacgccagcgacggccggaaguccaccccgcugcaccucgccgcgggcuacaaccgcgugaagaucgugcagcugcugcuccagcacggggccgacguccacgccaaggacaagggcgaccuggugccccugcacaacgccugcagcuacgggcacuacgaggugaccgagcuccuggucaagcacggcgcgugcgugaacgccauggaccuguggcaguucaccccgcuccacgaggccgccuccaagaaccggguggaggucugcagccugcugcucuccuacggggccgaccccacccugcugaacugccacaacaagagcgcgaucgaccucgcccccacgccccagcugaaggagcgccuggccuacgaguucaagggccacucccuccugcaggccgcccgggaggcggacgugacccgcaucaagaagcaccugagccucgagauggugaacuucaagcacccccagacccacgagaccgcccugcacugcgccgccgccucccccuacccgaagcggaagcagaucugcgagcugcuccugcgcaagggcgcgaacaucaacgagaagaccaaggaguuccugacgccccuccacgucgccagcgagaaggcccacaacgacguggucgaggugguggucaagcacgaggccaaggugaacgcgcuggacaaccuggggcagaccucccugcaccgcgccgccuacugcggccaccuccagaccugccggcugcugcucagcuacgggugcgaccccaacaucaucagccugcagggcuucaccgcccugcagauggggaacgagaacgugcagcagcuccugcaggagggcaucucccugggcaacagcgaggccgaccgccagcuccuggaggcggccaaggccggggacgucgagacggugaagaagcugugcaccgugcaguccgucaacugccgggacaucgagggccgccagagcaccccgcuccacuucgccgccggguacaaccggguguccguggucgaguaccugcugcagcacggcgcggacgugcacgccaaggacaagggcgggcucgugccccugcacaacgccugcagcuacggccacuacgaggucgccgagcugcucgugaagcacggggccguggucaacguggcggaccuguggaaguucacgccccugcacgaggccgccgccaagggcaaguacgagaucugcaagcuccugcugcagcacggggcggaccccaccaagaagaaccgcgacggcaacaccccgcucgaccuggugaaggacggcgacaccgacauccaggaccugcuccgcggggacgccgcccugcuggacgccgccaagaagggcugccucgcgcgggucaagaagcuguccagccccgacaacgugaacugccgggacacccaggggcgccacuccacgccccugcaccucgccgccggcuacaacaaccuggagguggccgaguaccugcuccagcacggggccgacgucaacgcgcaggacaagggcggccugaucccccugcacaacgccgccagcuacgggcacguggacguggccgcccuccugaucaaguacaacgcgugcgucaacgccaccgacaagugggccuucacgccccugcacgaggccgcccagaagggccggacccagcucugcgcgcugcugcucgcccacggggccgacccgacccugaagaaccaggagggccagacgccccuggaccucguguccgccgacgacgugagcgcgcugcugaccgccgccaugcccccguccgcccuccccagcugcuacaagccccagguccugaacggggugcgcucccccggcgccaccgcggacgcccugagcuccggcccgagcucccccagcagccucuccgccgccagcucccuggacaaccugagcggguccuucagcgagcucuccagcguggucuccagcuccggcaccgagggggccagcucccuggagaagaaggaggugcccggcguggacuucagcaucacccaguucguccggaaccuggggcucgagcaccugauggacaucuucgagcgcgagcagaucacccuggacgugcucguggagaugggccacaaggagcugaaggagaucggcaucaacgcguacgggcaccggcacaagcugaucaagggcgucgagcgccucaucuccgggcagcagggccugaaccccuaccugacccucaacaccagcggguccggcacgauccugaucgaccugagcccggacgacaaggaguuccagagcguggaggaggagaugcaguccaccgugcgggagcaccgcgacggcgggcacgccggcgggaucuucaaccgguacaacauccucaagauccagaaggucugcaacaagaagcugugggagcgcuacacccaccgccggaaggaggugagcgaggagaaccacaaccacgccaacgagcgcaugcuguuccacggcucccccuucgugaacgccaucauccacaagggcuucgacgagcggcacgccuacaucgggggcauguucggggcgggcaucuacuucgccgagaacagcuccaagagcaaccaguacgucuacgggaucggcggcgggaccggcugccccgugcacaaggaccgcuccugcuacaucugccaccggcagcuccuguucugccgcgugacgcugggcaagagcuuccuccaguucuccgccaugaagauggcccacagcccgcccgggcaccacuccgucaccgggcggcccagcgugaacggccuggcgcuggccgaguacgugaucuaccgcggcgagcaggccuaccccgaguaccucaucaccuaccagaucaugcggcccgaggggauggucgacggcuga

SEQ ID NO: 37938 - RNA, 3984 nt, Artificial Sequence
  derived and/or modified sequence opt1 from TNKS__Homo_sapiens__NP_003738
auggccgccagccgccggucccagcaccaccaccaccaccaccagcagcagcugcagcccgcgccgggcgccagcgcccccccccccccgcccccccccccgcucucccccgggcuggcccccggcaccacccccgccagcccgacggcguccgggcuggcccccuucgccagcccccgccacggccucgcccugcccgagggggacggcucccgggacccgcccgaccgcccccggagccccgacccgguggacggcaccuccugcugcagcaccaccuccacgaucugcaccgucgcggccgcccccguggugcccgccgucagcaccuccagcgccgcggggguggcccccaacccggccggcuccgggagcaacaacucccccagcuccagcagcucccccaccagcuccagcuccagcucccccagcuccccgggcagcucccuggccgagagccccgaggccgcggggguguccagcacggccccccucggcccgggcgccgccgggcccggcaccgggguccccgccguguccggcgcgcugcgcgagcugcucgaggccugccggaacggcgacgugagccgcgucaagcggcugguggacgccgccaacgugaacgccaaggacauggcggggcgcaaguccagcccccugcacuucgccgccggcuucgggcggaaggacgucguggagcaccuccugcagaugggcgccaacgugcacgcgcgcgacgacgggggccugaucccgcuccacaacgccugcuccuucggccacgccgaggucgugagccugcugcucugccagggggccgaccccaacgcccgggacaacuggaacuacaccccccugcacgaggcggccaucaagggcaagaucgacgugugcaucguccugcuccagcacggggccgaccccaacauccgcaacaccgacggcaagagcgcccuggaccuggccgacccguccgcgaaggccgugcucacgggggaguacaagaaggacgagcugcuggaggccgcccggagcggcaacgaggagaagcucauggcccugcugaccccccucaacgugaacugccacgcguccgacggccgcaagagcaccccccugcaccuggccgccggguacaaccggguccgcaucgugcagcuccugcugcagcacggcgccgacgugcacgcgaaggacaaggggggccucgucccccugcacaacgccugcuccuacgggcacuacgaggugaccgagcugcuccugaagcacggcgccugcgucaacgccauggaccuguggcaguucacgccgcuccacgaggccgcgagcaagaaccggguggaggugugcucccugcugcucagccacggcgccgaccccacccuggucaacugccacgggaaguccgccguggacauggcccccacccccgagcugcgcgagcggcucaccuacgaguucaagggccacagccugcugcaggccgcgcgcgaggccgaccuggccaaggugaagaagacgcucgcccuggagaucaucaacuucaagcagccgcagucccacgagaccgcccugcacugcgcggucgccagccuccaccccaagcgcaagcaggugaccgagcugcugcuccggaagggggccaacgugaacgagaagaacaaggacuucaugaccccccugcacgucgccgcggagcgcgcccacaacgacgugauggaggugcugcacaagcacggcgccaagaugaacgcccucgacacgcugggccagaccgcccugcaccgggcggcccucgccgggcaccugcagaccugccgccugcuccuguccuacggcagcgaccccuccaucaucagccugcagggguucaccgccgcccagaugggcaacgaggcgguccagcagauccucuccgagagcacgccgauccggaccagcgacguggacuaccgccugcuggaggccuccaaggccggggaccucgagaccgugaagcagcugugcagcucccagaacgucaacugccgggaccuggagggccgccacagcaccccccuccacuucgccgccggcuacaaccggguguccguggucgaguaccugcugcaccacggggcggacgugcacgccaaggacaagggcgggcucgugccccugcacaacgccugcagcuacggccacuacgaggucgccgagcugcucgugcgccacggggccuccgugaacgucgcggaccuguggaaguucacgccccugcacgaggccgccgccaagggcaaguacgagaucugcaagcuccugcugaagcacggcgcggacccgaccaagaagaaccgggacgggaacaccccccucgaccuggugaaggagggcgacaccgacauccaggaccugcuccgcggggacgccgcccugcuggacgccgccaagaagggcugccucgcgcgggugcagaagcugugcacgcccgagaacaucaacugccgcgacacccaggggcggaacagcaccccgcugcaccucgccgccggcuacaacaaccuggaggucgccgaguaccugcucgagcacggcgccgacgugaacgcgcaggacaaggggggccugaucccccugcacaacgccgccuccuacgggcacguggacaucgccgcccuccugaucaaguacaacaccugcgucaacgcgaccgacaagugggccuucacgccccugcacgaggccgcccagaagggccgcacccagcucugcgcgcugcugcucgcccacggggccgaccccaccaugaagaaccaggagggccagaccccgcuggaccuggccacggccgacgacauccgggcgcuccugaucgacgccaugccccccgaggcccugcccaccugcuucaagccgcaggccaccguggugagcgccucccucaucagccccgcguccacccccagcugccuguccgccgccagcuccaucgacaaccugacgggcccccucgccgagcuggccgucgggggcgcgagcaacgccggggacggcgccgccggcaccgagcgcaaggagggggagguggcgggccuggacaugaacaucucccaguuccucaagagccuggggcuggagcaccuccgggacaucuucgagaccgagcagaucacccuggacgugcuggccgacaugggccacgaggagcucaaggagaucgggaucaacgccuacggccaccgccacaagcugaucaagggcgucgagcgccugcucgggggccagcaggggacgaacccguaccugaccuuccacugcgugaaccagggcaccauccugcucgaccuggcccccgaggacaaggaguaccagagcguggaggaggagaugcaguccaccauccgggagcaccgcgacgggggcaacgccggcgggaucuucaaccgguacaacgucauccgcauccagaagguggugaacaagaagcugcgggagcgcuucugccaccggcagaaggaggucagcgaggagaaccacaaccaccacaacgagcgcaugcucuuccacggcucccccuucaucaacgcgaucauccacaagggguucgacgagcggcacgccuacaucggcgggauguucggcgccggcaucuacuucgccgagaacagcuccaagagcaaccaguacguguacgggaucggcgggggcacgggcugccccacccacaaggaccgcuccugcuacaucugccaccggcagaugcuguucugccgcgugacccuggggaagagcuuccuccaguucuccaccaugaagauggcccacgcgccgcccggccaccacagcgucaucgggcggcccuccgugaacggccuggccuacgccgaguacgugaucuaccgcggggagcaggccuaccccgaguaccugaucacguaccagaucaugaagccggaggcccccagccagaccgcgaccgccgccgagcagaagaccuga

SEQ ID NO: 37939 - RNA, 954 nt, Artificial Sequence
  derived and/or modified sequence opt1 from TNMD__Homo_sapiens__NP_071427
auggccaagaacccgcccgagaacugcgaggacugccacauccugaacgccgaggcguucaagagcaagaagaucugcaagucccucaagaucugcggccugguguucgggauccuggcccucacccugaucguccuguucuggggcagcaagcacuucuggcccgaggugcccaagaaggccuacgacauggagcacaccuucuacuccaacggggagaagaagaagaucuacauggagaucgaccccgugacgcgcaccgagaucuuccggagcggcaacgggaccgacgagacccucgagguccacgacuucaagaacggcuacacgggcaucuacuucguggggcugcagaagugcuucaucaagacccagaucaaggugaucccggaguucuccgagcccgaggaggagaucgacgagaacgaggagaucaccaccacguucuucgagcagagcgucaucugggugcccgccgagaagcccaucgagaaccgcgacuuccugaagaacuccaagauccucgagaucugcgacaacgugaccauguacuggaucaacccgacccugaucagcgucuccgagcugcaggacuucgaggaggagggcgaggaccuccacuuccccgccaacgagaagaaggggaucgagcagaacgagcaguggguggugccccaggucaagguggagaagacccggcacgcgcgccaggccagcgaggaggagcugcccaucaacgacuacacggagaacggcaucgaguucgacccgaugcuggacgagcggggguacugcugcaucuacugccgccggggcaaccgcuacugccggcgcgugugcgagccccuccugggcuacuaccccuaccccuacugcuaccagggcgggcgggucaucugccgcgugaucaugccgugcaacugguggguggcccggaugcuggggcgcgucuga

SEQ ID NO: 37940 - RNA, 486 nt, Artificial Sequence
  derived and/or modified sequence opt1 from TNNC1__Homo_sapiens__NP_003271
auggacgacaucuacaaggccgccguggagcagcugaccgaggagcagaagaacgaguucaaggcggccuucgacaucuucguccucggcgccgaggacgggugcaucagcaccaaggagcugggcaaggugaugcgcaugcuggggcagaaccccacgccggaggagcuccaggagaugaucgacgagguggacgaggacggcuccgggaccgucgacuucgacgaguuccuggugaugauggugcggugcaugaaggacgacagcaagggcaaguccgaggaggagcugagcgaccucuuccgcauguucgacaagaacgccgacggcuacaucgaccuggacgagcugaagaucaugcuccaggccaccggggagaccaucacggaggacgacaucgaggagcugaugaaggacggcgacaagaacaacgacgggcggaucgacuacgacgaguuccuggaguucaugaagggcgucgaguga

SEQ ID NO: 37941 - RNA, 3900 nt, Artificial Sequence
  derived and/or modified sequence opt1 from TNN__Homo_sapiens__NP_071376
augagccugcaggagauguuccgcuuccccaugggccuccugcugggguccgugcuccuggucgccagcgccccggcgacccuggagccgcccggcugcuccaacaaggagcagcaggucaccgugagccacacguacaagaucgacgugcccaaguccgcccucguccagguggacgccgacccccagccccugagcgacgacggggccucccugcucgcccugggcgaggcgcgggaggagcagaacaucaucuuccgccacaacauccggcugcagacgccccagaaggacugcgagcucgccgggagcgugcaggaccugcuggcccgcgugaagaagcucgaggaggagaugguggagaugaaggagcagugcuccgcccagcggugcugccagggcgucaccgaccugagccgccacugcuccggccacgggaccuucagccuggagaccugcuccugccacugcgaggagggccgggaggggcccgcgugcgagcgccucgccugcccgggcgccugcagcgggcacggccggugcguggacggccgcugccugugccacgagcccuacgugggggccgacugcggcuaccccgccugccccgagaacugcuccgggcacggcgagugcguccggggcgugugccagugccacgaggacuucaugagcgaggacugcuccgagaagcgcugcccgggggacugcagcggccacggguucugcgacaccggcgagugcuacugcgaggagggguucaccggccuggacugcgcccagguggucacgccccagggccuccagcugcugaagaacaccgaggacucccuccuggugagcugggagcccagcucccagguggaccacuaccugcucagcuacuacccccuggggaaggagcuguccggcaagcagauccaggucccgaaggagcagcacagcuacgagauccucgggcugcugcccggcaccaaguacaucgugacccuccggaacgugaagaacgaggucuccagcagcccccagcaccuccuggcgaccacggaccuggccgugcuggggaccgccugggugaccgacgagaccgagaacucccuggacgucgagugggagaaccccuccacggagguggacuacuacaagcuccgcuacggcccgaugaccggccaggaggucgccgaggugaccgugcccaagagcuccgaccccaagagccgguacgacaucaccgggcugcaccccggcacggaguacaagaucaccgucgugccgaugcgcggggagcuggagggcaagcccauccuccugaacgggcggaccgagaucgacucccccaccaacguggucacggaccgcgugaccgaggacaccgcgaccgugagcugggaccccguccaggccgugaucgacaaguacgugguccgguacacguccgccgacggcgacaccaaggagauggccgugcacaaggacgagagcuccaccgugcugaccggccucaagccgggggaggccuacaaggucuacgugugggcggagcgcggcaaccaggggagcaagaaggccgacacgaacgcccugaccgagaucgacucccccgccaaccuggugaccgaccgggucaccgagaacacggccaccaucagcugggaccccgugcaggcgaccaucgacaaguacgugguccgcuacaccagcgccgacgaccaggagacccgcgaggugcucgugggcaaggagcaguccagcacgguccugaccggccugcggccggggguggaguacaccgugcacgucugggcccagaagggcgaccgcgaguccaagaaggccgacaccaacgcgcccacggacaucgacagccccaagaaccuggugaccgaccgggugaccgagaacauggccaccgucuccugggaccccgugcaggccgccaucgacaaguacgugguccgcuacacgagcgccgggggcgagacccgggaggugccgguggggaaggagcaguccagcaccguccucaccggccugcgccccggcauggaguacauggugcacgugugggcgcagaagggggaccaggaguccaagaaggccgacacgaaggcccagaccgacaucgacagcccccagaaccuggucaccgaccgggugaccgagaacauggccacgguguccugggaccccguccgcgccaccaucgaccgguacguggugcgcuacaccagcgcgaaggacggcgagacccgggaggucccgguggggaaggagcaguccagcacggugcucaccggccugcgccccggggucgaguacaccgugcacgugugggcccagaagggcgcccaggaguccaagaaggccgacaccaaggcccagacggacaucgacagcccccagaaccuggucaccgacugggugaccgagaacaccgcgacggucuccugggaccccgugcaggccaccaucgaccgguacgugguccacuacaccagcgccaacggcgagacccgcgaggugccgguggggaaggagcagagcuccacgguccucaccggccugcggcccgggauggaguacaccgugcacgugugggcccagaagggcaaccaggagagcaagaaggcggacaccaaggcccagacggagaucgacgggcccaagaaccuggucaccgacugggugaccgagaacauggccaccguguccugggaccccguccaggccaccaucgacaaguacauggugcgcuacacgagcgccgacggcgagacccgggaggugccggucggcaaggagcacuccagcaccgugcucaccgggcugcgccccggcauggaguacauggugcacgucugggcgcagaagggggcccaggaguccaagaaggccgacacgaaggcccagaccgagcuggacccgccccggaaccuccgccccagcgccgugacccaguccggcgggauccugaccuggacgccgcccagcgcgcagauccacggcuacauccugaccuaccaguuccccgacggcaccgugaaggagaugcagcucgggcgcgaggaccagcgguucgcccugcagggccuggagcagggggccaccuaccccgucucccucguggccuucaagggcggccgccggagccgcaacguguccacgacccugagcaccgucggggcccgguucccccaccccuccgacugcagccaggugcagcagaacuccaacgcggccagcggccuguacaccaucuaccuccacggggacgccucccgcccgcuccagguguacugcgacauggagacggacggcgggggcuggaucgucuuccagcggcgcaacaccggccagcuggacuucuucaagcgguggcgcagcuacguggagggguucggcgaccccaugaaggaguucuggcuggggcuggacaagcugcacaaccucaccaccggcacgcccgcccgguacgaggugcgcgucgaccugcagaccgcgaacgagagcgccuacgccaucuacgacuucuuccagguggccuccagcaaggagcgguacaagcugaccguggggaaguaccgcggcaccgccggcgacgcgcucacguaccacaacggguggaaguucaccaccuucgaccgggacaacgacaucgcccuguccaacugcgcccugacccaccacggcggguggugguacaagaacugccaccucgccaaccccaacggccgcuacggggagacgaagcacagcgagggcgucaacugggagccguggaagggccacgaguucuccauccccuacguggagcugaagauccggccccacggguacagccgcgagcccgugcugggccggaagaagcgcacccuccgggggcgccugcgcaccuucuga

SEQ ID NO: 37942 - RNA, 564 nt, Artificial Sequence
  derived and/or modified sequence opt1 from TNNI1__Homo_sapiens__NP_003272
augcccgagguggagcgcaagccgaagaucaccgccagccggaagcugcuccugaagucccugaugcucgccaaggcgaaggagugcugggagcaggagcacgaggagcgcgaggccgagaagguccgguaccuggccgagcgcauccccacccugcagacgcggggccucagccuguccgcccugcaggaccucugccgcgagcugcacgccaagguggagguggucgacgaggagcgguacgacaucgaggcgaagugccugcacaacacccgcgagaucaaggaccucaagcugaaggugauggaccugcgggggaaguucaagcgcccgccccuccggcgcgugcgggucagcgccgacgccaugcugcgcgcccugcucggcuccaagcacaaggugagcauggaccugcgggcgaaccugaaguccgugaagaaggaggacaccgagaaggagcgccccgucgaggugggggacuggcggaagaacguggaggccaugagcggcauggaggggcgcaagaagauguucgacgccgccaagucccccaccagccaguga

SEQ ID NO: 37943 - RNA, 549 nt, Artificial Sequence
  derived and/or modified sequence opt1 from TNNI2__Homo_sapiens__NP_001139313
augagccagugcaagaagcgcaaccgggccaucaccgcccgccggcagcaccugaaguccgugaugcuccagaucgcggccaccgagcuggagaaggaggagagccgccgggaggccgagaagcagaacuaccuggccgagcacugccccccgcuccacauccccggcuccaugagcgagguccaggagcugugcaagcagcugcacgccaagaucgacgcggccgaggaggagaaguacgacauggaggugcgcgugcagaagacguccaaggagcucgaggacaugaaccagaagcuguucgaccugcgggggaaguucaagcgccccccccuccggcgcguccggaugagcgccgacgccaugcugaaggcgcugcucggcuccaagcacaaggugugcauggaccugcgcgccaaccugaagcaggugaagaaggaggacaccgagaaggagcgggaccuccgcgacgucggggacuggcggaagaacaucgaggagaagagcggcauggaggggcgcaagaagauguucgaguccgagagcuga

SEQ ID NO: 37944 - RNA, 633 nt, Artificial Sequence
  derived and/or modified sequence opt1 from TNNI3__Homo_sapiens__NP_000354
auggccgacggcagcuccgacgccgcgcgcgagccccggccggcccccgcccccauccgccggcgcagcuccaacuaccgggccuacgccaccgagccccacgcgaagaagaaguccaagaucagcgccagccgcaagcugcagcucaagacccugcugcuccagaucgccaagcaggagcuggagcgggaggccgaggagcgccgcggggagaagggccgggcgcuguccacgcggugccagccgcucgagcuggccgggcugggcuucgccgagcuccaggaccugugccgccagcugcacgcccggguggacaaggucgacgaggagcgcuacgacaucgaggccaaggugaccaagaacaucaccgagaucgcggaccucacccagaagaucuucgaccugcgggggaaguucaagcgccccacgcugcggcgcgugcggaucagcgccgacgccaugaugcaggcccuccugggcgcccgcgcgaaggagucccuggaccuccgggcccaccugaagcaggucaagaaggaggacaccgagaaggagaaccgcgaggugggcgacuggcgcaagaacaucgacgcccugagcgggauggagggccggaagaagaaguucgaguccuga

SEQ ID NO: 37945 - RNA, 756 nt, Artificial Sequence
  derived and/or modified sequence opt1 from TNNT1__Homo_sapiens__NP_001278703
augagcgacaccgaggagcaggaguacgaggaggagcagcccgaggaggaggccgccgaggaggaggaggaggaggaggagcgcccgaagcccucccggcccguggugcccccgcugaucccgcccaagauccccgagggcgagcgcguggacuucgacgacauccaccggaagcgcauggagaaggaccuccuggagcugcagacccucaucgacgugcacuucgagcagcggaagaaggaggaggaggagcuggucgcgcugaaggagcgcaucgagcggcgccggagcgagcgcgccgagcagcagcgguuccgcacggagaaggagcgggagcgccaggccaagcucgccgaggagaagaugcggaaggaggaggaggaggccaagaagcgcgcggaggacgacgccaagaagaagaaggugcuguccaacaugggggcccacuucggcggguaccuggugaaggccgagcagaagcggggcaagcgccagaccgggcgggagaugaagguccgcauccucagcgagcggaagaagccccuggacaucgacuacaugggcgaggagcagcugcgcgagaaggcgcaggagcucuccgacuggauccaccagcuggagagcgagaaguucgaccugauggccaagcucaagcagcagaaguacgagaucaacgugcuguacaaccgcaucucccacgcccagaaguuccggaagggcgccgggaagggccgcgucgggggccgguggaaguga

SEQ ID NO: 37946 - RNA, 867 nt, Artificial Sequence
  derived and/or modified sequence opt1 from TNNT2__Homo_sapiens__NP_001001430
augagcgacaucgaggagguggucgaggaguacgaggaggaggagcaggaggaggccgccguggaggagcaggaggaggcggccgaggaggacgccgaggccgaggccgagaccgaggagacccgcgcggaggaggacgaggaggaggaggaggccaaggaggccgaggacggccccauggaggaguccaagccgaagccccggagcuucaugcccaaccuggugcccccgaagauccccgacggggagcgcgucgacuucgacgacauccaccggaagcgcauggagaaggaccucaacgagcugcaggcccugaucgaggcgcacuucgagaaccggaagaaggaggaggaggagcucgugucccugaaggaccgcaucgagcggcgccgggccgagcgcgccgagcagcagcggauccgcaacgagcgggagaaggagcgccagaaccggcuggccgaggagcgcgcccggcgcgaggaggaggagaaccggcgcaaggcggaggacgaggcccggaagaagaaggcccucagcaacaugaugcacuucggcggguacauccagaagcaggcccagacggagcgcaaguccggcaagcgccagaccgagcgggagaagaagaagaagauccuggccgagcgccggaaggugcuggcgaucgaccaccucaacgaggaccagcugcgcgagaaggccaaggagcuguggcagagcaucuacaaccucgaggccgagaaguucgaccugcaggagaaguucaagcagcagaaguacgagaucaacguccugcggaaccgcaucaacgacaaccagaagguguccaagacccgggggaaggccaaggugaccggccgcuggaaguga

SEQ ID NO: 37947 - RNA, 753 nt, Artificial Sequence
  derived and/or modified sequence opt1 from TNNT3__Homo_sapiens__NP_001036245
augagcgacgaggagguggagcaggucgaggagcaguacgaggaggaggaggaggcccaggaggaggaggaggugcaggaggaggagaagccccgcccgaagcugaccgcccccaagauccccgagggcgagaagguggacuucgacgacauccagaagaagcggcagaacaaggaccucauggagcugcaggcgcugaucgacucccacuucgaggcccgcaagaaggaggaggaggagcucgucgcccugaaggagcggaucgagaagcgccgggccgagcgcgccgagcagcagcggauccgcgcggagaaggagcgggagcgccagaaccggcuggccgaggagaaggcccgccgggaggaggaggacgccaagcgccgggcggaggacgaccucaagaagaagaaggcccugagcuccaugggggccaacuacagcuccuaccuggccaaggccgaccagaagcgcggcaagaagcagaccgcgcgggagaugaagaagaagauccucgccgagcgccggaagccccugaacaucgaccaccugggggaggacaagcuccgcgacaaggccaaggagcugugggagacgcugcaccagcucgagaucgacaaguucgaguucggcgagaagcugaagcggcagaaguacgacaucaugaacgugcgcgcccgcgugcagaugcuggccaaguucagcaagaaggcggggaccccggccaagggcaaggucggcgggcgguggaaguga

SEQ ID NO: 37948 - RNA, 168 nt, Artificial Sequence
  derived and/or modified sequence opt1 from TNP1__Homo_sapiens__NP_003275
augagcaccucccgcaagcugaagucccacggcaugcggcgcuccaagagccggagcccccacaagggggugaagcgcggcgggagcaagcggaaguaccgcaagggcaaccucaagucccggaagcgcggggacgacgccaaccggaacuaccgcagccaccuguga

SEQ ID NO: 37949 - RNA, 417 nt, Artificial Sequence
  derived and/or modified sequence opt1 from TNP2__Homo_sapiens__NP_005416
auggacacccagacccacagccugcccaucacgcacacccagcuccacuccaacagccagccgcagucccgcaccugcacccggcacugccagacguucagccaguccugccgccagagccaccggggcucccgcagccaguccagcucccagagccccgccucccaccggaaccccaccggggcccacagcuccagcggccaccagucccagagccccaacaccuccccgccccccaagcgccacaagaagaccaugaacagccaccacagccccaugcggccgacgauccugcacugccgcugccccaagaaccggaagaaccuggaggggaagcucaagaagaagaagauggcgaagcgcauccagcagguguacaagaccaagacccgguccagcggcuggaaguccaacuga

SEQ ID NO: 37950 - RNA, 2697 nt, Artificial Sequence
  derived and/or modified sequence opt1 from TNPO1__Homo_sapiens__NP_002261
auggugugggaccgccagaccaagauggaguacgaguggaagcccgacgagcagggccugcagcagauccuccagcugcugaaggagagccaguccccggacaccacgauccagcggaccguccagcagaagcucgagcagcugaaccaguaccccgacuucaacaacuaccugaucuucgugcucaccaagcucaagagcgaggacgagcccacccgcucccugagcgggcugauccugaagaacaacgugaaggcccacuuccagaacuuccccaacggcgucacggacuucaucaaguccgagugccugaacaacaucggggacagcuccccgcucauccgggccaccgugggcauccugaucaccaccaucgcgagcaagggggagcugcagaacuggcccgaccuccugcccaagcugugcucccuccuggacagcgaggacuacaacacgugcgagggcgccuucggcgcccugcagaagaucugcgaggacuccgccgagauccucgacagcgacgugcuggaccgcccccugaacaucaugaucccgaaguuccuccaguucuucaagcacuccagccccaagauccggucccacgccgucgcgugcgugaaccaguucaucaucagccgcacccaggcccugaugcugcacaucgacuccuucaucgagaaccucuucgcccuggccggggacgaggagcccgaggugcggaagaacgucugccgcgcgcuggugaugcuccuggaggugcggauggaccgccugcucccccacaugcacaacaucgucgaguacaugcugcagcggacccaggaccaggacgagaacguggcccuggaggccugcgaguucuggcucacccuggccgagcagccgaucugcaaggacgugcugguccgccaccuccccaagcugauccccgugcuggugaacggcaugaaguacagcgacaucgacaucauccuccugaagggggacgucgaggaggacgagacgauccccgacuccgagcaggacauccggccgcgcuuccaccggagccgcaccguggcccagcagcacgacgaggacggcaucgaggaggaggacgacgacgacgacgagaucgacgacgacgacaccaucagcgacuggaaccugcggaagugcuccgcggccgcccucgacgugcuggccaacgucuaccgcgacgagcugcucccccacauccugccccugcugaaggagcuccuguuccaccacgaguggguggugaaggagagcgggauccugguccucggcgccaucgcggagggcugcaugcaggggaugauccccuaccugccggagcugaucccccaccucauccagugccuguccgacaagaaggcccuggugcggagcaucacgugcuggacccucucccgcuacgcccacugggucgugagccagccgcccgacaccuaccugaagccccugaugaccgagcuccugaagcggauccuggacuccaacaagcgcgugcaggaggccgccugcagcgcguucgccacccucgaggaggaggccugcacggagcugguccccuaccuggccuacauccucgacacccugguguucgccuucuccaaguaccagcacaagaaccugcucauccuguacgacgcgaucggcacccuggccgacagcguggggcaccaccucaacaagcccgaguacauccagaugcugaugcccccgcugauccagaaguggaacaugcucaaggacgaggacaaggaccuguucccccugcucgagugccuguccagcgucgccaccgcccugcaguccggcuuccuccccuacugcgagccgguguaccagcgcugcgugaaccugguccagaagacgcuggcgcaggccaugcucaacaacgcccagcccgaccaguacgaggcccccgacaaggacuucaugaucguggcccuggaccugcucagcggccuggcggaggggcugggcgggaacaucgagcagcucguggcccgguccaacauccugacccugauguaccagugcaugcaggacaagaugcccgagguccgccagagcuccuucgcccuccugggcgaccugaccaaggccugcuuccagcacgugaagccgugcaucgccgacuucaugcccauccucgggaccaaccugaaccccgaguucaucagcgugugcaacaacgcgacgugggccaucggcgagaucuccauccagaugggcaucgagaugcagcccuacaucccgaugguccugcaccagcucguggagaucaucaaccggcccaacacccccaagacccugcuggagaacaccgccaucacgaucgggcgccucggcuacgugugcccccaggaggucgccccgaugcugcagcaguucauccggcccuggugcaccagccugcgcaacauccgggacaacgaggagaaggacagcgccuuccgcgggaucugcaccaugaucuccgugaaccccagcggcgugauccaggacuucaucuucuucugcgacgcggucgccuccuggaucaaccccaaggacgaccuccgggacauguucugcaagauccugcacggguucaagaaccaggugggcgacgagaacuggcgccgguucagcgaccaguucccgcugccccucaaggagcgccuggccgccuucuacggcguguga

SEQ ID NO: 37951 - RNA, 2664 nt, Artificial Sequence
  derived and/or modified sequence opt1 from TNPO2__Homo_sapiens__NP_001129667
auggacuggcagcccgacgagcagggccugcagcagguccuccagcugcugaaggacagccagucccccaacaccgccacccagcgcaucgugcaggacaagcucaagcagcugaaccaguuccccgacuucaacaacuaccugaucuucgugcucacgcggcucaagagcgaggacgagcccacccgcucccugagcgggcugauccugaagaacaacgugaaggcccacuaccaguccuucccgccgcccgucgcggacuucaucaagcaggagugccugaacaacaucggcgacgccagcucccucauccgggccaccaucgggauccugaucaccacgaucgccagcaagggcgagcugcagauguggcccgagcuccugccccagcugugcaaccuccugaacuccgaggacuacaacacgugcgagggggccuucggcgcgcugcagaagaucugcgaggacagcuccgagcuccuggacagcgacgcccugaaccgcccccucaacaucaugauccccaaguuccugcaguucuucaagcacugcucccccaagauccggagccacgccaucgccugcgugaaccaguucaucauggaccgcgcgcaggcccugauggacaacaucgacaccuucaucgagcaccucuucgcccuggccguggacgacgaccccgagguccggaagaacgugugccgcgcccuggugaugcuccuggagguccggaucgaccgccugaucccgcacaugcacuccaucauccaguacaugcuccagcggacccaggaccacgacgagaacguggcgcuggaggccugcgaguucuggcugacccucgccgagcagcccaucugcaaggaggugcuggccagccaccugguccagcucauccccauccuggugaacggcaugaaguacuccgagaucgacaucauccugcucaagggggacguggaggaggacgaggccguccccgacagcgagcaggacaucaagccgcgcuuccacaagucccggaccgugacccugccccacgaggcggagcgccccgacggcagcgaggacgccgaggacgacgacgacgacgacgcccugagcgacuggaaccuccggaagugcuccgccgccgcgcuggacgugcuggccaacgucuuccgcgaggagcuccugccccaccuccugccgcugcugaaggggcuccuguuccaccccgaguggguggugaaggagagcggcauccugguccugggggccaucgccgagggcugcaugcagggcauggugcccuaccuccccgagcugaucccgcaccugauccagugccucuccgacaagaaggcccuggugcggagcaucgcgugcuggacccugucccgcuacgcccacugggucgugagccagccgcccgacaugcaccucaagccccugaugacggagcugcucaagcggauccuggacgggaacaagcgcguccaggaggccgccugcuccgcguucgccacccuggaggaggaggccugcaccgagcucgugcccuaccugagcuacauccuggacacccucguguucgccuucggcaaguaccagcacaagaaccugcugauccucuacgacgccaucgggacgcuggcggacuccgucggccaccaccugaaccagcccgaguacauccagaagcucaugcccccgcugauccagaaguggaacgagcugaaggacgaggacaaggaccucuucccccugcuggagugccucagcuccguggccaccgcccugcagagcggcuuccugcccuacugcgagcccguguaccagcggugcgucacccucgugcagaagacccuggcccaggccaugauguacacgcagcacccggagcaguacgaggcgcccgacaaggacuucaugaucguggcccuggaccuccuguccgggcuggccgagggccucgggggccacgucgagcagcugguggcccgcagcaacaucaugacccuccuguuccagugcaugcaggacuccaugcccgaggugcgccagagcuccuucgcccugcugggggaccucaccaaggcgugcuucauccacgucaagcccugcaucgccgaguucaugccgauccugggcaccaaccugaaccccgaguucaucagcgugugcaacaacgccacgugggccaucggcgagaucugcaugcagaugggggcggagaugcagcccuacgugcagaugguccucaacaaccugguggagaucaucaaccggcccaacaccccgaagacccugcucgagaacaccgccaucacgaucggccgccugggguacgugugcccccaggaggucgcccccaugcugcagcaguucauccggcccuggugcaccucccuccgcaacauccgggacaacgaggagaaggacagcgccuuccgcggcaucugcaugaugaucggggugaacccgggcggcgugguccaggacuucaucuucuucugcgacgccguggcgagcugggugucccccaaggacgaccugcgggacauguucuacaagauccugcacggguucaaggaccaggucggcgaggacaacuggcagcaguucagcgagcaguucccgccccuccugaaggagcgccuggccgccuucuacgggguguga

SEQ ID NO: 37952 - RNA, 2580 nt, Artificial Sequence
  derived and/or modified sequence opt1 from TNPO3__Homo_sapiens__NP_001177957
auggagggcgccaagcccacccugcagcucguguaccaggccgugcaggcgcuguaccacgacccggaccccagcgggaaggagcgcgccuccuucuggcugggcgagcuccagcggagcgugcacgccugggagaucuccgaccagcugcugcagauccgccaggacguggagagcugcuacuucgccgcccagaccaugaagaugaagauccagacguccuucuacgagcuccccaccgacagccacgcgucccugcgggacagccugcucacccacauccagaaccugaaggaccugucccccgucaucgugacccagcucgcccuggccaucgccgaccuggcgcuccagaugccgagcuggaaggggugcgugcagacgcuggucgagaaguacuccaacgacgugaccagccugcccuuccuccuggagauccugaccgugcuccccgaggagguccacucccgcagccugcggaucggcgccaaccgccggaccgagaucaucgaggaccuggccuucuacuccagcacgguggugucccuccugaugaccugcgucgagaaggccgggaccgacgagaagaugcugaugaagguguuccgcugccucggcagcugguucaaccugggcgugcuggacuccaacuucauggccaacaacaagcuccuggcgcuccucuucgagguccugcagcaggacaagaccagcagcaaccugcacgaggccgccuccgacugcgugugcagcgcccucuacgccaucgagaacguggagacgaaccugccccuggcgaugcagcuguuccaggggguccugacccuggagaccgccuaccacauggccguggcccgggaggaccucgacaaggugcugaacuacugccgcaucuucaccgagcugugcgagacguuccucgagaagaucgucugcaccccgggccaggggcugggcgaccugcggacccucgagcugcugcugaucugcgccgggcacccccaguacgaggugguggagaucuccuucaacuucugguaccgccucggcgagcaccuguacaagaccaacgacgaggucauccacggcaucuucaaggcguacauccagcggcugcuccacgcccuggcccgccacugccagcuggagcccgaccacgagggggugcccgaggagacggacgacuucggcgaguuccggaugcgcgucagcgaccucgugaaggaccugaucuuccugaucggguccauggagugcuucgcccagcucuacagcacccugaaggagggcaacccgcccugggaggugaccgaggccguccuguucaucauggcggccaucgccaaguccguggaccccgagaacaaccccacccucguggagguccuggagggcguggugcggcugccggagacgguccacaccgccgugcgcuacaccagcaucgagcucgugggggagauguccgaggucguggaccggaacccccaguuccugggcaccgcgcuggugcucgcccgccugccccuggacaagaucacggagugccucagcgagcugugcuccguccaggugauggcccugaagaagcuccugagccaggagcccuccaacgggaucagcuccgacccgaccguguuccuggaccggcucgccgucaucuuccgccacaccaaccccaucguggagaacggccagacccaccccugccagaaggugauccaggagaucuggcccguccugagcgagacgcugaacaagcaccgcgccgacaaccggaucguggagcgcugcugccggugccuccgcuucgcggugcggugcgucgggaagggcuccgccgcccugcugcagccgcucgugacccagauggugaacgucuaccacgugcaccagcacagcugcuuccuguaccugggcuccauccucguggacgaguacgggauggaggagggcugccgccaggggcugcuggacaugcuccaggcccugugcauccccaccuuccagcugcucgagcagcagaacggccugcagaaccaccccgacaccgucgacgaccuguuccggcucgccacgcgcuucauccagcggagccccgugacccugcugcgcagccagguggucaucccgauccuccagugggcgaucgccuccaccacccuggaccaccgggacgccaacugcagcgugaugcgcuuccugcgggaccucauccacaccgggguggccaacgaccacgaggaggacuucgagcugcgcaaggagcugaucggccaggucaugaaccagcucggccagcagcuggugucccagcugcuccacacgugcugcuucugccugccgcccuacacccugcccgacguggccgagguccucugggagaucaugcaggucgaccggcccaccuucugccgcuggcuggagaacagccugaaggggcuccccaaggagaccacggugggcgcggugaccgugacccacaagcagcugaccgacuuccacaagcaggucacguccgccgaggagugcaagcaggucugcugggcccugcgggacuucacccgccucuuccgguga

SEQ ID NO: 37953 - RNA, 8907 nt, Artificial Sequence
  derived and/or modified sequence opt1 from TNRC18__Homo_sapiens__NP_001073964
auggacggccgcgacuucgggccccagcgguccgugcacgggcccccgccgccccuccucuccgggcuggccauggacucccaccgcgucggcgccgccaccgccgggcggcugccggccuccggccuccccggcccccugcccccggggaaguacauggccggccugaaccuccacccccaccccggggaggccuuccugggcagcuucguggccuccgggaugggccccagcgccuccagccacggcucccccgugccccugcccagcgaccucuccuuccgcagccccacccccuccaaccugcccaugguccagcugugggccgcccacgcccacgagggguucagccaccuccccuccggccuguaccccagcuaccugcaccucaaccaccuggagccgcccuccagcgggagcccccugcucagccagcugggccagcccagcaucuucgacacgcagaagggccaggggcccggcggggacggcuucuaccugcccaccgccggggcccccggcucccuccacagccacgcccccuccgcccggacccccggcgggggccacagcuccggggcccccgccaagggcagcuccagccgcgacgggcccgccaaggagcgggccggccgcggcggggagcccccgccccuguucggcaagaaggacccccgggcccgcggggaggaggccuccggcccccggggcgugguggaccugacccaggaggcccgcgccgagggccggcaggaccgcgggccgccccggcucgccgagcgccugagccccuuccuggccgaguccaagacgaagaacgccgcccuccagcccagcguccugaccaugugcaacgggggcgccggggacgugggccugcccgcccucguggccgaggccggccgcggcggggccaaggaggccgcccgccaggacgagggggcccggcugcugcgccggaccgagacccuccugcccggcccccgccccugccccagcccccugccgccgccgcccgcgccgcccaaggggccgcccgcgccgcccgccgccacgcccgcgggcgucuacaccguguuccgcgagcagggccgggagcaccgcguggucgcccccaccuucgugcccagcguggaggccuucgacgagcggcccgggcccauccagaucgccucccaggcccgcgacgcgcgggcccgcgagcgggaggccggccgccccgggguccuccaggccccgcccggcagcccccggccccuggaccgccccgaggggcugcgggagaagaacuccgugauccgcagccucaagcggcccccgcccgccgacgcgcccaccgugcgcgccacgcgggccucccccgacccccgcgccuacguccccgcgaaggagcugcugaagcccgaggccgacccccggcccugcgagcgcgcgccccggggccccgccggccccgccgcgcagcaggccgccaagcuguucgggcuggagcccggccgcccgccgcccaccgggcccgagcacaaguggaagcccuucgagcugggcaacuucgccgccacccagauggcggugcucgccgcccagcaccaccacagccgcgccgaggaggaggccgcgguggucgccgccagcuccagcaagaaggccuaccuggaccccggggcggugcugccccgguccgccgcgaccugcggccgccccguggccgacaugcacagcgccgcgcacggcuccggggaggccagcgccaugcagucccucaucaaguacagcggcuccuucgcccgggacgccgucgcggugcgccccgggggcugcgggaagaagucccccuucggcggccuggggacgaugaagcccgagcccgcccccaccuccgccggcgccagccgggcccaggcgcgccugccccacuccgggggccccgccgccggcgggggccggcagcugaagcgcgaccccgagcggccggagagcgccaaggccuucgggcgcgagggcuccggggcgcagggcgaggccgagguccggcacccgcccgugggcaucgccguggccgucgcgcgccagaaggacagcgggggcuccgggcggcucggccccgggcugguggaccaggagcgcagccugagccucuccaacgugaagggccacggccgggccgacgaggacugcgucgacgaccgcgcccggcaccgcgaggagcggcugcugggggcccgccucgaccgggaccaggagaagcugcugcgcgagagcaaggagcucgccgaccuggcgcgccugcacccgaccuccugcgcccccaacggccucaaccccaaccugauggugaccgggggccccgcccuggccgggagcggccggugguccgccgacccggcggcccaccucgccacgcaccccuggcugccccgcagcggcaacgccuccauguggcuggccgggcaccccuacggccucgggccgcccagccugcaccagggcauggcgcccgccuucccgcccggccucgggggcucccuccccagcgccuaccaguucgugcgggacccccaguccgggcagcuggucgugauccccagcgaccaccucccccacuucgccgagcucauggagcgcgcgaccgugccgccccuguggcccgcccuguacccgcccggccggagcccccugcaccacgcccagcagcugcagcuguucagccagcagcacuuccuccgccagcaggaguuccuguaccugcagcagcaggccgcccaggcgcucgagcugcagcgguccgcccagcugguccaggagcgccucaaggcccaggagcaccgggccgagauggaggagaaggggagcaagcgcggccuggaggccgcgggcaaggccgggcuggccaccgccggcccggggcuccugccccggaagccgcccggccuggccgcggggccggccggcaccuacggcaaggccgugagcccgccgcccagcccccgcgccucccccguggcggcccugaaggccaaggucauccagaagcuggaggacgugagcaagccgcccgccuacgccuaccccgcgacgcccagcucccaccccaccagcccgccgcccgccagcccgccgcccacccccgggaucacccggaaggaggaggcccccgagaacguggucgagaagaaggaccuggagcucgagaaggaggcccccucccccuuccaggcccuguucuccgacaucccgccccgguaccccuuccaggcgcugccgccccacuacggccggcccuaccccuuccuccugcagcccacggccgccgccgacgccgacgggcuggcgcccgacgugccccucccggccgacggccccgagcgccuggcccugucccccgaggacaagcccauccggcucuccccgagcaagaucaccgagccccugcgcgaggggcccgaggaggagccccuggccgagcgggaggugaaggccgaggucgaggacauggacgagggcccgaccgagcugccgccccuggagagcccccugccgcuccccgcggccgaggccauggccacccccagccccgcgggcgggugcggcgggggccugcuggaggcccaggcccucuccgccacggggcagagcugcgccgagccguccgagugccccgacuucguggagggccccgagccgcgcguggacagccccggccgcaccgagcccugcaccgcggcccuggaccuggggguccagcucacccccgagacgcugguggaggccaaggaggagccgguggagguccccguggccgugcccgucguggaggccgugcccgaggagggccuggcgcaggucgccccguccgagagccagcccacccucgagauguccgacugcgacgugcccgccggggagggccagugccccagccuggagccgcaggaggccgugcccguccugggcuccacgugcuuccucgaggaggccagcagcgaccaguuccugcccagccuggaggacccccucgcggggaugaacgcccuggccgccgcggccgagcugccgcaggcccggccccuccccagccccggcgccgccggggcgcaggcccuggagaagcuggaggccgccgagucccucgugcuggagcagagcuuccugcacggcaucacccuccuguccgagaucgccgagcuggagcucgagcgccggagccaggagaugggcggcgcggagcgcgcccugguggcccggccgucccuggagagccuccuggccgccggcucccacaugcugcgcgagguccucgacgggcccgugguggacccccugaagaaccugcggcugccccgcgagcucaagccgaacaagaaguacagcuggaugcggaagaaggaggagcgcauguacgcgaugaaguccagccuggaggacauggacgcccuggagcucgacuuccggaugcgccuggccgagguccagcggcaguacaaggagaagcagcgcgagcuggugaagcuccagcggcgccgggacuccgaggaccgccgggaggagccccaccgcagccuggcccggcgcggccccgggcgcccccggaagcgcacccacgcgccguccgcccuguccccgccccggaagcgcggcaaguccgggcacagcuccggcaagcucagcagcaagucccugcugaccagcgacgacuacgagcucggcgccgggauccggaagcgccacaagggcuccgaggaggagcacgacgcccugaucgggaugggcaaggcccgggggcgcaaccagaccugggacgagcacgaggcgagcuccgacuucaucagccagcugaagaucaagaagaagaagauggccuccgaccaggagcagcucgccagcaagcuggacaaggcccugucccucaccaagcaggacaagcugaaguccccguucaaguucuccgacagcgccggcggcaaguccaagaccagcgggggcugcgggcgguaccugacgcccuacgacucccuccugggcaagaaccgcaaggcgcuggccaaggggcucggccugagccugaaguccagccgggagggcaagcacaagcgcgccgccaagacccggaagauggaggugggguucaaggcccgcggccagcccaaguccgcgcacagccccuucgccagcgaggucuccagcuacuccuacaacaccgacagcgaggaggacgaggaguuccucaaggacgaguggccggcccaggggcccuccagcuccaagcugacccccagccugcucugcuccaugguggccaagaacagcaaggccgcgggcggccccaagcugacgaagcgggggcuggccgccccgcgcacccucaagcccaagcccgccaccucccggaagcagcccuucugccugcugcuccgcgaggcggaggcccggagcuccuucagcgacuccagcgaggaguccuucgaccaggacgagagcuccgaggaggaggacgaggaggaggagcuggaggaggaggacgaggccagcggcgggggcuaccgccugggggcccgcgagcgggcccucagcccgggccuggaggaguccggccuggggcuccuggcgcgcuucgccgccagcgcccugcccucccccaccgugggccccagccucuccgucgugcagcuggaggccaagcagaaggcgcggaagaaggaggagcgccagagccugcucgggacggaguucgaguacaccgacuccgagagcgaggugaagguccggaagcgcuccccggccggccugcugcggcccaagaaggggcucggcgagcccggccccagccuggccgccccgacccccggggcccgcggccccgaccccuccagcccggacaaggcgaagcuggccguggagaaggggcggaaggcccgcaagcuccggggccccaaggagcccggguucgaggccggccccgaggcguccgacgacgaccuguggacccgccggcgcagcgagcggaucuuccugcacgacgccuccgccgccgccccggcgcccgucagcacggcccccgccaccaagaccucccgcugcgccaagggcgggccgcucagcccccggaaggacgccggccgcgcgaaggaccggaaggacccccgcaagaagaagaaggggaaggaggccggccccggcgccgggcugccgccgccccgggcccccgcccugccgagcgaggcgcgcgcgccccacgccuccagccucaccgccgccaagcgcuccaaggcgaaggccaagggcaaggaggugaagaaggagaaccgggggaagggcggggccgugagcaagcugauggaguccauggccgcggaggaggacuucgagcccaaccaggacagcuccuucagcgaggacgagcaccucccccgcggcggcgccgucgagcggccgcucacgcccgcgccccgcuccugcaucaucgacaaggacgagcugaaggacgggcugcgggugcucauccccauggacgacaagcugcuguacgccggccacgugcagaccguccacagcccggacaucuaccgcgugguggucgagggggagcggggcaaccgcccccacaucuacugccucgagcagcugcugcaggaggccaucaucgacgugcggcccgcguccacccgcuuccucccccaggggacccggaucgccgccuacuggagccagcaguaccgcugccuguacccgggcacggugguccggggccugcucgaccuggaggacgacggggaccugaucaccguggaguucgacgacggcgacaccgggcgcaucccccucucccacauccggcugcugccgcccgacuacaagauccagugcgccgagccgagccccgcccuccuggugcccuccgcgaagcgccggagccgcaagaccuccaaggacacgggcgaggggaaggacggcggcaccgccgggagcgaggagccgggcgccaaggcccgggggcgcggccgcaagcccuccgccaaggcgaagggggaccgggccgccacccuggaggagggcaaccccaccgacgagguccccagcacgccgcucgcccuggagcccagcuccacccccggcagcaagaaguccccgcccgagcccguggacaagcgcgcgaaggcccccaaggcccggcccgccccgccccagcccagccccgccccgcccgcguucaccuccugccccgcccccgagcccuucgccgagcugcccgcccccgccaccagccucgcgcccgccccgcugaucacgaugcccgccacccgccccaagcccaagaaggcccgggccgcggaggaguccggggccaagggcccgcgccggcccggggaggaggccgagcugcucgugaagcuggaccacgagggcgucaccagccccaaguccaagaaggccaaggaggcgcugcuccugcgcgaggacccgggcgccgggggcuggcaggagcccaagagccugcucucccuggggagcuacccgcccgccgccggcuccagcgagcccaaggcccccuggcccaaggcgaccgacggggaccuggcccaggagcccggcccgggccucaccuucgaggacuccgggaaccccaagagccccgacaaggcccaggccgagcaggacggcgccgaggaguccgagagcuccagcagcuccagcuccgggagcuccagcuccagcuccagcuccagcuccagcggcuccgagacggagggggaggaggagggcgacaagaacggcgacgggggcugcgggaccggcgggcggaacugcagcgcggccuccagccgcgccgccucccccgccagcagcuccagcuccagcuccagcuccagcuccagcuccagcuccagcuccagcuccagcuccagcagcuccagcuccagcuccagcuccagcuccagcuccagcuccagcuccagcuccagcuccagcagcuccagcuccagcuccagcuccagcuccagcuccagcuccagcaccaccgacgaggacuccagcugcuccagcgacgacgaggcggccccggcccccacggccggccccagcgcccaggcggcccugcccaccaaggccaccaagcaggccggcaaggcgcggccguccgcccacagccccgggaagaagacccccgcgccccagccgcaggcgccgccgccccagccgacgcagccccugcagcccaaggcccaggcgggcgccaagucccgccccaagaagcgggagggggugcaccuccccaccaccaaggagcuggccaagcgccagcggcugcccagcguggagaaccgccccaagaucgccgccuuccugccggcgcggcagcucuggaagugguucggcaagcccacccagcgccggggcaugaaggggaaggcccgcaagcuguucuacaaggccaucguccggggcaaggagaugauccgcaucggggacugcgccguguuccuguccgccggccgccccaaccuccccuacaucgggcggauccagagcaugugggaguccuggggcaacaacauggugguccgcgugaagugguucuaccacccggaggagacgagccccggcaagcaguuccaccaggggcagcacugggaccagaaguccagccggucccugcccgcggcccugcgcgugagcucccagcggaaggacuucauggagcgcgcccucuaccagagcucccacgucgacgagaacgacgugcagaccgugagccacaagugccuggucgugggccuggagcaguacgagcagaugcucaagaccaagaaguaccaggacuccgaggggcuguacuaccuggccggcaccuacgagcccacgaccgggaugaucuucagcaccgacggcgugccgguccucugcuga

SEQ ID NO: 37954 - RNA, 5889 nt, Artificial Sequence
  derived and/or modified sequence opt1 from TNRC6A__Homo_sapiens__NP_055309
augcgcgagcuggaggcgaaggccaccaaggacguggagcggaaccucagccgcgaccuggugcaggaggaggagcagcugauggaggagaagaagaagaagaaggacgacaagaagaagaaggaggcggcccagaagaaggccaccgagcagaagaucaaggugcccgagcagaucaagcccagcgugagccagccccagcccgccaacagcaacaacgggaccagcaccgccaccuccaccaacaacaacgcgaagcgggccacggccaacaaccagcagccccagcagcagcagcagcagcagcagccccagcagcagcagccccagcagcagccccagccccagccccagcagcagcagccccagcagcagccccaggcccucccccgcuacccccgggaggugccgccccgcuuccggcaccaggagcacaagcagcugcugaagcgcgggcagcacuuccccgugaucgcggccaaccucgggagcgccgugaagguccugaacucccagagcgaguccagcgcccugaccaaccagcagccccagaacaacggggaggugcagaacuccaagaaccagagcgacaucaaccacuccaccagcgggucccacuacgagaacagccagcgggggcccguguccagcaccuccgacagcagcacgaacugcaagaacgccgucguguccgaccucagcgagaaggaggcguggcccuccgcccccgggagcgaccccgagcuggccuccgagugcauggacgccgacagcgccuccagcuccgagagcgagcgcaacaucaccaucauggcguccggcaacaccgggggcgagaaggacgggcugcggaacagcaccggccucgggucccagaacaaguucguggucggcagcuccagcaacaacgugggccacggguccagcacgggccccuggggguucucccacggcgccaucaucuccacgugccaggugagcgucgacgcccccgaguccaagagcgaguccagcaacaaccgcaugaacgccuggggcaccguguccagcuccagcaacgggggccugaaccccuccacccugaacagcgccuccaaccacggggcguggcccgugcucgagaacaacggccuggcccugaaggggcccgucggcagcggcuccagcgggaucaacauccagugcuccaccaucggccagaugcccaacaaccagagcaucaacuccaaggugagcgggggcagcacccacgggaccuggggcucccuccaggagaccugcgagagcgagguguccggcacgcagaaggucagcuucuccgggcagccccagaacaucaccaccgagaugaccggccccaacaacacgaccaacuucaugaccagcucccugcccaacagcggguccgugcagaacaacgagcugcccagcuccaacaccggcgccuggcgggugagcacgaugaaccacccgcagaugcaggcccccuccgggaugaacggcaccagccucucccaccugagcaacggcgaguccaagagcgggggcuccuacgggaccaccuggggcgccuacggcagcaacuacagcggggacaagugcuccggccccaacgggcaggcgaacggcgacacggucaacgccacccugaugcagcccggggugaacggcccgaugggcaccaacuuccaggucaacaccaacaagggcggcggggugugggagagcggggccgccaacucccagagcacguccugggggagcggcaacggcgcgaacuccgggggcagccgccggggguggggcacccccgcccagaacaccgggaccaaccuccccuccguggaguggaacaagcugcccagcaaccagcacuccaacgacagcgccaacggcaacggcaagaccuucacgaacggguggaaguccaccgaggaggaggaccagggcagcgccaccucccagaccaacgagcagagcuccgucugggccaagaccggcgggaccguggagagcgacggguccaccgagagcaccgggcgccuggaggagaagggcacgggggagagccagucccgggaccgccggaagaucgaccagcacacccuccugcagagcaucgugaaccgcaccgaccuggacccgcggguccucuccaacagcggcugggggcagacccccaucaagcagaacacggcgugggacaccgagaccagcccccgcggcgagcgcaagaccgacaacggcacggaggccugggggagcuccgccacccagaccuucaacagcggcgccugcaucgacaagaccucccccaacgggaacgacacgagcuccgugagcggcuggggcgacccgaagcccgcccugcgguggggcgacuccaagggcagcaacugccagggcgggugggaggacgacuccgcggccaccgggauggucaagagcaaccaguggggcaacugcaaggaggagaaggccgccuggaacgacucccagaagaacaagcagggguggggcgacggccagaaguccucccagggguggagcgucagcgccuccgacaacuggggcgagaccagccgcaacaaccacuggggcgaggcgaacaagaaguccagcuccggcgggagcgacuccgaccggagcguguccggcuggaacgagcugggcaagaccagcuccuucacgugggggaacaacaucaaccccaacaacagcuccggcugggacgagagcuccaagcccaccccgagccagggguggggcgacccgcccaaguccaaccagagccucggcuggggcgacuccagcaagcccgugagcuccccggacuggaacaagcagcaggacaucgucggcagcugggggaucccgcccgccaccggcaagccgcccgggaccggcuggcugggcgggcccauccccgcccccgccaaggaggaggagcccacgggcugggaggagcccucccccgagagcauccgccggaagauggagaucgacgacgggaccuccgcguggggcgacccgagcaaguacaacuacaagaacgugaacauguggaacaagaacgugcccaacgggaacucccgcagcgaccagcaggcccagguccaccagcugcucacccccgccuccgccaucagcaacaaggaggccuccagcggcuccggcuggggcgagcccuggggcgagccgagcacccccgcgacgaccguggacaacgggaccuccgccuggggcaagcccaucgacagcgggcccuccuggggcgagccgaucgccgccgccagcuccaccagcacguggggcagcuccagcguggggccccaggcgcuguccaagagcggccccaaguccaugcaggacggguggugcggcgacgacaugccccugccggggaaccggcccaccggcugggaggaggaggaggacgucgagaucggcauguggaacagcaacuccagccaggagcucaacuccagccugaacuggccgcccuacaccaagaagauguccagcaaggggcuguccggcaagaagcgccggcgcgagcgggggaugaugaagggcggcaacaagcaggaggaggccuggaucaacccguucgugaagcaguucagcaacaucuccuucagccgcgacucccccgaggagaacgugcagagcaacaagauggaccucagcgggggcaugcugcaggacaagcggauggagaucgacaagcacucccugaacaucggggacuacaaccgcaccgucggcaaggggcccggcagccggccccagaucuccaaggagagcuccauggagcgcaacccguacuucgacaaggacggcaucguggccgacgagagccagaacaugcaguucauguccagccaguccaugaagcugccgcccagcaacuccgcccugcccaaccaggcccuggggagcaucgcgggccucgggaugcagaaccugaacuccgugcggcagaacggcaacccgagcauguucggggucggcaacaccgccgcccagccccgcggcaugcagcagcccccggcccagccccuguccagcucccagcccaaccugcgggcccaggugcccccgccccuccugagcccccaggugcccgucucccugcucaaguacgccccgaacaacgggggccugaacccccuguucgggccccagcaggucgccaugcucaaccagcugagccagcugaaccagcucagccagaucucccagcugcagcgccugcucgcccagcagcagcgcgcccagagccagcgguccgugcccagcggcaaccgcccgcagcaggaccagcaggggcggccccuguccguccagcagcagaugaugcagcagagccgccagcuggaccccaaccuccuggugaagcagcagacgcccccgucccagcagcagccccugcaccagcccgcgaugaaguccuuccucgacaacgugaugccccacaccaccccggagcugcagaagggccccucccccaucaacgccuucagcaacuuccccaucggccugaacuccaaccucaacgucaacauggacaugaacagcaucaaggagccgcagucccggcugcgcaaguggaccacgguggacagcaucuccgugaacaccagccuggaccagaacuccagcaagcacggggccaucuccagcggcuuccggcucgaggagagccccuucguccccuacgacuucaugaacuccagcaccucccccgccagcccgcccggguccaucggcgacggguggccccgcgccaagagcccgaacggcuccagcuccgugaacuggccgcccgaguuccggcccggcgagccguggaagggguaccccaacaucgaccccgagaccgaccccuacgugacgccgggcagcgucaucaacaaccuguccaucaacaccgugcgcgagguggaccaccuccgggaccgcaacagcggguccagcuccagccucaacaccacccugcccuccacgagcgcgugguccagcauccgggccagcaacuacaacgucccccuguccagcaccgcccaguccaccagcgcccgcaacuccgacagcaagcucaccuggucccccggcagcgugacgaacaccucccuggcccacgagcuguggaaggugccgcugccgcccaagaacaucaccgcgcccagccggccgccgcccggccugaccgggcagaagcccccgcuguccacgugggacaacagcccccuccgcaucggcgggggcugggggaacuccgacgcccgguacacccccggcagcuccuggggcgagagcuccagcgggcgcaucaccaacuggcugguccugaagaaccucacgccccagaucgacggcuccacgcugcggacccugugcaugcagcacgggccgcucaucaccuuccaccugaaccugccccacggcaacgcccucgugcgcuacagcagcaaggaggagguggucaaggcccagaagucccugcacaugugcgugcuggggaacaccacgauccucgccgaguucgcgagcgaggaggagaucucccgguucuucgcccagagccagucccugacccccagcccgggcuggcagucccugggcagcucccagagccgccucgggucccuggacugcagccacuccuucagcucccgcaccgaccugaaccacuggaacggcgccgggcucagcggcaccaacugcggggaccugcacggcacgucccuguggggcacgccccacuacagcaccucccucugggggccgcccagcagcuccgacccgcggggcaucagcucccccagccccaucaacgccuuccuguccguggaccaccucggcggcggcggggagagcauguga

SEQ ID NO: 37955 - RNA, 3090 nt, Artificial Sequence
  derived and/or modified sequence opt1 from TNRC6B__Homo_sapiens__NP_001020014
augcagaccaacgagggcgaggugagcgaggaguccagcuccaaggucgagcaggaggacuucgugauggaggggcacggcaagacccccccgcccggggaggagagcaagcaggagaaggagcaggagcgcgaggagcagcugauggaggacaagaagcggaagaaggaggacaagaagaagaaggaggccacgcagaaggugaccgagcagaagaccaagguccccgaggugaccaagcccucccucagccagccgacggccgcgucccccaucggcagcucccccagccccccggugaacgggggcaacaacgccaagcgcgucgccgugcccaacggccagccccccuccgccgcccgguacaugccgcgcgaggugcccccccgguuccgcugccagcaggaccacaagguccugcugaagcgggggcagcccccgccccccagcugcaugcuccugggcgggggcgcggggcccccgcccugcaccgcccccggcgccaaccccaacaacgcccaggugaccggcgcgcugcuccaguccgagagcgggaccgccccggugugguccaagagcacgccccccgcccccgacaacggcaccuccgccuggggggagccgaacgagagcucccccggcuggggcgagauggacgacaccggggccagcaccacgggcugggggaacacccccgcgaacgccccgaacgccaugaagcccaacagcaaguccaugcaggacggcuggggggagagcgacggccccgucaccggcgcccgccaccccuccugggaggaggaggaggacgggggcguguggaacaccacggggagccagggcuccgccagcucccacaacagcgcguccugggggcagggcggcaagaagcagaugaagugcagccugaaggggggcaacaacgacuccuggaugaacccgcuggccaagcaguucagcaacauggggcuccugucccagaccgaggacaaccccagcuccaagauggaccugagcgugggcucccucagcgacaagaaguucgacgucgacaagcgggccaugaaccugggggacuucaacgacaucaugcgcaaggaccgguccggcuuccgcccccccaacagcaaggacaugggcaccaccgacagcgggccguacuucgagaagggcgggucccacggccuguucggcaacagcacggcccagucccgggggcuccacacccccgugcagccccugaacagcucccccagccugcgcgcccaggugccgccccaguucaucuccccccaggucagcgcguccaugcucaagcaguuccccaacagcggccuguccccggggcuguucaacgugggcccccagcucagcccccagcagaucgccaugcugucccagcugccccagaucccgcaguuccagcucgccugccagcugcugcuccagcagcagcagcagcagcagcugcugcagaaccagcggaagaucagccaggccgugcgccagcagcaggagcagcagcucgcccggauggucuccgcgcugcagcagcagcagcagcagcagcagcgccagcccgggaugaagcacagccccucccaccccgugggcccgaagccccaccuggacaacauggugcccaacgcccucaacgucggccugccggaccugcagaccaaggggcccauccccggcuacgggagcggcuucagcuccgggggcauggacuacggcaugguggggggcaaggaggccgggaccgagagccgguucaagcaguggacguccaugauggagggccuccccagcgucgccacccaggaggcgaacaugcacaagaacggggccaucguggccccgggcaagacccgcggcgggucccccuacaaccaguucgacaucauccccggcgacacccuggggggccacacggggcccgccggcgacagcuggcugccggccaaguccccccccaccaacaagaucggcagcaaguccagcaacgcguccuggcccccggaguuccagcccggggugcccuggaagggcauccagaacaucgaccccgagagcgacccguacgucacccccggguccgugcucggcggcaccgccacgagccccaucguggacaccgaccaccagcugcugcgggacaacaccaccggguccaacagcucccucaacacgagccugcccuccccgggcgccuggcccuacagcgccagcgacaacuccuucaccaacguccacagcaccuccgccaaguuccccgacuacaagagcaccuggucccccgacccgaucgggcacaaccccacccaccugagcaacaagauguggaagaaccacaucuccagccgcaacacgaccccccucccccgcccgccccccggccugaccaacccgaagcccuccagccccugguccagcaccgcgccccgguccgugcgcggguggggcacgcaggacagccggcuggccuccgccagcaccugguccgacggcgggagcgugcgcccguccuacuggcucguccugcacaaccugaccccccagaucgacggcagcacccugcggacgaucugcaugcagcacgggccccuccugaccuuccaccugaaccucacccagggcaccgcccugauccgcuacagcacgaagcaggaggccgcgaaggcccagaccgcccugcacaugugcgugcucgggaacaccaccauccuggccgaguucgcgacggacgacgaggugucccgguuccuggcccaggcccagcccccgacccccgccgccacccccagcgcgcccgccgccggcuggcagucccucgagaccggccagaaccagagcgacccggucgggcccgcccugaaccuguucggcggguccacgggccucgggcaguggagcuccagcgccggcggcuccagcggggcggaccuggccggcgccucccugugggggccccccaacuacagcuccagccucuggggcgugccgaccguggaggacccccaccgcaugggcucccccgccccccugcugccgggggaccuccugggcgggggcagcgacuccaucuga

SEQ ID NO: 37956 - RNA, 4077 nt, Artificial Sequence
  derived and/or modified sequence opt1 from TNR__Homo_sapiens__XP_011508249
augggcgccgacggggagaccgugguccugaagaacaugcucaucggcaucaaccugauccugcucgggagcaugaucaagcccuccgagugccagcuggaggugaccacggagcgcgugcagcggcagagcgucgaggaggagggcgggaucgccaacuacaacaccuccagcaaggagcagccggugguguucaaccacgucuacaacaucaacgugccccuggacaaccucugcuccagcggccuggaggcguccgccgagcaggaggugagcgccgaggacgagacccuggccgaguacaugggccagaccuccgaccacgagagccaggucacguucacccaccgcaucaacuuccccaagaaggccugccccugcgcguccagcgcccaggugcuccaggagcugcugucccggaucgagaugcucgagcgcgaggugagcguccugcgggaccagugcaacgccaacugcugccaggaguccgccgcgaccgggcagcuggacuacaucccgcacugcagcggccacgggaacuucuccuucgagagcugcggcugcaucugcaacgaggggugguucggcaagaacugcuccgagcccuacugcccccucggcugcagcagccgcggggugugcguggacggccagugcaucugcgacuccgaguacagcggggacgacugcuccgagcugcggugccccaccgacugcagcucccgcggccugugcgucgacggcgagugcgugugcgaggagccguacacgggggaggacugccgggagcuccgcugccccggcgacugcagcgggaagggccggugcgccaacgggaccugccugugcgaggagggcuacgugggcgaggacugcgggcagcgccagugccugaacgccugcuccggccgggggcagugcgaggagggccucugcgucugcgaggagggguaccagggccccgacugcagcgccguggcccccccggaggaccugcgcguggcgggcaucuccgaccggagcaucgagcuggagugggacgggcccauggccgucaccgaguacgugaucuccuaccagcccaccgcccucggcgggcugcagcugcagcagcgcgugcccggcgacuggagcggggucacgaucaccgagcucgagccgggccugaccuacaacaucuccguguacgccgucaucagcaacauccugucccuccccaucaccgccaagguggcgacgcaccugagcaccccccagggccugcaguucaagaccaucaccgagacgaccguggagguccagugggagcccuucuccuucagcuucgacgggugggagaucuccuucaucccgaagaacaacgagggcggggugaucgcccaggugcccagcgacgucaccagcuucaaccagaccggccucaagcccggcgaggaguacaucgugaacguggucgcccugaaggagcaggcccggucccccccgacgagcgccuccgugagcaccgugaucgacgggcccacccagauccugguccgcgacguguccgacaccguggcguucgucgaguggauccccccccgggccaagguggacuucauccuccugaaguacggccugguggggggcgaggggggccgcacgaccuuccggcuccagccgccccugagccaguacuccguccaggcccugcgccccggcagccgcuacgagguguccgugagcgccguccgggggaccaacgaguccgacagcgccaccacgcaguucaccaccgagaucgacgcgccgaagaaccuccgcgugggcucccggaccgccacgagccuggaccuggagugggacaacuccgaggccgaggugcaggaguacaaggucguguacagcacccucgccggggagcaguaccacgaggugcuggucccccgcggcaucgggcccaccacccgggcgacccugacggaccucgugcccggcaccgaguacggcguggggaucuccgccgucaugaacagccagcagagcgugccggccaccaugaacgcccgcaccgagcuggacuccccccgggaccugauggugacggccagcuccgagaccagcaucucccugaucuggaccaaggcgagcggccccaucgaccacuaccgcaucaccuucacgcccuccagcgggaucgccuccgaggucaccgugccgaaggaccggaccagcuacacccucacggaccuggagcccggcgccgaguacaucaucuccgugaccgccgagcgcgggcggcagcagagccuggaguccaccgucgacgccuucaccggcuuccgccccaucagccaccuccacuucucccacgugacgagcuccagcgugaacaucaccugguccgaccccagcccgcccgcggaccggcugauccugaacuacagcccccgcgacgaggaggaggagaugauggaggucucccucgacgccaccaagcggcacgccgugcugaugggccugcagcccgccaccgaguacaucgugaaccucgucgccgugcacgggacggugaccagcgagccgaucgucggcuccaucaccaccgggaucgacccccccaaggacaucacgaucagcaacgugaccaaggacuccgugauggucagcuggucccccccgguggcgagcuucgacuacuaccgcguguccuaccggcccacccaggucggccgccuggacagcuccgugguccccaacaccgugacggaguucaccaucacccggcugaaccccgccaccgaguacgagaucagccucaacuccgugcgcgggcgcgaggagagcgagcggaucugcacgcugguccacaccgccauggacaacccgguggaccugaucgccaccaacaucacccccacggaggcgcuccugcaguggaaggcccccgugggcgaggucgagaacuacgugaucgugcugacccacuucgccgucgccggcgagaccauccucguggacgggguguccgaggaguuccgccuggucgaccugcucccgagcacccacuacaccgccacgauguacgcgaccaacggcccccugaccuccgggaccaucagcacgaacuucuccacccugcucgacccccccgccaaccugaccgccagcgaggugacccggcagagcgcccugaucuccuggcagccgccccgcgccgagaucgagaacuacgugcucacguacaagagcaccgacggcucccggaaggagcugaucgucgacgcggaggacaccuggauccgccuggagggccuccuggagaacaccgacuacacggugcugcuccaggccgcccaggacaccaccuggagcuccaucaccagcacggccuucaccaccgggggccggguguucccccacccccaggacugcgcccagcaccugaugaacggggacacccuguccggcgucuacccgaucuuccucaacggggagcugagccagaagcugcagguguacugcgacaugacgaccgacggcggcggguggaucguguuccagcgccggcagaacggccagaccgacuucuuccgcaagugggcggacuaccgggucggguucggcaacguggaggacgaguucuggcucgggcuggacaacauccaccgcaucaccucccagggccgguacgagcugcgcguggacaugcgggacggccaggaggccgccuucgccagcuacgaccgcuucuccgucgaggacagccggaaccucuacaagcugcgcaucggguccuacaacggcacggcgggggacagccuguccuaccaccagggccggcccuucagcaccgaggaccgcgacaacgacguggccgugaccaacugcgccauguccuacaagggggccuggugguacaagaacugccaccggaccaaccucaacggcaaguacggcgagagccgccacucccaggggaucaacugguaccacuggaagggccacgaguucagcauccccuucgucgagaugaagaugcgccccuacaaccaccggcugauggccgggcgcaagcggcagagccugcaguucuga

SEQ ID NO: 37957 - RNA, 5208 nt, Artificial Sequence
  derived and/or modified sequence opt1 from TNS1__Homo_sapiens__NP_072174
auguccgugucccggaccauggaggacuccugcgagcuggaccucguguacgugaccgagcggaucaucgccguguccuuccccuccaccgccaacgaggagaacuuccgcuccaaccugcgggaggucgcccagaugcugaaguccaagcacggcgggaacuaccuccuguucaaccuguccgagcgccggcccgacaucaccaagcuccacgccaaggugcuggaguucggcuggcccgaccugcacacccccgcccucgagaagaucugcagcaucugcaaggccauggacaccuggcugaacgccgacccccacaacguggucgugcugcacaacaaggggaaccgcggccggaucgggguggucaucgcggccuacaugcacuacuccaacaucagcgccuccgccgaccaggcgcucgaccgcuucgccaugaagcgguucuacgaggacaagaucgugcccaucggccagcccucccagcgccgguacgugcacuacuucuccggccugcugagcggguccaucaagaugaacaacaagccccucuuccugcaccacgucaucaugcacggcauccccaacuucgagagcaagggcgggugccgccccuuccugcggaucuaccaggccaugcagcccguguacacguccgggaucuacaacauccccggcgacagccagaccuccgugugcaucaccaucgagcccggccuccugcugaagggggacauccuccugaagugcuaccacaagaaguuccgcagccccgcccgggacgucaucuuccgcgugcaguuccacacgugcgccauccacgaccugggcguggucuucgggaaggaggaccucgacgacgcguucaaggacgaccgguuccccgaguacggcaagguggaguucguguucagcuacggccccgagaagauccaggggauggagcaccuggagaacggccccuccgucagcguggacuacaacacguccgacccccugauccgcugggacagcuacgacaacuucuccgggcaccgggacgacggcauggaggagguggucgggcacacccagggcccccucgacggcagccuguacgccaaggugaagaagaaggacucccugcacgggagcaccggcgccgucaacgccacccgccccacgcucuccgccacccccaaccacguggagcacacccugagcguguccagcgacuccgggaacagcaccgcguccacgaagaccgacaagaccgacgagcccguccccggcgccagcuccgccaccgccgcccugagcccccaggagaagcgggagcucgaccgccugcuguccggguucggccucgagcgcgagaagcagggcgcgauguaccacacgcagcaccuccgcagccgccccgccgggggcagcgccgugccguccagcgggcggcacgugguccccgcccaggugcacgugaacggcggggcccuggcguccgagcgcgagaccgacauccuggacgacgagcugcccaaccaggacggccacagcgccggcuccauggggacccugagcucccucgacggcgucaccaacacgagcgagggcggguaccccgaggcccuguccccgcugaccaacggccucgacaagagcuaccccauggagcccauggugaacgggggcggguacccguacgaguccgccagccgggcgggccccgcccacgccgggcacaccgcccccaugcgccccuccuacagcgcccaggagggccuggcgggcuaccagcgggaggggccgcaccccgccuggccccagcccgugaccacgucccacuacgcccacgacccgagcggcauguuccgcucccagagcuucagcgaggccgagccccagcugccgcccgccccgguccgcggcggguccagccgcgaggcggugcagcgggggcucaacuccuggcagcagcagcagcagcagcagcagcagccccggccgccgccccggcagcaggagcgcgcccaccuggagagccugguggccucccggcccagcccccagccccuggccgagacccccauccccucccuccccgaguucccccgcgccgcgagccagcaggagaucgagcaguccaucgagacccugaacaugcugaugcucgaccuggagccggccagcgccgccgcgccccugcacaagucccagagcguccccggggccuggccgggcgccagcccccugagcucccagccccugagcggguccagccggcagucccacccccugacccagagccgcagcggcuacaucccguccgggcacagccucggcacgcccgagcccgcgccccgggccucccuggagagcgugccgcccgggcgcuccuacagccccuacgacuaccagcccugccuggcgggcccgaaccaggacuuccacuccaagagccccgccuccagcucccuccccgccuuccugcccaccacccacagcccgcccggcccccagcagcccccggccucccugcccgggcucaccgcccagccccugcugagccccaaggaggcgacguccgacccgagccgcacccccgaggaggagccccucaaccuggagggccugguggcccaccgggucgccggggugcaggcccgcgagaagcagcccgccgagccgcccgcgccccuccggcgccgggccgccuccgacggccaguacgagaaccagagcccggaggccaccagcccccgcagccccggggugcggagccccguccagugcguguccccggagcuggcgcugaccaucgcccucaaccccggcggccgccccaaggagccccaccuccacagcuacaaggaggccuucgaggagauggaggggaccuccccgagcagcccgccgcccagcggcgugcgguccccgcccgggcuggccaagacgccccucagcgcccugggccugaagccccacaacccggcggacauccuccugcaccccaccggcgucacccgccggcgcauccagcccgaggaggacgaggggaagguggugguccggcuguccgaggagccccgcagcuacguggaguccguggcccggaccgccgucgccggcccgcgcgcccaggacagcgagcccaaguccuucagcgcgcccgccacgcaggccuacgggcacgagaucccccuccggaacggcacccucgggggcuccuucgugagcccgagcccccugagcaccuccagccccauccucagcgccgacuccaccagcgugggcuccuuccccagcggggaguccagcgaccagggcccgcgcacgcccacccagccccugcuggaguccggguuccggagcggcucccucgggcagccgagccccuccgcccagcgcaacuaccagagcuccagcccccugcccaccgucggcuccagcuacuccagcccggacuacucccugcagcacuucagcagcucccccgagagccaggcgcgggcccaguucuccguggccggcgugcacaccguccccgggagcccccaggcccgccaccgcacggugggcaccaacaccccgcccucccccggguucggcuggcgggccaucaaccccagcauggcggccccguccagccccucccucagccaccaccagaugauggggccgcccggcaccggcuuccacggguccacggugagcuccccgcagagcuccgccgccaccacccccggcagccccucccugugccgccaccccgcgggggucuaccaggugagcggccugcacaacaagguggccaccacgccgggcucccccagccucgggcggcaccccggcgcccaccaggggaaccuggccagcggccugcacuccaacgccaucgcgagccccggguccccgagccucggccgccaccugggcggguccggcagcgucgugcccgggucccccugccuggaccggcacguggccuacggcggguacagcaccccggaggaccgccggcccacccucucccgccagagcuccgccagcggcuaccaggcccccuccacccccagcuucccggucucccccgccuacuaccccggccugagcucccccgcgacgagcccgagccccgacuccgccgccuuccggcaggggagccccacccccgcccugccggagaagcgccggauguccgugggcgaccgcgccgggagccuccccaacuacgcgaccaucaacggcaagguguccagccccgucgccuccgggaugagcucccccagcggcggcuccaccgugagcuucucccacacgcugccggacuucagcaaguacuccaugcccgacaacagccccgagacccgggccaaggugaaguucguccaggacaccuccaaguacugguacaagcccgagaucagccgcgagcaggccaucgcgcugcucaaggaccaggagccgggggccuucaucauccgggacucccacagcuuccgcggcgccuacgggcuggccaugaaggugagcagcccgccgcccaccaucaugcagcagaacaagaagggcgacaugacgcacgagcugguccggcacuuccucaucgagaccgggccgcgcggcgugaagcugaagggcugccccaacgagcccaacuucgggagccuguccgcccucguguaccagcacagcaucaucccccuggcgcugccgugcaagcucgucauccccaaccgggaccccaccgacgaguccaaggacagcuccggcccggccaacagcaccgccgaccugcugaagcagggggccgccugcaacguccuguucgugaacuccgucgacauggagagccugacgggcccccaggcgaucuccaaggccaccagcgagacccuggccgccgaccccacccccgccgcgaccaucgugcacuucaagguguccgcccagggcaucacgcucaccgacaaccagcgcaagcuguucuuccgccggcacuacccgcugaacaccgucaccuucugcgaccucgacccccaggagcgcaaguggaugaagacggagggcggcgcccccgccaagcuguucggguucguggcgcggaagcagggcagcaccaccgacaacgccugccaccuguucgccgagcucgaccccaaccagccggccuccgccaucgugaacuucgucagcaaggugaugcugaacgcggggcagaagcgcuga

SEQ ID NO: 37958 - RNA, 4260 nt, Artificial Sequence
  derived and/or modified sequence opt1 from TNS2__Homo_sapiens__NP_056134
auggacggcgggggcgugugcgucgggcgcggcgaccugcucagcuccccccaggcccuggggcagcugcuccggaaggagagccgcccgcggcgcgccaugaagccccggaaggcggagccccacuccuuccgcgagaagguguuccggaagaagcccccggugugcgccgucugcaaggugaccaucgacggcaccggcgugagcugccgcgucugcaagguggccacgcaccggaagugcgaggccaaggugaccuccgccugccaggcgcugccccccgucgagcugcgccggaacaccgcccccgugcgccggaucgagcaccucgggagcaccaagucccugaaccacagcaagcagcgcuccacgcugccgcggagcuucucccucgacccccugauggagcgccggugggaccuggaccucaccuacgugaccgagcgcauccuggccgccgcguuccccgcccggcccgacgagcagcgccaccggggccaccugcgcgagcucgcccacguccugcagagcaagcaccgcgacaaguaccugcucuucaaccuguccgagaagcggcacgaccugacccgccucaacccgaaggugcaggacuucggguggcccgagcugcacgcccccccccuggacaagcucugcagcaucugcaaggccauggagacguggcuguccgcggacccgcagcacguggucgugcuguacugcaagggcaacaaggggaagcucggcgugaucgucagcgccuacaugcacuacuccaagaucagcgccggcgccgaccaggcccuggcgacccugaccaugcggaaguucugcgaggacaagguggccaccgagcuccagcccucccagcgccgguacaucagcuacuucagcgggcugcuguccggcagcauccgcaugaacuccagcccccucuuccugcacuacgugcugauccccaugcucccggccuucgagcccgggacgggcuuccagcccuuccugaagaucuaccaguccaugcagcuggucuacaccagcggcguguaccacaucgccgggcccggcccgcagcagcucugcaucucccuggagcccgcccugcuccugaagggggacgugauggucaccugcuaccacaagggcgggcggggcaccgaccgcacgcugguguuccggguccaguuccacaccugcaccauccacggcccccagcucaccuuccccaaggaccagcuggacgaggcguggacggacgagcgcuucccguuccaggccagcguggaguucguguucuccagcucccccgagaagaucaaggggagcaccccccggaacgacccguccgucagcguggacuacaacaccaccgagcccgccgugcgcugggacuccuacgagaacuucaaccagcaccacgaggacagcgucgacggcucccugacgcacacccgggggccccucgacggcagccccuacgcccaggugcagcgcccgccccggcagaccccccccgccccgucccccgagccccccccgccccccaugcugagcgugagcuccgacagcgggcacuccagcacccugacgaccgagcccgcggccgaguccccgggccgccccccccccaccgccgccgagcggcaggagcuggaccgccuccugggcgggugcggcgucgcgagcgggggccggggggccggccgcgagaccgccauccuggacgacgaggagcagccgacggugggcgggggcccccaccucgggguguaccccggccaccgccccggccugucccggcacugcagcugccgccagggguaccgggagccgugcggcguccccaacgggggcuacuaccgccccgaggggacccuggagcggcgccggcucgccuacggcggcuacgagggguccccgcagggcuacgccgaggcgagcauggagaagcgccggcugugccgcucccugagcgaggggcucuaccccuacccccccgagaugggcaagccggccaccggggacuucggcuaccgggcccccggcuaccgcgagguggugauccuggaggaccccgggcugcccgcccucuacccgugccccgccugcgaggagaagcuggcgcugcccaccgccgcccucuacggccugcggcuggagcgcgaggccggggagggcugggccuccgaggcggggaagccccuccugcacccgguccggcccggccacccccugccccuccugcugccggccugcggccaccaccacgcccccaugcccgacuacagcugccucaagcccccgaaggccggggaggagggccacgaggggugcuccuacacgaugugccccgagggccgcuacgggcaccccggcuaccccgcgcuggugaccuacagcuacggcggggccgugccguccuacugccccgccuacggccgggucccccacagcugcgggagccccggcgagggccgcggguacccgucccccggcgcccacagcccccgggccggguccaucagcccgggcuccccccccuacccccagagccgcaagcuguccuacgagaucccgaccgaggaggggggcgaccgguacccccuccccggccaccuggcgagcgccgggccccuggccuccgccgagagccucgagccgguguccuggcgcgagggccccagcgggcacuccacccugccccgcagcccccgggacgccccgugcuccgcgagcuccgagcugagcggccccuccaccccccuccacacgagcagccccgugcaggggaaggaguccacccgccggcaggacacccgcagcccgaccuccgcccccacgcagcggcugagccccggcgaggcccugcccccggucucccaggccggcaccgggaaggcccccgagcuccccagcggcuccgggcccgagccgcuggcgcccagccccgugucccccaccuucccgcccagcucccccagcgacuggccgcaggagcgcucccccggcgggcacagcgacggcgccuccccccggagccccgugccgaccacgcugcccggccuccgccacgcccccuggcaggggccccggggcccgcccgacucccccgacgggagcccccugaccccgguccccucccagaugcccuggcugguggccagccccgagccgccccagagcucccccacccccgcguucccgcucgccgccagcuacgacaccaacggccugucccagcccccccugcccgagaagcgccaccucccgggccccgggcagcagcccggcccgugggggcccgagcaggccagcucccccgcccggggcaucagccaccacgugacguucgcgccccugcuguccgacaacgucccgcagacccccgagccccccacccaggagagccaguccaacgugaaguucgugcaggacaccagcaaguucugguacaagccgcaccucucccgcgaccaggccaucgcccugcugaaggacaaggaccccggggccuuccucauccgggacagccacuccuuccagggcgccuacggccuggcgcugaaggucgccacgccccccccgagcgcccagcccuggaagggggaccccguggagcagcucgugcgccacuuccugaucgagaccggccccaagggggucaagaucaagggcugcccguccgagcccuacuucgggagccuguccgcccucgugagccagcacuccaucagccccaucagccugcccugcugccugcggaucccguccaaggacccccucgaggagacccccgaggcccccgugccgaccaacaugagcacggcggccgaccugcugcgccagggcgccgccugcuccguccucuaccugaccagcguggagaccgagucccugaccggcccccaggccguggcgcgggccagcuccgccgcccucagcugcuccccccgccccacgccggcggucgugcacuucaaggugagcgcccaggggaucacccugaccgacaaccagcggaagcuguucuuccgccgccacuaccccgucaacuccaucaccuucagcuccacggacccccaggaccggcgcuggaccaacccggacggcaccaccagcaagaucuucggguucguggccaagaagcccggcucccccugggagaacgugugccaccucuucgccgagcuggaccccgaccagccggccggggcgaucgucacguucaucaccaaggugcugcucggccagcggaaguga

SEQ ID NO: 37959 - RNA, 4686 nt, Artificial Sequence
  derived and/or modified sequence opt1 from TNS3__Homo_sapiens__XP_011513778
augugcagccgccagcgguccggcuucgggugcaucaccaacugguggaagaugggcacccgccaccccgcccacccggcccagcccgaggagcugacgagcucccuccacgcguucaagaacaaggccuucaagaagagcaaggugugcggggucugcaagcagaucaucgacggccaggggaucuccugccgggccugcaaguacagcugccacaagaagugcgaggccaagguggugauccccugcggcguccaggugcgccuggagcaggcccccggcuccagcacccuguccagcucccucugccgggacaagccgcugcgccccgugauccugagccccaccauggaggaggggcacggccucgaccugaccuacaucacggagcggaucaucgcggucuccuuccccgccgggugcagcgaggaguccuaccugcacaaccuccaggaggugacccgcaugcugaagagcaagcacggcgacaacuaccuggugcucaaccuguccgagaagcgguacgaccugaccaagcucaacccgaagaucauggacgucggguggcccgagcugcacgcccccccccuggacaagaugugcaccaucugcaaggcccaggagagcuggcucaacuccaaccugcagcacgugguggucauccacugccgcggcggcaaggggcggaucggcguggugaucagcagcuacaugcacuucacgaacgucuccgcgagcgccgaccaggcccuggaccgcuucgccaugaagaaguucuacgacgacaagguguccgcccucaugcagccgagccagaagcgguacgugcaguuccuguccgggcugcucagcggcuccgucaagaugaacgcgagcccccuguuccugcacuucgugauccuccacggcacccccaacuucgacaccgggggcgugugccgccccuuccugaagcuguaccaggccaugcagccggucuacaccuccgggaucuacaacgugggccccgagaaccccagccggaucugcaucgugaucgagcccgcccagcuccugaagggggacgucauggugaagugcuaccacaagaaguaccgcuccgccacgcgggacgucaucuuccgccugcaguuccacaccggcgccgugcagggcuacgggcucguguucggcaaggaggaccuggacaacgcgagcaaggacgaccgguucccggacuacgggaaggucgagcugguguucuccgccacccccgagaagauccagggcagcgagcaccucuacaacgaccacggggugaucgucgacuacaacaccacggacccccugauccgcugggacuccuacgagaaccugagcgccgacggcgaggugcuccacacccagggccccguggacgggucccuguacgccaagguccggaagaagagcuccagcgacccgggcauccccgggggcccccaggccauccccgcgaccaacagcccggaccacuccgaccacacccugagcguguccagcgacuccgggcacagcacggccuccgcccgcaccgacaagaccgaggagcgccucgcccccggcacccggcgcggccugagcgcccaggagaaggcggagcuggaccagcuccuguccggguucggccuggaggaccccgggagcucccucaaggagaugacggacgcccggagcaaguacuccggcacccgccacguggucccggcccaggugcacgugaacggcgacgccgcgcugaaggaccgggagaccgacauccuggacgacgagaugccccaccacgaccugcacagcgucgacucccucgggacccugagcuccagcgagggcccccagagcgcccaccuggggcccuucacgugccacaaguccagccagaacucccuccugagcgacggcuucggguccaacgugggcgaggacccgcagggcacccuggugcccgaccucgggcugggcauggacgggcccuacgagcgcgagcggaccuucggcagccgcgagcccaagcagccgcagccccugcuccggaagcccuccgucagcgcccagaugcaggccuacgggcaguccagcuacuccacccagacgugggugcgccagcagcagaugguggucgcccaccaguacagcuucgcgcccgacggcgaggcccggcuggugucccgcugcccggccgacaaccccggccuggugcaggcccagccccgggucccccucaccccgacccgcgggaccagcucccggguggccgugcagcgcggcgucgggagcggcccccacccccccgacacgcagcagccgucccccagcaaggcguucaagccccgguuccccggggaccagguggugaacggcgccggcccggagcuguccaccgggcccagccccggcagcccgacccuggacaucgaccaguccaucgagcagcucaaccgccugauccuggagcucgaccccaccuucgagcccauccccacccacaugaacgcccuggggagccaggccaacggcuccgucagcccggacuccguggggggcggccugcgggccagcucccgccuccccgacacgggggagggccccagccgcgcgaccgggcggcagggcuccagcgccgagcagccccugggcgggcgccugcggaagcucucccugggccaguacgacaacgacgccgggggccagcugccguucagcaagugcgccugggggaaggcgggcguggacuacgcccccaaccucccccccuucccgucccccgccgacgucaaggagaccaugacccccggcuacccccaggaccuggacaucaucgacgggcgcauccugagcuccaaggagagcaugugcuccacgccggccuuccccgugagccccgagacccccuacgugaagaccgcccuccggcacccgcccuucuccccccccgagccgccccugagcagccccgcgucccagcacaagggcgggcgcgagccccggagcugcccggagacccugacgcacgccgucggcauguccgagagccccaucgggcccaaguccaccaugcuccgcgccgacgccagcuccaccccgagcuuccagcaggccuucgcguccagcugcaccaucuccagcaacggccccggccagcggcgcgaguccagcuccagcgccgagcggcaguggguggaguccagccccaagcccauggugucccugcuggggagcggccgcccgacggggagcccccucuccgccgaguucagcggcacccggaaggacucccccguccugagcugcuuccccccguccgagcugcaggcccccuuccacagccacgagcucucccuggccgagccccccgacagccuggcgccgcccuccagccaggccuuccucggguucggcaccgcccccgugggcuccgggcugcccccggaggaggaccugggcgcccuccuggcgaacagccacggggccucccccacccccagcaucccccugacggccaccggcgccgccgacaacggcuuccucucccacaacuuccugaccguggcgccggggcacagcucccaccacagccccggccugcaggggcagggcgucacccuccccgggcagcccccgcugcccgagaagaagcgcgccuccgagggcgaccggagccugggcagcgugucccccagcuccagcggguucuccagcccccacuccggcagcacgaucuccaucccguuccccaacgugcuccccgacuucagcaaggccuccgaggccgccagcccgcugcccgacucccccggggacaagcuggucaucgugaaguucgugcaggacaccagcaaguucugguacaaggcggacaucucccgcgagcaggccaucgccaugcucaaggacaaggagcccggcagcuucaucguccgggacucccacagcuuccgcggggccuacggccuggccaugaagguggcgaccccgccccccuccgugcugcagcucaacaagaaggccggcgaccuggccaacgagcugguccggcacuuccucaucgagugcacccccaagggggugcgccugaagggcugcagcaacgagccguacuucgggagccugacggcccucgucugccagcacuccaucaccccccuggcccugcccugcaagcuccugauccccgagcgggacccgcuggaggagaucgcggagagcuccccccagaccgccgccaacagcgccgcggagcuccugaagcagggcgccgccugcaacgugugguaccugaacuccguggagauggagagccucaccgggcaccaggccauccagaaggcccuguccaucacgcugguccaggagccccccccggugagcaccgugguccacuucaagguguccgcgcagggcaucacccucaccgacaaccagcgcaagcuguucuuccgccggcacuaccccgugaacagcgucaucuucugcgcccuggacccccaggaccgcaaguggaucaaggacggccccuccagcaagguguucggguucguggcccggaagcagggcuccgccacggacaacgucugccaccucuucgccgagcacgacccggagcagcccgcgagcgccaucgugaacuucguguccaaggucaugaucgggagccccaagaagguguga

SEQ ID NO: 37960 - RNA, 2148 nt, Artificial Sequence
  derived and/or modified sequence opt1 from TNS4__Homo_sapiens__NP_116254
augagccaggugauguccagcccccugcucgccggcgggcacgccgucucccuggcgccgugcgacgagccccgccggacccugcaccccgcccccagcccgucccuccccccccagugcagcuacuacaccacggagggcuggggggcccaggcccugauggcccccgugccgugcaugggcccccccgggcgccugcagcaggcgccccagguggaggccaaggccaccugcuuccucccgucccccggcgagaaggcccugggcacccccgaggaccuggacagcuacaucgacuucucccucgagagccugaaccagaugauccuggagcucgaccccaccuuccagcugcugccgcccgggacgggcgggucccaggcggagcucgcccagagcaccauguccaugcggaagaaggaggagagcgaggcccuggacaucaaguacaucgaggucaccuccgcccgcagccggugccacgacggcccccagcacugcuccagccccuccgugaccccgcccuucgggagccugcgcagcggcggccuccugcugucccgggacgugccccgcgagacgcggagcuccagcgagucccucaucuucagcgggaaccagggccgcgggcaccagcggccccugccgcccuccgagggccugagcccccgccccccgaacucccccagcaucuccauccccugcaugggcagcaaggccuccagcccgcacgggcucggcuccccccuggucgcgagcccccggcuggagaagcgccucgggggccuggccccccagcgggggucccgcaucagcgugcuguccgccagcccggugagcgacgucuccuacauguucggcagcucccagagccuccugcacuccagcaacuccagccaccaguccagcucccggagccuggagucccccgccaacagcuccagcucccuccacagccugggcagcgugucccugugcacccgccccagcgacuuccaggccccccggaacccgacccucaccauggggcagccccgcacgccccacucccccccgcuggcgaaggagcacgccagcuccugcccccccagcaucaccaacuccaugguggacauccccaucguccugaucaacggcugcccggagcccgggagcucccccccccagcggaccccgggccaccagaacagcgugcagcccggggccgccucccccagcaaccccugcccggccacccgcuccaacagccagacgcucuccgacgcgcccuucaccaccugccccgagggcccggcccgcgacaugcagcccaccaugaaguucgugauggacacgagcaaguacugguucaagcccaacaucacccgggagcaggccaucgagcugcugcgcaaggaggagcccggcgccuucgucauccgggacuccagcuccuaccgcgggagcuucggccucgcccugaaggugcaggaggugccggcgagcgcccagucccggcccggggaggacagcaacgaccugauccgccacuuccucaucgaguccagcgccaagggcguccaccugaagggggccgacgaggagcccuacuucggcucccugagcgcguucgugugccagcacuccaucauggcccucgcccugcccugcaagcugaccaucccgcagcgggagcugggcggggccgacggcgccagcgacuccaccgacagccccgcguccugccagaagaagagcgccgggugccacacgcucuaccuguccagcguguccgucgagacccugaccggcgcccucgccgugcagaaggccaucagcaccacguucgagcgcgacauccugcccacccccaccgugguccacuucaaggugaccgagcagggcaucacgcugaccgacguccagcggaagguguucuuccgccggcacuacccgcucaccacccugcgcuucugcgggauggaccccgagcagcggaaguggcagaaguacugcaagcccuccuggaucuucggcuucguggcgaagagccagacggagccccaggagaacgucugccaccuguucgccgaguacgacauggugcagccggccucccaggugaucgggcucgucaccgcccugcugcaggacgccgagcgcauguga

SEQ ID NO: 37961 - RNA, 12729 nt, Artificial Sequence
  derived and/or modified sequence opt1 from TNXB__Homo_sapiens__NP_061978
augaugcccgcccaguacgcccugaccagcucccucgugcugcugguccuccugagcaccgcgcgcgccggcccguucuccagccgguccaacgugacgcugcccgccccccgccccccgccccagcccgggggccacaccgugggggccggcgucgggagccccuccagccagcucuacgagcacaccguggagggcggcgagaagcagguggucuucacccaccggaucaaccugccgcccuccacggggugcggcugcccccccgggaccgagccgcccgugcuggccagcgaggugcaggcgcuccgcguccggcuggagauccuggaggagcucgugaagggccugaaggagcagugcaccgggggcugcugccccgccuccgcccaggccggcaccgggcagacggacgugcgcacccugugcagccuccacggcgucuucgaccugucccggugcaccugcagcugcgagcccggguggggcggcccgaccugcuccgaccccacggacgcggagaucccccccagcuccccgcccagcgccuccgggagcugccccgacgacugcaacgaccagggccgcugcgugcgggggcgcugcgugugcuuccccggcuacaccgggccgagcugcggcuggcccuccugccccggcgacugccaggggcggggccgcugcguccagggggugugcgugugccgggccggcuucagcgggcccgacugcucccagcgcagcugcccgcggggcugcucccagcgcggccggugcgaggggggccgcugcgucugcgaccccggguacaccggcgacgacugcgggaugcggagcugcccccgcggcugcucccagcggggccgcugcgagaacgggcgcugcgugugcaacccgggcuacaccggggaggacugcggcgugcggagcugcccccgcggcugcucccagcgggggcgcugcaaggacggccggugcgucugcgaccccggguacacgggcgaggacugcgggacccgcagcugccccugggacugcggcgagggcgggcggugcguggacggccgcugcgugugcuggccgggguacaccggcgaggacugcuccacccggacgugcccccgcgacugccgggggcgcggccggugcgaggacggcgagugcaucugcgacaccggguacagcggcgacgacugcgggguccgcuccugccccggcgacugcaaccagcgggggcgcugcgaggacggccggugcgugugcuggcccggcuacaccgggaccgacugcggcagccgcgccugcccgcgggacugccgcgggcgcggccggugcgagaacggggucugcgugugcaacgccggcuacuccggcgaggacugcggggugcgcagcugccccggcgacugccgggggcgcggccggugcgaguccggccgcugcaugugcuggcccggguacacgggccgggacugcgggacccgcgcgugccccggcgacugccgggggcgcggccggugcgucgacggccgcugcgugugcaacccgggguucaccggcgaggacugcgggagccggcgcugccccggcgacugccgggggcacggccugugcgaggacggcgugugcgucugcgacgccggguacuccggcgaggacugcagcacccgcagcugccccgggggcugccgggggcgcggccagugccucgacggccggugcgugugcgaggacggguacuccggcgaggacugcggggugcgccagugccccaacgacugcagccagcacggcgucugccaggacggcgugugcaucugcugggagggguacguguccgaggacugcagcauccggacgugcccguccaacugccacggccgcgggcgcugcgaggagggccggugccugugcgaccccggguacaccggccccaccugcgccacccgcaugugccccgccgacugccggggccgcgggcggugcguccagggcgugugccugugccacgugggguacggcggggaggacugcggccaggaggagccgcccgccagcgcgugccccggcgggugcggcccccgcgagcucugccgggccgggcagugcgucugcguggagggcuuccgcgggccggacugcgccauccagacgugccccggcgacugccggggccgcggggagugccacgacggcuccugcgugugcaaggacggguacgccggcgaggacugcggggaggagguccccaccaucgagggcaugcggaugcaccugcuggaggagaccaccgugcgcacggaguggaccccggcccccggccccguggacgcguacgagauccaguucauccccaccaccgagggggccagcccgcccuucaccgcccggguccccuccagcgccuccgccuacgaccagcgcggccucgcgcccgggcaggaguaccaggugacggugcgggcccugcgcggcaccagcuggggccugccggccuccaagaccaucaccacgaugaucgacgggccccaggaccuccgggucguggccgugacccccaccacccuggagcugggcuggcuccgcccccaggcggaggucgaccgguucguggugagcuacgucuccgccgggaaccagcgcgugcgccuggaggugccgcccgaggccgacggcacgcugcucaccgaccugaugcccggggucgaguacguggugaccgucaccgccgagcggggccgcgccgugagcuaccccgcguccgugcgggccaacacgggcagcagcccgcuggggcuccugggcaccaccgacgagcccccccccuccgggccgagcaccacgcagggcgcccaggccccccugcuccagcagcgcccccaggagcugggggagcugcggguccucggccgcgacgagaccggccggcugcgcgugguguggaccgcccagcccgacaccuucgcguacuuccagcugcggaugcgcgucccggaggggcccggcgcccacgaggaggugcuccccggggacgugcggcaggcccugguccccccgccccccccgggcacgcccuacgagcugucccuccacggggugccccccggcggcaagccgagcgaccccaucaucuaccaggggaucauggacaaggacgaggagaagcccggcaaguccagcgggcccccgcgccugggcgagcugaccgugaccgaccggaccuccgacagccugcuccugcgcuggacgguccccgagggggaguucgacuccuucgugauccaguacaaggaccgggacggccagccccaggugguccccguggagggcccgcagcgcagcgccgucaucaccucccuggaccccgggcggaaguacaaguucgugcucuacggcuucguggggaagaagcgccacggcccccuggucgccgaggcgaagauccugccccagagcgacccgucccccggcacccccccccaccucgggaaccugugggugaccgacccgacgcccgacagccugcaccucuccuggaccgugcccgagggccaguucgacaccuucaugguccaguaccgggaccgcgacgggcggccccagguggugccggucgagggccccgagcgcagcuucgugguguccagccuggaccccgaccacaaguaccgcuucacccuguucgggaucgccaacaagaagcgguacggcccccucacggccgacggcaccaccgccccggagcgcaaggaggagcccccccggccggaguuccuggagcagccccugcucggggagcugaccgucacgggcgugacccccgacucccugcgccucagcuggaccguggcgcaggggcccuucgacagcuucaugguccaguacaaggacgcccagggccagccgcaggccgugcccguggccggggacgagaacgaggucaccgugcccggccuggaccccgaccggaaguacaagaugaaccuguacggccuccgcgggcggcagcgcgugggcccggaguccgucguggccaagaccgcgccccaggaggacguggacgagacgcccagccccaccgagcuggggaccgaggccccggagucccccgaggagccccugcucggcgagcugaccgucacggggagcucccccgacagccugucccucuucuggaccgugccgcagggcagcuucgacuccuucaccgugcaguacaaggaccgggacggccgcccccgggccguccgcguggggggcaaggagagcgaggugaccgucgggggccuggagcccggccacaaguacaagaugcaccuguacgggcuccacgagggccagcggguggggcccguguccgccgucggcgugacggccccgcagcaggaggagaccccccccgcgaccgagagcccccuggagccgcgccugggggagcucaccgugacggacgucacccccaacuccgugggccugagcuggaccgugcccgagggccaguucgacuccuucaucguccaguacaaggacaaggacgggcagccgcagguggugcccgucgccgccgaccagcgggaggugaccguguacaaccuggagcccgagcgcaaguacaagaugaacauguacggccuccacgacgggcagcggaugggcccccugagcgucgugaucgugacggccccgcugccccccgcccccgcgaccgaggccuccaagccgccccucgagccccgccugggggagcugaccgucaccgacaucacgcccgacagcgugggccucuccuggaccgugccggagggcgaguucgacagcuucgucgugcaguacaaggaccgggacgggcagccccaggucgugcccguggccgccgaccagcgcgaggucaccauccccgaccuggagccgagccgcaaguacaaguuccugcucuucggcauccaggacgggaagcggcgcucccccgugagcguggaggcgaagaccgucgcccggggcgacgccucccccggggcccccccgcgccugggcgagcugugggugacggaccccacccccgacagccuccggcuguccuggaccgugcccgagggccaguucgacagcuucgucgugcaguucaaggacaaggacgggccgcaggugguccccguggagggccacgagcgcuccgugaccgucacgccccuggacgccgggcggaaguaccgcuuccuccuguacggccugcucgggaagaagcggcacggcccccugaccgcggacggcaccaccgaggcccgcagcgccauggacgacacggggaccaagcggccgcccaagccccgccugggcgaggagcuccaggugaccaccgugacgcagaacuccgucgggcugagcuggaccgugccggagggccaguucgacuccuucgugguccaguacaaggaccgggacggccagccccagguggugcccgucgaggggagccugcgcgagguguccgugcccggccucgacccggcccaccgguacaagcugcugcucuacgggcugcaccacggcaagcgcgucgggcccaucagcgccguggcgaucaccgccggccgggaggagaccgagaccgagacgaccgcccccacccccccggcccccgagccccaccugggcgagcucaccguggaggaggccacgucccacacccugcaccugagcuggauggucaccgagggggaguucgacuccuucgagauccaguacaccgaccgcgacggccagcuccagauggugcggaucgggggcgaccgcaacgacaucacgcugagcgggcuggaguccgaccaccgguaccucgugacccuguacggcuucagcgacggcaagcacgucgggcccgugcacguggaggcgcugaccgucccggaggaggagaagcccagcgagccccccaccgccacgccggagccccccaucaagccccgccucggcgagcugaccgugaccgacgccaccccggacucccugagccucuccuggacggugcccgaggggcaguucgaccacuuccugguccaguaccgcaacggcgacgggcagcccaaggccgugcgggugcccggccacgaggagggcgucaccaucagcgggcuggagccggaccacaaguacaagaugaaccucuacggcuuccacgggggccagcgcaugggccccguguccguggucggggugaccgccgcggaggaggagacccccagccccacggagccguccauggaggcccccgagcccgccgaggagccgcugcugggcgagcucaccgugaccgggagcucccccgacagccugucccugagcuggaccgucccccagggccgguucgacuccuucacggugcaguacaaggaccgcgacgggcggccccaggugguccgcgugggcggcgaggagagcgaggucaccguggggggccucgagccggggcggaaguacaagaugcaccuguacggccugcacgaggggcgccgggugggccccgucuccgccgugggcgugaccgcgcccgaggaggagagccccgacgccccgcucgccaagcugcgccuggggcagaugaccguccgggacaucacguccgacagccucucccugagcuggaccgugcccgagggccaguucgaccacuuccuggugcaguucaagaacggggacggccagcccaaggccguccgcgugcccgggcacgaggacggcgugaccaucagcggccuggagccggaccacaaguacaagaugaaccucuacggguuccacggcgggcagcgggucggccccguguccgccguggggcugaccgcgcccggcaaggacgaggagauggcccccgccagcacggagccgcccacccccgagcccccgaucaagccccgccuggaggagcucaccgucaccgacgccacgcccgacucccugagccuguccuggaccgugcccgagggccaguucgaccacuuccucgugcaguacaagaacggggacggccagccgaaggccacccggguccccgggcacgaggaccgcgugaccaucagcggccuggagcccgacaacaaguacaagaugaaccuguacggcuuccacgggggccagcggguggggcccgucuccgcgaucggcgugacggccgccgaggaggagaccccgagccccaccgagcccuccauggaggccccggagccccccgaggagccccuccugggggagcugaccgugaccggcagcuccccggacagccucucccugagcuggacggucccccagggccgcuucgacuccuucaccgugcaguacaaggaccgggacgggcgcccccaggugguccgcgugggcggggaggagagcgaggugaccgucggcgggcuggagcccggccggaaguacaagaugcaccucuacggccugcacgaggggcgccgggugggcccgguguccaccgucggggugacggccccccaggaggacguggacgagacccccagccccaccgagccgggcaccgaggcgcccgggccccccgaggagccgcugcucggcgagcugacggucaccggcuccagccccgacagccugucccucagcuggaccgugccccaggggcgcuucgacuccuucaccgugcaguacaaggaccgggacggccgcccccaggccguccggguggggggccaggagagcaaggugacgguccgcggccuggagccggggcggaaguacaagaugcaccuguacggccuccacgaggggcgccggcugggccccguguccgccgugggggucaccgaggacgaggccgagaccacccaggcggugcccacgaugacccccgagccgcccaucaagccccgccugggcgagcucaccaugaccgacgccacgccggacagccugucccugagcuggaccgugcccgagggccaguucgaccacuuccucguccaguaccggaacggggacggccagcccaaggccgugcgcgugcccgggcacgaggacggcgucaccaucuccgggcuggagccggaccacaaguacaagaugaaccuguacggcuuccacggcgggcagcgggugggccccaucagcgucaucggggugaccgccgccgaggaggagacgcccucccccaccgagcucagcaccgaggcgccggagccccccgaggagccccugcugggcgagcucaccgugacgggguccagcccggacucccugagccuguccuggaccaucccccagggccacuucgacagcuucaccguccaguacaaggaccgcgacggccggccccaggugaugcgcgugcggggggaggagagcgaggucaccgugggcgggcucgagcccggccgcaaguacaagaugcaccuguacgggcugcacgagggccggcgcgugggcccggucuccacggugggggugaccgaggacgaggccgagaccacccaggccguccccacgaccacccccgagcccccgaacaagccccgccucggcgagcugaccgugaccgacgccacgcccgacagccugucccucagcuggauggugcccgaggggcaguucgaccacuuccugguccaguaccggaacggcgacggccagccgaagguggugcgcguccccgggcacgaggacggcgugaccaucuccgggcuggagcccgaccacaaguacaagaugaaccucuacggcuuccacgggggccagcgggugggccccaucagcgucaucggggugaccgccgcggaggaggagaccccggcccccacggagcccuccaccgaggccccggagccccccgaggagccccugcugggcgagcucaccgugaccgggagcuccccggacagccugucccugagcuggacgaucccccagggccgcuucgacuccuucaccguccaguacaaggaccgggacgggcgcccccagguggugcggguccgcggcgaggagagcgaggugaccgugggcgggcucgagcccggcugcaaguacaagaugcaccuguacgggcugcacgagggccagcgggucgggccgguguccgccgugggcgucaccgcccccaaggacgaggcggagacgacccaggccgugcccaccaugacccccgagccgcccaucaagccccgccucggcgagcugacggugaccgacgccacccccgacagccugucccucagcuggauggucccggaggggcaguucgaccacuuccuggugcaguaccggaacggcgacgggcagcccaaggccgugcgcguccccggccacgaggacggggugaccaucuccggccuggagcccgaccacaaguacaagaugaaccucuacggcuuccacgggggccagcggguggggccggucagcgcgaucggcgugacggaggaggagacccccagccccaccgagcccuccaccgaggccccggaggcccccgaggagccccugcugggcgagcucacggugaccgggagcucccccgacagccugucccugagcuggaccgucccgcagggccgcuucgacuccuucaccgugcaguacaaggaccgggacgggcagccccaggugguccgcgugcggggcgaggagagcgaggugacggucgggggccucgagcccggccgcaaguacaagaugcaccuguacgggcugcacgagggccagcggguggggccggucuccaccgugggcaucaccgccccccuccccaccccccugccgguggagccccgccugggggagcucgccgucgcggccgugacgagcgacuccgugggccugagcuggaccgucgcccagggccccuucgacuccuuccuggugcaguaccgcgacgcccaggggcagccccaggccgugccggucagcggcgaccuccgggcgguggccguguccgggcuggaccccgcccgcaaguacaaguuccugcucuucggccugcagaacgggaagcggcacggccccguccccguggaggcccgcaccgccccggacaccaagcccagcccccggcugggcgagcucacggugaccgacgcgacccccgacuccgucgggcugagcuggaccgugccggagggcgaguucgacuccuucgugguccaguacaaggacaaggacgggcgccugcagguggugcccgucgccgccaaccagcgggaggugaccgugcagggccucgagcccagccgcaaguaccgguuccugcuguacggccucagcgggcgcaagcggcugggccccaucuccgccgacagcacgaccgccccgcuggagaaggagcuccccccccaccugggggagcugaccgucgcggaggagaccuccagcucccuccgccugagcuggacgguggcccagggccccuucgacuccuucgugguccaguaccgggacaccgacgggcagccgcgcgccgugcccguggccgcggaccagcggaccgucaccguggaggaccuggagcccggcaagaaguacaaguuccuccuguacggccugcuggggggcaagcgccucgggccggugagcgcccugggcaugacggcccccgaggaggacacccccgcccccgagcuggccccggaggcgcccgagccccccgaggagccgcggcucgggguccugaccgugaccgacacgacccccgacuccaugcgccugagcugguccguggcccagggccccuucgacagcuucgucgugcaguacgaggacaccaacggccagccccaggcccuccugguggacggggaccaguccaagauccugaucagcggccucgagccguccacccccuaccgguuccugcuguacgggcuccacgagggcaagcgccuggggccccugagcgccgagggcacgaccggccucgcccccgcggggcagaccuccgaggagagccggccgcgccugucccagcugagcgucaccgacgugacgaccagcucccuccgccugaacugggaggccccccccggcgccuucgacagcuuccugcuccgguucggggugcccuccccgagcacccuggagccccacccccgcccccugcuccagcgggagcugauggucccgggcacccgccacuccgccgugcugcgggaccuccgcagcgggacgcuguacucccugacccucuacggccugcggggcccccacaaggccgacagcauccaggggaccgcgcgcacccugucccccgugcucgagagcccccgggaccugcaguucuccgagauccgcgagacgagcgccaaggucaacuggaugccgccccccucccgggccgacagcuucaagguguccuaccagcuggccgacggcggggagccgcagagcgugcaggucgacggccaggcgcgcacccagaagcuccagggccugauccccggggcccgguacgaggugaccguggucuccgugcgcggcuucgaggagagcgagccccugaccggguuccucacgaccguccccgacggcccgacccagcugcgggcccugaaccucaccgagggguucgccgugcugcacuggaagcccccccagaaccccguggacacguacgacguccaggugaccgccccgggcgcgcccccccugcaggccgagacccccggcuccgccguggacuacccgcuccacgaccugguccugcacaccaacuacaccgccacggugcgcgggcuccggggccccaaccugaccagccccgccagcaucaccuucaccacggggcuggaggcgccccgcgaccucgaggccaaggaggugaccccgcggaccgcccugcugaccuggacggagccccccguccgccccgccggcuaccuccuguccuuccacaccccggggggccagaaccaggagauccugcuccccggcgggaucaccagccaccagcugcugggccucuuccccuccaccagcuacaacgcccgccugcaggcgaugugggggcagucccugcuccccccggugagcacguccuucaccaccggcgggcugcggauccccuucccccgcgacugcggcgaggagaugcagaacggcgccggggccagccggaccuccacgaucuuccugaacggcaaccgcgagcggccccucaacguguucugcgacauggagaccgacgggggcggcuggcuggucuuccagcgccggauggacgggcagaccgacuucuggcgcgacugggaggacuacgcccacggcuucgggaacaucagcggcgaguucuggcuggggaacgaggcgcuccacucccugacccaggccggcgacuacagcaugcggguggaccugcgcgccggcgacgaggccguguucgcccaguacgacuccuuccacgucgacagcgcggccgaguacuaccggcuccaccuggagggguaccacggcacggccggggacuccaugagcuaccacuccggcagcguguucuccgcccgcgaccgggacccgaacagccugcucaucagcugcgccguguccuaccgcggggcguggugguaccggaacugccacuacgccaaccugaacggccuguacggcagcaccgucgaccaccaggggguguccugguaccacuggaagggcuucgaguucagcgugcccuucaccgagaugaagcuccgcccccggaacuuccgcuccccggccgggggcggguga

SEQ ID NO: 37962 - RNA, 1038 nt, Artificial Sequence
  derived and/or modified sequence opt1 from TOB1__Homo_sapiens__NP_001230806
augcagcuggagauccagguggcccucaacuucaucaucagcuaccuguacaacaagcugccccgccggcgcgucaacaucuucggcgaggagcucgagcggcugcugaagaagaaguacgaggggcacugguaccccgagaagcccuacaagggcuccggguuccgcugcauccacaucggcgagaagguggaccccgugaucgagcaggccagcaaggaguccgggcucgacaucgacgacguccggggcaaccugccccaggaccugagcguguggaucgaccccuucgagguguccuaccagaucggcgagaaggggcccgucaaggugcucuacguggacgacaacaacgagaacggcugcgagcuggacaaggagaucaagaacagcuucaaccccgaggcgcaggucuucaugcccaucuccgacccggccagcuccgugagcuccagccccuccccgcccuucgggcacagcgccgccgugucccccaccuucaugccccgcagcacccagccccugacguucaccaccgccaccuucgcggccacgaaguucggcuccaccaagaugaagaacagcgggcgguccaacaaggucgcccgcaccagccccaucaaccucggccugaacgugaacgaccugcucaagcagaaggccaucagcuccagcaugcacucccuguacggccuggggcucggcagccagcagcagccgcagcagcagcagcagcccgcgcagccgccgcccccgccgccgccgccccagcagcagcagcagcagaagaccuccgcccugagccccaacgccaaggaguucaucuuccccaacaugcaggggcagggcuccagcacgaacggcauguuccccggggacagcccccugaaccucagcccccugcaguacuccaacgccuucgacguguucgccgcguacggcgggcugaacgagaaguccuucgucgacggccucaacuucucccugaacaacaugcaguacagcaaccagcaguuccagcccgugauggccaacuga

SEQ ID NO: 37963 - RNA, 1035 nt, Artificial Sequence
  derived and/or modified sequence opt1 from TOB2__Homo_sapiens__NP_057356
augcagcuggagaucaagguggcccucaacuucaucaucagcuaccuguacaacaagcugccccgccggcgcgccgaccucuucggcgaggagcuggagcggcugcucaagaagaaguacgaggggcacugguacccggagaagccccugaagggcuccggguuccgcugcguccacaucggcgagaugguggaccccguggucgagcuggcggccaagcggagcgggcucgccguggaggacgugcgcgccaacguccccgaggagcuguccguguggaucgacccguucgaggugagcuaccagaucggcgagaagggcgccgucaaggugcuguaccucgacgacuccgaggggugcggcgcgcccgagcuggacaaggagaucaagagcuccuucaaccccgacgcccagguguucguccccaucgggagccaggacuccagccuguccaacagcccgucccccagcuucggccagucccccagccccaccuucaucccgcgguccgcccagcccaucaccuucacgaccgccagcuucgcggccaccaaguucggguccaccaagaugaagaagggcggcggggccgccagcggcgggggcguggccagcuccggcgccgggggccagcagccgccccagcagccccgcauggcccggagccccacgaacucccuccugaagcacaagagccugucccucagcaugcacucccugaacuucaucaccgccaaccccgcgccccagagccagcuguccccgaacgccaaggaguucguguacaacgggggcgggagccccucccucuucuucgacgcggccgacggccagggcagcgggacccccggccccuucgggggcuccggggccgggaccugcaacagcuccagcuucgacauggcccaggucuucggcggcggcgccaacucccuguuccuggagaagacgccguucguggaggggcucagcuacaaccugaacaccaugcaguaccccucccagcaguuccagcccgugguccuggcgaacuga

SEQ ID NO: 37964 - RNA, 825 nt, Artificial Sequence
  derived and/or modified sequence opt1 from TOLLIP__Homo_sapiens__NP_061882
auggccaccaccgugagcacgcagcgcggccccgucuacaucggggagcugccgcaggacuuccuccggaucacccccacccagcagcagcgccaggugcagcuggacgcccaggcggcccagcagcugcaguacggcggggccgugggcaccgucgggcggcucaacaucacgguggugcaggccaagcuggccaagaacuacggcaugacccgcauggaccccuacugccggcugcgccucggcuacgcggucuacgagacccccaccgcccacaacggggccaagaacccgcgguggaacaaggugauccacugcacggugccgcccggcgucgacuccuucuaccuggagaucuucgacgagcgcgccuucagcauggacgaccggaucgcguggacccacaucaccauccccgagucccugcgccaggggaagguggaggacaagugguacagccucuccggccggcagggggacgacaaggagggcaugaucaaccuggugaugagcuacgcccugcuccccgccgccauggucaugccgccccagcccguggugcugaugcccaccgucuaccagcagggcgugggguacgugcccaucacgggcaugcccgccgucugcucccccgggauggugccgguggcgcugccgcccgccgccgucaacgcccagccccgcugcagcgaggaggaccucaaggccauccaggacauguuccccaacauggaccaggaggugauccgguccgugcuggaggcgcagcgcggcaacaaggacgccgccaucaacagccugcuccagaugggcgaggagcccuga

SEQ ID NO: 37965 - RNA, 1383 nt, Artificial Sequence
  derived and/or modified sequence opt1 from TOM1__Homo_sapiens__NP_001129201
auggagaucugcgacaucaucaacgagaccgaggagggccccaaggacgcccugcgcgccgugaagaagcggaucgucgggaacaagaacuuccacgaggugaugcucgcccugaccgugcuggagacgugcgucaagaacugcggccaccgcuuccacgugcucguggccagccaggacuucgucgaguccgugcuggugcggaccauccugccgaagaacaacccgcccaccaucguccacgacaaggugcucaaccugauccagagcugggccgacgccuuccgcuccagccccgaccugaccgggguggucacgaucuacgaggaccuccggcgcaagggccuggaguuccccaugaccgaccuggacaugcucucccccauccacacgccccagcggaccguguucaacagcgagacccaguccgggcaggacagcgugggcaccgacuccagccagcaggaggacuccggccagcacgccgcgccccugccggccccgcccauccugagcggggacacccccaucgcccccacccccgagcagaucggcaagcuccgcuccgagcuggagauggucagcgggaacgugcgggugauguccgagaugcugacggagcucguccccacccaggccgagcccgcggaccuggagcugcuccaggagcugaaccggaccugccgcgccaugcagcagcgcgugcuggagcucaucccgcagaucgccaacgagcagcugaccgaggagcugcucaucgugaacgacaaccugaacaacgucuuccugcggcacgagcgcuucgagcgguuccgcacgggccagaccaccaaggcccccagcgaggccgagcccgcggccgaccucaucgacauggggcccgacccggccgccaccggcaaccuguccagccagcuggccggcaugaaccucggguccagcagcgugcgggcgggccugcagucccuggaggccagcgggcgccucgaggacgaguucgacauguucgcccugacgcggggcuccagccuggccgaccagcgcaaggaggugaaguacgaggcgccccaggccaccgacggccucgccggggcccuggacgcccggcagcaguccaccggcgccauccccgucacccaggcgugccugauggaggacaucgagcaguggcucagcacggacguggggaacgacgccgaggagcccaagggcgucaccuccgaggggaaguucgacaaguuccuggaggagcgcgccaaggccgcggaccgccugccgaaccucagcucccccagcgccgagggcccgcccggcccgcccuccgggcccgcgccccggaagaagacccaggagaaggacgacgacaugcuguucgcccuguga

SEQ ID NO: 37966 - RNA, 1431 nt, Artificial Sequence
  derived and/or modified sequence opt1 from TOM1L1__Homo_sapiens__NP_005477
auggccuucggcaagagccaccgcgaccccuacgccaccuccguggggcaccugaucgagaaggcgaccuucgccggcguccagacggaggacugggggcaguucaugcacaucugcgacaucaucaacaccacccaggacggcccgaaggacgccgugaaggcccucaagaagcggaucagcaagaacuacaaccacaaggagauccagcugacccugucccucaucgacaugugcgugcagaacugcgggcccagcuuccagucccugaucgucaagaaggaguucgugaaggagaaccuggugaagcuccugaacccccgcuacaaccugccccucgacauccagaaccggauccugaacuucaucaagacguggagccagggcuucccgggcggggucgacguguccgaggugaaggaggucuaccuggaccucgugaagaagggcgugcaguucccgcccagcgaggccgaggcggagaccgcccgccaggagaccgcccagaucuccagcaacccgcccaccuccguccccacggcccccgcgcugagcuccgugaucgcccccaagaacagcaccgugacccugguccccgagcagaucgggaagcuccacuccgagcuggacauggugaagaugaacgugcgggucaugagcgccauccugauggagaacacccccggcuccgagaaccacgaggacaucgagcuccugcagaagcuguacaagacggggcgcgagaugcaggagcggaucauggaccuccuggugguggucgagaacgaggacgugaccguggagcugauccaggucaacgaggaccucaacaacgccauccugggcuacgagcgcuucacccggaaccagcagcgcauccuggagcagaacaagaaccagaaggaggccaccaacacgaccagcgagcccuccgcgcccagccaggaccuccuggaccugagcccgagcccccggaugccccgcgccacccucggcgagcugaacaccaugaacaaccagcuguccgggcucaacuucucccugcccagcuccgacgugacgaacaaccugaagccgagccuccacccccagaugaaccugcuggcccucgagaacaccgagaucccgcccuucgcccagcggaccucccagaaccugaccagcucccacgccuacgacaacuuccuggagcacagcaacuccgucuuccuccagcccgugagccugcagacgaucgcggccgcccccuccaaccagagccugccgccccuccccuccaaccaccccgccaugaccaagagcgaccugcagcccccgaacuacuacgaggugauggaguucgacccccuggcccccgcggucaccaccgaggccaucuacgaggagaucgacgcccaccagcacaagggcgcccagaacgacggggacuga

SEQ ID NO: 37967 - RNA, 438 nt, Artificial Sequence
  derived and/or modified sequence opt1 from TOMM20__Homo_sapiens__NP_055580
auggugggccgcaacagcgccaucgccgcgggggucugcggcgcccuguucaucggguacugcaucuacuucgaccggaagcgccgguccgaccccaacuucaagaaccgccuccgggagcgccggaagaagcagaagcuggccaaggagcgcgccggccugagcaagcucccggaccugaaggacgccgaggcggugcagaaguucuuccuggaggagauccagcucggggaggagcugcuggcccagggcgaguacgagaagggcguggaccaccucaccaacgccaucgccgucugcgggcagccccagcagcugcuccaggugcugcagcagacccugcccccgcccguguuccagaugcugcucacgaagcugcccaccaucucccagcggaucgucagcgcgcagucccuggccgaggacgacguggaguga

SEQ ID NO: 37968 - RNA, 930 nt, Artificial Sequence
  derived and/or modified sequence opt1 from TOMM34__Homo_sapiens__NP_006800
auggcccccaaguucccggacagcguggaggagcugcgcgccgcgggcaacgaguccuuccggaacgggcaguacgccgaggccagcgcccucuacggccgcgcccugcggguccugcaggcgcagggguccagcgaccccgaggaggaguccgugcucuacagcaaccgcgccgccugccaccugaaggacggcaacugccgggacugcaucaaggacugcaccuccgcccuggcgcucgugcccuucagcaucaagccccugcugcgccgggccuccgccuacgaggcccucgagaaguacccgauggccuacgucgacuacaagaccgugcugcagaucgacgacaacgugacgagcgcggucgaggggaucaaccgcaugacccgggcccugauggacucccucggccccgaguggcgccugaagcugcccagcaucccccucgugccgguguccgcccagaagcgguggaacagccugcccuccgagaaccacaaggagauggccaagagcaaguccaaggagaccaccgccacgaagaaccgcguccccagcgcgggcgacguggagaaggcccgggugcugaaggaggaggggaacgagcucgucaagaagggcaaccacaagaaggccaucgagaaguacuccgagagccugcugugcagcaaccucgaguccgccaccuacagcaaccgcgcccugugcuaccuggugcucaagcaguacaccgaggcggugaaggacugcaccgaggcccugaagcuggacgggaagaacgucaaggccuucuaccggcgcgcccaggcccacaaggcgcucaaggacuacaaguccagcuucgccgacaucuccaaccugcugcagaucgagccccggaacggcccggcccagaagcuccgccaggaggugaagcagaaccugcacuga

SEQ ID NO: 37969 - RNA, 1086 nt, Artificial Sequence
  derived and/or modified sequence opt1 from TOMM40__Homo_sapiens__NP_001122389
augggcaacgugcuggccgccagcagcccgcccgcggggcccccgcccccgcccgcccccgcccucgucggccugcccccgcccccgcccuccccgcccggguucacccugccgccccucggcgggucccugggcgccggcaccagcacgucccgcagcuccgagcggacccccggggccgcgaccgccagcgccuccggcgccgcggaggacggggccugcggcugccugcccaaccccgggaccuucgaggagugccaccgcaagugcaaggagcuguuccccauccagauggagggcgugaagcugacggugaacaagggccugagcaaccacuuccaggucaaccacaccguggcccucuccaccaucggggagagcaacuaccacuucggcgugaccuacgucgggacgaagcagcucucccccaccgaggccuuccccgugcuggugggcgacauggacaacagcggcucccucaacgcccaggucauccaccagcuggggcccggccugcggagcaagauggcgauccagacccagcaguccaaguucgugaacuggcaggucgacggggaguaccgcggcagcgacuucaccgccgccgugacgcucgggaaccccgacgugcuggugggcuccggcauccuggucgcccacuaccuccagagcaucacccccugccuggcccucgggggcgagcugguguaccaccggcgccccggggaggagggcaccgugaugagccuggcggggaaguacacccugaacaacuggcucgccacggucacccugggccaggccggcaugcacgccaccuacuaccacaaggccuccgaccagcugcaggucgggguggaguucgaggcgagcacccggaugcaggacacguccgugagcuucggcuaccagcucgaccugcccaaggccaaccugcuguucaagggguccguggacagcaacuggaucgugggcgccacccucgagaagaagcugcccccgcucccccugacccuggcccucggggccuuccugaaccaccgcaagaacaaguuccagugcggcuucggccugaccaucggguga

SEQ ID NO: 37970 - RNA, 1827 nt, Artificial Sequence
  derived and/or modified sequence opt1 from TOMM70A__Homo_sapiens__NP_055635
auggccgccagcaagcccguggaggcggccgucguggccgccgccgugcccuccagcggcuccggggucggcgggggcgggaccgcgggccccggcaccgggggccugccccgcuggcagcucgcccuggccgugggggcgccccugcuccugggcgcgggggccaucuaccuguggagccggcagcagcgccggcgcgaggcccggggccgcggcgacgccuccgggcucaagcggaacagcgagcgcaagacgccggagggccgggccucccccgcgcccgggagcggccaccccgagggcccgggggcccaccuggacaugaacucccuggaccgcgcccaggccgccaagaacaagggcaacaaguacuucaaggcggggaaguacgagcaggccauccagugcuacaccgaggccaucagccucugccccaccgagaagaacguggaccuguccaccuucuaccagaaccgggccgccgcguucgagcagcugcagaaguggaaggaggucgcccaggacugcacgaaggccguggagcucaaccccaaguacgugaaggcccuguuccgccgggccaaggcgcacgagaagcuggacaacaagaaggagugccucgaggacgucaccgccgugugcauccuggagggcuuccagaaccagcagagcaugcugcucgccgacaaggugcugaagcugcucgggaaggagaaggccaaggagaaguacaagaaccgcgagccccugaugccgagcccccaguucaucaagagcuacuucuccagcuucaccgacgacaucaucucccagcccaugcugaagggcgagaaguccgacgaggacaaggacaaggagggcgaggcgcucgaggucaaggagaacuccggguaccugaaggccaagcaguacauggaggaggagaacuacgacaagaucaucagcgagugcagcaaggagaucgacgccgagggcaaguacauggccgaggcccugcuccugcgggcgaccuucuaccugcucaucgggaacgccaacgccgccaagcccgaccuggacaaggugaucucccugaaggaggccaacgugaagcuccgcgcgaacgcccugaucaagcggggcagcauguacaugcagcagcagcagccgcugcucuccacgcaggacuucaacauggccgccgacaucgacccccagaacgccgacgucuaccaccaccgcgggcagcugaagauccugcucgaccagguggaggaggcgguggccgacuucgacgagugcauccggcugcgccccgagagcgcccuggcccaggcgcagaagugcuucgcccucuaccggcaggccuacaccggcaacaacuccagccagauccaggccgccaugaagggcuucgaggaggucaucaagaaguucccccgcugcgcggagggguacgcccuguacgcccaggcccugaccgaccagcagcaguucggcaaggccgacgagauguacgacaagugcaucgaccucgagccggacaacgcgaccacguacgugcacaaggggcugcugcagcuccaguggaagcaggaccuggaccgcggccuggagcugaucuccaaggccaucgagaucgacaacaagugcgacuucgccuacgagaccauggggaccaucgaggugcagcggggcaacauggagaaggccaucgacauguucaacaaggccaucaaccucgccaagagcgagauggagauggcccaccuguacucccugugcgacgccgcccacgcgcagaccgaggucgccaagaaguacggccucaagccgcccacgcuguga

SEQ ID NO: 37971 - RNA, 4137 nt, Artificial Sequence
  derived and/or modified sequence opt1 from TONSL__Homo_sapiens__NP_038460
augagccuggagcgcgagcuccggcagcuguccaaggccaaggccaaggcgcagcgcgccggccagcggcgcgaggaggccgcccugugccaccagcucggggagcugcuggccggccacgggcgguacgcggaggcccucgagcagcacuggcaggagcugcagcugcgcgagcgggccgacgacccccucggcugcgccguggcgcaccgcaagaucggggagcggcuggccgagauggaggacuacccggccgcccugcagcaccagcaccaguaccucgagcuggcccacagccugcgcaaccacaccgagcuccagcgggcgugggccaccaucggccgcacgcaccuggacaucuacgaccacugccagucccgggacgcccugcuccaggcccaggccgcguucgagaagucccuggccaucgucgacgaggagcuggagggcacccucgcccagggggagcugaacgagaugcgcacccggcuguaccucaaccugggccugaccuucgagucccuccagcagacggcccugugcaacgacuacuuccgcaagagcaucuuccuggccgagcagaaccaccucuacgaggaccuguuccgggcgcgcuacaaccuggggaccauccacuggcgggccggccagcacucccaggccaugcgcugccucgagggggcccgggagugcgcccacaccaugcgcaagcgcuucauggagagcgagugcugcguggugaucgcgcagguccugcaggaccugggcgacuuccucgccgccaagcgggcccugaagaaggcguaccgccugggcucccagaagcccgugcagcgggccgccaucugccagaaccuccagcacgugcuggccgucgugcgccugcagcagcagcucgaggaggccgaggggcgggacccccagggcgcgauggugaucugcgagcagcugggggaccuguucagcaaggccggcgacuucccccgcgccgccgaggccuaccagaagcagcuccgguucgcggagcugcuggaccgcccgggcgccgagcgggccaucauccacgucucccucgccaccacgcugggggacaugaaggaccaccacggcgccgugcgccacuacgaggaggagcugcggcugcgcagcgggaacgugcucgaggaggcgaagaccuggcugaacaucgcccugucccgggaggaggccggcgacgccuacgagcuccuggcgcccugcuuccagaaggcccugagcugcgcccagcaggcccagcgcccccagcuccagcggcagguccugcagcaccuccacaccgugcagcuccgccugcagccccaggaggccccggagaccgagacgcggcugcgcgagcucuccguggcggaggacgaggacgaggaggaggaggccgaggaggccgccgccaccgcggagagcgaggcccuggaggccggggaggucgagcugagcgagggcgaggacgacaccgacggccugacgccccagcuggaggaggacgaggagcugcaggggcaccucggccggcgcaaggggagcaaguggaaccgccggaacgacaugggcgagacccugcugcaccgcgccugcaucgaggggcagcuccggcgcgugcaggaccuggugcggcagggccacccccugaacccccgcgacuacugcggcuggaccccgcuccacgaggccugcaacuacgggcaccuggagaucguccgguuccugcucgaccacggcgcggccguggacgaccccgggggccaggggugcgagggcaucacgccccugcacgacgcccugaacugcggccacuucgagguggccgagcuccugcuggagcgcggggcguccgucacccuccggacccgcaagggccugagcccccuggagacccuccagcagugggugaagcuguaccggcgcgaccuggaccucgagacccggcagaaggcccgcgccauggagaugcugcugcaggccgccgcgagcgggcaggacccgcacuccagccaggccuuccacacccccuccagccuccuguucgaccccgagacguccccgccccugagccccugccccgagcccccguccaacagcacccggcuccccgaggccucccaggcccacgugcgcgucagccccggccaggccgcgcccgccauggcccggccgcgccggucccgccacggccccgccagcuccagcuccagcuccgagggggaggacagcgccggccccgcgcggccgucccagaagcgcccccgcugcagcgccaccgcccagcggguggccgccuggacccccgggcccgcgagcaaccgcgaggccgccacggccuccaccagccgggcggccuaccaggccgccauccgcggcgucggguccgcccagagccggcugggcccgggcccgccccgcgggcacuccaaggcgcuggcgccccaggccgcccucauccccgaggaggagugccuggccggcgacuggcuggagcucgacaugccccugacccggagccgccggccccgcccccgggggaccggcgacaaccgccggccguccagcacguccgggagcgacuccgaggagagccgcccccgggcccgcgccaagcagguccggcugaccugcaugcaguccugcagcgcccccgugaacgccggccccuccagccucgccuccgagccgcccggcagccccagcacgccccgcguguccgagccgagcggggacuccagcgcggccggccagccccuggggcccgcgcccccgccgcccauccgggugcgcgugcagguccaggaccaccuguuccucauccccgugccccacuccagcgacacccacuccguggccuggcuggccgagcaggccgcccagcgcuacuaccagaccugcggccugcucccccggcugacccugcgcaaggagggggcccuccuggcgccccaggaccugaucccggacguccuccagagcaacgacgaggugcuggccgaggugaccuccugggaccugccgccccucaccgaccgguaccgccgggccugccagagccugggccagggcgagcaccagcagguccugcaggccguggagcuccaggggcugggccuguccuucagcgccugcucccucgcccuggaccaggcgcagcugacgccccuccugcgcgcccugaagcuccacaccgcccugcgggagcugcgccucgccgggaaccggcugggcgacaagugcguggccgagcuggucgcggcccucgggaccaugcccagccuggcccugcucgaccuguccagcaaccaccugggccccgagggccuccgccagcuggccauggggcugcccggccaggcgacccugcagucccucgaggagcuggaccugagcaugaacccccucggggacggcugcggccagucccuggccagccugcuccacgccugcccgcugcugagcacccuccggcugcaggccugcggguucggccccuccuucuuccugagccaccagacggcccucggguccgcguuccaggacgccgagcaccugaagacccugagccucuccuacaacgcccugggcgcccccgcccuggcgcgcacccuccagagccugcccgccgggacccugcuccaccuggagcuguccagcguggccgccggcaagggcgacuccgaccucauggagccgguguuccgguaccuggccaaggaggggugcgcgcuggcccaccucacgcugagcgccaaccaccugggcgacaaggccguccgcgaccucugccggugccugucccugugccccagccucaucucccuggaccugagcgccaaccccgagaucuccugcgcgagccucgaggagcugcuguccacccuccagaagcgcccccaggggcugagcuuccugggccucuccgggugcgccgugcagggcccgcugggccuggggcucugggacaagaucgccgcccagcugcgggagcugcagcucugcagccgccggcugugcgcggaggaccgcgacgcccugcggcagcuccagcccagccgccccggccccggggagugcacccuggaccacggcuccaagcuguucuuccgccggcucuga

SEQ ID NO: 37972 - RNA, 2298 nt, Artificial Sequence
  derived and/or modified sequence opt1 from TOP1__Homo_sapiens__NP_003277
augagcggcgaccaccuccacaacgacucccagaucgaggccgacuuccgccucaacgacagccacaagcacaaggacaagcacaaggaccgggagcaccgccacaaggagcacaagaaggagaaggaccgggagaaguccaagcacagcaacuccgagcacaaggacagcgagaagaagcacaaggagaaggagaagaccaagcacaaggacggguccagcgagaagcacaaggacaagcacaaggaccgcgacaaggagaagcggaaggaggagaaggugcgcgccuccggcgacgcgaagaucaagaaggagaaggagaacggguucagcagcccgccccagaucaaggacgagcccgaggacgacggcuacuucgucccgcccaaggaggacaucaagccccugaagcggccccgcgacgaggacgacgccgacuacaagcccaagaagaucaagaccgaggacacgaagaaggagaagaagcggaagcuggaggaggaggaggacgggaagcucaagaagcccaagaacaaggacaaggacaagaaggugccggagcccgacaacaagaagaagaagcccaagaaggaggaggagcagaaguggaaguggugggaggaggagcgcuaccccgagggcaucaaguggaaguuccuggagcacaagggcccgguguucgccccgcccuacgagccccugcccgagaacgucaaguucuacuacgacgggaaggugaugaagcucucccccaaggccgaggagguggccaccuucuucgcgaagaugcuggaccacgaguacaccaccaaggagaucuuccggaagaacuucuucaaggacuggcgcaaggagaugacgaacgaggagaagaacaucaucaccaaccuguccaagugcgacuucacccagaugagccaguacuucaaggcccagaccgaggcccggaagcagauguccaaggaggagaagcugaagaucaaggaggagaacgagaagcugcugaaggaguacggcuucugcaucauggacaaccacaaggagcgcaucgccaacuucaagaucgagccgcccggccucuuccgggggcgcgggaaccaccccaagaugggcaugcugaagcggcgcaucaugcccgaggacaucaucaucaacugcagcaaggacgcgaagguccccagcccgccgcccggccacaaguggaaggaggugcggcacgacaacaaggugacguggcuggucuccuggaccgagaacauccagggguccaucaaguacaucaugcucaaccccagcagccgcaucaagggcgagaaggacuggcagaaguacgagaccgcccggcgccugaagaagugcguggacaagauccgcaaccaguaccgggaggacuggaaguccaaggagaugaaggugcgccagcgggccgucgcccuguacuucaucgacaagcucgcccugcgcgcggggaacgagaaggaggagggcgagaccgccgacacggugggcugcugcagccugcggguggagcacaucaaccuccaccccgagcuggacgggcaggaguacgucguggaguucgacuuccugggcaaggacuccauccgcuacuacaacaaggugcccgucgagaagcggguguucaagaaccuccagcuguucauggagaacaagcagcccgaggacgaccuguucgaccgccucaacaccgggauccugaacaagcaccuccaggaccugauggagggccugaccgccaagguguuccggaccuacaacgccagcaucacgcugcagcagcagcucaaggagcugaccgcccccgacgagaacaucccggcgaagauccuguccuacaaccgcgccaaccgggccgucgccauccucugcaaccaccagcgcgccccgcccaagaccuucgagaaguccaugaugaaccugcagaccaagaucgacgcgaagaaggagcagcuggccgacgcccggcgcgaccucaagagcgccaaggccgacgcgaaggugaugaaggacgccaagacgaagaagguggucgagagcaagaagaaggccgugcagcggcuggaggagcagcugaugaagcucgagguccaggccaccgaccgcgaggagaacaagcagaucgcgcuggggaccuccaagcugaacuaccucgacccccggaucaccguggccuggugcaagaaguggggcgugcccaucgagaagaucuacaacaagacgcagcgcgagaaguucgccugggccaucgacauggccgacgaggacuacgaguucuga

SEQ ID NO: 37973 - RNA, 4596 nt, Artificial Sequence
  derived and/or modified sequence opt1 from TOP2A__Homo_sapiens__NP_001058
auggaggugagcccccugcagccggucaacgagaacaugcaggucaacaagaucaagaagaacgaggacgccaagaagcgccucuccguggagcggaucuaccagaagaagacccagcuggagcacauccugcuccgccccgacaccuacaucggcagcgucgagcuggugacgcagcagauguggguguacgacgaggacgucgggaucaacuaccgggaggugaccuucgugcccggccuguacaagaucuucgacgagauccucgucaacgccgcggacaacaagcagcgcgaccccaagauguccugcauccgggugaccaucgacccggagaacaaccugaucagcaucuggaacaacgggaagggcauccccguggucgagcacaagguggagaagauguacgugcccgcccugaucuucgggcagcuccugaccuccagcaacuacgacgacgacgagaagaaggucacgggcggccgcaacggguacggcgccaagcugugcaacaucuucuccaccaaguucaccguggagaccgccagccgggaguacaagaagauguucaagcagacguggauggacaacauggggcgcgccggcgagauggagcucaagcccuucaacggggaggacuacacgugcaucaccuuccagccggaccuguccaaguucaagaugcagagccuggacaaggacaucguggcgcucaugguccggcgcgccuacgacaucgccggcuccaccaaggacgugaagguguuccugaacggcaacaagcugcccgucaagggguuccggagcuacguggacauguaccucaaggacaagcuggacgagacgggcaacucccugaaggugauccacgagcaggucaaccaccgcugggaggugugccucaccaugagcgagaagggguuccagcagaucuccuucgucaacagcaucgccaccuccaagggcggccggcacguggacuacguggcggaccagaucgucaccaagcugguggacguggucaagaagaagaacaagggcgggguggccgugaaggcccaccaggucaagaaccacauguggaucuucgugaacgcccugaucgagaaccccacguucgacagccagaccaaggagaacaugacccuccagcccaaguccuucggguccacgugccagcugagcgagaaguucaucaaggccgcgaucggcugcgggaucguggaguccauccugaacugggucaaguucaaggcccaggugcagcucaacaagaagugcagcgccgugaagcacaaccgcaucaagggcaucccgaagcuggacgacgccaacgacgccggcgggcggaacuccaccgagugcacccugauccucaccgagggcgacagcgcgaagacccuggccgucuccgggcugggcgugguggggcgcgacaaguacggcgucuucccccuccggggcaagauccugaacgugcgcgaggccagccacaagcagaucauggagaacgccgagaucaacaacaucaucaagaucguggggcugcaguacaagaagaacuacgaggacgaggacagccucaagacccugcgguacggcaagaucaugaucaugaccgaccaggaccaggacgggagccacaucaagggccugcucaucaacuucauccaccacaacuggcccucccugcugcgccaccgguuccucgaggaguucaucacccccaucgugaaggugagcaagaacaagcaggagauggccuucuacucccugccggaguucgaggaguggaaguccagcacccccaaccacaagaaguggaaggugaaguacuacaaggggcugggcacgagcaccuccaaggaggcgaaggaguacuucgccgacaugaagcgccaccgcauccaguucaaguacagcggccccgaggacgacgccgccaucucccucgccuucagcaagaagcagaucgacgaccggaaggaguggcugaccaacuucauggaggaccgccggcagcgcaagcugcucgggcugcccgaggacuaccuguacggccagaccacgaccuaccugaccuacaacgacuucaucaacaaggagcucauccuguucuccaacagcgacaacgagcggagcaucccguccauggucgacgggcugaagcccggccagcgcaagguccucuucacgugcuucaagcggaacgacaagcgcgaggugaagguggcgcagcuggccggcagcguggccgagauguccagcuaccaccacggggagaugucccugaugaugaccaucaucaaccucgcccagaacuucgugggcagcaacaaccugaaccugcuccagcccaucgggcaguucggcacccggcugcacgggggcaaggacuccgcgagcccccgcuacaucuucaccaugcuguccagccucgcccggcugcuguucccgcccaaggacgaccacacccucaaguuccuguacgacgacaaccagcgcgucgagcccgagugguacauccccaucaucccgauggugcugaucaacggcgccgaggggaucggcaccgggugguccugcaagauccccaacuucgacgugcgggagaucgucaacaacauccgccggcucauggacggcgaggagccccugccgaugcugcccagcuacaagaacuucaaggggacgaucgaggagcucgcccccaaccaguacgugaucuccggcgagguggccauccugaacagcaccaccaucgagaucuccgagcugcccguccgcaccuggacgcagaccuacaaggagcagguccucgagccgaugcugaacggcaccgagaagaccccgccccugaucacggacuaccgggaguaccacaccgacaccaccgugaaguucguggugaagaugacggaggagaagcucgcggaggccgagcgcguggggcugcacaaggucuucaagcugcagaccagccugaccugcaacuccaugguccucuucgaccacgugggcugccugaagaaguacgacaccgugcucgacauccugcgggacuucuucgagcugcgccucaaguacuacgggcugcgcaaggaguggcugcucggcaugcugggggccgagagcgccaagcugaacaaccaggcccgguucauccucgagaagaucgacggcaagaucaucaucgagaacaagcccaagaaggagcugaucaaggugcugauccagcgcggcuacgacagcgaccccgugaaggcguggaaggaggcccagcagaagguccccgacgaggaggagaacgaggaguccgacaacgagaaggagacggagaaguccgacagcgugaccgacagcgggcccaccuucaacuaccuccuggacaugccccugugguaccucaccaaggagaagaaggacgagcugugccggcugcgcaacgagaaggagcaggagcucgacacgcugaagcggaaguccccgagcgaccuguggaaggaggaccucgccaccuucaucgaggagcuggaggccguggaggccaaggagaagcaggacgagcaggucggccugcccgggaagggcgggaaggcgaagggcaagaagacccagauggccgaggugcuccccuccccgcgcggccagcgggucaucccccgcaucaccaucgagaugaaggccgaggccgagaagaagaacaagaagaagaucaagaacgagaacacggaggggagcccccaggaggacggcguggagcuggaggggcugaagcagcggcucgagaagaagcagaagcgcgagcccggcaccaagaccaagaagcagaccacgcuggcguucaagcccaucaagaagggcaagaagcggaacccgugguccgacagcgaguccgaccgcagcuccgacgagagcaacuucgacgugccgccccgggagaccgagccccgccgggccgccaccaagaccaaguucacgauggaccuggacuccgacgaggacuucagcgacuucgacgagaagaccgacgacgaggacuucguccccuccgacgccagcccgcccaagaccaagaccucccccaagcucagcaacaaggagcugaagccccagaaguccguggugagcgaccuggaggccgacgacgucaaggggagcgugccccucuccagcagcccgcccgcgacgcacuuccccgacgagaccgagaucaccaaccccgugcccaagaagaacgucaccgugaagaagaccgccgccaagucccaguccagcacguccaccaccggcgccaagaagcgcgccgcgccgaaggggaccaagcgggaccccgcccugaacagcggcgugucccagaagcccgaccccgccaagacgaagaaccgccggaagcgcaagccgagcaccuccgacgacagcgacuccaacuucgagaagaucgucagcaaggccgugaccuccaagaaguccaagggggagagcgacgacuuccacauggacuucgacagcgccguggcgccccgggccaagagcguccgcgccaagaagcccaucaaguaccuggaggaguccgacgaggacgaccucuucuga

SEQ ID NO: 37974 - RNA, 4866 nt, Artificial Sequence
  derived and/or modified sequence opt1 from TOP2B__Homo_sapiens__NP_001059
auggccaagagcggcgggugcggcgccggggcgggcgucgggggcggcaacggggcccugaccugggugaacaacgccgccaagaaggaggaguccgagaccgccaacaagaacgacagcuccaagaagcucagcguggagcgcguguaccagaagaagacgcagcuggagcacauccugcuccggcccgacaccuacaucggcuccgucgagccgcugacccaguucauguggguguacgacgaggacguggggaugaacugccgcgaggucaccuucgugcccggccuguacaagaucuucgacgagauccucgugaacgcggccgacaacaagcagcgggacaagaacaugacgugcaucaaggucagcaucgaccccgaguccaacaucaucagcaucuggaacaacgggaagggcauccccgugguggagcacaaggucgagaagguguacgugccggcccugaucuucggccagcugcucaccuccagcaacuacgacgacgacgagaagaaggucaccgggggccgcaacggguacggcgccaagcugugcaacaucuucuccaccaaguucacgguggagaccgcgugcaaggaguacaagcacagcuucaagcagaccuggaugaacaacaugaugaagaccuccgaggccaagaucaagcacuucgacggcgaggacuacacgugcaucaccuuccagcccgaccugagcaaguucaagauggagaagcucgacaaggacaucguggcccugaugacccggcgcgccuacgaccuggccggguccugccggggcgucaaggugauguucaacgggaagaagcuccccgugaacggcuuccgcagcuacgucgaccuguacgugaaggacaagcuggacgagaccgggguggcgcucaaggucauccacgagcuggccaacgagcggugggacgugugccugacgcucuccgagaagggcuuccagcagaucagcuucgucaacuccaucgccaccaccaagggcgggcgccacguggacuacguggucgaccagguggugggcaagcugaucgaggucgugaagaagaagaacaaggccggggugagcgucaagcccuuccaggugaagaaccacaucuggguguucaucaacugccugaucgagaacccgaccuucgacagccagacgaaggagaacaugacccuccagcccaaguccuucggcagcaagugccagcuguccgagaaguucuucaaggccgcgagcaacugcgggaucgucgaguccauccugaacugggugaaguucaaggcccagacccagcucaacaagaagugcagcuccgugaaguacagcaagaucaagggcauccccaagcuggacgacgccaacgacgccggcgggaagcacucccuggagugcacccucauccugacggagggcgacagcgccaagucccuggcggucagcgggcucggcgugaucgggcgggaccgcuacggcguguucccccugcggggcaagauccugaacguccgcgaggccucccacaagcagaucauggagaacgccgagaucaacaacaucaucaagaucguggggcuccaguacaagaaguccuacgacgacgccgagagccugaagacccugcgguacggcaagaucaugaucaugaccgaccaggaccaggacgggagccacaucaagggccuccugaucaacuucauccaccacaacuggccgucccugcucaagcacggcuuccuggaggaguucaucacccccaucgugaaggccagcaagaacaagcaggagcuguccuucuacagcauccccgaguucgacgaguggaagaagcacaucgagaaccagaaggcguggaagaucaaguacuacaaggggcucggcacgagcaccgccaaggaggccaaggaguacuucgccgacauggagcgccaccggauccuguuccgcuacgcggggcccgaggacgacgccgccaucacccuggccuucuccaagaagaagaucgacgaccggaaggaguggcucaccaacuucauggaggaccgccggcagcgccgccugcacggccugccggagcaguuccuguacgggacggccaccaagcaccucaccuacaacgacuucaucaacaaggagcugauccuguucagcaacuccgacaacgagcggagcauccccucccucgucgacggcuucaagcccggccagcgcaaggugcuguucacgugcuucaagcggaacgacaagcgcgaggugaaggucgcgcagcuggccgggagcguggccgagauguccgccuaccaccacggcgagcaggcccucaugaugacgaucgugaaccuggcgcagaacuucgucgggagcaacaacaucaaccugcuccagcccaucggccaguucgggacccggcugcacggcggcaaggacgccgccuccccgcgcuacaucuucaccaugcugagcacccucgcccggcugcuguuccccgccguggacgacaaccuccugaaguuccuguacgacgacaaccagcgcguggagcccgagugguacauccccaucaucccgaugguccucaucaacggggcggagggcaucgggaccggcugggccugcaagcugcccaacuacgacgcccgggagaucgugaacaacgugcgccggaugcuggacgggcucgacccccaccccaugcugccgaacuacaagaacuucaagggcacgauccaggagcugggccagaaccaguacgccgucuccggggagaucuucgugguggaccgcaacaccgucgagaucaccgagcuccccgugcggaccuggacccagguguacaaggagcagguccuggagcccaugcugaacggcaccgacaagaccccggcgcucaucagcgacuacaaggaguaccacaccgacacgaccgugaaguucguggucaagaugaccgaggagaagcuggcccaggccgaggccgccgggcugcacaagguguucaagcuccagaccacgcugaccugcaacuccauggugcuguucgaccacaugggcugccucaagaaguacgagaccguccaggacauccugaaggaguucuucgaccugcgccucagcuacuacgggcugcggaaggaguggcuggugggcaugcucggcgcggaguccaccaagcugaacaaccaggcccgcuucauccuggagaagauccaggggaagaucacgaucgagaaccggagcaagaaggaccucauccagaugcuggugcagcgcggcuacgaguccgaccccgucaaggccuggaaggaggcccaggagaaggccgcggaggaggacgagacccagaaccagcacgacgacagcagcuccgacagcgggacccccuccggccccgacuucaacuacauccugaacaugagccucuggucccugaccaaggagaagguggaggagcugaucaagcagcgggacgccaagggccgcgaggugaacgaccucaagcgcaagagcccguccgaccuguggaaggaggaccuggccgccuucgucgaggagcucgacaagguggagagccaggagcgggaggacguccuggccgggauguccggcaaggcgaucaaggggaaggugggcaagcccaaggugaagaagcugcagcucgaggagacgaugcccagccccuacgggcgccggaucaucccggagaucaccgccaugaaggccgacgccuccaagaagcugcugaagaagaagaagggcgaccucgacaccgcggccgucaagguggaguucgacgaggaguucagcggcgcccccguggagggggccggcgaggaggcccugacccccuccguccccaucaacaaggggccgaagcccaagcgcgagaagaaggagcccggcacgcgggugcgcaagacccccaccagcuccgggaagccgagcgcgaagaaggugaagaagcggaaccccugguccgacgacgagagcaaguccgagagcgaccuggaggagaccgagcccgucgugaucccccgcgacagccuccugcggcgcgccgccgccgagcggccgaaguacacguucgacuucuccgaggaggaggacgacgacgccgacgacgacgacgacgacaacaacgaccuggaggagcucaaggugaaggcgagccccaucaccaacgacggcgaggacgaguucguccccuccgacggccuggacaaggacgaguacaccuucagccccgggaaguccaaggccaccccggagaagucccugcacgacaagaagucccaggacuucggcaaccucuucagcuuccccagcuacagccagaaguccgaggacgacagcgccaaguucgacuccaacgaggaggacagcgccuccguguucagccccuccuucgggcugaagcagacggacaaggugccgagcaagaccgucgccgcgaagaagggcaagcccuccagcgacaccgugcccaagcccaagcgcgccccgaagcagaagaagguggucgaggccgugaacagcgacuccgacagcgaguucgggauccccaagaagaccacgacccccaagggcaagggccgcggggccaagaagcggaaggccuccggcagcgagaacgagggggacuacaaccccggccggaagaccuccaagaccaccagcaagaagccgaagaagacguccuucgaccaggacagcgacguggacaucuuccccuccgacuuccccaccgagcccccgagccugccccgcaccggccgggcgcgcaaggaggucaaguacuucgccgaguccgacgaggaggaggacgacguggacuucgccauguucaacuga

SEQ ID NO: 37975 - RNA, 3006 nt, Artificial Sequence
  derived and/or modified sequence opt1 from TOP3A__Homo_sapiens__NP_004609
augaucuuccccguggcccgcuacgcccugcgguggcuccgccggccggaggaccgcgcguucagccgggccgccauggagauggcccugcgcggcguccggaaggugcugugcguggccgagaagaacgacgcggccaaggggaucgccgaccuccuguccaacggccgcaugcggcgccgggaggggcugagcaaguucaacaagaucuacgaguucgacuaccaccucuacggccagaacgucaccauggugaugaccuccgugagcgggcaccuccuggcccacgacuuccagaugcaguuccgcaaguggcaguccugcaacccccucguccuguucgaggcggagaucgagaaguacugccccgagaacuucguggacaucaagaagacgcuggagcgggagacccgccagugccaggcccucgugaucuggaccgacugcgaccgggagggcgagaacaucggcuucgagaucauccacgucugcaaggccgugaagcccaaccuccaggugcugcgcgcccgguucagcgagaucaccccgcacgccguccgcacggcgugcgagaaccugaccgagcccgaccagcggguguccgacgccguggacguccgccaggagcuggaccugcggaucggggccgccuucacccgcuuccagacccuccgccugcagcggaucuuccccgaggugcuggccgagcagcucaucagcuacggcuccugccaguuccccacgcugggguucguggucgagcgcuucaaggcgauccaggccuucgugccggagaucuuccaccggaucaaggugacccacgaccacaaggacggcaucgucgaguucaacuggaagcgccaccggcuguucaaccacaccgccugccucgugcuguaccagcugugcguggaggaccccauggccaccgucguggagguccgcagcaagcccaaguccaaguggcggccccaggcccucgacacgguggagcuggagaagcuggcgagccgcaagcuccggaucaacgccaaggagaccaugcgcaucgccgagaagcuguacacccagggguacaucuccuacccgcggaccgagacgaacaucuucccccgcgaccugaaccucaccgugcuggucgagcagcagacccccgacccccgguggggcgccuucgcccagagcauccuggagcgcggcgggccgacgccccggaacggcaacaaguccgaccaggcgcacccgcccauccaccccaccaaguacaccaacaaccuccagggggacgagcagcgccuguacgaguucaucgugcggcacuuccuggccugcugcagccaggacgcccagggccaggagaccaccguggagaucgacaucgcccaggagcgcuucgucgcgcacggccucaugauccuggcccggaacuaccuggacguguaccccuacgaccacugguccgacaagauccuccccguguacgagcaggggagccacuuccagcccuccacggucgagaugguggacggcgagaccagcccgcccaagcugcugaccgaggccgaccucaucgcccugauggagaagcacgggaucggcaccgacgccacgcacgcggagcacaucgagaccaucaaggcccgcauguacguggggcugacccccgacaagcgcuuccuccccggccaccugggcauggggcuggucgagggcuacgacagcaugggguacgagauguccaagccggaccugcgggccgagcucgaggccgaccugaagcugaucugcgacggcaagaaggacaaguucguggugcuccgccagcagguccagaaguacaagcaggucuucaucgaggccguggcgaaggccaagaagcuggacgaggcccuggcccaguacuucgggaacggcaccgagcucgcccagcaggaggacaucuaccccgcgaugcccgagccgauccggaagugcccccagugcaacaaggacauggugcugaagacgaagaagaacggcggguucuaccugagcugcaugggcuuccccgagugccgcuccgccguguggcuccccgacagcgugcuggaggccucccgggacagcuccgucugcccggugugccagccccaccccguguaccgccugaagcucaaguucaagcgggggagccugcccccgaccaugccccuggaguucgucugcugcaucggcgggugcgacgacacccuccgcgagauccuggaccugcgguucuccggcggcccgccccgcgccagccagcccuccgggcggcuccaggcgaaccagagccugaaccgcauggacaacucccagcacccccagcccgccgacagccggcagaccggcuccagcaaggcccuggcccagacgcugcccccgcccaccgccgcgggggaguccaacagcgugaccugcaacugcggccaggaggccgugcugcugaccguccgcaaggagggccccaaccgggggcgccaguucuucaagugcaacggcggguccugcaacuucuuccucugggccgacagccccaacccgggcgccgggggcccgcccgcccuggcguaccggccccugggcgccagccucgggugcccgcccggccccgggauccaccugggcggguucggcaaccccggcgacggguccggcagcgggaccuccugccugugcagccagcccuccgugacgcgcaccgugcagaaggacggccccaacaaggggcggcaguuccacacgugcgccaagccccgcgagcagcagugcggcuucuuccagugggucgacgagaacaccgccccgggcaccagcggggcccccuccuggaccggcgaccgggggcgcacccucgagagcgaggcgcgcuccaagcggccccgcgccagcuccagcgacaugggcuccaccgccaagaagccccggaagugcagccugugccaccagccggggcacacgcgccccuucugcccccagaaccgguga

SEQ ID NO: 37976 - RNA, 2589 nt, Artificial Sequence
  derived and/or modified sequence opt1 from TOP3B__Homo_sapiens__NP_001269042
augaagaccgugcugauggucgccgagaagcccagccucgcccaguccaucgcgaagauccugagccgcggcucccugagcucccacaaggggcucaacggcgccugcagcgugcacgaguacaccgggacguucgccggccagccggugcgguucaagaugaccuccgucugcgggcacgugaugacccuggacuuccugggcaaguacaacaagugggacaagguggaccccgccgagcuguucagccaggcccccaccgagaagaaggaggcgaaccccaagcugaacauggucaaguuccuccagguggagggccgcgggugcgacuacaucgugcucuggcuggacugcgacaaggagggcgagaacaucugcuucgagguccuggacgccgugcucccggugaugaacaaggcccacgggggcgagaagacggucuuccgggcccgcuucuccagcaucaccgacaccgacaucugcaacgcgauggccugccugggggagcccgaccacaacgaggcccuguccguggacgcccggcaggagcucgaccugcgcaucggcugcgccuucacccgguuccagacgaaguacuuccagggcaaguacggggaccuggacagcucccucaucagcuucggccccugccagacccccacccugggguucugcguggagcgccacgacaagauccaguccuucaagccggagaccuacuggguccugcaggcgaaggugaacacggacaaggaccggagccuccugcuggacugggaccgcgugcgggucuucgaccgcgagaucgcccagauguuccucaacaugaccaagcuggagaaggaggcccagguggaggccaccucccggaaggagaaggccaagcagcgcccccuggcgcucaacaccguggagaugcugcgggucgccagcuccagccugggcaugggcccccagcacgccaugcagacggccgagcgccucuacacccagggguacaucagcuacccccggaccgagaccacgcacuacccggagaacuucgaccugaagggcucccugcgccagcaggccaaccaccccuacugggcggacaccgugaagcggcuccuggccgaggggaucaaccgcccccggaagggccacgacgccggggaccacccgcccaucacccccaugaaguccgccaccgaggccgagcugggcggcgacgcguggcgccucuacgaguacaucacgcgccacuucaucgccaccgugucccacgacugcaaguaccugcagagcaccaucuccuuccggaucgggcccgagcuguucacgugcagcggcaagaccguccucucccccggguucaccgaggugaugccguggcagagcgucccccuggaggagucccugcccacgugccagcgcggcgacgccuuccccgugggggaggugaagaugcucgagaagcagaccaacccgcccgacuaccugaccgaggccgagcugaucacccucauggagaagcacggcaucggcaccgacgcgagcauccccguccacaucaacaacaucugccagcggaacuacgugaccguggaguccgggcgccggcugaagcccacgaaccugggcaucguccucgugcacggguacuacaagaucgacgccgagcuggugcugccgaccauccgcagcgccgucgagaagcagcugaaccucaucgcccagggcaaggccgacuaccgccaggugcuggggcacacccuggacguguucaagcggaaguuccacuacuucgucgacuccaucgcgggcauggacgagcucauggaggugagcuucagcccccuggccgccaccggcaagccccugagccggugcgggaagugccaccgcuucaugaaguacauccaggccaagccgucccggcuccacugcagccacugcgacgagaccuacacgcugccccagaacggcaccaucaagcuguacaaggagcuccgcugcccccuggacgacuucgagcuggugcucugguccagcgggagccggggcaaguccuacccccugugcccguacugcuacaaccacccgcccuuccgcgacaugaagaagggcauggggugcaacgagugcacccaccccagcugccagcacucccugagcaugcucggcaucgggcagugcgucgagugcgaguccggcgugcuggugcuggaccccaccagcgggcccaaguggaaggucgccugcaacaagugcaacgugguggcgcacugcuucgagaacgcccaccggguccgcguguccgccgacacgugcagcgugugcgaggccgcccuccuggacgucgacuucaacaaggcgaaguccccgcugcccggcgacgagacccagcacaugggcugcguguucugcgaccccguguuccaggagcucgucgagcugaagcacgccgccagcugccaccccaugcaccgcgggggccccgggcggcggcagggccgcgggcgcggccgggcccgccggcccccgggcaagcccaacccccgccggcccaaggacaagauguccgcgcuggccgccuacuucguguga

SEQ ID NO: 37977 - RNA, 4569 nt, Artificial Sequence
  derived and/or modified sequence opt1 from TOPBP1__Homo_sapiens__NP_008958
augagccgcaacgacaaggagcccuucuucgugaaguuccugaaguccagcgacaacuccaagugcuucuucaaggcccucgagagcaucaaggaguuccaguccgaggaguaccugcagaucaucaccgaggaggaggcccugaagaucaaggagaacgaccggagccucuacaucugcgacccguucuccggcgucguguucgaccaccugaagaagcuggggugccgcaucgugggcccccaggucgugaucuucugcaugcaccaccagcggugcgugccccgcgcggagcaccccgucuacaacauggugaugagcgacgugaccaucuccugcacgagccucgagaaggagaagcgggaggagguccacaaguacgugcagaugaugggcgggcgcguguaccgggaccugaacgucuccgugacccaccugaucgccggggaggugggcagcaagaaguaccucgucgccgccaaccugaagaagccgauccugcuccccuccuggaucaagacccugugggagaagucccaggagaagaagaucacccgcuacacggacaucaacauggaggacuucaagugccccaucuuccugggcugcaucaucugcgugaccgggcucugcggccuggaccggaaggaggugcagcagcugaccgucaagcacgggggccaguacauggggcagcucaagaugaacgagugcacccaccugaucgugcaggagcccaagggccagaaguacgagugcgccaagcgcuggaacgugcacugcgucacgacccagugguucuucgacuccaucgagaagggcuucugccaggacgagagcaucuacaagaccgagccgcggcccgaggcgaagaccaugcccaacuccagcacgcccaccucccagaucaacaccaucgacagccgcacccugagcgacguguccaacaucagcaacaucaacgccuccugcgugagcgaguccaucugcaacagccucaacuccaagcuggagccgacgcuggagaaccucgagaaccuggacgucagcgccuuccaggcccccgaggaccugcucgacgggugccggaucuaccugugcggcuucuccgggcgcaagcuggacaagcuccggcgccugaucaacagcggcggcggggugcgguucaaccagcugaacgaggacgucacccacgugaucgugggcgacuacgacgacgagcucaagcaguucuggaacaaguccgcgcaccgcccccacgucgugggggccaaguggcugcuggagugcuucagcaagggcuacaugcucuccgaggagcccuacauccacgccaacuaccagccgguggagauccccgucagccacaagcccgaguccaaggccgcccugcugaagaagaagaacagcuccuucagcaagaaggacuucgcgcccuccgagaagcacgagcaggccgacgaggaccuccugagccaguacgagaacgggagcuccaccgugguggaggccaagaccagcgaggcccggccguucaacgacuccacgcacgccgagccccugaacgacagcacccacaucucccuccaggaggagaaccagagcuccgucagccacugcgugcccgacguguccaccaucaccgaggagggccuguucagccagaaguccuuccugguccucggcuucagcaacgagaacgaguccaacaucgcgaacaucaucaaggagaacgccgggaagaucaugagccugcugucccgcacgguggccgacuacgccguggucccccuccugggcugcgagguggaggccaccgugggggaggucgugaccaacaccuggcuggugacgugcaucgacuaccagacccuguucgaccccaagagcaacccccucuucacccccguccccgugaugaccggcaugacgccgcuggaggacugcgugaucuccuucagccagugcgcgggggccgagaaggagagccugaccuuccucgccaaccugcugggcgccuccguccaggaguacuucgugcggaaguccaacgccaagaagggcauguucgcgagcacccaccucauccugaaggagcgcgggggcagcaaguacgaggccgccaagaaguggaaccugcccgccgugaccaucgcguggcuccuggagacggcccgcaccgggaagcgggccgacgagucccacuuccugaucgagaacagcaccaaggaggagcgcucccucgagaccgagaucaccaacggcaucaaccugaacagcgacacggccgagcaccccgggacccggcugcagacccaccgcaagaccgucgugacgccgcucgacaugaaccgguuccaguccaaggccuuccgcgcgguggucagccagcacgcccgccagguggccgccucccccgccgugggccagccccugcagaaggagcccagccugcaccucgacaccccguccaaguuccugagcaaggacaagcuguucaagcccuccuucgacgucaaggacgcgcucgccgcccuggagacccccggccggcccagccagcagaagcggaagccguccacgccccugagcgaggugaucgugaagaaccuccagcuggcccuggccaacuccagccgcaacgcggucgcccucagcgccagcccccagcugaaggaggcccagagcgagaaggaggaggcgcccaagccgcugcacaaggugguggucugcguguccaagaagcucagcaagaagcaguccgagcugaacgggaucgccgccagccugggcgccgacuaccggugguccuucgacgagaccgugacccacuucaucuaccaggggcgccccaacgacaccaaccgggaguacaagagcgucaaggagcgcggcgugcacaucguguccgagcacuggcuccuggacugcgcccaggagugcaagcaccuccccgagagccuguacccccacaccuacaacccgaagaugucccuggacaucagcgcgguccaggacggccggcugugcaacucccgccuccugagcgccguguccagcacgaaggacgacgagcccgacccccugauccucgaggagaacgacguggacaacauggccaccaacaacaaggaguccgcccccagcaacggguccggcaagaacgacagcaaggggguccugacccagacccuggagaugcgggagaacuuccagaagcagcuccaggagaucaugagcgccacguccaucgugaagccgcagggccagcgcaccagccugucccggagcgggugcaacuccgcgagcuccacccccgacagcacccgcuccgcccgcagcggccggucccgcgugcuggaggcccuccggcagagccgccagacgguccccgacgugaacaccgagcccucccagaacgagcagaucaucugggacgacccgaccgcccgggaggagcgcgcccggcuggcgagcaaccugcaguggcccuccugccccacccaguacagcgagcuccaggucgacauccagaaccuggaggacuccccguuccagaagccccugcacgacagcgagaucgccaagcaggccgugugcgaccccggcaacauccgcgugacggaggcccccaagcacccgaucuccgaggagcucgagacccccaucaaggacagccaccugauccccacgccccaggcgccgagcaucgccuucccccuggccaacccgcccgucgccccgcacccccgggagaagaucaucaccaucgaggagacccacgaggagcucaagaagcaguacaucuuccagcuguccagccugaacccccaggagcgcaucgacuacugccaccucaucgagaagcucgggggccuggugaucgagaagcagugcuucgacccgaccugcacccacaucguggucgggcacccccugcggaacgagaaguaccuggccuccguggcggccggcaagugggugcugcaccgcagcuaccucgaggccugccggaccgccgggcacuucguccaggaggaggacuacgaguggggcuccagcuccauccuggacgugcugacgggcaucaacgugcagcagcgccggcucgcccuggcggccaugcgcuggcggaagaagauccagcagcgccaggagagcgggaucgucgagggcgccuucuccggguggaaggugauccugcacguggaccagagccgggaggccggcuucaagcgccuccugcaguccgggggcgccaagguccugcccggccacagcgugccccucuucaaggaggcgacccaccuguucuccgaccugaacaagcucaagcccgacgacagcggggugaacaucgccgaggccgccgcccagaacgucuacugccugcggaccgaguacaucgcggacuaccugaugcaggaguccccgccccacguggagaacuacugccuccccgaggccaucagcuucauccagaacaacaaggagcugggcaccgggcugucccagaagcgcaaggcccccacggagaagaacaagaucaagcgcccgcgggugcacuga

SEQ ID NO: 37978 - RNA, 2943 nt, Artificial Sequence
  derived and/or modified sequence opt1 from TOPORS__Homo_sapiens__NP_001182551
augaucauggccagcgccgcgaaggaguucaagauggacaacuucucccccaaggccggcaccagcaagcugcagcagaccgugccggccgacgccucccccgacagcaagugccccaucugccucgaccgcuucgacaacgucuccuaccuggaccggugccugcacaaguucugcuuccgcugcgugcaggaguggagcaagaacaaggccgagugcccccucugcaagcagccguucgacuccaucuuccacagcgugcgggcggaggacgacuucaaggaguacguccugcgccccuccuacaacgggagcuucgugacgcccgaccggcgcuuccgguaccgcaccacccugacccgggagcgcaacgccuccguguacagccccuccggcccggucaaccggcgcacgaccaccccgcccgacagcgggguccucuucgagggccuggggaucuccacccggccccgcgacguggagaucccccaguucaugcggcagaucgccgugcgccggcccacgaccgccgacgagcgcagccugcggaagauccaggagcaggacaucaucaacuuccgccggacccucuaccgcgcgggcgcccgcgugcggaacaucgaggacggcgggcgcuaccgggacaucuccgccgaguucuuccgccggaaccccgccugccugcaccgccuggugcccuggcucaagcgggagcugaccguccuguucggcgcccacgggagccucgugaacaucgugcagcacaucaucauguccaacgucacgcgcuacgaccuggagagccaggcguucgugagcgaccugcggccguuccuccugaaccgcaccgagcacuucauccacgaguucaucuccuucgcccggagccccuucaacauggccgccuucgaccagcacgccaacuacgacugccccgcgcccuccuacgaggagggcagccacuccgacagcuccgugaucaccaucagcccggacgaggccgagacccaggagcuggacaucaacgucgccacggugucccaggcccccugggacgacgagacccccgggcccagcuacuccagcuccgagcagguccacgugaccaugagcucccuccugaacaccagcgacuccagcgacgaggagcuggugacgggcggcgccaccucccagauccagggggugcagaccaacgacgaccucaacaacgacagcgacgacagcuccgacaacugcgucaucgugggcuucgucaagccgcuggcggagcgcacccccgagcugguggagcucagcuccgacagcgaggaccugggguccuacgagaagauggagacggugaagacccaggagcaggagcagagcuacuccagcggcgacuccgacgucagccggugcuccagcccccacuccgugcugggcaaggacgagcagaucaacaaggggcacugcgacagcuccacccgcaucaagagcaagaaggaggagaagcgguccaccagccucagcagcccccgcaaccugaacagcuccgugcggggcgaccgcgucuacagcccguacaaccaccggcaccgcaagcgcgggcggucccgcagcuccgacagccggucccagagccgcuccggccacgaccagaagaaccaccggaagcaccacgggaagaagcgcaugaaguccaagcggucccgcagccgggaguccagccgcccccggggccgccgggacaagaagcgcucccggacgcgcgacagcuccuggagccggcgcagccagacccugucccucagcuccgagagcaccucccggagccgcucccggagcuccgaccacggcaagcgccgcagccggucccgcaaccgggaccgcuacuaccugcggaacaacuacgggagccgcuacaagugggaguacaccuacuacucccggaacaaggaccgcgacggcuacgagagcuccuaccggcgccggacgcugagccgcgcccacuacucccggcagagcuccagccccgaguuccgcgugcagagcuucuccgagcggaccaacgcccgcaagaagaacaaccacagcgagcggaaguacuacuacuacgagcgccaccggucccgcagccucuccagcaaccgcucccggaccgccagcaccgggacggaccgcgugcggaacgagaagccgggcgggaagcgcaaguacaagacccggcaccuggagggcaccaacgaggucgcccagcccucccgcgaguucgcgagcaaggccaaggacucccacuaccagaaguccagcagcaagcuggacggcaacuacaagaacgaguccgacaccuucagcgacucccggagcuccgaccgcgagaccaagcacaagcggcgcaagcggaagacgcgcagccucagcguggagaucguguacgaggggaaggccaccgacaccaccaagcaccacaagaagaagaagaagaagcacaagaagaagcacaagaagcaccacggcgacaacgccucccggagccccgucgugaucacgaucgacuccgacagcgacaaggacuccgaggugaaggaggacaccgagugcgacaacagcgggccccaggacccgcugcagaacgaguuccuggcgcccucccucgagcccuucgagaccaaggacgucgugaccaucgaggccgaguucggcgugcuggacaaggagugcgacaucgccacgcugagcaacaaccucaacaacgccaacaagaccgucgacaacaucccgccccuggccgcguccguggagcagacccuggacgugcgcgaggagagcaccuucgucuccgaccucgagaaccagcccagcaacaucgugucccugcagacggagcccagccggcagcugcccuccccgcgcaccagccugauguccgugugccucgggcgggacugcgacaugagcuga

SEQ ID NO: 37979 - RNA, 999 nt, Artificial Sequence
  derived and/or modified sequence opt1 from TOR1A__Homo_sapiens__NP_000104
augaagcugggccgcgccgugcucgggcugcugcuccuggcccccagcgucgugcaggcgguggagccgaucucccugggccucgcccuggccgggguccugaccggcuacaucuacccccggcucuacugccuguucgccgagugcugcgggcagaagcgcagccugucccgggaggcccuccagaaggaccuggacgacaaccuguucggccagcaccucgcgaagaagaucauccugaacgccguguucggcuucaucaacaaccccaagcccaagaagccgcugacccucagccugcacggguggacgggcaccgggaagaacuucguguccaagaucaucgccgagaacaucuacgagggcgggcugaacagcgacuacguccaccucuucguggccacccugcacuucccccacgcguccaacaucacccuguacaaggaccagcuccagcuguggauccgcggcaacgugagcgccugcgcccgguccaucuucaucuucgacgagauggacaagaugcacgccggccugaucgacgccaucaagcccuuccucgacuacuacgaccuggucgacggggugagcuaccagaaggcgauguucaucuuccuguccaacgccggcgccgagcgcaucacggacguggcccucgacuucuggcggagcgggaagcagcgcgaggacaucaagcugaaggacaucgagcacgcccuguccgucagcguguucaacaacaagaacuccggcuucuggcacagcucccucaucgaccggaaccugaucgacuacuucgugcccuuccugccgcucgaguacaagcaccugaagaugugcauccgcgucgagaugcagagccggggcuacgagaucgacgaggacaucgugucccgcguggcggaggagaugaccuucuuccccaaggaggagcgggucuucagcgacaaggggugcaagaccguguucaccaagcuggacuacuacuacgacgacuga

SEQ ID NO: 37980 - RNA, 1752 nt, Artificial Sequence
  derived and/or modified sequence opt1 from TOR1AIP1__Homo_sapiens__NP_056417
auggccggcgacgggcgccgggccgaggcggugcgcgagggcuggggcgucuacgugacgccccgggccccgauccgcgaggggcgggggcgccuggcgccccagaacggcggcagcuccgacgcccccgccuaccggacgcccccgagccgccaggggcggcgcgaggugcgguucuccgacgagccgcccgaggucuacggcgacuucgagccccucguggccaaggagcgcagccccguggggaagcggacccgccuggaggaguuccgguccgacagcgccaaggaggagguccgcgaguccgccuacuaccugcggagccgccagcggcgccagccccggccccaggagaccgaggagaugaagacccgccgcaccacccggcuccagcagcagcacuccgagcagcccccgcugcagcccagccccgugaugacccgccggggccugcgcgacucccacagcuccgaggaggacgaggccagcucccagaccgaccucagccagaccaucuccaagaagacggugcggagcauccaggaggcgcccgucuccgaggaccuggugauccgccugcggcgcccgccccuccgguacccccgcuacgaggccaccagcgugcagcagaaggucaacuucagcgaggagggggagaccgaggaggacgaccaggacuccagccacuccagcgugaccacggugaaggcccggucccgcgacagcgacgaguccggcgacaagaccacccggagcuccagccaguacaucgaguccuucuggcagagcucccagagccagaacuucaccgcccacgacaagcagcccuccguccugagcuccggcuaccagaagacgccgcaggagugggcgccccagaccgcccgcauccggacccgcaugcagaacgacagcauccugaaguccgagcucgggaaccagagccccagcaccuccagccgccaggugacgggccagccccagaacgccuccuucgugaagcggaaccggugguggcugcugccgcucaucgccgcccuggccagcggguccuucugguucuucagcacccccgaggucgagaccaccgcggugcaggaguuccagaaccagaugaaccagcugaagaacaaguaccagggccaggacgagaagcucuggaagcgcucccagacguuccuggagaagcaccugaacagcucccacccccgcagccagcccgccauccuccugcugaccgccgcccgggacgccgaggaggcgcuccgcugccuguccgagcagaucgccgacgccuacagcuccuuccggagcgugcgcgccauccggaucgacggcaccgacaaggccacccaggacuccgacacggucaagcuggagguggaccaggagcucagcaacggguucaagaacggccagaacgcggccgugguccaccgcuucgaguccuucccggccgggagcacccugaucuucuacaaguacugcgaccacgagaacgccgcguucaaggacguggcccugguccucaccgugcugcuggaggaggagacccucggcacgagccuggggcugaaggagguggaggagaagguccgggacuuccucaaggugaaguucaccaacuccaacacccccaacagcuacaaccacauggaccccgacaagcugaacggccuguggucccgcaucagccaccucgugcugccgguccagcccgagaacgcccugaagcggggcaucugccucuga

SEQ ID NO: 37981 - RNA, 396 nt, Artificial Sequence
  derived and/or modified sequence opt1 from TOR1AIP2__Homo_sapiens__NP_071742
auguucagcgacaacucccacugccccgacugcggccagcagugguucccgagccuggagcucgggcacuggcuguaccagaccgagcugguggagaacgagugcuaccaggucuuccucgaccgcaucaaccgggccgacuacugccccgagugcuaccccgacaaccccgccaaccgcucccuggugcugccguggagcuucccccucgagugggcgccccagaaccugacccgguggacguucgagaaggccugccaccccuuccugcucggcccgccccuggugcgcaagcggauccacgacucccgcgucgccggguucaaccccgcccugcagcucauccugacccggaccgacaagacccugaacaagaagcucggccagaacaaguga

SEQ ID NO: 37982 - RNA, 1011 nt, Artificial Sequence
  derived and/or modified sequence opt1 from TOR1B__Homo_sapiens__NP_055321
augcugcgcgccggcuggcuccgcggggccgcggcccuggcccugcuccuggccgcccggguggucgcggccuucgagcccaucaccgugggccuggccaucggggccgcgagcgccaucaccggcuaccucuccuacaacgacaucuacugccgguucgccgagugcugccgcgaggagcggccgcugaacgccagcgcccugaagcucgaccuggaggagaagcuguucgggcagcaccucgcgacggaggugaucuucaaggcccugaccggcuuccgcaacaacaagaaccccaagaagccccugacccucucccugcacggcugggccgggaccggcaagaacuucgucagccagaucguggccgagaaccugcaccccaaggggcucaaguccaacuucgugcaccuguucgucagcacgcugcacuucccgcacgagcagaagaucaagcucuaccaggaccagcugcagaaguggauccggggcaacguguccgccugcgcgaacagcguguucaucuucgacgagauggacaagcugcaccccgggaucaucgacgccaucaagcccuuccucgacuacuacgagcaggucgacggcguguccuaccgcaaggccaucuucaucuuccugagcaacgccggcggggaccugaucaccaagaccgcccucgacuucuggcgggcgggccgcaagcgggaggacauccagcugaaggaccuggagcccgugcucuccgucgggguguucaacaacaagcacagcggccuguggcacuccggccugaucgacaagaaccucaucgacuacuucaucccguuccugccccuggaguaccgccacgugaagaugugcguccgggccgagaugcgcgcccgggggagcgccaucgacgaggacaucgugacccgcguggccgaggagaugacguucuucccccgggacgagaagaucuacuccgacaagggcugcaagaccguccagagccgccucgacuuccacuga

SEQ ID NO: 37983 - RNA, 966 nt, Artificial Sequence
  derived and/or modified sequence opt1 from TOR2A__Homo_sapiens__NP_001078816
auggccgccgcgacccgcggcugccggcccugggggagccugcucggccugcuggggcucguguccgccgccgccgccgcgugggaccuggccagccugcgcugcacccucggcgccuucugcgagugcgacuuccggccggaccugcccgggcuggagugcgaccucgcccagcaccuggcgggccagcaccuggccaaggcccucgucgugaaggcccugaaggccuucgugcgcgaccccgcgcccacgaagccgcugguccucucccugcacggcuggaccgggaccggcaagagcuacguguccagccugcucgcccacuaccuguuccagggcgggcugcggagcccccgcgugcaccacuucagccccguccuccacuucccccacccgucccacaucgagcgguacaagaaggaccugaaguccugggugcaggggaaccugaccgccugcggccgcucccucuuccuguucgacgagauggacaagaugccgcccggccugauggaggugcuccggcccuuccuggggagcuccugggucguguacggcacgaacuaccgcaaggccaucuucaucuucaucagcaacaccgggggcgagcagaucaaccagguggcccuggaggcguggcggucccgccgggaccgcgaggagauccuccugcaggagcuggagcccgucaucagccgggccgugcucgacaacccccaccacggcuucuccaacagcgggaucauggaggagcgccugcuggacgccgugguccccuuccucccccugcagcggcaccacgugcgccacugcgugcugaacgagcucgcccagcugggccuggagccgcgggacgaggucgugcaggccgugcucgacuccaccaccuucuuccccgaggacgagcagcuguucagcagcaacgggugcaagacggucgcgucccgcaucgccuucuuccuguga

SEQ ID NO: 37984 - RNA, 1395 nt, Artificial Sequence
  derived and/or modified sequence opt1 from TOX2__Homo_sapiens__NP_001092266
augagcgacggcaaccccgagcugcucuccaccagccagaccuacaacgggcaguccgagaacaacgaggacuacgagaucccgcccaucacgccgcccaaccugcccgagcccagccugcuccaccugggcgaccacgaggccuccuaccacagccugugccacgggcucacccccaacggccugcugcccgccuacuccuaccaggcgauggaccucccggccaucauggugagcaacaugcuggcccaggacucccaccuccucagcgggcagcugcccaccauccaggagaugguccacuccgagguggccgccuacgacagcggccgccccggcccccugcucgggcggccggcgaugcuggccucccacaugagcgcccugucccagagccagcucaucucccagaugggcauccgcagcuccaucgcccacagcagccccuccccgcccgggagcaaguccgcgacccccagccccuccagcuccacgcaggaggaggagagcgaggugcacuucaagaucuccggcgagaagcggcccagcgccgaccccgggaagaaggccaagaacccgaagaagaagaagaagaaggaccccaacgagccccagaagcccgucuccgccuacgcccuguucuuccgcgacacccaggcggccaucaagggccagaacccgagcgccaccuucggcgacguguccaagaucguggccagcaugugggacucccugggggaggagcagaagcaggccuacaagcggaagaccgaggcggccaagaaggaguaccugaaggcccuggccgccuaccgcgcgagccuggucuccaagagcucccccgaccagggcgagaccaagagcacgcaggccaacccgcccgccaagaugcucccgcccaagcagcccauguacgccaugcccgggcuggccagcuuccugacccccuccgaccuccaggcguuccggagcggcgccucccccgccagccuggcccgcacccugggcuccaagagccuccugcccgggcuguccgcgagcccgcccccgccgcccuccuucccccucagccccacgcugcaccagcagcugucccucccgccccacgcccagggcgcccugcugagcccgcccguguccaugagccccgcgccccagccgcccgugcuccccacccccauggcccugcagguccagcuggccaugucccccagcccgcccgggccccaggacuucccccacaucuccgaguuccccagcagcuccggcagcugcucccccgggcccagcaaccccaccuccagcggcgacugggacuccagcuaccccuccggcgagugcgggaucagcacgugcucccuccugccgcgggacaagagccuguaccucaccuga

SEQ ID NO: 37985 - RNA, 1731 nt, Artificial Sequence
  derived and/or modified sequence opt1 from TOX3__Homo_sapiens__NP_001073899
auggacgugcgcuucuaccccgccgccgcgggcgacccggccagccuggacuucgcccagugccucggguacuacggcuacuccaaguucgggaacaacaacaacuacaugaacauggccgaggccaacaacgcguucuucgccgccagcgagcagaccuuccacacccccucccugggcgacgaggaguucgagaucccgcccaucacgcccccgcccgagagcgaccccgcccuggggaugcccgacguccuccugcccuuccaggcgcuguccgacccccuccccagccagggcuccgaguucaccccgcaguucccgccccagagccuggaccugcccuccaucaccaucagccggaaccucguggagcaggacggcgugcugcacuccagcgggcugcacauggaccagucccacacccaggucagccaguaccgccaggaccccucccucaucaugcggagcaucgugcacaugacggacgccgcccgcuccggcgugaugccgcccgcccagcugaccaccaucaaccagagccagcuguccgcccagcucgggcugaaccugggcggggcgagcaugccccacaccagccccuccccgcccgccagcaaguccgccacgcccagccccuccagcuccaucaacgaggaggacgccgacgaggccaaccgggcgaucggcgagaagcgcgccgcccccgacagcggcaagaagcccaagacccccaagaagaagaagaagaaggacccgaacgagccccagaagcccgucuccgccuacgcccucuucuuccgggacacccaggcggccaucaaggggcagaacccgaacgccaccuucggcgaggugagcaagaucguggccuccaugugggacagccugggggaggagcagaagcaggucuacaagcgcaagacggaggccgcgaagaaggaguaccugaaggcccucgccgccuaccgggcgucccuggugagcaaggccgccgccgaguccgccgaggcgcagaccauccgcagcgugcagcagacccuggccuccaccaaccucacgagcucccugcugcucaacacgccccugagccagcacggcaccgucagcgccagcccccagacccugcagcagucccucccccgguccaucgccccgaagccccugaccaugcgccugcccaugaaccagaucgugaccagcgugaccaucgccgcgaacaugcccuccaacaucggcgccccgcucaucagcuccauggggaccacgauggucggcagcgcccccuccacccaggugagccccuccgugcagacccagcagcaccagaugcagcugcagcagcagcagcagcagcagcagcagcagaugcagcagaugcagcagcagcagcugcagcagcaccagaugcaccagcagauccagcagcagaugcagcagcagcacuuccagcaccacaugcagcagcaccuccagcagcagcagcagcaccuccagcagcagaucaaccagcagcagcugcagcagcagcugcagcagcggcugcagcugcagcagcuccagcacaugcagcaccagagccagcccuccccgcgccagcacagccccgucgccucccagaucaccagccccauccccgccaucggguccccgcagcccgcgagccagcagcaccagagccagauccagucccagacgcagacccaggugcugagccagguguccaucuucuga

SEQ ID NO: 37986 - RNA, 1797 nt, Artificial Sequence
  derived and/or modified sequence opt1 from TOX4__Homo_sapiens__NP_001290452
auggagaccuuccacacccccagccugggcgacgaggaguucgagaucccgcccaucucccucgacagcgaccccucccuggccgugagcgacgucguggggcacuucgacgaccuggccgaccccuccagcucccaggacggcagcuucuccgcgcaguacggggugcagacgcucgacaugcccgucggcaugacccacgggcugauggagcagggcggcgggcugcucagcggcgggcugaccauggaccuggaccacuccaucggcacccaguacagcgccaacccgcccgugacgaucgacgugcccaugaccgacaugaccuccgggcucaugggccacagccagcugaccacgaucgaccaguccgagcugagcucccagcucggccugagccucgggggcgggaccauccugccgcccgcccagucccccgaggaccgccugagcaccacccccagcccgacguccagccugcacgaggacggcgucgaggacuuccggcgccagcuccccucccagaagaccgugguggucgaggccggcaagaagcagaaggcccccaagaagcggaagaagaaggaccccaacgagccgcagaagcccgugagcgcguacgcccuguucuuccgcgacacccaggccgccaucaaggggcagaaccccaacgcgaccuucggcgagguguccaagaucgucgccagcaugugggacucccugggggaggagcagaagcaggucuacaagcggaagacggaggccgccaagaaggaguaccucaaggcccuggcggccuacaaggacaaccaggagugccaggccaccguggagaccguggagcuggaccccgccccgcccagccagacccccuccccgccgcccauggccacgguggaccccgcgagccccgcccccgccuccaucgagccgcccgcccucagccccuccaucguggucaacagcacccuguccagcuacguggccaaccaggcguccagcggcgccgggggccagcccaacaucaccaagcugaucaucaccaagcagaugcuccccuccagcaucacgaugagccagggcgggauggugaccgucauccccgccaccguggugaccucccgcggccugcagcuggggcagacgagcaccgccaccauccagcccucccagcaggcccagaucgucacccggagcgugcuccaggcggccgccgccgcggccgccgccgccuccaugcagcugcccccgccccgccugcagcccccgccccuccagcagaugccccagccgcccacgcagcagcaggucaccauccugcagcagcccccgccccugcaggcgaugcagcagcccccgccccagaaggugcggaucaaccuccagcagcagcccccgccccugcagaucaagagcgugccccugcccacccucaagaugcagaccacgcuggucccgcccaccguggaguccagccccgagcgccccaugaacaacucccccgaggcccacaccguggaggcccccagccccgagaccaucugcgagaugaucaccgacgucgugcccgagguggagucccccagccagauggacgucgagcugguguccggcagccccguggcccucuccccgcagccccggugcguccgcagcgggugcgagaacccgcccaucguguccaaggacugggacaacgaguacugcagcaacgagugcguggucaagcacugccgggacguguuccuggccuggguggcgagccgcaacuccaacacggucguguucgugaaguga

SEQ ID NO: 37987 - RNA, 1581 nt, Artificial Sequence
  derived and/or modified sequence opt1 from TOX__Homo_sapiens__NP_055544
auggacgugcgcuucuacccgccgcccgcccagcccgccgcggcccccgacgcccccugccugggccccagccccugccucgaccccuacuacugcaacaaguucgacggggagaacauguacauguccaugaccgagcccagccaggacuacguccccgccucccagagcuaccccggccccucccuggagagcgaggacuucaacaucccgcccaucaccccgcccucccugcccgaccacagccucgugcaccugaacgagguggaguccggguaccacagccugugccaccccaugaaccacaacggccuccugcccuuccacccccagaacauggaccugccggagaucacggucuccaacaugcucgggcaggacggcacccugcugagcaacuccaucagcgugaugcccgacauccggaaccccgagggcacccaguacuccagccacccccagauggccgcgaugcgcccgcgggggcagcccgccgacauccgccagcagcccggcaugaugccccacgggcagcucaccacgaucaaccagucccagcugagcgcccagcugggccucaacaugggcggguccaacgugccccacaacagccccagcccgcccggcuccaagagcgccacccccucccccagcuccagcguccacgaggacgagggggacgacaccuccaagaucaacggcggggagaagcggcccgcgagcgacaugggcaagaagccgaagacccccaagaagaagaagaagaaggaccccaacgagccccagaagccgguguccgccuacgcccuguucuuccgcgacacgcaggccgccaucaagggccagaaccccaacgcgaccuucggggaggugagcaagaucgucgccuccaugugggacggccugggggaggagcagaagcaggucuacaagaagaagaccgaggccgccaagaaggaguaccucaagcagcuggccgcguaccgggccagccugguguccaagagcuacuccgagcccguggacgugaagaccagccagcccccgcagcucaucaacuccaagcccagcguguuccacggccccucccaggcccacagcgcccuguaccugagcucccacuaccaccagcagcccgggaugaacccgcaccucacggccaugcaccccagccugccccgcaacaucgcgcccaagccgaacaaccagaugcccgucaccguguccaucgccaacauggccgugagcccgccgccgccccugcagaucagcccgccccuccaccagcaccugaacaugcagcagcaccagccccugaccaugcagcagccccucggcaaccagcugcccaugcagguccaguccgcccugcacucccccaccaugcagcagggcuucacgcuccagcccgacuaccagaccaucaucaaccccaccagcaccgccgcccagguggugacgcaggcgauggaguacguccgguccgggugccgcaacccgccgccccagcccguggacuggaacaacgacuacugcagcuccggcgggaugcagcgggacaaggcccuguaccugaccuga

SEQ ID NO: 37988 - RNA, 363 nt, Artificial Sequence
  derived and/or modified sequence opt1 from TP53AIP1__Homo_sapiens__NP_001182123
augggcagcuccagcgaggccuccuuccgcagcgcccaggccuccugcagcggggcccggcgccagggccuggggcggggcgaccagaaccucuccgugaugcccccgaacgggcgcgcccagacccacacccccggcugggucagcgacccccuggugcugggcgcccaggugcacgggggcugccgggggaucgaggcccucuccgucagcuccggcagcugguccagcgcgacgguguggauccugaccgggcugucccgccccuuccucccgggcgccaccgugcugcgggaccgcccccugggcagcgccuucgagcucuccuacgaccagaagaaggcgccccugcggcugcaguga

SEQ ID NO: 37989 - RNA, 5928 nt, Artificial Sequence
  derived and/or modified sequence opt1 from TP53BP1__Homo_sapiens__NP_001135451
augcccggcgagcagauggaccccaccgggagccagcuggacagcgacuucagccagcaggacacccccugccucaucaucgaggacagccagcccgagagccaggugcuggaggacgacuccggcagccacuucuccaugcugagccggcaccuccccaaccugcagacccacaaggagaaccccguccuggacgugguguccaaccccgagcagaccgccggggaggagcggggcgacgggaacagcggcuucaacgagcaccucaaggagaacaaggucgccgaccccguggacuccagcaaccuggacacgugcggcuccaucagccaggugaucgagcagcugccccagccgaaccgcaccuccagcguccucgggauguccguggagagcgcgcccgccguggaggaggagaagggcgaggagcuggagcagaaggagaaggagaaggaggaggacaccuccgggaacaccacccacagccugggcgccgaggacaccgccagcucccagcucggguucggcguccuggagcugagccagucccaggacguggaggagaacacggugcccuacgaggucgacaaggagcagcuccagagcgugaccaccaacuccggcuacacccggcugagcgacguggacgccaacacggcgaucaagcacgaggagcaguccaacgaggacauccccaucgccgagcagagcuccaaggacauccccgucaccgcccagcccagcaaggacgugcacguggucaaggagcagaacccgccgcccgcccgcuccgaggacaugcccuucagccccaaggcguccguggccgccauggaggccaaggagcagcugagcgcccaggagcucauggaguccgggcugcagauccagaagucccccgagcccgaggugcuguccacccaggaggaccucuucgaccagagcaacaagaccgucuccagcgacggcugcagcacgcccucccgggaggagggcgggugcagccuggcguccacccccgccaccacccugcaccuccugcagcugagcggccagcgcucccucgugcaggacagccuguccacgaacagcuccgaccugguggcccccagccccgacgccuuccgguccacccccuucaucguccccagcucccccaccgagcaggaggggcgccaggacaagccgauggacaccagcgugcucuccgaggagggcggggagcccuuccagaagaagcugcagagcggcgagcccgucgagcuggagaacccgccccuccugcccgaguccacggugagcccccaggccagcaccccgaucucccagagcacccccguguucccgcccgggucccugccgauccccagccagccccaguucucccacgacaucuucauccccagcccgucccucgaggagcagagcaacgacggcaagaaggacggcgacaugcacuccagcucccugaccgucgagugcagcaagacguccgagaucgagcccaagaacagccccgaggaccuggggcucucccugaccggcgacagcugcaagcugaugcucuccaccagcgaguacucccagagccccaagauggagagccuguccagccaccggaucgacgaggacggggagaacacccagaucgaggacacggagccgaugucccccgugcugaacagcaaguucgugcccgcggagaacgacuccauccucaugaaccccgcccaggacggcgagguccagcugagccagaacgacgacaagaccaagggggacgacaccgacacccgcgacgacaucuccauccuggccacgggcugcaagggccgggaggagaccguggccgaggacgugugcaucgaccugaccugcgacagcgggucccaggccgucccgagccccgcgacccgcuccgaggcccugagcuccgugcuggaccaggaggaggccauggagaucaaggagcaccaccccgaggagggcagcuccgggagcgagguggaggagauccccgagaccccgugcgagucccagggcgaggagcugaaggaggagaacauggagagcgucccccuccaccugucccugacggagacccagagccaggggcucugccugcagaaggagaugcccaagaaggagugcagcgaggccauggagguggagaccuccgugaucagcaucgacuccccgcagaagcuggccauccucgaccaggagcuggagcacaaggagcaggaggcgugggaggaggccaccagcgaggacuccagcgucgugaucguggacgucaaggagcccagcccccggguggacguguccugcgagccccuggagggcgucgagaagugcuccgacagccaguccugggaggacaucgccccggagaucgagcccugcgccgagaaccgccucgacacgaaggaggagaaguccguggaguacgagggcgaccugaaguccgggaccgcggagaccgagcccguggagcaggacagcucccagcccagccugccgcucguccgggccgacgacccccugcgccuggaccaggagcuccagcagccccagacccaggagaagacguccaacagccugaccgaggacuccaagauggccaacgccaagcagcugagcagcgacgccgaggcgcagaagcucggcaagcccuccgcccacgccagccaguccuucugcgagagcuccagcgagaccccguuccacuucacccugcccaaggagggggacaucaucccgccccucacgggcgccaccccgccccucaucggccaccugaagcuggagcccaagcggcacuccacccccaucgggaucagcaacuacccggaguccaccaucgccacgagcgacgugauguccgagagcaugguggagacccacgaccccauccucggcuccgggaagggcgacagcggggcggcccccgacgucgacgacaagcugugccugcgcaugaagcucgugucccccgagaccgaggccagcgaggagucccugcaguucaaccuggagaagccggccaccggcgagcggaagaacggcagcacggccguggcggaguccgucgccagcccccagaagaccaugagcgugcucuccugcaucugcgaggcccgccaggagaacgaggcccggagcgaggacccgcccaccaccccgauccgcgggaaccugcugcacuuccccuccagccagggcgaggaggagaaggagaagcucgagggggaccacacgauccgccagucccagcagcccaugaagccgaucagccccgugaaggaccccgucucccccgcgagccagaagauggugauccagggcccguccagcccccagggggaggccauggugaccgacguccuggaggaccagaaggagggccgguccaccaacaaggagaaccccagcaaggcccugaucgagcgccccucccagaacaacaucggcauccagaccauggagugcagccuccgggugccggagacgguguccgccgccacccagaccaucaagaacgucugcgagcaggggaccagcacgguggaccagaacuucggcaagcaggacgcgaccgugcagaccgagcgcggguccggcgagaagcccgucagcgcccccggggacgacaccgagucccugcacagccagggcgaggaggaguucgacaugccccagccgccccacggccacgugcugcaccggcacaugcgcacgauccgggaggugcgcacccucgucacccgggugaucaccgacguguacuacgucgacgggaccgagguggagcgcaaggugacggaggagaccgaggagcccaucgucgagugccaggagugcgagaccgaggugagccccucccagaccggcgggagcuccggcgaccugggggacaucagcuccuucagcuccaaggccagcucccugcaccggacgagcuccggcaccagccucuccgccaugcacagcuccggcagcuccgggaagggcgccgggccgcugcgcggcaagaccagcggcaccgagcccgcggacuucgcccugcccagcucccgcgggggccccgggaagcucagcccgcgcaagggcgucucccagacggggacccccgugugcgaggaggacggcgacgccggccuggggauccggcagggcgggaaggcccccgugacgccccgcggccgggggcgccggggccgcccgcccagccgcaccacgggcacccgggagaccgccguccccgggccccugggcaucgaggacaucuccccgaaccucagccccgacgacaaguccuucagccgcguggugccccgggucccggacuccacccgccggacggacgugggggcgggcgcccugcgccggagcgacucccccgagauccccuuccaggccgccgcggggcccagcgacggccuggacgccuccagcccgggcaacuccuucguggggcuccgcgucguggccaaguggagcuccaacggcuacuucuacagcgggaagaucacccgggacgugggcgccggcaaguacaagcugcuguucgacgacggguacgagugcgacguccucggcaaggacauccugcugugcgaccccaucccccucgacaccgaggugaccgcccuguccgaggacgaguacuucagcgcggggguggucaagggccaccgcaaggagagcggggagcuguacuacuccaucgagaaggagggccagcggaagugguacaagcgcauggccgugauccucagccuggagcagggcaaccggcugcgcgagcaguacgggcucggccccuacgaggccgugacgccgcugaccaaggccgccgacaucucccuggacaaccucgucgaggggaagcggaagcgccggagcaacguguccagccccgcgacccccaccgccuccagcuccagcuccacgacccccacccgcaagaucaccgagagcccgcgggccuccaugggcgugcugagcgggaagcgcaagcugaucacguccgaggaggagcggagccccgccaagcgcggccgcaaguccgccaccgucaagcccgugggcgcgggggaguucgugagccccugcgaguccggcgacaacaccggggagccgagcgcccucgaggagcagcggggcccccugccccugaacaagacccucuuccugggguacgccuuccugcucacgauggccaccaccagcgacaagcuggccucccgcagcaagcugcccgacggcccgaccggcuccagcgaggaggaggaggaguuccucgagaucccgcccuucaacaagcaguacacggagucccagcugcgggcgggggccggcuacauccuggaggacuucaacgaggcccagugcaacaccgccuaccagugccuccugaucgcggaccagcacugccgcacccggaaguacuuccugugccucgccagcgggauccccugcgucucccacgugugggugcacgacagcugccacgccaaccagcugcagaacuaccgcaacuaccugcucccggccggcuacucccuggaggagcagcggauccuggacuggcagccccgcgagaaccccuuccagaaccucaagguccugcuggugagcgaccagcagcagaacuuccucgagcugugguccgagauccugaugaccgggggcgccgcgagcgugaagcagcaccacuccagcgcccacaacaaggacaucgcccugggcgucuucgacgugguggucaccgacccguccugccccgccagcgugcucaagugcgccgaggcgcugcagcugcccguggucucccaggagugggugauccagugccucaucgugggggagcggaucggcuucaagcagcaccccaaguacaagcacgacuacgucagccacuga

SEQ ID NO: 37990 - RNA, 3405 nt, Artificial Sequence
  derived and/or modified sequence opt1 from TP53BP2__Homo_sapiens__NP_001026855
augcgcuucggcagcaagaugaugcccauguuccugaccguguaccucuccaacaacgagcagcacuucaccgaggucccggugacgcccgagaccaucugccgggacguggucgaccugugcaaggagcccggggagagcgacugccaccuggccgagguguggugcggcuccgagcgccccguggccgacaacgagcggauguucgacguccuccagcgcuucgggagccagcggaacgaggugcgcuucuuccugcggcacgagcgcccgcccggccgggacaucguguccgggccccgcagccaggaccccucccugaagcggaacggcgucaaggugccgggcgaguaccgccggaaggagaacggggugaacagcccccgcauggaccucacccuggcggagcugcaggagauggccucccggcagcagcagcagaucgaggcccagcagcagcuccuggccaccaaggagcagcgccugaaguuccucaagcagcaggaccagcggcagcagcagcaggucgccgagcaggagaagcugaagcgccugaaggagaucgcggagaaccaggaggccaagcucaagaaggugcgggcccugaagggccacguggagcagaagcgccugagcaacgggaagcucgucgaggagaucgagcagaugaacaaccuguuccagcagaagcagcgggagcuggugcucgccguguccaaggucgaggagcugacgcgccagcuggagaugcucaagaacggccgcaucgacagccaccacgacaaccaguccgcgguggccgagcuggaccggcuguacaaggagcuccagcugcgcaacaagcugaaccaggagcagaacgccaagcuccagcagcagcgggagugccugaacaagcgcaacagcgagguggccgucauggacaagcgggugaacgagcugcgcgaccggcucuggaagaagaaggccgcgcugcagcagaaggagaaccugcccguguccagcgacgggaaccucccccagcaggccgccuccgccccgagccgcgucgccgcggugggccccuacauccaguccagcaccaugccccggaugcccagccgcccggagcugcuggucaagcccgcccuccccgacggcucccuggugauccaggccagcgaggggcccaugaagauccagacccugccgaacaugcgguccggcgccgccagccagaccaagggguccaagauccaccccgugggccccgacuggagccccuccaacgcggaccucuucccgagccagggcuccgccagcgucccccaguccacggggaacgcccuggaccagguggacgacggcgaggugccccugcgcgagaaggagaagaagguccggcccuucagcauguucgacgccguggaccaguccaacgccccgcccagcuucgggacccuccgcaagaaccaguccagcgaggacauccugcgggacgcccagguggccaacaagaacgucgccaaggugcccccgcccgugcccaccaagcccaagcagaucaaccugccguacuucggccagaccaaccagccgcccuccgacaucaagcccgacgggagcucccagcagcucagcacggucgugcccagcaugggcaccaagcccaagcccgccggccagcagccccgcgugcugcuguccccgagcauccccuccgucgggcaggaccagacccugagccccggcuccaagcaggagagcccgcccgcggccgccgugcggcccuucacgccccagcccuccaaggacacccuccugccgcccuuccgcaagccccagaccguggccgccagcuccaucuacagcauguacacccagcagcaggcgcccgggaagaacuuccagcaggccguccaguccgcccugaccaagacgcacacccggggcccgcacuucagcuccguguacgggaagcccgugaucgccgccgcgcagaaccagcagcagcaccccgagaacaucuacagcaacucccagggcaagccgggcagccccgagcccgagaccgagcccgucuccagcgugcaggagaaccacgagaacgagcgcaucccgcgcccccucagccccaccaagcugcugcccuuccucuccaacccguaccggaaccagagcgacgccgaccuggaggcccugcgcaagaagcucuccaacgcgccccggccccugaagaagcgcagcuccaucacggagcccgaggggccgaacggccccaacauccagaagcugcucuaccagcggaccaccaucgccgcgauggagaccaucagcgugcccuccuaccccagcaaguccgccagcgucacggccuccagcgaguccccgguggagauccagaaccccuaccugcacguggagcccgagaaggaggucgugagccuggugcccgagucccucagcccggaggacgucgggaacgccuccaccgagaacagcgacaugcccgcgcccucccccggccuggacuacgagccggagggggugcccgacaacagccccaaccugcagaacaaccccgaggagccgaaccccgaggcgccccacgugcucgacgucuaccuggaggaguacccgcccuacccgccgccgcccuaccccagcggcgagcccgagggccccggggaggacuccgugagcaugcgcccgcccgagaucaccggccaggugucccugccgcccgggaagcggaccaaccuccgcaagacgggcagcgagcggaucgcccacggcaugcgcgucaaguucaacccccuggcccugcuccuggacuccagccuggagggggaguucgaccucgugcagcggaucaucuacgagguggacgaccccucccugcccaacgacgagggcaucaccgcccugcacaacgccgucugcgccgggcacaccgagaucgugaaguuccucgugcaguucggcgucaacgugaacgccgccgacagcgacggguggacgccccugcacugcgccgcguccugcaacaacgugcaggucugcaaguuccugguggagagcggcgccgccguguucgccaugaccuacuccgacaugcagaccgccgcggacaagugcgaggagauggaggagggcuacacccagugcagccaguuccucuacgggguccaggagaagaugggcaucaugaacaagggggugaucuacgcccugugggacuacgagccccagaacgacgacgagcugcccaugaaggagggcgacugcaugaccaucauccaccgcgaggacgaggacgagaucgagugguggugggcccggcucaacgacaaggagggguacgugccccgcaaccugcugggccucuacccccggaucaagccccgccagcggucccuggccuga

SEQ ID NO: 37991 - RNA, 1182 nt, Artificial Sequence
  derived and/or modified sequence opt1 from TP53__Homo_sapiens__NP_000537
auggaggagccccagagcgacccguccguggagccgccccugagccaggagaccuucuccgaccucuggaagcugcugcccgagaacaacguccucagcccccugcccucccaggccauggacgaccugaugcucagccccgacgacaucgagcagugguucaccgaggaccccggcccggacgaggcgccccgcaugcccgaggccgcgcccccgguggcccccgcccccgccgcccccacgccggccgcccccgcccccgcgcccuccuggccgcugagcuccagcgugcccucccagaagaccuaccaggggagcuacggcuuccggcugggguuccuccacuccggcaccgccaagagcgugaccugcacguacucccccgcccugaacaagauguucugccagcuggccaagaccugccccguccagcucuggguggacagcaccccgccgcccgggacccgcguccgggccauggcgaucuacaagcagucccagcacaugacggagguggugcgccggugcccccaccacgagcgcugcagcgacuccgacggccuggccccgccccagcaccugauccgggucgagggcaaccuccgcguggaguaccuggacgaccggaacaccuuccgccacagcguggucgugcccuacgagccgcccgagguggggagcgacugcaccaccauccacuacaacuacaugugcaacuccagcugcaugggcgggaugaaccggcgccccauccugacgaucaucacccucgaggacuccagcggcaaccugcuggggcggaacuccuucgagguccgcgugugcgccugccccggccgggaccgccggaccgaggaggagaaccuccgcaagaagggcgagccccaccacgagcugccgcccgggagcaccaagcgggcccugcccaacaacacguccagcagcccccagcccaagaagaagccccucgacggcgaguacuucacccugcagauccgcgggcgggagcgcuucgagauguuccgcgagcugaacgaggcccucgagcugaaggacgcgcaggccggcaaggagcccggcgggucccgggcccacuccagccaccugaaguccaagaagggccagagcaccucccgccacaagaagcucauguucaagaccgaggggccggacagcgacuga

SEQ ID NO: 37992 - RNA, 570 nt, Artificial Sequence
  derived and/or modified sequence opt1 from TP53I11__Homo_sapiens__NP_001245253
auggccgccaagcagcccccgccccugaugaagaagcacagccagaccgaccucgugucccgccugaagacccggaagauccugggcgucgggggcgaggacgacgacggggaggugcaccgcagcaagaucucccaggugcucggcaacgagaucaaguucacgauccgggagccccuggggcugcgcgucuggcaguucgugagcgcgguccucuucuccggcaucgccaucauggcccuggccuuccccgaccagcuguacgacgccguguucgacggcgcccaggugaccagcaagaccccgauccggcucuacgggggcgcgcugcuguccaucagccucaucauguggaacgcccuguacaccgccgagaaggugaucauccgcuggacgcugcucaccgaggcgugcuacuucgggguccaguuccugguggugaccgccacccuggccgagacgggccucaugucccuggggauccugcuccugcuggucagccggcuccuguucguggugaucuccaucuacuacuacuaccaggucggccgccggcccaagaaggccuga

SEQ ID NO: 37993 - RNA, 1182 nt, Artificial Sequence
  derived and/or modified sequence opt1 from TP53I13__Homo_sapiens__NP_612358
auggcgcccccgccgcccagcccccagcugcuccugcuggccgcccucgcccgccugcugggccccuccgaggugauggccgggcccgccgaggaggccggcgcgcacugccccgagagccucuggccccugccgccccaggucagcccccgggugaccuacacccgcgugucccccgggcaggccgaggacgucacguuccuguaccacccgugcgcccaccccuggcucaagcugcagcuggcccuccuggcguacgccugcauggccaaccccucccugacccccgacuucagccucacccaggaccggccgcuggugcugaccgccuggggccucgcccuggagauggcguggguggagcccgccugggccgcccacuggcugaugcgccggcgccggcgcaagcagcggaagaagaaggccuggaucuacugcgagucccucagcgggcccgcgcccuccgagccgacgcccggccgcggccggcugugccgccgggggugcguccaggcccuggcccucgccuucgcccugcgcagcuggcggccgcccggcaccgaggugaccucccaggggccccgccagcccagcuccagcggcgcgaagcggcgccggcugcgcgccgcccucgggccccagcccacccgguccgcccugcgcuucccgagcgccucccccggcagccugaaggcgaagcaguccauggccggcauccccgggcgcgagagcaacgccccgagcgugcccacggucucccuccugcccggcgcccccgggggcaacgcgagcucccggaccgaggcccaggugccgaacggccaggggagccccggcgggugcgugugcuccagccaggccucccccgcgccccgcgccgccgccccgccccgggccgcccgcggccccacgccccggaccgaggaggccgcgugggccgccauggcccugaccuuccuccugguccugcucacccuggccacccugugcacccgccuccaccggaacuuccgccgcggggagagcaucuacuggggcccgacggcggacucccaggacaccguggccgccgugcugaagcggcggcugcuccagcccagccgccgggucaagcgcucccggcgccggccccugcugcccccgacccccgacagcggccccgagggggaguccagcgaguga

SEQ ID NO: 37994 - RNA, 747 nt, Artificial Sequence
  derived and/or modified sequence opt1 from TP53I3__Homo_sapiens__NP_001193731
augcuggccgugcacuucgacaagcccggcgggccggagaaccucuacgucaaggagguggccaagcccagccccggcgagggggaggugcugcugaaggucgcggccuccgcccucaaccgcgccgaccugaugcagcggcagggccaguacgacccgccgcccggggccagcaacauccugggccucgaggcguccggccacguggccgagcuggggcccggcugccaggggcacuggaagaucggcgacaccgccauggcccugcuccccgggggcggccaggcgcaguacgugaccguccccgaggggcugcugaugcccauccccgagggccucacgcugacccaggccgccgccauccccgaggccuggcugaccgcguuccagcuccugcaccugguggggaacgugcaggccggcgacuacguccucauccacgccggccugagcggggugggcaccgccgccauccagcugacgcgcauggcgggggccaucccgcucgugaccgccggcucccagaagaagcugcagauggccgagaagcugggggccgcggccggcuucaacuacaagaaggaggacuucagcgaggccacccucaaguucaccaagguccaggccaacgccggcgagugcuuccacggggcgaacuccgccagccugcugcacggcgggccgcccacguccgccgccggcagcgggcagaaccuccccuccgaccggaaccccggcggccccuga

SEQ ID NO: 37995 - RNA, 495 nt, Artificial Sequence
  derived and/or modified sequence opt1 from TP53INP1__Homo_sapiens__NP_001129205
auguuccagcgccugaacaagauguucgugggcgaggucagcuccagcuccaaccaggagcccgaguucaacgagaaggaggacgacgaguggauccucguggacuucaucgacacgugcaccggguucagcgccgaggaggaggaggaggaggaggacaucuccgaggagagcccgaccgagcaccccuccguguucagcugccugcccgccucccuggagugccucgcggacaccagcgacuccugcuuccugcaguucgagagcugccccauggaggaguccugguucaucaccccgccgcccugcuucaccgccggcgggcugacgaccaucaaggucgagaccagccccauggagaaccuccugaucgagcaccccuccaugagcguguacgccgugcacaacuccugccccggccugagcgaggccacccgggggacggacgagcuccacucccccagcagcccccgcgcccggaaguccugccuguga

SEQ ID NO: 37996 - RNA, 663 nt, Artificial Sequence
  derived and/or modified sequence opt1 from TP53INP2__Homo_sapiens__NP_067025
auguuccagcgccugagcucccucuucuucagcacccccuccccgcccgaggaccccgacugcccccgggccuucgugagcgaggaggacgaggucgacggguggcugaucaucgaccugccggacuccuacgccgcgccgcccagccccggggccgcccccgcccccgccggccgcccgccgcccgcgcccucccucauggacgagagcugguucgugaccccgcccgccugcuucacggccgaggggcccggccuggggcccgcccggcugcaguccagcccccucgaggaccugcugaucgagcaccccuccaugagcguguacgucaccggcuccaccaucgugcucgagcccggcagccccagcccccugcccgacgcggcccugccggacggggaccucuccgagggcgagcugacccccgcccgccgggagccccgcgccgcccggcacgcggcgccccugccggcccgcgccgcccuccuggagaaggccggccaggugcggcgccugcagcgggcccgccagcgggccgagcgccacgcccucuccgccaaggcgguccagcggcagaaccgcgcccgggagagccgcccccggcgcuccaagaaccagagcagcuucaucuaccagcccugccagcggcaguucaacuacuga

SEQ ID NO: 37997 - RNA, 762 nt, Artificial Sequence
  derived and/or modified sequence opt1 from TP53RK__Homo_sapiens__NP_291028
auggccgccgcgcgcgccaccacccccgccgacggcgaggagccggcccccgaggccgaggcgcuggccgccgcccgggagcgcagcucccgguuccucagcgggcuggagcuggugaagcagggcgcggaggcccgcgucuuccgggggcgcuuccagggccgggccgccgugaucaagcaccgcuuccccaagggguaccggcaccccgcccucgaggcgcgccugggccggcgccggacggugcaggaggcccgcgcccugcuccggugccgccgggccggcaucuccgccccggucguguucuucguggacuacgcgagcaacugccuguacauggaggagaucgagggguccgucaccgugcgcgacuacauccagagcaccauggagaccgagaagacgccccagggccuguccaaccucgccaagaccaucggccaggugcuggcccggaugcacgacgaggaccugauccacggggaccucaccaccagcaacaugcugcugaagccgccccucgagcagcugaacaucguccugaucgacuucgggcucuccuucaucagcgcccugcccgaggacaagggcguggaccuguacgugcucgagaaggccuuccuguccacgcaccccaacaccgagaccgucuucgaggcguuccucaagagcuacuccaccagcuccaagaaggcccgccccgugcugaagaagcuggacgaggugcggcugcgcggccgcaagcggagcauggucggguga

SEQ ID NO: 37998 - RNA, 375 nt, Artificial Sequence
  derived and/or modified sequence opt1 from TP53TG3C__Homo_sapiens__NP_001192188
augcgcgccagccccugcaucucccagccggccgcgagcuggcacccccggcccuccgcccugcgccccaccgccggcagcgggccggacacccggacgcccggcaccguggaggacggguccgcccccugccccgccuuccgcagcccggcggucucccccugcggcgaggagcccugcugcuuccagaucagccccgccgaggagacccucgagcuggggcggcugguguccccgggcaacugcgacacccucagcccccgcgccgccggcuucuacgcgugccacgugcggucccugauccccugccgcagcacgaaggggcgguggccccugaccgccuccgccgccggccucagcuccuucagcggguga

SEQ ID NO: 37999 - RNA, 1668 nt, Artificial Sequence
  derived and/or modified sequence opt1 from TP63__Homo_sapiens__NP_001108450
augaacuucgagaccagccgcugcgccacccugcaguacugccccgaccccuacauccagcgguucguggagacgcccgcccacuucuccuggaaggagagcuacuaccgcuccaccaugagccaguccacccagaccaacgaguuccucagccccgaggucuuccagcacaucugggacuuccuggagcagcccaucugcuccgugcagcccaucgaccugaacuucguggacgagcccagcgaggacggcgcgacgaacaagaucgagaucuccauggacugcauccggaugcaggacagcgaccucuccgaccccauguggccccaguacaccaaccuggggcugcucaacagcauggaccagcagauccagaacggcuccagcuccaccagccccuacaacaccgaccacgcccagaacuccgucacggcccccagccccuacgcccagcccuccagcaccuucgacgcccugagcccgucccccgcgauccccagcaacaccgacuaccccgggccgcacuccuucgacgugagcuuccagcaguccagcaccgccaaguccgccacguggaccuacagcaccgagcugaagaagcucuacugccagaucgccaagaccugccccauccagaucaaggugaugacgcccccgccccagggcgcggucauccgcgccaugcccguguacaagaaggccgagcacgugaccgaggucgugaagcggugccccaaccacgagcugucccgcgaguucaacgaggggcagaucgcgcccccgagccaccugauccggguggagggcaacucccacgcccaguacgucgaggaccccaucaccggccgccagagcgugcucgugcccuacgagcccccgcaggucgggaccgaguucacgaccgugcuguacaacuucaugugcaacuccagcugcgugggcgggaugaaccggcgccccauccugaucaucgucacccucgagacccgggacggccaggugcuggggcgccggugcuucgaggcccgcaucugcgccugccccggccgggaccgcaaggccgacgaggacuccauccggaagcagcaggucagcgacuccacgaagaacggcgacgggaccaagcgcccguuccggcagaacacccacggcauccagaugaccagcaucaagaagcgccggucccccgacgacgagcugcucuaccugcccgugcgcgggcgcgagacguacgagaugcugcucaagaucaaggagagccuggagcugaugcaguaccucccccagcacaccaucgagaccuaccggcagcagcagcagcagcagcaccagcaccuccugcagaagcagaccagcauccaguccccgagcuccuacggcaacagcuccccgccccugaacaagaugaacagcaugaacaagcugcccuccgugagccagcugaucaacccccagcagcgcaacgcccucacgcccaccaccauccccgacggcaugggggccaacauccccaugaugggcacccacaugccgauggcgggggacaugaacggccugucccccacgcaggcccugccgccgccccucagcaugcccuccaccagccacugcaccccgccgccgcccuaccccaccgacugcuccaucgugcggaucuggcaggucuga

SEQ ID NO: 38000 - RNA, 1911 nt, Artificial Sequence
  derived and/or modified sequence opt1 from TP73__Homo_sapiens__XP_011540366
auggcccagagcaccgccaccucccccgacggcgggacgaccuucgagcaccuguggagcucccucgagccggacagcaccuacuucgaccugccccaguccagccgcggcaacaacgagguggucgggggcaccgacuccagcauggacguguuccaccuggaggggaugacgaccuccgugauggcgcaguucaaccuccugagcuccaccauggaccagaugagcucccgggccgccagcgccucccccuacacccccgagcacgccgcgagcgucccgacgcacucccccuacgcccagcccagcuccaccuucgacaccaugagccccgccccggugauccccagcaacaccgacuaccccggcccccaccacuucgaggugacguuccagcaguccagcaccgccaaguccgcgaccuggaccuacagcccgcugcucaagaagcuguacugccagaucgccaagacgugccccauccagaucaaggucuccaccccgcccccgcccggcaccgccauccgcgccaugcccguguacaagaaggccgagcacgugaccgacgucgugaagcggugccccaaccacgagcuggggcgcgacuucaacgagggccagagcgcgccggccucccaccucauccggguggaggggaacaaccugagccaguacgucgacgaccccgugacgggccgccaguccguggucgugcccuacgagccgccccagguggggaccgaguucaccaccauccuguacaacuucaugugcaacagcuccugcgucggcggcaugaaccggcgccccauccucaucaucaucacgcuggagaugcgggacggccaggugcuggggcgccggagcuucgaggggcgcaucugcgccugccccggccgggaccgcaaggccgacgaggaccacuaccgggagcagcaggcccucaacgaguccagcgcgaagaacggcgccgccuccaagcgcgccuucaagcagagcccgcccgccgugcccgcgcugggggccggcgucaagaagcggcgccacggggacgaggacaccuacuaccuccaggugcggggccgcgagaacuucgagauccugaugaagcugaaggagucccuggagcucauggagcuggugccccagccccuggucgacagcuaccggcagcagcagcagcuccugcagcgccccucccaccuccagccgcccagcuacgggcccgugcugagccccaugaacaagguccacggcggcaugaacaagcugcccuccgugaaccagcugguggggcagcccccgccccacagcuccgccgccacccccaaccucggccccgucgggccgggcaugcugaacaaccacgggcacgccgugcccgcgaacggcgagaugagcuccagccacuccgcccagagcaugguguccggcagccacugcaccccgccgccgcccuaccacgccgaccccucccuggucagcuuccucacggggcugggcugccccaacugcaucgaguacuucaccucccaggggcugcagagcaucuaccaccuccagaaccugaccaucgaggaccugggcgcccucaagauccccgagcaguaccgcaugaccaucuggcgggggcugcaggaccugaagcagggccacgacuacuccacggcgcagcagcuccugcgcagcuccaacgccgccaccaucagcaucggcgggagcggcgagcugcagcggcagcgcgugauggaggccgugcacuuccggguccgccacaccaucaccauccccaaccgcgggggccccggcgggggccccgacgagugggccgacuucggguucgaccuccccgacugcaaggcgcggaagcagcccaucaaggaggaguucacggaggccgagauccacuga

SEQ ID NO: 38001 - RNA, 1263 nt, Artificial Sequence
  derived and/or modified sequence opt1 from TPBG__Homo_sapiens__XP_011534399
augcccggcgggugcagccgcggccccgccgccggggacggccggcugcgccucgcgcggcuggcccuggugcuccuggggugggucuccagcuccagccccaccuccagcgccuccagcuucuccagcuccgcccccuuccuggccagcgcgguguccgcccagcccccgcuccccgaccagugccccgcccugugcgagugcagcgaggccgcgcgcaccgugaagugcgucaaccggaaccugacggaggugcccaccgaccucccggccuacgugcgcaaccuguuccugaccggcaaccagcucgccguccugcccgccggcgccuucgcgcggcgcccgccccuggccgagcucgccgcccugaaccuguccgggagccggcucgacgaggugcgcgccggcgcguucgagcaccuccccucccugcggcagcuggaccugagccacaacccccuggccgaccucucccccuucgccuucagcgggagcaacgccuccgugagcgcccccuccccgcuggucgagcugauccucaaccacaucgugccgcccgaggacgagcgccagaaccggagcuucgagggcaugguggucgcggcccugcuggccgggcgcgcccuccagggccugcggcgccuggagcucgccuccaaccacuuccuguaccugccccgggacgugcucgcgcagcugcccagccugcgccaccucgaccuguccaacaacagccuggugucccucaccuacgucagcuuccggaaccugacgcaccuggagucccuccaccuggaggacaacgcccugaaggugcuccacaacggcacccuggccgagcugcaggggcugccccacauccgcguguuccucgacaacaaccccugggucugcgacugccacauggccgacauggugaccuggcugaaggagaccgaggugguccagggcaaggaccggcugacgugcgcguaccccgagaagaugcgcaaccgcgugcuccuggagcugaacagcgccgaccucgacugcgacccgauccugccgcccucccugcagaccagcuacguguuccucgggaucguccuggcccugaucggcgccaucuuccuccuggugcuguaccucaaccggaagggcaucaagaaguggaugcacaacauccgcgacgccugccgggaccacauggagggguaccacuaccgcuacgagaucaacgcggacccccggcugaccaaccuguccagcaacuccgacgucuga

SEQ ID NO: 38002 - RNA, 2667 nt, Artificial Sequence
  derived and/or modified sequence opt1 from TPCN1__Homo_sapiens__NP_001137291
auggagagcugcuacaucgcccaggccggccuggagcuccugggguccagcuccagccccacccugaccucccagagcgcggagaucacggaggacgccuccaacggcggggugagcgagcagcaccccuggcccuccggcuucgagcgcgagcucaagcccgagaccaucagcucccccggguaccacauccugcgggccaccggcgaggagaacauggccgucagccuggacgacgacgugccgcucauccugacccuggacgagggcggguccgcgccccucgcccccagcaacggccuggggcaggaggagcugcccuccaagaacggcgggagcuacgccauccacgacucccaggccccgagccucuccagcggcggcgagagcucccccagcucccccgcccacaacugggagaugaacuaccaggaggcggccaucuaccugcaggagggggagaacaacgacaaguucuucacgcaccccaaggacgccaaggcccuggccgcguaccucuucgcccacaaccaccuguucuaccugauggagcucgccaccgcccugcugcuccugcugcucagccugugcgaggccccggcggugcccgcccugcgccucggcaucuacguccacgccacccuggagcuguucgcccucauggugguggucuucgagcugugcaugaagcugcgguggcucgggcugcacaccuucauccgccacaagcggacgauggugaagaccuccgugcuggucgugcaguucguggaggccaucgucgugcucgugcgccagaugagccacguccgggugacccgcgcgcugcggugcaucuuccugguggacugccgcuacugcggcggcguccggcgcaaccuccggcagaucuuccagucccugccgcccuucauggacauccugcuccugcuccucuucuucaugaucaucuucgccauccugggguucuaccuguucagccccaaccccuccgaccccuacuucagcacccucgagaacuccaucgugagccuguucgugcugcugacgaccgccaacuuccccgacgucaugaugccguccuacagccgcaaccccugguccugcguguucuucaucguguaccucagcaucgagcuguacuucaucaugaaccugcuccuggccgucguguucgacaccuucaacgacaucgagaagcggaaguucaagucccugcuccugcacaagcgcaccgccauccagcacgcguaccggcugcucaucagccagcgccggcccgccggcaucuccuaccgccaguucgaggggcugaugcgguucuacaagccccgcaugagcgcccgcgagcgguaccugacguucaaggcccucaaccagaacaacaccccgcugcugagccucaaggacuucuacgacaucuacgaggucgcggcccugaaguggaaggccaagaagaaccgcgagcacugguucgacgagcugccccggaccgcccuccugaucuucaagggcaucaacauccuggugaaguccaaggccuuccaguacuucauguaccucguggucgcggugaacgggguguggauccuggucgagaccuucaugcugaagggcggcaacuucuucagcaagcacgugcccugguccuaccucguguuccugacgaucuacggggucgagcuguuccucaagguggccggccuggggcccguggaguaccugagcuccggcuggaaccucuucgacuucagcgucaccguguucgccuuccuggggcugcucgcccuggcccugaacauggagccguucuacuucaucgugguccuccgcccccugcagcugcuccggcuguucaagcugaaggagcgcuaccggaacgugcucgacaccauguucgagcugcugccccgcauggcgucccucggccugacccugcucaucuucuacuacagcuucgccaucgugggcauggaguucuucugcgggaucgucuucccgaacugcugcaacacguccaccguggccgacgccuaccgguggcgcaaccacaccgugggcaaccggaccgucguggaggagggguacuacuaccugaacaacuucgacaacauccugaacagcuucgugacgcuguucgagcugaccgucgugaacaacugguacaucaucauggagggcgugaccucccagaccagccacuggucccgccuguacuucaugacguucuacaucgucaccaugguggugaugaccaucaucgucgccuucauccucgaggcguucguguuccggaugaacuacagccgcaagaaccaggacuccgagguggacgggggcaucacccuggagaaggagaucagcaaggaggagcuggucgccgugcucgagcuguaccgggaggcccgcggcgccuccagcgacgugacgcggcugcucgagacccugagccagauggagcgcuaccagcagcacuccauggucuuccuggggcggcgcagccgcaccaaguccgaccucagccugaagauguaccaggaggagauccaggagugguacgaggagcacgcgcgggagcaggagcagcagcgccagcuguccagcuccgccgcccccgccgcccagcagccgcccggcagccggcagcgcucccagaccgugaccuga

SEQ ID NO: 38003 - RNA, 2259 nt, Artificial Sequence
  derived and/or modified sequence opt1 from TPCN2__Homo_sapiens__NP_620714
auggccgagccccaggccgagagcgagccgcugcucggcggggcgcgcggcgggggcggggacuggcccgccggccugaccaccuaccgguccauccaggugggccccggggccgccgcccgcugggaccugugcaucgaccaggcggucguguucaucgaggacgccauccaguaccggagcaucaaccaccgcguggacgccuccagcauguggcucuaccggcgcuacuacuccaacgucugccagcggacgcugagcuucaccaucuuccugauccucuuccuggccuucaucgagacccccuccagccugaccuccacggcggacgugcgcuaccgggccgccccgugggagccgcccugcggccucaccgagagcguggagguccugugccugcucguguucgccgccgaccuguccgugaagggguaccuguucggcugggcgcacuuccagaagaaccucuggcugcugggguaccucgucgugcugguggucagccugguggacuggaccgugucccucagccuggucugccacgagccccugcgcauccggcgccuccugcggcccuucuuccugcuccagaacuccagcaugaugaagaagacccugaagugcauccgcuggucccugcccgagauggccagcgugggccuccugcuggccauccaccucugccuguucacgauguucggcaugcugcuguucgccgggggcaagcaggacgacgggcaggaccgggagcgccugaccuacuuccagaaccugcccgagucccucaccagccugcuggugcuccugaccacggccaacaaccccgacgucaugaucccggcguacagcaagaaccgggccuacgccaucuucuucaucguguucaccgugaucggcucccuguuccucaugaaccugcugaccgccaucaucuacagccaguuccgcggcuaccucaugaagucccugcagaccagccuguuccggcgccggcuggggacgcgcgccgcguucgagguccucuccagcauggugggcgagggcggggccuucccccaggccgugggggucaagccccagaaccugcuccaggugcuccagaagguccagcuggacuccagccacaagcaggccaugauggagaaggugcgcuccuacggcagcgugcugcucuccgccgaggaguuccagaagcuguucaacgagcuggaccggagcgucgugaaggagcacccgccccgccccgaguaccagucccccuuccuccagagcgcgcaguuccuguucggccacuacuacuucgacuaccuggggaaccucaucgcccuggccaaccugguguccaucugcgucuuccucgugcuggacgccgacgugcugcccgcggagcgggacgacuucauccucggcauccugaacugcgucuucaucguguacuaccugcucgagaugcugcugaagguguucgcccucgggcugcgcggcuaccugagcuacccguccaacgucuucgacgggcuccugaccguggugcugcucguccuggagaucagcacccuggccguguaccggcucccccaccccggcuggcgccccgagauggugggccugcugucccucugggacaugacccggaugcugaacaugcugaucgucuuccgcuuccuccggaucaucccgagcaugaagcugauggccgugguggccagcacgguccuggggcucgugcagaacaugcgcgcguucggcgggauccugguggucguguacuacguguucgccaucaucggcaucaaccuguuccgcggggucaucguggcccuccccggcaacuccagccuggcccccgccaacggcuccgcgcccugcgggagcuucgagcagcuggaguacugggccaacaacuucgacgacuucgccgccgcccucgugacccuguggaaccugauggucgugaacaacuggcaggucuuccucgacgcguaccggcgguacuccggcccguggagcaagaucuacuucgugcugugguggcugguguccagcgugaucugggucaaccucuuccuggcccugauccucgagaacuuccugcacaagugggacccccgcucccaccuccagccccuggccgggaccccggaggccaccuaccagaugacgguggagcugcuguuccgggacauccucgaggagcccggcgaggacgagcugaccgagcgccugagccagcacccccaccucuggcugugccgguga

SEQ ID NO: 38004 - RNA, 675 nt, Artificial Sequence
  derived and/or modified sequence opt1 from TPD52__Homo_sapiens__NP_001020423
auggacugccgcgagauggaccuguacgaggacuaccagagccccuucgacuucgacgccggcgugaacaaguccuaccucuaccugagcccguccgggaacagcuccccgcccggcagccccacccugcagaaguucgggcuccugcggaccgaccccguccccgaggagggcgaggacguggccgcgacgaucuccgccaccgagacccugagcgaggaggagcaggaggagcuccgccgggagcuggccaagguggaggaggagauccagacccugucccagguccucgccgccaaggagaagcaccuggcggagaucaagcgcaagcuggggaucaacagccuccaggagcugaagcagaacaucgccaagggcuggcaggacgugacggccaccuccgccuacaagaagaccagcgagacccugucccaggcgggccagaaggccagcgccgccuucuccagcgugggguccgucaucacgaagaagcucgaggacgugaagaacagccccaccuucaaguccuucgaggagaagguggagaaccucaagagcaaggucggcgggaccaagcccgccggcggggacuucggcgaggugcugaacagcgcggccaacgccuccgccaccacgaccgagccgcugcccgagaagacccaggagagccuguga

SEQ ID NO: 38005 - RNA, 435 nt, Artificial Sequence
  derived and/or modified sequence opt1 from TPD52L1__Homo_sapiens__NP_001003396
auggaggcccaggcccagggccugcucgagaccgagccccugcaggggaccgacgaggacgcgguggccagcgccgacuucuccagcaugcuguccgaggaggagaaggaggagcucaaggccgagcugguccagcuggaggacgagaucacgacccuccgccaggugcugagcgccaaggagcggcaccugguggagaucaagcagaagcucggcaugaaccugaugaacgagcugaagcagaacuucuccaagagcuggcacgacaugcagaccaccacggcguacaagaagacccacgagacccucucccacgccgggcagaaggccaccgccgcguucagcaacgucggcacggccaucuccaagaaguucggggacaugagcuacuccauccgccacagcaucuccaugccggccaugcggcgcaaguga

SEQ ID NO: 38006 - RNA, 492 nt, Artificial Sequence
  derived and/or modified sequence opt1 from TPD52L2__Homo_sapiens__NP_001230821
auggacagcgccggccaggggguggccgcgcgcacccccgccgucgagggccugaccgaggccgaggaggaggagcuccgggccgagcugacgaagguggaggaggagaucgugacccugcgccagguccucgccgcgaaggagcggcacugcggggagcugaagcgccggcugggccucuccacccugggggagcugaagcagaaccucagccgcuccuggcacgacguccaggugagcuccgccuacaagaagacccaggagacgcugagccaggccggccagaagaccuccgccgcgcugagcaccgugggcuccgccaucagccggaagcucggggacaugcgcaacuccgccaccuucaagagcuucgaggaccgggugggcacgaucaaguccaagguggucggggaccgcgagaacggcagcgacaaccugccguccagcgccggguccggcgacaagccccugagcgaccccgcccccuucuga

SEQ ID NO: 38007 - RNA, 774 nt, Artificial Sequence
  derived and/or modified sequence opt1 from TPGS2__Homo_sapiens__NP_001258879
auggaggaggaggccagcucccccggccuggggugcagcaagccgcaccucgagaagcugacccugggcaucacccgcauccucgaguccagccccggggugacggaggucaccaucaucgagaagccgcccgccgagcggcacaugaucuccagcugggagcagaagaacaacugcgugaugcccgaggacgugaagaacuucuaccugaugaccaacggcuuccacaugaccugguccgucaagcuggacgcgagcgacgaccagcccgagaagccccacuucgacucccgcagcgugaucuucgagcucgacuccugcaacgggagcggcaaggugugccuggucuacaaguccggcaagcccgcccuggccgaggacacggagaucugguuccucgaccgggcccuguacuggcacuuccugaccgacaccuucaccgccuacuaccgccuccugaucacgcaccuggggcucccgcaguggcaguacgcguucaccagcuacggcaucagcccccaggccaagcagugguucuccauguacaagcccaucaccuacaacaccaaccugcugacggaggagaccgacuccuucgugaacaagcucgaccccagcaagguguucaaguccaagaacaagaucgucaucccgaagaagaaggggcccgugcagcccgccggcgggcagaagggccccagcggcccgagcgggcccuccaccagcuccaccagcaaguccagcuccggcagcgggaaccccacgcggaaguga

SEQ ID NO: 38008 - RNA, 1335 nt, Artificial Sequence
  derived and/or modified sequence opt1 from TPH1__Homo_sapiens__NP_004170
augaucgaggacaacaaggagaacaaggaccacagccuggagcgcggccgggccucccucaucuucagccugaagaacgaggucgggggccugaucaaggcccucaagaucuuccaggagaagcacgugaaccugcugcacaucgagucccgcaagagcaagcggcgcaacuccgaguucgagaucuucguggacugcgacaucaaccgggagcagcucaacgacaucuuccaccuccugaagucccacaccaacgugcuguccgucaaccugcccgacaacuucacccugaaggaggacgggauggagacggugccgugguuccccaagaagaucagcgaccucgaccacugcgcgaaccgcgugcugauguacggcuccgagcuggacgccgaccaccccggguucaaggacaacgucuaccggaagcgccggaaguacuucgccgaccucgccaugaacuacaagcacggcgaccccaucccgaagguggaguucaccgaggaggagaucaagaccuggggcaccguguuccaggagcugaacaagcuguaccccacgcacgccugccgcgaguaccucaagaaccugccccugcucagcaaguacugcggguaccgggaggacaacaucccccagcuggaggacgucuccaacuuccugaaggagcgcaccggcuucagcauccggccgguggcgggguaccucagcccccgcgacuuccugagcggccuggccuuccggguguuccacugcacccaguacguccgccacuccagcgaccccuucuacacccccgagccggacacgugccacgagcuccuggggcacgugccccugcucgccgagcccuccuucgcccaguucagccaggagaucggccuggcgucccugggcgccagcgaggaggccgugcagaagcucgcgaccugcuacuucuucaccgucgaguucgggcugugcaagcaggacggccagcugcggguguucggggccggccuccugagcuccaucagcgagcugaagcacgcccucuccggccacgccaaggugaagcccuucgacccgaagaucacgugcaagcaggagugccugaucaccaccuuccaggacgucuacuucgugagcgaguccuucgaggacgccaaggagaagaugcgcgaguucaccaagaccaucaagcggcccuucggggugaaguacaaccccuacacgcgcagcauccagauccugaaggacaccaaguccaucaccagcgccaugaacgagcuccagcacgaccuggacgucguguccgacgcccuggcgaaggugagccggaagcccuccaucuga

SEQ ID NO: 38009 - RNA, 1473 nt, Artificial Sequence
  derived and/or modified sequence opt1 from TPH2__Homo_sapiens__NP_775489
augcagcccgccaugaugauguucagcuccaaguacugggcccgccggggcuucagccuggacuccgcggugccggaggagcaccagcuccuggggagcuccacccugaacaagcccaacagcggcaagaacgacgacaaggggaacaagggcuccagcaagcgcgaggccgccaccgaguccgggaagacggccgucguguucagccucaagaacgaggugggcggccuggucaaggcccugcgccucuuccaggagaagcgggugaacauggugcacaucgagucccgcaagagccggcggcgcuccagcgaggucgagaucuucguggacugcgagugcgggaagaccgaguucaacgagcugauccagcugcucaaguuccagaccaccaucgugacgcugaacccgcccgagaacaucuggaccgaggaggaggagcuggaggacguccccugguucccccggaagaucuccgagcucgacaagugcagccaccgcgugcugauguacggcuccgagcuggacgcggaccaccccggguucaaggacaacguguaccggcagcgccggaaguacuucgucgacguggccaugggcuacaaguacgggcagcccaucccgcgcguggaguacaccgaggaggagaccaagacguggggcgucguguuccgggagcucagcaagcuguaccccacccacgccugccgcgaguaccugaagaacuucccccuccugaccaaguacugcggcuaccgggaggacaacgugccccagcuggaggacgucuccauguuccucaaggagcgcagcggguucaccgugcggccgguggccggcuaccugagcccccgcgacuuccuggcggggcucgccuaccgggucuuccacugcacgcaguacauccgccacggcuccgacccccuguacacccccgagccggacacgugccacgagcugcucggccacgugccccugcuggccgaccccaaguucgcccaguucagccaggagaucgggcucgccucccugggcgcgagcgacgaggacgugcagaagcuggcgaccugcuacuucuucaccaucgaguucgggcucugcaagcaggagggccagcugcgcgccuacggggccggccugcucuccagcaucggcgagcugaagcacgcccuguccgacaaggccugcgucaaggccuucgaccccaagacgaccugccuccaggagugccugaucaccaccuuccaggaggccuacuucgugagcgaguccuucgaggaggccaaggagaagaugcgggacuucgccaagagcaucacccgcccguucuccgucuacuucaaccccuacacccagagcaucgagauccugaaggacacccgguccaucgagaacguggugcaggaccuccgcagcgaccugaacacggucugcgacgcgcugaacaagaugaaccaguaccucgggaucuga

SEQ ID NO: 38010 - RNA, 750 nt, Artificial Sequence
  derived and/or modified sequence opt1 from TPI1__Homo_sapiens__NP_000356
auggcccccagccgcaaguucuucgugggcgggaacuggaagaugaacggccggaagcagucccugggggagcucaucggcacccugaacgccgcgaaggucccggccgacaccgagguggugugcgccccgcccacggccuacaucgacuucgcccgccagaagcuggaccccaagaucgcggucgccgcccagaacugcuacaaggugaccaacggggccuucaccggcgagaucagccccggcaugaucaaggacugcggggcgaccugggugguccucggccacuccgagcggcgccacguguucggggagagcgacgagcugaucggccagaagguggcccacgcccuggccgaggggcucggcgucaucgccugcaucggcgagaagcuggacgagcgggaggcggggaucacggagaaggugguguucgagcagaccaaggucaucgccgacaacgugaaggacugguccaaggugguccuggccuacgagcccgugugggccaucggcaccgggaagaccgccacgccccagcaggcgcaggaggugcacgagaagcuccgcggcuggcucaagagcaacgucuccgacgccguggcccagagcacccggaucaucuacggcggguccgugaccggcgcgaccugcaaggagcuggccagccagcccgacgucgacggguuccuggugggcggggccucccugaagccggaguucguggacaucaucaacgccaagcaguga

SEQ ID NO: 38011 - RNA, 585 nt, Artificial Sequence
  derived and/or modified sequence opt1 from TPK1__Homo_sapiens__NP_001035947
auggagcacgccuucacgccccuggagccgcuccugagcaccggcaaccugaaguacugccucgugauccugaaccagccccuggacaacuacuuccgccaccucuggaacaaggcccugcugcgggcgugcgccgacgggggcgccaaccgccucuacgacaucaccgagggggagcgggaguccuuccugcccgaguucaucaacggcgacuucgacagcauccgccccgagguccgggaguacuacgccaccaaggggugcgagcugaucuccaccccggaccaggaccacaccgacuucacgaagugccucaagaugcugcagaagaagaucgaggagaaggaccugaagggcaagcaccgccuccacguggacaccggcauggagggggacuggugcggccugauccccguggggcagcccugcaugcaggucaccaccacgggccugaaguggaaccucaccaacgacgugcuggccuucgggacccuggugagcaccuccaacacguacgacggcagcggcgucgugaccguggagaccgaccacccccuccuguggaccauggcgaucaaguccuga

SEQ ID NO: 38012 - RNA, 855 nt, Artificial Sequence
  derived and/or modified sequence opt1 from TPM1__Homo_sapiens__NP_000357
auggacgccaucaagaagaagaugcagaugcugaagcucgacaaggagaacgcccuggaccgcgcggagcaggccgaggccgacaagaaggccgccgaggaccggagcaagcagcuggaggacgagcucgugucccugcagaagaagcugaagggcaccgaggacgagcucgacaaguacagcgaggcgcugaaggacgcccaggagaagcuggagcucgccgagaagaaggccaccgacgcggaggccgacgucgccucccugaaccgccggauccagcugguggaggaggagcucgaccgcgcccaggagcggcuggccacggcgcugcagaagcucgaggaggccgagaaggccgccgacgagagcgagcgcgggaugaaggugaucgagucccgggcccagaaggacgaggagaagauggagauccaggagauccagcugaaggaggcgaagcacaucgccgaggacgccgaccgcaaguacgaggaggucgcccggaagcuggugaucaucgagagcgaccucgagcgcgccgaggagcgggcggagcuguccgagggccaggugcgccagcuggaggagcagcuccggaucauggaccagacccugaaggcccugauggccgccgaggacaaguacagccagaaggaggaccgcuacgaggaggagaucaagguccucuccgacaagcugaaggaggccgagacccgggcggaguucgccgagcgcagcgugaccaagcuggagaaguccaucgacgaccucgaggacgagcuguacgcccagaagcugaaguacaaggccaucagcgaggagcucgaccacgcgcugaacgacaugacguccauguga

SEQ ID NO: 38013 - RNA, 855 nt, Artificial Sequence
  derived and/or modified sequence opt1 from TPM2__Homo_sapiens__NP_001288155
auggacgccaucaagaagaagaugcagaugcugaagcucgacaaggagaacgccaucgaccgcgcggagcaggccgaggccgacaagaagcaggccgaggaccggugcaagcagcuggaggaggagcagcaggcccugcagaagaagcucaagggcaccgaggacgagguggagaaguacagcgaguccgucaaggaggcgcaggagaagcuggagcaggccgagaagaaggccaccgacgccgaggcggacguggccagccugaaccgccggauccagcucguggaggaggagcuggaccgcgcccaggagcggcuggccacggcccuccagaagcuggaggaggcggagaaggccgccgacgaguccgagcgcgggaugaaggucaucgagaaccgggccaugaaggacgaggagaagauggagcugcaggagaugcagcucaaggaggccaagcacaucgcggaggacagcgaccgcaaguacgaggagguggcccggaagcuggugauccuggagggcgagcucgagcgcuccgaggagcgggccgaggucgccgagagcaagugcggggaccuggaggaggagcugaagaucgugaccaacaaccucaagucccuggaggcccaggcggacaaguacagcaccaaggaggacaaguacgaggaggagaucaagcugcucgaggagaagcugaaggaggccgagacccgcgccgaguucgccgagcgguccguggccaagcuggagaagacgaucgacgaccucgaggagacccuggcgagcgccaaggaggagaacgucgagauccaccagacccuggaccagacccuccuggagcugaacaaccucuga

SEQ ID NO: 38014 - RNA, 747 nt, Artificial Sequence
  derived and/or modified sequence opt1 from TPM3__Homo_sapiens__NP_001036816
auggccggcaucaccaccaucgaggccgugaagcgcaagauccagguccugcagcagcaggcggacgacgccgaggagcgggccgagcgccuccagcgggagguggagggggagcgccgggcccgcgagcaggccgaggcggagguggccagccugaaccggcgcauccagcuggucgaggaggagcucgaccgggcccaggagcgccuggccacggcgcugcagaagcucgaggaggccgagaaggccgccgacgaguccgagcggggcaugaaggugaucgagaaccgcgcccugaaggacgaggagaagauggagcugcaggagauccagcucaaggaggcgaagcacaucgccgaggaggccgaccggaaguacgaggagguggcccgcaagcuggucaucaucgagggggaccuggagcggaccgaggagcgcgccgagcucgcggagagcaagugcuccgagcuggaggaggagcugaagaacgugaccaacaaccucaagagccuggaggcccaggccgagaaguacucccagaaggaggacaaguacgaggaggagaucaagauccugaccgacaagcucaaggaggccgagacgcgggccgaguucgcggagcgcagcguggccaagcuggagaagaccaucgacgaccuggaggacaagcucaagugcaccaaggaggagcaccugugcacccagcggaugcuggaccagacgcuccuggaccugaacgagauguga

SEQ ID NO: 38015 - RNA, 855 nt, Artificial Sequence
  derived and/or modified sequence opt1 from TPM4__Homo_sapiens__NP_001138632
auggaggccaucaagaagaagaugcagaugcugaagcucgacaaggagaacgccaucgaccgcgcggagcaggccgaggccgacaagaaggccgccgaggacaagugcaagcaggucgaggaggagcugacccaccuccagaagaagcugaagggcaccgaggacgagcuggacaaguacagcgaggaccugaaggacgcgcaggagaagcucgagcugacggagaagaaggccuccgacgccgagggggacguggccgcgcugaaccggcgcauccagcucguggaggaggagcuggaccgggcccaggagcgccuggccaccgcccuccagaagcuggaggaggccgagaaggcggccgacgagagcgagcggggcaugaaggugaucgagaaccgcgccaugaaggacgaggagaagauggagauccaggagaugcagcugaaggaggccaagcacaucgccgaggaggcggaccggaaguacgaggaggucgcccgcaagcucgugauccuggagggggagcuggagcgggccgaggagcgcgccgagguguccgagcucaagugcggcgaccuggaggaggagcugaagaacgucaccaacaaccucaagagccuggaggccgcguccgagaaguacagcgagaaggaggacaaguacgaggaggagaucaagcugcucuccgacaagcugaaggaggccgagacccgggccgaguucgccgagcgcacgguggccaagcuggagaagaccaucgacgaccucgaggagaagcuggcgcaggccaaggaggagaacguggggcugcaccagacccucgaccagacccugaacgagcugaacugcaucuga

SEQ ID NO: 38016 - RNA, 738 nt, Artificial Sequence
  derived and/or modified sequence opt1 from TPMT__Homo_sapiens__NP_000358
auggacggcacccgcaccagccuggacaucgaggaguacuccgacacggaggugcagaagaaccagguccucacccuggaggaguggcaggacaagugggugaacgggaagaccgccuuccaccaggagcagggccaccagcugcucaagaagcaccuggacaccuuccugaagggcaagagcgggcuccggguguucuucccccugugcgggaaggccgucgagaugaagugguucgcggaccgcggccacuccguggugggcgucgagaucagcgagcuggggauccaggaguucuucacggagcagaaccucuccuacagcgaggagccgaucaccgagauccccggcaccaagguguucaaguccagcuccgggaacaucagccuguacugcugcuccaucuucgaccugccccggaccaacaucggcaaguucgacaugaucugggaccgcggggcccucguggccaucaaccccggcgaccggaagugcuacgccgacacgauguucagccugcugggcaagaaguuccaguaccuccugugcguccuguccuacgacccgaccaagcaccccgggccgcccuucuacgugccccacgccgagaucgagcgccucuucggcaagaucugcaacauccggugccuggagaagguggacgcguucgaggagcgccacaagagcugggggaucgacugccuguucgagaagcucuaccugcugaccgagaaguga

SEQ ID NO: 38017 - RNA, 2802 nt, Artificial Sequence
  derived and/or modified sequence opt1 from TPO__Homo_sapiens__NP_001193673
augcgcgcccuggccgugcucagcgucacccuggugauggcgugcaccgaggccuucuuccccuucaucucccggggcaaggagcugcucugggggaagccggaggagagccgcguguccagcguccuggaggaguccaagcggcugguggacacggccauguacgccaccaugcagcgcaaccucaagaagcggggcauccugagccccgcccagcugcucuccuucagcaagcugcccgagcccaccuccggggugaucgcgcgcgccgccgagaucauggagaccagcauccaggccaugaagcggaaggucaaccugaagacgcagcagucccagcacccgaccgacgcgcucagcgaggaccugcuguccaucaucgccaacaugagcggcugccuccccuacaugcugccgcccaagugccccaacacgugccuggccaacaaguaccgccccaucaccggggccugcaacaaccgggaccacccccgcuggggcgccuccaacaccgcgcucgcccgguggcugcccccgguguacgaggacggcuucagccagccccgcggguggaaccccggcuuccuguacaacggguucccccucccgcccgugcgggaggucacccgccacgugauccagguguccaacgaggucgugaccgacgacgaccgguacagcgaccugcugauggccuggggccaguacaucgaccacgacaucgccuucacgccccaguccaccagcaaggccgcguucgggggcggcgccgacugccagaugaccugcgagaaccagaaccccugcuucccgauccagcuccccgaggaggcccgccccgccgccgggaccgcgugccugcccuucuaccggagcuccgccgccugcggcaccggggaccagggcgcccuguucggcaaccucagcacggccaacccgcgccagcagaugaacgggcugaccuccuuccuggacgcgagcaccguguacggcuccagccccgcccucgagcggcagcugcgcaacuggaccuccgccgaggggcugcuccggguccacgcccgccugcgcgacagcggccgggcguaccugcccuucgugcccccgcgcgcccccgccgccugcgcccccgagccggggauccccggcgagacgcggggccccugcuuccucgcgggggacggccgcgccuccgaggugcccagccugaccgcccugcacacccucuggcugcgggagcacaaccgccuggccgccgcgcucaaggcccugaacgcccacugguccgccgacgccgucuaccaggaggcgcggaagguggugggggcccugcaccagaucaucacccuccgcgacuacaucccgcggauccugggccccgaggccuuccagcaguacgucgggcccuacgagggcuacgacagcacggccaaccccaccguguccaacguguucagcaccgcggccuuccgcuucggccacgccaccauccacccgcugguccggcgccucgacgccuccuuccaggagcaccccgaccugcccgggcuguggcugcaccaggccuucuucagccccuggacgcuccugcggggcgggggccuggacccgcucauccgcgggcugcuggcgcggcccgccaagcuccaggugcaggaccagcugaugaacgaggagcugaccgagcgccucuucguccuguccaacagcuccacccuggaccucgccagcaucaaccugcagcggggccgcgaccacggccugcccggguacaacgaguggcgggaguucugcggccucccccgccuggagaccccggccgaccugagcacggccaucgcgucccgcagcguggccgacaagauccucgaccuguacaagcaccccgacaacaucgacguguggcucgggggccuggccgagaacuuccugccccgggcccgcaccggcccccuguucgccugccucaucgggaagcagaugaaggcgcugcgggacggcgacugguucuggugggagaacucccacgucuucaccgacgcccagcgccgggagcuggagaagcacagccucucccgcgugaucugcgacaacaccgggcugacgcgggugccgauggacgccuuccaggucggcaaguuccccgaggacuucgagagcugcgacuccaucaccgggaugaaccuggaggccuggcgcgagaccuucccccaggacgacaagugcggcuuccccgagagcguggagaacggcgacuucgugcacugcgaggaguccgggcggcgcguccucguguacagcugccggcacggcuacgagcugcaggggcgcgagcagcugaccugcacccaggagggcugggacuuccagccgccccucugcaaggacgugaacgagugcgcggacggggcccacccgcccugccacgccuccgcccggugccgcaacacgaagggcggcuuccagugccugugcgccgaccccuacgagcugggggacgacggccggaccugcgucgacagcgggcgccucccccgggugaccuggaucuccaugagccuggcggcccugcucaucggcggguucgccggccugaccuccacggugaucugccgcuggacccggaccggcaccaagagcacgcugcccaucuccgagaccgggggcgggaccccggagcuccgcugcggcaagcaccaggccgucgggaccagcccccagcgggccgcggcccaggacagcgagcaggaguccgccggcauggagggccgcgacacgcaccgccugccccgggcccuguga

SEQ ID NO: 38018 - RNA, 1692 nt, Artificial Sequence
  derived and/or modified sequence opt1 from TPP1__Homo_sapiens__NP_000382
augggccugcaggccugccuccuggggcuguucgcccucauccugagcggcaagugcuccuacagccccgagccggaccagcgccggacccugccgcccgggugggugucccucggccgcgcggaccccgaggaggagcugagccugaccuucgcccuccggcagcagaacgucgagcgccuguccgagcuggugcaggccgugagcgaccccuccagcccccaguacgggaaguaccucacgcuggagaacgucgccgaccuggugcggcccagcccccucacccugcacaccgugcagaaguggcugcucgccgcgggcgcccagaagugccacuccgucaucacccaggacuuccugacgugcuggcuguccauccgccaggccgagcuccugcugccgggcgccgaguuccaccacuacgucgggggccccaccgagacccacguggugcggagcccccaccccuaccagcucccgcaggcgcuggcgccccacguggacuucgucgggggccugcaccgcuucccgcccaccuccagccuccggcagcgccccgagccccaggugacggggaccgugggccugcaccugggcgugacccccuccgucauccggaagcgcuacaaccucaccagccaggacgugggguccggcacgagcaacaacucccaggccugcgcccaguuccuggagcaguacuuccacgacagcgaccuggcccaguucaugcggcuguucgggggcaacuucgcccaccaggccagcguggcccgcgucgugggccagcaggggcggggccgcgccgggaucgaggccucccuggacgugcaguaccugaugagcgcgggcgccaacaucuccaccugggucuacagcucccccgggcggcacgagggccaggagccguuccuccaguggcugaugcugcucagcaacgaguccgcccugccccacgugcacaccgugagcuacggcgacgacgaggacucccugagcuccgccuacauccagcgcgucaacaccgagcucaugaaggccgcggcccgggggcugacgcuccucuucgccagcggcgacuccggggccggcugcuggagcguguccgggcgccaccaguuccggcccaccuuccccgccagcuccccguacgucaccaccgugggcggcacgagcuuccaggagcccuuccugaucaccaacgagaucguggacuacaucuccgggggcggguucagcaacgucuucccccgccccagcuaccaggaggaggcggugaccaaguuccuguccagcuccccgcaccucccgcccagcuccuacuucaacgccagcggccgcgccuaccccgacguggccgcgcuguccgacggguacugggucgugagcaaccgggugcccauccccugggucuccggcaccagcgccuccacgcccguguucggcgggauccugagccugaucaacgagcaccgcauccucuccggccggccgccccugggguuccugaacccccgccucuaccagcagcacggcgccggccuguucgacgugacccgggggugccacgagagcugccuggacgaggaggucgagggccagggguucugcuccggccccgggugggacccggugaccggcuggggcacccccaacuuccccgcccuccugaagacgcugcucaaccccuga

SEQ ID NO: 38019 - RNA, 3750 nt, Artificial Sequence
  derived and/or modified sequence opt1 from TPP2__Homo_sapiens__NP_003282
auggccaccgccgcgaccgaggagcccuucccguuccacggccugcuccccaagaaggagacgggggccgccagcuuccugugccgcuaccccgaguacgacggccgcggggugcugaucgccguccucgacaccggcguggaccccggggccccgggcaugcaggucaccaccgacggcaagcccaagaucguggacaucaucgacacgaccggguccggcgacgugaacaccgcgaccgagguggagcccaaggacggggagaucgucggccugagcgggcgggugcugaagauccccgccuccuggacgaacccgagcggcaaguaccacaucggcaucaagaacggguacgacuucuaccccaaggcccucaaggagcggauccagaaggagcgcaaggagaagaucugggaccccgugcaccgggucgcccuggcggaggccugccgcaagcaggaggaguucgacguggccaacaacggcuccagccaggccaacaagcugaucaaggaggagcuccagucccagguggagcugcugaacagcuucgagaagaaguacuccgaccccgggccggucuacgacugccucguguggcacgacggcgagguguggcgggccugcaucgacagcaacgaggacggcgaccuguccaagagcaccguccugcgcaacuacaaggaggcgcaggaguacggguccuucggcaccgccgagaugcucaacuacagcgugaacaucuacgacgacgggaaccugcuguccaucgugaccagcggcggggcccacggcacgcacgucgccuccaucgccgcgggccacuuccccgaggagcccgagcggaacgggguggcccccggcgcccagauccucagcaucaagaucggggacacccgccuguccaccauggagaccggcacggggcugauccgggccaugaucgaggugaucaaccacaagugcgaccucgucaacuacagcuacggcgaggccacccacuggccgaacagcggccgcaucugcgaggugaucaacgaggcgguguggaagcacaacaucaucuacgucuccagcgccgggaacaacggccccugccuguccaccguggggugccccggcgggaccacgagcuccgucaucggcgugggcgccuacgugagccccgacaugauggucgccgaguacucccugcgggagaagcucccggccaaccaguacaccuggagcucccgcgggcccagcgcggacggcgcccuggggguguccaucagcgcccccggcggcgccaucgcguccgugcccaacuggacccugcgggggacccagcucaugaacggcacgagcauguccagcccgaacgccugcgggggcaucgcccugauccuguccgggcucaaggccaacaacaucgacuacaccguccacagcgugcgccgggcccuggagaacaccgcggugaaggccgacaacaucgaggucuucgcccagggccacggcaucauccagguggacaaggccuacgacuaccuggugcagaacaccuccuucgccaacaagcucggguucacggucaccgugggcaacaaccgcgggaucuaccugcgggaccccgugcaggucgcggcccccagcgaccacggcguggggaucgagcccguguucccggagaacaccgagaacagcgagaagaucucccugcagcuccaccuggcccugaccagcaacuccagcuggguccagugccccucccaccucgagcugaugaaccagugccgccacaucaacauccggguggacccccgcggccugcgcgagggccuccacuacacggaggugugcggguacgacaucgccagcccgaacgccggcccccuguuccggguccccaucaccgcggugaucgccgccaaggugaacgaguccagccacuacgaccuggccuucaccgacguccacuucaagcccgggcagauccgccggcacuucaucgaggugccggagggcgcgaccugggccgaggugacggucugcuccugcagcuccgaggugagcgccaaguucgugcuccacgccguccagcuggugaagcagcgcgccuaccggucccacgaguucuacaaguucugcagccugcccgagaaggggacccucaccgaggcguuccccgugcugggcggcaaggccaucgaguucugcaucgcccgcuggugggccucccugagcgacgucaacaucgacuacaccaucuccuuccacgggaucgugugcaccgcgccccagcugaacauccacgccagcgagggcaucaaccgguucgacgugcagagcucccucaaguacgaggaccuggccccgugcaucacgcugaagaacuggguccagacccuccgccccgugagcgccaagaccaagccccuggggucccgggacgugcugcccaacaaccgccagcucuacgagaugguccugaccuacaacuuccaccagcccaagagcggcgaggugacgcccuccugcccccugcucugcgagcugcuguacgagagcgaguucgacucccagcucuggaucaucuucgaccagaacaagcggcagauggggagcggcgacgccuacccccaccaguacucccugaagcuggagaagggcgacuacaccauccgccuccagauccggcacgagcagaucagcgaccuggagcgccugaaggaccucccguucaucgugucccaccggcugagcaacacccugucccucgacauccacgagaaccacagcuucgcccugcuggggaagaagaaguccagcaaccucacccugccgcccaaguacaaccagcccuucuucgucacgucccugccggacgacaagauccccaagggcgcggggcccggcugcuaccucgccggcagccugacccuguccaagaccgagcucgggaagaaggccgacgugauccccgugcacuacuaccugaucccgccgcccaccaagacgaagaacggcagcaaggacaaggagaaggacagcgagaaggagaaggaccugaaggaggaguucaccgaggcccuccgcgaccugaagauccaguggaugaccaagcuggacuccagcgacaucuacaacgagcucaaggagaccuaccccaacuaccugccccuguacgucgcgcggcuccaccagcuggacgccgagaaggagcgcaugaagcggcugaacgagaucguggacgccgccaacgccgugaucucccacaucgaccagacggcgcucgccgucuacaucgccaugaagaccgacccccgccccgacgccgccaccaucaagaacgacauggacaagcagaaguccacccugguggacgcgcugugccgcaaggggugcgcccucgccgaccaccuccugcacacgcaggcccaggacggcgccaucagcaccgacgcggaggggaaggaggaggagggcgagagcccgcuggacucccuggccgagaccuucugggagaccacgaaguggaccgaccuguucgacaacaaggugcucaccuucgccuacaagcacgcccuggucaacaagauguacggccgggggcugaaguucgccaccaagcucguggaggagaagcccacgaaggagaacuggaagaacugcauccagcugaugaagcugcucggcuggacccacugcgcgagcuucaccgagaacuggcugcccaucauguacccgcccgacuacugcgucuucuga

SEQ ID NO: 38020 - RNA, 513 nt, Artificial Sequence
  derived and/or modified sequence opt1 from TPPP2__Homo_sapiens__XP_005267381
auggccagcgaggccgagaagaccuuccaccgcuucgcggccuucggcgaguccagcuccagcgggaccgagaugaacaacaagaacuucuccaagcugugcaaggacugcggcaucauggacgggaagacggugaccagcaccgacgucgacaucguguucuccaaggugaaggccaagaacgcccggaccaucacguuccagcaguucaaggaggccgucaaggagcucggccagaagcgcuucaagggcaagagccccgacgaggugcuggagaacaucuacgggcugauggagggcaaggacccggcgaccaccggggccaccaaggccacgaccgugggcgccgucgaccggcucaccgacaccuccaaguacacggggacccacaaggagcgcuucgacgagagcggcaaggggaagggcaucgcgggccgggaggagaugaccgacaacaccggguacguguccggcuacaaggggagcggcacguacgacaagaagaccaaguga

SEQ ID NO: 38021 - RNA, 531 nt, Artificial Sequence
  derived and/or modified sequence opt1 from TPPP3__Homo_sapiens__NP_057224
auggccgccagcaccgacauggcgggccuggaggaguccuuccgcaaguucgccauccacggggaccccaaggccagcggccaggagaugaacgggaagaacugggccaagcucugcaaggacugcaagguggccgacggcaaguccgucaccgggacggacguggacaucguguucagcaaggucaagggcaaguccgcgcgggugaucaacuacgaggaguucaagaaggcccuggaggagcuggccaccaagcgcuucaagggcaagagcaaggaggaggccuucgacgcgaucugccagcucguggccgggaaggagccggccaacgucggcgugaccaaggccaagaccgggggcgccguggaccggcugacggacaccucccgcuacaccgggagccacaaggagcgguucgacgaguccggcaagggcaaggggaucgcgggccgccaggacauccuggacgacagcggguacgucuccgccuacaagaacgccggcaccuacgacgccaaggugaagaaguga

SEQ ID NO: 38022 - RNA, 660 nt, Artificial Sequence
  derived and/or modified sequence opt1 from TPPP__Homo_sapiens__NP_008961
auggccgacaaggccaagcccgcgaaggccgccaaccgcaccccgcccaagagccccggcgaccccuccaaggaccgggccgccaagcgccugagccucgaguccgagggggcgggcgagggggccgccgccagcccggagcuguccgcgcuggaggaggccuuccggcgcuucgccgugcacggcgacgcccgggccaccgggcgcgagaugcacggcaagaacuggagcaagcucugcaaggacugccaggucaucgacggccggaacgugacggugaccgacgucgacaucguguucuccaagaucaagggcaagagcugccgcaccaucaccuucgagcaguuccaggaggcgcuggaggagcuggccaagaagcgguucaaggacaaguccagcgaggaggccgugcgcgagguccaccggcucaucgaggggaaggcccccaucaucuccggggugacgaaggccaucagcucccccaccgugagccgccugaccgacaccacgaaguucaccggcucccacaaggagcgguucgaccccagcgggaagggcaagggcaaggcggggcgcgucgaccugguggacgaguccggcuacgugagcggguacaagcacgccggcaccuacgaccagaagguccagggcgggaaguga

SEQ ID NO: 38023 - RNA, 828 nt, Artificial Sequence
  derived and/or modified sequence opt1 from TPRG1__Homo_sapiens__NP_940887
augagcaccaucggcuccuucgagggguuccaggccgugagccugaagcaggagggcgacgaccagcccuccgagaccgaccaccucagcauggaggaggaggacccgaugccccgccagaucucccggcagagcuccgucacggagagcacccuguaccccaaccccuaccaccagccguacaucucccgcaaguacuucgccacccggcccggggcgaucgagaccgccauggaggaccugaagggccacguggccgagacgagcggggagaccauccagggcuucuggcuccugaccaagaucgaccacuggaacaacgagaaggagcgcauccugcucgugaccgacaagacgcugcugaucugcaaguacgacuucaucaugcucuccugcguccagcugcagcggaucccccugagcgccguguaccgcaucugccucggcaaguucaccuuccccgggaugucccuggacaagcggcagggcgaggggcugcgcaucuacuggggcagcccggaggagcagucccuccugagccgguggaaccccugguccaccgaggugcccuacgccaccuucacggagcaccccaugaaguacaccagcgagaaguuccuggagaucugcaagcucuccggguucaugagcaagcuggucccggcgauccagaacgcccacaagaacagcaccggcuccggccgcgggaagaagcugauggugcucaccgagcccauccugaucgagacguacaccggccugaugagcuucaucgggaaccggaacaagcucggcuacucccuggcccgcggcagcaucggguucuga

SEQ ID NO: 38024 - RNA, 7092 nt, Artificial Sequence
  derived and/or modified sequence opt1 from TPR__Homo_sapiens__NP_003283
auggccgccgugcugcagcagguccucgagcgcaccgagcugaacaagcugcccaaguccgugcagaacaagcucgagaaguuccuggccgaccagcaguccgagaucgacggccugaaggggcggcacgagaaguucaagguggaguccgagcagcaguacuucgagaucgagaagcgccucucccacagccaggagcggcuggugaacgagacccgcgagugccagucccugcggcucgagcuggagaagcugaacaaccagcucaaggcccugaccgagaagaacaaggagcuggagaucgcccaggaccgcaacaucgccauccagagccaguucacccggaccaaggaggagcucgaggccgagaagcgcgaccugauccggaccaacgagcgccugucccaggagcucgaguaccugaccgaggacgugaagcggcugaacgagaagcucaaggagagcaacaccaccaagggcgagcugcagcugaagcucgacgagcugcaggcguccgacgugagcgugaaguaccgcgagaagcggcuggagcaggagaaggagcuccugcacucccagaacaccuggcugaacacggagcucaagaccaagaccgacgagcugcuggcccucgggcgcgagaagggcaacgagauccuggagcugaagugcaaccucgagaacaagaaggaggaggugagccggcuggaggagcagaugaacgggcugaagaccuccaacgagcaccuccagaagcacguggaggaccugcugacgaagcucaaggaggccaaggagcagcaggccagcauggaggagaaguuccacaacgagcugaacgcgcacaucaagcuguccaaccucuacaagagcgccgccgacgacuccgaggccaagagcaacgagcugacccgcgccgucgaggagcugcacaagcuccugaaggaggcgggcgaggccaacaaggccauccaggaccaccuccuggagguggagcaguccaaggaccagauggagaaggagaugcucgagaagaucggccggcuggagaaggagcuggagaacgccaacgaccuccugagcgccaccaagcgcaagggggcgauccugagcgaggaggagcucgccgccaugucccccaccgccgccgcgguggccaagaucgucaagcccggcaugaagcugacggagcuguacaacgccuacguggagacccaggaccagcuccugcuggagaagcucgagaacaagcggaucaacaaguaccuggacgagaucgugaaggaggucgaggccaaggcccccauccugaagcgccagcgggaggaguacgagcgcgcgcagaaggccguggccagccucuccgugaagcuggagcaggccaugaaggagauccagcgccugcaggaggacaccgacaaggcgaacaagcagagcuccguccucgagcgggacaaccgccggauggagauccaggugaaggaccugagccagcagauccgcgugcugcucauggagcuggaggaggcccgggggaaccacgucauccgcgacgaggagguguccagcgccgacaucuccagcuccagcgaggugaucucccagcaccuggucagcuaccggaacaucgaggagcuccagcagcagaaccagcgccugcugguggcccuccgggagcugggcgagacccgcgagcgggaggagcaggagacgaccuccagcaagaucaccgagcugcagcucaagcuggaguccgcccugaccgagcucgagcagcugcgcaagagccggcagcaccagaugcagcuggucgacuccaucgugcgccagcgggacauguaccgcauccuccugagccagacgaccgggguggcgaucccccugcacgccagcucccucgacgacgucagccuggccuccacccccaagcggcccagcaccucccagacggugagcacccccgcccccgugcccgucaucgaguccaccgaggccaucgaggcgaaggccgcccugaagcagcuccaggagaucuucgagaacuacaagaaggagaaggccgagaacgagaagauccagaacgagcagcuggagaagcugcaggagcaggucaccgaccuccgcagccagaacacgaagaucuccacccagcuggacuucgccagcaagcgguacgagaugcugcaggacaacguggagggcuaccgccgcgagaucaccucccuccacgagcggaaccagaagcugaccgcgacgacccagaagcaggagcagaucaucaacaccaugacccaggaccugcgcggcgccaacgagaagcucgccgucgccgaggugcgggcggagaaccugaagaaggagaaggagaugcugaagcucagcgaggugcgccugucccagcagcgggagagccugcucgccgagcagcgcgggcagaaccugcugcucaccaaccugcagacgauccagggcauccuggagcgguccgagaccgagaccaagcagcgccucagcucccagaucgagaagcuggagcacgagaucagccaccugaagaagaagcucgagaacgaggucgagcagcggcacacccugacgcgcaaccuggacgugcagcuccuggacaccaagcggcagcuggacaccgagaccaaccuccaccugaacacgaaggagcugcucaagaacgcccagaaggagaucgccacccugaagcagcaccugagcaacauggaggugcaggucgccucccagagcucccagcgcaccgggaagggccagcccagcaacaaggaggacguggacgaccucgugucccagcugcggcagaccgaggagcaggucaacgaccugaaggagcgccucaagacgagcaccuccaacguggagcaguaccaggcgauggugaccagccuggaggagucccugaacaaggagaagcaggucaccgaggaggugcggaagaacaucgaggugcgccucaaggagagcgccgaguuccagacgcagcuggagaagaagcugauggaggucgagaaggagaagcaggagcuccaggacgacaagcggcgcgccaucgaguccauggagcagcagcugagcgagcugaagaagacccucuccagcgugcagaacgaggugcaggaggcccugcagcgggccuccaccgcgcugagcaacgagcagcaggcccgccgggacugccaggagcaggccaagaucgccgucgaggcccagaacaaguacgagcgcgagcucaugcugcacgcggccgacguggaggcccugcaggccgcgaaggagcaggucuccaagauggccagcguccgccagcaccuggaggagaccacgcagaaggccgagucccagcuccuggagugcaaggccagcugggaggagcgggagcgcaugcugaaggacgaggugagcaagugcgugugccggugcgaggaccucgagaagcagaaccgccugcugcacgaccagaucgagaagcucuccgacaaggucguggccagcgugaaggagggcguccaggggccccugaacgugucccugagcgaggagggcaagucccaggagcagauccucgagauccugcgguucauccgccgggagaaggagaucgcggagacccgcuucgagguggcccaggucgagagccugcgguaccgccagcggguggagcuccuggagcgcgagcugcaggagcuccaggacucccugaacgccgagcgggagaaggugcaggucaccgccaagaccauggcccagcacgaggagcugaugaagaagacggagaccaugaacguggugauggagaccaacaagaugcuccgcgaggagaaggagcggcuggagcaggaccugcagcagaugcaggcgaagguccgcaagcucgagcuggacauccugccccuccaggaggccaacgccgagcugagcgagaaguccgggaugcugcaggccgagaagaagcuccuggaggaggacgugaagcgguggaaggcccgcaaccagcaccuggugagccagcagaaggacccggacaccgaggaguaccggaagcuccuguccgagaaggagguccacacgaagcgcauccagcagcugaccgaggagaucggccgccucaaggcggagaucgcccggagcaacgccucccugaccaacaaccagaaccugauccagagccucaaggaggaccugaacaaggugcgcaccgagaaggagacgauccagaaggaccuggacgccaagaucaucgacauccaggagaaggugaagaccaucacccaggucaagaagaucgggcggcgcuacaagacccaguacgaggagcucaaggcccagcaggacaaggugauggagacguccgcgcagagcuccggcgaccaccaggagcagcacgucagcgugcaggagaugcaggagcugaaggagacccugaaccaggccgagaccaaguccaagagccucgagagccagguggagaaccugcagaagacccuguccgagaaggagaccgaggcccggaaccuccaggagcagacgguccagcugcagagcgagcugucccgccuccggcaggaccugcaggaccgcaccacccaggaggagcagcugcggcagcagaucaccgagaaggaggagaagacgcgcaaggccaucguggcggccaagagcaagaucgcccaccucgccggcgugaaggaccagcugaccaaggagaacgaggagcugaagcagcggaacggggcccucgaccagcagaaggacgagcuggacguccgcaucaccgcgcugaagucccaguacgagggccggaucagccgccucgagcgggagcugcgcgagcaccaggagcggcaccuggagcagcgcgacgagccccaggagcccuccaacaaggugcccgagcagcagcggcagaucacccucaagacgaccccggccagcggggagcgcggcaucgccuccaccagcgacccgcccaccgccaacaucaagcccacgccgguggucuccacccccagcaaggugaccgccgcggccauggccgggaacaaguccacgccccgggccagcauccgccccauggugacgccggccaccgucaccaaccccaccacgacccccaccgcgaccgugaugcccacgacccagguggagucccaggaggccaugcagagcgagggcccggucgagcacgugcccguguucggcuccaccagcggguccguccgcagcaccagccccaacgugcagccguccaucagccagcccauccugacggugcagcagcagacccaggccaccgccuucguccagcccacccagcagucccacccccagaucgagccggcgaaccaggagcugagcuccaacaucguggaggugguccagagcucccccguggagcggcccagcacguccaccgccguguucggcaccgucagcgccacccccuccagcucccucccgaagcgcacgcgggaggaggaggaggacagcaccaucgaggccuccgaccaggugagcgacgacaccguggagaugccccugcccaagaagcugaaguccgucacccccguggggaccgaggaggaggugauggccgaggagagcacggacggcgaggucgagacccagguguacaaccaggacucccaggacagcaucggggagggcgugacccagggcgacuacaccccgauggaggacagcgaggagacgucccagagccuccagaucgaccuggggccccugcaguccgaccagcagaccaccaccagcucccaggacggccaggggaagggcgacgacgucaucgugaucgacagcgacgacgaggaggaggacgacgacgagaacgacggcgagcacgaggacuacgaggaggacgaggaggacgacgacgacgacgaggacgacacggggaugggcgacgagggggaggacuccaacgagggcaccgggagcgcggacggcaacgacggcuacgaggccgacgacgccgagggcggggacgggaccgaccccggcaccgagacggaggaguccaugggcgggggcgaggggaaccaccgcgccgccgacagccagaacuccggcgaggggaacaccggcgcggccgagagcuccuucagccaggaggugucccgggagcagcagcccagcuccgccagcgagcgccaggccccgcgggcgccccagagcccccgccggcccccgcacccccugccgccccgccugaccauccacgcgccgccccaggagcuggggcccccgguccagcggauccagaugacccgccggcagagcgugggccgcggccuccagcugacgcccgggaucggcgggaugcagcagcacuucuucgacgacgaggaccggaccgugcccagcacccccacccuggucgugccgcaccgcacggacggcuucgccgaggccauccacagcccccagguggccggggucccccgguuccgcuucgggcccccggaggacaugccccagaccagcuccagccacuccgaccucggccagcuggcgagccagggcggccuggggauguacgagacgccccuguuccuggcccacgaggaggaguccggcggccggagcgugcccaccacgccgcuccagguggccgcccccgucaccguguucaccgaguccaccacgagcgacgccuccgagcacgcgagccaguccgugcccauggucaccaccagcaccgggacgcucuccaccaccaacgagaccgccacgggcgacgacggggacgagguguucgucgaggccgagagcgagggcaucuccagcgaggccgggcuggagaucgacagccagcaggaggaggagcccgugcaggccuccgacgagagcgaccugccguccaccagccaggacccgcccuccagcuccagcguggacaccuccagcucccagcccaagccguuccgccgcguccggcuccagaccacgcugcgccagggcgugcggggccgccaguucaaccggcagcgcggggugagccacgcgaugggcgggcggggcgggaucaaccgcggcaacaucaacuga

SEQ ID NO: 38025 - RNA, 2136 nt, Artificial Sequence
  derived and/or modified sequence opt1 from TPRN__Homo_sapiens__NP_001121700
auggccgcccugggccgccccgggagcggcccgcgggcggccgugcccgccuggaagcgcgagauccucgagcggaagcgcgccaagcuggccgcgcuggggggcggggccggccccggcgccgccgagcccgagcagcggguccucgcggagucccuggggccgcugcgcgagaaccccuucaugcuccuggaggccgagcggcgccggggcgggggcgccgccggggcccgccugcucgagcgguaccgccgggugcccggcgugcgcgcgcugcgggccgacagcguccugaucaucgagaccgugcccggcuucccgcccgccccccccgccccgggggccgcgcagauccgcgccgccgaggugcucgucuacggcgccccccccgggcgggugucccgccugcuggagcgguucgaccccccggccgcgccccgccggcgcggcagccccgagcgcgcccggcccccgcccccccccccgccccccgcccccccgcgcccccccccggccgcccccuccccccccgcggccccgggcccccgggggggcggggccagccccggcgcccgccgguccgacuuccuccagaagaccgggagcaacuccuucacggugcacccccgcggccugcaccggggcgcgggggcccgccugcucagcaacggccacuccgccccggagccccgggccgggcccgccaaccgccuggcgggcagccccccgggguccggccaguggaagcccaaggucgagagcggcgaccccucccugcaccccccgcccagccccgggacccccuccgccaccccggccagcccccccgccuccgccacccccagccagcggcagugcgugagcgcggccacguccaccaacgacagcuucgagauccgcccggcccccaagcccgugauggagaccaucccgcucggcgaccugcaggcccgggcccuggcgucccuccgcgccaacagccggaacuccuucauggucauccccaagagcaaggccuccggggccccccccccggagggccgccagagcguggagcugcccaagggggaccugggccccgcgucccccagccaggagcucggcucccagccggugcccgggggcgacggggcccccgcccugggcaagagcccccuggaggucgaggcccagugggccguggaggagggcgcgugcccgcggaccgccacggcccucgccgaccgcgccauccgguggcagcgccccuccagcccccccccguuccugcccgcggccuccgaggaggccgagcccgccgaggggcugcgcgugcccggccucgccaagaacagccgggaguacguccgcccggggcugcccgugaccuucaucgacgagguggacuccgaggaggcgccccaggccgccaagcugcccuaccucccgcaccccgcccggccccugcaccccgcgcgcccgggcugcgucgccgagcugcagccccgggggagcaacaccuucaccguggugcccaagcgcaagccgggcacgcuccaggaccagcacuucucccaggccaaccgggagccccgcccccgggaggccgaggaggaggaggccagcugccugcugggccccacccucaagaagcgcuacccgaccguccacgagaucgaggugaucgggggcuaccuggcgcugcagaagagcugccucaccaaggccggguccagccggaagaagaugaagaucuccuucaacgacaagagccugcagacgaccuucgaguaccccuccgagagcucccuggagcaggaggaggaggucgaccagcaggaggaggaggaggaggaggaggaggaggaggaggaggaggaggagggcagcggguccgaggagaagcccuucgcccucuuccugccccgcgccaccuucgugagcuccgugcggccggagagcucccgccugcccgagggcagcuccggccugagcuccuacacccccaagcacagcgucgccuucagcaaguggcaggagcaggcgcucgagcaggccccccgggaggccgagccgccccccguggaggccaugcugacgcccgccucccagaacgaccugagcgacuuccgcuccgagccggcgcucuacuucuga

SEQ ID NO: 38026 - RNA, 828 nt, Artificial Sequence
  derived and/or modified sequence opt1 from TPSAB1__Homo_sapiens__NP_003285
augcugaaccuccugcugcucgcccugcccgugcuggccagccgcgcguacgccgccccggcccccggccaggcccuccagcgggucgggaucgugggcgggcaggaggcgccccgcuccaaguggcccuggcaggucagccugcgggugcacggcccguacuggaugcacuucugcgggggcucccugauccacccccagugggugcucaccgccgcccacugcgugggccccgacgucaaggaccuggccgcgcugcgcgugcagcuccgggagcagcaccuguacuaccaggaccagcugcuccccgugagccgcaucaucguccacccgcaguucuacaccgcccagaucggggccgacaucgcccugcuggagcucgaggagcccgugaacguguccagccacguccacacggugacccugccgcccgccuccgagaccuucccgcccggcaugcccugcugggugaccggguggggcgacgucgacaacgacgagcggcugcccccgcccuucccccucaagcaggucaaggugcccaucauggagaaccacaucugcgacgcgaaguaccaccugggggccuacacgggcgacgacgugcgcaucgugcgggacgacaugcugugcgccggcaacacccgccgggacagcugccagggggacuccggcgggccccucgugugcaaggucaacggcaccuggcugcaggccggcguggugagcuggggcgaggggugcgcccagcccaaccgccccgggaucuacacccgggucacguacuaccuggacuggauccaccacuacgugcccaagaagccguga

SEQ ID NO: 38027 - RNA, 828 nt, Artificial Sequence
  derived and/or modified sequence opt1 from TPSB2__Homo_sapiens__NP_077078
augcugaaccuccugcugcucgcccugcccgugcuggccagccgcgcguacgccgccccggcccccggccaggcccuccagcgggucgggaucgugggcgggcaggaggcgccccgcuccaaguggcccuggcaggucagccugcgggugcgcgaccgguacuggaugcacuucugcggcgggucccugauccacccgcagugggugcucaccgccgcccacugcgugggccccgacgucaaggaccuggccgcgcugcgcgugcagcuccgggagcagcaccuguacuaccaggaccagcugcuccccgugagccgcaucaucguccacccccaguucuacaccgcccagaucggcgccgacaucgcccugcuggagcucgaggagccggugaacguguccagccacguccacacggugacccugccgcccgccuccgagaccuucccgcccgggaugcccugcugggugaccggcuggggcgacgucgacaacgacgagcggcugcccccgcccuucccccucaagcaggucaaggugcccaucauggagaaccacaucugcgacgcgaaguaccaccugggggccuacacgggggacgacgugcgcaucgugcgggacgacaugcugugcgccggcaacacccgccgggacagcugccagggcgacuccgggggcccccucgugugcaaggucaacgggaccuggcugcaggccggcguggugagcuggggcgaggggugcgcccagcccaaccgccccggcaucuacacccgggucacguacuaccuggacuggauccaccacuacgugcccaagaagcccuga

SEQ ID NO: 38028 - RNA, 729 nt, Artificial Sequence
  derived and/or modified sequence opt1 from TPSD1__Homo_sapiens__NP_036349
augcugcuccuggcgccccagaugcugagccuccugcugcucgcccugcccgugcuggccucccccgccuacgucgcccccgcccccggccaggcccuccagcagaccgggaucgugggcgggcaggaggcgccgcgcagcaaguggcccuggcaggucucccugcgggugcgcggccccuacuggaugcacuucugcgggggcagccugauccacccccagugggugcucaccgccgcccacugcguggagccggacaucaaggaccuggccgcgcugcggguccagcuccgcgagcagcaccuguacuaccaggaccagcugcuccccgugucccggaucaucgugcacccccaguucuacaucauccagacgggcgccgacaucgcccugcuggagcucgaggagcccgucaacaucagcucccacauccacaccgugacccugccgcccgccagcgagaccuucccgcccgggaugcccugcugggugacgggcuggggcgacgucgacaacaacgugcaccucccgccgcccuacccccugaaggagguggagguccccgugguggagaaccaccugugcaacgccgaguaccacaccgggcugcacaccgggcacuccuuccagaucguccgcgacgacaugcucugcgcgggcagcgagaaccacgacuccugccagggcgacagcgggggcccccuggugugcaaggugaacgggaccuga

SEQ ID NO: 38029 - RNA, 966 nt, Artificial Sequence
  derived and/or modified sequence opt1 from TPSG1__Homo_sapiens__NP_036599
auggcccugggcgccugcgggcuccugcugcuccuggcggugcccggcgucagccugcgcacccuccagccggggugcggccggccccagguguccgacgccgggggccgcaucgugggcgggcacgccgcccccgccggcgcguggcccuggcaggccagccugcggcugcgccggguccacgugugcgggggcucccuccugagcccgcagugggugcugaccgccgcccacugcuucuccgggagccucaacuccagcgacuaccagguccaccugggcgagcuggagaucacgcucagcccccacuucuccaccgugcgccagaucauccugcacuccagccccuccggccagcccgggaccagcggcgacaucgcgcugguggagcucuccgucccggugacccugagcucccggauccugcccgugugccuccccgaggccagcgacgacuucugccccgggauccgcugcugggucacgggcuggggcuacacccgggagggggagccgcugcccccgcccuacucccugcgcgaggugaaggugagcgucguggacaccgagaccugccggcgcgacuaccccggccccgggggcagcauccuccagcccgacaugcugugcgcccgggggcccggcgacgccugccaggacgacuccggcgggccgcuggugugccaggucaacggcgccugggugcaggcggggaucgugagcuggggcgaggggugcggccgccccaaccggcccggcgucuacacgcgcgugcccgccuacgugaacuggauccggcgccacaucaccgccuccgggggcagcgaguccggguacccgcggcucccccugcuggccggcuucuuccuccccgggcuguuccugcuccuggucagcugcgugcugcucgccaagugccugcugcaccccuccgcggacggcaccccguuccccgcccccgacuga

SEQ ID NO: 38030 - RNA, 417 nt, Artificial Sequence
  derived and/or modified sequence opt1 from TPT1__Homo_sapiens__NP_001273202
auggugagccgcaccgagggcaacaucgacgacucccugaucgggggcaacgccagcgccgaggggcccgagggcgaggggaccgaguccacggucaucaccggcguggacaucgugaugaaccaccaccuccaggagaccagcuucaccaaggaggcguacaagaaguacaucaaggacuacaugaaguccaucaagggcaagcuggaggagcagcggccggagcgcgucaagcccuucaugacgggggccgccgagcagaucaagcacauccuggccaacuucaagaacuaccaguucuucaucggcgagaacaugaaccccgacgggaugguggcccuccuggacuaccgggaggacggcgugacccccuacaugaucuucuucaaggacgggcuggagauggagaagugcuga

SEQ ID NO: 38031 - RNA, 1236 nt, Artificial Sequence
  derived and/or modified sequence opt1 from TPTE2__Homo_sapiens__NP_001135440
augaacgagagcccccagaccaacgaguucaagggcaccacggaggaggccccggccaaggagagcccccacaccuccgaguucaagggggcggcccuggugucccccaucagcaaguccaugcucgagcgccugagcaaguucgaggucgaggacgccgagaacguggccuccuacgaguggacccaccuggugcggcuccugcgccugaucauccucauccggaucuuccaccuccugcaccagaagcgccagcuggagaagcugaugcggcgccuggucagcgagaacaagcggcgcuacacccgggacggcuucgaccucgaccugacguacgugaccgagcgcaucaucgccauguccuuccccagcuccgggcggcagagcuucuaccgcaacccgaucgaggaggugguccgguuccuggacaagaagcaccgcaaccacuaccggguguacaaccucugcuccgagcgcgcguacgaccccaagcacuuccacaaccgggugagccgcaucaugaucgacgaccacaacguccccacccugcacgagauggugguguucaccaaggaggucaacgaguggauggcccaggaccuggagaacaucguggccauccacugcaagggcgggaagggccggacgggcaccauggugugcgcccuccugaucgcguccgagaucuuccugaccgccgaggagagccucuacuacuucggggagcgccggaccaacaagacgcacuccaacaaguuccagggcgucgagacccccagccagaaccgcuacgugggguacuucgcccaggugaagcaccuguacaacuggaaccugccgccccgccggauccucuucaucaagcgcuucaucaucuacuccauccggggcgacgucugcgaccugaagguccagguggugauggagaagaaggugguguucagcagcaccucccuggggaacugcagcauccuccacgacaucgagaccgacaagauccugaucaacgucuacgacggcccgccccuguacgacgacgugaagguccaguucuucuccagcaaccuccccaaguacuacgacaacugccccuucuucuucugguucaacacguccuucauccagaacaaccgccugugccugccccggaacgagcucgacaacccccacaagcagaaggccuggaagaucuacccgcccgaguucgccguggagauccuguucggcgagaaguga

SEQ ID NO: 38032 - RNA, 1602 nt, Artificial Sequence
  derived and/or modified sequence opt1 from TPTE__Homo_sapiens__NP_954868
augaacgagagccccgacccgaccgaccuggccggcgugaucaucgagcucgggcccaacgacagcccccagaccuccgaguucaagggcgccacggaggaggcgcccgccaaggaguccguccuggcccgccugagcaaguucgagguggaggacgccgagaacguggccuccuacgacagcaagaucaagaagaucguccacuccaucgugagcuccuucgcguucggccucuucgggguguuccugguccugcucgacgugacccugauccuggccgaccucaucuucaccgacagcaagcuguacaucccgcuggaguaccgguccaucagccucgccaucgcccuguucuuccugauggacgugcuccugcgcgucuucguggagcggcgccagcaguacuucuccgaccuguucaacauccucgacaccgcgaucaucgugauccugcugcucgucgacgugguguacaucuucuucgacaucaagcugcugcggaacaucccccgcuggacgcaccuccugcggcugcuccgccugaucauccugcuccggaucuuccaccuguuccaccagaagcgccagcuggagaagcucauccggcgccgggucagcgagaacaagcgccgguacacccgcgacggguucgaccuggaccugaccuacgugaccgagcggaucaucgccauguccuuccccagcuccggccgccagagcuucuaccggaaccccaucaaggaggugguccgcuuccucgacaagaagcaccggaaccacuaccgcguguacaaccugugcuccgagcgcgccuacgacccgaagcacuuccacaaccgggugguccgcaucaugaucgacgaccacaacgugcccacgcugcaccagaugguggucuucaccaaggaggugaacgaguggauggcccaggaccucgagaacaucgucgccauccacugcaagggcgggaccgaccggaccggcacgauggugugcgcguuccugaucgccagcgagaucugcagcaccgccaaggagucccuguacuacuucggggagcgccggaccgacaagacccacagcgagaaguuccagggcguggagacgcccucccagaagcgcuacgucgccuacuucgcccaggugaagcaccucuacaacuggaaccugcccccgcggcgcauccuguucaucaagcacuucaucaucuacagcaucccccgguacgugcgcgaccucaagauccagaucgagauggagaagaaggucguguucuccaccaucagccuggggaagugcuccgugcuggacaacaucaccaccgacaagauccucaucgacgucuucgacggccugccccuguacgacgacgugaaggugcaguucuucuacagcaaccugcccacguacuacgacaacugcuccuucuacuucuggcuccacaccagcuucaucgagaacaaccggcuguaccugccgaagaacgagcucgacaaccugcacaagcagaaggcgcgccggaucuaccccuccgacuucgccgucgagauccuguucggcgagaagaugaccagcuccgacgugguggccgggagcgacuga

SEQ ID NO: 38033 - RNA, 2244 nt, Artificial Sequence
  derived and/or modified sequence opt1 from TPX2__Homo_sapiens__XP_011527001
augagccaggugaaguccagcuacuccuacgacgcccccagcgacuucaucaacuucuccagccuggacgacgagggcgacacccagaacaucgacuccugguucgaggagaaggccaaccucgagaacaagcugcuggggaagaacggcaccgggggccucuuccaggggaagacgccgcugcgcaaggcgaaccugcagcaggccaucgucacgccccucaagcccguggacaacaccuacuacaaggaggccgagaaggagaaccugguggagcagagcauccccuccaacgccugcagcucccuggaggucgaggccgcgaucagccggaagaccccggcccagccccagcgccggucccuccgccugagcgcccagaaggaccuggagcagaaggagaagcaccacgugaagaugaaggccaagcggugcgcgacccccgugaucaucgacgagauccuccccuccaagaagaugaaggucagcaacaacaagaagaagccggaggaggagggcuccgcccaccaggacaccgccgagaagaacgccagcucccccgagaaggccaagggccgccacaccgugcccugcaugcccccggcgaagcagaaguuccucaagagcaccgaggagcaggagcuggagaaguccaugaagaugcagcaggagguggucgagaugcggaagaagaacgaggaguucaagaagcuggcccuggccgggaucggccagcccgugaagaaguccgugagccaggucaccaagagcguggacuuccacuuccgcacggacgagcggaucaagcagcaccccaagaaccaggaggaguacaaggaggugaacuucaccagcgagcugcgcaagcaccccuccagcccggcccgggucaccaaggggugcacgaucgugaagcccuucaaccucucccagggcaagaagcgcaccuucgacgagaccgugagcaccuacgucccccuggcccagcaggucgaggacuuccacaagcggacgcccaaccgcuaccaccuccgguccaagaaggacgacaucaaccugcugccgagcaaguccagcgugaccaagaucugccgcgacccccagacccccgugcugcagaccaagcaccgggcgcgcgccgugacgugcaaguccaccgccgagcucgaggccgaggagcuggagaagcugcagcaguacaaguucaaggcccgggagcucgacccccgcauccuggagggcgggccgauccugcccaagaagccgcccgugaagccgcccaccgagcccaucggcuucgaccucgagaucgagaagcggauccaggagcgcgagagcaagaagaagaccgaggacgagcacuucgaguuccacucccgcccgugccccacgaagauccuggaggacgucguggggguccccgagaagaaggugcugcccaucaccgugcccaagagccccgcguucgcccucaagaaccggauccgcaugcccaccaaggaggacgaggaggaggacgagcccgucgugaucaaggcccagccggugccccacuacggcguccccuucaagccccagaucccggaggcccggaccguggagaucugccccuucuccuucgacagccgcgacaaggagcggcagcugcagaaggagaagaagaucaaggagcugcagaagggggaggugcccaaguucaaggcccucccccugccgcacuucgacacgaucaaccugcccgagaagaaggucaagaacgugacccagaucgagcccuucugccucgagaccgaccgccggggcgcgcugaaggcccagaccuggaagcaccagcuggaggaggagcuccgccagcagaaggaggccgccugcuucaaggcgcggcccaacacggugaucucccaggagccguucguccccaagaaggagaagaaguccguggccgagggccugagcgggagccuggugcaggagcccuuccagcucgccaccgagaagcgcgccaaggagcggcaggagcuggagaagcgcauggccgaggucgaggcgcagaaggcccagcagcuggaggaggcccggcuccaggaggaggagcagaagaaggaggagcuggcccgccugcggcgcgagcuggugcacaaggccaaccccauccggaaguaccagggccucgagaucaagagcuccgaccagccgcugaccgugcccgucagccccaaguucuccacccgcuuccacugcuga

SEQ ID NO: 38034 - RNA, 543 nt, Artificial Sequence
  derived and/or modified sequence opt1 from TRA2A__Homo_sapiens__NP_001269688
auguccaaccgccggcgccacaccggcucccgggccaaccccgacccgaacacgugccuggggguguucggccucagccuguacaccaccgagcgcgaccugcgggaggucuucucccgcuacgggccccucagcggcgugaacguggucuacgaccagcggaccgggcgcucccggggcuucgccuucguguacuucgagcgcaucgacgacagcaaggaggcgauggagcgggccaacggcauggagcuggacgggcgccggauccgcguggacuacuccaucaccaagcgggcccacacgcccacccccggcaucuacauggggcgcccgacccacagcggcgggggcggcgggggcgggggcggcgggggcgggggcgggggcggccggcgccgggacuccuacuacgaccgcggguacgaccggggcuacgaccgcuacgaggacuacgacuaccgcuaccggcgcagccccucccccuacuacagccgguaccgcucccggagccgcucccggagcuacagcccccgccgguacuga

SEQ ID NO: 38035 - RNA, 567 nt, Artificial Sequence
  derived and/or modified sequence opt1 from TRA2B__Homo_sapiens__NP_001230808
augagcacccgccggcgccacgugggcaaccgggccaaccccgacccgaacugcugccugggggucuucggccucucccuguacaccacggagcgcgaccugcgggagguguucagcaaguacgggcccaucgccgacguguccaucgucuacgaccagcagagccgccggucccgcggcuucgcguucguguacuucgagaacguggacgacgccaaggaggccaaggagcgggccaacgggauggagcucgacggccgccggauccgcgucgacuucagcaucaccaagcggccccacacccccaccccgggcaucuacauggggcgccccacguacggcuccagccggcgccgggacuacuacgaccgcggguacgaccggggcuacgacgaccgcgacuacuacucccggagcuaccgcgggggcggcgggggcgggggcggcuggcgcgccgcgcaggaccgggaccagaucuaccgccggcgcucccccagccccuacuacucccgcgggggcuaccggagccggucccgcagccgguccuacagcccgcgccgguacuga

SEQ ID NO: 38036 - RNA, 1371 nt, Artificial Sequence
  derived and/or modified sequence opt1 from TRABD2A__Homo_sapiens__NP_001074293
augagccccugguccugguuccugcuccagacccugugccugcucccgaccggcgccgccagccgccgcggggcgcccggcacggccaacugcgagcugaagccccagcaguccgagcugaacagcuuccucuggaccaucaagcgggacccgcccuccuacuucuucgggaccauccacgugcccuacacccgggucugggacuucauccccgacaacagcaaggaggccuuccugcaguccagcaucguguacuucgagcuggaccucacggaccccuacaccaucuccgcccugaccagcugccagaugcugccgcagggcgagaaccuccaggacgugcugccccgcgacaucuacugccggcugaagcgccaccucgaguacgucaagcugaugaugccccuguggaugacccccgaccagcgggggaagggccucuacgccgacuaccuguucaacgcgaucgccggcaacugggagcgcaagcggccggugugggugaugcugauggucaacucccucacggagguggacaucaagagccgcggggugcccguccuggaccuguuccucgcccaggaggccgagcggcugcgcaagcagaccggcgcgguggagaagguggaggagcagugccacccccugaacgggcucaacuucucccagguccccaacuucaucaacgccacccugccgccccaggagcggaucaccgcccaggagaucgacagcuaccugcgccgggagcucaucuacaagcgcaacgagcggaucggcaagcgcgugaaggcccugcuggaggaguuccccgacaagggguucuucuucgccuucggcgcgggccacuucauggggaacaacacggugcucgacguccugcggcgcgagggcuacgagguggagcacgcccccgccgggcggccgauccacaagggcaaguccaagaagaccagcacccgccccacccuguccacgaucuucgcccccaaggugcccacccucgaggucccggcccccgaggcggugagcuccggccacagcacccugccgccccuggugagccgccccggguccgccgacacccccagcgaggccgagcagcgguuccgcaagaagcggcgccggucccagcgccggccccgccuccggcaguucagcgaccuguggguccgccuggaggaguccgacaucgugccgcagcuccaggugcccguccuggaccggcacaucagcacggagcugcgccucccccggcgcggccacucccaccacagccagaugguggccuccagcgccugccugucccuguggacccccgucuucugggugcucgugcuggcguuccagaccgagaccccgcugcuguga

SEQ ID NO: 38037 - RNA, 1131 nt, Artificial Sequence
  derived and/or modified sequence opt1 from TRABD__Homo_sapiens__NP_079480
auggacggcgaggagcagcagcccccgcacgaggccaacguggagcccgucgugcccagcgaggccuccgagcccgugccgcgcguccugagcggggacccccagaaccucuccgacguggacgcguucaaccugcugcucgagaugaagcugaagcggcgccggcagcgccccaaccugccccggaccgugacccagcucgucgccgaggacggcagccgcguguacguggucgggacggcccacuucuccgacgacagcaagcgggacguggugaagaccauccgcgagguccagccggacgugguggucguggagcugugccaguaccggguguccaugcugaagauggacgagagcacccuccugcgcgaggcccaggagcugucccucgagaagcugcagcaggccguccggcagaacggccugaugagcgggcucaugcagaugcugcugcucaagguguccgcgcacaucaccgagcagcugggcauggcccccggcggggaguuccgcgaggccuucaaggaggccagcaaggugcccuucugcaaguuccaccugggcgaccggcccaucccggucacguucaagcgcgcgaucgccgcccucuccuucuggcagaaggugcggcuggccugggggcugugcuuccucagcgaccccaucuccaaggacgacguggagcgcugcaagcagaaggaccugcuggagcagaugauggccgagaugaucggcgaguuccccgaccuccaccggaccaucgucagcgagcgcgacguguaccugaccuacaugcugcggcaggcggcccgccggcucgagcugccccgcgccuccgacgccgagccgcgcaagugcguccccagcgugguggucgggguggugggcaugggccacguccccgggaucgagaagaacugguccaccgaccugaacauccaggagaucaugacggugcccccgcccagcgugagcggccgggucucccgccucgccgugaaggcggccuucuucgggcugcugggcuacagccucuacuggaugggccggcgcaccgccucccuggugcugagccuccccgccgcccaguacugccugcagcgggucaccgaggcgcgccacaaguga

SEQ ID NO: 38038 - RNA, 939 nt, Artificial Sequence
  derived and/or modified sequence opt1 from TRADD__Homo_sapiens__XP_011521722
auggccgccggccagaacgggcacgaggagugggugggcagcgcguaccuguucgucgaguccagccucgacaagguggugcuguccgacgccuacgcccacccccagcagaaggucgccguguaccgcgcccugcaggcggcccucgccgagagcgggggcucccccgacgugcugcagaugcugaagauccaccggagcgacccccagcucaucguccagcugcgcuucugcgggcggcagcccugcggccgcuuccugcgggccuaccgcgagggcgcgcuccgggccgcccugcagcgcucccuggccgccgcgcucgcccagcacagcgugccccugcagcuggagcuccgggccggggccgagcgccuggacgcccugcucgcggacgaggagcggugccuguccugcauccuggcccagcagcccgaccgccuccgggacgaggagcuggccgagcuggaggacgcccuccgcaaccugaagugcggcagcggggcccggggcggggacggcgagguggcguccgcgccccugcagccgcccguccccagccucuccgaggugaagcccccgccgcccccgccgcccgcccagaccuuccuguuccagggccagcccguggucaaccgcccccugagccucaaggaccagcagaccuucgcccgguccguggggcugaaguggcgcaaggugggccggagccugcagcgcgggugccgggcccuccgcgaccccgcccuggacucccuggccuacgaguacgagcgcgagggccucuacgagcaggccuuccagcugcugcggcgcuucguccaggccgagggccggcgcgcgacgcuccagcggcugguggaggcccuggaggagaacgagcucaccagccuggccgaggaccugcucgggcugaccgaccccaacggcgggcuggccuga

SEQ ID NO: 38039 - RNA, 885 nt, Artificial Sequence
  derived and/or modified sequence opt1 from TRAF1__Homo_sapiens__NP_001177876
augaagcaguggaaggcccgccugggcugcgggcucgagagcggccccauggcccuggagcagaaccuguccgaccuccagcugcaggcggccguggaggucgccggggaccuggagguggacugcuaccgggccccgugcagcgagucccaggaggagcucgcccugcagcacuucaugaaggagaagcugcucgcggagcuggagggcaagcugcgcguguucgagaacaucgucgccgugcucaacaaggagguggaggccagccaccuggcccuggcgaccuccauccaccagagccagcucgaccgggagcgcauccugucccuggagcagcgggucguggagcuccagcagacccuggcccagaaggaccaggcccuggggaagcucgagcagagccugcgccugauggaggaggccuccuucgacggcacguuccucuggaagaucaccaacgugacccggcgcugccacgagagcgccugcggccggaccgucucccuguucagccccgcguucuacacggccaaguacggguacaagcugugccuccgccuguaccugaacggcgacgggaccggcaagcggacccaccucucccuguucaucgugaucaugcgcggggaguacgacgcccugcuccccuggcccuuccggaacaaggugaccuucaugcugcuggaccagaacaaccgcgagcacgccaucgacgccuuccggccggaccucagcuccgcgagcuuccagcgcccccaguccgagacgaacgucgccagcggcugcccccuguucuucccccuguccaagcuccagagcccgaagcacgccuacgugaaggacgacaccauguuccugaagugcaucguggagaccagcaccuga

SEQ ID NO: 38040 - RNA, 1506 nt, Artificial Sequence
  derived and/or modified sequence opt1 from TRAF2__Homo_sapiens__NP_066961
auggccgccgcgagcgugacgcccccgggcucccuggagcuccugcagcccggguucagcaagacccugcucggcaccaagcuggaggccaaguaccugugcuccgccugccgcaacguccuccggcgccccuuccaggcccagugcgggcaccgguacugcagcuucugccuggccuccauccugagcuccggcccccagaacugcgcggccugcgugcacgaggggaucuacgaggagggcaucagcauccucgaguccagcuccgccuucccggacaacgccgcgcgccgggagguggagagccugcccgccgucugccccuccgacggcugcaccuggaaggggacccugaaggaguacgagagcugccacgagggccgcugcccccucaugcugaccgagugcccggccugcaaggggcuggugcggcucggcgagaaggagcgccaccuggagcacgagugccccgagcggucccugagcugccgccacugccgggcccccugcugcggggccgacgugaaggcgcaccacgaggucugccccaaguucccgcucacgugcgacggcugcggcaagaagaagaucccccgcgagaaguuccaggaccacgugaagaccugcgggaagugccgggugcccugccgcuuccacgccaucggcugccuggagaccgucgagggggagaagcagcaggagcacgaggugcaguggcugcgggagcaccucgccaugcugcuguccagcgugcucgaggccaagccccugcugggcgaccagucccacgccggcagcgagcuccugcagcgcugcgagagccuggagaagaagaccgcgacguucgagaacaucgucugcgugcucaaccgggagguggagcgcgucgccaugaccgccgaggccugcucccggcagcaccgccuggaccaggacaagaucgaggcccugagcuccaaggugcagcagcucgagcggagcaucgggcugaaggaccuggcgauggccgaccucgagcagaaggugcuggagauggaggccuccaccuacgacggcgucuucaucuggaagaucagcgacuucgcccgcaagcgccaggaggccguggcggggcggaucccggccaucuucucccccgccuucuacaccagccgcuacggcuacaagaugugccugcggaucuaccucaacggggacggcacgggccgcgggacccaccugucccuguucuucguggucaugaagggccccaacgacgcccuccugcgguggcccuucaaccagaaggugacccugaugcuccuggaccagaacaaccgcgagcacgugaucgacgcguuccggccggacgucaccagcuccagcuuccagcgccccgugaacgacaugaacaucgccuccgggugcccccuguucugccccgucagcaagauggaggccaagaacuccuacgugcgggacgacgccaucuucaucaaggccaucguggaccucacgggccuguga

SEQ ID NO: 38041 - RNA, 1458 nt, Artificial Sequence
  derived and/or modified sequence opt1 from TRAF3__Homo_sapiens__NP_001186356
auggagagcuccaagaagauggacagccccggcgcccugcagaccaacccgccccucaagcugcacaccgaccgcuccgccgggacgcccguguucguccccgagcagggcggguacaaggagaaguucgugaagaccguggaggacaaguacaagugcgagaagugccaccugguccucugcagcccgaagcagaccgagugcggccaccgguucugcgaguccugcauggcggcccugcugagcuccagcucccccaagugcaccgccugccaggagagcaucgugaaggacaagguguucaaggacaacugcugcaagcgcgagauccucgcccugcagaucuacugccggaacgagucccgcgggugcgccgagcagcugaugcucggccaccuccugguccaccugaagaacgacugccacuucgaggagcugcccugcgugcggcccgacugcaaggagaaggugcugcgcaaggaccuccgggaccacgucgagaaggcgugcaaguaccgcgaggccacgugcagccacugcaagucccaggugccgaugaucgcccuccaggugagccugcugcagaacgaguccgucgagaagaacaagagcauccagucccugcacaaccagaucugcagcuucgagaucgagaucgagcggcagaaggagaugcugcgcaacaacgaguccaagauccuccaccuccagcgggugaucgacagccaggccgagaagcugaaggagcuggacaaggagauccgccccuuccggcagaacugggaggaggcggacagcaugaaguccagcguggagucccugcagaaccgcgucaccgagcuggagagcguggacaaguccgccggccagguggcccggaacaccgggcuccuggagagccagcugucccgccacgaccagaugcucagcguccacgacauccggcuggccgacauggaccugcgcuuccaggugcucgagaccgccuccuacaacggcgugcugaucuggaagauccgggacuacaagcgccggaagcaggaggcggucauggggaagacgcugagccucuacucccagcccuucuacaccggcuacuucggguacaagaugugcgcccgcguguaccugaacggcgacggcauggggaagggcacccaccugagccucuucuucgugaucaugcgcggggaguacgacgcccugcugcccuggccguucaagcagaaggucacccucaugcugauggaccagggcuccagccggcgccaccugggcgacgccuucaagcccgaccccaacuccagcuccuucaagaagcccacgggggagaugaacaucgccagcggcugcccgguguucgucgcgcagaccgugcucgagaacgggaccuacaucaaggacgacaccaucuucaucaaggugaucgucgacacguccgaccugcccgaccccuga

SEQ ID NO: 38042 - RNA, 1878 nt, Artificial Sequence
  derived and/or modified sequence opt1 from TRAF3IP1__Homo_sapiens__NP_001132962
augaacgccgccgugguccgccggacccaggaggcgcugggcaaggugauccgccggcccccgcucaccgagaagcugcugagcaagccgcccuuccgcuaccuccacgacaucaucacggaggugauccggaugaccggguucaugaagggccuguacaccgacgccgagaugaaguccgacaacgucaaggacaaggacgccaagaucagcuuccugcagaaggccaucgacgugguggucaugguguccggggagccccuccuggccaagcccgcgcgcaucguggccggccacgagcccgagcggaccaacgagcugcuccagaucaucgggaagugcugccugaacaagcugagcuccgacgacgccguccgccgggugcucgccggcgagaagggcgaggugaaggggcgcgcgagccugacgucccggagccaggagcuggacaacaagaacguccgcgaggaggagucccgggugcacaagaacaccgaggaccgcggcgacgccgagaucaaggagcggagcaccucccgcgaccggaagcagaaggaggagcucaaggaggaccgcaagccccgggagaaggacaaggacaaggagaaggccaaggagaacgggggcaaccgccaccgggagggggagcgcgagcgcgccaaggcccgggcgcgccccgacaacgagcggcagaaggaccgcggcaaccgggagcgcgaccgggacagcgagcgcaagaaggagaccgagcggaaguccgagggcgggaaggagaaggagcgccugcgggaccgcgaccgggagcgcgaccgggacaagggcaaggaccgcgaccggcgccgggugaagaacggggagcacagcugggaccuggaccgcgagaagaaccgcgagcacgacaagccggagaagaaguccgccagcuccggcgagaugagcaagaagcucuccgacggcacguucaaggacagcaaggccgagaccgagaccgagaucagcacccgggccuccaagagccugacgaccaagaccuccaagcgccggagcaagaacuccgucgagggggacagcaccuccgacgccgagggcgacgcggggcccgccggccaggacaagagcgaggugcccgagacgcccgagaucccgaacgagcuguccagcaacauccgccggaucccccgccccggguccgcccggcccgccccgccccgcgugaagcggcaggacagcauggaggcccuccagauggaccgcuccggcagcggcaagaccgucuccaacgugaucaccgagagccacaacuccgacaacgaggaggacgaccaguucguggucgaggcggcgccccagcugagcgagauguccgagaucgagauggugaccgccguggagcuggaggaggaggagaagcacgggggccucgucaagaagauccuggagacgaagaaggacuacgagaagcugcagcagagccccaagccgggggagaaggagcggagccucuucgaguccgccuggaagaaggagaaggacaucgugagcaaggagaucgagaagcugcgcaccuccauccagacccugugcaagagcgcccucccccugggcaagaucauggacuacauccaggaggacgucgacgccaugcagaacgagcugcagauguggcacuccgagaaccggcagcacgccgaggcccuccagcaggagcagcgcaucaccgacugcgccguggagccccugaaggcggagcuggccgagcucgagcagcugaucaaggaccagcaggacaagaucugcgccgugaaggccaacauccugaagaacgaggagaagauccagaagauggucuacagcaucaaccucacgucccggcgcuga

SEQ ID NO: 38043 - RNA, 1695 nt, Artificial Sequence
  derived and/or modified sequence opt1 from TRAF3IP2__Homo_sapiens__NP_001157753
augaaccgcagcauccccguggaggucgacgaguccgagccguaccccagccagcugcucaagcccauccccgaguacuccccggaggaggagagcgagccgcccgcccccaacauccggaacauggcccccaacucccugagcgcgcccaccaugcugcacaacuccagcggcgacuucucccaggcccacagcacccucaagcuggccaaccaccagcgccccgugucccgccaggugacgugccugcggacccagguccucgaggacagcgaggacuccuucugccggcgccaccccgggcugggcaaggccuucccgagcgggugcuccgccgugagcgagcccgcguccgagagcguggucggcgcccugcccgccgagcaccaguucuccuucauggagaagcggaaccaguggcucgugagccagcugagcgccgcgucccccgacaccgggcacgacagcgacaaguccgaccagagccugccgaacgccuccgccgacagccucggcggcucccaggagauggugcagcgcccccagccccaccggaaccgcgccgggcuggaccugcccaccaucgacacgggcuacgacagccagccgcaggacguccucgggauccggcagcuggagcgcccccugccccucaccuccgugugcuacccccaggaccugccgcggccccugcgcagccgggaguucccccaguucgagccccagcgcuacccggccugcgcgcagaugcucccgcccaaccugagcccccacgcccccuggaacuaccacuaccacugccccggcucccccgaccaccaggugccguacgggcacgacuacccccgggccgccuaccagcaggucauccagcccgcccugcccggccagccgcuccccggcgcguccgugcgcgggcugcaccccgugcagaaggucauccugaacuaccccagcccgugggaccacgaggagcggcccgcccagcgcgacugcuccuuccccggccucccccggcaccaggaccagccgcaccaccagccgcccaaccgcgccggggcccccggcgagagccuggagugccccgccgagcugcgcccccaggugccccagcccccgucccccgcggccgugccccggccgcccagcaacccgcccgcccgcggcacccucaagaccuccaaccugcccgaggagcugcggaaggucuucaucacguacagcauggacaccgccauggagguggugaaguucgucaacuuccuccuggugaacggguuccagaccgccaucgacaucuucgaggaccgcauccggggcaucgacaucaucaaguggauggagcgcuaccugcgggacaccgugaugaucaucgucgcgaucagccccaaguacaagcaggacguggagggggccgagucccagcucgacgaggacgagcacggccugcacacgaaguacauccaccgcaugaugcagaucgaguucaucaagcaggggagcaugaacuuccgguucauccccguccuguuccccaacgccaagaaggagcacgugccgaccuggcuccagaacacccacguguacuccuggcccaagaacaagaagaacauccugcugcgccuccugcgggaggaggaguacgucgccccgccccgcggcccccugcccacccuccagguggugccccuguga

SEQ ID NO: 38044 - RNA, 1413 nt, Artificial Sequence
  derived and/or modified sequence opt1 from TRAF4__Homo_sapiens__NP_004286
augcccggcuucgacuacaaguuccuggagaagccgaagcgccggcuccugugcccccugugcgggaagcccaugcgcgagcccgugcaggucagcacgugcggccaccgguucugcgacacgugccuccaggaguuccuguccgaggggguguucaagugcccggaggaccagcugccccucgacuacgccaagaucuaccccgaccccgagcuggaggugcagguccugggccucccgauccgcugcauccacagcgaggaggggugccggugguccggcccccugcgccaccuccagggccaccugaacacgugcagcuucaacgugauccccugccccaaccggugcccgaugaagcugucccgccgggaccugcccgcccaccuccagcacgacugccccaagcgccggcugaagugcgaguucugcgggugcgacuucagcggcgaggcguacgagucccacgaggggaugugcccccaggagagcguguacugcgagaacaagugcggcgcccgcaugaugcggcgccugcucgcccagcacgccaccuccgagugcccgaagcggacccagcccugcaccuacugcaccaaggaguucgucuucgacaccauccagagccaccaguaccagugcccccgccugcccguggccugcccgaaccagugcggggugggcaccgucgcgcgggaggaccugcccggccaccucaaggacuccugcaacaccgcccuggugcugugccccuucaaggacagcgggugcaagcaccgcugccccaagcucgccauggcccggcacguggaggaguccgucaagccgcaccuggcgaugaugugcgcccuggugagccgccagcggcaggagcuccaggagcugcgccgcgagcuggaggagcucuccgugggcagcgacgggguccugaucuggaagaucggcuccuacggccggcgccugcaggaggccaaggccaagcccaaccucgagugcuucagccccgccuucuacacccacaaguacggguacaagcuccagguguccgcguuccugaacggcaacgggagcggcgaggggacccaccugagccuguacauccgggugcugcccggcgccuucgacaaccuccuggaguggccguucgcccgccgggucaccuucucccugcucgaccagagcgaccccggccuggccaagccccagcacgugaccgagacguuccacccggaccccaacuggaagaacuuccagaagcccgggaccuggcgcggcucccuggacgagagcucccucggguucggcuaccccaaguucaucagccaccaggacauccggaagcgcaacuacgugcgggacgacgccgucuucauccgcgcggccguggagcugccgcggaagauccuguccuga

SEQ ID NO: 38045 - RNA, 1674 nt, Artificial Sequence
  derived and/or modified sequence opt1 from TRAF5__Homo_sapiens__NP_665702
auggccuacagcgaggagcacaagggcaugcccugcggguucauccgccagaacuccggcaacagcaucucccuggacuucgagccgagcaucgaguaccaguucguggagcggcucgaggagcgcuacaagugcgccuucugccacuccguccugcacaacccccaccagaccgggugcggccaccgguucugccagcacugcauccugagccuccgcgagcugaacaccgugcccaucugccccguggacaaggaggucaucaagucccaggagguguucaaggacaacugcugcaagcgggaggugcugaaccucuacgucuacugcagcaacgcgccggggugcaacgccaaggugauccugggccgcuaccaggaccaccuccagcagugccucuuccagcccgugcagugcuccaacgagaagugccgggagcccguccugcgcaaggaccugaaggagcaccucagcgccuccugccaguuccggaaggagaagugccuguacugcaagaaggacgugguggucaucaaccugcagaaccacgaggagaaccucugccccgaguacccgguguucugccccaacaacugcgccaagaucauccugaagacggagguggacgagcaccuggccgucugccccgaggcggagcaggacugccccuucaagcacuacggcugcgccgugaccgacaagcgccggaaccuccagcagcacgagcacagcgcccugcgcgagcacaugcggcuggugcucgagaagaacguccagcuggaggagcagaucuccgaccugcacaagagccucgagcagaaggaguccaagauccagcagcuggccgagaccaucaagaagcuggagaaggaguucaagcaguucgcgcagcuguucgggaagaacggcagcuuccugccgaacauccagguguucgccucccacaucgacaagagcgccuggcuggaggcccaggugcaccagcuccugcagauggucaaccagcagcagaacaaguucgaccugcgcccccucauggaggccguggacaccgugaagcagaagaucacgcugcuggagaacaacgaccagcggcucgcgguccuggaggaggagaccaacaagcacgacacccacaucaacauccacaaggcccagcuguccaagaacgaggagcgcuucaagcuccuggaggggaccugcuacaacggcaagcugaucuggaaggugacggacuacaagaugaagaagcgggaggccgucgacgggcacaccgugagcaucuucagccaguccuucuacaccagccgcugcggcuaccggcucugcgcccgcgccuaccugaacggcgacggguccggccgggggagccaccugucccucuacuucguggucaugcgcggcgaguucgacagccugcugcaguggcccuuccgccagcgggugacccucaugcugcuggaccaguccggcaagaagaacaucauggagacguucaagcccgacccgaacagcuccagcuucaagcgccccgacggggagaugaacaucgcguccggcugcccccgguucguggcccacagcguccuggagaacgccaagaacgccuacaucaaggacgacacccucuuccugaagguggccguggaccugaccgaccucgaggaccuguga

SEQ ID NO: 38046 - RNA, 1569 nt, Artificial Sequence
  derived and/or modified sequence opt1 from TRAF6__Homo_sapiens__NP_665802
augagccugcucaacugcgagaacuccugcggcagcucccagagcgaguccgacugcugcguggccauggccagcuccugcagcgcggucaccaaggacgacuccgucgggggcaccgccagcacggggaaccuguccagcuccuucauggaggagauccagggcuacgacguggaguucgacccgccccuggagagcaaguacgagugccccaucugccucauggcccugcgcgaggccgugcagacccccugcgggcaccgguucugcaaggccugcaucaucaaguccauccgcgacgcgggccacaagugccccguggacaacgagauccugcucgagaaccagcuguucccggacaacuucgccaagcgggagauccugagccucauggugaagugccccaacgagggcugccugcacaagauggagcugcgccaccucgaggaccaccaggcccacugcgaguucgcccugauggacugcccccagugccagcggcccuuccagaaguuccacaucaacauccacauccugaaggacugcccgcgccggcaggucuccugcgacaacugcgcggccagcauggccuucgaggacaaggagauccacgaccagaacugcccccucgccaacgugaucugcgaguacugcaacaccauccugauccgcgagcagaugcccaaccacuacgaccuggacugccccaccgccccgauccccugcacguucuccaccuucgggugccacgagaagaugcagcggaaccaccucgcgcgccaccuccaggagaacacccagagccacaugcggaugcuggcccaggccgugcacagccuguccgucauccccgacagcggcuacaucuccgaggugcgcaacuuccaggagaccauccaccagcuggaggggcggcuggugcgccaggaccaccagauccgggagcucacggccaagauggagacccagagcauguacgucuccgagcugaagcgcaccauccggacccuggaggacaagguggccgagaucgaggcgcagcagugcaacggcaucuacaucuggaagaucgggaacuucggcaugcaccucaagugccaggaggaggagaagcccguggucauccacagcccgggcuucuacacggggaagcccggcuacaagcugugcaugcgccugcaccuccagcugcccaccgcccagcggugcgccaacuacaucucccuguucgugcacaccaugcagggggaguacgacagccaccuccccuggccguuccagggcaccauccgccugacgauccuggaccaguccgaggcccccgugcggcagaaccacgaggagaucauggacgccaagcccgagcuccuggcguuccagcgccccaccaucccgcgcaaccccaagggcuucggguacgucaccuucaugcaccuggaggcccuccggcagcgcaccuucaucaaggacgacacgcugcuggugcggugcgaggugagcacccgcuucgacaugggcucccuccggcgcgagggguuccagccccggagcaccgacgccggcgucuga

SEQ ID NO: 38047 - RNA, 2013 nt, Artificial Sequence
  derived and/or modified sequence opt1 from TRAF7__Homo_sapiens__NP_115647
augagcuccggcaagagcgcccgguacaaccgguucuccgggggccccagcaaccugccgacccccgacgugaccacggggacccgcauggagaccaccuucggccccgccuucuccgcggucacgaccaucaccaaggccgacgggaccagcacguacaagcagcacugccggacccccuccagcuccagcacccucgccuacuccccgcgcgacgaggaggacagcaugccgcccaucuccacgccccggcgcagcgacuccgccaucagcgugcggucccugcacagcgaguccagcaugagccugcgcuccaccuucagccuccccgaggaggaggaggagcccgagccccugguguucgccgagcagcccuccgucaagcugugcugccagcucugcugcagcguguucaaggacccggugaucacgaccugcggccacaccuucugccggcgcugcgcgcugaaguccgagaagugccccgucgacaacgugaagcugaccguggucgugaacaacaucgccguggccgagcagaucggcgagcuguucauccacugccggcacgggugccgcgucgccggcagcgggaagccgcccaucuucgagguggacccccggggcugccccuucaccaucaagcucuccgcgcgcaaggaccacgaggggagcugcgacuaccggcccgugcgcugccccaacaacccguccugcccgccccugcuccggaugaaccuggaggcccaccugaaggagugcgagcacaucaagugcccccacagcaaguacggcugcaccuucaucggcaaccaggacaccuacgagacgcaccucgagaccugccgcuucgaggggcugaaggaguuccugcagcagaccgacgaccgguuccacgagaugcacgucgcccucgcccagaaggaccaggagaucgccuuccugcgcuccaugcugggcaagcucagcgagaagaucgaccagcuggagaagucccuggagcucaaguucgacgugcuggacgagaaccagagcaagcuguccgaggaccucauggaguuccggcgcgacgcgagcaugcugaacgacgagcugucccacaucaacgcccgccucaacauggggauccugggcagcuacgacccccagcagaucuucaagugcaagggcaccuucguggggcaccagggccccgucuggugccugugcguguacuccaugggggaccuccuguucagcggcagcuccgacaagacgaucaaggugugggacacgugcaccaccuacaagugccagaagacccuggaggggcacgacggcaucguccucgcccugugcauccagggcugcaagcuguacagcggguccgccgacugcaccaucaucgugugggacauccagaaccuccagaaggugaacaccauccgggcccacgacaaccccgucugcacccuggugagcucccacaacguccuguucagcggcucccucaaggcgaucaaggugugggacaucguggggacggagcugaagcugaagaaggagcucaccggccugaaccacuggguccgcgcccugguggccgcccagagcuaccucuacuccgggagcuaccagaccaucaagaucugggacauccggacccuggacugcauccacgugcugcagacguccggcggcagcgucuacuccaucgccgugaccaaccaccacaucgugugcgggaccuacgagaaccugauccacgucugggacaucgagagcaaggagcagguccgcacccucaccggccacguggggacgguguacgcgcuggccgugaucuccacccccgaccagaccaagguguucagcgccuccuacgaccggagccugcgcgucuggagcauggacaacaugaucugcacccagacgcuccugcggcaccagggcuccgugaccgcccuggccgugagccgcgggcgccucuucuccggcgcggucgacagcaccgugaagguguggaccugcuga

SEQ ID NO: 38048 - RNA, 1749 nt, Artificial Sequence
  derived and/or modified sequence opt1 from TRAFD1__Homo_sapiens__NP_006691
auggccgaguuccuggacgaccaggagacccgccucugcgacaacugcaagaaggagauccccguguucaacuucaccauccacgagauccacugccagcggaacaucggcaugugcccgacgugcaaggagcccuuccccaagagcgacauggagacccacauggccgcggagcacugccaggugaccugcaagugcaacaagaagcuggagaagcgccugcucaagaagcacgaggagaccgagugcccccugcggcuggccgucugccagcacugcgaccucgagcuguccauccugaagcucaaggagcacgaggacuacugcggggcccgcacggagcugugcggcaacugcgggcggaacgugcuggucaaggaccucaagacccacccggaggugugcggccgcgagggggaggagaagcggaacgagguggccaucccgcccaacgccuacgacgagagcuggggccaggacggcaucuggaucgcgucccagcugcugcgccagaucgaggcccucgacccgcccaugcggcugccccgccggccccugcgcgccuucgagagcgacgucuuccacaaccggaccaccaaccagcgcaacaucacggcccagguguccauccagaacaaccucuucgaggagcaggagcggcaggagcgcaaccgggggcagcagccgcccaaggagggcggggaggagagcgcgaaccuggacuucaugcuggcccucucccugcagaacgagggccaggccagcuccguggccgagcaggacuucuggcgcgccgucugcgaggcggaccagagccacgggggcccccggucccugagcgacaucaagggcgccgccgacgagaucaugcuccccugcgaguucugcgaggagcuguaccccgaggagcugcucaucgaccaccagaccuccugcaaccccagccgcgcccugcccucccugaacaccgggagcuccagcccccggggcguggaggagcccgacgugaucuuccagaacuuccuccagcaggccgcguccaaccagcuggacagccugauggggcucagcaacucccacccggucgaggagagcaucaucauccccugcgaguucugcggcgugcagcuggaggaggaggugcuguuccaccaccaggaccagugcgaccagcgccccgccaccgccacgaaccacgucaccgagggcaucccccgccucgacucccagccgcaggagaccagccccgagcugccccggcgccgggugcgccaccagggggaccuguccagcggcuaccucgacgacaccaagcaggagacggccaacgggcccaccuccugccugccgcccagccggcccaucaacaacaugaccgccaccuacaaccagcugucccgcagcacguccggcccgcggcccgggugccagcccagcucccccugcgugccgaagcucagcaacuccgacagccaggacauccagggccgcaaccgggacucccagaacggcgcgaucgcccccgggcacgucagcgugauccgcccgccccagaaccuguaccccgagaacaucgugcccuccuucagccccggccccagcgggcgguacggcgccuccgggcgcagcgagggcggccggaacucccgcgucaccccggccgccgcgaacuaccggagccgcaccgccaaggccaagcccuccaagcagcagggggccggcgacgcggaggaggaggaggaggaguga

SEQ ID NO: 38049 - RNA, 2862 nt, Artificial Sequence
  derived and/or modified sequence opt1 from TRAK1__Homo_sapiens__NP_001036111
auggcccugguguuccaguucggccagcccguccgcgcccagccgcuccccgggcugugccacggcaagcugauccggaccaacgcgugcgacgugugcaacagcaccgaccuccccgagguggagaucaucucccugcuggaggagcagcucccccacuacaagcugcgcgccgacacgaucuacggguacgaccacgacgacuggcugcacaccccgcucaucagccccgacgccaacaucgaccugaccaccgagcagaucgaggagacgcugaaguacuuccuccugugcgccgagcgggucggccagaugaccaagaccuacaacgacaucgacgccgugacccgccugcucgaggagaaggagcgggaccuggagcuggcggcccgcaucgggcagucccuccugaagaagaacaagacgcugaccgagcggaacgagcuccuggaggagcaggucgagcacauccgcgaggaggugagccagcugcggcacgagcucuccaugaaggacgagcugcugcaguucuacaccagcgccgccgaggaguccgagcccgagagcgugugcuccacgccccucaagcgcaacgagagcuccagcuccgugcagaacuacuuccaccuggacagccugcagaagaagcucaaggaccuggaggaggagaacgucgugcugcgguccgaggcgagccagcucaagaccgagaccaucaccuacgaggagaaggagcagcagcuggugaacgacugcgucaaggagcugcgcgacgccaacgugcagaucgccuccaucagcgaggagcucgccaagaagaccgaggacgccgcgcggcagcaggaggagaucacgcaccuccugucccagaucguggaccugcagaagaaggccaaggccugcgccgucgagaacgaggagcuggugcagcaccugggcgccgcgaaggacgcccagcgccagcucaccgccgagcugcgggagcuggaggacaaguacgccgagugcauggagaugcuccacgaggcccaggaggagcugaagaaccugcgcaacaagaccaugccgaacaccacgagccggcgcuaccacagccucggccuguuccccauggacucccuggcggccgagaucgaggggaccaugcggaaggagcugcagcucgaggaggccgagagccccgacaucacccaccagaagcgcguguucgagaccguccggaacaucaaccagguggugaagcagcgcucccugacgcccagcccgaugaacauccccggcuccaaccagagcuccgccaugaacagccugcucuccagcugcgucuccacgccccgcagcuccuucuacgggagcgacaucggcaacguggugcuggacaacaagaccaacuccaucauccuggagaccgaggccgcggaccucgggaacgacgagcggagcaagaagcccggcaccccgggcacccccgggucccacgaccuggagaccgcccugcgccggcucagccugcgccgggagaacuaccuguccgagcgccgguucuucgaggaggagcaggagcgcaagcuccaggagcuggccgagaagggcgagcugcggagcgggagccucacccccacggaguccaucaugagccugggcacccacucccgcuucagcgaguucaccggcuucuccgggaugagcuucuccagccgguccuaccugcccgagaagcuccagaucgucaagccgcuggagggcagcgccacccugcaccacuggcagcagcucgcgcagccccaccucgggggcauccuggacccccgccccgggguggucacgaagggcuuccggacccuggacguggaccuggacgagguguacugccugaacgacuucgaggaggacgacaccggcgaccacaucucccucccgcgccuggccaccagcacccccguccagcaccccgagacguccgcccaccaccccgggaagugcaugagccagaccaacuccaccuucaccuucacgaccugccggauccugcacccgagcgacgagcucacccgcgugacccccucccugaacagcgcccccacgccggccugcggcagcaccucccaccucaagagcacccccguggcgacccccugcacgccccggcgccugucccuggccgagagcuucaccaacacccgggaguccaccacgaccaugagcaccucccuggggcucgucuggcugcugaaggagcgcggcaucagcgccgccguguacgacccgcaguccugggaccgcgccgggcggggcagccuccugcacuccuacacccccaagauggcggugauccccagcacgcccccgaacucccccaugcagacccccaccagcuccccgcccagcuucgaguucaagugcaccuccccgcccuacgacaacuuccuggccagcaagcccgccuccagcauccuccgcgagguccgggagaagaacgugcgcagcuccgagagccagacggacguguccgucagcaaccugaaccugguggacaaggugcggcgcuucggcgucgccaagguggugaacuccgggcgggcccacguccccacccucaccgaggagcagggcccccugcugugcgggccgcccggccccgcgcccgcccucgugccccgcgggcuggugcccgagggccugccgcuccggugccccaccgucacgagcgccaucggcgggcugcagcugaacuccggcauccgccggaaccgcagcuuccccaccauggugggguccagcaugcagaugaaggccccggugacccucaccuccggcauccugaugggcgcgaagcugagcaagcagacgucccuccgguga

SEQ ID NO: 38050 - RNA, 2745 nt, Artificial Sequence
  derived and/or modified sequence opt1 from TRAK2__Homo_sapiens__NP_055864
augagccagucccagaacgccaucuucaccagccccaccggcgaggagaaccugaugaacuccaaccaccgcgacagcgaguccaucacggacgugugcagcaacgaggaccucccggaggucgagcuggugucccugcucgaggagcagcugccccaguaccggcugaagguggacacccucuuccuguacgagaaccaggacuggacccagagcccccaccagcgccagcacgccuccgacgcgcugagccccguccucgccgaggagaccuuccgguacaugauccuggggacggaccgcguggagcagaugaccaagaccuacaacgacaucgacauggugacccaccuccuggccgagcgggaccgcgaccuggagcuggccgcccggaucggccaggcgcuccugaagcgcaaccacguccuguccgagcagaacgagagccucgaggagcagcuggggcaggccuucgaccaggugaaccagcugcagcacgagcucugcaagaaggacgagcugcugcggaucguguccaucgccagcgaggaguccgagacggacagcuccugcagcaccccgcuccgcuucaacgaguccuucagccugagccagggccugcuccagcuggagaugcugcaggagaagcucaaggagcuggaggaggagaacauggcccugcgguccaaggcgugccacaucaagaccgagaccgucacguacgaggagaaggagcagcagcucgugagcgacugcgugaaggagcugcgcgagaccaacgcccagaugucccggaugaccgaggagcugagcgggaaguccgacgagcucauccgcuaccaggaggagcugagcucccugcucagccagaucgucgaccugcagcacaagcugaaggagcacgugaucgagaaggaggagcucaagcugcaccuccaggccuccaaggacgcccagcggcagcugaccauggagcugcacgagcugcaggaccgcaacauggagugccucggcaugcugcacgagagccaggaggagaucaaggagcugcggucccgcagcggccccacggcccaccuguacuucucccagagcuacggggcguucaccggcgagucccucgccgccgagaucgaggggaccaugcggaagaagcugagccuggacgaggaguccagccucuucaagcagaaggcccagcagaagcgcguguucgacaccguccggaucgccaacgacacgcgcggccgcuccaucagcuuccccgcgcugcugcccaucccggggagcaaccgguccagcgugaucaugaccgccaagcccuucgaguccggccuccagcagaccgaggacaagagccugcugaaccagggcuccagcuccgaggagguggccgggagcucccagaagaugggccagcccgggcccagcggcgacuccgaccucgccaccgcccugcaccgccugagccuccggcgccagaacuaccuguccgagaagcaguucuucgcggaggaguggcagcggaagauccagguccuggccgaccagaaggagggcgugagcgggugcgugacgccgaccgagucccucgccagccugugcaccacccaguccgagaucacggaccugagcagcgccuccugccuccgcggcuucaugcccgagaagcugcagaucgucaagccccuggaggggagccagacccucuaccacuggcagcagcuggcccagcccaaccugggcaccauccucgacccgcggcccggggugaucaccaagggcuucacgcagcugcccggcgacgcgaucuaccacaucuccgaccuggaggaggacgaggaggaggggaucaccuuccaggugcagcagccccucgaggucgaggagaagcugagcaccuccaagccggugaccggcaucuuccugccgcccaucacgagcgccgggggccccgucaccguggccaccgccaaccccgggaagugccucuccugcaccaacagcaccuucacguucacgaccugccgcauccugcaccccuccgacaucacccaggugacccccagcuccggcuuccccagccuguccugcggcagcuccgggagcuccagcuccaacaccgcggucaacagcccggcccucagcuaccggcuguccaucggcgagagcaucaccaaccgccgggacuccaccacgaccuucagcuccaccaugagccuggccaagcuccugcaggagcgcgggaucuccgccaagguguaccacagccccaucuccgagaacccccugcagccgcuccccaagagccuggccauccccuccacgcccccgaacagccccucccacagccccugccccuccccgcugcccuucgagccccgggugcaccucagcgagaacuuccuggcgucccgccccgccgagaccuuccugcaggagauguacggccuccggccgagccgcaacccgcccgacgucgggcagcugaagaugaaccugguggaccggcucaagcgccugggcaucgcccggguggucaagaaccccggcgcccaggagaacgggcgcugccaggaggccgagaucggcccccagaagcccgacuccgcgguguaccugaacagcgggagcucccuccugggcggccugcgccggaaccagagccuccccgugaucaugggguccuucgccgcccccgucugcaccagcuccccgaagaugggcgugcugaaggaggacuga

SEQ ID NO: 38051 - RNA, 1125 nt, Artificial Sequence
  derived and/or modified sequence opt1 from TRAM1__Homo_sapiens__NP_055109
auggccauccgcaagaaguccaccaagagcccgcccgugcugagccacgaguucguccuccagaaccacgccgacaucguguccugcguggcgauggucuuccugcugggccucauguucgagaucaccgccaaggccagcaucaucuucgugacgcugcaguacaacgugacccugcccgccaccgaggagcaggccaccgaguccgucagccucuacuacuacgggaucaaggaccuggcgacgguguucuucuacaugcugguggccaucaucauccacgccgucauccaggaguacaugcucgacaagaucaaccggcgcaugcacuucuccaagaccaagcacagcaaguucaacgaguccggccagcugagcgccuucuaccuguucgcgugcgugugggggaccuucauccucaucuccgagaacuacaucagcgaccccaccauccuguggcgggccuacccccacaaccugaugacguuccagaugaaguucuucuacaucucccagcucgccuacuggcugcacgccuucccggagcuguacuuccagaagaccaagaaggaggacaucccccgccagcucguguacaucggccuguaccuguuccacaucgccggggcguaccuccugaaccugaaccaccucggccugguccugcucgugcugcacuacuucguggaguuccuguuccacaucagccgccucuucuacuucuccaacgagaaguaccagaagggcuucagccugugggccguccuguucgugcucgggcggcugcugacccucauccuguccgugcugaccgucggcuucgggcucgcccgggccgagaaccagaagcuggacuucagcacgggcaacuucaacgugcuggccgugcgcaucgcgguccucgccuccaucugcgugacccaggccuucaugauguggaaguucaucaacuuccagcugcggcgcuggcgggagcacagcgccuuccaggcccccgcggugaagaagaagcccaccgucaccaaggggcgcagcuccaagaagggcacggagaacggcgugaacgggacccugaccagcaacgucgccgacuccccgcggaacaagaaggagaaguccagcuga

SEQ ID NO: 38052 - RNA, 1110 nt, Artificial Sequence
  derived and/or modified sequence opt1 from TRAM1L1__Homo_sapiens__NP_689615
augggccugcgcaagaaguccaccaagaacccgcccgugcucagccaggaguucauccugcagaaccacgccgacaucgucagcugcguggggauguucuuccugcucggccugguguucgaggggaccgccgaggcguccaucgucuuccugacgcuccagcacagcguggccgugcccgccgccgaggagcaggccaccggcuccaagagccuguacuacuacggggucaaggaccuggcgaccguguucuucuacaugcucguggccaucaucauccacgccaccauccaggaguacguccuggacaagaucaacaagcggaugcaguucacgaaggccaagcagaacaaguucaacgaguccggccaguucagcguguucuacuucuucuccugcaucuggggcaccuucauccugaucagcgagaacugccucuccgaccccacccugaucuggaaggcgcgcccccacagcaugaugaccuuccagaugaaguucuucuacaucucccagcuggccuacugguuccacgccuucccggagcucuacuuccagaagacgaagaagcaggacaucccccggcagcugguguacaucgggcugcaccucuuccacaucaccggcgccuaccugcuguaccucaaccaccuggggcugcuccugcugguccuccacuacuucguggagcugcugagccacaugugcggccucuucuacuucuccgacgagaaguaccagaaggggaucagccugugggccaucguguucauccugggccgccucgucacccugaucguguccgugcugaccgucggcuuccaccucgcggggagccagaaccggaaccccgacgcccugacgggcaacgugaacgugcuggccgccaagaucgccguccucuccagcagcugcaccauccaggcguacgugaccuggaaccugaucacccuguggcuccagcgcuggguggaggacuccaacauccaggccagcugcaugaagaagaagcggucccgcagcuccaagaagcggacggagaacggggucggcguggagaccagcaaccgcgucgacugcccgcccaagcggaaggagaaguccagcuga

SEQ ID NO: 38053 - RNA, 1113 nt, Artificial Sequence
  derived and/or modified sequence opt1 from TRAM2__Homo_sapiens__NP_036420
auggccuuccgccggcgcaccaagagcuacccccuguucucccaggaguucgugauccacaaccacgccgacaucggcuucugccucguccugugcgugcugaucgggcucauguucgaggugaccgcgaagaccgccuuccuguucauccugccgcaguacaacaucagcguccccaccgccgacuccgagaccgugcacuaccacuacggccccaaggaccucgugaccauccuguucuacaucuucaucacgaucauccugcacgccgucgugcaggaguacauccucgacaagaucagcaagcggcugcaccuguccaaggugaagcacagcaaguucaacgaguccgggcagcucgucguguuccacuucaccagcgugaucuggugcuucuacgucguggugaccgagggcuaccugaccaacccccgcucccugugggaggacuacccgcacguccaccuccccuuccaggugaaguucuucuaccugugccagcuggccuacuggcuccacgcgcugcccgagcuguacuuccagaaggugcggaaggaggagaucccccgccagcuccaguacaucugccuguaccugguccacaucgccggggccuaccuccugaaccugagccggcucggccugauccugcuccugcugcaguacuccacggaguuccucuuccacaccgcccgccuguucuacuucgcggacgagaacaacgagaagcuguucagcgccugggccgccguguucggcgugacccgccucuucauccugacccuggccguccucgcgaucggguucggccuggcccggauggagaaccaggccuucgacccggagaaggggaacuucaacacgcuguucugccggcucugcgugcugcugcucgugugcgccgcccaggcguggcugauguggcgcuucauccacucccagcugcggcacuggcgcgaguacuggaacgagcagagcgccaagcggcgcguccccgccacgccccggcuccccgcccgccugaucaagcgggaguccggcuaccacgagaacgggguggucaaggccgagaacggcaccagcccgcgcaccaagaagcugaagucccccuga

SEQ ID NO: 38054 - RNA, 1956 nt, Artificial Sequence
  derived and/or modified sequence opt1 from TRAP1__Homo_sapiens__NP_001258978
auggcccgcgagcugcgggcccuccugcuguggggccgccggcuccgcccccugcugcgggcgccggcccucgccgccgugcccgggggcagcaccuccaagcacgaguuccaggccgagaccaagaagcugcuggacaucgucgcgcgcagccucuacuccgagaaggagguguucauccgggagcugaucagcaacgccuccgacgcccuggagaagcuccgccacaagcuggugagcgacgggcaggcccugcccgagauggagauccaccuccagacgaacgcggagaagggcaccaucaccauccaggacaccgggaucggcaugacgcaggaggagcuggucuccaaccugggcaccaucgcccggagcggguccaaggccuuccucgacgcccugcagaaccaggccgaggcgagcuccaagaucaucggccaguucggggugggcuucuacagcgccuucaugguggccgaccgcgucgagguguacucccggagcgccgcccccgggucccugggcuaccaguggcucagcgacggcuccgggguguucgagaucgcggaggccagcggcguccgcaccgggaccaagaucaucauccaccugaaguccgacugcaaggaguucagcagcgaggcccgggugcgcgacguggucacgaaguacuccaacuucgugagcuucccgcuguaccucaacggccggcgcaugaacacccugcaggccaucuggaugauggaccccaaggacgugcgggaguggcagcacgaggaguucuaccgcuacgucgcccaggcgcacgacaagccccgguacacccugcacuacaagaccgacgcgccccucaacauccgcuccaucuucuacgugccggacaugaagcccagcauguucgacgugucccgggagcugggcagcuccgucgcccuguacagccgcaaggugcucauccagacgaaggccaccgacauccugcccaaguggcugcgcuucauccgcgggguggucgacuccgaggacaucccccucaaccugagccgggagcugcuccaggaguccgcccugauccggaagcugcgcgacgugcuccagcagcggcugaucaaguucuucaucgaccagagcaagaaggacgccgagaaguacgccaaguucuucgaggacuacggccuguucaugcgcgaggggaucgugaccgccaccgagcaggaggucaaggaggacaucgccaagcuccugcgguacgaguccagcgcgcugccguccggccagcucacgagccuguccgaguacgccagccgcaugcgggccgggacccgcaacaucuacuaccugugcgcccccaaccggcaccucgccgagcacucccccuacuacgaggcgaugaagaagaaggacaccgaggugcuguucugcuucgagcaguucgacgagcugacccugcuccaccuccgcgaguucgacaagaagaagcugaucagcgucgagacggacaucgugguggaccacuacaaggaggagaaguucgaggaccggagccccgccgccgagugccuguccgagaaggagaccgaggagcugauggccuggaugcgcaacguccugggcagccgggugaccaacgugaaggucacccuccgccuggacacgcacccggccauggugaccgugcuggagaugggcgcggcccggcacuuccuccgcaugcagcagcuggccaagacccaggaggagcgggcccagcugcuccagcccacccuggagaucaacccccgccacgcccugaucaagaagcucaaccagcugcgcgcguccgagcccgggcuggcccagcuccuggucgaccagaucuacgagaacgccaugaucgccgcgggccugguggacgacccgcgggccaugguggggcgccucaacgagcugcuggucaaggcccucgagcggcacuga

SEQ ID NO: 38055 - RNA, 3780 nt, Artificial Sequence
  derived and/or modified sequence opt1 from TRAPPC10__Homo_sapiens__NP_003265
auggacgccagcgaggagccccugccgcccgugaucuacaccauggagaacaagcccaucgugaccugcgccggcgaccagaaccucuucacguccguguaccccacccugagccagcagcugccgcgcgagcccauggaguggcggcgcuccuacgggcgggcgcccaagaugauccaccucgagagcaacuucgugcaguucaaggaggagcugcugcccaaggagggcaacaaggcccuccugaccuucccguuccugcacaucuacuggaccgagugcugcgacacggaggucuacaaggccaccgugaaggacgaccucaccaaguggcagaacgugcugaaggcccacuccagcgucgacuggcugaucgugaucguggagaacgacgccaagaagaagaacaagaccaacauccucccccgcacguccaucgucgacaagauccggaacgacuucugcaacaagcagagcgaccgcugcguggugcuguccgacccccugaaggacagcucccggacccaggagagcuggaacgcguuccucaccaagcugcgcacccugcuccugauguccuucacgaagaaccuggggaaguucgaggacgacaugcggacccuccgcgagaagcggaccgagcccggcuggagcuucugcgaguacuucaugguccaggaggagcuggccuucguguucgagaugcugcagcaguucgaggacgcccucgugcaguacgacgagcuggacgcccuguucucccaguacgucgugaacuucggggcgggcgacggcgccaacuggcucaccuucuucugccagccggucaagagcuggaacgggcugauccugcgcaagcccaucgacauggagaagcgggaguccauccagcgccgggaggccacgcuccuggaccugcgcagcuaccucuucucccggcagugcacccugcuccuguuccugcagcgccccugggaggucgcccagcgggcccuggagcuccugcacaacugcgugcaggagcugaagcuccuggaggugagcgugcccccgggcgcgcuggacugcuggguguuccucagcugccuggaggugcugcagcgcaucgaggggugcugcgaccgggcccagaucgacuccaacaucgcccacaccgucggccucuggagcuacgccaccgagaagcugaagucccugggguaccugugcggccucgugagcgagaagggccccaacuccgaggaccugaaccgcacggucgaccugcucgccgggcugggcgcggagcgccccgagaccgccaacaccgcccagagccccuacaagaagcugaaggaggcccucuccagcguggaggccuucgagaagcacuaccuggaccugucccacgcgaccaucgagauguacacgagcaucgggcggauccgcuccgccaaguucgugggcaaggaccucgccgaguucuacaugcggaagaaggccccgcagaaggccgagaucuaccugcagggcgcgcugaagaacuaccucgccgaggggugggcccugcccaucacccacacccgcaagcagcuggccgagugccagaagcaccucggccagaucgagaacuaccugcagaccagcucccugcucgcgagcgaccaccaccugacggaggaggagcggaagcacuucugccaggagauccuggacuucgccucccagcccagcgacucccccgggcacaagaucguccucccgaugcacagcuucgcccagcugcgcgaccugcacuucgaccccuccaacgccguggugcacgucggcggggugcucugcguggagaucaccauguacagccagaugcccguccccgugcacguggagcagaucgucgugaacgugcacuucagcaucgagaagaacuccuaccggaagaccgccgaguggcugaccaagcacaagacgagcaacggcaucaucaacuucccgcccgagaccgcgcccuucccggucucccagaacagccugcccgcccucgagcuguacgagauguucgagcgcucccccagcgacaacucccugaacaccaccggcaucaucugccggaacgugcacaugcuccugcgccggcaggagagcuccagcucccuggagaugcccagcgggguggcccucgaggagggcgcccacguccugcgcugcucccacgugacgcuggagccgggggccaaccagaucaccuuccggacccaggcgaaggagcccggcaccuacacccuccgccagcugugcgccagcgugggguccgucugguucgugcugccccacaucuaccccaucgugcaguacgacgucuacagccaggagccgcagcuccacguggagccccuggccgacucccugcucgccggcaucccccagcgggugaaguucacggucaccaccggccacuacaccaucaagaacggggacagccugcagcugagcaacgccgaggcgaugcucauccugugccaggccgagucccgcgccgugguguacagcaacacgcgggagcaguccagcgaggccgcgcugcgcauccaguccagcgacaaggucaccuccaucagccuccccguggccccggccuaccacgugaucgaguucgagcuggagguccugucccuccccagcgcccccgcccugggcggggaguccgacaugcugggcauggcggagccccaccggaagcacaaggacaagcagcgcaccgggcgcugcauggugaccacggaccacaaggugagcaucgacugcccgugguccaucuacagcaccgucaucgcccucaccuucuccgugcccuuccggaccacgcacagccugcuguccagcggcacccgcaaguacgugcaggucugcgugcagaaccucuccgagcuggacuuccagcugagcgacagcuaccucguggacaccggcgacuccaccgaccugcagcuggucccccucaacacgcagagccagcagcccaucuacuccaagcagagcguguucuucgugugggagcugaaguggaccgaggagccgccgcccucccugcacugccgguucagcgucggguucucccccgccagcgaggagcagcucuccaucagccugaagcccuacaccuacgaguucaagguggagaacuucuucacccuguacaacgugaaggccgagaucuucccgcccuccggcauggaguacugccgcacggggagccucugcucccuggagguccugaucacccggcucagcgaccugcuggagguggacaaggacgaggcccucaccgaguccgacgagcacuucagcaccaagcugauguacgagguggucgacaacuccagcaacugggcggugugcggcaaguccugcggcgucaucagcaugcccguggccgcccgcgccacgcaccgggugcacauggaggucaugccccuguucgccggguaccucccccugcccgacgugcgccuguucaaguaccucccgcaccacagcgcgcacuccagccagcuggacgccgacuccuggaucgagaacgacagccuguccguggacaagcacggcgacgaccagcccgacagcuccagccucaagucccgggggagcguccacuccgccugcagcuccgagcacaagggccugcccaugccccgccugcaggcccucccggcggggcaggucuucaacagcuccagcggcacccaggugcuggucauccccucccaggacgaccacgugcuggaggugagcgucaccuga

SEQ ID NO: 38056 - RNA, 3402 nt, Artificial Sequence
  derived and/or modified sequence opt1 from TRAPPC11__Homo_sapiens__NP_068761
augagccccacccagugggacuucccgguggagcugugcugccgccccauggccuucgucacccucacgggccuggacgugguguacaacgccguccaccgggcggugugggacgccuucugcgccaaccgccgggccgaccgcgugcccaucuccuucaagguccugcccggggaccacgaguacccgaagugccggcccaagcgcaccagcuacgagugguacauccccaagggcauccucaagaccggguggaugaacaagcaccugaaccuggugcccgcccucguggucguguucuacgagcuggacugggacgagccgcaguggaaggagaagcaguccgagugcgcgacccggguggagaucguccgccagagccugcagggccggaacacgaagguggccgugguccucauccagaagaagacgccccugccgcccggggaggacgugaucgccuccgagcgcgccgcggcccugugcaacgccugcgagcucagcggcaagucccuguucgugcugccccacaccgaccaccucgucggcuacaucauccggcuggagaacgccuucuacgagcacgcccagaccuacuacuacaccgagauccgccgggucaagagccacaaggaguuccugaacaagaccacccaccagcuccuguucgugcgccaccaguucaagaucgcguucuucuccgagcugaagcaggacacccagaacgcccucaagaacuaccggacggccuacaaccuggugcacgagcugcgcgcccacgagaccaacauccucgagaucaagaccauggccggguucaucaacuacaagaucugccggcugugcuuccagcacaacacgccccuggacgcgaucgcccaguuccgcaagcacaucgaccucugcaagaagaagaucggcagcgccgagcuguccuucgagcacgacgccuggaugagcaagcaguuccaggccuucggggaccuguucgacgaggcgaucaagcucggccugaccgccauccagacccagaaccccggguucuacuaccagcaggccgccuacuacgcccaggagcggaagcagcuggcgaagacccucugcaaccacgaggccuccgugauguaccccaacccggacccccuggagacccagacgggcgugcuggacuucuacggccagcgcagcuggcggcaggggauccucuccuucgaccugagcgaccccgagaaggagaaggucggcauccuggccauccagcucaaggagcgcaacgugguccacuccgagaucaucaucacccugcugagcaacgccguggcgcaguucaagaaguacaagugcccccgcaugaagucccaccucauggugcagaugggggaggaguacuacuacgccaaggacuacaccaaggcccugaagcugcucgacuacgucaugugcgacuaccggagcgagggcugguggacccugcugacgagcgugcucaccaccgcccugaagugcuccuaccugauggcccagcugaaggacuacaucaccuacagccucgagcugcugggccgcgcguccacgcucaaggacgaccagaagucccggaucgagaagaaccugaucaacgugcugaugaacgagagcccggaccccgagcccgacugcgacauccucgccgucaagaccgcccagaagcugugggccgaccgcaucagccuggccggguccaacaucuucaccaucggcgugcaggacuucgugcccuucguccagugcaaggcgaaguuccacgccccgagcuuccacguggacgugcccguccaguucgacaucuaccucaaggccgacugcccccaccccauccgguucuccaagcugugcgugagcuucaacaaccaggaguacaaccaguucugcgugaucgaggaggccuccaaggccaacgagguccuggagaaccucacccaggggaagaugugccuggugccgggcaagacgcgcaagcuccuguucaaguucguggcgaagaccgaggacgucgggaagaagaucgagaucaccagcguggaccuggcccugggcaacgagaccggccggugcgugguccucaacuggcagggcgggggcggggacgccgccuccagccaggaggcgcugcaggccgcccgcuccuucaagcggcgccccaagcugcccgacaacgaggugcacugggacagcaucaucauccaggccuccacgaugaucaucagccgggugccgaacaucuccguccaccuccugcacgagccgcccgcccugaccaacgagauguacugccucguggugaccguccagagccacgagaagacccagauccgcgacgugaagcugaccgcggggcugaagcccggccaggacgccaaccucacgcagaagacccacgugacccugcacggcaccgagcugugcgacgagagcuaccccgcccuccugacggacauccccgucggggaccugcaccccggcgagcagcucgagaagaugcuguacgugcggugcgggaccgugggcucccgcauguuccuggucuacgugagcuaccucaucaacaccaccguggaggagaaggagaucgucugcaagugccacaaggacgagacggugaccaucgagaccguguuccccuucgacgucgccgugaaguucguguccaccaaguucgagcaccuggagcgggucuacgccgacaucccguuccugcucaugacggaccugcugagcgcgucccccugggcccucaccaucgugagcuccgagcugcagcuggcccccagcaugaccaccguggaccagcucgagucccaggucgacaacgugauccugcagacgggggagagcgccuccgagugcuucugccugcagugccccagccucggcaacaucgagggcgggguggccaccggccacuacaucaucuccuggaagcgcaccagcgcgauggagaacaucccgaucaucaccacggucaucacccugccccacgugaucguggagaacaucccccugcacgucaacgccgaccuccccuccuucgggcgggugcgcgagagccugccggucaaguaccaccuccagaacaagaccgaccuggugcaggacguggagaucuccgucgagcccagcgacgccuucauguucagcggccugaagcagauccggcugcgcauccuccccggcaccgagcaggagaugcuguacaacuucuacccccugauggccggguaccagcagcucccgucccugaacaucaaccugcuccgcuuccccaacuucacgaaccagcugcugcggcgcuucauccccaccagcaucuucgugaagccccagggccggcucauggacgacaccuccaucgcggccgccuga

SEQ ID NO: 38057 - RNA, 438 nt, Artificial Sequence
  derived and/or modified sequence opt1 from TRAPPC1__Homo_sapiens__NP_067033
augaccgugcacaaccuguaccucuucgaccgcaacggcgucugccugcacuacagcgaguggcaccggaagaagcaggccgggauccccaaggaggaggaguacaagcugauguacggcaugcuguucuccauccgcagcuucguguccaagaugagcccgcucgacaugaaggacggguuccuggccuuccagaccucccgguacaagcuccacuacuacgagacgcccaccggcaucaagguggucaugaacaccgaccugggggugggccccauccgcgacgugcugcaccacaucuacagcgcgcucuacgucgagcugguggugaagaacccccugugcccgcucggccagaccguccaguccgagcuguuccggagccgccuggacuccuacgugcggagccuccccuucuucuccgcccgcgccggguga

SEQ ID NO: 38058 - RNA, 525 nt, Artificial Sequence
  derived and/or modified sequence opt1 from TRAPPC2__Homo_sapiens__NP_001122307
augagcuccuggaagcaggaccgcagcggccugcgguccaccgagcugaacgugcuggaguaccagccccugugcgccguccgcagccacauccucaagaccauguccgggagcuucuacuucgugaucgugggccaccacgacaacccggucuucgagauggaguuccugcccgccgggaaggcggaguccaaggacgaccaccggcaccugaaccaguucaucgcccacgccgcccucgaccugguggacgagaacauguggcugagcaacaacauguaccucaagacgguggacaaguucaacgagugguucgucuccgccuucgugaccgcgggccacaugcgcuucaucaugcugcacgacauccggcaggaggacgggaucaagaacuucuucaccgacguguacgaccuguacaucaaguucagcaugaaccccuucuacgagcccaacuccccgauccgcagcuccgccuucgaccggaagguccaguuccucggcaagaagcaccuccugagcuga

SEQ ID NO: 38059 - RNA, 660 nt, Artificial Sequence
  derived and/or modified sequence opt1 from TRAPPC4__Homo_sapiens__NP_057230
auggccaucuucagcguguacgucgugaacaaggccggcgggcugaucuaccagcucgacuccuacgcgccccgcgccgaggccgagaagaccuucagcuacccgcuggaccugcuccugaagcugcacgacgagcgggugcucgucgccuucggccagcgcgacgggauccgggugggccacgccgugcuggcgaucaacgggauggacgucaacggccgcuacaccgccgacggcaaggaggugcuggaguaccucgggaaccccgccaacuaccccguguccauccgguucggccgcccccggcugacgagcaacgagaagcugaugcucgccuccauguuccacagccuguucgcgaucgggucccagcugagcccggagcagggcuccagcgggaucgagaugcucgagaccgacaccuucaagcugcacugcuaccagacccugacgggcaucaaguucgucgugcucgccgacccccgccaggccggcaucgacucccugcugcggaagaucuacgagaucuacagcgacuucgcccucaagaaccccuucuacucccuggagaugcccauccgcugcgagcuguucgaccagaaccucaagcuggcccuggagguggcggagaaggccgggaccuucggcccggggagcuga

SEQ ID NO: 38060 - RNA, 3447 nt, Artificial Sequence
  derived and/or modified sequence opt1 from TRAPPC9__Homo_sapiens__NP_001153844
augagcgugcccgacuacaugcagugcgccgaggaccaccagacccugcucgucguggugcagccggucggcaucguguccgaggagaacuucuuccgcaucuacaagcggaucugcagcgugucccagaucagcguccgcgacucccagcgggugcuguacauccgcuaccggcaccacuacccgcccgagaacaacgaguggggcgacuuccagacccaccgcaagguggucgggcugaucacgaucaccgacugcuucagcgccaaggacuggccccagaccuucgagaaguuccacgugcagaaggagaucuacggguccacccucuacgacagccggcuguucguguucggccugcagggggagaucgucgagcagccccgcacggacguggcguucuaccccaacuacgaggacugccagaccguggagaagcggaucgaggacuucaucgagucccucuucaucguccuggagagcaagcgccuggaccgggccaccgacaaguccggcgacaagaucccccuccugugcgugcccuucgagaagaaggacuucgugggccuggacaccgacagccgccacuacaagaagcggugccaggggcgcaugcggaagcacgucggcgaccucugccugcaggccgggaugcugcaggacucccucgugcacuaccacaugagcguggagcugcugcgcuccgucaacgacuuccucuggcugggcgccgcccuggaggggcucugcagcgcguccgugaucuaccacuacccgggcggcaccgggggcaagagcggggcccggcgcuuccagggcuccacgcugcccgccgaggccgcgaaccggcaccgccccggcgcccaggaggugcugaucgaccccggggcccucaccaccaacggcaucaacccggacacgagcaccgagaucgggcgggccaagaacugccugagccccgaggacaucaucgacaaguacaaggaggccaucuccuacuacagcaaguacaagaacgcgggcgucaucgagcuggaggccugcaucaaggccgugcgcguccucgccauccagaagcgcuccauggaggccagcgaguuccugcagaacgcgguguacaucaaccugcggcagcucuccgaggaggagaagauccagcgcuacagcauccuguccgagcuguacgagcucaucggguuccaccgcaagagcgccuucuucaagcggguggccgccaugcagugcgucgcccccuccaucgcggagcccggcuggcgggccugcuacaagcugcugcucgagacccugccgggcuacagccugucccucgaccccaaggacuucagccgcgggacccaccggggcugggccgccgugcagaugcgccugcugcacgagcucguguacgccucccggcgcauggggaaccccgcgcugagcguccggcaccuguccuuccuccugcagacgaugcuggacuuccucagcgaccaggagaagaaggacguggcccagucccuggagaacuacaccagcaagugccccggcaccauggagccgaucgcccugcccgggggccugacccucccgcccgugcccuucacgaagcugcccaucguccgccacgugaagcugcucaaccugcccgccucccugcggccccacaagaugaagucccuccugggccagaacgugagcaccaagagcccguucaucuacagccccaucaucgcgcacaaccgcggggaggagcggaacaagaagaucgacuuccaguggguccagggcgacgugugcgaggugcagcugauggucuacaaccccaugccguucgagcuccgcguggagaacauggggcugcugaccuccggcguggaguucgagagccuccccgccgcccugucccugcccgccgagagcgggcucuaccccgucacccuggugggcgugccgcagacgaccggcaccaucaccgucaacggguaccacacgaccguguucggcguguucuccgacugccugcucgacaaccugcccgggaucaagaccagcggcuccaccgucgaggugauccccgcccugccccggcuccagaucagcacgucccugccgcgcagcgcgcacucccugcagcccagcuccggcgacgagaucagcaccaacguguccguccagcucuacaacggggagagccagcagcugaucaucaagcuggagaacaucggcauggagccccucgagaagcuggaggugaccagcaaggugcugaccacgaaggagaagcucuacggggacuuccuguccuggaagcuggaggagacccucgcccaguucccccugcagccgggcaaggucgccaccuucaccaucaacaucaaggugaagcuggacuucagcugccaggagaaccuccugcaggaccuguccgacgacgggaucagcguguccggcuucccccucagcucccccuuccggcaggucgugcgcccccgcguggagggcaagccggucaacccgcccgagagcaacaaggccggggacuacucccacgugaagacccuggaggccgugcugaacuucaaguacagcggcgggcccggccacacggagggguacuaccggaaccucucccugggccugcacgucgagguggagcccagcguguucuucacccgcgucuccacccuccccgcgaccagcacgcggcagugccaccuccugcuggacguguucaacuccaccgagcacgagcugaccgugagcacccgcuccagcgaggcccugauccuccacgccggcgagugccagcggauggccauccaggucgacaaguucaacuucgaguccuuccccgagagccccggggagaagggccaguucgccaacccgaagcagcuggaggaggagcgccgggaggcgcgcgggcuggagauccacagcaagcucggcaucugcuggcggauccccucccugaagcgcagcggggaggccuccguggagggccugcucaaccagcuggugcuggagcaccuccagcuggcgccccugcagugggacguccucguggacggccagccgugcgaccgggaggccguggccgccugccaggucggggaccccgugcgccuggagguccggcugacgaaccgcagcccccgguccgugggccccuucgcccucaccguggucccguuccaggaccaccagaacggggugcacaacuacgaccugcacgacaccgugagcuucgucggcuccagcaccuucuaccuggacgccgugcagcccuccgggcagagcgccugccucggcgcgcugcuguuccucuacacgggcgacuucuuccugcacauccgcuuccacgaggacuccaccagcaaggagcugccgcccuccugguucugccuccccagcgugcacgucugcgcccuggaggcccaggccuga

SEQ ID NO: 38061 - RNA, 561 nt, Artificial Sequence
  derived and/or modified sequence opt1 from TRAT1__Homo_sapiens__NP_057472
augagcggcaucuccgggugccccuucuuccuguggggccuccuggcccugcucgggcuggcccuggugaucagccucaucuucaacaucucccacuacgucgagaagcagcgccaggacaagauguacagcuacuccagcgaccacacccggguggacgaguacuacaucgaggacaccccgaucuacggcaaccuggacgacaugaucuccgagcccauggacgagaacugcuacgagcagaugaaggcgcgccccgagaaguccgugaacaagaugcaggaggccacgcccagcgcccaggccaccaacgagacccagaugugcuacgccagccuggaccacuccgucaaggggaagcggcgcaagccgcggaagcagaacacccacuucagcgacaaggacggcgacgagcagcuccacgcgaucgacgccuccgugagcaagacgacccugguggacuccuucagccccgagucccaggccgucgaggagaacauccacgacgaccccauccgccuguucggccucauccgggccaagcgcgagcccaucaacuga

SEQ ID NO: 38062 - RNA, 1176 nt, Artificial Sequence
  derived and/or modified sequence opt1 from TRDMT1__Homo_sapiens__NP_004403
auggagccccugcgcgugcucgagcuguacagcggcgucgggggcaugcaccacgcccugcgggaguccugcauccccgcccaggugguggcggccaucgacgucaacaccguggccaacgagguguacaaguacaacuucccccacacccagcuccuggccaagacgaucgaggggaucacccuggaggaguucgaccgccucagcuucgacaugauccugauguccccgcccugccagcccuucacccggaucggccgccagggggacaugaccgacagccggacgaacuccuuccugcacauccucgacauccugccccgccugcagaagcuccccaaguacauccugcuggagaacgucaagggcuucgaggugagcuccacccgggaccuccugauccagaccaucgagaacugcggcuuccaguaccaggaguuccugcucagccccaccucccuggggaucccgaacagccgccugcgguacuuccucaucgccaagcugcaguccgagccccugcccuuccaggcgcccggccaggugcucauggaguucccgaagaucgagagcguccacccccagaaguacgccauggacguggagaacaagauccaggagaagaacguggagcccaacaucuccuucgacgggagcauccagugcuccggcaaggacgccauccuguucaagcuggagacggccgaggagauccaccgcaagaaccagcaggacagcgaccucuccgucaagaugcugaaggacuuccuggaggacgacaccgacgugaaccaguaccuccugcccccgaagucccugcuccgguacgcgcugcugcucgacaucgugcagccgaccugccgccggagcgucugcuucaccaagggguacggcagcuacaucgagggcacggggagcgugcugcagaccgccgaggacgugcaggucgagaacaucuacaagucccugaccaaccucagccaggaggagcagaucaccaagcugcugauccucaagcugcgcuacuucacgcccaaggagaucgccaaccugcucggcuucccgcccgaguucggguuccccgagaagaucaccgugaagcagcgguaccgccugcugggcaacucccucaacgugcacgucguggccaagcugaucaagauccuguacgaguga

SEQ ID NO: 38063 - RNA, 1386 nt, Artificial Sequence
  derived and/or modified sequence opt1 from TRDN__Homo_sapiens__NP_001238916
augaccgagaucaccgccgagggcaacgccagcacgaccaccaccgugaucgacuccaagaacgggagcguccccaaguccccgggcaaggugcugaagcgcacggugaccgaggacaucgucaccaccuucagcucccccgcggccuggcuccuggugaucgcccugaucaucacguggagcgccguggccaucgucauguucgaccucguggacuacaagaacuucuccgcgagcuccaucgccaagaucgggagcgacccccugaagcuggugcgggacgccauggaggagaccaccgacuggaucuacggcuucuucucccuccugagcgacaucaucuccagcgaggacgaggaggacgacgacggggacgaggacaccgacaagggcgagaucgacgagcccccgcugcgcaagaaggagauccacaaggacaagacggagaagcaggagaagcccgagcggaagauccagaccaaggucacccacaaggagaaggagaagggcaaggagaaggugcgcgagaaggagaagcccgagaagaaggccacccacaaggagaagaucgagaagaaggagaagcccgagacgaagacccucgcgaaggagcagaagaaggccaagaccgccgagaaguccgaggagaagaccaagaaggaggugaagggcgggaagcaggagaaggucaagcagacggccgccaaggugaaggaggugcagaagaccccgagcaagcccaaggagaaggaggacaaggagaaggcggccgucuccaagcacgagcagaaggaccaguacgccuucugccgguacaugaucgacaucuucgugcacggggaccugaagcccggccagagccccgccaucccgccgccccugcccaccgagcaggccucccgccccacccccgcgagccccgcccucgaggagaaggagggggagaagaagaaggccgagaagaaggugacgagcgagaccaagaagaaggccgagaaggaggacaucaagaagaaguccgagaaggagaccgccaucgacgucgagaagaaggagcccggcaaggcgagcgagaccaagcagggcacggugaagaucgccgcccaggccgccgcgaagaaggacgagaagaaggaggacuccaagaagaccaagaagccggccgagguggagcagcccaaggggaagaagcaggagaagaaggagaagcacgucgagcccgccaagagccccaagaaggagcacuccgugccgagcgacaagcaggucaaggccaagaccgagcgggcgaaggaggagaucggcgccguguccaucaagaaggccgugcccgggaagaaggaggagaagaccacgaagaccgucgagcagggcaagaagaaguga

SEQ ID NO: 38064 - RNA, 1659 nt, Artificial Sequence
  derived and/or modified sequence opt1 from TREH__Homo_sapiens__NP_001287994
augcccggccgcaccugggagcugugccuccugcugcuccuggggcugggccucgggagccaggaggcccugccgccgcccugcgaguccgagaucuacugccacggcgagcugcucaaccaggugcagauggccaagcuguaccaggacgacaagcaguucgucgacaugccccugagcaucgcgccggagcagguccuccagaccuucacggagcugucccgggaccacaaccacagcaucccccgcgagcagcugcaggccuucgugcacgagcacuuccaggccaaggggcaggagcuccagcccuggacccccgccgacuggaaggacuccccgcaguuccugcagaagaucagcgacgccaagcugcgggcgugggccggccagcuccaccagcuguggaagaagcugggcaagaagaugaagcccgaggugcucucccaccccgagcgcuucagccugaucuacuccgagcaccccuucaucgugcccgggggccgguucguggaguucuacuacugcuacgggcacguccccaacggcgggcgcguguacuaccugcagcggagccagccgccccuccugacccugaugauggacugcuaccucacccacacgaacgacaccgccuuccugcaggagaacaucgagacccuggcccucgagcuggacuucuggaccaagaaccgcacgguguccgucagccuggagggcaagaacuaccuccugaaccgguacuacgugcccuacggcgggccccgccccgaguccuacagcaaggacguggagcuggcggacacccuccccgagggcgaccgggaggcccugugggccgagcugaaggccggggccgaguccggcugggacuucagcucccgcuggcucaucggcgggccgaaccccaacagccuguccggcauccggaccagcaagcugguccccguggaccucaacgcguuccugugccaggccgaggagcugaugagcaacuucuacucccgccucgggaacgacagccaggccaccaaguaccggauccugcgcucccagcggcuggccgcccucaacacggugcugugggacgagcagaccggcgcgugguucgacuacgaccuggagaagaagaagaagaaccgcgaguucuaccccagcaaccugaccccgcucugggccgggugcuucuccgaccccggcgucgccgacaaggcccugaaguaccuggaggacaaccggauccucaccuaccaguacggcauccccacgagccugcagaagaccgggcagcagugggacuuccccaacgccugggcgccgcugcaggaccucgugauccgcggccuggccaaggcgccccugcggcgcgcccaggagguggccuuccagcucgcccagaacuggauccgcaccaacuucgacgucuacucccagaaguccgccauguacgagaaguacgacgugagcaacgggggccagcccgggggcggcggggaguacgaggugcaggagggcuucggguggaccaacggcgucgugcugaugcugcucgaccgguacggggaccgccugacgagcggcgccaagcuggccuuccucgagccgcacugccuggcggccacccugcuccccucccugcugcucagccugcugcccugguga

SEQ ID NO: 38065 - RNA, 678 nt, Artificial Sequence
  derived and/or modified sequence opt1 from TREM1__Homo_sapiens__NP_001229518
augcgcaagacccggcuguggggccuccuguggaugcuguucgugagcgagcuccgcgccgccaccaagcugacggaggagaaguacgagcugaaggaggggcagacccucgacgucaagugcgacuacacccuggagaaguucgcguccagccagaaggccuggcagaucauccgggacggcgagaugcccaagacccuggccugcacggagcgcccguccaagaacagccaccccguccagguggggcggaucauccucgaggacuaccacgaccacggccugcugcgcgugcggauggugaaccuccagguggaggacuccgggcuguaccagugcgucaucuaccagccgcccaaggagccccacaugcuguucgaccgcauccggcucguggugaccaagggcuucagcggcacccccggguccaacgagaacagcacccagaacgucuacaagaucccgcccacgaccaccaaggcccugugcccccuguacaccagcccccgcacggugacccaggccccgcccaaguccaccgcggacguguccacccccgacagcgagaucaaccucacgaacgucaccgacaucauccgguacuccuuccaggugcccggcccccugguguggacccugagcccccucuucccgucccugugcgccgagcgcauguga

SEQ ID NO: 38066 - RNA, 660 nt, Artificial Sequence
  derived and/or modified sequence opt1 from TREM2__Homo_sapiens__NP_001258750
auggagccccugcgccuccugauccugcuguucgugaccgagcugagcggcgcccacaacaccacggucuuccaggggguggccggccagucccuccaggugagcugccccuacgacuccaugaagcacugggggcggcgcaaggcguggugccggcagcucggcgagaaggggcccugccagcgcgucgugagcacccacaaccuguggcugcucuccuuccugcggcgcuggaacggcagcaccgccaucaccgacgacacgcugggcgggacccucaccaucacccugcggaaccugcagccccacgacgccggccucuaccagugccagucccugcacgggagcgaggccgacacgcugcgcaaggugcucgucgaggugcuggccgacccccuggaccaccgggacgcgggcgaccucugguucccgggggaguccgagagcuucgaggacgcccacguggagcacuccaucagccgcgccgagcggcacgucaaggaggacgacggccgcaagucccccggcgaggugccgcccgggaccagccccgccugcauccuggcgaccuggccgcccggccugcucgugcugcuguggcaggagaccacgcuccccgagcacugcuucuccuggacccuggaggccgggaccggcuga

SEQ ID NO: 38067 - RNA, 600 nt, Artificial Sequence
  derived and/or modified sequence opt1 from TREML1__Homo_sapiens__NP_001258736
augggccugacccuccugcugcuccugcugcucgggcuggagggccaggggaucgugggcagccugcccgagguccuccaggccccggugggguccagcauccuggugcagugccacuaccgccugcaggacgucaaggcccagaagguguggugccgguuccuccccgagggcugccagccccugguguccagcgcggucgaccgccgggcccccgccggccgccggaccuuccugacggaccucgggggcgggcugcuccagguggagauggugacccugcaggaggaggacgccggcgaguacgggugcauggucgacggcgcccgcggcccgcagauccugcaccgggugucccugaacauccucccgcccgaggaggaggaggagacccacaagaucgggagccuggcggagaacgccuucuccgaccccgccggcagcgccaacccccuggagcccucccaggacgagaaguccaucccccucaucuggggcgcggugcugcuggucggccuccugguggccgccgugguccuguucgccgugauggccaagcgcaagcaggagagccuccugagcgggcccccgcggcaguga

SEQ ID NO: 38068 - RNA, 966 nt, Artificial Sequence
  derived and/or modified sequence opt1 from TREML2__Homo_sapiens__NP_079083
auggcccccgccuuccugcuccugcugcuccuguggccgcagggcugcgugagcgggcccuccgcggacagcgucuacaccaaggugcgccugcucgagggcgagacccuguccgugcagugcagcuacaagggguacaagaaccgggucgagggcaagguguggugcaagauccgcaagaagaagugcgagcccggguucgcccgggugugggucaagggcccccgcuaccugcuccaggacgacgcccaggccaagguggugaacaucacgauggucgcccugaagcugcaggacuccggccgguacuggugcaugcgcaacaccagcgggauccucuacccgcugaugggcuuccagcuggacgugucccccgcgccccagaccgagcggaacauccccuucacccaccucgacaacauccucaagagcgggacggugaccaccggccaggccccgaccuccgggcccgacgcccccuucacgaccggcgucaugguguucacccccggccugaucacccugccgcgccugcuggccagcacgcggcccgcguccaagaccggguacagcuucaccgccaccuccacgaccagccagggcccccgccggaccauggggucccagaccgugacggccagccccuccaacgcccgcgacagcuccgccggcccggagagcaucagcaccaaguccggcgaccucagcacccggucccccaccacggggcugugccugaccagccgcucccuccugaaccggcugcccagcaugcccuccauccgccaccaggacgucuacagcaccgugcucggcgugguccugacccugcucgugcugaugcugaucaugguguacggguucuggaagaagcggcacauggcguccuacagcaugugcuccgacccgagcacgcgcgacccgcccggccggcccgagcccuacgucgagguguaccucaucuga

SEQ ID NO: 38069 - RNA, 3603 nt, Artificial Sequence
  derived and/or modified sequence opt1 from TRERF1__Homo_sapiens__XP_006715208
augggcgaccagcagcuguacaagaccaaccacguggcccacgggagcgagaaccucuucuaccagcagcccccgcugggcguccacuccgggcugaaccacaacuacggcaacgccgugaccgggggcggcauggacgcgccccaggccagccccaucuccccccacuucccgcaggacacgcgcgacgggcucggccugcccguggggagcaagaaccugggccagauggacaccucccggcaggggggcuggggcagccacgccgggcccggcaaccacguccagcuccgcgggaaccuggccaacuccaacaugauguggggcgcccccgcgcaggccgagccgaccgacggcuaccaguacaccuacagccaggccuccgagauccggacgcagaagcugaccagcggggugcuccacaagcuggacuccuucacccagguguucgccaaccagaaccugcgcauccaggucaacaacauggcgcaggugcuccacacccagagcgccgugauggacggcgcccccgacuccgcccugcggcagcugcucagccagaagcccauggagcccccggcccccgcgauccccucccgcuaccagcaggucccccagcagccgcaccccggguucacgggcgggcugagcaagcccgcccugcaggugggccagcaccccacccagggccaccucuacuacgacuaccagcagccgcuggcccaggugcccguccaggggggccagccccugcaggccccccagaugcucucccagcacaugcagcagaugcagcagcaccaguacuacccgccccagcagcagcagcaggccgggcagcagcggaucagcaugcaggagauccagacccagccccagcagauccgccccucccagccgcagccccccccgcagcagcagcagccccagcagcugcagcugcagcagcggcagggcagcaugcagaucccccaguacuaccagccccagccgaugaugcagcaccuccaggagcagcagcagcagcagaugcaccugcagccccccagcuaccaccgcgacccccaccaguacaccccggagcaggcgcacacggugcagcugaucccccucggguccaugagccaguacuacuaccaggagccccagcagcccuacucccacccgcuguaccagcagagccaccugucccagcaccagcagcgggaggacagccagcucaagaccuacuccagcgaccgccaggcccaggccaugcuguccagccacggcgaccugggcccccccgacaccgggaugggcgaccccgccuccagcgaccucacccggguguccagcacgcugccgcaccgcccccugcucucccccagcgggauccaccugaacaacaugggcccccagcaccagcagcuguccccgagcgccauguggccccagaugcaccuccccgacgggcgggcgcagcccggcuccccggagagcagcggccagcccaagggggccuucggcgagcaguucgacgccaagaacaagcugaccugcuccaucugccugaaggaguucaagaaccuccccgcccugaacgggcacaugcgcagccacggcggcaugcgggccuccccgaaccugaagcaggaggagggggagaagguccuccccccccagccccagccgccccugccccccccgcccccccccccgccccccccccagcugccgcccgaggcggagagccucacccccauggugaugcccguguccgucccggugaagcugcugccccccaagcccagcucccagggcuucaccaacagcacgguggccgccccguccgcccgcgacaagcccgcgagcuccaugagcgacgacgagaugcccguccuggagaucccccggaagcaccagccguccgugcccaaggccgaggagccccucaagaccgugcaggagaagaagaaguuccgccaccggccggagccccuguucaucccccccccgcccagcuacaaccccaaccccgccgccuccuacagcggggccacccuguaccagucccagcuccgcagcccgcgcguccugggcgaccaccugcuccuggaccccacccacgagcugccccccuacacgccgccccccaugcucagccccgugcggcagggguccggccuguucagcaacguccugaucuccggccacgggccgggcgcgcacccccagcucccccugaccccccugaccccgaccccccgcgugcuccugugccggagcaacuccaucgacgggagcaacgugacggucacccccggccccggggagcagaccguggacguggagccgcgcaucaacaucggccugcgguuccaggccgagauccccgagcuccaggacaucuccgcccuggcccaggacacccacaaggccacgcuggucuggaagcccuggcccgagcucgagaaccacgaccugcagcagcgcguggagaaccugcucaaccugugcugcagcuccgcgcugccgggcgggggcaccaacagcgaguucgcccuccacucccuguucgaggccaagggggacgugauggucgcccuggagaugcuccugcugcggaagcccgugcgccucaagugccacccccuggccaacuaccacuacgcgggcagcgacaaguggaccucccuggagcggaagcucuucaacaaggcccuggccaccuacagcaaggacuucaucuucgugcagaagauggucaaguccaagacgguggcccagugcguggaguacuacuacaccuggaagaagaucaugcgccuggggcggaagcaccgcacccggcucgcggagaucaucgacgacugcgucaccagcgaggaggaggaggagcuggaggaggaggaggaggaggacccggaggaggaccgcaaguccaccaaggaggaggagagcgaggugcccaagucccccgagcccccgcccgugcccguccuggcccccacggagggcccgccccuccaggcccugggccagcccagcgggagcuucaucugcgagaugcccaacugcggcgccguguucuccagccggcaggcccugaacgggcacgcgcgcauccacggcgggaccaaccaggugaccaaggcccggggcgccaucccguccggcaagcagaagcccgggggcacccagagcggguacugcuccgucaagagcucccccagccacuccacgaccagcggcgagaccgaccccaccacgaucuucccgugcaaggagugcggcaagguguucuucaagaucaagucccgcaacgcccacaugaagacccaccggcagcaggaggagcagcagcgccagaaggcccagaaggcggccuucgccgccgagauggccgcgaccaucgagcgcaccacggggcccgugggcgcccccgggcuccugccccuggaccagcucagccugaucaagccgaucaaggacgucgacauccuggacgacgacguggugcagcagcucggcggggucauggaggaggccgaggugguggacaccgaccugcugcucgacgaccaggacuccguccugcugcagggcgacgccgagcucuga

SEQ ID NO: 38070 - RNA, 915 nt, Artificial Sequence
  derived and/or modified sequence opt1 from TREX1__Homo_sapiens__NP_009179
augcagacccugaucuucuucgacauggaggccaccggccuccccuucagccagccgaaggugacggagcugugccugcucgccguccaccgcugcgcgcuggaguccccgcccaccagccaggggcccccgcccaccgugccgccgccgccccggguggucgacaagcugucccucugcguggcccccggcaaggccugcagccccgccgccuccgagaucaccgggcugagcacggcggugcuggccgcccacggccgccagugcuucgacgacaaccucgccaaccugcugcucgcguuccugcggcgccagccccagcccuggugccuggucgcccacaacggggaccgguacgacuucccccuccugcaggccgagcuggccaugcucggccugaccuccgcccuggacggcgcguucugcguggacagcaucaccgcccucaaggcccuggagcgcgccuccagccccuccgagcacgggccccgcaagagcuacucccugggcagcaucuacacccggcucuacgggcaguccccgcccgacagccacacggccgagggcgacgugcuggcgcugcucuccaucugccaguggcggccccaggcccugcugcgcugggucgacgcccacgcccggcccuucgggaccauccgccccauguacggcgugaccgccagcgcgcggaccaagccccgccccuccgccgugacgaccaccgcccaccucgccaccacgcggaacaccagccccagccugggcgagucccgcgggaccaaggaccugccgcccgucaaggaccccggcgcccucagccgggaggggcugcuggcgccccucggccugcuggccauccucacccuggccguggccacgcuguacggccucucccuggcgacccccggggaguga

SEQ ID NO: 38071 - RNA, 711 nt, Artificial Sequence
  derived and/or modified sequence opt1 from TREX2__Homo_sapiens__NP_542432
augagcgaggcgccccgcgccgagaccuucguguuccuggaccucgaggccaccggccugccguccgucgagcccgagaucgccgagcugagccucuucgccgugcaccgguccagccuggagaaccccgagcacgacgaguccggggcccuggugcucccccgcguccuggacaagcugacgcucugcaugugcccggagcggcccuucaccgccaaggcgagcgagaucaccggccuguccagcgaggggcuggcccgcugccggaaggccggcuucgacggggccguggugcgcacccuccaggcguuccugucccggcaggccggccccaucugccuggucgcccacaacggcuucgacuacgacuucccccuccugugcgccgagcugcgccggcucggggcccgccugccgcgggacacggugugccuggacacccuccccgcgcugcgcggccuggaccgggcccacagccacgggacccgcgcccggggccgccagggguacucccucggcagccuguuccaccgguacuuccgcgccgagcccuccgccgcgcacagcgccgagggcgacgugcacacccugcuccugaucuuccugcaccgggccgccgagcuccuggccugggcggacgagcaggcccgcgggugggcccacaucgagcccauguaccugccgcccgacgaccccucccucgaggccuga

SEQ ID NO: 38072 - RNA, 3075 nt, Artificial Sequence
  derived and/or modified sequence opt1 from TRHDE__Homo_sapiens__NP_037513
augggcgaggacgacgccgcccugcgcgcggggagccggggccucuccgaccccugggccgacagcguggggguccgcccgcggaccaccgagcgccacaucgccgugcacaagcggcuggugcuggccuucgccgucucccucguggcgcugcuggccgugacgaugcucgccguccugcugagccuccgcuucgacgagugcggcgccuccgcgacccccggggccgacggcggccccagcggguuccccgagcggggcgggaacggcucccugccggggagcgcccgccggaaccaccacgccggcggcgacuccuggcagcccgaggccgggggcguggcgagccccgggaccaccuccgcccagcccccgagcgaggaggagcgcgagcccugggagcccuggacgcagcugcggcucuccggccaccugaagccccugcacuacaaccucaugcugaccgccuucauggagaacuucaccuucagcggcgaggugaacgucgagaucgccugccgcaacgccacccgguacguggugcugcacgcgucccgcgucgccguggagaaggugcagcucgccgaggaccgggccuucggggccgucccgguggcgggcuucuuccuguacccccagacccaggugcuggucguggugcucaaccgcacgcuggacgcccagcggaacuacaaccugaagaucaucuacaacgcccucaucgagaacgagcugcugggguucuuccgcagcuccuacguccuccacggcgagcggcgcuuccugggggugacccaguucagccccacccacgcccggaaggccuuccccugcuucgacgagccgaucuacaaggcgacguucaagaucuccaucaagcaccaggccaccuaccugagccucagcaacaugcccguggagaccuccgucuucgaggaggacggcugggugaccgaccacuucagccagacgccccugauguccaccuacuaccuggccugggccaucugcaacuucaccuaccgcgagaccacgaccaagagcggcgucguggugcgccucuacgcgcggcccgacgccauccgccggggguccggcgacuacgcccugcacaucaccaagcgccugaucgaguucuacgaggacuacuucaaggucccguacagccuccccaagcuggaccugcucgccgugcccaagcaccccuacgccgcgauggagaacugggggcuguccaucuucguggagcagcggauccugcucgacccgagcgucuccagcaucuccuaccugcuggacgugaccauggugaucguccacgagaucugccaccagugguucggcgaccucgugacgcccguguggugggaggacgucuggcugaaggagggguucgcccacuacuucgaguucgugggcaccgacuaccuguaccccggcuggaacauggagaagcagcgcuuccucaccgacgugcugcacgaggucaugcugcuggacgggcucgccagcucccaccccgugagccaggaggugcugcaggccaccgacaucgaccgggucuucgacuggaucgccuacaagaagggcgcggcccugauccgcaugcucgccaacuucauggggcacuccguguuccagcggggccugcaggacuaccugacgauccacaaguacgggaacgccgcccgcaacgaccucuggaacacccugagcgaggcgcugaagcggaacggcaaguacgugaacauccaggaggucauggaccaguggacccuccagaugggcuacccggugaucaccauccuggggaacacgaccgccgagaaccgcaucaucaucacccagcagcacuucaucuacgacaucuccgccaagaccaaggcccugaagcuccagaacaacagcuaccuguggcagaucccccugacgaucguggucggcaaccggucccacgugagcagcgaggcgaucaucuggguguccaacaagagcgagcaccaccgcaucaccuaccucgacaagggguccuggcugcugggcaacaucaaccagaccggcuacuuccgggucaacuacgaccuccgcaacuggcggcugcugaucgaccagcucauccgcaaccacgaggugcugagcguguccaaccgggccgggcugaucgacgacgccuucagccucgcccgcgccggcuaccugccccagaacaucccgcuggagaucauccgcuaccucuccgaggagaaggacuuccugcccuggcacgcggccagccgggcccuguacccccucgacaagcugcuggaccgcauggagaacuacaacaucuucaacgaguacauccucaagcaggucgccaccaccuacaucaagcugggguggcccaagaacaacuucaacggcucccuggugcaggccagcuaccagcacgaggagcuccggcgcgaggugaucaugcuggcgugcuccuucgggaacaagcacugccaccagcaggccagcacgcugaucuccgacuggaucagcuccaaccggaaccgcaucccgcucaacguccgggacaucguguacugcaccggcgugagccugcuggacgaggacgucugggaguucaucuggaugaaguuccacuccaccaccgccgugagcgagaagaagauccuccuggaggcccugacgugcagcgacgaccgcaaccuccugaaccggcugcucaaccugucccugaacagcgaggugguccucgaccaggacgccaucgacgugaucauccacguggcgcgcaacccccacggccgggaccuggccuggaaguucuuccgcgacaaguggaagauccugaacacccgguacggggaggcccucuucaugaacuccaagcugaucagcggcgucaccgaguuccugaacaccgagggggagcucaaggagcugaagaacuucaugaagaacuacgacggcguggccgcggccuccuucagccgcgccguggagacggucgaggccaacgugcgguggaagaugcuguaccaggacgagcuguuccaguggcucgggaaggcccugcgccacuga

SEQ ID NO: 38073 - RNA, 729 nt, Artificial Sequence
  derived and/or modified sequence opt1 from TRH__Homo_sapiens__NP_009048
augcccggcccguggcugcuccuggcccuggcccucacccugaaccugaccggggugcccggcgggcgcgcgcagcccgaggccgcccagcaggaggccgucacggccgcggagcaccccggccucgacgacuuccugcgccagguggagcggcuccuguuccugcgggagaacauccagcgccugcagggggaccagggcgagcacagcgccucccagaucuuccagagcgacuggcucuccaagcggcagcacccgggcaagcgcgaggaggaggaggaggaggggguggaggaggaggaggaggaggagggcggggccgucggcccccacaagcggcagcaccccgggcgccgggaggacgaggccagcugguccguggacgugacccagcacaagcgccagcaccccggccggcgcagcccguggcuggcguacgccguccccaagcggcagcaccccggccgccggcuggccgaccccaaggcccagcgcuccugggaggaggaggaggaggaggaggagcgggaggaggaccucaugccggagaagcgccagcaccccgggaagcgggcccugggcgggcccugcggcccccagggcgcguacgggcaggccggccugcuccuggggcugcucgacgaccugagccgcucccagggcgccgaggagaagcggcagcacccggggcgccgcgccgccugggugcgggagccccuggaggaguga

SEQ ID NO: 38074 - RNA, 1197 nt, Artificial Sequence
  derived and/or modified sequence opt1 from TRHR__Homo_sapiens__XP_011515565
auggagaacgagaccgugagcgagcugaaccagacccagcuccagccccgcgccgucguggcccuggaguaccagguggucaccauccugcucgugcugaucaucugcggccuggggaucgugggcaacaucauggucgugcucguggucaugcggaccaagcacaugcgcaccccgaccaacugcuaccuggugucccuggcgguggccgaccucaugguccugguggccgccgggcugcccaacaucacggacagcaucuacggcuccuggguguacggguacgucggcugccucugcaucaccuaccugcaguaccugggcaucaacgccagcuccugcagcaucaccgcguucaccaucgagcgguacaucgccaucugccaccccaucaaggcccaguuccucugcacguucucccgcgccaagaagaucaucaucuucgugugggcguucaccagccuguacugcaugcugugguucuuccuccuggaccugaacaucuccaccuacaaggacgccaucgugaucagcugcggguacaagaucucccggaacuacuacagccccaucuaccucauggacuucggcgucuucuacguggugccgaugauccuggccaccguccuguacggguucaucgcccgcauccucuuccugaaccccauccccuccgaccccaaggagaacagcaagacguggaagaacgacuccacccaccagaacaccaaccugaacgugaacaccagcaaccggugcuucaacuccacggugagcucccgcaagcaggucaccaagaugcucgccguggucgugauccuguucgcgcugcucuggaugccguaccggacccugguggucgugaacagcuuccugagcucccccuuccaggagaacugguuccuccuguucugccgcaucugcaucuaccugaacagcgccaucaaccccgugaucuacaaccucaugucccagaaguuccgggccgccuuccgcaagcugugcaacugcaagcagaagcccaccgagaagccggccaacuacagcgucgcgcugaacuacuccgugaucaaggagagcgaccacuucuccacggagcucgacgacaucaccgugaccgacaccuaccugagcgccacgaaggucuccuucgacgacacgugccuggccagcgagguguccuucagccaguccuga

SEQ ID NO: 38075 - RNA, 231 nt, Artificial Sequence
  derived and/or modified sequence opt1 from TRIAP1__Homo_sapiens__NP_057483
augaacagcgugggcgaggccugcaccgacaugaagcgcgaguacgaccagugcuucaaccggugguucgccgagaaguuccugaagggggacuccagcggcgaccccugcaccgaccucuucaagcgcuaccagcagugcguccagaaggcgaucaaggagaaggagaucccgaucgaggggcuggaguucaugggccacgggaaggagaagcccgagaacuccagcuga

SEQ ID NO: 38076 - RNA, 1119 nt, Artificial Sequence
  derived and/or modified sequence opt1 from TRIB1__Homo_sapiens__NP_079471
augcgcgugggccccguccggagcgccauguccggggccagccagccgcgcggccccgcgcuccuguuccccgccacccgcggggugcccgccaagcggcugcuggacgccgacgacgccgcggccguggccgccaagugcccgcggcucuccgagugcagcuccccgcccgacuaccugagcccgcccggcucccccugcagcccccagcccccgcccgcggcccccggggccggcggcggguccggcagcgcccccgggccgucccgcaucgccgacuaccugcuccugccccuggcggagcgggagcacgucagccgcgcccucugcauccacaccggccgggagcugcgcugcaagguguuccccaucaagcacuaccaggacaagauccggcccuacauccagcugcccucccacagcaacaucacggggaucguggaggucauccucggcgagaccaaggccuacguguucuucgagaaggacuucggcgacaugcacuccuacgugcgcagccggaagcgccugcgggaggaggaggccgcccgccuguucaagcagaucgucuccgcgguggcccacugccaccagagcgccaucgugcucggggaccugaagcugcggaaguucgucuucuccaccgaggagcgcacccagcuccggcuggagagccuggaggacacgcacaucaugaagggcgaggacgacgcccucagcgacaagcacgggugccccgccuacgugucccccgagauccugaacaccaccggcaccuacagcggcaaggcggccgacguguggucccugggggucaugcucuacacgcugcuggugggccgcuaccccuuccacgacagcgacccguccgcccucuucagcaagauccggcgcgggcaguucugcauccccgagcacaucucccccaaggcccgcugccugauccggagccugcuccgccgggagcccuccgagcgccugaccgccccggagauccugcuccaccccugguucgagagcgugcuggagcccggcuacaucgacuccgagaucgggaccagcgaccagaucgucccggaguaccaggaggacuccgacaucagcuccuucuucugcuga

SEQ ID NO: 38077 - RNA, 1032 nt, Artificial Sequence
  derived and/or modified sequence opt1 from TRIB2__Homo_sapiens__NP_067675
augaacauccaccgcagcacccccaucaccaucgcccgguacggccgcucccggaacaagacgcaggacuucgaggagcugagcuccauccgcagcgccgagccgucccagagcuucucccccaaccucgggagccccuccccgcccgagacccccaaccugagccacugcguguccugcaucggcaaguaccugcuccuggagccccuggagggggaccacgucuuccgggcggugcaccuccacagcggcgaggagcuggugugcaaggucuucgacaucuccugcuaccaggagagccuggcccccugcuucugccucuccgcccacagcaacaucaaccagaucaccgagaucauccugggggagaccaaggccuacguguucuucgagcgcuccuacggcgacaugcacagcuucgugcggacgugcaagaagcugcgcgaggaggaggccgcgcgccucuucuaccagaucgccuccgccgucgcccacugccacgacggcgggcuggugcugcgggaccucaagcugcggaaguucaucuucaaggacgaggagcgcacccgggugaagcuggagagccucgaggacgcguacauccugcgcggcgacgacgacagccuguccgacaagcacgggugcccggccuacgucagccccgagauccucaacaccuccggcagcuacuccgggaaggccgccgacguguggagccugggcgugaugcuguacaccaugcucgucggccgguaccccuuccacgacaucgagcccuccagccuguucuccaagauccgccgggggcaguucaacaucccggagacgcugagccccaaggccaagugccucauccgcuccauccugcggcgcgagcccagcgagcggcugaccucccaggagauccucgaccaccccugguucagcaccgacuucuccgugagcaacuccgcguacggcgccaaggaggugagcgaccagcuggucccggacgugaacauggaggagaaccuggaccccuucuucaacuga

SEQ ID NO: 38078 - RNA, 1077 nt, Artificial Sequence
  derived and/or modified sequence opt1 from TRIB3__Homo_sapiens__NP_001288117
augcgcgccacgccccuggccgcgccggccggcagccucucccggaagaagcgccuggagcuggacgacaaccucgacaccgagcggcccgugcagaagcgcgcccggagcgggccccagccccgccugccgcccugccugcucccccuguccccgcccaccgcccccgaccgggccaccgcggucgccaccgccagccgccugggccccuacgugcuccuggagcccgaggagggcgggcgggccuaccaggcgcugcacugcccgaccgggacggaguacacgugcaagguguaccccguccaggaggcccucgccgugcuggagcccuacgcccgccugcccccgcacaagcacguggcccggcccaccgagguccucgcgggcacccagcugcuguacgccuucuucacccgcacccacggcgacaugcacucccucgugcggagccgccaccggauccccgagcccgaggccgccgugcuguuccgccagauggccaccgcgcuggcccacugccaccagcacgggcucguccugcgggaccugaagcucugccgcuucguguucgccgaccgggagcgcaagaagcuggugcuggagaaccucgaggacuccugcguccugaccggcccggacgacagccugugggacaagcacgccugccccgccuacguggggcccgagauccucuccagccgggcguccuacagcggcaaggccgccgacguguggucccugggggucgcccuguucacgaugcucgccggccacuaccccuuccaggacagcgagccggugcugcuguucggcaagauccgccgcggggcguacgcccuccccgccggccuguccgcccccgcgcggugccuggugcgcugccuccugcggcgcgagcccgccgagcggcugaccgccaccgggauccuccugcacccguggcugcgccaggaccccaugccccucgccccgacccggagccaccugugggaggccgcgcaggucgugcccgacggccugggccucgacgaggcccgcgaggaggagggggaccgggaggugguccuguacggcuga

SEQ ID NO: 38079 - RNA, 1446 nt, Artificial Sequence
  derived and/or modified sequence opt1 from TRIM10__Homo_sapiens__NP_006769
auggccagcgccgcguccgugaccagccuggccgacgaggucaacugccccaucugccagggcacccuccgcgagccggugacgaucgacugcgggcacaacuucugccgggccugccugacccgcuacugcgagauccccggccccgaccuggaggaguccccgaccugcccccucugcaaggagcccuuccggcccgggagcuuccgccccaacuggcagcuggccaacguggucgagaacaucgagcggcugcagcucguguccacccugggccugggggaggaggacgugugccaggagcacggcgagaagaucuacuucuucugcgaggacgacgagaugcagcucugcgucgugugccgcgaggccggcgagcacgcgacgcacaccaugcgguuccuggaggacgccgccgccccguaccgcgagcagauccacaagugccugaagugccuccggaaggagcgcgaggagauccaggagauccagagccgggagaacaagcgcaugcagguccugcugacccagguguccaccaagcggcagcaggucaucagcgaguucgcgcaccuccgcaaguuccuggaggagcagcaguccauccugcucgcccagcuggagagccaggacggggacauccugcggcagcgcgacgaguucgaccuccugguggccggcgagaucugccgguucuccgcccugaucgaggagcucgaggagaagaacgagcgccccgcccgggagcugcugacggacauccgcagcacccucauccggugcgagacccgcaagugccgcaagcccguggcggugucccccgagcuggggcagcggauccgcgacuucccgcagcaggcccugccccuccagcgggagaugaagauguuccuggagaagcugugcuucgagcucgacuacgagcccgcccacaucagccuggacccccagaccucccacccgaagcugcuccugagcgaggaccaccagcgcgcccaguucuccuacaaguggcagaacagccccgacaacccccagcgguucgaccgcgccacgugcgugcuggcgcacaccggcaucaccgggggccggcacaccugggucguguccaucgaccucgcccacggcgggagcugcacggugggcgucgugagcgaggacgugcagcgcaagggggagcugcggcugcgccccgaggagggcgucugggccgugcggcucgccuggggcuucguguccgcccuggggagcuucccgacccgccugacccucaaggagcagccccggcagguccgcgugucccuggacuacgaggucggcugggugaccuucacgaacgcggugacccgggagcccaucuacaccuucaccgccagcuucacgcgcaaggucauccccuucuucgggcuguggggccggggguccagcuucucccucagcuccuga

SEQ ID NO: 38080 - RNA, 1407 nt, Artificial Sequence
  derived and/or modified sequence opt1 from TRIM11__Homo_sapiens__NP_660215
auggccgcccccgaccugagcaccaaccuccaggaggaggcgaccugcgccaucugccuggacuacuucacggaccccgugaugaccgacugcggccacaacuucugccgcgagugcauccggcgcugcugggggcagcccgagggccccuacgccugccccgagugccgggagcuguccccgcagcgcaaccuccggcccaaccgcccccuggccaagauggccgagauggcgcggcgccugcacccgccgagccccgucccccagggggugugccccgcccaccgggagccgcucgccgccuucugcggcgacgagcugcgccugcucugcgcggccugcgagcgguccggggagcacugggcccaccgcgugcggccccugcaggacgccgccgaggaccugaaggcgaagcucgagaagucccuggagcaccuccgcaagcagaugcaggacgcccugcuguuccaggcccaggccgacgagaccugcguccuguggcagaagaugguggagagccagcggcagaacgugcucggcgaguucgagcgccugcggcgccugcucgccgaggaggagcagcagcugcugcagcggcucgaggaggaggagcuggagguccugccccgccuccgggagggcgcggcccaccuggggcagcagagcgcccaccuggccgagcucaucgccgagcuggagggccgcugccagcugcccgcgcucgggcugcugcaggacaucaaggacgcccuccgccgggugcaggacgugaagcugcagccgcccgaggucgugcccauggagcugcgcaccgugugccggguccccggccucguggagacgcugcgccgguuccgcggggacgugacccuggacccggacaccgccaaccccgagcucauccuguccgaggaccggcgcagcguccagcggggcgaccugcgccaggcccuccccgacucccccgagcgguucgacccgggccccugcgugcuggggcaggagcgcuucaccagcggccggcacuacugggagguggaggucggggaccgcacguccugggcccugggcgugugccgggagaacgugaaccgcaaggagaagggcgagcucagcgcggggaacggcuucuggauccuggucuuccugggguccuacuacaacagcuccgagcgggcccuggcgccccuccgcgacccgccccggcgcgugggcaucuuccuggacuacgaggccgggcaccugagcuucuacuccgccaccgacggcagccuccuguucaucuuccccgagauccccuucuccggcacccugcgcccccucuucagcccccugagcuccagccccacccccaugacgaucugccggccgaagggcggguccggggacacccuggccccgcaguga

SEQ ID NO: 38081 - RNA, 1233 nt, Artificial Sequence
  derived and/or modified sequence opt1 from TRIM13__Homo_sapiens__NP_001007279
auggacgugauggagcugcucgaggaggaccugaccugccccaucugcugcagccuguucgacgacccgcgcguccuccccugcucccacaacuucugcaagaagugccuggagggcauccuggaggggagcgugcggaacucccucuggcgccccgcccccuucaagugcccgaccugccggaaggagacgagcgccaccggcaucaacucccuccaggugaacuacagccugaaggggaucgucgagaaguacaacaagaucaagaucucccccaagaugcccgugugcaagggccaccucgggcagccccugaacaucuucugccugaccgacaugcagcucaucugcggcaucugcgcgacccgcggcgagcacacgaagcacguguucugcagcaucgaggacgccuacgcccaggagcgggacgccuucgagucccuguuccagagcuucgagaccuggcgccgcggggacgcccugucccggcucgacacccuggagaccagcaagcggaagucccugcagcuccugacgaaggacagcgacaaggucaaggaguucuucgagaagcugcagcacacccucgaccagaagaagaacgagauccuguccgacuucgagaccaugaagcuggcggugaugcaggccuacgacccggagaucaacaagcucaacaccauccugcaggagcagcgcauggccuucaacaucgccgaggcguucaaggacgugagcgagcccaucgucuuccugcagcagaugcaggaguuccgggagaagaucaaggugaucaaggagacgccccugcccccguccaaccugcccgccagcccccugaugaagaacuucgacaccucccagugggaggacaucaagcucguggacgucgacaagcugagccugccccaggacaccggcaccuucaucagcaagaucccgugguccuucuacaagcuguuccuccugauccuccugcuggggcucgugaucguguucggccccacgauguuccuggaguggagccuguucgacgaccucgccaccuggaaggggugccuguccaacuucagcuccuaccugaccaagaccgccgacuucaucgagcagagcgucuucuacugggagcaggucacggacggcuucuucaucuucaacgagcgcuucaagaacuucacccucguggugcugaacaacguggccgaguucgugugcaaguacaagcugcucuga

SEQ ID NO: 38082 - RNA, 1398 nt, Artificial Sequence
  derived and/or modified sequence opt1 from TRIM15__Homo_sapiens__NP_150232
augcccgccaccccgagccugaaggugguccacgagcuccccgccugcacccugugcgcgggcccccuggaggacgccgugacgauccccugcgggcacaccuucugccgccucugccugccggcccugucccagaugggcgcccagagcuccgggaagauccuccugugcccccugugccaggaggaggagcaggccgagacccccauggcgcccgugccgcucggcccccugggggagaccuacugcgaggagcacggcgagaagaucuacuucuucugcgagaacgacgccgaguuccugugcgucuucugccgggagggccccacgcaccaggcccacaccgugggguuccucgacgaggccauccagcccuaccgcgaccggcugcgcagccggcuggaggcgcucuccaccgagcgcgacgagaucgaggacgugaagugccaggaggaccagaagcugcagguccugcucacccagaucgagagcaagaagcaccagguggagacggccuucgagcggcugcagcaggagcuggagcagcagcgcugccuccugcuggcccggcuccgcgagcuggagcagcagaucuggaaggagcgggacgaguacaucaccaagguguccgaggaggucacccgccugggcgcccaggugaaggagcucgaggagaagugccagcagccggccagcgagcugcugcaggacgugcgggucaaccagucccgcugcgagaugaagaccuucgugagccccgaggcgaucucccccgaccucgugaagaagauccgggacuuccaccgcaagauccugacgcugcccgagaugaugcggauguucagcgagaaccucgcccaccaccuggagaucgacuccggggucaucacccuggacccgcagaccgccagccgcucccucgugcugagcgaggaccggaaguccgugcgcuacacccggcagaagaagucccugcccgacagcccccuccgcuucgacggccugcccgccguccugggguucccgggcuucagcagcggccgccaccgguggcaggucgaccuccagcugggggacggcgggggcugcacggugggcguggccggggagggcgugcgccggaagggggagaugggccuguccgcggaggacggggugugggccgucaucaucagccaccagcagugcugggccuccaccagccccggcaccgaccucccccuguccgagaucccccgcggcgugcgggucgcccuggacuacgaggccggccaggugacccuccacaacgcgcagacgcaggagccgaucuucaccuucaccgccagcuucuccgggaagguguuccccuucuucgccgucuggaagaaggggagcugccugacccugaagggcuga

SEQ ID NO: 38083 - RNA, 1695 nt, Artificial Sequence
  derived and/or modified sequence opt1 from TRIM16__Homo_sapiens__NP_006461
auggccgagcuggaccucauggcccccggcccgcugccccgcgcgaccgcccagccgcccgcgccccugagccccgacuccgggagccccucccccgacagcggcuccgccagcccgguggaggaggaggacgucggguccagcgagaagcucggccgggagaccgaggagcaggacuccgacagcgccgagcagggggaccccgccggcgagggcaaggaggugcugugcgacuucugccuggacgacacgcgccgggugaaggccgucaaguccugccugaccugcauggugaacuacugcgaggagcaccuccagccccaccaggugaacaucaagcugcagagccaccuccugaccgagcccgucaaggaccacaacuggcgcuacugcccggcccaccacagcccccugagcgccuucugcugccccgaccagcagugcaucugccaggacugcugccaggagcacuccgggcacaccaucgugagccucgacgcggcccggcgcgacaaggaggccgagcugcagugcacgcagcuggaccucgagcggaagcugaagcugaacgagaacgccaucucccgccuccaggccaaccagaaguccgugcuggucuccgugagcgaggugaaggcggucgccgagaugcaguucggcgagcugcucgccgccgugcggaaggcccaggcgaacgugaugcuguuccuggaggagaaggagcaggccgcccucagccaggccaacgggaucaaggcccaccuggaguaccgcuccgcggagauggagaaguccaagcaggagcuggagcggauggccgccaucagcaacaccguccaguuccucgaggaguacugcaaguucaagaacaccgaggacaucaccuuccccagcguguacgugggccugaaggacaagcuguccgggauccgcaaggucaucacggagagcaccgugcaccucauccagcugcuggagaacuacaagaagaagcuccaggaguucuccaaggaggaggaguacgacauccggacccaggugagcgccgucgugcagcgcaaguacuggaccuccaagccggagcccagcacgcgggagcaguuccugcaguacgccuacgacaucaccuucgaccccgacaccgcgcacaaguaccugcgccuccaggaggagaaccggaaggugaccaacacgacccccugggagcacccguaccccgaccugcccucccgcuuccugcacuggcggcagguccucagccagcagucccuguaccugcaccgcuacuacuucgagguggagaucuucggcgccggcaccuacgucgggcugaccugcaagggcaucgaccggaagggggaggagcgcaacagcugcaucuccggcaacaacuucagcuggucccuccaguggaacggcaaggaguucacggccugguacagcgacauggagacgccccugaaggccgggccguuccgccggcucggcguguacaucgacuuccccgggggcauccuguccuucuacgggguggaguacgacaccaugacccugguccacaaguucgcgugcaaguucagcgagcccguguacgccgccuucuggcucagcaagaaggagaacgccauccgcaucguggaccugggcgaggagcccgagaagccggcccccucccuggucggcaccgcgcccuga

SEQ ID NO: 38084 - RNA, 1434 nt, Artificial Sequence
  derived and/or modified sequence opt1 from TRIM17__Homo_sapiens__NP_001020111
auggaggccguggagcuggcccgcaagcuccaggaggaggcgaccugcagcaucugccuggacuacuucaccgaccccgucaugacgaccugcggccacaacuucugccgggccugcauccagcuguccugggagaaggcccgcgggaagaagggccggcgcaagcggaaggggagcuucccgugccccgagugccgcgagaugagcccccagcggaaccuccugcccaaccgccugcucaccaagguggccgagauggcccagcagcacccgggccugcagaagcaggaccugugccaggagcaccacgagccccucaagcuguucugccagaaggaccagucccccaucugcguggucugccgggagucccgcgagcaccggcugcaccgcgugcuccccgcggaggaggccgugcagggguacaagcugaagcuggaggaggacauggaguaccuccgggagcagaucacccgcacgggcaaccugcaggcccgggaggagcagagccuggccgaguggcagggcaaggucaaggagcgccgggagcgcaucgugcucgaguucgagaagaugaaccuguaccugguggaggaggagcagcggcuccugcaggcgcuggagaccgaggaggaggagaccgccucccgccuccgggagagcgucgccugccuggaccgccaggggcacucccuggagcuccugcugcuccagcuggaggagcgcagcacccagggcccgcugcagaugcuccaggacaugaaggagccccugucccggaagaacaacgugagcgugcagugccccgaggucgcgcccccgacgcgcccccggaccgugugccgcgugcccgggcagaucgagguccugcggggcuuccucgaggacguggugcccgacgccaccuccgccuacccguaccugcugcucuacgagagccgccagcggcgcuaccugggguccagccccgagggcuccggcuucugcagcaaggaccgguucgucgccuaccccugcgccguggggcagaccgccuucuccagcggccgccacuacugggagguggggaugaacaucacgggcgacgcccugugggcgcucggcgucugccgggacaacgugagccgcaaggaccgggugcccaagugcccggagaacggguucugggucgugcagcuguccaagggcaccaaguaccugagcaccuucuccgcccucacccccgucaugcugauggagccgcccagccacauggggaucuuccuggacuucgaggccggcgagguguccuucuacagcguguccgacgggagccaccuccacacguacucccaggccaccuuccccggcccccugcagcccuucuucugccugggcgcccccaagagcgggcagauggucaucuccaccgugaccaugugggugaagggcuga

SEQ ID NO: 38085 - RNA, 1428 nt, Artificial Sequence
  derived and/or modified sequence opt1 from TRIM21__Homo_sapiens__NP_003132
auggccagcgccgcccgccugaccaugaugugggaggaggugaccugccccaucugccucgacccguucgucgagcccguguccaucgagugcggccacagcuucugccaggagugcaucucccagguggggaagggcgggggcagcgucugccccgugugccggcagcgcuuccugcugaagaaccuccggcccaaccgccagcuggccaacauggugaacaaccugaaggagaucucccaggaggcccgggaggggacgcagggcgagcgcugcgccguccacggcgagcggcuccaccuguucugcgagaaggacgggaaggcccugugcugggugugcgcgcagagccgcaagcaccgggaccacgccauggugccgcucgaggaggccgcccaggaguaccaggagaagcugcaggucgcgcugggcgagcuccgccggaagcaggagcuggccgagaagcuggagguggagaucgccaucaagcgcgccgacuggaagaagaccguggagacccagaagucccggauccacgccgaguucguccagcagaagaacuuccucguggaggaggagcagcgccagcugcaggagcuggagaaggacgagcgggagcagcuccgcauccugggggagaaggaggcgaagcuggcccagcagagccaggcccuccaggagcugaucuccgagcuggaccggcgcugccacagcuccgcccucgagcugcugcaggaggugaucaucguccucgagcggagcgaguccuggaaccugaaggaccuggacaucaccagccccgagcuccgcuccgugugccacgugcccggccugaagaagaugcugcggacgugcgccguccacaucacccucgaccccgacaccgcgaacccguggcugauccugagcgaggaccgccgccaggugcggcucggggacacccagcaguccauccccggcaacgaggagcgcuucgacagcuaccccauggugcugggcgcccagcacuuccacuccgggaagcacuacugggaggucgacgugacgggcaaggaggccugggaccugggggugugccgggacagcguccgccggaagggccacuuccuccugagcuccaagagcggcuucuggaccaucuggcuguggaacaagcagaaguacgaggccgggaccuacccccagaccccgcuccaccuccaggugccgcccugccaggucggcaucuuccuggacuacgaggccgggaugguguccuucuacaacaucacggaccacggcagccugaucuacuccuucagcgagugcgcguucaccgggccccugcgccccuucuucucccccggcuucaacgacggcgggaagaacaccgcgccccugacccucugcccccugaacaucggcagccagggguccacggacuacuga

SEQ ID NO: 38086 - RNA, 1485 nt, Artificial Sequence
  derived and/or modified sequence opt1 from TRIM22__Homo_sapiens__NP_001186502
auggacuucagcgugaaggucgacaucgagaaggaggugaccugccccaucugccuggagcuccugaccgagccccugucccucgacugcggccacagcuucugccaggccugcaucacggccaagaucaaggaguccgugaucaucagccgcggggaguccagcugccccgucugccagacccgguuccagcccggcaaccugcgccccaaccggcaccuggcgaacaucguggagcgcgugaaggaggucaagauguccccgcaggaggggcagaagcgggacgugugcgagcaccacggcaagaagcuccagaucuucugcaaggaggacgggaaggugaucugcugggucugcgagcugagccaggagcaccagggccaccagaccuuccgcaucaacgagguggugaaggagugccaggagaagcugcaggucgcccuccagcggcugaucaaggaggaccaggaggccgagaagcuggaggacgacauccgccaggagcggaccgccuggaagaucgagcgccagaagauccucaagggcuucaacgagaugcgggugauccuggacaacgaggagcagcgcgagcugcagaagcucgaggagggggaggugaacguccuggacaaccuggccgcggccacggaccagcucgugcagcagcggcaggacgccuccacccugaucagcgaccugcagcgccggcuccgcggcuccagcguggagaugcugcaggacgucaucgacgugaugaagcgguccgagagcuggacccugaagaagcccaaguccgugagcaagaagcucaaguccgucuuccgcgugcccgaccugagcgggaugcuccaggugcugaaggagcugaccgacguccaguacuacuggguggacgucaugcugaaccccggcuccgccacgagcaacguggcgaucagcguggaccagcggcaggucaagaccgugcggaccugcaccuucaagaacuccaacccgugcgacuucagcgccuucgggguguucggcugccaguacuucuccagcggcaaguacuacugggaggucgacguguccgggaagaucgccuggauccucggcgugcacagcaagaucuccagccugaacaagcgcaaguccagcggguucgccuucgaccccuccgucaacuacagcaagguguacucccgcuaccgcccccaguacggcuacugggugaucggccugcagaacacgugcgaguacaacgccuucgaggacagcuccagcuccgaccccaagguccucacccuguucauggcggugccgcccugccggaucgggguguuccuggacuacgaggccggcaucgucagcuucuucaacgugaccaaccacggggcccucaucuacaaguucuccggcugccgcuucagccggcccgccuaccccuacuucaacccguggaacugccuggugcccaugaccgucugcccgcccagcuccuga

SEQ ID NO: 38087 - RNA, 1725 nt, Artificial Sequence
  derived and/or modified sequence opt1 from TRIM23__Homo_sapiens__NP_001647
auggccacccugguggucaacaagcucggcgccgggguggacagcggccgccaggggucccggggcaccgcgguggucaaggugcuggagugcggggugugcgaggacgucuucagccugcagggcgacaaggugccccgccuccugcugugcggccacacggugugccacgacugccucacccggcugccgcugcacgggcgcgccauccggugccccuucgaccgccaggucaccgaccucggcgacuccgggguguggggccugaagaagaacuucgcccugcucgagcugcuggagcggcuccagaacgggcccaucggccaguacggcgccgccgaggagagcaucgggaucuccggcgagagcaucauccgcugcgacgaggacgaggcgcaccuggccuccguguacugcaccgucugcgccacgcaccugugcagcgagugcucccaggugacccacagcaccaagacccucgccaagcaccggcgcgugccccuggcggacaagccgcacgagaagacgaugugcucccagcaccagguccacgccaucgaguucgugugccuggaggaggggugccagaccagcccccucaugugcugcgugugcaaggaguacggcaagcaccagggccacaagcacuccguccuggagcccgaggccaaccagauccgggccagcauccuggacauggcccacugcauccgcaccuucaccgaggagaucuccgacuacagccggaagcucguggggaucgugcagcacaucgagggcggggagcagaucgucgaggacggcaucgggauggcgcacacggagcacgugcccggcaccgccgagaacgcccgcuccugcauccgggccuacuucuacgaccugcacgagacccugugccgccaggaggagauggcccucagcguggucgacgcgcacgugcgggagaagcugaucuggcugcgccagcagcaggaggacaugaccauccuccuguccgaggucagcgccgccugccugcacugcgagaagacgcuccagcaggacgacugccggguggugcuggccaagcaggagaucacccgccugcucgagacccugcagaagcagcagcagcaguucaccgaggucgccgaccacauccagcuggacgcgagcaucccggugacguucaccaaggacaaccgggugcacaucggccccaagauggagauccgcgucgugacccucgggcuggacggcgccgggaagaccacgauccuguucaagcucaagcaggacgaguucaugcagcccauccccaccaucggcuucaacguggagaccgucgaguacaagaaccugaaguucaccaucugggacgucgggggcaagcacaagcugcgcccgcucuggaagcacuacuaccugaacacgcaggccgugguguucgugguggacuccagccaccgggaccgcaucuccgaggcccacagcgagcuggccaagcuccugaccgagaaggagcugcgggacgcgcugcuccugaucuucgccaacaagcaggacgucgccggcgcccuguccguggaggagaucaccgagcuccugagccugcacaagcucugcugcgggcgcuccugguacauccagggcugcgacgcgcggagcgggaugggccuguacgaggggcuggacuggcucucccgccagcugguggccgccggcguccuggacguggccuga

SEQ ID NO: 38088 - RNA, 3051 nt, Artificial Sequence
  derived and/or modified sequence opt1 from TRIM24__Homo_sapiens__NP_003843
auggagguggccgucgagaaggccguggcggccgccgccgccgcgagcgccgccgccuccggcgggcccagcgcggccccguccggcgagaacgaggccgagagccgccaggggcccgacuccgagcggggcggggaggccgcccgccugaaccuccuggacaccugcgcggugugccaccagaacauccagagccgggcccccaagcugcuccccugccugcacuccuucugccagcgcugccugccggccccccagcgguaccucaugcugcccgcccccaugcugggcagcgccgagaccccgccccccguccccgcgccgggcucccccgugagcggguccagccccuucgccacgcaggugggcgucauccgcugccccgugugcucccaggagugcgccgagcggcacaucaucgacaacuucuucgugaaggacaccaccgaggucccgagcuccaccguggagaagagcaaccaggugugcacguccugcgaggacaacgccgaggccaacggguucugcgucgagugcguggaguggcucugcaagaccugcauccgcgcgcaccagcgggugaaguucaccaaggaccacaccguccgccagaaggaggaggugagccccgaggccgugggcgucacgucccagcggcccguguucugccccuuccacaagaaggagcagcugaagcuguacugcgagaccugcgacaagcucaccugccgcgacugccagcugcuggagcacaaggagcaccgguaccaguucaucgaggaggccuuccagaaccagaaggugaucaucgacacccucaucacgaagcugauggagaagaccaaguacaucaaguucaccgggaaccagauccagaaccgcaucaucgaggucaaccagaaccagaagcagguggagcaggacaucaagguggccaucuucacccugauggucgagaucaacaagaagggcaaggcccuccugcaccagcuggagagccucgcgaaggaccaccggaugaagcugaugcagcagcagcaggagguggccggccugagcaagcagcucgagcacgucaugcacuucuccaagugggccgugagcuccgggagcuccacggcccugcuguacagcaagcgccucaucaccuaccggcugcgccaccugcuccgggcgcgcugcgacgccuccccggugaccaacaacaccauccaguuccacugcgaccccagcuucugggcccagaacaucaucaaccugggcucccuggucaucgaggacaaggagagccagccccagaugcccaagcagaacccggugguggagcagaacucccagccccccagcgggcucuccagcaaccagcuguccaaguuccccacgcagaucagccuggcccagcuccggcugcagcacaugcagcagcagcagccgcccccccgccugaucaacuuccagaaccacuccccgaagcccaacggccccguccuccccccgcacccccagcagcugcgcuacccccccaaccagaacaucccgcggcaggccaucaagcccaacccccugcagauggcguuccucgcccagcaggccaucaagcaguggcagaucagcuccggccaggggacccccagcaccaccaacagcacguccagcaccccguccagccccaccaucaccuccgccgccggcuacgacgggaaggcguucggcagccccaugaucgaccuguccagccccguggggggcuccuacaaccugccgagccuccccgacaucgacugcuccagcacgaucaugcuggacaacaucgugcgcaaggacaccaacaucgaccacggccagccccggcccccguccaaccgcaccguccagagccccaacuccagcgugcccucccccgggcuggccggcccggugaccaugacgagcguccacccccccauccggagcccguccgccagcuccguggggagccgcggcuccagcggguccagcuccaagcccgccggcgccgacagcacccacaaggugcccgucgugaugcucgagcccauccggaucaagcaggagaacuccggcccgcccgagaacuacgacuuccccguggucaucgugaagcaggagagcgacgaggagucccgcccccagaacgcgaacuacccgcggagcauccugaccucccugcugcucaacagcucccagagcuccaccagcgaggagacggugcugcgcagcgacgcccccgacuccaccggggaccagcccggccugcaccaggacaacagcuccaacgggaagagcgaguggcucgaccccucccagaagagcccgcugcacgucggcgagacccggaaggaggacgaccccaacgaggacuggugcgccgugugccagaacgggggcgagcugcucugcugcgagaagugccccaagguguuccaccuguccugccacguccccacccugaccaacuucccgagcggcgaguggaucugcacguucugccgcgaccucuccaagcccgagguggaguacgacugcgacgcccccagccacaacuccgagaagaagaagaccgaggggcuggugaagcugacccccaucgacaagcggaagugcgagcgccuccugcuguuccucuacugccacgagaugagccuggcguuccaggacccggucccccugaccgugcccgacuacuacaagaucaucaagaaccccauggaccucuccacgaucaagaagcggcugcaggaggacuacagcauguacuccaagccggaggacuucguggccgacuuccgccugaucuuccagaacugcgccgaguucaacgagcccgacagcgaggucgccaacgccggcaucaagcucgagaacuacuucgaggagcugcugaagaaccucuaccccgagaagcgguuccccaagccggaguuccgcaacgaguccgaggacaacaaguucagcgacgacuccgacgacgacuucgugcagccccggaagaagcgccugaagagcaucgaggagcgccagcugcucaaguga

SEQ ID NO: 38089 - RNA, 1893 nt, Artificial Sequence
  derived and/or modified sequence opt1 from TRIM25__Homo_sapiens__NP_005073
auggccgagcugugcccccucgccgaggagcugagcugcuccaucugccuggagccguucaaggagcccgugaccacccccugcggccacaacuucugcgggagcugccucaacgagacgugggcgguccagggcucccccuaccugugcccgcagugccgcgccguguaccaggcccggccccagcugcacaagaacaccgugcucugcaacgucguggagcaguuccugcaggccgaccuggcccgcgagccgcccgcggacguguggaccccgcccgcccgggccagcgcccccucccccaacgcgcaggucgccugcgaccacugccucaaggaggccgccgugaagaccugccuggugugcauggccagcuucugccaggagcaccuccagccgcacuucgacucccccgcguuccaggaccacccccugcagcccccgguccgcgaccugcugcggcgcaagugcagccagcacaaccggcuccgcgaguucuucugccccgagcacuccgagugcaucugccacaucugccugguggagcacaagacgugcagccccgccucccugagccaggccuccgccgaccucgaggccacccugcggcacaagcugaccgugauguacagccagaucaacggggcgucccgcgcccucgacgacguccggaaccgccagcaggacgugcggaugaccgccaaccgcaagguggagcagcugcagcaggaguacacggagaugaaggcccugcucgacgccagcgagaccaccuccacccggaagaucaaggaggaggagaagcgcgucaacagcaaguucgacacgaucuaccagauccugcugaagaagaaguccgagauccagacccucaaggaggagaucgagcagagccugaccaagcgggacgaguucgaguuccuggagaaggcgagcaagcuccgcggcaucuccaccaagcccguguacaucccggagguggagcugaaccacaagcugaucaaggggauccaccagagcacgaucgaccucaagaacgagcugaagcagugcaucggccggcugcaggagcccacccccuccagcggcgaccccggggagcacgacccggccuccacccacaagagcacccgccccgucaagaagguguccaaggaggagaagaaguccaagaagcccccgcccgugcccgcccuccccagcaagcugcccacguucggcgcccccgagcagcuggucgaccucaagcaggccgggcuggaggcggccgccaaggccaccagcucccaccccaacagcaccucccugaaggcgaaggugcucgagaccuuccuggccaagagccggcccgagcugcucgaguacuacaucaaggugauccuggacuacaacacggcccacaacaaggucgcccuguccgagugcuacaccguggccagcgucgcggagaugccgcagaacuaccgcccccacccccagcgcuucaccuacugcucccaggugcucggccugcacugcuacaagaaggggauccacuacugggagguggagcugcagaagaacaacuucugcggcgucggcaucugcuacgggagcaugaaccggcagggccccgagucccgccuggggcggaacagcgccagcuggugcguggagugguucaacaccaagaucuccgccuggcacaacaacguggagaagacgcucccgagcaccaaggccacccgcgucggcgugcugcugaacugcgaccacggcuucgugaucuucuucgccgucgcggacaaggugcaccucauguacaaguuccggguggacuucaccgaggcccuguaccccgccuucugggucuucuccgccggggccacgcugagcaucugcucccccaaguga

SEQ ID NO: 38090 - RNA, 1620 nt, Artificial Sequence
  derived and/or modified sequence opt1 from TRIM26__Homo_sapiens__XP_005249435
auggccaccagcgcgccccugcgcucccucgaggaggaggugaccugcagcaucugccuggacuaccugcgggacccggucacgaucgacugcggccacguguucugccgcuccugcaccaccgacgugcggcccaucagcgggucccgccccgucugcccccucugcaagaagccguucaagaaggagaacauccggcccguguggcagcuggccagccugguggagaacaucgagcgccucaaggucgacaagggccggcagcccggggaggugacccgcgagcagcaggacgccaagcugugcgagcggcaccgcgagaagcugcacuacuacugcgaggacgacggcaagcuccugugcgugaugugccgggagucccgcgagcaccggccccacacggccguccugauggagaaggccgcccagccgcaccgcgagaagauccucaaccaccugagcacccugcggcgcgaccgggacaagauccagggguuccaggcgaagggcgaggccgacauccucgccgcccugaagaagcugcaggaccagcgccaguacaucguggcggaguucgagcagggccaccaguuccuccgggagcgcgaggagcaccuccuggagcagcuggccaagcuggagcaggagcugaccgaggggcgggagaaguucaagucccgcggcgugggggagcucgcccgccuggcccuggucaucagcgagcucgagggcaaggcccagcagcccgcggccgagcugaugcaggacacccgggacuuccugaaccgcuacccccggaagaaguucuggguggggaagcccaucgcccgcguggucaagaagaagacgggcgaguucuccgacaagcuccugagccugcagcggggccuccgcgaguuccaggggaagcugcugcgggaccucgaguacaagaccguguccgugacccuggacccgcagagcgccuccggcuaccugcagcucagcgaggacuggaagugcgucaccuacacgucccuguacaagagcgccuaccugcacccccagcaguucgacugcgagcccggggugcucggcuccaagggcuucaccugggggaagguguacugggaggucgagguggagcgcgagggcuggagcgaggacgaggaggagggggacgaggaggaggagggcgaggaggaggaggaggaggaggaggcgggguacggcgacggcuacgacgacugggagaccgacgaggacgaggagagccugggggacgaggaggaggaggaggaggaggaggaggaggaggugcuggaguccugcauggucggcguggcccgggacagcgucaagcgcaagggggaccucucccugcggcccgaggacggcgugugggcccugcgccucagcuccagcgggaucugggccaacaccuccccggaggccgagcuguuccccgcgcugcggccccgccgggugggcaucgcccuggacuacgagggcgggacggucaccuucaccaacgccgagagccaggagcucaucuacaccuucacggccaccuucacccgccggcuggugcccuuccuguggcucaaguggccgggcacccgccugcugcuccggcccuga

SEQ ID NO: 38091 - RNA, 1542 nt, Artificial Sequence
  derived and/or modified sequence opt1 from TRIM27__Homo_sapiens__NP_006501
auggccagcggcuccguggccgagugccugcagcaggagacgaccugccccgucugccuccaguacuucgccgagccgaugaugcuggacugcgggcacaacaucugcugcgccugccuggcccgcugcuggggcaccgccgagaccaacgugagcugcccccagugccgggagaccuucccccagcgccacaugcggcccaaccgccaccucgccaacgugacccagcuggucaagcagcugcggacggagcgcccguccgggcccggcggggagaugggcgugugcgagaagcaccgggagccccucaagcuguacugcgaggaggaccagaugcccaucugcguggucugcgaccgcagccgggagcaccgcggccacuccgugcugccgcucgaggaggcgguggagggguucaaggagcagauccagaaccagcuggaccaccugaagcgggucaaggaccucaagaagcgccggcgcgcccagggcgagcaggcccgggccgagcugcugagccucacccagauggagcgcgagaagaucgugugggaguucgagcagcuguaccacucccugaaggagcacgaguaccggcuccuggcgcgccuggaggagcucgaccuggccaucuacaacagcaucaacggggccaucacccaguucuccugcaacaucagccaccuguccagccucaucgcccagcuggaggagaagcagcagcagcccacccgggagcugcuccaggacaucggcgacacgcugucccgcgccgagcggauccgcauccccgagcccuggaucaccccgcccgaccugcaggagaagauccacaucuucgcgcagaagugccucuuccugaccgagagccugaagcaguucaccgagaagaugcaguccgacauggagaagauccaggagcuccgcgaggcccagcuguacagcguggacgucacgcuggaccccgacaccgccuaccccucccucauccugagcgacaaccugcgccaggugcgguacuccuaccuccagcaggaccugccggacaaccccgagcgguucaaccuguuccccugcgugcucgggagccccugcuucaucgccggccgccacuacugggaggucgaggugggcgacaaggccaaguggaccaucggggugugcgaggacagcgucugccggaagggcggggugaccuccgcgccgcagaacggcuucugggccgugagccugugguacggcaaggaguacugggcccugacgucccccaugaccgcccucccccugcgcacgccccugcagcgggucgggaucuuccucgacuacgacgccggcgaggugagcuucuacaacgugaccgagcgcugccacaccuucaccuucucccacgcgaccuucugcgggccgguccggcccuacuucagccuguccuacagcggcgggaaguccgccgcgccccugaucaucugccccaugagcggcaucgacggcuucuccgggcacgugggcaaccacgggcacagcauggagaccuccccguga

SEQ ID NO: 38092 - RNA, 2508 nt, Artificial Sequence
  derived and/or modified sequence opt1 from TRIM28__Homo_sapiens__NP_005753
auggccgccagcgcggccgccgccuccgccgcggccgccagcgccgcguccggcagccccgggccgggcgagggguccgccggcggggagaagcgcagcaccgcccccuccgccgccgcgagcgccuccgccagcgccgccgcguccagccccgccggcggcggggccgaggcccuggagcuccuggagcacugcggcgugugccgggagcgccugcggcccgagcgcgagccgcggcuccugcccugccugcacuccgccugcagcgcgugccucgggcccgccgcccccgccgccgcgaacuccagcggcgacgggggcgccgccggcgacgggaccgucguggacugcccggugugcaagcagcagugcuucuccaaggacaucgucgagaacuacuucaugcgcgacagcggcuccaaggccgcgacggacgcccaggacgccaaccagugcugcaccagcugcgaggacaacgcccccgccaccagcuacugcguggagugcuccgagccccugugcgagaccugcguggaggcgcaccagcgggucaaguacacgaaggaccacaccgugcgcagcaccgggcccgccaagucccgggacggcgagcgcaccguguacugcaacguccacaagcacgagccgcugguccucuucugcgagagcugcgacacgcugaccugccgggacugccagcugaacgcccacaaggaccaccaguaccaguuccucgaggacgccgugcgcaaccagcggaagcugcuggccucccucgugaagcgccugggcgacaagcacgcgacccugcagaaguccaccaaggaggugcggagcagcauccgccagguguccgacguccagaagcggguccagguggacgugaagauggccauccuccagaucaugaaggagcugaacaagcgcgggcgggugcuggugaacgacgcccagaaggucacggagggccagcaggagcgccucgagcggcagcacuggaccaugaccaagauccagaagcaccaggagcacauccugcgcuucgccagcugggcccuggaguccgacaacaacaccgcgcuccugcugagcaagaagcucaucuacuuccagcugcaccgcgcccugaagaugaucguggaccccguggagccccacggggagaugaaguuccagugggaccucaacgccuggacgaaguccgccgaggcguucggcaagaucgucgccgagcggcccgggaccaacagcaccggcccggcccccauggccccgccccgcgcccccggcccccuguccaagcaggggagcggcuccagccagcccauggaggugcaggagggguacggcuucggguccggcgacgaccccuacagcagcgcggagccgcacgucuccggcgugaagcggagccgcuccggggagggcgaggugagcgggcugaugcggaaggucccccgcgugucccucgagcggcuggaccuggaccucaccgccgacagccagccgcccguguucaaggucuuccccggcuccacgaccgaggacuacaaccugaucgugaucgagcgcggggccgccgccgcggccaccggccagcccggcaccgcccccgccgggacgccgggcgccccgccccuggcggggauggccaucgugaaggaggaggagaccgaggccgccaucggcgcgccgcccaccgccaccgagggccccgagacgaagcccguccucauggcccuggccgaggggcccggcgccgaggggccccggcuggcgagccccuccggcagcaccuccagcgggcucgaggugguggcccccgagggcaccuccgcccccggcgggggcccggggacccuggacgacagcgccacgaucugccgcgucugccagaagcccggcgaccuggugaugugcaaccagugcgaguucugcuuccaccucgacugccaccuccccgcccugcaggacgugcccggggaggagugguccugcagccugugccacguccugccggaccugaaggaggaggacggcucccugagccucgacggcgcggacagcaccggggugguggccaagcugucccccgccaaccagcggaagugcgagcgcguccugcucgcccuguucugccacgagcccugccggccccugcaccagcucgccaccgacagcaccuucucccuggaccagccgggcgggacgcuggaccucacccugauccgcgcgcggcugcaggagaagcucagcccgcccuacuccagcccccaggaguucgcccaggacgugggccgcauguucaagcaguucaacaagcugaccgaggacaaggccgacgugcaguccaucaucgggcugcagcgguucuucgagacccgcaugaacgaggccuucggcgacaccaaguucagcgccguccucguggagcccccgcccaugucccugcccggcgcggggcugagcucccaggagcucagcggcgggcccggcgacgggcccuga

SEQ ID NO: 38093 - RNA, 1767 nt, Artificial Sequence
  derived and/or modified sequence opt1 from TRIM29__Homo_sapiens__NP_036233
auggaggccgccgacgcgagccgcuccaacggcagcucccccgaggcccgggacgcccgcagcccguccgggcccagcggcucccuggagaacgggaccaaggccgacggcaaggacgccaagaccacgaacgggcacggcggcgaggcggccgagggcaagagccucggguccgcccugaagcccggggagggccggagcgcccuguucgcggggaacgaguggcgccggcccaucauccaguucguggaguccggcgacgacaagaacagcaacuacuucuccauggacagcauggagggcaagcgcuccccguacgccgggcuccagcugggcgccgccaagaagccgcccgucaccuucgccgagaagggggagcugcgcaagagcaucuucuccgagagccggaagcccaccguguccaucauggagcccggcgagacccggcgcaacagcuacccccgggcggacacgggccucuucagccgcuccaagagcggguccgaggaggugcugugcgacagcugcaucggcaacaagcagaaggccgucaaguccugccuggugugccaggccagcuucugcgagcuccaccugaagccccaccuggagggggccgccuuccgggaccaccagcuccuggagcccauccgcgacuucgaggcgcggaagugcccggugcacggcaagaccauggagcuguucugccagaccgaccagaccugcaucugcuaccucugcauguuccaggagcacaagaaccacuccacggucaccguggaggaggccaaggccgagaaggagaccgagcugagccugcagaaggagcagcuccagcugaagaucaucgagaucgaggacgaggccgagaaguggcagaaggagaaggaccgcaucaaguccuucaccacgaacgagaaggccauccuggagcagaacuuccgggaccucgugcgcgaccuggagaagcagaaggaggagguccgggcggcccuggagcagcgcgagcaggacgccguggaccaggugaaggucaucauggacgcccucgacgagcgggccaaggugcugcacgaggacaagcagacccgcgagcagcugcacagcaucuccgacagcguccucuuccugcaggaguucggggcgcugauguccaacuacagccucccgccgccccugcccaccuaccacgugcugcucgagggcgagggccuggggcagucccugggcaacuucaaggacgaccuccugaacgugugcaugcgccacguggagaagaugugcaaggccgaccugagccggaacuucaucgagcgcaaccacauggagaacgggggcgaccaccgguacgucaacaacuacaccaacuccuucgggggcgaguggagcgcccccgacacgaugaagcgcuacuccauguaccucacccccaagggcggggugcggaccagcuaccagcccagcucccccggccgcuucaccaaggagacgacccagaagaacuucaacaaccuguacgggaccaagggcaacuacaccagccgggugugggaguacuccagcuccauccagaacagcgacaacgaccugcccgucgugcagggguccagcuccuucagccucaagggcuaccccucccugaugcgcagccagucccccaaggcccagccgcagacguggaaguccggcaagcagaccaugcugagccacuaccggcccuucuacgugaacaaggggaacggcaucgggagcaacgaggcgcccuga

SEQ ID NO: 38094 - RNA, 2235 nt, Artificial Sequence
  derived and/or modified sequence opt1 from TRIM2__Homo_sapiens__NP_001123539
auggccagcgagggcaccaacauccccuccccggugguccgccagaucgacaagcaguuccugaucugcagcaucugccucgagcgguacaagaaccccaaggugcugcccugccugcacaccuucugcgagcgcugccuccagaacuacauccccgcccacucccugacgcugagcugcccggugugccggcagaccuccauccuccccgagaagggggucgcggcccugcagaacaacuucuucaucaccaaccugauggacgugcuccagcgcacccccggcagcaacgccgaggaguccagcauccuggagacggugaccgccgucgccgcggggaagccccuguccugcccgaaccacgacggcaacgugauggaguucuacugccagagcugcgagaccgccaugugccgggagugcaccgagggggagcacgccgagcaccccacggugccccucaaggacgucguggagcagcacaaggccucccuccaggugcagcuggacgcggucaacaagcgccugcccgagaucgacagcgcccugcaguucaucuccgagaucauccaccagcugaccaaccagaaggccagcaucguggacgacauccacuccaccuucgacgagcuccagaagacccugaacgugcgcaagagcguccugcucauggagcuggaggugaacuacggccugaagcacaaggugcuccagucccagcuggacacgcugcuccagggccaggagagcaucaaguccugcagcaacuucaccgcccaggcccugaaccacgggaccgagaccgagguccugcucgugaagaagcagaugagcgagaagcugaacgagcuggcggaccaggacuucccgcuccacccccgggagaacgaccagcuggacuucaucguggagacggagggccugaagaaguccauccacaaccucgggaccauccugaccaccaacgccgucgccagcgagacgguggccaccggcgaggggcugcggcagaccaucaucggccagcccauguccgugaccaucacgaccaaggacaaggacggcgagcucugcaagaccgggaacgccuaccugaccgcggagcugagcacgcccgacggcuccgucgccgacggggagauccucgacaacaagaacggcaccuacgaguuccuguacaccgugcagaaggagggcgacuucacccugagccuccgccuguacgaccagcacauccggggguccccguucaagcugaaggucauccgcagcgccgacgugucccccacgaccgagggcgugaagcggcgcgucaagagccccggguccggccacgugaagcagaaggccgugaagcggcccgccagcauguacuccaccgggaagcgcaaggagaacccgaucgaggacgaccucaucuuccgggucggcaccaagggccgcaacaagggggaguucacgaaccugcagggcguggcggccagcaccaacgggaagauccugaucgccgacuccaacaaccagugcgugcagaucuucagcaacgacggccaguucaagucccgguucgggauccgcggccggagccccggccagcugcagcgccccaccggggucgccgugcaccccuccggcgacaucaucaucgccgacuacgacaacaagugggugagcaucuucagcuccgacgggaaguucaagaccaagaucggcagcgggaagcucaugggcccgaagggcgucuccguggaccgcaacgggcacaucaucguggucgacaacaaggcgugcugcguguucaucuuccagcccaacggcaagaucgugacccgguucgggagccgcggcaacggcgaccggcaguucgccgggccccacuucgccgccgucaacuccaacaacgagaucaucaucacggacuuccacaaccacagcgugaagguguucaaccaggagggcgaguucaugcugaaguucggguccaacggcgaggggaacggccaguucaacgcgcccaccggcgucgccguggacagcaacgggaacaucaucguggccgacuggggcaacucccgcauccaggucuucgacgggagcggcuccuuccugagcuacaucaacaccuccgccgacccgcucuacgggccccagggccuggcccugaccagcgacggccacgugguggucgcggacuccgggaaccacugcuucaagguguaccgguaccuccaguga

SEQ ID NO: 38095 - RNA, 1278 nt, Artificial Sequence
  derived and/or modified sequence opt1 from TRIM31__Homo_sapiens__NP_008959
auggccagcggccaguucgugaacaagcugcaggaggaggucaucugccccaucugccucgacauccugcagaagccggugaccaucgacugcgggcacaacuucugccugaagugcaucacccagaucggcgagacguccugcggguucuucaagugcccccucugcaagaccagcgugcgcaagaacgccauccgguucaacucccugcugcgcaaccucgucgagaagauccaggcgcugcaggccagcgaggugcaguccaagcggaaggaggcgaccugcccccgccaccaggagauguuccacuacuucugcgaggacgacggcaaguuccugugcuucgugugccgggagagcaaggaccacaagucccacaacgucagccucaucgaggaggccgcccagaacuaccaggggcagauccaggagcagauccaggugcugcagcagaaggagaaggagaccgugcaggucaaggcccagggcgugcaccgcguggacgucuucacggaccagguggagcacgagaagcagcggauccugaccgaguucgagcuccugcaccaggugcuggaggaggagaagaacuuccuccugucccgcaucuacuggcugggccacgaggggaccgaggccggcaagcacuacgucgccagcaccgagccccagcucaacgaccugaagaagcugguggacucccucaagacgaagcagaacaugccgccccggcagcugcuggaggacaucaaggugguccucugccgcagcgaggaguuccaguuccugaaccccacccccgugccgcuggagcucgagaagaagcuguccgaggccaagagccggcacgacuccaucaccgggagccugaagaaguucaaggaccagcuccaggcggaccgcaagaaggacgagaaccgguucuucaaguccaugaacaagaacgacaugaaguccuggggccugcugcagaagaacaaccacaagaugaacaagaccagcgagcccgggagcagcuccgccggcggccgcacgaccagcgggccgcccaaccaccacuccagcgcccccucccacagccucuuccgggccuccagcgccggcaaggugaccuuccccgucugccugcuggcguccuacgacgagaucagcgggcagggcgccuccagccaggacaccaagacguucgacguggcccucuccgaggagcugcacgccgcccugagcgaguggcucaccgcgauccgcgccugguucugcgaggugcccuccagcuga

SEQ ID NO: 38096 - RNA, 1962 nt, Artificial Sequence
  derived and/or modified sequence opt1 from TRIM32__Homo_sapiens__XP_011516700
auggccgccgcggccgccagccaccugaaccuggacgcccugcgcgaggugcuggagugccccaucugcauggaguccuucaccgaggagcagcuccggccgaagcugcugcacugcggccacaccaucugccgccagugccucgagaagcugcuggccagcuccaucaacgggguccggugccccuucugcagcaagaucacgcgcaucaccucccucacccagcugaccgacaaccugacggugcucaagaucaucgacaccgcgggccugagcgaggccguggggcugcucaugugccgguccugcggccgccggcugccccgccaguucugccggagcugcgggcugguccucugcgagcccugccgcgaggccgaccaccagccgcccggccacugcacccugcccgugaaggaggccgcggaggagcggcgccgggacuucggcgagaagcugacccgccuccgggagcugaugggggagcugcagcgccggaaggccgcccucgagggcguguccaaggaccugcaggcccgcuacaaggccguccugcaggaguacgggcacgaggagcggcgcgugcaggacgagcucgcgcggagccgcaaguucuucacgggcucccuggccgagguggagaaguccaacagccaggucguggaggagcagagcuaccugcucaacaucgccgaggugcaggccgucucccgcugcgacuacuuccuggccaagaucaagcaggcggacguggcccugcucgaggagaccgccgacgaggaggagcccgagcugaccgccagccugccgcgggagcucacccugcaggacguggagcugcucaaggucgggcacgugggcccccugcagaucggccaggccgugaagaagccccgcacggucaacguggaggacuccugggcgauggaggccaccgccagcgccgccuccaccagcgugaccuuccgggagauggacaugagccccgaggaggucguggcguccccgcgcgccagccccgccaagcagcgggggcccgaggccgcguccaacauccagcagugccuguuccucaagaagaugggcgccaaggggagcacgcccggcauguucaaccugccggugucccuguacgucaccagccagggcgaggugcucgucgccgaccgcgggaacuaccggauccagguguucacccgcaagggcuuccugaaggagauccggcgcucccccagcgggaucgacuccuucgugcugagcuuccucggcgccgaccugcccaaccugacgccccuguccgucgccaugaacugccaggggcucaucggcgugaccgacagcuacgacaacucccugaagguguacacccuggacggccacugcgucgcgugccaccggagccagcucuccaagccgugggggaucaccgcccugcccagcggccaguucguggugaccgacgucgagggcgggaagcuguggugcuucacgguggaccgcggguccggcguggucaaguacagcugccucugcuccgccgugcggcccaaguucgugaccugcgacgccgagggcaccgucuacuucacccaggggcugggccugaaccucgagaaccgccagaacgagcaccaccuggagggcggguucagcaucgggagcgugggccccgacggccagcuggggcggcagaucucccacuucuucagcgagaacgaggacuuccgcugcaucgccggcaugugcguggacgcgcgcggggaccucaucgucgccgacuccagccggaaggagauccugcacuucccgaagggcggcggguacuccgugcugauccgggagggccucacgugccccguggggaucgcccugacccccaagggccagcugcucguccuggacugcugggaccacugcaucaagaucuacagcuaccaccuccgccgcuacuccacccccuga

SEQ ID NO: 38097 - RNA, 1467 nt, Artificial Sequence
  derived and/or modified sequence opt1 from TRIM34__Homo_sapiens__NP_067629
auggccagcaagauccugcucaacgugcaggaggaggugaccugccccaucugccuggagcugcucaccgagccgcugucccuggacugcggccacagccucugccgcgccugcaucacggucuccaacaaggaggcggugaccagcaugggcgggaaguccagcugccccgucugcgggaucuccuacagcuucgagcaccuccaggccaaccagcaccuggccaacaucguggagcggcugaaggaggugaagcugucccccgacaacggcaagaagcgcgaccugugcgaccaccacggggagaagcuccugcuguucugcaaggaggaccggaaggucaucugcuggcucugcgagcgcagccaggagcaccggggccaccacaccgugcugaccgaggagguguucaaggagugccaggagaagcugcaggccguccucaagcgccugaagaaggaggaggaggaggccgagaagcuggaggcggacauccgggaggagaagacguccuggaaguaccaggugcagaccgagcgccagcggauccagaccgaguucgaccagcuccgcagcauccugaacaacgaggagcagcgggagcugcagcgccucgaggaggaggagaagaagacccuggacaaguucgccgaggccgaggacgagcuggugcagcagaagcagcucguccgggagcugaucuccgacguggagugccgcagccagugguccacgauggagcugcuccaggacaugagcggcaucaugaagugguccgagaucuggcggcugaagaagcccaagauggugagcaagaagcugaagaccgucuuccacgccccggaccucucccgcaugcugcagauguuccgggagcugaccgcggugcgcugcuacuggguggacgucacccucaacagcgugaaccugaaccugaaccucgugcugagcgaggaccagcggcaggucaucuccgugcccaucuggcccuuccagugcuacaacuacggggugcugggcagccaguacuucuccagcgggaagcacuacugggaggucgacguguccaagaagacggccuggauccucggcgucuacugccgcaccuacagccggcacaugaaguacguggugcgccgcugcgccaaccggcagaaccuguacaccaaguaccgcccccuguucggguacugggucaucggccuccagaacaagugcaaguacggcguguucgaggagucccugagcuccgacccggaggugcugacccucagcauggccgucccgcccugccggguggggguguuccuggacuacgaggccggcaucgucuccuucuucaacgugacgagccacgggucccugaucuacaaguucagcaagugcugcuucucccagcccguguaccccuacuucaaccccuggaacugccccgcgcccaugacccugugcccgcccagcuccuga

SEQ ID NO: 38098 - RNA, 1482 nt, Artificial Sequence
  derived and/or modified sequence opt1 from TRIM35__Homo_sapiens__NP_741983
auggagcgcagccccgacguguccccgggccccagccgguccuucaaggaggagcugcucugcgccgucugcuacgaccccuuccgcgacgccgugacccugcggugcgggcacaacuucugccgcggcugcgugagccggugcugggagguccagguguccccgaccugccccgugugcaaggaccgcgcgagccccgccgaccugcggacgaaccacacccucaacaaccuggucgagaagcugcuccgcgaggaggccgagggggcccgguggaccuccuaccgcuucagccgggugugccgccugcaccggggccagcugucccucuucugccuggaggacaaggagcugcucugcugcagcugccaggccgacccccgccaccaggggcaccgggugcagcccgucaaggacaccgcgcacgacuuccgcgccaagugccggaacauggagcacgcccugcgcgagaaggccaaggcguucugggccaugcggcgcuccuacgaggccaucgccaagcacaaccagguggaggccgcguggcuggagggccggauccgccaggaguucgacaagcuccgcgaguuccugcggguggaggagcaggccauccuggacgccauggccgaggagacgcgccagaagcagcuccuggccgacgagaagaugaagcagcugaccgaggagaccgagguccucgcgcacgagaucgagcggcugcagauggagaugaaggaggacgacgugagcuuccugaugaagcacaagucccgcaagcggcgccucuucugcaccauggagccggagcccgugcagcccggcaugcugaucgacgucugcaaguaccuggggagccuccaguaccggguguggaagaagaugcuggccuccguggagagcguccccuucuccuucgacccgaacacggccgccggcuggcugagcguguccgacgaccucaccagcgugaccaaccacggguaccgcguccagguggagaaccccgagcgguucagcuccgcccccugccugcugggcagccgcguguucucccaggggagccacgcgugggaggucgcccucggcggccugcaguccuggcgggugggggucgugcgcgugcggcaggacagcggcgccgaggggcacucccacagcugcuaccacgacacccgcuccggcuucugguacgucugccggacgcagggcguggagggggaccacugcgugaccagcgaccccgccaccuccccgcugguccucgccaucccccgccggcugcgcguggagcuggagugcgaggagggcgagcucagcuucuacgacgcggagcggcacugccaccuguacaccuuccacgcccgcuucggggaggugcgccccuacuucuaccugggcggggcccggggcgccgggcccccggagccccuccgcaucugcccccugcacaucuccgucaaggaggagcuggacggcuga

SEQ ID NO: 38099 - RNA, 183 nt, Artificial Sequence
  derived and/or modified sequence opt1 from TRIM36__Homo_sapiens__NP_001017397
augagcgaguccggcgagaugagcgaguucggguacaucauggagcugaucgccaagggcaagaugcccgacuggcgccggggguaccgcugccggcagggcugcgggaagaccaccgagcucgccacggcgaccgacuucucccagaccggcaacaagagcggcaagcacuucaagaccuga

SEQ ID NO: 38100 - RNA, 2895 nt, Artificial Sequence
  derived and/or modified sequence opt1 from TRIM37__Homo_sapiens__NP_056109
auggacgagcagagcguggaguccaucgccgaggucuuccgcugcuucaucugcauggagaagcugcgggacgcccgccucugcccccacugcagcaagcugugcugcuucuccugcauccggcgcuggcugaccgagcagcgggcgcagugcccgcacugccgcgcgccccuccagcugcgggagcuggugaacugccgcugggccgaggaggugacccagcagcucgacacgcugcagcugugcagccucaccaagcacgaggagaacgagaaggacaagugcgagaaccaccacgagaagcuguccgucuucugcuggaccugcaagaagugcaucugccaccagugcgcccuguggggcgggaugcacggcgggcacaccuucaagccccucgccgagaucuacgagcagcacgugacgaaggugaacgaggaggucgcgaagcugcggcgccggcugauggagcucaucagccuggugcaggagguggagcgcaacgucgaggccgugcggaacgccaaggacgagcgcgugcgggagauccgcaacgccgucgagaugaugaucgcgcggcuggacacccagcucaagaacaagcugaucacccugaugggccagaagaccucccucacgcaggagaccgagcugcuggagagccuccugcaggagguggagcaccagcugcgcuccugcagcaaguccgagcucaucagcaaguccagcgagauccugaugauguuccagcagguccaccggaagcccauggccuccuucgugaccaccccggugccgcccgacuucacgagcgagcuggugcccuccuacgacagcgccaccuucguccucgagaacuucuccacccugcgccagcgggccgaccccguguacagcccgccccuccaggugagcgggcugugcuggcgccugaaggucuaccccgacggcaacggcguggugcgcggguacuaccuguccgucuuccucgagcugagcgccggccugcccgagaccuccaaguacgaguaccggguggagaugguccaccagagcugcaacgaccccacgaagaacaucauccgcgaguucgcguccgacuucgaggugggggagugcuggggcuacaaccgguucuuccgccucgaccugcuggccaacgagggguaccucaacccccagaacgacaccgugauccugcgguuccagguccgcagccccaccuucuuccagaagucccgggaccagcacugguacaucacccagcuggaggccgcccagacgagcuacauccagcagaucaacaaccucaaggagcgccugaccaucgagcugucccggacccagaagucccgcgaccucagcccgcccgacaaccaccugagcccccagaacgacgacgcccuggagacccgggcgaagaaguccgccugcagcgacaugcugcucgagggcggccccacgaccgccuccgugcgcgaggccaaggaggacgaggaggacgaggagaagauccagaacgaggacuaccaccacgagcugagcgacggggaccuggaccucgaccugguguacgaggacgaggucaaccagcuggacggcuccagcuccagcgccagcuccaccgcgaccagcaacacggaggagaacgacaucgacgaggagaccauguccggggagaacgacguggaguacaacaacauggagcucgaggagggcgagcugauggaggacgccgccgccgccggcccggcggggagcucccacggcuacguggggagcuccagccggaucucccgccggacccaccugugcagcgccgccaccuccagccuccuggacaucgacccccugauccucauccaccuccuggaccugaaggaccgcuccagcaucgagaaccuguggggccugcagccccggcccccggccucccuccugcagcccacggcgagcuacucccgcaaggacaaggaccagcggaagcagcaggccauguggcgcguccccagcgaccugaagaugcucaagcgccugaagacccagauggccgaggugcggugcaugaagaccgacgugaagaacacccugagcgagaucaaguccagcuccgccgccagcggggacaugcagacgucccucuucagcgcggaccaggccgcccuggccgccugcggcaccgagaacuccggccgccugcaggaccucgggauggagcugcuggccaagagcuccgucgccaacugcuacauccggaacagcaccaacaagaaguccaacagccccaagccggcccgcuccagcguggccggcucccucagccugcggcgcgccguggaccccggggagaacucccggagcaagggcgacugccagacccuguccgaggggagccccggcagcucccagagcggcucccgccacagcuccccgcgggcgcucauccacgggagcaucggcgacauccugcccaagaccgaggaccgccagugcaaggcccuggacuccgacgccgucgugguggccgucuucagcgggcuccccgcgguggagaagcggcgcaagauggugacgcugggcgccaacgccaagggcgggcaccuggagggccuccagaugaccgaccuggagaacaacuccgagaccggggagcugcagcccguccucccggagggcgccagcgccgcgcccgaggaggggauguccagcgacuccgacaucgagugcgacaccgagaacgaggagcaggaggagcacacgagcgugggcggcuuccacgacuccuucauggugaugacccagccgcccgacgaggacacccacagcuccuuccccgacggggagcagaucggccccgaggaccugagcuucaacaccgacgagaacuccgggcgguga

SEQ ID NO: 38101 - RNA, 1398 nt, Artificial Sequence
  derived and/or modified sequence opt1 from TRIM38__Homo_sapiens__XP_005248857
auggccagcaccaccuccacgaagaagaugauggaggaggcgaccugcagcaucugccugucccucaugaccaaccccgugagcaucaacugcggccacuccuacugccaccugugcaucaccgacuucuucaagaaccccagccagaagcagcugcgccaggagacguucugcugcccccagugccgggcccccuuccacauggacucccuccgccccaacaagcagcuggggagccugaucgaggcccucaaggagaccgaccaggagauguccugcgaggagcacggcgagcaguuccaccuguucugcgaggacgaggggcagcugaucugcuggcggugcgagcgcgccccgcagcacaagggccacaccaccgcccucgucgaggacgugugccagggguacaaggagaagcugcagaaggccgugacgaagcugaagcagcucgaggaccggugcaccgagcagaagcugagcaccgcgaugcgcaucaccaaguggaaggagaagguccagauccagcggcagaagauccgcuccgacuucaagaaccugcagugcuuccuccacgaggaggagaaguccuaccuguggcggcuggagaaggaggagcagcagacgcucucccgccugcgggacuacgaggccggccugggccucaagagcaacgagcugaagucccacauccuggagcucgaggagaagugccaggggagcgcccagaagcugcugcagaacgugaacgacacccucucccgcagcugggccgugaagcuggagaccuccgaggcggucagccuggagcuccacaccaugugcaacgugagcaagcuguacuucgacgugaagaagaugcugcggucccaccaggucagcgugacgcucgaccccgacaccgcccaccacgagcugauccuguccgaggaccgccgccaggugacccggggcuacacccaggagaaccaggacacgagcucccggcgcuucaccgccuuccccugcguccucgggugcgagggcuucaccagcgggcggcgcuacuucgagguggacgugggcgagggcaccgggugggaccugggcgucugcauggagaacgugcagcgggggacgggcaugaagcaggagccccaguccggcuucuggacccugcgccucugcaagaagaagggguacguggcccugaccagcccgcccaccucccugcaccuccacgagcagccccugcuggucggcaucuuccucgacuacgaggccgggguggugagcuucuacaacggcaacacggggugccacaucuucaccuuccccaaggcguccuucagcgacacccugcgcccguacuuccaggucuaccaguacagcccccuguuccucccgccgcccggcgacuga

SEQ ID NO: 38102 - RNA, 1557 nt, Artificial Sequence
  derived and/or modified sequence opt1 from TRIM39__Homo_sapiens__NP_067076
auggccgagaccagccugcucgaggccggcgccuccgccgccagcaccgccgccgcgcuggagaaccuccagguggaggccuccugcagcgucugccuggaguaccugaaggagcccgugaucaucgagugcgggcacaacuucugcaaggccugcaucacgcgcuggugggaggaccuggagcgcgacuucccgugccccgugugccgcaagaccucccgguaccgcagccuccggcccaaccgccagcugggcuccauggucgagaucgccaagcagcugcaggcggugaagcggaagauccgcgacgagagccucugcccccagcaccacgaggcccugucccuguucugcuacgaggaccaggaggccgugugccucaucugcgccaucagccacacccaccgggcccacaccgucgugccgcuggacgacgcgacgcaggaguacaaggagaagcugcagaagugccucgagccccuggagcagaagcugcaggagaucacccgcugcaaguccagcgaggagaagaagcccggggagcucaagcggcugguggagucccgccggcagcagauccugcgcgaguucgaggagcuccaccggcgccuggacgaggagcagcagguccugcucagccggcuggaggaggaggagcaggacauccugcagcgccuccgggagaacgccgcccaccugggcgacaagcgccgggaccuggcccaccucgccgcggagguggaggggaagugccugcaguccggcuucgagaugcugaaggacgucaagagcacccucgagaagaacaucccccgcaaguucggcgggucccugagcaccaucugcccgcgcgaccacaaggcccugcucggccuggugaaggagaucaaccggugcgagaaggugaagacgauggaggugaccuccgucagcaucgagcuggagaagaacuucagcaacuucccccgccaguacuucgcccuccggaagauccugaagcagcugaucgccgacgugacccucgaccccgagaccgcccaccccaaccuggugcuguccgaggaccgcaagagcgucaaguucguggagacgcggcuccgcgaccugccggacaccccgcggcgcuucaccuucuaccccugcgugcuggcgaccgagggguucacguccggccggcacuacugggaggucgaggugggggacaagacccacugggccgugggcgucugccgcgacagcgugucccggaagggcgagcucacgccccugccggagaccggguacuggcgcguccggcuguggaacggcgacaaguacgccgccaccaccacccccuucacgccccugcacaucaaggugaagcccaagcgcguggggaucuuccucgacuacgaggccggcacccugagcuucuacaacgucaccgaccggucccacaucuacaccuucaccgacacguucaccgagaagcuguggccccucuucuaccccggcauccgcgcggggcggaagaacgccgcgccccugaccauccggcccccgaccgacugggaguga

SEQ ID NO: 38103 - RNA, 2235 nt, Artificial Sequence
  derived and/or modified sequence opt1 from TRIM3__Homo_sapiens__XP_011518146
auggccaagcgcgaggacagccccggcccggaggugcagcccauggacaagcaguuccuggucugcuccaucugccucgaccgguaccagugccccaaggugcugcccugccugcacaccuucugcgagcgcugccuccagaacuacaucccggcccagagccugacccuguccugccccgugugccggcagacgagcauccuccccgagcagggggucuccgcgcugcagaacaacuucuucaucagcucccugauggaggccaugcagcaggcccccgacggcgcccacgacccggaggacccccacccccucagcgugguggccgggcgcccccuguccugcccgaaccacgagggcaagaccauggaguucuacugcgaggcgugcgagaccgccaugugcggggagugccgggccggcgagcaccgcgagcacggcaccguccugcuccgggacgugguggagcagcacaaggccgcgcugcagcgccagcuggaggccguccgggggcgccucccccagcugagcgccgccaucgcccuggugggcgggaucucccagcagcuccaggagcggaaggcggaggcccuggcccagaucagcgccgccuucgaggaccuggagcaggcgcuccagcagcgcaagcaggcccugguguccgaccuggagacgaucugcggcgccaagcagaagguccuccagagccagcuggacacccugcggcaggggcaggagcacaucggcuccagcugcuccuucgccgagcaggcccuccgccugggcagcgcgcccgaggugcugcucgugcggaagcacaugcgcgagcggcuggccgcccuggccgcccaggcguuccccgagcgcccgcacgagaacgcccagcucgagcugguccuggagguggacgggcuccggcgcuccgugcugaaccugggcgcccuccugaccaccagcgccacggcgcacgagaccgucgccaccggggagggccugcggcaggcccucgugggccagcccgccagccugaccgugacgaccaaggacaaggacgggcgccugguccgcaccggcuccgccgagcuccgggcggagaucaccgggcccgacggcacgcgccugcccgugccgguggucgaccacaagaacgggaccuacgagcugguguacaccgcccggaccgagggcgagcuccugcugagcguccugcucuacggccagcccgugcgcgggucccccuuccgggugcgcgcccugcggcccggcgaccugccgcccagccccgacgacgucaagcgccgggugaagucccccgggggcccggggagccacgugcgccagaaggccguccggcgccccuccagcauguacuccacgggcggcaagcggaaggacaaccccaucgaggacgagcucguguuccgcguggggagccggggccgcgagaagggggaguucaccaaccugcagggcgucuccgccgcgagcuccgggcggaucgugguggccgacagcaacaaccagugcauccaggucuucuccaacgagggccaguucaaguuccgcuucggcgugcgggggcgcagcccgggccagcugcagcgccccaccgggguggccgucgacaccaacggcgacaucaucguggccgacuacgacaaccgguggguguccaucuucagccccgagggcaaguucaagacgaagaucggggccggccgccucauggggcccaagggcgucgcgguggaccggaacgggcacaucaucguggucgacaacaaguccugcugcguguucaccuuccagccgaacggcaagcuggugggccgcuucgggggccgcggggccaccgaccggcacuucgccggcccccacuucgucgccgugaacaacaagaacgagaucguggucaccgacuuccacaaccacagcgugaagguguacagcgcggacggggaguuccuguucaaguucggcucccacggcgaggggaacggccaguucaacgcccccacgggggucgccguggacagcaacggcaacaucaucguggccgacugggggaacucccggauccaggucuucgacagcuccggcagcuuccucuccuacaucaacaccagcgccgagccccuguacggcccgcaggggcuggcgcucaccuccgacggccacgugguggucgccgacgccgggaaccacugcuucaaggccuaccgcuaccugcaguga

SEQ ID NO: 38104 - RNA, 777 nt, Artificial Sequence
  derived and/or modified sequence opt1 from TRIM40__Homo_sapiens__NP_001273562
augaucccccugcagaaggacaaccaggaggagggcgugugccccaucugccaggagagccucaaggaggccgucuccaccaacugcgggcaccuguucugccgcgugugccugacccagcacguggagaaggccagcgcguccggcgucuucugcugcccccucugccggaagcccugcagcgaggaggugcuggggacgggcuacaucugccccaaccaccagaagcgcgugugccgguucugcgaggagucccgccugcuccugugcgucgagugccuggugagcccggagcacaugucccaccacgagcucaccaucgagaacgcccugagccacuacaaggagcggcugaaccgccggucccgcaagcuccggaaggacaucgccgagcugcagcgccugaaggcccagcaggagaagaagcuccaggcccugcaguuccagguggaccacgggaaccaccggcuggaggcgggccccgagagccagcaccagacccgcgagcagcucggcgcccugccccagcaguggcuggggcagcucgagcacaugcccgccgaggccgcgcggauccuggacaucucccgcgccgucacccagcugcggagccucgugaucgaccuggagcgcacggccaaggagcuggacaccaacacccucaagaacgccggcgaccugcugaaccgguccgccccgcagaagcucgaggugaucuacccccagcuggagaagggggucagcgagcugcuccugcagccgccccagaagcuguga

SEQ ID NO: 38105 - RNA, 2172 nt, Artificial Sequence
  derived and/or modified sequence opt1 from TRIM42__Homo_sapiens__NP_689829
auggagaccgccaugugcgugugcugccccugcugcaccuggcagcgcugcugcccgcagcugugcagcugccucugcugcaaguucaucuucacguccgagcggaacugcacgugcuuccccugccccuacaaggacgagcgcaacugccaguucugccacugcacgugcagcgagucccccaacugccacuggugcugcugcagcugggccaacgacccgaacugcaagugcugcugcaccgcguccagcaaccugaacugcuacuacuacgagucccggugcugccgcaacaccaucaucaccuuccacaagggccggcugcgcagcauccacaccuccagcaagaccgcccuccggaccggguccagcgacacccaggucgacgaggugaaguccauccccgccaacagccaccuggugaaccaccugaacugccccaugugcucccgccuccggcugcacagcuucaugcugcccugcaaccacucccucugcgagaagugccugcgccagcugcagaagcacgccgaggucaccgagaacuucuucauccucaucugcccggugugcgaccggagccacugcaugcccuacuccaacaagaugcagcugcccgagaacuaccugcacggccgccucaccaagcgguacaugcaggagcacggguaccugaaguggcgcuucgaccggagcagcggccccauccugugccaggugugccgcaacaagcggaucgccuacaagcgcugcaucacgugccggcucaaccugugcaacgacugccugaaggcguuccacuccgacgucgccaugcaggaccacguguucguggacaccagcgccgaggagcaggacgagaagaucugcauccaccacccguccagccgcaucaucgaguacugccggaacgacaacaagcuccugugcaccuucugcaaguucuccuuccacaacgggcacgacaccaucagccugaucgacgccugcuccgagcgcgcggccagccucuucuccgccaucgccaaguucaaggccguccgcuacgagaucgacaacgaccugauggaguucaacauccugaagaacagcuucaaggcggacaaggaggccaagcggaaggagauccgcaacggcuuccucaagcugcgguccauccugcaggagaaggagaagaucaucauggagcagaucgagaaccucgaggugagccgccagaaggagaucgagaaguacguguacgucacgaccaugaaggugaacgagauggacggccugaucgccuacuccaaggaggcccugaaggagaccggccagguggccuuccuccagagcgcgaagauccuggucgaccagaucgaggacgggauccagaccacguaccggcccgacccccagcugcgccuccacuccaucaacuacgugccccuggacuucguggagcugagcuccgccauccacgagcuguucccgaccgggcccaagaagguccggagcuccggcgacagccuccccagccccuacccggugcacuccgagaccaugaucgcccgcaaggugaccuucagcacgcacucccuggggaaccagcacaucuaccagcggagcuccagcaugcucuccuucagcaacaccgacaagaaggccaaggucggccuggaggccugcggccgcgcgcaguccgccacccccgccaagcccaccgacgggcuguacacguacuggagcgccggcgccgacucccagagcgugcagaacuccagcuccuuccacaacugguacagcuucaacgacggguccgugaagacccccggcccgaucgucaucuaccagacccucguguacccccgggcggccaaggucuacuggaccugccccgccgaggacguggacagcuucgagauggaguucuacgaggugaucacgagcccgcccaacaacguccagauggagcugugcggccagauccgcgacaucaugcagcagaaccuggagcuccacaaccugacccccaacaccgaguacguguucaaggugcgggccaucaacgacaacgggcccggccagugguccgacaucugcaaggucgugaccccggacgggcacggcaagaaccgcgcgaagugggggcugcugaagaacauccagagcgcccuccagaagcacuucuga

SEQ ID NO: 38106 - RNA, 1035 nt, Artificial Sequence
  derived and/or modified sequence opt1 from TRIM44__Homo_sapiens__NP_060053
auggccagcggcgugggggccgcguucgaggagcugccccacgacgggaccugcgacgagugcgagccggacgaggcccccggcgccgaggaggucugccgcgagugcggcuucugcuacugccggcgccacgccgaggcccaccggcagaaguuccucucccaccaccuggcggaguacgugcacgggagccaggccuggaccccgcccgccgacggcgagggcgccgggaaggaggaggcggaggugaaggucgagcaggagcgcgagaucgaguccgaggccggcgaggagagcgaguccgaggaggagagcgaguccgaggaggagagcgagacggaggaggaguccgaggacgagagcgacgaggaguccgaggaggacagcgaggaggagauggaggacgagcaggaguccgaggccgaggaggacaaccaggaggagggggagagcgaggccgagggcgagaccgaggccgaguccgaguucgaccccgagaucgagauggaggcggagcggguggccaagcgcaagugccccgaccacgggcuggaccucagcaccuacugccaggaggaccggcagcugaucugcgugcugugccccgucaucggcgcccaccagggccaccagcucuccacccuggacgaggccuucgaggagcugcgcagcaaggacuccgggggccucaaggccgcgaugaucgagcugguggagcggcugaaguucaagagcagcgaccccaaggugacgcgcgaccagaugaagauguucauccagcaggaguucaagaagguccagaaggugaucgccgacgaggagcagaaggcccuccaccugguggacauccaggaggccauggccaccgcgcacgucaccgagauccuggccgacauccagucccacauggaccggcucaugacccagauggcccaggccaaggagcagcuggacacgagcaacgaguccgccgagccgaaggcggagggggacgaggagggccccagcggcgccuccgaggaggaggacaccuga

SEQ ID NO: 38107 - RNA, 1464 nt, Artificial Sequence
  derived and/or modified sequence opt1 from TRIM50__Homo_sapiens__NP_835226
auggccuggcaggucagccugcccgagcucgaggaccgccugcagugcccgaucugccuggagguguucaaggagccccucaugcugcagugcggccacuccuacugcaaggggugccuggugagccucuccugccaccuggacgccgagcugcggugccccgugugccgccaggcggucgacggcagcuccagccuccccaacgugucccuggcccgggugaucgaggcccugcgccucccgggggaccccgagcccaaggucugcgugcaccaccggaacccccugagccuguucugcgagaaggaccaggagcucaucugcggccugugcgggcugcucggcucccaccagcaccacccggugacccccgucagcaccguguacucccgcaugaaggaggagcuggccgcccugaucagcgagcucaagcaggagcagaagaagguggacgagcugaucgcgaagcuggucaacaaccggacccgcaucgugaacgaguccgacguguucagcugggucauccggcgcgaguuccaggagcuccaccaccugguggacgaggagaaggcccggugccuggagggcaucgggggccacacccgcgggcucguggccucccuggacaugcagcuggagcaggcccagggcacccgggagcgccucgcgcaggccgagugcguccuggagcaguucgggaacgaggaccaccacaaguucauccggaaguuccacagcauggccucccgcgccgagaugccccaggcccggccccuggagggcgcguucagcccgaucuccuucaagcccggccuccaccaggccgacaucaagcugaccguguggaagcgccuguuccggaaggugcuccccgcccccgagccgcugaagcuggaccccgccacggcccacccccuccuggagcugagcaaggggaacaccgucgugcagugcggccuccuggcgcagcgccgggccagccagcccgagcgcuucgacuacuccacgugcgugcuggccagccgcggguucuccugcggccggcacuacugggaggucguggucggcagcaaguccgacuggcgccucggggugaucaagggcaccgccagccggaaggggaagcugaaccgcuccccggagcacggcguguggcugaucgggcucaaggagggccgggucuacgaggccuucgcgugcccccgcgugccccugcccguggccggccacccgcaccggaucgggcuguaccugcacuacgagcagggcgagcucaccuucuucgacgccgaccgccccgacgaccugcggccccuguacaccuuccaggccgacuuccaggggaagcucuaccccauccuggacacgugcuggcacgagcgcggcagcaacucccugccgaugguccucccgccgcccagcgggcccggcccccugucccccgagcagcccaccaagcuguga

SEQ ID NO: 38108 - RNA, 2268 nt, Artificial Sequence
  derived and/or modified sequence opt1 from TRIM56__Homo_sapiens__NP_112223
auggugagccacggcuccagccccucccugcucgaggcccugagcuccgacuuccuggccugcaagaucugccucgagcagcugcgcgcgccgaagacccugcccugccuccacaccuacugccaggacugccuggcccagcuggccgacgggggccggguccgcugccccgagugccgggagacggugcccgugccgcccgagggggucgccagcuucaagaccaacuucuucgugaacggccuccuggaccuggugaaggcccgcgcgugcggggaccuccgggccggcaagcccgccugcgcccugugcccccuggucggcgggaccuccaccggcgggccggcgacggcccgcugccucgacugcgccgacgaccugugccaggccugcgccgacggccaccggugcacccgccagacccacacccaccgggugguggaccuggucggguaccgcgcgggcugguacgacgaggaggcccgggagcgccaggccgcccagugcccccagcaccccggcgaggcccuccgguuccugugccagcccugcagccagcugcucugccgcgagugccggcuggacccgcaccuggaccaccccugccucccccuggcggaggccgugcgcgcccggcgccccgggcuggagggccuccuggccgggguggacaacaaccuggucgagcucgaggccgcgcggcgcguggagaaggaggcccuggcccggcugcgcgagcaggccgcccgcgugggcacgcaggucgaggaggcggccgagggcgugcuccgggcccugcuggcccagaagcaggaggugcucgggcagcugcgcgcgcacgucgaggccgccgaggaggccgcccgggagcgccuggcggagcucgagggccgggagcaggucgcccgcgccgccgccgcguucgcccggcgcgugcugucccuggggcgggaggccgagauccucagccuggagggcgccaucgcccagcgccugcggcagcuccaggggugcccgugggcgcccggccccgcccccugccugcugccgcagcucgagcugcaccccggccugcuggacaagaacugccaccuccugcgccuguccuucgaggagcagcagccccagaaggacgggggcaaggacggggccggcacccagggcggggaggagagccagucccggcgcgaggacgagcccaagaccgagcggcagggcggggugcagccgcaggccggcgacggggcgcagacccccaaggaggagaaggcccagacgacccgcgaggagggcgcccagacccucgaggaggaccgggcccagacgccccacgaggacgggggcccccagccgcaccgcggcgggcggcccaacaagaagaagaaguucaagggccgccugaaguccaucucccgcgagcccagcccggcccuggggcccaaccucgacggcuccggccugcugccccggcccaucuucuacugcagcuucccgacccgcaugcccggggacaagcggagcccccgcaucaccggccucugccccuucgggccgcgggagauccugguggcggacgagcagaaccgcgcccugaagcgguucagccucaacggcgacuacaaggggaccgugcccguccccgagggcugcagccccugcuccguggccgcccugcagagcgccgucgcguucuccgccagcgcccgccuguaccucaucaacccgaacggcgaggugcaguggcggcgcgcccugucccugagccaggccucccacgcgguggccgcccuccccagcggggaccgggucgccguguccguggcgggccacgucgagguguacaacauggaggggagccuggccacccgcuucauccccggcgggaaggccucccggggccugcgcgcccucguguuccugacgaccagcccccagggccacuucgucggguccgacuggcagcagaacagcguggugaucugcgacggccuggggcaggucgugggcgaguacaaggggccgggccuccacggcugccagcccggguccgugagcgucgacaagaagggcuacaucuuccugacccugcgggaggugaacaagguggucauccucgaccccaaggggucccugcugggcgacuuccucaccgccuaccacgggcuggagaagccccgcgugacgaccaugguggacggccgguaccuggucgugagccucuccaacggcaccauccacaucuuccgcgugcggagcccggacagcuga

SEQ ID NO: 38109 - RNA, 1461 nt, Artificial Sequence
  derived and/or modified sequence opt1 from TRIM58__Homo_sapiens__NP_056246
auggccugggcgcccccgggcgagcgccugcgggaggacgcccgcugccccgugugccucgacuuccugcaggagcccgucagcguggacugcgggcacuccuucugccugcggugcaucagcgaguucugcgagaaguccgacggcgcccagggcgggguguacgccugcccccagugccgcgggccguuccggcccagcggcuuccgccccaaccggcagcucgccggccuggucgaguccgugcgccggcuggggcucggcgccgggcccggcgcgcgccggugcgcccgccacggggaggaccugagccgguucugcgaggaggacgaggccgcccugugcugggugugcgacgcgggcccggagcaccgcacccaccggaccgcgccccuccaggaggccgccggcuccuaccaggucaagcugcagauggcccuggagcucaugcgcaaggagcuggaggacgcccugacccaggaggccaacguggggaagaagaccgugaucuggaaggagaaggucgagaugcagcggcagcgcuuccggcucgaguucgagaagcaccgcggcuuccuggcccaggaggagcagcggcagcugcgccgccucgaggccgaggagcgggccacccugcagcgccugcgggagagcaagucccgccucgugcagcagagcaaggcgcugaaggagcuggccgacgagcuccaggagcggugccagcgccccgcccuggggcugcucgagggcgugcggggcguccugucccgcagcaaggccgugacccggcuggaggccgagaacauccccauggagcucaagacggcgugcugcaucccggggcgccgggagcugcugcgcaaguuccagguggacgucaagcucgaccccgccaccgcccaccccucccugcugcucaccgccgaccugcggagcgugcaggacggcgagcccuggcgcgacgugccgaacaaccccgagcgguucgacaccuggcccugcauccuggggcuccaguccuucagcuccggccgccacuacugggagguccuggugggggagggcgccgaguggggccugggggugugccaggacacgcucccccggaagggcgagaccaccccgagccccgagaacggggucugggcgcuguggcugcucaagggcaacgaguacauggugcuggccucccccagcgugccccugcuccagcuggagagcccgcgcugcaucgggaucuuccuggacuacgaggccggcgagaucuccuucuacaacgucaccgacggcagcuacaucuacacguucaaccagcuguucuccgggcuccugcggcccuacuucuucaucugcgacgccacgccccugauccugcccccgaccaccaucgcgggcagcgggaacugggccucccgcgaccaccucgaccccgccagcgacgugcgcgacgaccaccuguga

SEQ ID NO: 38110 - RNA, 1212 nt, Artificial Sequence
  derived and/or modified sequence opt1 from TRIM59__Homo_sapiens__NP_775107
augcacaacuucgaggaggagcugaccugccccaucugcuacagcaucuucgaggacccgcgcgugcuccccugcucccacaccuucugccggaacugccuggagaacauccugcaggccagcggcaacuucuacaucuggcgcccccuccggaucccccugaagugcccgaacugccgcuccaucacggagaucgcccccaccgggaucgagagccugcccgucaacuucgcgcuccgggccaucaucgagaaguaccagcaggaggaccaccccgacaucgugaccugcccggagcacuaccgccagccccugaacguguacugccugcucgacaagaagcuggucugcggccacugccugaccaucgggcagcaccacggccaccccaucgacgaccuccaguccgccuaccugaaggagaaggacacgccccagaagcugcucgagcagcugaccgacacccacuggaccgaccugacgcaccucaucgagaagcugaaggagcagaagucccacagcgagaagaugauccagggggacaaggaggccgugcugcaguacuucaaggagcucaacgacacccuggagcagaagaagaaguccuuccugaccgcccucugcgacgugggcaaccugaucaaccaggaguacaccccgcagaucgagcggaugaaggagauccgcgagcagcagcuggagcucauggcgcugacgaucagccugcaggaggagagcccccucaaguuccuggagaaggucgacgacgugcggcagcacgugcagauccugaagcagcgcccccuccccgagguccagccgguggagaucuacccccggguguccaagauccugaaggaggaguggagccgcaccgagaucggccagaucaagaacguccugauccccaagaugaagaucucccccaagcggaugagcugcuccuggccggggaaggacgagaaggagguggaguuccucaagauccugaacaucguggucgugacccugaucagcgugauccucauguccauccuguucuucaaccagcacaucaucaccuuccugagcgagaucacgcucaucugguucuccgaggccagccugagcgucuaccagucccugagcaacucccuccacaaggugaagaacauccugugccacaucuucuaccugcucaaggaguucguguggaagaucgucagccacuga

SEQ ID NO: 38111 - RNA, 1482 nt, Artificial Sequence
  derived and/or modified sequence opt1 from TRIM5__Homo_sapiens__NP_149023
auggccagcggcauccuggugaacgucaaggaggaggugaccugccccaucugccucgagcugcugacccagccgcucucccuggacugcgggcacagcuucugccaggccugccugacggcgaaccacaagaaguccaugcucgacaagggcgagagcuccugccccgugugccgcaucagcuaccagcccgagaacauccggcccaaccgccacgucgccaacaucguggagaagcugcgggaggugaagcuguccccggaggggcagaaggucgaccacugcgcccgccacggcgagaagcuccugcuguucugccaggaggacgggaaggugaucugcuggcucugcgagcggagccaggagcaccgcggccaccacaccuuccugaccgaggagguggcccgggaguaccaggucaagcugcaggccgcgcucgagaugcugcgccagaagcagcaggaggccgaggagcuggaggccgacauccgggaggagaaggccuccuggaagacccagauccaguacgacaagacgaacgugcucgcggacuucgagcagcugcgcgacauccuggacugggaggagagcaacgagcuccagaaccuggagaaggaggaggaggacauccugaagucccucaccaacagcgagaccgagauggugcagcagacccagucccugcgggagcugaucagcgaccucgagcaccgccugcagggcuccgucauggagcugcuccaggggguggacggcgugaucaagcggacggagaacgucacccugaagaagcccgagaccuuccccaagaaccagcgccggguguuccgcgcccccgaccugaaggggaugcucgagguguuccgggagcugaccgacguccgccgguacuggguggacgugacggucgccccgaacaacaucagcugcgccgugaucuccgaggacaagcgccaggugagcucccccaagccccagaucaucuacggcgcccgggggacccgcuaccagaccuucgucaacuucaacuacugcaccggcauccugggcagccagagcaucacguccgggaagcacuacugggagguggacgucagcaagaagaccgcguggauccucggcgugugcgccggguuccagcccgacgccaugugcaacaucgagaagaacgagaacuaccagccgaaguacggcuacugggugaucggccuggaggagggggucaagugcuccgccuuccaggacagcuccuuccacacccccagcgugcccuucaucgugccccuguccgucaucaucugcccggaccgcgugggcguguuccucgacuacgaggccugcaccgucagcuucuucaacaucacgaaccacggguuccugaucuacaaguucucccacugcagcuucucccagcccguguuccccuaccugaacccccggaagugcggcgugccgaugacccucugcagccccuccagcuga

SEQ ID NO: 38112 - RNA, 1065 nt, Artificial Sequence
  derived and/or modified sequence opt1 from TRIM62__Homo_sapiens__XP_011540007
augcccgagaagaccgccguggaccagccguggacccaggcccugcgcgagcucaaggaccagcugcaggcgcugcaggacagcgagcgggagcacacggaggcccuccagcugcugaagcgccagcucgccgagaccaaguccagcaccaagucccugcggaccacgaucggcgaggccuucgagcgccugcaccggcuccugcgcgagcggcagaaggccaugcuggaggagcucgaggcggacaccgcccgcacccugaccgacaucgagcagaagguccagcgguacagccagcagcugcgcaaggugcaggagggggcccagauccuccaggagcggcuggccgagacggaccgccacaccuuccuggcgggcguggccucccucagcgagcggcugaaggggaagauccacgagaccaaccugaccuacgaggacuuccccacguccaaguacaccggcccccuccaguacaccaucuggaagucccuguuccaggacauccaccccgucccggccgcccugacccucgaccccgggacggcccaccagcgccugauccugagcgacgacugcaccaucguggcguacggcaaccuccacccccagccccugcaggacagcccgaagcgguucgacguggaggucuccgugcugggcagcgaggccuucuccagcggggugcacuacugggaggucgugguggccgagaagacccagugggucaucggccucgcccacgaggccgcgucccgcaaggggagcauccagauccagcccucccggggcuucuacugcaucgugaugcacgacgggaaccaguacagcgccugcaccgagcccuggacgcgccugaacgugcgggacaagcuggacaaggucggcguguuccucgacuacgaccagggccugcugaucuucuacaacgccgacgacauguccuggcucuacaccuuccgcgagaaguuccccgggaagcugugcagcuacuucagcccgggccagucccacgccaacgggaagaacgugcagccccugcggaucaacaccguccgcaucuga

SEQ ID NO: 38113 - RNA, 3651 nt, Artificial Sequence
  derived and/or modified sequence opt1 from TRIM66__Homo_sapiens__NP_055633
auggcccgcaacugcuccgagugcaaggagaagcgggccgcccacauccugugcaccuacugcaaccgcuggcugugcuccuccugcaccgaggagcaccggcacucccccgugcccggcgggcccuucuucccccgcgcccagaagggcagccccggggucaacggcgggcccggcgacuucacccuguacugcccccugcacacccaggaggugcucaagcuguucugcgagaccugcgacaugcugaccugccacuccugccucguggucgagcacaaggagcaccggugccgccacguggaggaggugcugcagaaccagcggaugcugcucgagggcgucacgacccagguggcccacaagaaguccucccugcagaccagcgccaagcagaucgaggaccgcaucuucgaggugaagcaccagcaccggaaggucgagaaccagaucaagauggccaagauggugcugaugaacgagcucaacaagcaggccaacgggcugaucgaggagcuggagggcaucaccaacgagcgcaagcggaagcucgagcagcagcugcaguccaucauggugcugaaccgccaguucgagcacguccagaacuucaucaacugggccgugugcagcaagacguccgugcccuuccucuucagcaaggagcugaucgucuuccagaugcagcggcugcucgagaccuccugcaacaccgaccccgggagccccugguccauccgcuucaccugggagcccaacuucuggacgaagcagcuggccagccugggcugcaucaccaccgagggcgggcagaugucccgggccgacgcgcccgccuacggcgggcuccagggcagcucccccuucuaccagagccaccagagccccguggcccagcaggaggcccugucccaccccagccacaaguuccagucccccgccgugugcagcuccagcgucugcugcucccacugcagccccgugucccccagccugaaggggcaggucccgccgcccuccauccaccccgcgcacagcuuccgccagccgcccgagauggucccccagcagcucggcucccugcagugcagcgcccugcucccgcgggagaaggagcuggccugcagcccccacccgcccaagcugcuccagcccuggcuggagacccagccgcccguggagcaggagagcacgucccagcgccugggccagcagcucaccagccagcccgugugcaucgugccgccccaggacgugcagcagggggcccacgcccagcccacccugcagacccccuccauccagguccaguucggccaccaccagaagcugaagcucagccacuuccagcagcagccccagcagcagcugccgcccccgcccccgccccucccccacccgccgccgccccugcccccgccgccccagcagccccacccgccccugccgcccagccagcaccuggcguccagccagcacgagagcccgcccgggcccgccugcagccagaacauggacaucaugcaccacaaguucgagcucgaggagaugcagaaggaccuggagcugcuccugcaggcccagcagcccucccugcagcugagccagaccaagagcccccagcaccuccagcagacgaucgugggccagaucaacuacaucgugcggcagcccgcccccguccagagccagucccaggaggagacccugcaggccaccgacgagccgcccgcgagccagggguccaagcccgcccugccccucgacaagaacacggccgccgcccugccccaggcgagcggcgaggagacgccccuguccgugccgcccguggacagcaccauccagcacuccagccccaacgucgugcgcaagcacuccaccagccucagcaucaugggcuucuccaacacgcuggagauggagcugagcuccacccggcucgagcgcccccuggagccccagauccagagcguguccaaccugaccgccggggcgccccaggccguccccagccuccuguccgcgccgcccaagauggugagcucccugaccagcgugcagaaccaggccaugcccucccucacgaccagccaccuccagaccguccccucccuggugcacagcaccuuccaguccaugcccaaccucaucagcgacagcccccaggccauggccucccuggccuccgaccacccccaggcgggccccagccugaugagcgggcacacgcaggccgugcccucccucgcgaccugcccccugcagagcaucccgcccgucuccgacaugcagcccgagaccggcagcuccagcuccagcgggcgcaccuccggcagccugugcccccgggacggcgccgaccccucccucgagaacgcccugugcaaggugaagcuggaggagcccaucaaccucagcgugaagaagccgccccuggcgcccgucguguccaccagcacggcccugcagcaguaccagaaccccaaggagugcgagaacuucgagcagggggcccucgagcuggacgccaaggagaaccaguccauccgcgccuucaacagcgagcacaagaucccguacgugcggcuggagcgccucaagaucugcgcggccuccagcggcgagaugcccgucuucaagcugaagccccagaagaacgaccaggacggguccuuccugcucaucaucgagugcggcaccgagagcagcuccaugagcaucaaggugucccaggaccggcugagcgaggccacccaggcccccgggcuggagggccgcaaggugaccgucacgucccucgcgggccagcggccgcccgagguggaggggaccagccccgaggagcaccgccugaucccccggaccccgggcgccaagaaggggccgcccgcccccaucgagaacgaggacuucugcgccgugugccugaacggcggcgagcuccugugcugcgaccgcugcccgaaggucuuccaccuguccugccacgugcccgcccuccugagcuuccccgggggcgagugggugugcacccugugccggucccucacgcagcccgagauggaguacgacugcgagaacgcgugcuacaaccagccggggaugcgcgccagccccggccuguccauguacgaccagaagaagugcgagaagcugguccucagccugugcugcaacaaccugucccuccccuuccacgagcccgugagcccgcuggcccggcacuacuaccagaucaucaagcgccccauggaccuguccaucauccggcgcaagcuccagaagaaggaccccgcccacuacaccaccccggaggagguggucagcgacgugcggcugauguucuggaacugcgccaaguucaacuaccccgacuccgagguggcggaggccgggcgcugccuggaggucuucuucgagggcuggcucaaggagaucuaccccgagaagcgguucgcccagccccgccaggaggacagcgacuccgaggaggugagcagcgaguccggcugcagcaccccgcagggguuccccuggccgcccuacaugcaggagggcauccagccgaagcgccggcgccggcacauggagaacgagcgcgccaagcggauguccuuccgccuggccaacagcaucucccagguguga

SEQ ID NO: 38114 - RNA, 789 nt, Artificial Sequence
  derived and/or modified sequence opt1 from TRIM68__Homo_sapiens__NP_001291425
augcagaagcuggagcucaaccacagcgagcugauccagcagucccaggugcuguggcgcaugaucgccgagcucaaggagcggagccagcgccccguccgguggaugcugcaggacauccaggaggugcugaaccgcuccaagagcuggucccuccagcagccggagcccaucagccuggagcugaagaccgacugccgggugcucggccugcgcgagauccugaagaccuacgccgcggacguccggcucgaccccgacacggccuacucccgccugaucgugagcgaggaccggaagcgcgugcacuacggggacaccaaccagaagcugcccgacaacccggagcgguucuaccgcuacaacaucguccucggcucccagugcaucagcuccgggcggcacuacugggagguggaggugggcgaccgcagcgagugggggcugggcgucugcaagcagaacguggaccggaaggagguggucuaccugagcccccacuacggcuucugggugauccgccuccggaaggggaacgaguaccgcgccggcaccgacgaguaccccauccugucccugcccgugccgccccggcgcgucgggaucuucguggacuacgaggcccacgacaucuccuucuacaacgugaccgacugcggcagccacaucuucacguucccccgguaccccuucccggggcgccuccugcccuacuucucccccugcuacagcaucggcaccaacaacaccgcgccccuggccaucugcucccucgacggcgaggacuga

SEQ ID NO: 38115 - RNA, 891 nt, Artificial Sequence
  derived and/or modified sequence opt1 from TRIM69__Homo_sapiens__NP_001288073
auggaguuccugaagcuccaccaguuccugcacagcaaggagaaggacauccugaccgagcuccgcgaggagggcaaggcccugaacgaggagauggagcugaaccucucccagcugcaggagcagugccugcucgccaaggacaugcuggugagcauccaggcgaagaccgagcagcagaacuccuucgacuuccugaaggacaucacgacccuccugcacagccuggagcaggggaugaagguccucgccacccgggagcugaucucccgcaagcugaaccucggccaguacaaggggcccauccaguacaugguguggcgggagaugcaggacacccugugcccgggccugagcccccucacgcuggaccccaagaccgcccaccccaaccuggugcucuccaagagccagaccuccgucuggcacggggacaucaagaagaucaugccggacgaccccgagcgcuucgacagcuccguggccgugcugggcagccggggcuucaccuccgggaagugguacugggaggucgagguggccaagaagacgaaguggaccgugggcgucgugcgcgagagcaucauccggaagggguccugcccccugacccccgagcagggcuucuggcuccugcgccugcggaaccagaccgaccucaaggcgcuggaccugccgagcuucucccucacgcugaccaacaaccuggacaagguggggaucuaccucgacuacgagggcggccagcugagcuucuacaacgccaagaccaugacccacaucuacacguucuccaacaccuucauggagaagcuguaccccuacuucugccccugccucaacgacgggggcgagaacaaggagccccugcacauccugcacccgcaguga

SEQ ID NO: 38116 - RNA, 2529 nt, Artificial Sequence
  derived and/or modified sequence opt1 from TRIM6-TRIM34__Homo_sapiens__NP_001003819
augugcggcagcgagcgcauccugcaggccgggaacauccucgagauccgggugggccaggccggggcgcgccgggucgccaccaugaccucccccgugcugguggacauccgcgaggaggucacgugcccgaucugccuggagcuccugaccgagccccugagcaucgacugcggccacuccuucugccaggccugcaucacccccaacgggcgggagagcgugaucggccaggagggcgagcgcuccugccccgugugccagaccagcuaccagccggggaaccuccggcccaaccgccaccuggccaacaucguccggcgccugcgggagguggugcucggccccgggaagcagcugaaggccguccugugcgcggaccacggcgagaagcuccagcuguucugccaggaggacgggaaggugaucugcuggcugugcgagcgcucccaggagcaccggggccaccacacguuccucguggaggaggucgcccaggaguaccaggagaaguuccaggagagccugaagaagcugaagaacgaggagcaggaggccgagaagcucaccgccuucauccgcgagaagaagaccuccuggaagaaccagauggagcccgagcggugccgcauccagaccgaguucaaccagcugcggaacauccuggaccgcguggagcagcgggagcucaagaagcuggagcaggaggagaagaagggccugcgcaucaucgaggaggcggagaacgaccucgugcaccagacgcagagccugcgggagcugaucuccgaccucgagcgccgcugccaggggagcaccauggagcugcugcaggacgucuccgacgugaccgagcggagcgaguucuggacccuccgcaagccggaggcccugcccacgaagcugcgguccauguuccgcgcccccgaccucaagcggaugcugcgcgugugccgggagcugaccgacguccagagcuacugggccauccagggcucccucacccgccgggagcgccgggccagcggggugcgcacccggcgcucccagggcagcagcgcgauggccuccaagauccugcugaacgugcaggaggaggucacgugccccaucugccucgagcugcugaccgagccgcucagccuggacugcggccacucccugugccgggccugcaucaccgugagcaacaaggaggccgugaccuccaugggcggcaagagcuccugccccgucugcgggaucagcuacuccuucgagcaccuccaggccaaccagcaccuggcgaacaucguggagcgccugaaggaggucaagcucagccccgacaacgggaagaagcgggaccugugcgaccaccacggggagaagcugcuccuguucugcaaggaggaccgcaaggugaucugcuggcugugcgagcggucccaggagcaccgcggccaccacacggugcugaccgaggaggucuucaaggagugccaggagaagcuccaggccgugcugaagcgccugaagaaggaggaggaggaggccgagaagcucgaggccgacauccgggaggagaagaccagcuggaaguaccaggugcagaccgagcgccagcggauccagacggaguucgaccagcugcgcuccauccugaacaacgaggagcagcgggagcuccagcgccuggaggaggaggagaagaagacccuggacaaguucgccgaggcggaggacgagcucguccagcagaagcagcuggugcgggagcugaucagcgacguggagugccgcucccaguggagcaccauggagcuccugcaggacauguccggcaucaugaaguggagcgagaucuggcggcugaagaagcccaagauggucuccaagaagcucaagaccguguuccacgccccggaccugagccgcaugcugcagauguuccgggagcucacggccgugcgcugcuacugggucgacgugacccugaacagcgugaaccugaaccucaaccugguccuguccgaggaccagcgccaggugaucagcgugcccaucuggcccuuccagugcuacaacuacgggguccucggcucccaguacuucagcuccgggaagcacuacugggagguggacgugagcaagaagaccgccuggauccugggcgucuacugccggaccuacucccggcacaugaaguacguggugcgccggugcgccaaccgccagaaccuguacacgaaguaccggccccucuucggguacugggucaucggccugcagaacaagugcaaguacggcguguucgaggagagccuguccagcgacccggaggugcucacccuguccauggcggucccgcccugccgcguggggguguuccuggacuacgaggccggcaucgucagcuucuucaacgugaccucccacgggagccucaucuacaaguucuccaagugcugcuucagccagcccguguaccccuacuucaaccccuggaacugccccgcccccaugacccugugcccgcccuccagcuga

SEQ ID NO: 38117 - RNA, 2607 nt, Artificial Sequence
  derived and/or modified sequence opt1 from TRIM71__Homo_sapiens__NP_001034200
auggccagcuuccccgagaccgacuuccagaucugccugcucugcaaggagaugugcggcuccccggccccccugagcuccaacagcuccgcgagcuccagcuccagccagaccuccacgagcuccgggggcgggggcgggggccccggcgccgccgcccgccggcugcacgugcuccccugccugcacgccuucugccgcccgugccuggaggcgcaccggcuccccgccgccgggggcggggccgcgggcgagccccugaagcugcgcugccccgucugcgaccagaagguggugcucgccgaggccgccgggauggacgcccugccgagcuccgcguuccugcucagcaaccugcuggacgccgucguggccaccgccgacgagcccccccccaagaacggccgggccggcgcgccggccggggccggcgggcacuccaaccaccgccaccacgcccaccacgcccacccccgggcgagcgccuccgcccccccccucccgcaggccccccagccccccgccccgagccgcagcgcgcccggcggccccgccgccucccccagcgcccugcugcuccggcgcccgcacgggugcuccagcugcgacgagggcaacgcggccuccagccggugccuggacugccaggagcaccugugcgacaacugcgugcgcgcccaccagcggguccgccucaccaaggaccacuacaucgagcgggggccccccggccccggggccgccgcggccgcccagcagcugggccugggcccgcccuuccccgggccgcccuucuccauccucagcguguuccccgagcgccugggcuucugccagcaccacgacgacgaggugcugcaccucuacugcgacaccugcuccguccccaucugccgggagugcacgauggggcgccacggcgggcacagcuucaucuaccugcaggaggcccugcaggacucccgggcccucaccauccagcugcuggcggacgcccagcagggccgccaggccauccagcucagcaucgagcaggcccagaccguggccgagcagguggagaugaaggcgaaggucgugcaguccgaggugaaggccgucaccgcccggcacaagaaggcccuggaggagcgcgagugcgagcugcucuggaagguggagaagauccgccaggugaaggcgaagagccuguaccugcaggucgagaagcuccggcagaaccugaacaagcuggaguccacgaucagcgccgugcagcaggugcucgaggagggccgcgcccuggacauccugcucgcccgggaccgcaugcuggcccagguccaggagcugaagaccgugcggucccuccugcagccgcaggaggacgaccgcgugauguucaccccccccgaccaggcgcuguaccuggccaucaagagcuucggguucgucuccagcggcgccuucgccccccucaccaaggccacgggggacggccugaagcgggcgcugcaggggaagguggccagcuucaccgucaucggcuacgaccacgacggcgagccgcgccucuccgggggcgaccugaugagcgccguggugcuggggcccgacggcaaccucuucggcgccgaggucuccgaccagcagaacgggaccuacguggugagcuaccggccccagcuggagggcgagcaccuggucuccgugacccucugcaaccagcacaucgagaacagccccuucaagguggucgugaaguccgggcgcagcuacgugggcaucgggcugccgggccuguccuucggcagcgagggggacuccgacggcaagcucugccggcccuggggggucagcguggacaaggagggcuacaucaucguggccgaccgcuccaacaaccggauccaggucuucaagcccugcggggcguuccaccacaaguucggcacgcugggcagccgccccgggcaguucgaccggccggccggcguggccugcgacgccucccgccggaucguggucgcggacaaggacaaccaccgcauccagaucuucaccuucgaggggcaguuccugcucaaguucggcgagaaggggaccaagaacggccaguucaacuaccccugggacguggccgugaacagcgagggcaagauccuggucuccgacacccggaaccaccgcauccagcuguucgggcccgacggcguguuccucaacaaguacggguucgagggcgcccuguggaagcacuucgacagcccccgcgggguggccuucaaccacgagggccaccuggucgugacggacuucaacaaccaccggcuccuggugauccacccggacugccagagcgcccgcuuccugggcuccgaggggaccggcaacgggcaguuccuccggccccagggcgucgcgguggaccaggagggccgcaucaucguggccgacagccggaaccaccgcguccagauguucgaguccaacgggagcuuccugugcaaguucggcgcccagggguccggcuucgggcagauggaccggcccagcggcaucgccaucacccccgacggcaugaucgugguggucgacuucgggaacaaccgcauccugguguucuga

SEQ ID NO: 38118 - RNA, 1434 nt, Artificial Sequence
  derived and/or modified sequence opt1 from TRIM72__Homo_sapiens__NP_001008275
augagcgccgcccccggccugcuccaccaggagcuguccugcccgcugugccuccagcuguucgacgcgcccgugaccgccgagugcgggcacagcuucugccgcgccugccugggccgggucgccggggagcccgccgcggacggcaccgugcucugccccugcugccaggccccgacgcgcccccaggcccuguccaccaaccugcagcucgcccggcugguggaggggcuggcgcaggucccccagggccacugcgaggagcaccucgacccccugagcaucuacugcgagcaggaccgcgcccuggugugcggcgugugcgccucccucgggagccaccggggccaccgccugcugccggccgccgaggcgcacgcccggcucaagacccagcugccccagcagaagcugcagcuccaggaggccugcaugcgcaaggagaaguccgucgccgugcuggagcaccagcugguggaggucgaggagaccgugcggcaguuccgcggggccgugggcgagcagcucgggaagaugcgggucuuccuggcggcccuggagggcagccucgaccgcgaggccgagcgggugcgcggcgaggccgggguggcccugcggcgcgagcugggcucccucaacagcuaccuggagcagcugcggcagauggagaagguccucgaggagguggcggacaagccccagacggaguuccugaugaaguacugccuggugaccucccgccuccagaagauccuggccgagagcccgccgcccgcccggcuggacauccagcuccccaucaucuccgacgacuucaaguuccaggucuggcgcaagauguuccgggcccugaugcccgcccuggaggagcucaccuucgaccccagcuccgcgcaccccagccuggugguguccagcuccgggcgccgcgucgagugcagcgagcagaaggccccgcccgccggcgaggacccccggcaguucgacaaggccguggcgguggucgcccaccagcagcugagcgagggcgagcacuacugggagguggacgucggggacaagccccgcugggcccucggcgugaucgccgccgaggcgccccggcgcgggcggcugcacgccgugcccucccagggccuguggcuccuggggcugcgcgagggcaagauccuggaggcccacgucgaggccaaggagccgcgggcccuccgcagccccgagcggcgccccacccggaucggccuguaccuguccuucggggacggcgugcucagcuucuacgacgcguccgacgccgacgcccuggugccccuguucgccuuccacgagcgccucccgcggcccgucuaccccuucuucgacgugugcuggcacgacaaggggaagaacgcccagccgcugcugcucgugggccccgagggggcggaggccuga

SEQ ID NO: 38119 - RNA, 753 nt, Artificial Sequence
  derived and/or modified sequence opt1 from TRIM73__Homo_sapiens__NP_944606
auggccuggcaggucagccugcucgagcuggaggaccgccugcagugccccaucugccucgagguguucaaggagucccugaugcugcagugcggccacagcuacugcaaggggugccucgugucccugagcuaccaccuggacaccaaggugcggugcccgaugugcuggcaggucguggacggcuccagcucccuccccaacgugagccuggccugggucaucgaggcgcugcgccuccccggggaccccgagccgaaggugugcgugcaccaccggaacccccugucccuguucugcgagaaggaccaggagcucaucugcggccugugcgggcugcucggcagccaccagcaccaccccgucacccccguguccacggugugcagccgcaugaaggaggagcuggccgcccuguucuccgagcucaagcaggagcagaagaaggucgacgagcugaucgccaagcuggugaagaaccggacccgcaucgugaacgagagcgacgucuucuccugggugauccggcgcgaguuccaggagcuccggcacccgguggacgaggagaaggcccgcugccuggagggcaucgggggccacacccgggggcuggucgcgagccucgacaugcagcuggagcaggcccagggcacccgcgagcggcuggcccaggccgagugcgugcucgagcaguucgggaacgaggaccaccacgaguucaucuggaaguuccacuccauggcgagccgcuga

SEQ ID NO: 38120 - RNA, 750 nt, Artificial Sequence
  derived and/or modified sequence opt1 from TRIM74__Homo_sapiens__XP_011514491
auggccuggcaggucagccugcucgagcuggaggacuggcugcagugccccaucugccucgagguguucaaggagucccugaugcugcagugcggccacagcuacugcaaggggugccucgugucccugagcuaccaccuggacaccaaggugcgcugcccgaugugcuggcaggucguggacggcuccagcucccuccccaacgugagccuggccugggucaucgaggcgcugcggcuccccggggaccccgagccgaaggugugcgugcaccaccgcaacccccugucccuguucugcgagaaggaccaggagcucaucugcggccugugcgggcugcucggcagccaccagcaccaccccgucacccccguguccacggugugcagccggaugaaggaggagcuggccgcccuguucuccgagcucaagcaggagcagaagaaggucgacgagcugaucgccaagcuggugaagaaccgcacccggaucgugaacgagagcgacgucuucuccugggugauccgccgggaguuccaggagcuccgccacccgguggacgaggagaaggcccggugccuggagggcaucgggggccacacccgcgggcuggucgcgagccucgacaugcagcuggagcaggcccagggcacccgggagcgccuggcccaggccgagugcgugcucgagcaguucgggaacgaggaccaccacgaguucaucugguuccacuccauggcgagccgguga

SEQ ID NO: 38121 - RNA, 1656 nt, Artificial Sequence
  derived and/or modified sequence opt1 from TRIM8__Homo_sapiens__NP_112174
auggccgagaacuggaagaacugcuucgaggaggagcugaucugccccaucugccuccacguguucgucgagccggugcagcugcccugcaagcacaacuucugccgcggcugcaucggggaggccugggcgaaggacagcggccuggugcggugccccgagugcaaccaggccuacaaccagaagcccgggcucgagaagaaccugaagcugaccaacaucgucgagaaguucaacgcccuccacguggagaagccgcccgccgcccugcacugcguguucugccgccggggcccgccccugcccgcgcagaaggucugccuccgcugcgaggcccccugcugccagucccacgugcagacccaccuccagcagcccagcacggcccgggggcaccuccugguggaggccgacgacguccgcgcgugguccugcccccagcacaacgccuaccggcuguaccacugcgaggccgagcaggucgccgugugccaguacugcugcuacuacagcggcgcccaccagggccacuccgugugcgacguggagauccgccggaacgagauccgcaagaugcugaugaagcagcaggaccggcucgaggagcgcgagcaggacaucgaggaccagcuguacaagcuggagagcgacaagcggcucguggaggagaaggucaaccagcugaaggaggaggugcgccugcaguacgagaagcuccaccagcugcuggacgaggaccuccggcagaccguggagguccuggacaaggcgcaggccaaguucugcuccgagaacgccgcccaggcccugcaccucggggagcgcaugcaggaggcgaagaagcugcugggcagccuccagcugcuguucgacaagaccgaggacguguccuucaugaagaacaccaagagcgugaagauccucauggaccggacgcagaccugcaccuccagcucccugagcccgaccaagaucgggcaccugaacuccaagcuguuccugaacgaggucgccaagaaggagaagcagcugcgcaagaugcucgagggccccuucagcacgcccgugcccuuccugcaguccgugccgcuguaccccugcggggucagcuccagcggcgccgagaagcggaagcacagcaccgccuuccccgaggccuccuuccucgagaccagcuccggccccgucgggggccaguacggggcggccggcaccgccagcggcgaggggcaguccggccagccgcuggggcccugcagcuccacgcagcaccugguggcccuccccggcggggcccagcccgugcacagcuccccgguguucccgcccagccaguaccccaacggcuccgcggcccagcagcccaugcugccccaguacggcgggcgcaagauccuggucugcagcguggacaacugcuacugcuccagcguggccaaccacggcgggcaccagcccuacccgcgguccggccacuuccccuggaccguccccagccaggaguacucccacccccucccgcccacccccagcgugccccagucccugccgagccuggccgugcgcgacuggcuggacgcgagccagcagcccgggcaccaggacuucuaccgcgucuacggccagcccuccaccaagcacuacgugacgagcuga

SEQ ID NO: 38122 - RNA, 2133 nt, Artificial Sequence
  derived and/or modified sequence opt1 from TRIM9__Homo_sapiens__NP_055978
auggaggagauggaggaggagcugaagugccccgugugcggcagcuucuaccgcgagccgaucauccuccccugcucccacaaccugugccaggccugcgcccggaacauccugguccagacccccgagagcgagagcccccagagccaccgcgcggccggguccggcgugagcgacuacgacuaccucgaccuggacaagaugucccuguacagcgaggccgacuccggguacggcagcuacgggggcuucgccuccgccccgaccacgcccugccagaagucccccaacggcgugcgggucuucccgcccgcgaugcccccgcccgccacccaccucucccccgcccuggcccccgugccccgcaacagcugcaucacgugcccccagugccaccggucccugauccucgacgaccgcgggcugcggggcuucccgaagaaccgcgugcuggagggggucaucgaccgguaccagcagagcaaggcggccgcccucaagugccagcugugcgagaaggcccccaaggaggccaccgugaugugcgagcagugcgacguguucuacugcgaccccugccgccugcggugccacccgccccgcggcccccucgcgaagcaccggcuggucccgcccgcccaggggcgcgugucccggcgccugagcccccggaagguguccacgugcaccgaccacgagcucgagaaccacagcauguacugcguccagugcaagaugcccgugugcuaccagugccuggaggagggcaagcacagcucccacgaggugaaggcccugggcgccauguggaagcuccacaagagccagcugucccaggcccugaacgggcucagcgaccgcgcgaaggaggccaaggaguuccugguccagcugcggaacauggugcagcagauccaggagaacuccguggaguucgaggccugccucgucgcccagugcgacgcccugaucgacgcgcugaaccgccggaaggcccagcuccuggcccgcgugaacaaggagcacgagcacaagcugaaggugguccgcgaccagaucagccacugcaccgugaagcuccggcagaccaccggccugauggaguacugccuggaggugaucaaggagaacgaccccuccggguuccuccagaucagcgacgcccugauccgccggguccaccugaccgaggaccaguggggcaagggcacccucacgccccgcaugaccaccgacuucgaccugucccuggacaacagcccgcuccugcaguccauccaccagcuggacuucgugcaggucaaggccagcucccccgugcccgcgaccccgauccuccagcuggaggagugcugcacccacaacaacagcgccacgcuguccuggaagcagccgccccucagcaccgugcccgccgacggguacauccuggagcuggacgacggcaacgggggccaguuccgggaggucuacguggggaaggagaccaugugcaccguggacggccugcacuucaacuccacguacaacgcccgcgucaaggcguucaacaagaccggcgugagccccuacuccaagacccucgugcugcagaccagcgaggucgccugguucgccuucgaccccgggagcgcccacuccgacaucauccugagcaacgacaaccucacggugaccugcuccagcuacgacgaccgggugguccugggcaagaccggguucuccaagggcauccacuacugggagcugaccguggaccgcuacgacaaccaccccgaccccgccuucgggguggcgcggauggacgucaugaaggacgugaugcucggcaaggacgacaaggccugggccauguacguggacaacaaccgcagcugguucaugcacaacaacucccacacgaaccggaccgagggcgggaucaccaagggcgccaccaucgggguccugcuggaccucaaccgcaagaaccugacguucuucaucaacgacgagcagcagggcccgaucgccuucgacaacguggaggggcuguucuuccccgcggugagccucaaccggaacguccaggugacccugcacaccggccugcccgugcccgacuucuacuccagccgcgccuccaucgccuga

SEQ ID NO: 38123 - RNA, 7098 nt, Artificial Sequence
  derived and/or modified sequence opt1 from TRIOBP__Homo_sapiens__NP_001034230
auggaggaggugcccggggacgcccugugcgagcacuucgaggccaacauccucacccagaaccgcugccagaacugcuuccaccccgaggaggcccacggggcccgguaccaggagcugcgcucccccuccggcgccgaggugcccuacugcgaccugccccggugcccgcccgcccccgaggacccccucagcgccuccaccagcgggugccaguccgugguggaccccggccugcgccccgggcccaagcggggccccagccccuccgccggccugcccgaggaggggcccaccgccgcgccccgcagccggucccgcgagcucgaggccguccccuaccuggagggccugaccaccagccucugcggguccugcaacgaggaccccggcagcgaccccaccuccagccccgacuccgccacccccgacgacaccagcaacuccagcuccguggacugggacaccguggagcggcaggaggaggaggcccccagcugggacgagcuggccgucaugaucccccgccggccccgcgaggggccccgggccgacagcucccagcgcgcccccagccugcucacccggucccccgugggcggcgacgccgccgggcagaagaaggaggacaccggcgggggcggccgcagcgccgggcagcacugggcccggcugcgcggcgaguccgggcugagccucgagcggcaccgcuccacccugacccaggccagcuccaugacgccccacagcggcccccgguccacgaccagccaggccucccccgcccagcgcgacaccgcccaggccgccagcacccgcgagaucccccgggcguccagcccccaccgcaucacgcagcgggacaccucccgcgccagcuccacccagcaggagaucagccgggccagcuccacccagcaggagacgagccgcgccuccagcacccaggaggacacgccccgggccuccagcacccaggaggacacgccccgcgcguccagcacccaguggaacacgccccgggccuccagcccgucccgcagcacccagcuggacaacccccggacguccagcacccagcaggacaacccccagaccuccuucccgaccugcacgccgcagcgcgagaacccccggacccccugcgugcagcaggacgacccccgcgccagcuccccgaaccggaccacccagcgcgagaacagccggacgagcugcgcccagcgcgacaaccccaaggcgucccggaccagcucccccaaccgcgccacccgcgacaacccccggaccagcugcgcccagcgcgacaacccgcgggccuccagccccucccgcgccacccgggacaaccccacgaccagcugcgcgcagcgcgacaacccccgggccucccgcaccagcuccccgaaccgggccacccgcgacaacccccggacgagcugcgcccagcgcgacaacccccgggccuccagccccucccgcgcgacccgggacaacccgaccaccagcugcgcccagcgcgacaacccccgggccucccgcacgagcucccccaaccgggccacccgcgacaacccgcggaccagcugcgcccagcgcgacaacccccgcgcgagcucccccaaccgggccgcccgcgacaaccccaccacgagcugcgcccagcgggacaacccgcgcgcgucccggaccagcucccccaaccgcgccacccgggacaacccccgcaccagcugcgcccagcgggacaacccccgcgccuccagcccgaaccgggccacgcgcgacaaccccaccaccuccugcgcgcagcgggacaacccccgcgccagccggaccuccagccccaaccgcgccacgcgggacaacccgcgcaccuccugcgcccagcgggacaacccccgcgccagcucccccaaccgcaccacccagcaggacagcccccggacguccugcgcgcgccgggacgacccgcgcgccagcucccccaaccggaccauccagcaggagaacccccgcaccagcugcgcccuccgggacaacccccgcgccagcuccccgagccggaccauccagcaggagaacccccgcacguccugcgcccagcgggacgacccccgcgcgagcucccccaaccggaccacccagcaggagaacccgcgcaccagcugcgcccggcgcgacaacccccgggccuccagccgcaaccggacgauccagcgcgacaacccccggaccuccugcgcccagcgcgacaacccccgcgcgagcuccccgaaccggaccauccagcaggagaaccugcgcaccagcugcacgcggcaggacaacccccgcaccuccagccccaaccgggccacccgcgacaacccgcggaccuccugcgcccagcgcgacaaccugcgggccagcucccccauccgcgccacccagcaggacaacccccggacgugcauccagcagaacaucccccgcagcuccagcacccagcaggacaacccgaagaccagcugcaccaagcgggacaaccuccgccccacgugcacccagcgggaccgcacccaguccuucagcuuccagcgggacaaccccgggaccuccagcucccagugcugcacgcagaaggagaaccugcgccccagcuccccgcaccggagcacccaguggaacaacccccgcaacuccagcccccaccgcaccaacaaggacauccccugggcguccuucccgcugcggcccacccagagcgacggcccccgcacguccagccccucccggagcaagcaguccgaggucccgugggccagcaucgcccuccgccccacccagggcgaccggccccagaccuccagccccagccgcccggcccagcacgacccgccccaguccagcuucgggcccacccaguacaaccugcccucccgggccacgagcuccagccacaaccccggccaccaguccaccagccgcaccuccagccccguguaccccgcggccuacggggccccgcugaccucccccgagcccagccagccgcccugcgccgugugcaucggccaccgggacgcgccccgcgcguccuccccgccccgguaccuccagcacgaccccuuccccuucuuccccgagccccgcgcccccgaguccgagccgccccaccacgagccgcccuacaucccgcccgccgucugcaucgggcaccgggacgccccgcgcgccagcagcccgccccggcacacgcaguucgaccccuucccguuccugcccgacaccagcgacgcggagcaccagugccagagcccccagcacgagccccugcagcucccggcccccgugugcaucggcuaccgcgacgcgccccgggccuccagcccgccccgccaggcgcccgagcccucccugcuguuccaggaccucccgcgggccagcaccgagucccuggugcccagcauggacucccugcacgagugcccccacauccccaccccggucugcaucggccaccgcgacgcccccagcuucuccuccccgccccggcaggccccggagcccucccucuucuuccaggacccgcccgggacgagcauggagucccuggccccgagcaccgacucccugcacggcagccccgugcucaucccccaggugugcaucgggcaccgcgacgcgccccgcgccuccagcccgccccggcacccgcccuccgaccuggccuuccuggccccgagccccagccccggcuccagcgggggcucccgcggcagcgcgccgcccggggagacccggcacaaccucgagcgcgaggaguacaccguccuggcggaccugcccccgccccggcgccucgcccagcggcagcccggcccccaggcccagugcuccagcgggggccgcacgcacucccccggccgggccgagguggagcgccuguucgggcaggagcggcgcaagagcgaggccgcgggcgccuuccaggcccaggacgaggggcggucccagcagcccagccagggccagucccagcugcuccgccggcagagcucccccgcccccagccgccaggugaccaugcugcccgcgaagcaggccgagcugacccggcgcucccaggccgagccgccccaccccuggagccccgagaagcggccggagggggaccgccagcugcagggcagcccccugccgccccgcaccagcgcccggacgccggagcgcgagcugcggacccagcgcccccuggaguccggccaggccgggccccggcagccccucggcgucuggcagagccaggaggagccgcccgggagccagggcccccaccgccaccuggagcgguccuggagcucccaggagggcgggcugggccccgggggcuggugggggugcggcgagccgagccucggggcggccaaggcccccgagggcgccuggggcgggaccucccgcgaguacaaggagagcuggggccagcccgaggccugggaggagaagcccacccacgagcugccgcgggagcuggggaagcgcagcccccugacguccccgcccgagaacuggggcgggcccgcggaguccagccaguccuggcacagcggcacccccaccgccgugggcuggggcgccgagggcgccugccccuacccccggggguccgagcgccggcccgagcuggacuggcgcgaccugcucggccugcugcgggcccccggcgagggggugugggcgcgcguccccagccucgacugggagggccugcuggagcuccugcaggcccggcugccgcgcaaggaccccgccgggcaccgggacgaccucgcccgcgcgcugggccccgagcuggggcccccgggcaccaacgacgugcccgagcaggagucccacagccagcccgagggcugggccgaggccacccccgucaacgggcacuccccggcccuccagagccagucccccgugcagcugcccagccccgccugcacgagcacccaguggccgaagaucaaggugacccggggccccgcgaccgccacgcuggccgggcucgagcagaccggcccccuggggucccgcagcaccgccaagggccccucccugccggagcuccaguuccagcccgaggagcccgaggagagcgagcccucccgcggccaggacccgcugaccgaccagaagcaggccgacagcgcggacaagcggcccgccgaggggaaggccggcagcccccucaaggggcgccucgucacguccuggcggaugccgggcgaccgccccacccuguucaaccccuuccugcucucccugggggugcugcgguggcgccggcccgaccuccugaacuucaagaagggcuggaugagcauccuggacgagccgggcgagccgcccucccccagccucaccaccacguccaccagccaguggaagaagcacugguucgugcugaccgacuccagccugaaguacuaccgcgacuccaccgccgaggaggccgacgagcucgacggggagaucgaccugcggagcugcacggacgucaccgaguacgcggugcagcgcaacuacggcuuccagauccacaccaaggacgccguguacacccuguccgccaugacgagcgggauccggcgcaacuggaucgaggcccuccggaagaccguccgcccgaccagcgcccccgacgugaccaagcuguccgacagcaacaaggagaacgcgcugcacuccuacagcacgcagaagggcccccucaaggccggcgagcagcgggccggguccgaggugaucagccgcggcgggccccggaaggccgacggccagcgccaggcgcuggacuacgucgagcuguccccgcucacccaggccagcccccagcgggcccgcacccccgcccgcacccccgaccggcuggccaagcaggaggagcuggagcgcgaccucgcgcagcgguccgaggagcgccggaagugguucgaggccacggacagccgcaccccggaggugcccgccggggagggcccccggcgcggccugggggcgccccugaccgaggaccagcagaaccggcucuccgaggagaucgagaagaaguggcaggagcuggagaagcugccgcuccgcgagaacaagcgggugccccugaccgcccugcucaaccagagccgcggcgagcggcgcgggccgcccuccgacggccacgaggcgcuggagaaggagguccaggcccugcgggcccagcucgaggccuggcgccugcagggggaggccccgcagagcgcgcugcggucccaggaggacggccacaucccgcccggcuacaucagccaggaggccugcgagcgcucccucgccgagauggagagcucccaccagcaggucauggaggagcugcagcggcaccacgagcgcgagcugcagcggcuccagcaggagaaggaguggcugcuggccgaggagacggcggccaccgccagcgccaucgaggccaugaagaaggcguaccaggaggagcucagccgcgagcuguccaagacccgcagccugcagcaggggccggacggccuccggaagcagcaccaguccgacguggaggcccugaagcgcgagcugcagguccucagcgagcaguacucccagaagugccuggagaucggggcccugaugcggcaggccgaggagcgcgagcacacccuccggcgcugccagcaggagggccaggagcugcugcggcacaaccaggagcuccacgggcgccugagcgaggagaucgaccagcugcggggcuucaucgccucccagggcauggggaacggcugcgggcgcagcaacgagcgguccagcugcgagcucgaggugcugcugcgcgugaaggagaacgagcugcaguaccucaagaaggagguccagugccugcgggacgagcugcagaugaugcagaaggacaagcgcuucacguccggcaaguaccaggacguguacguggagcucagccacaucaagacccgguccgagcgcgagaucgagcagcugaaggagcaccuccggcucgcgauggccgcccugcaggagaaggagagcaugcgcaacucccuggccgaguga

SEQ ID NO: 38124 - RNA, 9294 nt, Artificial Sequence
  derived and/or modified sequence opt1 from TRIO__Homo_sapiens__NP_009049
augagcggcagcagcgggggcgccgccgcgcccgccgccuccagcgggcccgccgccgcggccuccgccgccggcagcgggugcggcggcggggcgggcgagggggccgaggaggccgccaaggaccuggccgacaucgcggccuucuuccgcuccggcuuccggaagaacgacgagaugaaggccauggacgugcuccccauccugaaggagaagguggccuaccugagcgggggccgcgacaagcggggcgggcccauccucaccuuccccgcccgcuccaaccacgaccggauccgccaggaggaccugcggcgccugaucagcuaccucgcgugcauccccuccgaggaggugugcaagcggggcuucaccgugaucguggacaugcgcgggagcaagugggacuccaucaagccccugcugaagauccuccaggagagcuuccccugcugcauccacguggcccugaucaucaagcccgacaacuucuggcagaagcagcggaccaacuucggcuccagcaaguucgaguucgagaccaacauggugucccuggagggccucaccaaggucguggaccccagccagcugacccccgaguucgacgggugccuggaguacaaccacgaggaguggaucgagauccgcguggccuucgaggacuacaucuccaacgccacccacaugcucagccggcuggaggagcugcaggacauccucgccaagaaggagcugccccaggaccuggagggcgcgcgcaacaugaucgaggagcacagccagcucaagaagaaggucaucaaggcccccaucgaggaccuggaccuggaggggcagaagcuccugcagcggauccaguccagcgaguccuuccccaagaagaacagcggcuccgggaacgccgaccugcagaaccuccugcccaaggugagcaccaugcuggaccgccuccacuccacccggcagcaccuccaccagauguggcacgugcgcaagcugaagcucgaccagugcuuccagcugcggcuguucgagcaggacgccgagaagauguucgacuggaucacccacaacaagggccucuuccugaacagcuacacggagaucggcaccucccacccccacgccauggagcugcagacccagcacaaccacuucgcgaugaacugcaugaacgucuacgugaacaucaaccgcaucaugagcguggccaaccggcucgucgaguccgggcacuacgccagccagcagauccgccagaucgccucccagcuggagcaggaguggaaggcguucgccgccgcccuggacgagcgcagcacccuccuggacauguccagcaucuuccaccagaaggccgagaaguacauguccaacguggacagcuggugcaaggcgugcggcgagguggaccugcccuccgagcuccaggaccuggaggacgccauccaccaccaccaggggaucuacgagcacaucacgcuggccuacagcgaggucagccaggacggcaagucccuccuggacaagcugcagcggccccugacccccgggagcuccgacagccucaccgccuccgccaacuacagcaaggcggugcaccacgugcuggacgucauccacgaggugcugcaccaccagcgccagcucgagaacaucuggcagcaccggaaggugcgccugcaccagcggcugcagcucugcgucuuccagcaggacgugcagcagguccuggacuggaucgagaaccacggcgaggccuuccuguccaagcacaccggcguggggaagucccuccaccgcgcccgggcccugcagaagcgccacgaggacuucgaggagguggcccagaacacguacaccaacgcggacaagcugcucgaggccgccgagcagcuggcccagaccggcgagugcgaccccgaggagaucuaccaggcggcccaccagcuggaggaccggauccaggacuucguccgccggguggagcagcgcaagauccuccuggacauguccgugagcuuccacacccacgucaaggagcuguggacguggcucgaggagcugcagaaggagcugcucgacgacguguacgccgaguccguggaggccguccaggaccugaucaagcgguucgggcagcagcagcagaccacccuccaggugaccgugaacgucaucaaggagggcgaggaccucauccagcagcugcgcgacagcgccaucuccagcaacaagacgccccacaacuccagcaucaaccacaucgagaccgugcugcagcagcucgacgaggcgcagucccagauggaggagcuguuccaggagcggaagaucaagcuggagcuguuccugcagcugcgcaucuucgagcgggacgccaucgacaucaucagcgaccucgagagcuggaacgacgagcugucccagcagaugaacgacuucgacaccgaggaccugaccaucgccgagcagcgccuccagcaccacgccgacaaggcccugacgaugaacaaccugaccuucgacgugauccaccaggggcaggaccuccugcaguacgucaacgaggugcaggcgagcggcguggagcugcucugcgaccgggacgucgacauggccacccgcgugcaggaccugcuggaguuccuccacgagaagcagcaggagcuggaccuggccgccgagcagcaccgcaagcaccucgagcagugcgugcagcugcggcaccuccaggccgaggucaagcagguccucggcuggauccgcaacggggaguccaugcugaacgcgggccugaucaccgccagcucccuccaggaggccgagcagcugcagcgggagcacgagcaguuccagcacgccaucgagaagacgcaccagagcgcgcuccaggugcagcagaaggccgaggccaugcugcaggccaaccacuacgacauggacaugauccgcgacugcgccgagaaggucgcgucccacuggcagcagcugaugcugaagauggaggaccggcucaagcuggugaacgccagcguggccuucuacaagaccuccgagcaggucugcagcgugcuggagucccucgagcaggaguacaagcgcgaggaggacuggugcgggggcgccgacaagcugggccccaacagcgagaccgaccacgugacccccaugaucuccaagcaccuggagcagaaggaggccuuccucaaggcgugcacgcuggcccggcgcaacgccgacgucuuccugaaguaccuccaccggaacagcgugaacaugcccgggauggugacccacaucaaggcccccgagcagcaggucaagaacauccugaacgagcuguuccagcgcgagaaccgggugcuccacuacuggaccaugcgcaagcggcgccuggaccagugccagcaguacguggucuucgagcgguccgccaagcaggcgcuggaguggauccacgacaacggcgaguucuaccucagcacccacaccuccacggggagcuccauccagcacacccaggagcugcugaaggagcacgaggaguuccagaucaccgccaagcagaccaaggagcgcgugaagcuccugauccagcuggccgacggcuucugcgagaaggggcacgcccacgccgcggagaucaagaagugcgugacggccgucgacaagcgguaccgcgacuucagccuccggauggagaaguaccgcaccagccuggagaaggcccugggcaucuccagcgacuccaacaagagcuccaagagccuccagcuggacaucauccccgccuccauccccggcagcgaggugaagcugcgggacgcggcccacgagcucaacgaggagaagcgcaaguccgcccgccggaaggaguucaucauggccgagcugauccagaccgagaaggccuacgugcgcgaccugcgggagugcauggacaccuaccucugggagaugacgagcggggucgaggagaucccgcccggcaucgugaacaaggagcugaucaucuucgggaacaugcaggagaucuacgaguuccacaacaacaucuuccugaaggagcucgagaaguacgagcagcugccggaggacgugggccacugcuucgucaccugggcggacaaguuccagauguacgugaccuacugcaagaacaagcccgacuccacccagcugauccuggagcacgccgggagcuacuucgacgagauccagcagcgccacggccucgccaacuccaucagcuccuaccugaucaagcccgugcagcggaucacgaaguaccagcugcuccugaaggagcugcugaccugcugcgaggagggcaagggggagaucaaggacggccuggaggucaugcugagcgugccgaagcgcgccaacgacgccaugcaccucuccaugcuggagggguucgacgagaacaucgagagccagggcgagcugauccuccaggaguccuuccaggugugggaccccaagacccugauccggaaggggcgcgagcggcaccuguuccucuucgagaugagccuggucuucagcaaggaggugaaggacuccagcggccgcuccaaguaccuguacaagagcaagcuguucaccuccgagcugggcgucacggagcacguggagggggaccccugcaaguucgcgcugugggugggccggacccccaccagcgacaacaagaucguccucaaggccuccagcaucgagaacaagcaggacuggaucaagcacauccgcgaggugauccaggagcggaccauccaccugaagggggcccugaaggagccgauccacauccccaagacggcccccgccacccgccagaagggccggcgcgacggggaggaccucgacucccagggcgacggcagcucccagcccgacaccaucagcaucgcgucccggaccagccagaacacgcuggacuccgacaagcugagcgggggcugcgagcucaccguggucauccacgacuucaccgccugcaacuccaacgagcugaccauccgccgggggcagacgguggaggugcuggagcgcccgcacgacaagcccgacuggugccucguccgcaccaccgaccggagccccgccgccgagggccuggugcccugcggcucccugugcaucgcgcacagccgcagcuccauggagauggaggggaucuucaaccacaaggacagccucuccgugagcuccaacgacgccagcccgcccgccuccgucgccagccugcagccccacaugaucggcgcccaguccagccccgggccgaagcggcccggcaacacccugcgcaaguggcucacgucccccgugcggcgccugagcuccgggaaggcggacggccacgugaagaagcuggcccacaagcacaagaagucccgggagguccgcaaguccgccgacgccggcagccagaaggacuccgacgacagcgccgcgacgccccaggacgagaccguggaggagcgggggcgcaacgagggccucuccagcgggacccugagcaaguccagcuccagcggcaugcaguccugcggggaggaggagggcgaggagggcgccgacgccgugccgcugccgccgcccauggccauccagcagcacagccuccugcagccggacucccaggacgacaaggccagcucccggcugcucguccgccccacgagcuccgagacccccagcgcggccgagcugguguccgccaucgaggagcuggucaagagcaagauggcccucgaggaccggccguccagccugcuggucgaccagggggacuccagcucccccagcuucaaccccagcgacaacucccuccugagcuccagcucccccaucgacgagauggaggagcgcaagagcuccagccugaagcggcgccacuacgugcuccaggagcugguggagaccgagcgggacuacguccgcgaccugggcuacgugguggagggguacauggcgcucaugaaggaggacggcgucccggacgacaugaaggggaaggacaagaucguguucggcaacauccaccagaucuacgacuggcaccgggacuucuuccugggcgagcuggagaagugccucgaggaccccgagaagcuggggucccuguucgugaagcacgagcgccggcuccacauguacaucgccuacugccagaacaagcccaagagcgagcacaucgucuccgaguacaucgacaccuucuucgaggaccugaagcagcgccugggccaccgccuccagcugaccgaccugcucaucaagcccgugcagcggaucaugaaguaccagcugcugcucaaggacuuccugaaguacagcaagaaggccucccuggacacgagcgagcucgagcgcgccguggaggucaugugcaucgugccgcggcgcugcaacgacaugaugaacguggggcggcugcagggcuucgacggcaagaucgucgcccaggggaagcugcuccugcaggacaccuuccuggugaccgaccaggacgcgggccuccugccccgcugccgggagcgccggaucuuccuguucgagcagaucgugaucuucuccgagccccucgacaagaagaagggguucagcaugcccggcuuccuguucaagaacuccaucaaggucagcugccugugccucgaggagaacguggagaacgacccgugcaaguucgcccugaccagccgcacgggggacguggucgagaccuucauccugcacuccagcucccccagcgugcggcagaccuggauccacgagaucaaccagauccucgagaaccagcgcaacuuccugaacgcccugaccucccccaucgaguaccagcggaaccacagcggcggcgggggcgggggcggguccggcggcagcgggggcgggggcggguccggcggcgggggcgcccccagcgggggcuccgggcacagcggcggcccguccagcugcgggggcgcccccuccacgagccgcucccggcccagccgcaucccccagccggugcggcaccacccgcccguccucguguccagcgcggccagcucccaggccgaggccgacaagaugagcgggaccuccacccccggccccagccugccgccgcccggcgccgcgccggaggccgggcccuccgcccccagccgccggccgcccggcgccgacgccgagggguccgagcgcgaggcggagcccauccccaagaugaaggugcuggagagcccgcgcaagggcgccgccaacgccuccgggagcucccccgacgcgcccgccaaggacgcccgggccagccucggcacccugccccugggcaagccgcgcgccggggcggccagcccccucaacagcccccuguccagcgccguccccucccugggcaaggagccguucccgcccagcagcccccugcagaagggcgggagcuucuggagcuccaucccggccagccccgccucccggcccgggagcuucacguuccccggcgacuccgacagccuccagcgccagaccccgcggcacgcggcccccggcaaggacaccgaccgcaugagcacgugcagcuccgccagcgagcaguccgugcagagcacccaguccaacgggagcgaguccagcuccagcuccaacaucagcaccaugcuggugacccacgacuacaccgccgucaaggaggacgagaucaacguguaccagggcgaggucgugcagauccuggccagcaaccagcagaacauguuccucguguuccgggcggccacggaccagugccccgccgccgagggguggauccccggcuucguccuggggcacaccuccgcggugaucguggagaacccggacggcacccugaagaaguccaccuccuggcacacggcccuccgccugcggaagaaguccgagaagaaggacaaggacggcaagcgcgaggggaagcuggagaacggcuaccggaagucccgcgaggggcucagcaacaaggucuccgugaagcugcugaaccccaacuacaucuacgacgugccgcccgaguucgucaucccgcucagcgaggugaccugcgagaccggcgagaccgugguccugcggugccgcgugugcgggcggcccaaggccuccaucacguggaagggccccgagcacaacacccugaacaacgacggccacuacagcaucuccuacagcgaccucggggaggccacccugaagaucgugggcgucaccacggaggacgacgggaucuacacgugcaucgccgugaacgacaugggcuccgcgagcuccagcgccucccugcgcgugcucggcccggggauggacggcaucauggucaccuggaaggacaacuucgacagcuucuacuccgagguggccgagcuggggcggggccgcuucagcguggucaagaagugcgaccagaaggggaccaagcgggccguggccacgaaguucgugaacaagaagcugaugaagcgcgaccaggucacccacgagcucggcauccugcagagccugcagcacccccuccuggugggccugcucgacaccuucgagacccccaccuccuacauccuggugcuggagauggcggaccaggggcggcuccuggacugcgucgugcgcuggggcagccugacggaggggaagauccgcgcccaccucggcgaggugcuggaggccguccgguaccugcacaacugccgcaucgcccaccucgaccugaagcccgagaacauccugguggacgagucccucgccaagccgaccaucaagcuggcggacuucggggacgccgugcagcugaacaccaccuacuacauccaccagcuccugggcaaccccgaguucgccgcccccgagaucauccugggcaaccccgucagccucacguccgacaccuggagcgugggggugcugaccuacguccugcucuccggcgugagcccguuccuggacgacuccguggaggagaccugccugaacaucugccggcucgacuucagcuuccccgacgacuacuucaagggggucucccagaaggcgaaggaguucgugugcuuccugcugcaggaggaccccgccaagcgccccagcgccgcccucgcccugcaggagcaguggcugcaggcgggcaacgggcgguccacgggcgugcucgacaccagccgccugaccuccuucaucgagcggcgcaagcaccagaacgacguccggccgauccgcagcaucaagaacuuccugcagucccggcuccugccccgcguguga

SEQ ID NO: 38125 - RNA, 1806 nt, Artificial Sequence
  derived and/or modified sequence opt1 from TRIP10__Homo_sapiens__NP_001275891
auggacuggggcaccgagcugugggaccaguucgaggugcucgagcgccacacccagugggggcuggaccugcucgaccgguacgucaaguucgugaaggagcgcacggagguggagcaggccuacgccaagcagcugcggagccuggucaagaaguaccuccccaagcgccccgcgaaggacgaccccgaguccaaguucagccagcagcaguccuucgugcagauccugcaggaggugaacgacuucgccggccagcgggagcuggucgccgagaaccucagcgugcgcgugugccuggagcugaccaaguacucccaggagaugaagcaggagcggaagaugcacuuccaggaggggcgccgggcccagcagcagcucgagaacggcuucaagcagcuggagaacagcaagcgcaaguucgagcgggacugccgcgaggccgagaaggcggcccagaccgccgagcggcuggaccaggacaucaacgccaccaaggcggacgucgagaaggccaagcagcaggcccaccuccgcucccacauggccgaggagagcaagaacgaguacgccgcgcagcugcagcgguucaaccgcgaccaggcccacuucuacuucucccagaugccccagaucuucgacaagcugcaggacauggacgagcggcgcgccacgcggcucggggccggcuacggccugcugagcgaggccgagcucgagguggugcccaucaucgcgaagugccuggaggggaugaaggucgccgccaacgccguggaccccaagaacgacucccacgugcugaucgagcuccacaagagcggcuucgcccgccccggggacgucgaguucgaggacuucucccagcccaugaaccgggcgcccagcgacuccagccugggcaccccguccgacgggcgccccgagcugcgcggccccggccggagccgcaccaagcgguggcccuucgggaagaagaacaagccgcggcccccgccccucuccccgcugggcgggcccgugcccagcgcccugcccaacggcccgcccagcccccgcuccggccgcgacccccucgccauccugagcgagaucuccaagagcgugaagccgcggcuggccuccuuccgcagccuccgggggucccgcggcaccgucgugacggaggacuucagccaccucccgcccgagcagcagcggaagcgccugcagcagcagcuggaggagcggucccgcgagcugcagaaggagguggaccagcgggaggcccugaagaagaugaaggacgucuacgagaagacgccccagaugggggaccccgcgagccucgagccccagaucgccgagacccuguccaacaucgagcgccugaagcucgaggugcagaaguacgaggccuggcuggccgaggcggagagccgggugcuguccaaccgcggcgacagccucucccggcacgcccggcccccggacccgcccgccagcgccccgcccgacuccagcuccaacagcgccagccaggacaccaaggaguccagcgaggagccgcccuccgaggagagccaggacacccccaucuacaccgaguucgacgaggacuucgaggaggagcccaccucccccaucgggcacugcgucgcgaucuaccacuucgagggcagcuccgagggcaccaucagcauggccgagggggaggaccugucccugauggaggaggacaagggcgacggguggacgcgcgugcgccgcaaggagggcggggagggcuacguccccaccagcuaccuccgggugacccugaacuga

SEQ ID NO: 38126 - RNA, 5940 nt, Artificial Sequence
  derived and/or modified sequence opt1 from TRIP11__Homo_sapiens__NP_004230
augagcuccuggcugggcgggcucgggagcgggcugggccagucccugggccaggugggcggcagccucgcgucccugaccgggcagaucagcaacuucaccaaggacaugcugauggagggcaccgaggaggucgaggccgagcuccccgacucccgcaccaaggagaucgaggcgauccacgccauccugcggagcgagaacgagcgccugaagaagcucugcaccgaccuggaggagaagcacgaggccuccgagauccagaucaagcagcagagcaccuccuaccggaaccagcugcagcagaaggagguggagaucagccaccucaaggcccgccagaucgcccugcaggaccagcugcucaagcugcaguccgcggcccagagcgugcccuccggggccggcgugcccgccaccaccgcgagcuccagcuucgccuacgggaucucccaccaccccagcgccuuccacgacgacgacauggacuucggcgacaucaucagcucccagcaggagaucaaccggcugagcaacgaggugucccgccucgagagcgaggugggccacuggcggcacaucgcccagaccuccaaggcccaggggaccgacaacagcgaccaguccgagaucugcaagcugcagaacaucaucaaggagcugaagcagaaccgcagccaggagaucgacgaccaccagcacgagauguccgugcuccagaacgcgcaccagcagaagcugacggagaucagccggcgccaccgggaggagcuguccgacuacgaggagcgcaucgaggagcucgagaaccugcugcagcagggcgggagcggcgugaucgagaccgaccucuccaagaucuacgagaugcagaagaccauccaggugcugcagaucgagaagguggagagcaccaagaagauggagcagcuggaggacaagaucaaggacaucaacaagaagcucuccagcgccgagaacgaccgggacauccugcgccgggagcaggagcagcugaacguggagaagcgccagaucauggaggagugcgagaaccucaagcuggagugcuccaagcugcagcccagcgccgugaagcaguccgacacgaugaccgagaaggagcggauccucgcccagagcgccagcgucgaggagguguuccgccugcagcaggcgcuguccgacgccgagaacgagaucaugcggcucagcucccugaaccaggacaacagccuggccgaggacaaccucaagcugaagaugcgcaucgaggugcuggagaaggagaagucccuccugagccaggagaaggaggagcugcagaugucccuccugaagcugaacaacgaguacgaggucaucaagagcaccgccacccgggacaucucccuggacagcgagcuccacgaccugcgccugaaccucgaggccaaggagcaggagcugaaccaguccaucagcgagaaggagacgcugaucgcggagaucgaggagcucgaccgccagaaccaggaggccaccaagcacaugauccugaucaaggaccagcuguccaagcagcagaacgagggcgacagcaucaucuccaagcucaagcaggaccugaacgacgagaagaagcgggugcaccagcuggaggacgacaagauggacaucaccaaggagcucgacgugcagaaggagaagcugauccagagcgaggucgcccugaacgaccuccaccugaccaagcagaagcuggaggacaagguggagaaccucguggaccagcugaacaagucccaggagagcaacgucagcauccagaaggagaaccuggagcucaaggagcacauccgccagaacgaggaggagcugucccggauccgcaacgagcugaugcagagccucaaccaggacuccaacagcaacuucaaggacacgcugcugaaggagcgggaggccgaggugcgcaaccucaagcagaaccuguccgagcuggagcagcucaacgagaaccugaagaagguggccuucgacgucaagauggagaacgagaagcuggugcucgcgugcgaggacguccggcaccagcuggaggagugccuggccgggaacaaccagcucagccuggagaagaacaccaucguggagacccugaagauggagaagggcgagaucgaggccgagcucugcugggccaagaagcgccugcuggaggaggcgaacaaguacgagaagaccaucgaggagcucuccaacgcccggaaccugaacacgagcgcccugcagcucgagcacgagcaccugaucaagcugaaccagaagaaggacauggagaucgccgagcucaagaagaacaucgagcagauggacaccgaccacaaggagaccaaggacgugcuguccagcucccuggaggagcagaagcagcucacccagcugaucaacaagaaggagaucuucaucgagaagcugaaggagcgcagcuccaagcuccaggaggagcuggacaaguacagccaggcccugcggaagaacgagauccuccgccagacgaucgaggagaaggaccggucccuggggagcaugaaggaggagaacaaccaccuccaggaggagcucgagcgccugcgggaggagcagucccgcaccgcgcccgucgccgaccccaagacccuggacagcgugaccgagcucgccuccgaggugagccagcugaacacgaucaaggagcaccuggaggaggagaucaagcaccaccagaagaucaucgaggaccagaaccagagcaagaugcagcuccugcagucccugcaggagcagaagaaggagauggacgaguuccgguaccagcacgagcagaugaacgccacccacacccagcuguuccuggagaaggacgaggagaucaagagccugcagaagaccaucgagcagaucaagacgcagcuccacgaggagcgccaggacauccagaccgacaacuccgacaucuuccaggagaccaagguccagagccugaacaucgagaacggcuccgagaagcacgaccugagcaaggccgagaccgagcggcucgugaaggggaucaaggagcgcgagcuggagaucaagcugcucaacgagaagaacaucucccugaccaagcagaucgaccagcugagcaaggacgaggugggcaagcucacgcagaucauccagcagaaggaccuggagauccaggcgcugcacgcccgcaucuccagcaccucccacacccaggacgucguguaccuccagcagcagcugcaggccuacgccauggagcgggagaagguguucgccguccugaacgagaagacccgcgagaacagccaccucaagacggaguaccacaagaugauggacaucguggcggccaaggaggccgcccugaucaagcugcaggacgagaacaagaagcucuccacccgguucgagagcuccggccaggacauguuccgcgagaccauccagaaccugagccggaucauccgcgagaaggacaucgagaucgacgcgcugucccagaagugccagacccuccuggccgugcugcagacgagcuccaccgggaacgaggccggcggggucaacagcaaccaguucgaggagcugcuccaggagcgggacaagcugaagcagcaggucaagaagauggaggaguggaagcagcaggucaugaccaccguccagaacaugcagcacgagagcgcccagcugcaggaggagcuccaccagcugcaggcccaggugcugguggacuccgacaacaacagcaagcuccaggucgacuacacgggccugauccaguccuacgagcagaacgagaccaagcugaagaacuucgggcaggagcucgcccaggugcagcacagcaucggccagcugugcaacaccaaggaccugcuccugggcaagcuggacaucaucagcccccagcucagcuccgccagccugcugacgccccaguccgccgagugccuccgcgccagcaaguccgaggugcugagcgaguccagcgagcugcuccagcaggagcuggaggagcugcggaagucccuccaggagaaggacgccacgauccgcacccugcaggagaacaaccaccggcugagcgacuccaucgcggccaccagcgagcucgagcgcaaggagcacgagcagaccgacuccgagaucaagcagcugaaggagaagcaggacguccugcagaagcuccugaaggagaaggaccugcucaucaaggccaagagcgaccagcugcugagcuccaacgagaacuucacgaacaaggugaacgagaacgagcuccugcggcaggccgugaccaaccugaaggagcgcauccucauccuggagauggacaucgggaagcugaagggcgagaacgagaagaucgucgagaccuaccgggggaaggagaccgaguaccaggcccuccaggagacgaacaugaaguucagcaugaugcugcgcgagaaggaguucgagugccacuccaugaaggagaaggcgcuggccuucgagcagcuccugaaggagaaggagcagggcaagaccggggagcugaaccagcuccugaacgccgugaaguccaugcaggagaagaccguggucuuccagcaggagcgggaccaggugaugcuggcccucaagcagaagcagauggagaacaccgcgcugcagaacgaggugcagcgccugcgggacaaggaguuccgcuccaaccaggagcucgagcggcugcgcaaccaccuccuggagagcgaggacuccuacacgcgcgaggcccuggccgccgaggaccgggaggccaagcugcgcaagaaggucaccgugcucgaggagaagcuggugagcuccagcaacgcgauggagaacgccucccaccaggccagcguccagguggagucccugcaggagcagcucaacguggucagcaagcagcgggacgagaccgcccugcagcuguccgugagccaggagcaggucaagcaguacgcccucucccuggcgaaccugcagaugguccucgagcacuuccagcaggaggagaaggccauguacagcgccgagcuggagaagcagaagcagcugaucgccgaguggaagaagaacgccgagaaccucgagggcaaggugaucucccugcaggagugccuggacgaggcgaacgccgcccucgacagcgccagccgccugaccgagcagcuggacgugaaggaggagcagaucgaggagcucaagcggcagaacgagcugcgccaggagaugcuggacgacguccagaagaagcucaugucccuggccaacagcuccgagggcaagguggacaaggugcugaugcggaaccucuucaucgggcacuuccacacgccgaagaaccagcgccacgagguccugcggcugaugggcagcauccucggggugcgccgggaggagauggagcagcuguuccacgacgaccagggcggcgugacccgcuggaugaccggguggcugggcgggggcuccaagagcguccccaacacgccccugcggcccaaccagcaguccguggucaacagcuccuucagcgagcuguucgugaaguuccuggagacggagucccacccgagcaucccgccgcccaagcucuccgugcacgacaugaagccgcuggacagccccgggcgccggaagcgcgacaccaacgcgcccgaguccuucaaggacaccgccgagagccgguccggccgccggaccgacgucaaccccuuccuggccccgcgcagcgccgcggugccccucaucaaccccgccggccuggggcccggcgggccgggccaccuccuccugaagcccaucuccgacgugcugcccaccuucacgccccugccggcccuccccgacaacagcgccggggucgugcugaaggaccugcucaagcaguga

SEQ ID NO: 38127 - RNA, 870 nt, Artificial Sequence
  derived and/or modified sequence opt1 from TRIP13__Homo_sapiens__NP_001159732
auggacgaggccgugggcgaccugaagcaggcccuccccugcgucgcggagagccccaccgugcacguggagguccaccagcgcggguccagcaccgccaagaaggaggacaucaaccuguccgugcggaagcugcucaaccgccacaacaucguguucggcgacuacacguggaccgaguucgacgagcccuuccugacccggaacguccagagcguguccaucaucgacaccgagcugaaggugaaggacagccagcccaucgaccucuccgccugcacggucgcccugcacaucuuccagcugaacgaggacgggcccagcuccgagaaccucgaggaggagaccgagaacaucaucgccgcgaaccacugggugcugccggccgccgaguuccacggccugugggacagccucguguacgacgucgaggugaagucccaccuccuggacuacgugaugaccacccugcuguucagcgacaagaacgucaacuccaaccugaucacguggaaccgcguggugcuccugcacgggccgcccggcaccggcaagaccagccugugcaaggcccucgcgcagaagcugaccauccggcuguccagccgcuaccgguacgggcagcucaucgagaucaacucccacagccuguucuccaagugguucagcgagagcggcaagcuggucacgaagauguuccagaagauccaggaccucaucgacgacaaggacgcccugguguucgugcugaucgacgaggucgagucccucaccgccgcccgcaacgccugccgggcggggaccgagcccagcgacgccauccgcguggugaacgccguccugacccagaucgaccagaucaagcgguga

SEQ ID NO: 38128 - RNA, 1746 nt, Artificial Sequence
  derived and/or modified sequence opt1 from TRIP4__Homo_sapiens__NP_057297
auggccguggccggcgcggucagcggggagccccuggugcacuggugcacccagcagcuccgcaagaccuucggccuggacguguccgaggagaucauccaguacguccugagcaucgaguccgccgaggagauccgggaguacgugacggaccuccugcaggggaacgagggcaagaaggggcaguucaucgaggagcugaucaccaaguggcagaagaacgaccaggagcucaucagcgacccgcugcagcagugcuucaagaaggacgagauccuggacggccagaaguccggcgaccaccucaagcgcgggcggaagaagggccgcaaccggcaggaggugcccgccuucaccgagcccgacaccacggccgaggucaagacccccuucgaccuggccaaggcgcaggagaacagcaacuccgugaagaagaagaccaaguucgugaaccuguacacccgcgaggggcaggaccggcucgccguccugcugccgggccgccaccccugcgacugccucgggcagaagcacaagcugaucaacaacugccugaucugcggccggaucgugugcgagcaggagggcagcgggcccugccucuucugcggcacgcuggugugcacccacgaggagcaggacauccugcagcgcgacuccaacaagagccagaagcuccugaagaagcugauguccggggucgagaacagcggcaagguggacaucuccaccaaggaccuccugccccaccaggagcugcggaucaagagcggccucgagaaggccaucaagcacaaggacaagcugcuggaguucgaccgcaccuccauccggcgcacccaggugaucgacgacgagagcgacuacuucgccuccgacagcaaccaguggcucuccaagcuggagcgggagacccugcagaagcgcgaggaggagcuccgggagcugcgccacgcgagccggcugagcaagaaggucaccaucgacuucgccgggcgcaagauccucgaggaggagaacucccuggccgaguaccacagccggcuggacgagaccauccaggccaucgccaacggcacgcucaaccagccgcugaccaagcuggaccgcuccagcgaggagccccucggggugcuggugaaccccaacauguaccaguccccgccccagugggucgaccacaccggcgcggccagccagaagaaggccuuccgcuccagcggguucggccuggaguucaacuccuuccagcaccagcuccggauccaggaccaggaguuccaggagggcuucgacgggggcuggugccugagcgugcaccagcccugggccucccugcucgugcgcgggaucaagcgggucgagggccgcagcugguacacgccccaccgggggcgccuguggaucgccgcgacggccaagaagcccuccccgcaggaggugagcgagcugcaggccaccuaccggcugcuccgcggcaaggacguggaguuccccaacgacuaccccuccggcugccugcuggggugcgucgaccucaucgacugccugagccagaagcaguucaaggagcaguuccccgacaucucccaggagagcgacuccccguucguguucaucugcaagaacccccaggagauggucgugaaguuccccaucaagggcaaccccaagaucuggaagcuggacagcaagauccaccagggggccaagaagggccucaugaagcagaacaaggccguguga

SEQ ID NO: 38129 - RNA, 1431 nt, Artificial Sequence
  derived and/or modified sequence opt1 from TRIP6__Homo_sapiens__XP_011514847
augagcggccccaccuggcugccgcccaagcagcccgagcccgcccgcgccccgcaggggcgggcgaucccccgcggcacccccgggcccccgcccgcccacggcgccgcccuccagccccacccccgggugaacuucugcccgcugcccuccgagcagugcuaccaggcccccgggggccccgaggaccgcggcccggcgugggucgggagccacggcgugcugcagcacacgcaggggcuccccgccgaccggggcgggcugcgccccggcucccuggacgccgagaucgaccuccugagcuccacccuggccgagcucaacggcgggcggggccacgcgagccgccggcccgaccgccaggccuacgagccgcccccgcccccggccuaccggaccgggucccugaagcccaaccccgccagcccccugccggccucccccuacggcggccccaccccggcgagcuacacgaccgccuccacccccgccgggcccgccuuccccgugcaggucaagguggcccagccggugcgcggcugcgggccgccccggcgcggcgcgagccaggccuccgggccccuccccggcccccacuucccccugcccggccgcggggaggucuggggcccgggguaccggagccagcgggagcccggccccggggccaaggaggaggccgccggcguguccggccccgcggggcgcggccgcgggggcgagcacgggccccaggugccccugagccagccgcccgaggacgagcucgaccggcugaccaagaagcugguccacgacaugaaccacccgcccuccggcgaguacuucggccagugcgggggcugcggggaggacguggugggcgacggcgccggggucguggcccucgaccggguguuccacgucggcugcuucgugugcagcacgugccgcgcccagcugcgcgggcagcacuucuacgccguggagcggcgcgcguacugcgagggcugcuacgucgccacccuggagaagugcgcgaccugcucccagcccauccucgaccggauccugcgcgccauggggaaggccuaccaccccggcugcuucacgugcguggugugccaccggggccuggacgggauccccuucaccgucgacgccaccagccagauccacugcaucgaggacuuccaccgcaaguucgcgccccggugcagcgugugcggcggggccaucaugcccgagccgggccaggaggagaccgugcgcaucgucgcccucgaccgguccuuccacaucgggugcuacaagugcgaggagugcggccugcugcucagcuccgagggcgagugccaggggugcuacccccuggacggccacauccugugcaaggccugcagcgccuggcgcauccaggagcucuccgccaccgugacgaccgacugcuga

SEQ ID NO: 38130 - RNA, 261 nt, Artificial Sequence
  derived and/or modified sequence opt1 from TRIQK__Homo_sapiens__XP_011515284
augggccgcaaggacgccgccaccaucaagcugcccguggaccaguaccggaagcagaucgggaagcaggacuacaagaagaccaagccgauccuccgcgcgacgaagcugaaggccgaggccaagaagaccgccaucggcaucaaggaggucgggcuggugcucgccgcgauccuggcccugcuccuggccuucuacgccuucuucuaccugcggcucaccaccgacguggaccccgaccuggaccaggacgaggacuga

SEQ ID NO: 38131 - RNA, 1020 nt, Artificial Sequence
  derived and/or modified sequence opt1 from TRMT10A__Homo_sapiens__NP_001128137
augagcuccgagaugcugcccgccuucaucgagaccagcaacguggacaagaagcagggcaucaacgaggaccaggaggagucccagaagccgcgccucggggagggcugcgagcccaucagcaagcggcagaugaagaagcugaucaagcagaagcagugggaggagcagcgcgagcugcggaagcagaagcgcaaggagaagcggaagcgcaagaagcucgagcggcagugccagauggagcccaacuccgacgggcacgaccgcaagcggguccgccgggacguggugcacagcacccugcgccugaucaucgacugcuccuucgaccaccucaugguccugaaggacaucaagaagcugcacaagcagauccagcggugcuacgccgagaaccgccgggcgcuccaccccgugcaguucuaccugacgagccacggcgggcagcugaagaagaacauggacgagaacgacaagggcugggugaacuggaaggacauccacaucaagccggagcacuacuccgagcucaucaagaaggaggaccugaucuaccugaccagcgacucccccaacauccucaaggagcuggacgagagcaaggccuacgucaucggcgggcugguggaccacaaccaccacaagggccucaccuacaagcaggccuccgacuacgggaucaaccacgcccagcugccccugggcaacuucgugaagaugaacagccgcaagguccucgccgugaaccacguguucgagaucauccuggaguaccuggagacccgggacuggcaggaggcguucuucacgauccucccccagcgcaagggggccgucccgaccgacaaggccugcgaguccgccagccacgacaaccaguccgugcggauggaggagggcggcagcgacuccgacagcagcgaggaggaguacucccgcaacgagcuggacagcccccacgaggagaagcaggacaaggagaaccacaccgaguccaccgugaacagccugccccacuga

SEQ ID NO: 38132 - RNA, 1347 nt, Artificial Sequence
  derived and/or modified sequence opt1 from TRMT12__Homo_sapiens__NP_060426
augcgcgagaacguggucgugagcaacauggagcgggaguccggcaagcccguggccgucguggccguggucaccgagccgugguucacccagcgcuaccgggaguaccugcagcgccagaagcuguucgacacgcagcaccggguggagaagaugcccgacgggagcguggcgcugcccguccugggcgagacccuccccgagcagcaccuccaggagcugcgcaaccggguggccccggggucccccugcaugcucacccagcugcccgaccccgugccgagcaagcgcgcccagggcugcucccccgcccagaagcugugccucgaggucagccgguggguggaggggcgcggcgugaagugguccgccgagcuggaggcggaccugccccggagcuggcagcgccacggcaaccuccugcugcucuccgaggacugcuuccaggccaagcaguggaagaaccuggggcccgagcugugggagaccgucgcccucgcccugggcgugcagcggcuggcgaagcgcgggcgggugagcccggacggcacgcgcacccccgccgucacccuccugcugggggaccacggcuggguggagcacguggacaacggcauccgguacaaguucgacgucacccagugcauguucuccuucgggaacaucacggagaagcuccgcguggccagccuguccugcgccggcgaggugcuggucgaccucuacgccgggaucggcuacuucacccugcccuuccuggugcacgcgggcgccgccuucguccacgccugcgaguggaacccccacgccgugguggcgcuccggaacaaccuggagaucaacggggucgccgaccgcugccagauccacuucggcgacaaccggaagcugaagcucagcaacaucgccgaccgcgugauccuggggcugaucccguccagcgaggagggcuggcccaucgccugccaggugcuccgccaggacgccgggggcauccugcacauccaccagaacgucgaguccuuccccggcaagaaccugcaggcgcucggggugagcaagguggagaaggagcacuggcuguacccccagcagaucaccaccaaccaguggaagaacggcgccacgcgggacucccgcgggaagaugcugagcccggccaccaagcccgaguggcagcggugggccgagagcgccgagacccgcaucgcgacccuccugcagcagguccacggcaagcccuggaagacgcagauccugcacauccagcccgugaaguccuacgccccgcacguggaccacaucguccucgaccuggagugcugccccugccccagcgugggguga

SEQ ID NO: 38133 - RNA, 1893 nt, Artificial Sequence
  derived and/or modified sequence opt1 from TRMT1__Homo_sapiens__NP_001136026
augcagggcagcucccuguggcucagccugaccuuccgcuccgcccgggugcugagccgcgcccgguucuucgaguggcagucccccgggcuccccaacaccgcggccauggagaacggcacggggcccuacggcgaggagcgcccccgggagguccaggagaccaccgugaccgagggggccgccaagaucgccuuccccagcgcgaacgagguguucuacaacccgguccaggaguucaaccgcgaccugacgugcgccgugaucaccgaguucgcccggauccagcugggcgccaagggcauccagaucaaggugcccggggagaaggacacccagaaggucgugguggaccucuccgagcaggaggaggagaaggucgagcugaaggagagcgagaaccuggcguccggcgaccagccccgcaccgccgccgugggggagaucugcgaggagggccuccacgugcuggaggggcuggccgccagcggccuccgguccauccgcuucgcgcuggagguccccggccugcggagcgugguggccaacgacgccuccacgcgcgccgucgaccucauccggcgcaacgugcagcugaacgacguggcccaccugguccagccgagccaggcggacgcccggaugcucauguaccagcaccagcgcguguccgagcgguucgacgugaucgaccuggaccccuacgggagccccgccaccuuccuggacgccgccguccaggcgguguccgagggcgggcuccugugcgugaccugcaccgacauggccguccuggccggcaacagcggcgagacgugcuacuccaaguacggggccauggcccucaagagccgcgcgugccacgagauggcccugcggaucgugcugcacagccucgaccugcgcgccaacugcuaccagcgguucgucgugccccugcucuccaucagcgccgacuucuacgugcgcgucuucgugcgcguguucaccggccaggcgaaggucaaggccuccgcccgggccaaguucagcgccgcgugcgggccgcccgugacccccgagugcgagcacugcggccagcgccaccagcucgggggccccaugugggccgagccgauccacgaccuggacuucgugggccggguccuggaggccguguccgccaaccccgggcgcuuccacaccagcgagcggauccgcggcgugcuguccgucaucacggaggagcugcccgacgugccccucuacuacacccuggaccagcugagcuccaccauccacugcaacaccccgagccuccugcagcugcgguccgcccuccugcacgcggacuuccgcgugagccugucccacgccugcaagaacgccgucaagacggacgcccccgccagcgcgcucugggacaucaugcggugcugggagaaggagugccccgugaagcgcgagcggcuguccgagaccagccccgccuuccgcauccuguccguggagccgcggcuccaggccaacuucaccauccgcgaggacgccaaccccagcucccggcagcgcgggcugaagcgguuccaggcgaaccccgaggccaacuggggcccccgcccgcgggcccgccccgggggcaaggccgccgacgaggcgauggaggagcgccggcgccugcugcagaacaagcggaaggagcccccggaggacgucgcccagcgcgccgcccggcucaagaccuuccccugcaagcgcuucaaggagggcacgugccagcgcggggaccagugcugcuacagccacagcccgcccaccccgcggguguccgccgacgcggcccccgacugccccgagaccagcaaccagaccccgcccggccccggggccgccgccggccccgggaucgacuga

SEQ ID NO: 38134 - RNA, 2274 nt, Artificial Sequence
  derived and/or modified sequence opt1 from TRMT44__Homo_sapiens__NP_689757
auggccgaggugggccgcaccgggaucagcuaccccggcgcccugcucccgcagggguucugggcggccgucgagguguggcuggagcggccccagguggccaacaagcgccugugcggcgcccggcucgaggcccgcugguccgcggcccugcccugcgccgaggcccgggggcccggcaccagcgcgggcuccgagcagaaggagcgcgggccgggccccgggcagggcagccccgggggcggccccgggccgcggucccugagcggccccgagcaggggacggccugcugcgagcucgaggaggcccagggccagugccagcaggaggaggcccagcgcgaggccgcguccgucccccugcgggacagcggccaccccgggcacgccgagggccgcgagggggacuucccggccgccgaccuggacucccucugggaggacuucagccagucccuggcccggggcaacagcgagcugcucgcguuccugaccuccagcggggccggcucccagcccgaggcccagcgcgagcuggacguggugcuccggaccgucauccccaagaccagcccccacugcccgcugacgacgccccgccgggagaucguggugcaggacguccugaacggcaccaucaccuuccucccccuggaggaggacgacgaggggaaccugaaggugaagauguccaacguguaccagauccagcucagccacuccaaggaggagugguucaucagcguccugaucuucugccccgagcgcuggcacagcgacggcaucguguacccgaagcccaccuggcugggggaggagcuccuggccaagcuggccaagugguccguggagaacaagaaguccgacuucaagagcacccucagccugaucuccaucaugaaguacagcaaggcguaccaggagcugaaggagaaguacaaggagauggucaagguguggcccgaggugaccgaccccgagaaguucgucuacgaggacguggccaucgccgccuaccuccugauccugugggaggaggagcgggccgagcgccggcucaccgcgcgccaguccuucguggaccugggcugcgggaacggccugcucguccacauccugagcuccgagggccacccggggcggggcaucgacgugcgccgccggaagaucugggacauguacgggccccagacgcagcuggaggaggacgccaucacccccaacgacaagacccucuuccccgacguggacuggcugaucggcaaccacagcgacgagcugaccccguggauccccgucaucgccgcccgcuccagcuacaacugccgguucuucgugcuccccugcugcuucuucgacuucaucgggcgcuacucccggcgccagagcaagaagacgcaguaccgggaguaccuggacuucaucaaggaggucggcuucacgugcggcuuccacguggacgaggacugccugcgcaucccguccaccaagcgggugugccucgucggcaagagccgcaccuaccccuccagccgggaggcguccguggacgagaagcgcacccaguacaucaagagccggcgcgggugccccgugagcccgcccgggugggagcugucccccagcccccggugggucgccgccggcuccgccggccacugcgacgggcagcaggcccuggacgcgcgcgugggcugcgugacccgggccugggccgccgagcacggggccggcccccaggcggaggggccguggcuccccggcuuccacccccgcgagaaggccgagcggguccgcaacugcgccgcccugccccgcgacuucaucgaccagguggugcugcaggucgccaaccugcuccugggcgggaagcagcugaacacccggagcucccgcaacggcagccucaagaccuggaacgggggcgagucccugagccuggcggagguggccaacgagcucgacacggagacccugcggcgccugaagcgggagugcgggggccuccagacccugcugcgcaacucccaccagguguuccaggucgugaacggccgggugcacauccgcgacuggcgggaggagacccucuggaagacgaagcagccggaggccaagcagcgccugcugagcgaggccugcaagacccggcucugcugguucuucaugcaccaccccgacgggugcgcgcuguccaccgacugcugccccuucgcccacggccccgccgagcugcgcccgccccggaccacgccccgcaagaagaucagcuga

SEQ ID NO: 38135 - RNA, 1530 nt, Artificial Sequence
  derived and/or modified sequence opt1 from TRMT5__Homo_sapiens__NP_065861
auggugcuguggauccucuggcgccccuucggcuucagcgggcgguuccugaagcuggagucccacagcaucaccgaguccaagagccucaucccggucgccuggaccucccugacgcagaugcugcucgaggcccccggcaucuuccugcuggggcagcgcaagcgguucagcaccaugcccgagaccgagacccacgagcgcgagacggagcuguucuccccgcccagcgacgugcggggcaugaccaagcucgaccgcaccgcguucaagaagaccgugaacauccccguccugaaggugcggaaggagaucguguccaagcucaugcgcagccugaagcgggccgcccugcagcgccccgggauccggcgcgucaucgaggaccccgaggacaaggagucccggcucaucaugcuggacccguacaagaucuucacgcacgacagcuucgagaaggccgagcuguccgugcucgagcagcugaacgugagcccccagaucuccaaguacaaccuggagcucaccuacgagcacuucaagagcgaggagauccugcgcgccguccugcccgagggccaggacgugaccuccggcuucagccggaucgggcacaucgcgcaccucaaccugcgcgaccaccagcugcccuucaagcaccucaucggccaggugaugaucgacaagaacccggggaucaccuccgccgucaacaagaucaacaacaucgacaacauguaccggaacuuccagauggaggugcugagcggcgagcagaacaugaugacgaaggugcgcgagaacaacuacaccuacgaguucgacuucagcaaggucuacuggaacccccggcuguccaccgagcacagccgcaucaccgagcuccugaagcccggggacgugcuguucgacguguucgccggcgucggccccuucgccaucccgguggcgaagaagaacugcacgguguucgccaacgaccucaaccccgagucccacaaguggcugcuguacaacugcaagcucaacaaggucgaccagaaggugaagguguucaaccuggacgggaaggacuuccugcagggccccgucaaggaggagcucaugcagcugcuggggcucagcaaggagcggaagcccuccgugcacgucgugaugaaccugccggccaaggccaucgaguuccugagcgccuucaaguggcuccuggacggccagcccugcuccagcgaguuccugcccaucgugcacugcuacuccuucagcaaggacgcgaaccccgccgaggacguccgccagcgcgccggcgccgugcucgggaucucccuggaggccugcagcuccgugcaccugguccggaacguggcgccgaacaaggagaugcugugcaucaccuuccagauccccgccagcgugcucuacaagaaccagacccgcaaccccgagaaccacgaggacccgccccugaagcggcagcgcaccgccgaggccuucuccgacgagaagacgcagaucgucagcaacaccuga

SEQ ID NO: 38136 - RNA, 924 nt, Artificial Sequence
  derived and/or modified sequence opt1 from TRMU__Homo_sapiens__NP_001269711
augaugugcagcggcgccgacgccaucgcgaccgggcacuacgcccgcaccucccuggaggacgaggagguguucgagcagaagcacgucaagaagcccgagggccucuuccggaaccgcuucgaggugcggaacgccgugaagcugcugcaggccgccgacagcuucaaggaccagacguucuuccucucccaggucagccaggacgcgcugcgccggaccaucuucccgcucgggggccugaccaaggaguucgugaagaagaucgccgccgagaaccgccugcaccacgugcugcagaagaaggaguccauggggaugugcuucaucggcaagcggaacuucgagcacuuccuccugcaguaccugcagccccgccccggccacuucaucagcaucgaggacaacaagguccucgggacccacaagggcugguuccuguacacgcuggggcagcgggccaacaucggcgggcuccgcgagcccugguacgugguggagaaggacuccgucaagggcgacguguucguggcgccgcggaccgaccaccccgcccuguaccgcgaccugcuccggaccagccgcguccacuggaucgccgaggagccgcccgccgcccuggugcgggacaagaugauggagugccacuuccgcuuccggcaccagauggcgcuggugcccugcguccucacccugaaccaggacggcacggugugggugaccgccguccaggccgugcgcgcccuggccaccgggcaguucgcgguguucuacaagggcgacgagugccucggguccggcaagauccugcggcugggccccagcgccuacacccuccagaaggggcagcgccgggccggcauggccacggagucccccagcgacucccccgaggacgggccgggccugagcccccugcucuga

SEQ ID NO: 38137 - RNA, 4296 nt, Artificial Sequence
  derived and/or modified sequence opt1 from TRO__Homo_sapiens__NP_001034794
auggaccgccggaacgacuacggcuaccgcgugccccuguuccaggggccgcucccgccgcccggcagccuggggcugcccuucccgcccgacauccagaccgagaccacggaggaggacuccguccuccugaugcacacccugcucgccgccaccaaggacagccuggcgauggacccgcccguggugaaccggcccaagaaguccaagaccaagaaggcccccaucaagacgaucaccaaggccgcccccgccgcgccgcccguccccgccgccaacgagaucgccaccaacaagcccaagaucaccuggcaggcgcugaaccuccccgugaucacgcagaucagccaggcccugcccaccaccgaggugaccaacacgcaggccuccagcgucaccgcccagcccaagaaggccaacaagaugaagcgcgugaccgcgaaggccgcccagggcucccagagccccaccgggcacgagggcggcacgauccagcugaaguccccgcuccaggugcugaagcugcccgucaucagccagaacauccacgcccccaucgccaacgaguccgcgagcucccaggcccucaucaccagcaucaagcccaagaaggccuccaaggccaagaaggccgcgaacaaggccaucgccagcgccaccgaggugucccuggccgcgaccgccacgcacaccgccaccacccaggggcagaucacgaacgagaccgccagcauccacaccaccgcggccuccauccggacgaagaaggccagcaaggcccgcaagaccaucgccaaggugaucaacaccgacaccgagcacaucgaggcgcugaacgucacggacgccgccacccggcagaucgaggccagcgugguggccauccgcccgaagaaguccaagggcaagaaggcggccagccgggggcccaacuccgucagcgagaucuccgaggcgccccucgccacccagaucgugaccaaccaggcccuggccgccacgcugcgcgugaagcggggcagccgcgcccggaaggccgcgaccaaggcccgcgccaccgagucccagacccccaacgccgaccagggggcccaggcgaagaucgccagcgcccagaccaacgucuccgcccucgagacccagguggccgcggccgugcaggcccuggccgacgacuaccuggcccagcucagccuggagccgacgacccggacccgcggcaagcggaaccgcaaguccaagcaccugaacggcgacgagcggagcggguccaacuaccgccggauccccuggggccgccgccccgcgccgccccgggacgucgccauccuccaggagcgcgccaacaagcuggugaaguaccugcucgugaaggaccagacgaagauccccaucaagcggagcgacaugcugcgcgacgucauccaggaguacgacgaguacuuccccgagaucaucgagcgggccuccuacacccuggagaagauguuccgcgugaaccucaaggagaucgacaagcagagcucccuguacauccugaucagcacccaggaguccagcgcggggauccucggcaccacgaaggacacccccaagcugggccugcucauggucauccugagcgugaucuucaugaacgggaacaaggccuccgaggccgugaucugggagguccugcggaagcucggccugcgccccggggugcggcacagccuguucggcgaggugcgcaagcucaucaccgacgaguucgucaagcagaaguaccuggaguacaagcgggugcccaacucccggcccccggaguacgaguucuucugggggcugcgcagcuaccacgagaccuccaagaugaaggugcucaaguucgccugccgcguccagaagaaggaccccaaggacugggccgugcaguaccgggaggcgguggagauggagguccaggccgccgccguggccguggcggaggccgaggcccgcgccgaggcccgggcgcagaugggcaucggcgaggaggccgucgccgggcccuggaacugggacgacauggacaucgacugccugacgcgcgaggagcugggcgacgacgcccaggccuggagccgguucuccuucgagaucgaggcgcgcgcccaggagaacgccgacgccagcaccaacgugaacuucucccgcggggcgagcacccgggccggcuucuccgacggggccagcaucuccuucaacggcgcccccagcuccagcggcggguucuccggcgggccgggcaucaccuucgggguggcccccagcacgagcgcguccuucagcaacaccgccuccaucagcuucggcggcacccuguccaccagcuccagcuucuccagcgccgccuccaucagcuucgggugcgcccacuccacgagcaccuccuucagcuccgaggcgagcaucuccuucggcgggaugcccugcaccagcgccagcuucuccggcggcgucagcuccagcuucuccgggccccucagcaccuccgccacguucagcggcggggccuccagcggcuucgggggcacccuguccaccaccgccggcuucagcggggugcuguccacgagcaccuccuucggcagcgcgccgaccaccuccacgguguucagcuccgcccucagcaccagcaccggguucggcgggauccuguccaccagcgucugcuucggcggcucccccagcuccagcggguccuucggcgggacgcugagcaccuccaucugcuucggcgggagccccugcaccuccaccggcuucggcgggacccucagcacguccgugagcuucggcggguccagcuccaccagcgccaacuucggcgggacccuguccaccagcaucugcuucgacggcagccccuccacgggcgccggguucggcggggcgcugaacaccagcgccuccuucggcagcgugcucaacaccuccaccggcuucgggggcgccaugagcacguccgccgacuucgggggcacccugagcaccuccgucugcuucgggggcagcccgggcaccuccgugagcuucggguccgcccugaacacgaacgcgggcuacgggggcgccgugagcaccaacaccgacuucgggggcacccucuccacgagcgucugcuucggcgggucccccagcaccuccgccggcuucgggggcgcccugaacaccaacgccagcuucgggugcgcggugagcaccuccgccagcuucuccggcgccgugagcacguccgccugcuucagcggcgcccccaucaccaaccccggguucggcggggcguucuccaccagcgccggcuucggcggggcccuguccaccgccgcggacuucggcgggacgccgagcaacuccaucggcuucggggccgcccccagcaccuccgucagcuucggcggcgcccacgggaccucccucugcuucggcggggcccccagcaccucccugugcuucggcagcgcguccaacacgaaccugugcuucgggggcccgcccagcaccagcgccugcuucuccggcgccaccagccccuccuucugcgacgggcccagcaccuccacgggcuucagcuucgggaacggccucuccaccaacgccggguucggcggcgggcugaacaccagcgccggcuucgggggcgggcugggcaccuccgcgggcuucagcgggggccucuccacgagcuccggguucgacggcggccuggggaccagcgccggcuucgggggcgggccgggcaccuccaccggcuucgggggcgggcugggcaccagcgccggguucuccggcggccucgggacgagcgccggcuucgggggcgggcuggugaccagcgacggcuucggcgggggccuggggaccaacgccuccuucggcagcacccucgggacguccgcgggcuucagcggcgggcuguccaccagcgacggcuucgggucccgccccaacgccagcuucgaccggggccuguccaccaucaucggcuucgggagcggcuccaacaccagcacgggguucaccggcgagcccuccaccagcaccggguucuccagcggccccuccagcaucgugggcuucuccgggggcccgagcacgggggucggcuucugcagcgggcccuccaccagcggcuucuccggcgggcccagcaccggcgccggguucggcgggggccccaacaccggcgccggguucggcgggggcccguccacgagcgccggcuucggguccggcgcggccagccucggggccugcggcuucuccuacggguga

SEQ ID NO: 38138 - RNA, 1578 nt, Artificial Sequence
  derived and/or modified sequence opt1 from TROVE2__Homo_sapiens__NP_001035828
auggaggagagcgugaaccagaugcagccccugaacgagaagcagaucgccaacucccaggacggcuacgucuggcaggucaccgacaugaaccgccuccaccgguuccugugcuucgggagcgagggcgggaccuacuacaucaaggagcagaagcugggccucgagaacgccgaggcgcugauccgccugaucgaggacgggcggggcugcgaggugauccaggagaucaaguccuucagccaggagggccgcacgaccaagcaggagccgaugcuguucgcccuggccaucugcucccagugcagcgacaucuccaccaagcaggccgccuucaaggcggugagcgaggugugccggauccccacccaccuguucacguucauccaguucaagaaggaccucaaggaguccaugaagugcgggauguggggccgcgcccugcggaaggccaucgccgacugguacaacgagaagggcgggauggcgcuggcccucgccgugaccaaguacaagcagcgcaacggguggagccacaaggaccugcugcggcucucccaccugaagcccagcuccgagggccuggccaucgucaccaaguacaucaccaagggcuggaaggaggugcacgagcucuacaaggagaaggcccugagcguggagacggagaagcugcucaaguaccuggaggcggucgagaaggugaagcgcacccgggacgagcuggaggugauccaccucaucgaggagcaccgccugguccgggagcaccuccucaccaaccaccugaaguccaaggagguguggaaggcccugcuccaggagaugccccugaccgcccugcuccgcaaccuggggaagaugacggccaacagcgugcuggagccgggcaacuccgaggucagccucgugugcgagaagcugugcaacgagaagcugcucaagaaggcccggauccaccccuuccacauccugaucgcgcuggagaccuacaagaccgggcacggccuccgcggcaagcugaaguggcggcccgacgaggagauccugaaggcccucgacgccgccuucuacaagaccuucaagacgguggagcccaccgggaagcgcuuccugcuggccgucgacguguccgcgagcaugaaccagcgggugcucggcagcauccugaacgccuccaccgucgccgccgccaugugcaugguggugacccgcacggagaaggacagcuacgucguggcguucuccgacgagauggucccgugccccgugaccaccgacaugacccugcagcagguccugauggccaugagccagauccccgccgggggcacggacugcucccuccccaugaucugggcccagaagaccaacaccccggcggacguguucaucguguucaccgacaacgagacguucgccgggggcgugcaccccgccaucgcccugcgggaguaccgcaagaagauggacauccccgccaagcugaucgucugcggcaugaccagcaacggguucaccaucgcggaccccgacgaccgcgcccuccagaacacccugcugaacaaguccuucuga

SEQ ID NO: 38139 - RNA, 3435 nt, Artificial Sequence
  derived and/or modified sequence opt1 from TRPA1__Homo_sapiens__XP_011515926
augagcaucuccaugaagaagggcgcccgcgcccgcggggagcagcugcaccagguggcgagcggcgucggguccaugaagcggagccuccggaagauguggcgccccggcgagaagaaggagccgcagggggugguguacgaggacguccccgacgacaccgaggacuucaaggagucccugaaggugguguucgagggcagcgccuacggccugcagaacuucaacaagcagaagaagcucaagcggugcgacgacauggacaccuucuuccugcacuacgccgccgccgaggggcagaucgagcugauggagaagaucacgcgcgacuccagccucgagguccugcacgagauggacgacuacggcaacacgccccugcacugcgcgguggagaagaaccagaucgaguccgugaaguuccuccugagccgcggggccaaccccaaccugcggaacuucaacaugauggccccgcuccacaucgccguccagggcaugaacaacgaggugaugaaggugcugcuggagcaccggaccaucgacgucaaccucgagggggagaacggcaacaccgcggugaucaucgccugcaccaccaacaacuccgaggcccugcagauccugcucaagaagggcgccaagcccugcaagagcaacaagugggggugcuuccccauccaccaggccgcguucuccggcagcaaggagugcauggagaucauccugcgcuucggggaggagcacggcuacucccggcagcugcacaucaacuucaugaacaacggcaaggccacgccccuccaccuggccgugcagaacggggaccuggagaugaucaagaugugccucgacaacggcgcccagaucgacccggucgagaaggggcgcugcaccgccauccacuucgcggccacccagggcgccaccgagaucgugaagcugaugaucagcuccuacagcggguccguggacaucgucaacaccaccgacggcugccacgagacgaugcugcaccgggccagccucuucgaccaccacgagcuggccgacuaccugaucagcgugggcgcggacaucaacaagaucgacuccgaggggcgcagcccccucauccuggccaccgccuccgccagcuggaacaucgugaaccugcuccuguccaagggcgcccaggucgacaucaaggacaacuucgggcggaacuuccugcaccucaccgugcagcagcccuacggccugaagaaccugcgccccgaguucaugcagaugcagcagaucaaggagcucgugauggacgaggacaacgacgggugcaccccgcugcacuacgcgugccggcagggcggccccgggagcgucaacaaccugcucggcuucaacguguccauccacagcaaguccaaggacaagaaguccccgcugcacuucgccgccagcuacgggcgcaucaacacgugccagcggcugcuccaggacaucagcgacacccgccugcugaacgagggcgaccuccacgggaugacgccccugcaccuggccgcgaagaacggccacgacaaggucgugcagcugcuccugaagaagggcgcccuguuccucuccgaccacaacggguggaccgcccugcaccacgccagcaugggcggguacacccagaccaugaaggugauccuggacaccaaccucaagugcaccgaccggcuggacgaggacggcaacacggcccugcacuucgcggcccgcgagggccacgccaaggccgucgcccuccugcugucccacaacgcggacaucgugcucaacaagcagcaggccagcuuccugcaccuggcccuccacaacaagcgcaaggaggugguccugaccaucauccgguccaagcgcugggacgagugccugaagaucuucagccacaacucccccgggaacaagugccccaucaccgagaugaucgaguaccuccccgagugcaugaaggugcugcuggacuucugcaugcuccacagcaccgaggacaagagcugccgggacuacuacaucgaguacaacuucaaguaccugcagugcccccuggaguucacgaagaagaccccgacccaggacgugaucuacgagccccucaccgcccugaacgccaugguccagaacaaccgcaucgagcugcucaaccaccccgugugcaaggaguaccugcugaugaaguggcucgcguacggcuuccgggcccacaugaugaaccugggguccuacugccugggccucauccccaugacgauccugguggucaacaucaagccggggauggccuucaacagcaccggcaucaucaacgagaccuccgaccacagcgagauccuggacaccacgaacuccuaccucaucaagaccugcaugauccugguguuccugagcuccaucuucggcuacugcaaggaggccgggcagaucuuccagcagaagcgcaacuacuucauggacaucagcaacgugcucgaguggaucaucuacaccaccggcaucaucuucguccugccccuguucguggagauccccgcgcaccuccaguggcagugcggggccaucgccguguacuucuacuggaugaacuuccugcuguaccuccagcgguucgagaacugcggcaucuucaucgucaugcuggaggugauccugaagacccuccugcgcuccacgguggucuucaucuuccugcuccuggccuucgggcugagcuucuacauccuccugaaccugcaggaccccuucuccagcccgcuccuguccaucauccagaccuucagcaugaugcugggcgacaucaacuaccgggaguccuuccucgagcccuaccugcgcaacgagcuggcccaccccgugcucagcuucgcgcagcugguguccuucaccaucuucgucccgaucgugcugaugaaccuccugaucggccuggccgugggggacaucgccgagguccagaagcacgccagccucaagcggaucgccaugcaggucgagcugcacaccagccuggagaagaagcucccccugugguuccugcgcaagguggaccagaaguccacgaucguguaccccaacaagccccggagcggcgggaugcuguuccacaucuucugcuuccucuucugcaccggcgagauccgccaggagaucccgaacgcggacaagucccuggagauggagauccucaagcagaaguaccggcugaaggaccugaccuuccuccuggagaagcagcacgagcugaucaagcucaucauccagaagauggagaucaucagcgagaccgaggacgacgacucccacugcagcuuccaggaccgcuucaagaaggagcagauggagcagcggaacucccgcuggaacacggugcugcgggccgugaaggccaagacccaccaccuggagcccuga

SEQ ID NO: 38140 - RNA, 2382 nt, Artificial Sequence
  derived and/or modified sequence opt1 from TRPC1__Homo_sapiens__NP_001238774
augauggccgcccuguaccccagcaccgaccucuccggcgcgagcuccagcucccugccgagcucccccagcuccagcucccccaacgaggugauggcccugaaggacguccgcgaggugaaggaggagaacacccucaacgagaagcuguuccugcucgccugcgacaagggggacuacuacauggugaagaagauccuggaggagaacagcuccggcgaccugaacaucaacugcgucgacgugcucgggcggaacgccgugacgaucaccaucgagaacgagaaccuggacauccugcagcuccugcuggacuacggcugccagagcgccgacgcgcuccuggucgccaucgacuccgagguggugggggccgucgacauccugcucaaccaccgccccaagcggagcucccgcccgaccaucgugaagcugauggagcggauccagaaccccgaguacagcaccacgauggacguggcccccgucauccuggcggcccaccgcaacaacuacgagauccucaccaugcugcugaagcaggacgugucccuccccaagccgcacgccgugggcugcgagugcacccugugcagcgccaagaacaagaaggacagccugcggcacucccgcuuccggcucgacaucuaccgcugccuggccagccccgcgcugaucaugcucaccgaggaggaccccauccugcgggccuucgagcuguccgccgaccucaaggagcugagccuggucgagguggaguuccgcaacgacuacgaggagcucgcccggcagugcaagauguucgccaaggaccugcuggcgcaggcccgcaacucccgggagcucgaggugauccugaaccacacgagcuccgacgagccccuggacaagcgcggccuccuggaggagcggaugaaccugagccgccucaagcuggccaucaaguacaaccagaaggaguucgucucccagagcaacugccagcaguuccugaacaccgugugguucgggcagauguccggcuaccggcgcaagccgaccugcaagaagaucaugaccgugcucacggucgggaucuucuggcccgugcugagccugugcuaccugaucgcccccaagucccaguucggccggaucauccacacccccuucaugaaguucaucauccacggggccagcuacuucaccuuccuccugcugcucaaccuguacucccugguguacaacgaggacaagaagaacaccaugggcccggcgcucgagcgcaucgacuaccugcugauccucuggaucaucggcaugaucuggagcgacaucaagcgccugugguacgaggggcuggaggacuuccucgaggagucccggaaccagcugagcuucgucaugaacucccuguaccucgccacguucgcccugaagguggucgcccacaacaaguuccacgacuucgccgaccgcaaggacugggacgcguuccaccccacccugguggccgagggccucuucgccuucgccaacgugcugagcuaccugcgccucuucuucauguacaccaccagcuccauccuggggccccugcagaucagcaugggccagaugcuccaggacuucggcaaguuccuggggauguuccugcucguccuguucuccuucacgaucggccugacccagcucuacgacaagggguacaccagcaaggagcagaaggacugcgugggcaucuucugcgagcagcaguccaacgacaccuuccacagcuucaucgggacgugcuucgcgcuguucugguacaucuucucccuggcccacguggccaucuucgucacccgguucagcuacggcgaggagcuccaguccuucgugggcgccgugaucgucgggaccuacaacgugguggucgugaucgugcugaccaagcugcucgucgccaugcugcacaagagcuuccagcugaucgcgaaccacgaggacaaggaguggaaguucgcccgggccaagcucuggcuguccuacuucgacgacaagugcacgcugcccccgcccuucaacaucauccccagccccaagaccaucugcuacaugaucuccagccucuccaaguggaucugcagccacaccuccaagggcaaggugaagcgccagaacagccugaaggaguggcggaaccugaagcagaagcgcgacgagaacuaccagaaggugaugugcugccucguccaccgguaccugaccagcaugcgccagaagaugcaguccacggaccaggccaccguggagaaccugaacgagcuccggcaggaccugagcaaguuccgcaacgagauccgggaccugcucggguuccgcaccuccaaguacgccauguucuacccgcggaacuga

SEQ ID NO: 38141 - RNA, 2766 nt, Artificial Sequence
  derived and/or modified sequence opt1 from TRPC3__Homo_sapiens__NP_001124170
augagcaccaaggugcgcaagugcaaggagcaggcccgggucaccuuccccgccccggaggaggaggaggacgagggcgaggacgagggggcggagccccagcgccggcgccggggcuggcgcggggugaacggcgggcuggagccccgguccgcccccagccagcgcgagccgcacggcuacugcccgccgcccuucucccacggccccgaccucagcauggaggggucccccagccugcggcgcaugacggugaugcgggagaagggccgccggcaggccguccgcgggcccgccuucauguucaacgaccggggcaccucccugaccgccgaggaggagcgcuuccucgacgcggccgaguacgggaacauccccguggugcggaagaugcuggaggagagcaagacccugaacgucaacugcguggacuacaugggccagaacgcccuccagcuggccgugggcaacgagcaccuggaggucacggagcuccugcugaagaaggagaaccucgcgcgcaucggggacgcccugcugcucgccaucuccaagggcuacgugcggaucguggaggccauccugaaccaccccggguucgccgcgagcaagcgccugacccucucccccugcgagcaggagcugcaggacgacgacuucuacgccuacgacgaggacggcacccgguucagccccgacaucacccccaucauccuggccgcccacugccagaaguacgaggucgugcacaugcuccugaugaagggcgcccgcaucgagcgcccgcacgacuacuucugcaagugcggggacugcauggagaagcagcggcacgacuccuucagccacucccgcagccggaucaacgcguacaagggccuggccucccccgccuaccucagccuguccagcgaggaccccgugcugacggcccucgagcugagcaacgagcuggccaagcucgcgaacaucgagaaggaguucaagaacgacuaccgcaagcuguccaugcagugcaaggacuucgucgugggggugcuggaccucugccgggacagcgaggaggucgaggccauccugaacggcgaccuggaguccgccgagccccucgaggugcaccgccacaaggccagccugucccgggugaagcuggccaucaaguacgaggucaagaaguucguggcgcacccgaacugccagcagcagcuccugaccaucugguacgagaaccugagcgggcuccgcgagcagaccaucgccaucaagugccuggugguccugguggucgcccucggccugcccuuccuggccaucggcuacuggaucgcgcccugcucccggcucgggaagauccugcgcagccccuucaugaaguucguggcccacgccgccuccuucaucaucuuccugggccugcucguguucaacgccagcgaccgguucgaggggaucaccacgcugccgaacaucaccgucaccgacuaccccaagcagaucuuccgcgugaagaccacgcaguucaccuggaccgagaugcugaucaugguguggguccucggcaugaugugguccgagugcaaggagcuguggcuggaggggccccgggaguacauccuccagcuguggaacgugcuggacuucggcaugcucagcaucuucaucgcggccuucaccgcccgcuuccuggccuuccugcaggccacgaaggcgcagcaguacguggacuccuacguccaggagagcgaccucuccgaggugacccugcccccggagauccaguacuucaccuacgcccgggacaaguggcugcccagcgacccccagaucaucuccgagggccucuacgccaucgccgugguccugagcuucucccgcaucgccuacauccugccggcgaacgagagcuucgggccccuccagaucagccugggccggaccgugaaggacaucuucaaguucauggugcuguucaucauggucuucuucgccuucaugaucgggauguucauccucuacuccuacuaccugggcgccaaggugaacgccgcguucacgaccguggaggagagcuucaagacccuguucugguccaucuucgggcucagcgaggucaccuccguggugcugaaguacgaccacaaguucaucgagaacaucggcuacguccuguacggcaucuacaacgugacgaugguggucgugcuccugaacaugcugaucgccaugaucaacagcuccuaccaggagaucgaggacgacagcgacguggaguggaaguucgcccgcuccaagcucuggcugagcuacuucgacgacgggaagacccugcccccgcccuucucccucguccccagccccaaguccuucguguacuucaucaugcggaucgugaacuuccccaagugccgccgccggcgccugcagaaggacaucgagaugggcauggggaacagcaagucccggcugaaccucuucacccagagcaacucccgcgucuucgagagccacagcuucaacuccauccugaaccagccgacccgguaccagcagaucaugaagcgccugaucaagcgguacgugcucaaggcccagguggacaaggagaacgacgaggucaacgagggcgagcugaaggagaucaagcaggacaucagcucccugcgcuacgagcuccuggaggacaagagccaggccacggaggagcuggcgauccucauccacaagcuguccgagaagcugaaccccagcaugcuccggugcgaguga

SEQ ID NO: 38142 - RNA, 2370 nt, Artificial Sequence
  derived and/or modified sequence opt1 from TRPC4AP__Homo_sapiens__NP_955400
auggccgccgcgcccguggccgccggcagcggggccggccgcgggcggcgcuccgccgcgaccgucgccgccuggggcggguggggcggccggccgcgccccgggaacauccugcuccagcugcggcagggccagcugaccgggcgcggccucgugcgggccgugcaguucacggagaccuuccugaccgagcgcgacaagcagagcaagugguccgggaucccccagcugcuccugaagcugcacaccacgagccaccuccacuccgacuucgucgagugccagaacauccugaaggagaucagcccccugcucuccauggaggcgauggccuucgugaccgaggagcggaagcugacccaggagaccacguacccgaacaccuacaucuucgaccuguucggcggcguggaccuccuggucgagauccugaugcgccccaccaucagcauccgggggcagaagcucaagaucuccgacgagaugagcaaggacugccuguccauccuguacaacacgugcgugugcaccgagggcgugaccaagcgccucgccgagaagaacgacuucgucaucuuccuguucacccugaugaccagcaagaagacguuccuccagaccgccacccugaucgaggacauccugggggugaagaaggagaugauccggcucgacgaggugcccaaccuguccagccuggucuccaacuucgaccagcagcagcucgccaacuucugccgcauccuggcggugaccaucagcgagauggacacgggcaacgacgacaagcacacccugcucgccaagaacgcccagcagaagaagucccugagccugggccccuccgccgccgagaucaaccaggcggcccuccugagcaucccgggguucguggagcggcugugcaagcucgccacccgcaaggucagcgaguccaccggcacggccagcuuccugcaggagcuggaggagugguacaccuggcucgacaacgcccuggugcuggacgcgcucaugcggguggccaacgaggaguccgagcacaaccagggggccagcgaggagaacggccugccccacaccuccgcccgcacccagcugccccagagcaugaagaucaugcacgagaucauguacaagcucgagguccuguacgugcugugcgugcugcucauggggcggcagcgcaaccagguccaccggaugaucgccgaguucaagcugauccccggccugaacaaccucuucgacaagcugaucuggcgcaagcacuccgcgagcgcccuggugcuccacggccacaaccagaacugcgacugcuccccggacaucacgcugaagauccaguuccugcgccuccugcagagcuucuccgaccaccacgagaacaaguaccugcuccugaacaaccaggagcugaacgagcucagcgccaucucccugaaggccaacauccccgagguggaggcgguccugaacaccgaccggagccucgugugcgacgggaagcgcggccugcugacccggcuccugcaggucaugaagaaggagcccgccgaguccagcuuccgcuucuggcaggcccgggccguggaguccuuccugcgcgggaccacgagcuacgccgaccagauguuccuccugaagcggggccugcucgagcacauccuguacugcaucguggacuccgagugcaagagccgcgacguccugcagagcuacuucgaccuccugggggagcugaugaaguucaacguggacgcguucaagcgguucaacaaguacaucaacaccgacgccaaguuccagguguuccucaagcagaucaacuccagccuggucgacuccaacaugcuggugcgcugcgugacccucagccuggaccgguucgagaaccaggucgacaugaagguggccgaggugcuguccgagugccgccuccuggccuacaucagccagguccccacccagauguccuuccuguuccggcucaucaacaucauccacgugcagacgcugacccaggagaacgugagcugccugaacaccucccucgucauccugaugcuggcccgccggaaggagcgccucccgcuguaccugcggcuccugcagcgcauggagcacagcaagaaguaccccggcuuccugcucaacaacuuccacaaccugcugcgguucuggcagcagcacuaccuccacaaggacaaggacuccacgugccuggagaacagcuccugcaucagcuucuccuacuggaaggagaccgugagcauccugcucaaccccgaccgccagucccccagcgcgcuggugagcuacaucgaggagccguacauggacaucgaccgcgacuucaccgaggaguga

SEQ ID NO: 38143 - RNA, 2682 nt, Artificial Sequence
  derived and/or modified sequence opt1 from TRPC4__Homo_sapiens__NP_001129427
auggcccaguucuacuacaagcgcaacgugaacgcccccuaccgggaccgcaucccgcugcggaucguccgcgcggagagcgagcucucccccagcgagaaggccuaccugaacgccguggagaagggcgacuacgccuccgugaagaagucccuggaggaggccgagaucuacuucaagaucaacaucaacugcaucgacccccucgggcggaccgcgcugcugaucgccaucgagaacgagaaccucgagcugaucgagcugcuccugagcuucaacgucuacgugggcgacgcccugcuccacgccauccgcaaggagguggucggggcgguggagcugcugcucaaccacaagaagcccagcggcgagaagcaggucccgcccauccugcuggacaagcaguucuccgaguucacccccgacaucacgcccaucauccucgccgcccacaccaacaacuacgagaucaucaagcugcuggugcagaagggggugagcgugccgcggccccacgagguccgcugcaacugcguggagugcguguccagcuccgacgucgacagccuccggcacucccgcagccggcugaacaucuacaaggcccuggccucccccagccucaucgcgcuguccagcgaggaccccuuccugaccgccuuccagcucuccugggagcugcaggagcugagcaagguggagaacgaguucaagagcgaguacgaggagcucucccgccagugcaagcaguucgccaaggaccugcuggaccagacccggagcucccgcgagcucgagaucauccugaacuaccgggacgacaacagccugaucgaggagcaguccggcaacgaccucgcccgccugaagcuggccaucaaguaccggcagaaggaguucguggcgcagccgaacugccagcagcuccuggccagccgcugguacgacgaguuccccggcuggcggcgccggcacugggccgucaagauggugacgugcuucaucaucgggcuccuguuccccguguucuccgucugcuaccugaucgcccccaagagcccgcugggccucuucauccgcaagcccuucaucaaguucaucugccacaccgccuccuaccugaccuuccuguuccuccugcugcuggcgagccagcacaucgaccgcuccgaccucaaccggcaggggcccccgcccaccaucguggaguggaugauccugcccugggugcugggcuucaucuggggcgagaucaagcagaugugggacgggggccuccaggacuacauccacgacugguggaaccugauggacuucgucaugaacagccuguaccucgccacgaucucccugaagaucguggccuucgucaaguacagcgcccugaacccccgcgaguccugggacauguggcaccccacccucguggccgaggcgcuguucgccaucgccaacaucuucagcucccugcggcucaucagccuguucaccgccaacucccaccuggggccgcuccagaucagccugggccgcaugcugcucgacauccugaaguuccuguucaucuacugccucgugcugcuggcguucgccaacgggcucaaccagcuguacuucuacuacgaggagaccaagggccugacgugcaagggcauccggugcgagaagcagaacaacgccuucagcacccucuucgagacccugcagucccuguucuggagcaucuucgggcucaucaaccuguacgucaccaacgugaaggcccagcacgaguucacggaguucgugggcgccaccauguucgggaccuacaacgucaucucccugguggugcuccugaacaugcugaucgcgaugaugaacaacagcuaccagcucaucgccgaccacgccgacaucgaguggaaguucgcccgcaccaagcuguggauguccuacuucgaggagggcgggacgcugcccacccccuucaacgucauccccagcccgaagucccucugguaccugaucaaguggaucuggacccaccugugcaagaagaagaugcggcgcaagcccgagagcuucggcaccaucggccggcgcgccgcggacaaccuccggcgccaccaccaguaccaggaggugaugcggaaccuggugaagcgcuacgucgccgccaugauccgggacgccaagacggaggaggggcugaccgaggagaacuucaaggagcucaagcaggacaucuccagcuuccgcuucgaggugcugggccugcuccggggguccaagcugagcaccauccaguccgccaacgcgagcaaggaguccagcaacuccgccgacagcgacgagaaguccgacagcgaggaggagguggcccgccagcaggccgcgggcccccuggagcggaacauccagcucgagagccgcgggcuggccucccgcggcgaccugagcaucccgggccucuccgagcagugcguccugguggaccaccgggagcgcaacaccgacacgcuggggcuccaggugggcaagcgggucugccccuucaagagcgagaaggugguggucgaggacaccgugcccaucauccccaaggagaagcacgccaaggaggaggacuccagcaucgacuacgaccugaaccugccggacaccgugacccacgaggacuacgucacgacccgccucuga

SEQ ID NO: 38144 - RNA, 2922 nt, Artificial Sequence
  derived and/or modified sequence opt1 from TRPC5__Homo_sapiens__NP_036603
auggcccagcuguacuacaagaaggugaacuacagccccuaccgcgaccggaucccgcuccagaucguccgcgccgagaccgagcuguccgcggaggagaaggccuuccugaacgccguggagaagggcgacuacgccaccgugaagcaggcccuccaggaggcggagaucuacuacaacgucaacaucaacugcauggacccccuggggcggagcgcccugcucaucgccaucgagaacgagaaccuggagaucauggagcugcuccugaaccacuccguguacgugggcgacgcccugcucuacgcgauccgcaaggaggucgugggggccguggagcugcugcucagcuaccggcgccccuccggcgagaagcagguccccacgcugaugauggacacccaguucagcgaguucaccccggacaucacccccaucaugcuggccgcccacacgaacaacuacgagaucaucaagcuccuggugcagaagcgggugaccaucccccgcccccaccagauccggugcaacugcgucgagugcguguccagcuccgagguggacagccugcgccacucccggagccgccucaacaucuacaaggcccuggcguccccgagccugaucgcccucuccagcgaggaccccauccugaccgccuuccggcuggggugggagcucaaggagcuguccaaggucgagaacgaguucaaggccgaguacgaggagcugagccagcagugcaagcuguucgccaaggaccuccuggaccaggcgcgcuccagccgggagcucgagaucauccugaaccaccgcgacgaccacagcgaggagcuggacccccagaaguaccacgaccucgccaagcugaagguggccaucaaguaccaccagaaggaguucguggcccagcccaacugccagcagcugcucgccacccugugguacgacggcuucccgggcuggcggcgcaagcacugggucgugaagcugcucacgugcaugaccaucggguuccuguuccccaugcuguccaucgcguaccucaucagcccccgguccaaccugggccuguucaucaagaagcccuucaucaaguucaucugccacaccgccagcuaccucaccuuccuguucaugcugcugcucgccucccagcacaucgugcgcacggaccugcacguccaggggccgccgcccaccgugguggaguggaugauccugcccuggguccucggcuucaucuggggcgagaucaaggagaugugggacgggggcuucaccgaguacauccacgacugguggaaccugauggacuucgccaugaacagccuguaccucgccaccaucucccugaagaucguggcguacgucaaguacaacgggagccggccccgcgaggagugggagauguggcaccccacgcugaucgccgaggcccucuucgccaucuccaacauccugagcucccugcgccucaucagccuguucaccgcgaacucccaccugggcccccuccagaucagccuggggcggaugcugcucgacauccugaaguuccuguucaucuacugccucgugcugcuggccuucgccaacggccucaaccagcuguacuucuacuacgagacccgcgccaucgacgagcccaacaacugcaagggcauccggugcgagaagcagaacaacgccuucuccacccuguucgagacgcuccagagccuguucugguccguguucgggcugcucaaccuguacgucaccaacgugaaggcgcgccacgaguucaccgaguucgugggcgccaccauguucgggacguacaacgucaucagccugguggugcuccugaacaugcugaucgccaugaugaacaacuccuaccagcucaucgccgaccacgccgacaucgaguggaaguucgcgcggaccaagcuguggaugagcuacuucgacgagggcgggacccugccgccgcccuucaacaucauccccagccccaaguccuuccucuaccugggcaacugguucaacaacaccuucugccccaagcgcgaccccgacggccggcgccggcgccggaaccugcgcagcuucacggagcggaacgccgacucccucauccagaaccagcacuaccaggaggucauccgcaaccuggugaagcgguacguggccgccaugauccgcaacagcaagacccacgaggggcugaccgaggagaacuucaaggagcucaagcaggacaucuccagcuuccgguacgagguccuggaccugcucggcaaccgcaagcacccgcgguccuucagcaccuccagcacggagcugucccagcgcgacgacaacaacgacgggagcggcggggcccgcgcgaaguccaagagcguguccuucaaccugggcugcaagaagaagaccugccacggcccgccccucauccggaccaugccccgcagcuccggggcccagggcaagagcaaggccgagagcuccagcaagcgguccuucauggggcccagccugaagaagcugggccuccuguucuccaaguucaacgggcacaugagcgagcccuccagcgagcccauguacaccaucuccgacggcaucgugcagcagcacugcauguggcaggacauccgcuacagccagauggagaagggcaaggccgaggcgugcucccagagcgagaucaaccuguccgaggucgagcucggggaggugcagggcgccgcccagagcuccgagugcccccuggccugcagcuccagccugcacugcgccuccagcaucugcagcuccaacagcaagcuccuggacuccagcgaggacguguucgagacguggggcgaggcgugcgaccugcucaugcacaaguggggcgacgggcaggaggagcaggucaccacccggcuguga

SEQ ID NO: 38145 - RNA, 2796 nt, Artificial Sequence
  derived and/or modified sequence opt1 from TRPC6__Homo_sapiens__NP_004612
augagccagucccccgccuucggcccgcgccgggggagcagcccccgcggcgccgcgggggccgccgcccggcgcaacgagucccaggacuaccugcucauggacuccgagcugggcgaggacgggugcccccaggcgccccugccgugcuacggcuacuaccccugcuuccggggcagcgacaaccgccucgcccaccggcgccagaccgugcugcgggagaaggggcgccggcuggccaaccgcggccccgccuacauguucuccgaccggagcaccucccucagcaucgaggaggagcgcuuccuggacgccgcggaguacgggaacauccccgucgugcggaagaugcuggaggagugccacucccucaacgugaacugcgucgacuacaugggccagaacgcccugcagcuggccguggccaacgagcaccucgagaucacggagcugcugcucaagaaggagaaccugagccgcgugggggacgcccugcuccuggcgaucuccaagggcuacguccggaucguggaggccauccugagccacccggccuucgccgagggcaagcgccucgccaccucccccagccaguccgagcugcagcaggacgacuucuacgcguacgacgaggacgggacccgguucagccacgacgugacccccaucauccuggccgcccacugccaggaguacgagaucguccacacgcuccugcgcaagggcgcccggaucgagcgcccccacgacuacuucugcaagugcaacgacugcaaccagaagcagaagcacgacuccuucagccacagccgcucccggaucaacgccuacaaggggcuggcgagcccggccuaccucucccugagcuccgaggaccccgugaugaccgcccuggagcucagcaacgagcuggccgugcuggccaacaucgagaaggaguucaagaacgacuacaagaagcucuccaugcagugcaaggacuucgucgugggccugcuggaccucugccgcaacaccgaggagguggaggcgauccugaacggcgacgucgagacccugcagagcggggaccacggccggcccaaccucucccgccugaagcuggccaucaaguacgaggugaagaaguucguggcccaccccaacugccagcagcagcuccugagcaucugguacgagaaccuguccgggcuccggcagcagacgauggccgucaaguuccugguggugcuggcggucgccaucggccucccguuccuggcccugaucuacugguucgcccccugcagcaagauggggaagaucaugcgcggccccuucaugaaguucguggcccacgcggccuccuucaccaucuuccugggccuccuggugaugaacgccgccgaccgguucgaggggaccaagcugcuccccaacgagaccagcacggacaacgccaagcagcuguuccgcaugaagaccuccugcuucagcuggauggagaugcugaucaucuccugggucaucggcaugaucugggcggagugcaaggagaucuggacccaggggccgaaggaguaccucuucgagcuguggaacaugcuggacuucggcaugcucgccaucuucgccgccagcuucaucgcccgguucauggcguucuggcacgccuccaaggcccagagcaucaucgacgccaacgacacccugaaggaccugacgaaggugacccucggggacaacgucaaguacuacaaccuggcgcgcaucaagugggaccccagcgacccccagaucaucuccgagggccuguacgccaucgccguggugcucagcuucucccggaucgccuacauccugcccgccaacgagagcuucggcccgcugcagaucucccucgggcgcaccgucaaggacaucuucaaguucauggugaucuucaucaugguguucgucgcguucaugaucggcauguucaaccuguacagcuacuacaucggggccaagcagaacgaggccuucaccacgguggaggaguccuucaagacccuguucugggccaucuucggccucagcgaggugaaguccgucgugaucaacuacaaccacaaguucaucgagaacaucggguacgugcuguacggcgucuacaacgugaccauggugaucguccugcucaacaugcugaucgccaugaucaacagcuccuuccaggagaucgaggacgacgcggacguggaguggaaguucgcccgggccaagcugugguucagcuacuucgaggagggccgcacccuccccgugcccuucaaccugguccccucccccaagagccuguucuaccuccugcugaagcucaagaaguggaucuccgagcuguuccaggggcacaagaagggcuuccaggaggacgccgagaugaacaagaucaacgaggagaagaagcuggggauccucggcagccacgaggaccuguccaagcugagccucgacaagaagcaggucggccacaacaagcagcccagcauccgguccagcgaggacuuccaccugaacuccuucaacaacccgccgcgccaguaccagaagaucaugaagcggcugaucaagcgcuacgugcuccaggcccagaucgacaaggagagcgacgaggugaacgagggggagcugaaggagaucaagcaggacaucuccagccugcgguacgagcuccuggaggagaagucccagaacacggaggaccuggcggagcucauccgcgagcugggcgagaagcugagcauggagcccaaccaggaggagaccaaccgcuga

SEQ ID NO: 38146 - RNA, 2241 nt, Artificial Sequence
  derived and/or modified sequence opt1 from TRPC7__Homo_sapiens__NP_001161048
augcugcgcaacagcaccuucaagaacaugcagcggcgccacaccacgcuccgggagaagggccgccggcaggccauccgcgggcccgccuacauguucaacgagaagggcaccucccugaccccggaggaggagcgguuccuggacagcgcggaguacgggaacauccccgugguccgcaagaugcucgaggaguccaagacccugaacuucaacugcguggacuacaugggccagaacgcccugcagcucgccguggggaacgagcaccuggaggucacggagcugcuccugaagaaggagaaccuggcccgggugggcgacgcccuccugcuggcgaucagcaagggcuacgugcgcaucgucgaggccauccucaaccaccccgccuucgcccaggggcagcggcugacccugagcccccucgagcaggagcugcgcgacgacgacuucuacgcguacgacgaggacggcacccgguucagccacgacaucaccccgaucauccuggccgcccacugccaggaguacgagaucgugcacauccuccugcugaagggggcccgcaucgagcggccccacgacuacuucugcaagugcaacgagugcacggagaagcagcgcaaggacuccuucagccacucccggagccgcaugaacgccuacaagggccucgcguccgccgccuaccugagccuguccagcgaggaccccgugcucaccgcccuggagcuguccaacgagcucgcccggcuggcgaacaucgagaccgaguucaagcuggggcgcacccuccggagccccuucaugaaguucgucgcccacgccguguccuucacgaucuuccugggccugcucguggucaacgccagcgaccgcuucgagggcgugaagacccugccgaacgagaccuucaccgacuaccccaagcagaucuuccgcgugaagacgacccaguucuccuggaccgagaugcugaucaugaaguggguccucgggaugaucuggagcgagugcaaggagaucugggaggagggcccccgggaguacgugcugcaccuguggaaccuccuggacuucgggaugcugagcaucuucguggccuccuucaccgcgcgcuucauggccuuccucaaggccacggaggcccagcuguacgucgaccagcacgugcaggacgacacccugcacaacgugagccugcccccggaggucgccuacuucaccuacgcgcgggacaagugguggcccuccgacccccagaucaucagcgagggccuguacgccaucgccguggugcuguccuucagccgcaucgccuacauccugcccgcgaacgaguccuucggcccgcuccagaucagccuggggcggaccgucaaggacaucuucaaguucauggugaucuucaucauggucuucguggccuucaugaucggcauguucaaccuguacuccuacuaccgcggggccaaguacaaccccgccuucacgaccguggaggagagcuucaagacccucuucugguccaucuucggccugagcgaggucaucuccguggugcugaaguacgaccacaaguucaucgagaacaucggguacguccucuacggcguguacaacgugaccauggucguggugcugcugaacaugcucaucgccaugaucaacaacagcuaccaggagaucgaggaggacgcggacgucgaguggaaguucgcccgggccaagcuguggcuguccuacuucgacgagggccgcacgcuccccgcccccuucaaccuggugccgagccccaaguccuucuacuaccugaucaugcggaucaagaugugccucaucaagcugugcaagagcaaggccaaguccugcgagaacgaccuggagauggggaugcucaacagcaaguucaagaagacccgcuaccaggcgggcaugcggaacagcgagaaccugaccgccaacaacacccuguccaagcccacgcgcuaccagaagaucaugaagcggcucaucaagcgcuacgugcugaaggcccaggucgaccgggagaacgacgaggugaacgagggggagcugaaggagaucaagcaggacaucagcucccuccgcuacgagcugcuggaggagaagucccaggccaccggcgagcucgccgaccugauccagcagcuguccgagaaguucgggaagaaccucaacaaggaccaccuccgggugaacaagggcaaggacaucuga

SEQ ID NO: 38147 - RNA, 4929 nt, Artificial Sequence
  derived and/or modified sequence opt1 from TRPM1__Homo_sapiens__NP_001238949
augagcuccuucaagcgcggcagccugaaguccagcaccuccgggagccagaagggccagaaguccuggaucgagaagaccuucugcaagcgggagugcaucuucgugauccccagcaugaaggacuccaaccgcugcugcugcgggcaguucacgaaccagcacaucccgccccuccccagcgccacccccuccaagaacgaggaggagagcaagcaggucgagacccagccggagaagugguccguggccaagcacacccagagcuaccccacggacuccuacggcgugcuggaguuccaggggggcggcuacagcaacaaggcgauguacauccgggucuccuacgacaccaagcccgacagccugcuccaccugauggugaaggacuggcagcuggagcuccccaagcugcugaucuccgugcacgggggccuccagaacuucgagaugcagccgaagcugaagcaggucuucgggaagggccugaucaaggccgccaugaccaccggggccuggaucuucacgggcggcgugagcaccggggugaucagccacgucggcgacgcccucaaggaccacuccagcaagucccgcgggcgggugugcgcgaucggcaucgcccccuggggcaucguggagaacaaggaggaccuggucgggaaggacgugacccgcguguaccagaccaugagcaacccccuguccaagcucagcguccugaacaacucccacacgcacuucauccuggccgacaacggcacccucgggaaguacggcgccgaggugaagcugcggcgccugcucgagaagcacaucagccugcagaagaucaacacccggcuggggcagggcgugccccucgucggccuggugguggaggggggcccgaacgucguguccaucgugcuggaguaccuccaggaggagccccccauccccgucgugaucugcgacgggagcggccgcgcguccgacauccugagcuucgcccacaaguacugcgaggaggggggcaucaucaacgagucccugcgggagcagcuccuggucaccauccagaagacguucaacuacaacaaggcccagagccaccagcuguucgccaucaucauggagugcaugaagaagaaggagcucgugaccguguuccgcaugggcuccgaggggcagcaggacaucgagauggccauccugaccgcgcugcucaagggcaccaacgucagcgccccggaccagcugucccuggcccucgccuggaaccggguggacaucgcccgcagccagaucuucguguucgggccccacuggcccccccugggcucccuggcgccgcccacggacagcaaggccaccgagaaggagaagaagccccccauggccaccaccaaggggggccggggcaaggggaagggcaagaagaaggggaaggucaaggaggagguggaggaggagacggacccgcgcaagaucgagcuccugaacugggugaacgcccuggagcaggccaugcucgacgcgcugguccuggaccggguggacuucgugaagcuccugaucgagaacggcgucaacaugcagcacuuccugaccaucccccgccuggaggagcucuacaacacccggcugggcccccccaacacccugcaccuccuggugcgcgacgugaagaagagcaaccugccgcccgacuaccacaucucccucaucgacaucgggcugguccuggaguaccucaugggcggggccuaccggugcaacuacacgcgcaagaacuuccgcacccuguacaacaaccuguucggccccaagcggccgaaggcccucaagcugcuggggauggaggacgacgagccccccgccaagggcaagaagaagaagaagaagaagaaggaggaggagaucgacaucgacguggacgaccccgccgugagccgcuuccaguacccguuccacgagcucauggucugggcggugcugaugaagcggcagaagauggccguguuccuguggcagcgcggcgaggaguccauggccaaggcccucgucgcgugcaagcuguacaaggccauggcccacgagagcuccgagagcgaccugguggacgacaucucccaggaccucgacaacaacagcaaggacuucgggcagcuggcccuggagcuccuggaccaguccuacaagcacgacgagcagaucgccaugaagcugcucaccuacgagcugaagaacuggagcaacuccaccugccugaagcucgcgguggccgccaagcaccgggacuucaucgcccacacgugcagccagaugcugcugaccgacauguggaugggccgccuccggaugcgcaagaaccccgggcugaaggucaucaugggcauccugcucccccccaccauccuguuccuggaguuccggaccuacgacgacuucuccuaccagacgagcaaggagaacgaggacgggaaggagaaggaggaggagaacaccgacgccaacgcggacgccggcucccgcaagggcgacgaggagaacgagcacaagaagcagcggagcaucccgaucgggaccaagaucugcgaguucuacaacgcccccaucgugaaguucugguucuacaccaucuccuaccucggcuaccugcugcucuucaacuacgugauccugguccgcauggacggguggcccagccugcaggaguggaucgugaucagcuacaucgugucccucgcccuggagaagauccgggagauccugaugagcgagcccggcaagcucucccagaagaucaaggucuggcugcaggaguacuggaacaucaccgaccugguggccaucagcacguucaugaucggggcgauccuccgccugcagaaccagccguacaugggcuacggccgggugaucuacugcgucgacaucaucuucugguacauccgcgugcuggacaucuucggggugaacaaguaccucggccccuacgucaugaugaucgggaagaugaugaucgacaugcuguacuucguggugaucaugcuggucgugcucauguccuucggcguggcccggcaggccauccugcaccccgaggagaagcccagcuggaagcuggcccgcaacaucuucuacaugccguacuggaugaucuacggggaggucuucgcggaccagaucgaccucuacgccauggagaucaacccccccugcggcgagaaccuguacgacgaggagggcaagcggcugcccccgugcauccccggggccuggcucacccccgcccugauggccugcuaccugcucguggcgaacauccugcuggugaaccuccugaucgccgucuucaacaacaccuucuucgaggugaaguccaucagcaaccagguguggaaguuccagcgcuaccagcugaucaugaccuuccacgaccgccccguccucccgccccccaugaucauccugucccacaucuacaucaucaucaugcggcugagcggccgcugccggaagaagcgcgagggggaccaggaggagcgggaccgcggccucaagcuguuccuguccgacgaggagcucaagcggcugcacgaguucgaggagcagugcgugcaggagcacuuccgcgagaaggaggacgagcagcagagcuccagcgacgagcggauccgcgugacguccgagcgggucgagaacaugagcaugcgccuggaggagaucaacgagcgggagaccuucaugaagaccucccuccagaccguggaccugcgccuggcccagcucgaggagcugagcaaccggauggucaacgcccuggagaaccucgccggcaucgaccgcuccgaccugauccaggcgcggagccgcgccagcuccgagugcgaggccacguaccugcuccggcagagcuccaucaacagcgccgacggguacucccuguaccgcuaccacuucaacggcgaggagcugcucuucgaggacaccagccuguccaccagcccggggaccggcgugcggaagaagacgugcuccuuccgcaucaaggaggagaaggacgugaagacccaccugguccccgagugccagaacagccugcaccucucccuggggaccagcaccuccgccacgcccgacggcagccaccuggcgguggacgaccucaagaacgccgaggaguccaagcugggccccgacaucgggaucagcaaggaggacgacgagcgccagaccgacuccaagaaggaggagaccaucagcccgucccugaacaagaccgacgugauccacggccaggacaagagcgacguccagaacacgcagcucaccguggagaccaccaacaucgaggggacgaucagcuacccccuggaggagaccaagaucacccgguacuuccccgacgagaccaucaacgccugcaagacgaugaagucccgcagcuucguguacucccggggccgcaagcuggucgggggcgugaaccaggacguggaguacagcuccaucaccgaccagcagcucaccaccgaguggcagugccagguccagaagaucacgcggagccacuccaccgacauccccuacaucgugagcgaggccgcggugcaggccgagcacaaggagcaguucgccgacaugcaggacgagcaccacgucgccgaggccaucccgcgcaucccccggcugucccugaccaucaccgaccgcaacggcauggagaaccuccugagcgugaagcccgaccagacgcugggguuccccucccuccggagcaagucccugcacggccacccgcgcaacgugaagagcauccaggggaagcuggaccgguccggccacgcgagcuccgucagcucccucgugaucgugagcgggaugaccgccgaggagaagaaggucaagaaggagaaggccagcaccgagaccgagugcuga

SEQ ID NO: 38148 - RNA, 4512 nt, Artificial Sequence
  derived and/or modified sequence opt1 from TRPM2__Homo_sapiens__XP_005261228
auggagcccagcgcccugcgcaaggccggcuccgagcaggaggagggguucgagggccucccgcggcgcgugaccgaccuggggauggucagcaaccugcggcgcuccaacagcucccucuucaagagcuggcggcugcagugccccuucggcaacaacgacaagcaggagucccugagcuccuggauccccgagaacaucaagaagaaggagugcguguacuucguggagagcuccaagcucagcgacgcggggaaggucgugugccagugcggcuacacccacgagcagcaccuggaggaggccacgaagccccacaccuuccagggcacccagugggacccgaagaagcacgugcaggagaugcccaccgacgccuucggggacaucgucuucacgggccugucccagaaggugaagaaguacgugcgcgucagccaggacacccccuccagcgugaucuaccaccucaugacccagcacugggggcuggacgugcccaaccugcucaucuccgucaccggcggggccaagaacuucaacaugaagccgcggcugaaguccaucuuccgccggggccuggugaagguggcccagacgaccggcgcguggaucaucaccgggggcucccacaccggggucaugaagcaggucggcgaggccgugcgcgacuucagccucagcuccagcuacaaggagggcgagcugaucacgaucggggucgccaccuggggcaccgugcaccggcgcgaggggcugauccaccccaccggcuccuuccccgccgaguacauccucgacgaggacgggcagggcaaccugacgugccuggacagcaaccacucccacuucauccucguggacgacggcacccacgggcaguacggcgucgagaucccccugcggacccgccuggagaaguucaucagcgagcagaccaaggagcgcgggggcguggcgaucaagaucccgaucgugugcgucgugcucgagggcgggcccggcacgcugcacaccaucgacaacgccaccaccaacgggacgcccugcgucgugguggagggcuccgggcgggucgccgacgugaucgcccagguggccaaccugcccgucagcgacaucaccaucucccucauccagcagaagcugagcguguucuuccaggagauguucgagaccuucaccgagucccggaucguggaguggacgaagaagauccaggacaucguccgccggcgccagcugcucaccguguuccgggagggcaaggacgggcagcaggacguggacgucgcgauccugcaggcccugcucaaggccagccgcucccaggaccacuucggccacgagaacugggaccaccagcugaagcuggccguggccuggaaccgcguggacaucgcgcggagcgagaucuucauggacgaguggcaguggaagccguccgaccuccaccccaccaugaccgccgcccugaucagcaacaagcccgaguucgucaagcuguuccucgagaacggcgugcagcugaaggaguucgugacgugggacacccugcucuaccuguacgagaaccuggaccccagcugccucuuccacagcaagcugcagaaggugcugguggaggacccggagcgccccgccugcgcccccgcggcgccccggcuccagaugcaccacguggcccagguccugcgcgagcugcugggggacuucacccagccgcucuacccccggccccgccacaacgaccggcugcgccugcuccugcccgugccgcacgugaagcugaacguccagggcgugucccuccggagccuguacaagcgcagcuccgggcacgugaccuucacgauggaccccauccgggaccugcucaucugggccaucguccagaaccgccgggagcuggccggcaucaucugggcccagagccaggacugcaucgccgccgcccuggcgugcuccaagauccucaaggagcugagcaaggaggaggaggacaccgacuccagcgaggagaugcuggcccucgccgaggaguacgagcaccgcgccaucggcguguucaccgagugcuaccggaaggacgaggagcgcgcccagaagcugcugacccggguguccgaggcgugggggaagaccacgugccuccagcuggcccuggaggccaaggacaugaaguucgucagccacggcgggauccaggccuuccucaccaaggugugguggggccagcuguccguggacaacgggcuguggcgcgucacccucugcaugcuggccuucccccugcuccugaccggccugaucagcuuccgggagaagcgccuccaggacgugggcacgccggcggcccgcgcccgggccuucuucaccgcccccguggucguguuccaccugaacauccuguccuacuucgcguuccucugccuguucgccuacgugcugauggucgacuuccagcccgugcccagcuggugcgagugcgccaucuaccucuggcuguucucccuggugugcgaggagaugcgccagcuguucuacgacccggacgagugcgggcucaugaagaaggccgcgcuguacuucagcgacuucuggaacaagcucgacgucggcgccauccugcuguucguggccgggcugaccugccggcucauccccgccacccuguaccccggccgcgugauccucucccuggacuucauccuguucugccuccggcugaugcacaucuucacgaucagcaagacccuggggcccaagaucaucaucgucaagcgcaugaugaaggacguguucuucuuccucuuccugcuggccgugugggucguguccuucggcguggcgaagcaggccauccucauccacaacgagcggcgcgucgacuggcuguuccggggcgccguguaccacagcuaccugaccaucuucgggcagaucccgggcuacaucgacggggucaacuucaaccccgagcacugcagccccaacggcaccgaccccuacaagccgaagugccccgaguccgacgccacgcagcagcgccccgccuuccccgaguggcucaccgugcugcugcucugccuguaccugcuguucaccaacauccuccugcucaaccugcugaucgcgauguucaacuacaccuuccagcagguccaggagcacacggaccagaucuggaaguuccagcggcacgaccucaucgaggaguaccacgggcgcccggccgccccgccgcccuucauccugcugagccaccuccagcuguucaucaagcggguggugcugaagacccccgccaagcgccacaagcagcucaagaacaagcuggagaagaacgaggaggccgcgcugcucuccugggagaucuaccugaaggagaacuaccugcagaaccggcaguuccagcagaagcagcgccccgagcagaagaucgaggacaucagcaacaagguggacgccauggucgaccuccuggaccuggacccccucaagcgguccggcagcauggagcagcgccuggccucccuggaggagcaggucgcccagaccgcgcaggcccuccacuggaucgugcggacccugcgcgccagcggcuucuccagcgaggccgacgugcccacgcuggccucccagaaggcggccgaggagcccgacgccgagcccgggggccggaagaagaccgaggagcccggggacagcuaccacgugaacgcccgccaccuccuguacccgaacugccccgugacccgcuuccccguccccaacgagaaggugccgugggagaccgaguuccugaucuacgacccgcccuucuacacggccgagcggaaggacgcggccgccauggaccccaugggcgacacccuggagccccucuccaccauccaguacaacguggucgacgggcugcgcgaccggcgcagcuuccacggccccuacaccgugcaggccggccugccccucaaccccauggggcggacgggccugcgcgggcggggcucccugagcugcuucggcccgaaccacacccucuaccccauggugacccgcuggcggcgcaacgaggacggggccaucugccggaaguccaucaagaagaugcuggagguccugguggugaagcucccccugagcgagcacugggcgcugcccggcgggucccgcgagccgggcgagaugcucccccggaagcugaagcgcauccugcggcaggagcacuggcccagcuucgagaaccuccugaagugcgggauggaggucuacaagggcuacauggacgacccccgcaacaccgacaacgccuggaucgagacgguggccgugagcguccacuuccaggaccagaacgacguggagcugaaccggcucaacuccaaccugcacgccugcgacagcggcgccuccauccgcuggcaggucguggaccggcgcaucccgcuguacgcgaaccacaagacccuccugcagaaggccgccgccgaguucggggcgcacuacuga

SEQ ID NO: 38149 - RNA, 5124 nt, Artificial Sequence
  derived and/or modified sequence opt1 from TRPM3__Homo_sapiens__NP_001007472
augcccgagccguggggcaccguguacuuccuggggaucgcccagguguucagcuuccucuucuccugguggaaccuggagggcgugaugaaccaggccgacgcgccccggccccugaacuggaccauccggaagcucugccacgccgccuuccugcccagcgugcgccugcucaaggcccagaaguccuggaucgagcgggccuucuacaagcgcgagugcguccacaucauccccagcaccaaggacccccaccggugcugcugcgggcgccugaucggccagcacguggggcugacccccuccaucagcgugcuccagaacgagaagaacgagucccggcugagccgcaacgacauccaguccgagaaguggagcaucuccaagcacacccagcugagccccaccgacgccuucggcacgaucgaguuccagggcgggggccacuccaacaaggccauguacguccgggugagcuucgacaccaagccggaccuccugcugcaccucaugaccaaggaguggcagcuggagcugcccaagcuccugaucuccgugcacgggggccugcagaacuucgagcuccagcccaagcugaagcaggucuucgggaagggccugaucaaggccgccaugaccacgggcgcguggaucuucaccgggggcgugaacaccggggugauccgccacgucggcgacgcccucaaggaccacgccagcaagucccggggcaagaucugcaccaucgggaucgcccccuggggcaucguggagaaccaggaggaccugaucgggcgcgacgugguccggccguaccagacgaugagcaaccccauguccaagcugaccgugcucaacagcaugcacagccacuucauccuggccgacaacggcaccaccgggaaguacggcgcggaggugaagcugcgccggcagcucgagaagcacaucucccugcagaagaucaacacgcgcaucggccaggggguccccgugguggcccugaucgucgagggcgggcccaacgugaucagcaucgugcucgaguaccugcgggacaccccgcccguccccguggucgugugcgacggcuccgggcgcgccagcgacauccuggccuucggccacaaguacuccgaggagggcgggcucaucaacgagagccugcgggaccagcugcucgugaccauccagaagaccuucacguacacccgcacccaggcccagcaccuguucaucauccugauggagugcaugaagaagaaggagcucaucaccgucuuccggaugggcuccgaggggcaccaggacaucgaccuggcgauccugacggcccuccugaagggcgccaacgccagcgcccccgaccagcugucccucgcgcuggccuggaaccgcguggacaucgcccgcagccagaucuucaucuacgggcagcaguggccggugggcucccuggagcaggccaugcuggacgcccucguccuggaccggguggacuucgugaagcugcucaucgagaacggcgucagcaugcaccgcuuccugaccaucucccggcuggaggagcucuacaacacccgccacgggcccagcaacacccuguaccaccuggugcgggacgugaagaagggcaaccugccgcccgacuaccgcaucucccugaucgacaucgggcuggucaucgaguaccucaugggcggcgcguaccggugcaacuacacgcgcaagcgguuccgcacccuguaccacaaccuguucgggccgaagcggcccaaggcccucaagcugcugggcauggaggacgacaucccccuccgccgggggcgcaagaccaccaagaagcgggaggaggagguggacaucgaccuggacgaccccgagaucaaccacuucccguuccccuuccacgagcugauggugugggccguccucaugaagcgccagaagauggcccuguucuucuggcagcacggcgaggaggcgauggccaaggcccugguggccugcaagcucugcaaggccauggcgcacgaggccagcgagaacgacaugguggacgacaucucccaggagcugaaccacaacagccgggacuucgggcagcuggccgucgagcuccuggaccaguccuacaagcaggacgagcagcuggccaugaagcuccugacguacgagcugaagaacuggagcaacgcgaccugccuccagcuggcgguggccgccaagcaccgcgacuucaucgcccacacgugcagccagaugcugcucaccgacauguggaugggccggcugcgcaugcgcaagaacuccggccugaaggugauccucgggauccugcugcccccgagcauccucucccuggaguucaagaacaaggacgacaugcccuacaugagccaggcccaggagauccaccuccaggagaaggaggcggaggagcccgagaagcccacgaaggagaaggaggaggaggacauggagcucaccgccaugcugggccggaacaacggggaguccagccgcaagaaggacgaggaggagguccaguccaagcaccggcugaucccgcucggccgcaagaucuacgaguucuacaacgcccccaucgugaaguucugguucuacacccuggccuacaucggguaccugaugcuguucaacuacaucgugcuggucaagauggagcgguggcccagcacccaggaguggaucgugaucuccuacaucuucacccugggcaucgagaagaugcgcgagauccucaugagcgagcccggcaagcugcugcagaaggugaaggucuggcuccaggaguacuggaacgugacggaccugaucgcgauccuccucuucuccguggggaugauccugcggcugcaggaccagccguuccgcagcgacggccgggucaucuacugcgugaacaucaucuacugguacauccgccuccuggacaucuucggggugaacaaguaccugggccccuacgucaugaugaucgggaagaugaugaucgacaugauguacuucgugaucaucaugcucgugguccugauguccuucggcguggcccggcaggccauccuguuccccaacgaggagcccagcuggaagcucgccaagaacaucuucuacaugccguacuggaugaucuacggcgagguguucgccgaccagaucgacccgcccugcgggcagaacgagacccgcgaggacggcaagaucauccagcugcccccgugcaagaccggggcguggaucguccccgccaucauggccugcuaccugcucguggccaacauccugcuggugaaccuccugaucgccgucuucaacaacaccuucuucgaggugaaguccaucagcaaccagguguggaaguuccagcgguaccagcugaucaugacguuccacgagcgccccguccucccgccgccccugaucaucuucucccacaugaccaugaucuuccagcaccugugcugccgguggcgcaagcacgagagcgaccccgacgagcgggacuacggccucaagcuguucaucaccgacgacgagcugaagaaggugcacgacuucgaggagcagugcaucgaggaguacuuccgcgagaaggacgaccgguucaacagcuccaacgacgagcgcauccgggugaccagcgagcgcgucgagaacauguccaugcgccucgaggaggugaacgagcgggagcacagcaugaaggcgucccugcagacgguggacauccgccuggcccagcucgaggaccugaucgggcggauggccaccgcccuggagcgccucaccggccuggagcgggccgagagcaacaagauccgcucccggaccagcuccgacugcacggacgcggccuacaucguccgccagagcuccuucaacagccaggagggcaacaccuucaagcugcaggaguccaucgaccccgccggggaggagaccaugagccccaccucccccacgcucaugccccggaugcgcagccacuccuucuacagcgugaacaugaaggacaagggcgggaucgagaagcuggaguccaucuucaaggagcggagccugagccugcaccgcgccaccuccagccacuccgucgcgaaggagcccaaggcccccgccgcccccgccaacacccucgcgaucgugcccgacagccggcgcccguccagcugcaucgacaucuacguguccgccauggacgagcugcacugcgacaucgacccccuggacaacagcgucaacauccucggccugggcgagcccuccuucagcacccccgugccguccacggcccccagcuccagcgccuacgccacccuggcgcccaccgaccggcccccgucccgcagcaucgacuucgaggacaucaccuccauggacacgcggagcuucuccagcgacuacacccaccuccccgagugccagaaccccugggacagcgagcccccgauguaccacaccaucgagcgcuccaagagcucccgguaccuggccaccacgcccuuccugcucgaggaggcccccaucgucaagagccacuccuucauguucagccccucccgcagcuacuacgccaacuucggggucccggugaagaccgccgaguacaccuccaucaccgacugcaucgacacgcgcugcgugaacgcgccccaggccaucgccgaccgggccgccuuccccggcgggcugggcgacaaggucgaggaccugaccugcugccaccccgagcgcgaggcggagcucagccacccguccagcgacuccgaggagaacgaggccaaggggcggcgcgccaccaucgccaucagcucccaggagggcgacaacagcgagcggacccuguccaacaacaucacggugcccaagaucgagcgcgcgaacagcuacuccgccgaggagcccagcgcccccuacgcccacacccgcaagagcuucuccaucagcgacaagcuggaccgccagcggaacaccgccucccuccgcaacccguuccagcggagcaaguccagcaagcccgagggccgcggggacucccugagcaugcggcgccugucccggaccagcgcguuccaguccuucgagagcaagcacaacuga

SEQ ID NO: 38150 - RNA, 3210 nt, Artificial Sequence
  derived and/or modified sequence opt1 from TRPM4__Homo_sapiens__NP_001182156
auggugguccccgagaaggagcagagcuggauccccaagaucuucaagaagaagaccugcaccacguucaucguggacuccaccgaccccggcgggacccugugccagugcggccgcccccggaccgcccaccccgccguggcgauggaggacgccuucggggccgccgucgugacggugugggacagcgacgcccacaccaccgagaagcccaccgacgcguacggcgagcucgacuucacgggggccggccgcaagcacuccaacuuccugcggcugagcgaccgcaccgaccccgccgccgucuacucccucgugacccggaccuggggcuuccgcgcgcccaaccugguggucagcgugcucgggggcuccgggggccccgugcugcagacguggcugcaggaccugcuccggcgcgggcugguccgggccgcccagagcaccggcgccuggaucgugaccggcgggcugcacaccggcaucgggcgccacgugggcgucgccgugcgggaccaccagauggcguccacgggcgggaccaagguggucgccaugggcguggccccguggggcgugguccgcaaccgggacacccucaucaaccccaagggcagcuuccccgcccgcuaccgguggcgcggggaccccgaggacggcgugcaguucccgcuggacuacaacuacuccgccuucuuccugguggacgacggcacccacgggugccucggcggggagaaccgguuccgccugcggcuggagagcuacaucucccagcagaagacgggcgucgggggcaccggcaucgacauccccgugcuccugcugcucaucgacggggacgagaagaugcugacccgcaucgagaacgcgacccaggcccagcugcccugccuccuggucgccggcagcgggggcgccgccgacugccuggcggagacgcucgaggacacccuggcccccggguccggcggcgcccggcagggggaggcccgcgaccgcauccggcgcuucuucccgaagggcgaccuggaggugcuccaggcccagguggagcggaucaugacccgcaaggagcugcugaccgucuacagcuccgaggacgggagcgaggaguucgagacgaucgugcucaaggcgcuggugaaggccugcggcuccagcgaggccagcgccuaccuggacgagcuccggcuggcggucgccuggaaccgcguggacaucgcccaguccgagcuguuccggggcgacauccaguggcgcagcuuccaccucgaggccucccugauggacgcccugcucaacgaccggcccgaguucgugcgccugcugaucagccacgggcucucccugggccacuuccugacccccaugcggcucgcgcagcuguacagcgccgcccccuccaacagccugauccgcaaccugcucgaccaggccucccacagcgccgggaccaaggcgccggcccugaagggcggggccgccgagcugcggccgcccgacgucggccacgugcuccgcaugcugcugggcaagaugugcgcgccccgguaccccuccgggggcgccugggacccccaccccgggcagggcuucggggagagcauguaccuccuguccgacaaggccaccagcccccugucccucgacgccggccugggccaggccccguggagcgaccugcuccugugggcgcugcuccugaaccgcgcccagauggccauguacuucugggagaugggguccaacgccgugagcuccgcccugggcgcgugccuccugcugcgggucauggcccgccucgagcccgacgccgaggaggccgcccggcgcaaggaccuggcguucaaguucgaggggaugggcguggaccuguucggggagugcuaccgcagcagcgaggugcgggccgcccgccuccugcugcggcgcugcccccucuggggcgacgccacgugccugcagcuggccaugcaggcggacgcccgggccuucuucgcccaggacggcguccagucccuccugacccagaagugguggggcgacauggcgagcaccaccccgaucugggcccuggugcucgccuucuucugcccgccccugaucuacacgcgccugaucaccuuccggaaguccgaggaggagcccacccgcgaggagcucgaguucgacauggacagcgugaucaacggggaggggcccgucggccugacccccgggcuguaccaccucggccggaccgugcugugcaucgacuucaugguguucacgguccgccugcuccacaucuucaccgugaacaagcagcugggccccaagaucgugaucgucuccaagaugaugaaggacguguucuucuuccuguucuuccucgggguguggcuggucgccuacggcguggccaccgaggggcugcuccggccccgcgacagcgacuucccguccauccugcggcgcguguucuaccggcccuaccugcagaucuucggccagaucccccaggaggacauggacgucgcgcucauggagcacagcaacugcuccagcgagcccggcuucugggcccacccgcccggggcccaggccgggaccugcgugucccaguacgccaacuggcuggugguccugcuccuggugaucuuccugcucguggcgaacauccugcuggucaaccuccugaucgccauguucagcuacacguucgggaaggugcagggcaacuccgaccuguacuggaaggcccagcgcuaccggcucauccgcgaguuccacagccggcccgcccuggcgcccccguucaucgugaucucccaccuccgccugcugcugcggcagcucugccgccgcccccggagcccccagcccuccagcccggcccuggagcacuuccgcgucuaccugagcaaggaggccgagcggaagcuccugaccugggaguccgugcacaaggagaacuuccugcucgcccgcgcccgggacaagcgcgagagcgacuccgagcggcugaagcgcaccagccagaagguggaccuggcccucaagcagcuggggcacauccgggaguacgagcagcgccugaagguccucgagcgggaggugcagcagugcucccgcgugcugggcugggucgcggaggcccugagccgguccgcccuccugccgcccggcgggccgccgccgcccgaccugcccggcagcaaggacuga

SEQ ID NO: 38151 - RNA, 3498 nt, Artificial Sequence
  derived and/or modified sequence opt1 from TRPM5__Homo_sapiens__NP_055370
augcaggacgugcagggcccccgccccgggagccccggcgacgccgaggaccggcgcgagcuggggcuccaccggggcgaggucaacuucgggggcuccggcaagaagcgcgggaaguucgugcgggugcccagcggcgucgcccccuccgugcuguucgaccugcuccuggcggaguggcaccuccccgcccccaaccugguggucagccuggugggggaggagcagcccuucgccaugaaguccuggcugcgcgacgugcuccggaagggccuggucaaggccgcccagagcaccggggcguggauccugaccuccgcccuccgcgugggccuggcccggcacgugggccaggccguccgcgaccacagccuggcguccacgagcaccaaggugcggguggucgccguggggauggccucccucggccgcgugcugcaccggcgcauccuggaggaggcccaggaggacuuccccguccacuacccggaggacgacgggggcagccagggcccccucugcucccuggacagcaaccugucccacuucauccucguggagcccgggcccccgggcaagggggacggccugaccgagcugcggcuccgccuggagaagcacaucagcgagcagcgggccggguacggcggcaccggguccaucgagauccccgugcugugccuccuggucaacggcgaccccaacacgcuggagcgcaucagccgggcgguggagcaggccgcccccuggcucauccuggugggguccggcgggaucgccgacguccuggccgcgcucgugaaccagccgcaccuccugguccccaagguggccgagaagcaguucaaggagaaguuccccagcaagcacuucagcugggaggacaucgugcgcuggaccaagcuccugcagaacaucaccucccaccagcaccuccugaccgucuacgacuucgagcaggagggcagcgaggagcuggacacggugauccugaaggcccuggugaaggccugcaagucccacagccaggagccccaggacuaccuggacgagcugaagcucgccgucgcgugggaccggguggacaucgccaaguccgagaucuucaacggcgacguggaguggaaguccugcgaccuggaggaggucaugguggacgcccuggugagcaacaagccggaguucguccgccuguucguggacaacggggccgacguggccgacuuccucaccuacggccgccugcaggagcuguaccggagcgucucccgcaagagccuccuguucgaccugcuccagcggaagcaggaggaggcgcgccugacccuggccgggcucggcacccagcaggcccgggagccgcccgccgggcccccggcguucucccugcacgaggugagccgcgugcugaaggacuuccuccaggacgccugccggggcuucuaccaggacggccgccccggggaccggcgccgggccgagaagggccccgccaagcgccccacggggcagaaguggcugcuggaccucaaccagaaguccgagaacccguggcgggaccuguuccugugggccguccuccagaaccgccacgagauggcgaccuacuucugggccaugggccaggagggcguggccgccgcccuggcggccugcaagauccugaaggagaugagccaccucgagaccgaggccgaggccgcccgggcgacccgcgaggccaaguacgagcggcuggcccuggaccucuucuccgagugcuacagcaacuccgaggcccgcgcguucgcccugcuggugcggcgcaaccgcugcuggagcaagacgaccugccuccaccuggccaccgaggccgacgccaaggcguucuucgcccacgacgggguccaggccuuccugacccggaucugguggggcgacauggccgccgggacgcccauccuccgccugcugggcgcguuccucugccccgcccugguguacaccaaccugaucaccuucuccgaggaggccccgcuccggaccgggcuggaggaccugcaggaccucgacagccuggacacggagaaguccccgcuguacggccuccagagccgcguggaggagcuggucgaggcgccccgggcccagggcgaccgcgggccccgggccguguuccugcucacccgcuggcggaaguucuggggcgcccccgugaccgucuuccuggggaacguggugauguacuucgccuuccuguuccucuucaccuacguccugcugguggacuuccgcccgccgccccagggccccagcgggcccgaggugacgcucuacuucugggucuucacccuggugcuggaggagauccggcagggcuucuucaccgacgaggacacccaccucgugaagaaguucacgcuguacgucggcgacaacuggaacaagugcgacaugguggccaucuuccuguucaucgugggggugaccugccgcaugcuccccuccgcguucgaggccggccggaccguccuggccauggacuucaugguguucacccugcgccucauccacaucuucgccauccacaagcagcuggggcccaagaucaucgucguggagcggaugaugaaggacguguucuucuuccuguucuuccucagcgucuggcugguggccuacggcgugacgacccaggcgcugcuccacccccacgacgggcgccuggaguggaucuuccggcgcguccuguaccggcccuaccuccagaucuucggccagaucccccuggacgagaucgacgaggcccgcgugaacugcuccacccacccccugcuccuggaggacagcccguccugccccagccuguacgccaacuggcucgugauccugcugcucgucaccuuccugcuggugaccaacguccuccugaugaaccugcucaucgccauguucuccuacacguuccagguggugcagggcaacgccgacauguucuggaaguuccagcgguacaaccugaucgucgaguaccacgagcgccccgcgcuggcgcccccguucauccuccugagccaccugucccucacccugcgccggguguucaagaaggaggccgagcacaagcgcgagcaccuggagcgggaccuccccgacccccuggaccagaagguggucaccugggagaccgugcagaaggagaacuuccugagcaagauggagaagcgccggcgcgacuccgagggggaggugcuccggaagacggcccaccgcgucgacuucaucgccaaguaccugggcgggcugcgggagcaggagaagcgcaucaagugccuggagagccagaucaacuacugcuccgugcucgugagcuccgucgccgacgugcuggcccagggcgggggcccccggagcagccagcacugcggcgaggggucccagcugguggccgccgaccaccgcggcgggcucgacggcugggagcagccgggcgccgggcagccgcccagcgacaccuga

SEQ ID NO: 38152 - RNA, 6054 nt, Artificial Sequence
  derived and/or modified sequence opt1 from TRPM6__Homo_sapiens__NP_001170781
augaucauccugagcaagucccagaagagcuggaucaagggcguguucgacaagcgcgagugcuccaccaucauccccagcuccaagaacccgcaccggugcacccccgucugccaggugugccagaaccucauccgcugcuacugcgggcggcugaucggcgaccacgccgggaucgacuacagcuggacgaucuccgccgcgaagggcaaggagagcgagcagugguccguggagaagcacaccaccaagagccccaccgacacguucgggaccaucaacuuccaggacggcgagcacacccaccacgccaaguacauccgcaccuccuacgacacgaagcuggaccaccuccugcaccugaugcucaaggaguggaagauggagcugcccaagcuggucaucagcgugcacggcgggauccagaacuucaccaugccguccaaguucaaggagaucuucagccagggccucgugaaggccgccgagaccaccggggccuggaucaucacggagggcaucaacaccggggucuccaagcacgugggcgacgcgcugaagagccacuccagccacucccugcggaagaucuggaccgugggcaucccccccuggggggucaucgagaaccagcgcgaccucaucggcaaggacguggugugccuguaccagacccuggacaacccccucagcaagcugacgacccugaacagcaugcacucccacuucauccucagcgacgacgggaccgucggcaaguacggcaacgagaugaagcugcggcgcaaccuggagaaguaccucucccugcagaagauccacugccggagccgccagggggugccgguggucggccuggugguggaggggggccccaacgucauccucuccgugugggagaccgugaaggacaaggaccccgucguggugugcgaggggacgggccgggccgccgaccugcuggccuucacccacaagcaccucgcggacgagggcaugcugcgcccccaggucaaggaggagaucaucugcaugauccagaacaccuucaacuucagccugaagcaguccaagcaccucuuccagauccugauggagugcauggugcaccgggacugcaucaccaucuucgacgccgacagcgaggagcagcaggaccuggaccucgccauccugacggcccugcucaaggggaccaaccuguccgccagcgagcagcugaaccucgcgauggccugggaccgcgucgacaucgccaagaagcacauccugaucuacgagcagcacuggaagccggacgcccuggagcaggccauguccgacgcgcucgugauggaccggguggacuucgucaagcugcugaucgaguacggcgugaaccuccaccgcuuccugaccaucccccggcuggaggagcucuacaacaccaagcaggggcccacgaacacccugcugcaccaccuggugcaggacgucaagcagcacacccuccugagcggcuaccgcaucacccugaucgacaucgggcucgugguggaguaccugaucggccgggccuaccgcuccaacuacacgcggaagcacuuccgcgcccuguacaacaaccucuaccgcaaguacaagcaccagcggcacagcuccggcaaccgcaacgagagcgccgaguccacccugcacagccaguucauccggaccgcccagcccuacaaguucaaggagaaguccaucguccugcacaagagccgcaagaagagcaaggagcagaacguguccgacgacccggagagcaccggguuccucuaccccuacaacgaccugcuggugugggcgguccucaugaagcggcagaagauggccauguucuucuggcagcacggcgaggaggccacggugaaggccgugaucgccugcauccuguaccgcgcgauggcccacgaggccaaggagucccacauggucgacgacgccagcgaggagcugaagaacuacuccaagcaguucgggcagcucgcgcuggaccugcucgagaaggccuucaagcagaacgagcggauggccaugacccugcugaccuacgagcuccgcaacuggagcaacuccaccugccugaagcuggccgugagcggcgggcuccggcccuucgugucccacaccugcacgcagaugcugcugaccgacauguggaugggccgccucaagaugcggaagaacagcuggcugaagaucaucaucuccaucauccugcccccgaccauccucacccuggaguucaagagcaaggccgagaugucccacgucccccagagccaggacuuccaguucaugugguacuacuccgaccagaacgcgagcuccagcaaggagagcgccuccgugaaggaguacgaccuggagcgcggccacgacgagaagcucgacgagaaccagcacuucgggcuggagagcggccaccagcaccugcccuggacgcggaagguguacgaguucuacuccgcccccaucgucaaguucugguucuacaccauggccuaccucgccuuccugaugcuguucaccuacaccgugcucguggagaugcagccgcagcccagcguccaggaguggcugguguccaucuacaucuucacgaacgcgaucgaggugguccgcgagaucugcaucagcgagcccgggaaguucacccagaaggugaagguguggaucuccgaguacuggaaccugaccgagaccgucgccaucggccucuucagcgccggcuucgugcugcgguggggggaccccccguuccacacggccggccgccugaucuacugcaucgacaucaucuucugguucucccggcuccuggacuucuucgccgugaaccagcacgcggggcccuacgucaccaugaucgccaagaugaccgccaacauguucuacaucgugaucaucauggccaucgugcugcucagcuucggcgucgcgcgcaaggccauccugucccccaaggagccgcccagcuggucccuggcccgggacaucguguucgagcccuacuggaugaucuacggggagguguacgccggcgagaucgacgucugcagcucccagcccagcugcccgcccggcuccuuccucacccccuuccugcaggccguguaccuguucgugcaguacaucaucauggucaaccuccugaucgcguucuucaacaacguguaccuggacauggagagcaucuccaacaaccucuggaaguacaaccgcuaccgcuacaucaugacguaccacgagaagcccuggcugccgcccccccugauccuccugagccacguggggcugcuccugcggcgccugugcugccaccgggccccccacgaccaggaggagggcgacgucgggcucaagcuguaccugagcaaggaggaccucaagaagcugcacgacuucgaggagcagugcguggagaaguacuuccacgagaagauggaggacgugaacugcuccugcgaggagcgcauccgggucaccagcgagcgcgugaccgagauguacuuccagcugaaggagaugaacgagaagguguccuucaucaaggacagccuccugucccuggacagccaggucggccaccuccaggaccuguccgcccugaccguggacacgcucaagguccugagcgccguggacacccugcaggaggacgaggcccuccuggcgaagcggaagcacuccaccugcaagaagcugccgcacagcugguccaacgugaucugcgccgagguccucgggagcauggagaucgccggcgagaagaaguaccaguacuacuccaugcccagcucccugcugcgcagccucgccggcgggcggcaccccccccgcgugcagcggggcgcccugcuggagaucaccaacuccaagcgcgaggcgacgaacgugcggaacgaccaggagcgccaggagacccagagcuccaucgucgugagcggggugagcccgaaccggcaggcccacuccaaguacggccaguuccuccugguccccagcaaccugaagcgcgugcccuucuccgccgagaccgugcucccccugagccggccguccguccccgacgugcuggccaccgagcaggacauccagacggaggugcugguccaccucaccgggcagacccccguggugagcgacugggcguccgucgacgagcccaaggagaagcacgagccgaucgcccaccugcuggacggccaggacaaggccgagcaggugcuccccacccugagcugcacgcccgagccgaugaccauguccagcccccugucccaggccaagaucaugcagaccggcgggggcuacgugaacugggccuucagcgagggggacgagaccggcgucuucuccaucaagaagaaguggcagacgugccuccccagcaccugcgacuccgacagcucccgcagcgagcagcaccagaagcaggcgcaggacuccagccugagcgacaacuccacccggagcgcccaguccagcgagugcuccgagguggggcccuggcugcagccgaacaccagcuucuggaucaacccccuccgccgguaccgccccuucgcccgcucccacagcuuccgguuccacaaggaggagaagcugaugaagaucugcaagaucaagaaccuguccggcagcuccgagaucggccagggggccugggugaaggccaagaugcucaccaaggaccgccggcugagcaagaagaagaagaacacgcagggccugcagguccccaucaucaccgugaacgcgugcucccagagcgaccagcucaacccggagcccggggagaacuccaucagcgaggaggaguacuccaagaacugguucaccgugagcaaguucucccacaccggcgucgagcccuacauccaccagaagaugaagacgaaggagaucggccagugcgccauccagaucagcgacuaccugaagcagagccaggaggaccuguccaagaacagccucuggaacucccgcagcaccaaccugaaccggaacucccugcucaagagcuccaucgggguggacaagaucagcgccucccugaagagcccccaggagccgcaccaccacuacuccgccaucgagcgcaacaaccugaugcggcucagccagaccauccccuucacccccgugcagcuguucgccggcgaggagaucacggucuaccgccuggaggaguccagcccccucaaccuggacaaguccaugagcuccuggagccagcgggggcgcgcggccaugauccaggugcugucccgggaggagauggacggcgggcuccgcaaggccaugcggguggucagcaccuggagcgaggacgacauccugaagccgggccagguguucaucgugaaguccuuccugcccgaggucgugcgcaccuggcacaagaucuuccaggagagcaccgugcuccaccugugccugcgggagauccagcagcagcgcgccgcccagaagcucaucuacacguucaaccaggucaagccccagaccauccccuacaccccgcgguuccuggagguguuccugaucuacugccacuccgcgaaccaguggcucaccaucgagaaguacaugacgggcgaguuccgcaaguacaacaacaacaacggggacgagaucacccccaccaacacccuggaggagcugaugcucgccuucagccacuggacguacgaguacacccggggcgagcugcuggugcucgaccugcagggggucggcgagaaccugaccgaccccuccgugaucaagcccgaggugaagcagagccgcgggauggucuucggcccggccaaccucggcgaggacgccauccgcaacuucaucgcgaagcaccacugcaacuccugcugccggaagcugaagcugcccgaccucaagcgcaacgacuacagccccgagcggaucaacuccaccuucgggcuggagaucaagaucgagagcgccgaggagcccccggcccgcgagacgggccggaacucccccgaggacgacaugcagcuguga

SEQ ID NO: 38153 - RNA, 5598 nt, Artificial Sequence
  derived and/or modified sequence opt1 from TRPM7__Homo_sapiens__NP_060142
augagccagaaguccuggaucgagagcacccugaccaagcgcgagugcguguacaucauccccuccagcaaggacccgcaccggugccuccccggcugccagaucugccagcagcugguccgcugcuucugcgggcggcuggugaagcagcacgccugcuucacggccucccucgcgaugaaguacagcgacgugaagcugggcgaccacuucaaccaggccaucgaggagugguccgucgagaagcacaccgagcagagccccaccgacgccuacggggugaucaacuuccagggcgggucccacagcuaccgcgccaaguacgugcggcuguccuacgacaccaagcccgaggucauccuccagcugcugcucaaggaguggcagauggagcugccgaagcuggugaucagcgugcacggcggcaugcagaaguucgagcuccacccccgcaucaagcagcugcuggggaagggccucaucaaggccgcggucacgaccggggccuggauccugaccggcggggugaacaccggcguggccaagcacgucggcgacgcccugaaggagcacgcgucccggagcucccgcaagaucugcacgaucgggaucgcccccuggggcgugaucgagaaccggaacgaccucguggggcgcgacgucguggcccccuaccagacccugcugaacccgcucagcaagcugaacgugcugaacaaccuccacucccacuucauccuggucgacgacggcaccgugggcaaguacggggccgaggugcggcugcgccgggagcucgagaagaccaucaaccagcagcgcauccacgcccggaucggccaggggguccccgugguggcgcugaucuucgagggcgggcccaacgucauccugacggugcucgaguaccugcaggagagccccccgguccccgugguggucugcgagggcaccggccgcgccgccgaccugcucgccuacauccacaagcagaccgaggaggggggcaaccugcccgacgccgcggagcccgacaucaucuccaccaucaagaagacguucaacuucgggcagaacgaggcccugcaccucuuccagacccugauggagugcaugaagcggaaggagcugaucaccguguuccacaucggcagcgacgagcaccaggacaucgacguggccauccucaccgcccugcugaaggggacgaacgccagcgcguucgaccagcucauccugacccuggccugggaccgcgucgacaucgccaagaaccacguguucguguacggccagcaguggcucgucggcucccuggagcaggccaugcuggacgcccucgugauggaccggguggcguucgucaagcugcugaucgagaacggggugagcaugcacaaguuccugaccaucccgcgccucgaggagcuguacaacaccaagcagggccccacgaaccccaugcuguuccaccucgugcgggacgucaagcaggggaaccugcccccgggcuacaagaucacccugaucgacaucgggcucgugaucgaguaccugaugggcggcaccuaccgcugcaccuacacgcgcaagcgguuccgccugaucuacaacucccucgggggcaacaaccggcgcagcgggcggaacaccuccagcuccaccccccagcugcgcaagagccacgaguccuucggcaaccgggccgacaagaaggagaagaugcgccacaaccacuucaucaagaccgcccagcccuaccggcccaagaucgacacggugauggaggagggcaagaagaagcgcaccaaggacgagaucgucgacaucgacgacccggagaccaagcgguuccccuacccccugaacgagcuccugaucugggccugccugaugaagcgccaggugauggcgcgguuccucuggcagcacggggaggagagcauggccaaggcccugguggccugcaagaucuaccgcuccauggccuacgaggcgaagcagagcgaccuggucgacgacaccuccgaggagcucaagcaguacagcaacgacuucggccagcuggccguggagcugcucgagcaguccuuccggcaggacgagacgauggccaugaagcugcugaccuacgagcucaagaacuggagcaacuccaccugccugaagcuggccgugagcucccgccuccggcccuucgucgcccacaccugcacccagaugcugcugagcgacauguggauggggcgccucaacaugcggaagaacagcugguacaaggugauccuguccauccuggugccgcccgcgauccuccugcuggaguacaagacgaaggccgagaugagccacaucccccagucccaggacgcccaccagaugaccauggacgacagcgagaacaacuuccagaacaucaccgaggagaucccgauggaggucuucaaggaggugcgcauccucgacuccaacgagggcaagaacgagauggagauccagaugaagagcaagaagcugcccaucacccgcaaguucuacgccuucuaccacgcccccaucgugaaguucugguucaacacgcuggcguaccucggguuccugaugcuguacaccuucgucgugcucgugcagauggagcagcugcccuccguccaggaguggaucgugaucgccuacaucuucaccuacgccaucgagaaggugcgggagaucuucaugagcgaggccggcaaggucaaccagaagaucaaggugugguucuccgacuacuucaacaucagcgacaccaucgcgaucaucuccuucuucaucggcuucgggcugcgcuucggcgccaaguggaacuucgccaacgccuacgacaaccacguguucgucgccgggcggcucaucuacugccugaacaucaucuucugguacgugcgccugcucgacuuccuggcggugaaccagcaggccggcccguacgucaugaugaucgggaagaugguggccaacauguucuacaucguggucaucauggcccuggugcuccugagcuucggcgugccccggaaggccauccuguacccccacgaggcgcccuccuggacgcucgccaaggacaucgucuuccacccguacuggaugaucuucggcgagguguacgccuacgagaucgacgugugcgccaacgacagcgucaucccccagaucugcgggcccggcaccuggcugacccccuuccugcaggccguguaccucuucguccaguacaucaucauggugaaccugcugaucgcguucuucaacaacguguaccuccaggucaaggccaucuccaacaucguguggaaguaccagcgcuaccacuucaucauggccuaccacgagaagccggugcugccccccccccugaucauccucagccacaucgucucccuguucugcugcaucugcaagcggcgcaagaaggacaagaccagcgacgggccgaagcuguuccucacggaggaggaccagaagaagcugcacgacuucgaggagcagugcguggagauguacuucaacgagaaggacgacaaguuccacagcggcuccgaggagcggauccgcgugaccuucgagcgggucgagcagaugugcauccagaucaaggaggugggggaccgcgugaacuacaucaagcggagccugcagucccucgacagccagaucggccaccugcaggaccuguccgcccucaccgucgacacccugaagacgcugaccgcgcagaaggccagcgaggccuccaaggugcacaacgagaucacccgcgagcucagcaucuccaagcaccuggcccagaaccugaucgacgacggccccgugcggcccagcgucuggaagaagcacgggguggugaacacccucuccagcucccugccccagggcgaccuggagagcaacaacccguuccacugcaacauccucaugaaggacgacaaggacccccagugcaacaucuucgggcaggaccugcccgccgucccccagcgcaaggaguucaacuucccggaggcgggcuccagcuccggggcccuguuccccagcgccgugucccccccggagcuccggcagcgccugcacggcguggagcugcucaagaucuucaacaagaaccagaagcugggcagcagcuccacgagcaucccccaccuguccagcccccccaccaaguucuucgucuccaccccgagccagcccuccugcaagagccaccucgagaccgggacgaaggaccaggagaccgugugcuccaaggccaccgagggcgacaacaccgaguucggggccuucgugggccaccgggacagcauggaccugcagcgcuucaaggagacguccaacaagaucaagauccugagcaacaacaacaccuccgagaacacccucaagcgggucagcucccuggcgggcuucaccgacugccaccgcacgagcauccccgugcacuccaagcaggccgagaagaucagccgccggcccuccaccgaggacacccacgagguggacagcaaggccgcccugaucccggacuggcugcaggaccgccccagcaaccgggagaugcccuccgaggaggggacccucaacggccugacgagccccuucaagccggccauggacaccaacuacuacuacuccgcggucgagcgcaacaaccugaugcggcucagccaguccauccccuucacccccgugcccccgcgcggggagcccgugaccgucuaccggcuggaggagagcucccccaacauccugaacaacagcauguccagcuggucccagcucggccugugcgccaagaucgaguuccugagcaaggaggagauggggggcggccuccgccgggccgugaaggugcagugcaccugguccgagcacgacauccugaagagcgggcaccuguacaucaucaaguccuuccuccccgaggucgugaacacguggagcuccaucuacaaggaggacaccgugcugcaccugugccuccgcgagauccagcagcagcgggccgcccagaagcugaccuucgcguucaaccagaugaagccgaagagcauccccuacuccccccgcuuccuggaggucuuccuccuguacugccacagcgccggccagugguucgccguggaggagugcaugaccggggaguuccggaaguacaacaacaacaacggcgacgagaucauccccacgaacacccuggaggagaucaugcucgccuucagccacuggaccuacgaguacacccgcggggagcugcuggugcucgaccugcagggcgucggcgagaaccugacggacccguccgugaucaaggcggaggagaagcggagcugcgacaugguguucgggcccgccaaccucggcgaggacgccaucaagaacuuccgcgccaagcaccacugcaacuccugcugccggaagcugaagcugcccgaccucaagcgcaacgacuacacccccgacaagaucaucuucccgcaggacgagcccagcgaccugaaccugcagcccgggaacuccaccaaggagagcgaguccaccaacagcguccggcucaugcuguga

SEQ ID NO: 38154 - RNA, 3315 nt, Artificial Sequence
  derived and/or modified sequence opt1 from TRPM8__Homo_sapiens__NP_076985
augagcuuccgcgccgcccggcuguccaugcgcaaccggcgcaacgacacccucgacagcacccggacgcuguacuccagcgcgucccgcagcaccgaccuguccuacagcgaguccgaccucgugaacuucauccaggccaacuucaagaagcgggagugcgucuucuucaccaaggacagcaaggccaccgagaacgugugcaagugcggcuacgcccagucccagcacauggaggggacgcagaucaaccagagcgagaaguggaacuacaagaagcacaccaaggaguuccccaccgacgccuucggcgacauccaguucgagacccuggggaagaagggcaaguacauccgccuguccugcgacacggacgcggagauccucuacgagcugcugacccagcacuggcaccucaagaccccgaaccuggugaucagcgucaccgggggcgccaagaacuucgcccugaagccccggaugcgcaagaucuucucccggcucaucuacaucgcccagagcaagggcgcguggauccugaccgggggcacgcacuacgggcugaugaaguacaucggcgagguggugcgcgacaacaccaucucccggagcuccgaggagaacaucgucgccaucgggaucgccgccuggggcauggugagcaaccgcgacacccucauccggaacugcgacgccgagggcuacuuccuggcgcaguaccugauggacgacuucacgcgcgacccccucuacauccuggacaacaaccacacccaccuccuccugguggacaacgggugccacggccaccccaccgucgaggccaagcugcggaaccagcucgagaaguacaucagcgagcgcaccauccaggacuccaacuacgggggcaagaucccgaucgugugcuucgcccagggcgggggcaaggagacgcugaaggccaucaacaccagcaucaagaacaagauccccugcguggucguggagggguccggccagaucgccgacgugaucgcgagccuggucgagguggaggacgcccucaccuccagcgccgugaaggagaagcugguccgguuccugccccgcaccgugucccggcuccccgaggaggagacggagagcuggaucaaguggcugaaggagauccuggagugcucccaccuccugaccgugaucaagauggaggaggccggggacgagaucgucagcaacgccaucuccuacgcgcuguacaaggccuucagcaccuccgagcaggacaaggacaacuggaacggccagcucaagcugcugcucgaguggaaccagcuggaccuggccaacgacgagaucuucaccaacgaccgccgcugggagagcgccgaccuccaggaggugauguucacggcccugaucaaggaccggccgaaguucgugcgccuguuccucgagaacggccugaaccugcggaaguuccucacccacgacguccugaccgagcuguucuccaaccacuucagcacccugguguaccgcaaccuccagaucgcgaagaacuccuacaacgacgcccugcugacguucgucuggaagcucguggccaacuuccggcgcggguuccggaaggaggaccgcaacggccgggacgagauggacaucgagcugcacgacgugagccccaucacccgccacccccugcaggcccucuucaucugggcgauccugcagaacaagaaggagcuguccaaggucaucugggagcagacccgggggugcacccucgccgcccugggcgccagcaagcugcucaagacgcuggccaaggugaagaacgacaucaacgcggccggggagagcgaggagcuggccaacgaguacgagacccgcgccguggagcuguucaccgagugcuacuccagcgacgaggaccuggccgagcagcugcucgucuacuccugcgaggcguggggcggcagcaacugccuggagcuggccguggaggccaccgaccagcacuucaucgcccagcccggggugcagaacuuccucuccaagcagugguacggcgagaucagccgggacaccaagaacuggaagaucauccugugccuguucaucaucccgcucgucgggugcggcuucguguccuuccgcaagaagcccguggacaagcacaagaagcugcugugguacuacgucgccuucuucacgagccccuucgugguguucuccuggaacgucguguucuacaucgcguuccuccugcuguucgccuacgugcuccugauggacuuccacagcgucccccacccgcccgagcuggugcucuacucccugguguucguccuguucugcgacgaggugcggcagugguacgugaacggggucaacuacuucaccgaccucuggaacgugauggacacccugggccuguucuacuucaucgccggcaucguguuccgccuccacagcuccaacaagagcucccuguacagcgggcgggucaucuucugccuggacuacaucaucuucacccuccgccugauccacaucuucacggugucccggaaccugggccccaagaucaucaugcuccagcgcaugcugaucgacguguucuucuuccuguuccucuucgccgucuggaugguggcguucgggguggcccgccagggcauccugcggcagaacgagcagcgcuggcgguggaucuuccgcagcgucaucuacgagcccuaccuggccauguucggccaggugccgagcgacguggacgggaccaccuacgacuucgcccacugcaccuucacgggcaacgaguccaagccccucugcgucgagcuggacgagcacaaccugccccgguuccccgaguggaucaccaucccgcucgugugcaucuacaugcugagcaccaacauccugcucgugaaccugcuggucgccauguucggguacaccgugggcacggugcaggagaacaacgaccaggucuggaaguuccagcgcuacuuccucgugcaggaguacugcucccggcugaacauccccuuccccuucaucguguucgcguacuucuacauggucgugaagaagugcuucaagugcugcugcaaggagaagaacauggagagcuccgugugcugcuucaagaacgaggacaacgagacccuggccugggagggggucaugaaggagaacuaccucgugaagaucaacaccaaggccaacgacaccagcgaggagaugcgccaccgguuccgccagcuggacacgaagcugaacgaccucaagggccugcugaaggagaucgccaacaagaucaaguga

SEQ ID NO: 38155 - RNA, 3858 nt, Artificial Sequence
  derived and/or modified sequence opt1 from TRPS1__Homo_sapiens__NP_001269831
augcagagcaacauggugcgcaagaagaacccgccccugcggaacgucgcguccgagggcgaggggcagauccucgagcccaucggcaccgagagcaagguguccgggaagaacaaggaguucagcgccgaccagauguccgagaacaccgaccagagcgacgcggccgagcugaaccacaaggaggagcacucccugcacgugcaggaccccagcuccagcuccaagaaggaccucaagagcgccguccuguccgagaaggccggcuucaacuacgagagccccuccaagggcgggaacuucccgagcuucccccacgacgaggugacggaccgcaacaugcuggccuucuccagccccgcggccggcggggugugcgagccccucaaguccccgcagcgggccgaggccgacgacccccaggacauggcgugcacccccagcggcgacagccuggagaccaaggaggaccagaagaugucccccaaggccaccgaggagacggggcaggcccagagcggccaggccaacugccaggggcuguccccggucagcguggccuccaagaacccccaggugcccagcgacggcggcguccgccucaacaaguccaagaccgaccugcuggugaacgacaaccccgacccggcgccccucagccccgagcugcaggacuucaagugcaacaucugcggguacggcuacuacgggaacgaccccaccgaccugaucaagcacuuccggaaguaccaccucggccugcacaaccgcacccggcaggacgccgagcuggacuccaagauccucgcccugcacaacauggugcaguucagccacuccaaggacuuccagaaggucaaccgcagcguguucuccggcgugcugcaggacaucaacagcucccggccgguccuccugaacgggacguacgacguccaggugaccagcggcgggaccuucaucggcaucgggcgcaagacccccgacugccagggcaacacgaaguacuuccggugcaaguucugcaacuucaccuacaugggcaacuccagcaccgagcuggagcagcacuuccuccagacccaccccaacaagaucaaggccucccugcccagcagcgagguggccaagccguccgagaagaacagcaacaaguccauccccgcgcugcagagcuccgacagcggggaccucggcaaguggcaggacaagaucacggugaaggccggggacgacacccccgugggcuacuccguccccaucaagccgcuggacagcucccgccagaacgggaccgaggccaccagcuacuacuggugcaaguucugcuccuucagcugcgaguccagcuccagccugaagcuccuggagcacuacggcaagcagcacggcgccgugcaguccgggggccugaaccccgagcucaacgacaagcugagccgggggagcgugaucaaccagaacgaccuggccaaguccagcgagggcgagacgaugaccaagaccgacaaguccagcuccggggcgaagaagaaggacuucagcuccaagggcgccgaggacaacauggucaccagcuacaacugccaguucugcgacuuccgcuacuccaagagccacggccccgacgugaucgucguggggccgcuccugcggcacuaccagcagcugcacaacauccacaagugcacgaucaagcacugccccuucugcccccgcggccucugcucccccgagaagcaccugggggagaucaccuacccguucgccugccgcaagagcaacugcucccacugcgcccugcuccugcugcaccucagccccggcgccgcgggcuccagccgggugaagcaccagugccaccagugcuccuucaccacccccgacgucgacgugcugcuguuccacuacgagagcgugcacgagucccaggccagcgacgucaagcaggaggccaaccaccuccaggggagcgacggccagcaguccgugaaggagagcaaggagcacuccugcacgaagugcgacuucaucacccagguggaggaggagaucagccggcacuaccgccgggcccacuccugcuacaagugccgccagugcagcuucaccgcggccgacacccagucccugcuggagcacuucaacacgguccacugccaggagcaggacaucaccaccgccaacggggaggaggacggccacgccaucagcaccaucaaggaggagcccaagaucgacuuccgcguguacaaccugcucacgccggacuccaagaugggggagcccgugagcgaguccgucgugaagcgggagaagcuggaggagaaggacggccugaaggagaagguguggaccgagagcuccagcgacgaccuccgcaacgucaccuggcggggcgccgacauccugcgcgggucccccagcuacacccaggcgucccugggccuccugacccccgugagcgggacgcaggagcagaccaagacccugcgggacuccccgaacguggaggccgcccaccucgcccgccccaucuacggccuggccgucgagaccaagggguuccugcagggcgcgcccgccggcggggagaaguccggcgcccucccccagcaguacccggccagcggggagaacaaguccaaggacgagagccagucccugcugcggcgccggcgcggcagcgggguguucugcgccaacugccucacgaccaagaccucccuguggcggaagaacgcgaacggcggcuacgugugcaacgccugcgggcuguaccagaagcuccacagcacgccccgcccccugaacaucaucaagcagaacaacggcgagcagaucauccggcgccggacccgcaagcggcugaaccccgaggcccuccaggccgagcagcugaacaagcagcagcgcggguccaacgaggagcaggucaacggcagcccgcuggagcggcgcuccgaggaccaccucaccgagagccaccagcgcgagaucccccugcccucccugagcaaguacgaggcgcaggggucccucaccaagagccacuccgcccagcagcccgugcuggugagccagacccuggacauccacaagcggaugcagccgcuccacauccagaucaagagcccccaggagagcacgggcgaccccggcaacuccagcagcgucuccgaggggaagggcagcuccgagcgcgggagcccgaucgagaaguacaugcggcccgccaagcaccccaacuacuccccgcccggcagccccaucgagaaguaccaguacccccuguucggccugcccuucgugcacaacgacuuccaguccgaggccgacuggcuccgcuucuggagcaaguacaagcuguccgugccggggaacccccacuaccugagccacguccccggccuccccaacccgugccagaacuacgugcccuaccccaccuucaaccugcccccgcacuucuccgccguggggagcgacaacgacaucccccuggaccucgcgaucaagcacucccggcccggccccaccgccaacggggccagcaaggagaagaccaaggccccgcccaacgucaagaacgagggcccccugaacguggugaagacggagaaggucgaccgcuccacccaggacgagcugagcaccaagugcgugcacugcggcaucguguuccucgacgaggucauguacgcccugcacauguccugccacggggacagcggccccuuccagugcuccaucugccagcaccugugcaccgacaaguacgacuucacgacccacauccagcgggggcuccaccgcaacaacgcccagguggagaagaacggcaagccgaaggaguga

SEQ ID NO: 38156 - RNA, 2520 nt, Artificial Sequence
  derived and/or modified sequence opt1 from TRPV1__Homo_sapiens__NP_542437
augaagaaguggagcuccaccgaccugggcgccgccgcggacccccuccagaaggacacgugcccggacccccuggacggggaccccaacagccggcccccgcccgccaagccccagcuguccaccgccaagagccgcacccgccucuucggcaagggggacuccgaggaggccuuccccguggacugcccgcacgaggagggcgagcuggacagcugccccaccaucaccgucucccccgugaucacgauccagcggcccggggacggcccgaccggcgcccgccugcucagccaggacuccguggcggccagcaccgagaagacccugcggcuguacgaccgccgguccaucuucgaggccgucgcccagaacaacugccaggaccucgagagccugcugcuguuccugcagaaguccaagaagcaccugacggacaacgaguucaaggaccccgagaccgggaagaccugccuccugaaggcgaugcugaaccuccacgacggccagaacaccacgaucccccugcugcucgagaucgcccgccagaccgacagccugaaggagcuggugaacgccuccuacaccgacagcuacuacaaggggcagaccgcccuccacaucgccaucgagcggcgcaacauggcgcuggugacgcugcucgucgagaacggcgccgacgugcaggccgccgcccacggggacuucuucaagaagaccaagggccggcccggcuucuacuucggggagcugccgcugucccucgcggccugcaccaaccagcugggcaucgugaaguuccugcuccagaacagcuggcagaccgccgacaucuccgcccgcgacagcgucgggaacacggugcugcacgcccugguggaggucgcggacaacaccgccgacaacaccaaguucgugaccagcauguacaacgagauccucaugcugggcgccaagcugcaccccacgcucaagcuggaggagcugaccaacaagaagggcaugacgccccucgcccuggccgcggggaccggcaagaucggggugcuggccuacauccuccagcgggagauccaggagcccgagugccgccaccugucccggaaguucaccgagugggccuacggcccgguccacagcucccuguacgaccucagcugcaucgacacgugcgagaagaacuccgugcuggaggugaucgccuacagcuccagcgagacccccaaccgccacgacaugcugcuggucgagccccucaaccggcugcugcaggacaagugggaccgcuucgugaagcggaucuucuacuucaacuuccucguguacugccuguacaugaucaucuucaccauggcggccuacuaccgccccgucgacgggcugccgcccuucaagauggagaagaccggcgacuacuuccgggugaccggcgagauccucuccgugcucgggggcgucuacuucuucuuccgcgggauccaguacuuccugcagcgccggcccagcaugaagacccucuucguggacuccuacagcgagaugcuguucuuccugcagucccucuucaugcuggccaccgucgugcuguacuucagccaccucaaggaguacguggccuccauggucuucagccuggcccugggcuggacgaacaugcucuacuacacccgcggguuccagcagaugggcaucuacgcggugaugaucgagaagaugauccugcgggaccugugccgcuucauguucguguacaucgucuuccucuucggcuucuccaccgccguggugacccugaucgaggacgggaagaacgacagccugcccuccgagagcaccagccaccgguggcgcggcccggccugccggccgcccgacuccagcuacaacucccucuacagcacgugccuggagcuguucaaguucaccaucgggaugggcgaccucgaguucaccgagaacuacgacuucaaggccgucuucaucauccugcugcucgccuacgugauccugaccuacauccugcuccugaacaugcugaucgcgcucaugggggagacggugaacaagaucgcccaggaguccaagaacaucuggaagcugcagcgcgccaucaccauccuggacaccgagaaguccuuccucaagugcaugcggaaggccuuccgcagcggcaagcugcugcaggucggcuacacccccgacgggaaggacgacuaccgguggugcuuccgcguggacgaggugaacuggacgaccuggaacaccaacgucggcaucaucaacgaggaccccgggaacugcgagggcgugaagcggacccucagcuucucccugcgcagcucccgggugagcggccgccacuggaagaacuucgcccuggucccccuccugcgggaggcguccgcccgcgaccggcagagcgcccagcccgaggagguguaccugcgccaguucuccgggagccucaagccggaggacgccgagguguucaagucccccgcggccagcggcgagaaguga

SEQ ID NO: 38157 - RNA, 2295 nt, Artificial Sequence
  derived and/or modified sequence opt1 from TRPV2__Homo_sapiens__NP_057197
augaccagccccuccagcuccccgguguuccgccuggagacccucgacggcgggcaggaggacggcagcgaggccgaccgggggaagcuggacuucggcuccgggcugccgcccauggagagccaguuccagggcgaggaccgcaaguucgcgccccagauccgggucaaccucaacuaccgcaagggcacgggggccucccagcccgaccccaaccgguucgaccgcgaccggcuguucaacgccgugagccgcggcgugcccgaggaccuggccgggcuccccgaguaccuguccaagaccagcaaguaccugaccgacuccgaguacaccgagggcagcacggggaagaccugccucaugaaggccguccugaaccugaaggacggcgugaacgccugcauccucccgcugcugcagaucgaccgggacuccggcaacccccagccccucgugaacgcgcagugcaccgacgacuacuaccgcgggcacagcgcccugcacaucgccaucgagaagcggucccugcagugcgucaagcuccugguggagaacggcgccaacgugcacgcgcgcgccugcgggcgguucuuccagaagggccaggggaccugcuucuacuucggcgagcugccccucagccuggccgccugcacgaagcagugggacgucguguccuaccugcucgagaacccgcaccagcccgccagccugcaggcgaccgacucccagggcaacaccgugcugcacgcccucgucaugaucagcgacaacagcgccgagaacaucgcccuggugaccuccauguacgacgggcugcuccaggccggcgcgcgccugugccccacggugcagcuggaggacauccggaaccuccaggaccugacgccccugaagcucgccgccaaggaggggaagaucgagaucuuccgccacauccugcagcgggaguucagcggccugucccaccucagccgcaaguucaccgaguggugcuacggcccgguccgggugucccuguacgaccuggccagcguggacuccugcgaggagaacagcguccucgagaucaucgccuuccacugcaagagcccccaccgccaccggaugguggugcuggagccccugaacaagcuccugcaggcgaagugggaccugcucauccccaaguucuuccugaacuuccugugcaaccugaucuacauguucaucuucaccgccgucgccuaccaccagccgacccucaagaagcaggccgcgccccaccugaaggccgagguggggaacuccaugcugcucaccggccacauccugauccugcucgggggcaucuaccugcugguggggcagcucugguacuucuggcgccgccacgucuucaucuggaucuccuucaucgacagcuacuucgagauccuguuccuguuccaggcccuccugaccguggucucccaggugcugugcuuccucgccaucgagugguaccugccccugcucgugagcgcccugguccugggcuggcucaaccugcuguacuacacccggggcuuccagcacacggggaucuacuccgugaugauccagaaggugauccuccgcgaccugcugcgguuccuccugaucuaccuggucuuccucuucggcuucgcgguggcccuggugagccugucccaggaggccuggcgccccgaggccccgaccgggcccaacgccaccgagagcguccagcccauggagggccaggaggacgaggggaacggcgcgcaguaccggggcauccucgaggccucccuggagcuguucaaguucaccaucgggaugggcgagcucgccuuccaggagcagcugcacuuccgcgggauggugcugcuccugcugcucgccuacgugcugcugacguacauccuccugcugaacaugcucaucgcccugaugagcgagaccgucaacagcguggcgaccgacuccuggagcaucuggaagcugcagaaggccaucuccgugcucgagauggagaacggcuacugguggugccggaagaagcagcgcgccggcgucaugcugaccguggggacgaagcccgacggcagcccggacgagcgguggugcuuccgcguggaggaggucaacugggccuccugggagcagacccugcccacccucugcgaggaccccagcggggccggcgugccgcggacccuggagaaccccgugcuggcguccccgcccaaggaggacgaggacggggccagcgaggagaacuacguccccgugcagcuccugcaguccaacuga

SEQ ID NO: 38158 - RNA, 2376 nt, Artificial Sequence
  derived and/or modified sequence opt1 from TRPV3__Homo_sapiens__NP_001245134
augaaggcccaccccaaggagauggugccgcugaugggcaagcgcgucgccgcgcccagcgggaaccccgccauccuccccgagaagcggccggccgagaucacccccaccaagaaguccgcccacuucuuccuggagaucgagggcuucgagcccaaccccacgguggccaagaccagcccgcccguguucuccaagcccauggacagcaacauccgccagugcaucuccgggaacugcgacgacauggacagcccccaguccccgcaggacgacgucaccgagacccccagcaaccccaacucccccagcgcgcagcuggccaaggaggagcagcggcgcaagaagcggcgccucaagaagcggaucuucgccgccguguccgagggcugcguggaggagcuggucgagcugcucguggagcugcaggagcugugccgccggcgccacgacgaggacgugccggacuuccucaugcacaagcugacggcgagcgacaccgggaagaccugccugaugaaggcccuccugaacaucaaccccaacaccaaggagaucguccggauccugcucgccuucgccgaggagaacgacauccugggccgcuucaucaacgccgaguacacggaggaggcguacgagggccagaccgcccugaacaucgccaucgagcggcgccagggggacaucgccgcccuccugaucgcggccggcgccgacgugaacgcccacgccaagggggcguucuucaaccccaaguaccagcacgagggcuucuacuucggggagacgccccuggcccucgccgccugcaccaaccagccggagaucgugcagcugcugauggagcacgagcagaccgacaucaccucccgggacagccgcggcaacaacauccuccacgcccuggucaccguggcggaggacuucaagacccagaacgacuucgugaagcggauguacgacaugauccugcuccgcuccggcaacugggagcuggagacgacccggaacaacgacgggcugacgccccuccagcuggccgccaagaugggcaaggccgagauccugaaguacauccucagccgcgagaucaaggagaagcggcugcgcucccugagccgcaaguucaccgacugggcguacgggcccgucuccagcagccucuacgaccugaccaacguggacaccaccaccgacaacuccgugcuggagaucacggucuacaacaccaacaucgacaaccggcacgagaugcucacccuggagccccugcacacccuccugcacaugaaguggaagaaguucgccaagcacauguucuuccugagcuucugcuucuacuucuucuacaacaucacgcucacccugguguccuacuaccgcccgcgggaggaggaggccaucccccacccccuggcccucacccacaagaugggcuggcugcagcugcugggccgcauguucgugcucaucugggccaugugcaucagcgucaaggaggggaucgcgaucuuccugcugcggcccuccgaccuccagagcauccuguccgacgccugguuccacuucguguucuucauccaggccgugcuggucauccucagcguguuccuguaccuguucgccuacaaggaguaccucgccugccugguccuggcgauggcccucggcugggccaacaugcuguacuacacccgcggguuccaguccaugggcauguacagcgugaugauccagaaggugauccugcacgacguccucaaguuccuguucguguacaucguguuccugcucggguucggcgucgcccuggccucccugaucgagaagugcccgaaggacaacaaggacugcagcuccuacggcagcuucuccgacgcggugcucgagcuguucaagcugacgaucgggcucggcgaccugaacauccagcagaacagcaaguaccccauccuguuccucuuccugcugaucaccuacgugauccucaccuucguccugcugcucaacaugcugaucgcccugaugggggagaccguggagaacguguccaaggagagcgagcggaucuggcgccuccagcgggcccgcacgauccuggaguucgagaagaugcugcccgaguggcuccggucccgcuuccggaugggcgagcugugcaaggucgccgaggacgacuuccgccugugccuccggaucaacgaggugaaguggaccgaguggaagacccacgugagcuuccugaacgaggacccggggcccguccgccggaccgcggacuucaacaagauccaggacagcucccgcaacaacagcaagaccacgcugaacgccuucgaggagguggaggaguuccccgagaccuccguguga

SEQ ID NO: 38159 - RNA, 2514 nt, Artificial Sequence
  derived and/or modified sequence opt1 from TRPV4__Homo_sapiens__NP_001170902
auggccgacagcuccgagggcccccgcgccgggccgggcgagguggcggagcugcccggggacgagagcggcacccccggggacggccggcccaaccuccgcaugaaguuccagggcgccuuccggaagggggucccgaaccccaucgaccugcuggaguccacccucuacgagagcuccguggugcccggccccaagaaggccccgauggacagccuguucgacuacgggacguaccgccaccacuccagcgacaacaagcgguggcgcaagaagaucaucgagaagcagccccagucccccaaggcccccgccccgcagcccccgcccauccugaaggucuucaaccggcccauccucuucgacaucgugagccgcggcuccaccgcggaccuggacgggcugcuccccuuccugcugacccacaagaagcggcucaccgacgaggaguuccgcgagcccagcacgggcaagaccugccugcccaaggcccugcucaaccuguccaacggccggaacgacaccaucccggugcugcucgacaucgccgagcgcaccgggaacaugcgggaguucaucaacagccccuuccgcgacaucuacuaccggggccagacggcccugcacaucgcgaucgagcgccggugcaagcacuacgucgagcugcucguggcccagggggccgacgugcacgcccaggcccgcggccgguucuuccagcccaaggacgagggcggguacuucuacuucggcgagcugccccugucccucgcggccugcaccaaccagccgcacaucgucaacuaccugaccgagaacccccacaagaaggccgacaugcgccggcaggacagccgcgggaacaccgugcugcacgcccucguggccaucgcggacaacacgcgcgagaacaccaaguucgucaccaagauguacgaccugcugcuccugaagugcgcccggcuguuccccgacuccaaccucgaggccgugcugaacaacgacggccugagcccccucaugauggccgccaagaccgggaagaucggcaucuuccagcacaucauccgccgggaggugacggacgaggacacccgccaccugucccggaaguucaaggacugggcguacggcccggucuacagcagccuguacgaccucuccagccuggacacgugcggggaggaggccuccgugcuggagauccucguguacaacagcaagaucgagaaccgccacgagaugcuggccgucgagcccaucaacgagcugcuccgggacaaguggcgcaaguucggcgccguguccuucuacaucaacguggucagcuaccugugcgccauggugaucuucacccugaccgcguacuaccagccccucgaggggaccccgcccuaccccuaccggaccaccguggacuaccugcgccuggccggcgaggucaucacgcuguucaccgggguccucuucuucuucaccaacaucaaggaccuguucaugaagaagugccccggcgugaacucccuguucaucgacggcagcuuccagcuccuguacuucaucuacuccgugcuggugaucgucagcgccgcccucuaccuggcggggaucgaggccuaccuggccgugaugguguucgcccucguccugggcuggaugaacgcccuguacuucacccgggggcucaagcugacgggcaccuacuccaucaugauccagaagauccuguucaaggaccucuuccgcuuccugcugguguaccuccuguucaugaucggguacgcgagcgcccuggugucccuccugaacccgugcgccaacaugaaggucugcaacgaggaccagaccaacugcaccgugcccacguaccccagcugccgggacuccgagaccuucagcaccuuccugcucgaccuguucaagcugaccaucggcaugggcgaccucgagaugcuguccagcacgaaguaccccguggucuucaucauccugcucgugaccuacaucauccugaccuucgugcugcuccugaacaugcugaucgcccucaugggggagaccgucggccagguguccaaggagagcaagcacaucuggaagcugcagugggccaccacgauccuggacaucgagcgcagcuucccgguguuccuccggaaggcguuccgcuccggggagauggucaccgugggcaagagcuccgacggcacccccgaccggcgcuggugcuuccggguggacgaggucaacuggagccacuggaaccagaaccuggggaucaucaacgaggaccccggcaagaacgagaccuaccaguacuacggguucucccacacggugggccgccugcgccgggaccgcuggagcuccguggucccccgggugguggagcucaacaagaacagcaacccggacgaggucguggugccccuggacuccauggggaacccccgcugcgacggccaccagcagggcuacccccggaaguggcgcaccgacgacgccccgcuguga

SEQ ID NO: 38160 - RNA, 2190 nt, Artificial Sequence
  derived and/or modified sequence opt1 from TRPV5__Homo_sapiens__NP_062815
augggcggguuccugcccaaggccgagggcccggggagccagcuccagaagcugcugcccuccuuccucgugcgcgagcaggacugggaccagcaccuggacaagcugcacaugcuccagcagaagcggauccuggagagcccccugcuccgcgccuccaaggagaacgaccugagcguccugcggcagcuccugcuggacugcacgugcgacgugcgccagcggggcgcgcucggggagaccgcccugcacaucgccgcccuguacgacaaccucgaggccgcgcuggugcugauggaggccgcccccgagcucgucuucgagccgacgaccugcgaggccuucgcgggccagaccgcccugcacaucgccguggugaaccagaacgucaaccuggugcgcgcccuccugacccggcgcgccuccgugagcgcgcgggccaccggcaccgccuuccgccacagcccccggaaccugaucuacuucggggagcacccccucuccuucgccgccugcgucaacuccgaggagaucgugcgccugcugaucgagcacggcgcggacauccgggcccaggacagccucgggaacaccgugcugcacauccugauccuccagcccaacaagaccuucgccugccagauguacaaccugcugcucuccuacgacggccacggggaccaccuccagccgcuggaccucguccccaaccaccagggccugacgcccuucaagcuggccggcguggaggggaacaccgugauguuccagcaccucaugcagaagcgccggcacauccaguggaccuacggcccccugaccagcauccuguacgaccucacggagaucgacuccuggggcgaggagcugagcuuccuggagcucgucguguccagcgacaagcgcgaggcccggcagauccuggagcagaccccggugaaggagcuggucuccuucaaguggaacaaguacgggcgccccuacuucugcauccuggcggcccucuaccugcuguacaugaucugcuucacgaccugcugcguguaccggccccucaaguuccgcggcgggaaccggacccacagccgcgacaucaccauccugcagcagaagcugcuccaggaggccuacgagacccgcgaggacaucauccggcuggugggcgagcuggucuccaucgugggggccgugaucauccuccugcuggagauccccgacaucuuccgcgucggcgccagccgguacuucgggaagaccauccucggcggcccguuccacgugaucaucaucacguacgcgagccugguccuggugaccauggugaugcgccucaccaacaccaacggggaggucgugcccauguccuucgcccuggugcugggcuggugcagcgucauguacuucacgcggggguuccagaugcucggccccuucaccaucaugauccagaagaugaucuucggggaccugaugcgcuucugcuggcugauggccguggugauccucggcuucgccuccgcguucuacaucaucuuccagaccgaggaccccaccagccugggccaguucuacgacuacccgauggcccuguucacgaccuucgagcuguuccugaccgucaucgacgcccccgccaacuacgacguggaccugcccuucauguucuccaucgugaacuucgccuucaccaucaucgcgacgcuccugaugcugaaccucuucaucgccaugaugggggacacccacuggcgggucgcccaggagcgcgacgagcuguggcgggcccaggugguggccaccaccgucaugcuggagcgcaagcucccccggugccuguggccgcgcagcggcaucugcgggugcgaguucggccugggggaccggugguuccuccgcguggagaaccacaacgaccagaacccccugcgggugcugcgcuacgucgagguguucaagaacuccgacaaggaggacgaccaggagcaccccagcgagaagcagcccuccggcgcggagagcggcacgcucgcccgggccucccuggcccugccgaccagcucccucagccgcaccgccucccagagcuccagccaccgggggugggagauccugcgccagaacacccugggccaccucaaccuggggcugaaccucuccgagggcgacggcgaggagguguaccacuucuga

SEQ ID NO: 38161 - RNA, 2298 nt, Artificial Sequence
  derived and/or modified sequence opt1 from TRPV6__Homo_sapiens__NP_061116
augggcccccugcagggggacggcgggccggcccucggcggggccgacguggcgccccgccugagccccguccggguguggccccgcccgcaggcccccaaggagcccgcccugcaccccaugggccucucccugccgaaggagaagggccugauccucugccuguggagcaaguucugccggugguuccagcgccgggaguccugggcccagagccgcgacgagcagaaccugcuccagcagaagcggaucugggagagcccccugcugcucgccgcgaaggacaacgacgugcaggcccugaacaagcugcucaaguacgaggacugcaagguccaccagcgcggggccaugggcgagaccgcccugcacaucgcggcccuguacgacaaccucgaggccgccauggugcugauggaggccgcgcccgagcugguguucgagcccaugaccuccgagcucuacgaggggcagacggcccugcacaucgccgucgugaaccagaacaugaaccuggugcgggcccuccuggcccgccgggcguccgucagcgcccgcgccaccggcaccgccuuccggcgcuccccgugcaaccugaucuacuucggggagcacccccucagcuucgccgcgugcgugaacuccgaggagaucgugcggcugcugaucgagcacggcgccgacauccgcgcccaggacagccucggcaacaccguccugcacauccugauccuccagcccaacaagacguucgccugccagauguacaaccugcugcucuccuacgaccggcacggggaccaccuccagccccuggaccucgugccgaaccaccagggccugacccccuucaagcuggccgggguggagggcaacaccgucauguuccagcaccucaugcagaagcgcaagcacacccaguggacguacggcccccugaccagcacccuguacgaccucaccgagaucgacuccagcggggacgagcagucccugcuggagcucaucaucacgaccaagaagcgggaggcgcgccagauccuggaccagacccccgugaaggagcuggugagccugaaguggaagcgguacggccgcccguacuucugcaugcucggggccaucuaccugcuguacaucaucugcuucaccaugugcugcaucuaccgcccccucaagccccggacgaacaaccgcaccagcccccgggacaacacccugcugcagcagaagcuccugcaggaggccuacaugaccccgaaggacgacauccgccuggucggcgagcucgugacggugaucggggccaucaucauccugcuggucgaggugcccgacaucuuccggaugggcgugacccgcuucuucggccagaccauccucgggggccccuuccacguccugaucaucaccuacgcguucauggugcuggucacgauggugaugcggcucaucuccgccagcggggaggugguccccauguccuucgcccuggugcugggcuggugcaacgugauguacuucgcccgcggguuccagaugcucggcccguucaccaucaugauccagaagaugaucuucggcgaccugaugcgguucugcuggcugauggccgucgugauccucggguucgcgagcgccuucuacaucaucuuccagaccgaggaccccgaggagcugggccacuucuacgacuaccccauggcccuguucuccaccuucgagcuguuccugacgaucaucgacgggccggccaacuacaacguggaccugcccuucauguacagcaucaccuacgccgcguucgccaucaucgccacccuccugaugcugaaccuccugaucgccaugaugggcgacacccacuggcgcgucgcccacgagcgggacgagcuguggcgcgcgcagaucguggccacgaccgugaugcucgagcggaagcugccccgcugccuguggccccgguccgggaucugcggccgcgaguacggccucggggaccggugguuccugcgcgucgaggaccggcaggaccugaaccgccagcgcauccagcgguacgcccaggccuuccacacccgcggcagcgaggaccucgacaaggacuccguggagaagcuggagcuggggugcccguucagcccccaccucucccugcccaugcccagcgugucccggagcaccucccgcagcuccgcgaacugggagcggcugcgccagggcacgcuccggcgcgaccugcggggcaucaucaaccgcgggcuggaggacggcgagagcugggaguaccagaucuga

SEQ ID NO: 38162 - RNA, 11580 nt, Artificial Sequence
  derived and/or modified sequence opt1 from TRRAP__Homo_sapiens__NP_001231509
auggcguucguggccacccagggggcgaccgugguggaccagaccacccugaugaagaaguaccuccaguucguggccgcccugaccgacgucaacacccccgacgagaccaagcugaagaugaugcaggaggugagcgagaacuucgagaacgugaccagcagcccccaguacagcaccuuccucgagcacaucaucccccgcuuccugaccuuccugcaggacggggagguccaguuccuccaggagaagcccgcccagcagcugcggaagcuggugcucgagaucauccaccgcauccccaccaacgagcaccuccgcccccacaccaagaacgugcugagcgucauguuccgcuuccucgagaccgagaacgaggagaacgugcugaucugccugcggaucaucaucgagcuccacaagcaguuccggccgcccaucacccaggagauccaccacuuccuggacuucgugaagcagaucuacaaggagcugcccaaggucgugaaccgguacuucgagaacccccaggucauccccgagaacaccgugccgccgcccgagauggugggcaugaucaccaccaucgccgugaaggucaaccccgagcgcgaggacagcgagacccggacgcacagcaucaucccccgcgggagccucagccugaaggugcuggcggagcuccccaucaucgugguccugauguaccagcuguacaagcucaacauccacaacgugguggccgaguucgucccccugaucaugaacaccaucgccauccaggugagcgcccaggcgcggcagcacaagcuguacaacaaggagcucuacgccgacuucaucgccgcccagaucaagacccugagcuuccuggccuacaucauccgcaucuaccaggagcucgucaccaaguacucccagcagauggugaagggcaugcugcagcugcucagcaacugccccgcggagacggcccaccuccggaaggagcugcucaucgccgccaagcacauccugaccaccgagcugcgcaaccaguucauccccugcauggacaagcuguucgacgaguccauccugaucgggagcggcuacaccgcccgggagacgcugcgcccccucgcguacuccacccuggccgaccuggugcaccacguccggcagcaccucccccugagcgaccugucccucgccgugcagcuguucgccaagaacaucgacgacgagagccugcccuccagcauccagaccaugagcugcaagcugcuccugaaccugguggacugcauccgcuccaagagcgagcaggaguccggcaacgggcgggacguccucaugcgcaugcuggagguguucgugcugaaguuccacaccaucgcccgguaccagcucagcgcgaucuucaagaagugcaagccccaguccgagcugggcgccgucgaggccgcccugcccggggugcccacggcccccgcggcccccggccccgcccccagccccgcccccgugcccgcgcccccgcccccgcccccgccgccgccgcccgccacccccgucacccccgcccccgugccgcccuucgagaagcagggggagaaggacaaggaggacaagcagaccuuccaggugacggacugccgcucccucgucaagacccuggugugcggcgugaagaccaucaccuggggcaucacgagcugcaaggcccccggggaggcccaguucauccccaacaagcagcugcagcccaaggagacccagaucuacaucaagcucgucaaguacgcgaugcaggcccuggacaucuaccaggugcagaucgccggcaacgggcagaccuacauccgcguggccaacugccagaccguccggaugaaggaggagaaggaggugcuggagcacuucgccggcguguucaccaugaugaacccccucacguucaaggagaucuuccagaccaccguccccuacaugguggagcgcaucuccaagaacuacgcgcugcagaucguggccaacagcuuccuggccaaccccaccacguccgcccucuucgccaccauccuggucgaguaccugcucgaccggcugcccgagaugggcagcaacguggagcuguccaaccucuaccugaagcuguucaagcucguguucgggagcgucucccuguucgcggccgagaacgagcagaugcugaagccccaccuccacaagaucgugaacagcuccauggagcuggcccagaccgccaaggagccguacaacuacuuccugcuccugcgcgcgcuguuccggagcaucggcgggggcucccacgaccuccuguaccaggaguuccugccccuccugcccaaccugcuccaggggcugaacaugcugcagagcggccuccacaagcagcacaugaaggaccuguucguggagcugugccucaccgucccggugcgccugagcucccugcuccccuaccugcccaugcugauggacccccucgugagcgcccugaacggcucccagacgcuggucagccaggggcuccggacccuggagcugugcguggacaaccuccagccggacuuccuguacgaccacauccagcccgugcgcgccgagcugaugcaggcccucuggcggacccugcgcaaccccgccgacuccaucagccacgucgcguaccgggugcugggcaaguucgggggcuccaaccgcaagaugcucaaggagagccagaagcugcacuacguggucaccgaggugcaggggcccuccaucacgguggaguucagcgacugcaaggccucccugcagcucccgauggagaaggccaucgagaccgcccuggacugccucaagagcgccaacaccgagcccuacuaccggcgccaggcgugggaggucaucaagugcuuccucguggccaugaugucccuggaggacaacaagcacgcccuguaccagcuccuggcccaccccaacuucaccgagaagacgauccccaacgugaucaucagccaccgguacaaggcccaggacaccccggcgcgcaagaccuucgagcaggcccugaccggcgccuucauguccgccgucaucaaggaccuccggcccagcgcgcugcccuucguggccucccugauccgccacuacacgaugguggccgucgcccagcagugcggccccuuccuccugccgugcuaccagguggggagccagcccagcaccgccauguuccacuccgaggagaacggcagcaaggggauggacccccugguccucaucgacgcgaucgccaucugcauggccuacgaggagaaggagcugugcaagaucggcgagguggcccuggccgugaucuucgacgucgcguccaucauccucgggagcaaggagcgggccugccagcugccccuguucuccuacaucguggagcgccucugcgccugcugcuacgagcaggccugguacgccaagcugggcggcguggucagcaucaaguuccugauggagcgccucccgcugaccugggugcugcagaaccagcagaccuuccugaaggcgcuccuguucgugaugauggaccugacgggggaggucuccaacggcgccguggccauggccaagaccacccucgagcagcugcugaugcggugcgccacgccccugaaggacgaggagcgcgcggaggagaucguggccgcccaggagaaguccuuccaccacgucacgcacgaccuggugcgggaggugaccucccccaacagcaccguccgcaagcaggccaugcacucccuccaggugcucgcccaggugaccggcaagagcgucacggugaucauggagccccacaaggaggugcugcaggacauggucccgcccaagaagcaccuccugcggcaccagcccgccaacgcccagaucggccugauggagggcaacaccuucugcaccacccugcagccccgccucuucacgauggaccugaacgugguggagcacaaggucuucuacaccgagcugcucaaccugugcgaggccgaggacuccgcccugaccaagcucccgugcuacaagagccugcccucccuggugccccuccggaucgcggcccugaacgcccuggccgccugcaacuaccucccgcagagccgcgagaagaucaucgcggcccuguucaaggcccugaacuccaccaacagcgagcuccaggaggccggggaggccugcaugcggaaguuccuggagggcgcgaccaucgagguggaccagauccacacgcacaugcgcccccugcucaugaugcugggggacuaccggucccugacccucaacgucgugaaccgccugaccagcgugacccggcuguuccccaacagcuucaacgacaaguucugcgaccagaugaugcagcaccuccgcaaguggauggaggucguggugaucacgcacaagggcgggcagcgguccgacggcaacgagagcaucuccgagugcggccgcugcccccugagcccguucugccaguucgaggagaugaagaucugcuccgccaucaucaaccuguuccaccucauccccgccgcgccccagacccuggucaagccccugcucgagguggugaugaagaccgagcgggccaugcugaucgaggccgggagcccguuccgcgagccccugaucaaguuccucacccggcaccccucccagacggucgagcuguucaugauggaggccacccugaacgacccccaguggagccgcauguucauguccuuccucaagcacaaggacgcccggccgcugcgcgacgugcuggccgcgaaccccaaccgcuucaucacccuccugcugcccggcggggcccagaccgccgugcggcccggcagcccguccacgagcaccaugcgccucgaccugcaguuccaggccaucaagaucaucuccaucaucgucaagaacgacgacagcuggcuggccucccagcacagccucgugucccagcugcggcgcgugugggucagcgagaacuuccaggagcggcaccgcaaggagaacauggcggccaccaacuggaaggagcccaagcugcucgccuacugccugcugaacuacugcaagcggaacuacggggacaucgagcuccuguuccagcugcuccgcgccuucaccggccgguuccugugcaacaugacguuccugaaggaguacauggaggaggagauccccaagaacuacuccaucgcccagaagcgcgcccuguucuuccgguucguggacuucaacgaccccaacuucggcgacgagcugaaggccaaggugcugcagcacauccucaacccggccuuccuguacagcuucgagaagggggagggcgagcagcugcucgggccgcccaaccccgagggcgacaacccggagagcaucaccuccgucuucaucaccaaggugcuggaccccgagaagcaggccgacaugcuggacagccuccgcaucuaccugcugcaguacgcgacccuccugguggagcacgcgccccaccacauccacgacaacaacaagaaccggaacuccaagcugcgccggcucaugacguucgccuggcccugccugcugagcaaggccugcgucgacccggccugcaaguacuccgggcaccuccugcuggcgcacaucaucgccaaguucgccauccacaagaagaucgugcuccagguguuccacagccugcugaaggcccacgccauggaggcgcgcgccaucguccggcaggccauggccauccucacccccgccgugcccgcgcgcauggaggacggccaccagaugcugacccacuggacccggaagaucaucgucgaggagggccacacggugccgcagcuggugcacauccuccaccugaucguccagcacuucaagguguacuaccccgugcgccaccaccugguccagcacaugguguccgccaugcagcgccugggguucacccccagcgugaccaucgagcagcggcgccucgccgucgaccuguccgagguggugaucaagugggagcugcagcggaucaaggaccagcagcccgacagcgacauggacccgaacuccagcggcgagggggucaacuccgugagcuccagcaucaagcgcggccucuccguggacagcgcccaggaggucaagcgguuccgcaccgccacgggggcgaucuccgccguguucggccggagccagagccugcccggcgccgacucccugcucgccaagcccaucgacaagcagcacaccgacaccguggucaacuuccugauccgcguggcgugccaggugaacgacaacaccaacacggccgggagccccggcgagguccugucccggcgcugcgugaaccuccugaagaccgcccugcggccggacauguggcccaagagcgagcucaagcugcagugguucgacaagcugcucaugaccguggagcagcccaaccaggucaacuacgggaacaucugcaccggccuggaggugcuguccuuccuccugacggugcugcagagccccgccauccucuccagcuucaagccgcugcagcgcggcaucgccgcgugcaugaccugcgggaacaccaagguccugcgggccgugcacucccuccugagccgccugauguccaucuuccccaccgagcccagcaccuccagcguggccuccaaguacgaggagcucgagugccuguacgccgccgucggcaaggugaucuacgaggggcugacgaacuacgagaaggcgaccaacgccaaccccagccagcuguucggcacccugaugauccugaaguccgccugcagcaacaacccguccuacaucgaccggcucaucagcguguucaugcgcagccugcagaagaugguccgggagcaccugaacccccaggccgccuccgggagcaccgaggcgacguccggcaccagcgagcucgugaugcugucccuggagcucgugaagacccgccuggccgucaugagcauggagaugcggaagaacuucauccaggccauccugaccucccucaucgagaagucccccgacgccaagauccugcgcgcgguggugaagaucgucgaggagugggugaagaacaacucccccauggccgccaaccagacgccgacccugcgggagaaguccauccuccuggugaagaugaugaccuacaucgagaagcgcuuccccgaggaccuggagcucaacgcccaguuccuggaccuggucaacuacguguaccgcgacgagacccucuccggcagcgagcugacggccaagcuggagcccgcguuccucuccgggcugcggugcgcccagccccugauccgcgccaaguucuucgagguguucgacaacagcaugaagcggcgcgucuacgagcggcuccuguacgugaccugcucccagaacugggaggccaugggcaaccacuucuggaucaagcagugcaucgagcugcuccuggccgugugcgagaaguccaccccgaucgggaccuccugccagggcgcgaugcugcccagcaucacgaacgucaucaaccucgccgacucccacgaccgcgccgccuucgccauggugacccacgugaagcaggagccccgggagcgcgagaacagcgagagcaaggaggaggacgucgagaucgacaucgagcuggcgccgggggaccagaccuccacccccaagacgaaggagcugagcgagaaggacaucggcaaccagcuccacaugcugaccaaccggcacgacaaguuccuggacacccuccgcgaggugaagaccggcgcccugcuguccgccuucguccagcucugccacaucagcacgacccuggccgagaagaccugggugcagcuguucccccggcucuggaagauccuguccgaccgccagcagcacgcgcuggccggggagaucagccccuuccucugcuccggcagccaccaggugcagcgggacugccagccguccgcccugaacugcuucgucgaggccaugagccagugcgugccgcccauccccauccgcccgugcgugcugaaguaccucgggaagacccacaaccugugguuccgguccacgcugaugcucgagcaccaggccuucgagaagggccugagccugcagaucaagcccaagcagaccaccgaguucuacgagcaggaguccaucacgccgccccagcaggagauccucgacagccuggcggagcuguacucccuccugcaggaggaggacaugugggccgggcuguggcagaagcgcugcaaguacagcgagacggccaccgccaucgccuacgagcagcacggcuucuucgagcaggcgcaggaguccuacgagaaggccauggacaaggccaagaaggagcacgagcggagcaacgccagcccggccaucuuccccgaguaccagcucugggaggaccacuggauccgcugcuccaaggagcugaaccagugggaggcgcugaccgaguacggccagagcaaggggcacaucaaccccuaccucguccuggagugcgccuggcggguguccaacuggaccgccaugaaggaggcccuggugcaggucgaggugagcugccccaaggagauggccuggaaggugaacauguaccgcggcuaccuggcgaucugccacccggaggagcagcagcucuccuucaucgagcgccuggucgagauggccagcucccuggccauccgggaguggcgccggcucccccacguggugagccacguccacacgccccugcugcaggccgcgcagcagaucaucgagcuccaggaggccgcccagaucaacgccgggcugcagcccaccaaccugggccgcaacaacucccuccacgacaugaagaccguggugaagaccuggcggaaccgccugccgaucgucagcgacgaccugucccacuggagcuccaucuucauguggcggcagcaccacuaccagggcaagcccacguggagcgggaugcacuccagcuccaucgugaccgccuacgagaacagcucccagcacgaccccagcagcaacaacgcgaugcucggcgugcacgccuccgccagcgccaucauccaguacgggaagaucgcccgcaagcagggccuggucaacguggcgcuggacauccucucccggauccacaccauccccaccgugccgaucgucgacugcuuccagaagauccgccagcaggucaagugcuaccugcagcuggccggggugaugggcaagaacgagugcaugcagggccucgaggucaucgagagcaccaaccugaaguacuucacgaaggagaugaccgccgaguucuacgcccugaaggggauguuccucgcccagaucaacaaguccgaggaggcgaacaaggccuucagcgccgccgugcagaugcacgacgugcuggucaaggcgugggccauguggggcgacuaccuggagaacaucuucgugaaggagcggcagcuccaccuggggguguccgccaucacgugcuaccugcacgccugccgccaccagaacgagagcaagucccggaaguaccucgccaagguccuguggcugcucagcuucgacgacgacaagaacacccuggcggacgccguggacaaguacugcaucggcgugccgcccauccaguggcuggccuggaucccccagcuccugacgugccuggucggguccgagggcaagcuccugcugaaccucaucagccaggugggccgcguguacccgcaggccgucuacuuccccauccggacccuguaccugacccucaagaucgagcagcgcgagcgguacaaguccgaccccgggccgauccgcgccaccgcgcccauguggcggugcagccgcaucaugcacaugcagcgggagcugcaccccacgcugcucuccagccuggagggcaucguggaccagauggugugguuccgcgagaacuggcacgaggagguccugcgccagcuccagcaggggcuggccaagugcuacuccguggccuucgagaaguccggcgccguguccgacgccaagaucacgccccacacccugaacuucgucaagaagcucgugagcaccuucggggugggccuggagaacgucagcaacguguccacgauguucagcuccgcggccagcgagucccuggcccggcgcgcccaggccaccgcgcaggacccgguguuccagaagcucaagggccaguucaccaccgacuucgacuucagcguccccggguccaugaagcugcacaaccugaucagcaagcucaagaaguggaucaagauccuggaggccaagacgaagcagcugcccaaguucuuccucaucgaggagaagugccgguuccuguccaacuucagcgcccagaccgccgagguggagauccccggcgaguuccugaugccgaagcccacccacuacuacaucaagaucgcgcgcuucaugccccgggucgagaucgugcagaagcacaacaccgccgcccgccggcucuacauccgcgggcacaacggcaagaucuaccccuaccuggugaugaacgacgccugccugacggagucccggcgcgaggagcggguccuccagcugcugcgccuccugaacccgugccuggagaagcggaaggagaccaccaagcgccaccucuucuucaccgugccccggguggucgccgugagcccccagaugcgccugguggaggacaaccccuccagccugucccucgucgagaucuacaagcagcggugcgcgaagaaggggaucgagcacgacaacccgaucagccgcuacuacgaccggcuggccacggugcaggcccgcggcacccaggccucccaccaggugcugcgcgacauccucaaggagguccagagcaacauggugccccgguccaugcugaaggagugggcccugcacaccuuccccaacgcgaccgacuacuggacguuccgcaagauguucaccauccagcucgcccugaucggcuucgccgaguucgugcugcaccucaaccggcugaaccccgagaugcugcagaucgcccaggacaccgggaagcucaacgucgccuacuuccgcuucgacaucaacgacgcgaccggcgaccuggacgccaaccggccggugcccuuccgccugacgcccaacaucagcgaguuccucaccaccaucggggugagcggcccccugaccgccuccaugaucgccgucgcgcggugcuucgcccagccgaacuucaagguggacggcauccugaagacggugcuccgcgacgagaucaucgccuggcacaagaagacccaggaggacaccagcagcccccuguccgccgccgggcagcccgagaacauggacucccagcagcuggucagccuggugcagaaggcggugaccgccaucaugacccggcuccacaaccuggcccaguucgagggcggggaguccaaggucaacacgcugguggccgccgcgaacagccucgacaaccugugccgcauggaccccgccuggcacccguggcuguga

SEQ ID NO: 38163 - RNA, 432 nt, Artificial Sequence
  derived and/or modified sequence opt1 from TSACC__Homo_sapiens__NP_001291755
augggcgagcgccccgccgggcuggcccagggcaccaccccgguggggguccagauggagcggcacacgagccaccccaaccgcaaggugcccgcgaaggaggaggccaacgccgugccccugugccgggccaagccgucccccagcuacaucaaccugcaggccuccagcccgcccgcgaccuuccugaacauccagaccaccaagcuccccuccgucgaccacaagcccaaggagugccugggccugcucgagugcauguacgccaaccugcagcugcagacgcagcucgcccagcagcagauggccgugcuggagcaccuccaggcgagcgugacccagcuggcccccgggcgcggcuccaacaacagcucccugcccgcccugagcccgaacccccuccugaaccaccucccccaguucuccaaguga

SEQ ID NO: 38164 - RNA, 3342 nt, Artificial Sequence
  derived and/or modified sequence opt1 from TSC1__Homo_sapiens__NP_001155899
auggcccagcaggccaacgugggcgagcugcucgcgaugcuggacagccccaugcuggggguccgcgacgacgugaccgccguguucaaggagaaccucaacuccgaccggggcccgaugcuggucaacacccugguggacuacuaccucgagacgagcucccagcccgcccugcacauccugaccacccuccaggagccccacgacaagauggacaccgacguggucgugcugacgaccggggugcugguccucaucaccaugcugcccaugaucccgcagagcggcaagcagcaccugcucgacuucuucgacaucuucgggcgccuguccagcuggugccugaagaagcccggccacguggccgagguguaccucguccaccugcacgccuccguguacgcgcuguuccaccggcucuacggcauguaccccugcaacuucgugagcuuccugcgcucccacuacagcaugaaggagaaccuggagaccuucgaggaggucgugaagcccaugauggagcacgugcggauccacccggagcucgucacgggguccaaggaccacgagcuggacccccgccgguggaagcgccuggagacccacgacguggugaucgagugcgccaagaucagccucgaccccaccgaggccuccuacgaggacggcuacagcgucucccaccagaucagcgcccgguucccccaccgcuccgcggacgugaccacgagcccguacgccgacacccagaacuccuacgggugcgccaccagcacccccuacagcacgucccggcugaugcugcucaacaugcccggccagcugccccagacccugagcuccccgagcacccgccucaucaccgagcccccccaggccacgcuguggucccccagcauggugugcgggaugaccaccccgcccaccucccccggcaacguccccccggaccugagccaccccuacuccaagguguucggcacgaccgccgggggcaaggggaccccccucggcacccccgcgacgagcccgccccccgccccgcugugccacuccgacgacuacguccacaucagccugccccaggccaccgugacccccccccggaaggaggagcgcauggacuccgcccggccgugccuccaccgccagcaccaccugcugaacgaccggggcagcgaggagccccccggguccaagggcagcgugacccucuccgaccugcccggguuccugggcgaccucgccagcgaggaggacuccaucgagaaggacaaggaggaggcggccaucagccgcgagcugagcgagaucacgaccgccgaggccgagccggucgugccccgggggggcuucgacucccccuucuaccgcgacagccugcccggcucccagcggaagacccacagcgccgcguccagcucccagggggccagcgugaacccggagccccuccacuccagccuggacaagcugggccccgacacccccaagcaggccuucacgccgaucgaccugcccugcggguccgccgacgagagccccgccggcgaccgcgagugccagaccucccucgagaccagcaucuucacccccuccccgugcaagauccccccccccacccgcgucggguucggcagcggccagccgccccccuacgaccaccuguucgagguggcgcugccgaagacggcccaccacuucgugauccggaagaccgaggagcuccugaagaaggccaaggggaacaccgaggaggacggcguccccuccaccagccccauggaggugcuggaccgccucauccagcagggggccgacgcgcacagcaaggagcugaacaagcugccccucccguccaagagcguggacuggacgcacuucggcggguccccccccagcgacgagauccggacccugcgcgaccagcugcuccugcugcacaaccagcuccuguacgagcgguucaagcgccagcagcacgcccugcggaaccgccggcuccugcgcaaggucaucaaggccgccgcccuggaggagcacaacgcggccaugaaggaccagcucaagcugcaggagaaggacauccagauguggaaggugucccugcagaaggagcaggcccgguacaaccagcuccaggagcagcgcgacaccauggugaccaagcugcacagccagauccggcagcugcagcacgaccgcgaggaguucuacaaccagucccaggagcuccagacgaagcuggaggacugccggaacaugaucgccgagcugcgcaucgagcucaagaaggccaacaacaaggucugccacaccgagcugcugcucagccaggugucccagaagcugagcaacuccgagagcgugcagcagcagauggaguuccugaaccggcagcuccugguccugggcgaggugaacgagcucuaccuggagcagcugcagaacaagcacuccgacaccaccaaggagguggagaugaugaaggcggccuaccgcaaggagcucgagaagaaccggagccacguccugcagcagacgcagcgccuggacaccucccagaagcgcauccucgagcuggagagccaccuggccaagaaggaccaccuccugcuggagcagaagaaguaccucgaggacgugaagcugcaggcccggggccagcugcaggccgcggagucccgcuacgaggcccagaagcggaucacccagguguucgagcucgagauccuggaccuguacgggcgccucgagaaggacggccugcugaagaagcucgaggaggagaaggccgaggccgcggaggccgccgaggagcggcuggacugcugcaacgacgggugcagcgacuccauggucggccacaacgaggaggccagcggccacaacggggagaccaagacgccccgcccgagcuccgcccggggcagcuccgggagccgcggcgggggcggcuccagcuccagcuccagcgagcuguccacccccgagaagcccccccaccagcgggcggggccguucagcucccgcugggagaccaccaugggcgaggccagcgccuccauccccacgaccguggggagccuccccuccagcaaguccuuccugggcaugaaggcccgggagcuguuccgcaacaagagcgagagccagugcgacgaggacgggaugaccuccagccucuccgagagccugaagaccgagcugggcaaggaccucggcguggaggccaagaucccccugaaccuggacgggccgcaccccuccccccccacgccggacagcgucggccagcuccacaucauggacuacaacgagacccaccacgagcacuccuga

SEQ ID NO: 38165 - RNA, 1713 nt, Artificial Sequence
  derived and/or modified sequence opt1 from TSC22D1__Homo_sapiens__NP_001230728
augcaccagcccccggagagcaccgccgccgcggccgccgccgccgacaucuccgcgcgcaagauggcccaccccgccauguucccccggcgcggcagcggguccggcagcgccuccgcgcugaacgccgccgggaccggcguggggagcaacgccacguccagcgaggacuucccgccgcccucccuccugcagccgcccccgcccgccgcgagcuccaccagcggcccccagccgccgccgccccagucccugaaccuccugagccaggcccagcugcaggcccagccccucgcccccggcgggacccagaugaagaagaaguccggcuuccagaucaccagcgucacgcccgcccagaucuccgcgagcaucuccagcaacaacagcaucgccgaggacaccgaguccuacgacgaccuggacgagagccacaccgaggaccuguccagcuccgagauccucgacgugagccugucccgggccaccgaccugggggagcccgagcgcagcuccagcgaggagacgcucaacaacuuccaggaggccgagacccccggcgccgugucccccaaccagccccaccucccccagccccaccucccccaccucccccagcagaacgucgugaucaacgggaacgcgcacccccaccaccuccaccaccaccaccagauccaccacggccaccaccuccagcacggccaccaccaccccagccacguggccgucgccuccgccagcaucaccgggggcccgcccuccagccccgugucccggaagcugagcaccacgggguccagcgacagcaucacccccguggcccccaccuccgcggucagcuccagcggcucccccgccagcgugaugaccaacaugcgcgcccccuccacgaccggcgggaucggcaucaacagcgugaccgggaccuccacggucaacaacgugaacaucaccgccgugggcagcuucaacccgaacgucaccuccagcaugcuggggaacgugaacaucuccaccagcaacauccccuccgcggccggcgugagcgucggccccggggugacguccggcgugaacgucaacauccugagcgggaugggcaacgggaccaucagcuccagcgccgccguguccagcgugcccaacgccgcggccggcaugaccggcggguccgucagcucccagcagcagcagccgaccgugaacacgagccgguuccgcgucgugaagcuggacuccagcuccgagcccuucaagaagggccgguggaccugcaccgaguucuacgagaaggagaacgccgugcccgccaccgaggggguccugaucaacaaggugguggagacggucaagcagaaccccaucgaggugaccagcgagcgcgaguccaccagcggcuccagcguguccagcuccgucagcacccugagccacuacacggaguccguggggagcggcgagaugggcgccccgaccguggucgugcagcagcagcagcagcagcagcagcagcagcagcagcagcccgcgcugcagggggugacccugcagcagauggacuucggcuccaccgggccccagagcauccccgccgucuccaucccgcagagcaucucccagagccagaucucccaggugcagcugcagagccaggagcuguccuaccugaccaugaaggugguccugcucaucguguaccugugcauguga

SEQ ID NO: 38166 - RNA, 234 nt, Artificial Sequence
  derived and/or modified sequence opt1 from TSC22D3__Homo_sapiens__NP_001015881
auggaccuggugaagaaccaccucauguacgccguccgcgaggagguggagauccugaaggagcagauccgggagcugguggagaagaacagccagcucgagcgcgagaacacccugcugaagacccucgccucccccgagcagcuggagaaguuccagagcugccuguccccggaggagcccgcgcccgagagcccccaggucccggaggcccccggcggguccgccguguga

SEQ ID NO: 38167 - RNA, 1188 nt, Artificial Sequence
  derived and/or modified sequence opt1 from TSC22D4__Homo_sapiens__NP_001289972
augagcggcgggaagaagaaguccagcuuccagaucaccuccgugaccacggacuacgagggccccgggagcccgggcgccuccgacccgcccacgccccagccgcccaccgggcccccgccccgccugcccaacggcgagcccagccccgaccccggcgggaagggcacgccccggaacggguccccgccgcccggcgcccccagcucccgcuuccgggucgugaagcucccccacgggcugggcgagcccuaccgccggggccgcuggaccugcguggacgucuacgagcgggaccuggagccccacagcuucgggggccuccuggaggggauccgcggcgcguccggcggggccggcgggcggagccuggacucccgccucgagcuggccagccugggccucggggcccccaccccgcccuccggccugagccagggccccaccuccuggcugcggcccccgcccaccagccccgggccccaggcccgcuccuucaccggcgggcucggccagcugguggugcccagcaaggcgaaggccgagaagccgccccugagcgccuccagcccccagcagcggcccccggagcccgagaccggggaguccgccggcaccagccgcgcggccacgccccuccccucccugcgggucgaggccgaggccggcgggagcggcgcccgcaccccgccccugucccggcgcaaggcgguggacaugcggcuccgcauggagcugggggcccccgaggagaugggccaggugcccccgcuggacagccggcccuccagccccgcccucuacuucacccacgacgccucccugguccacaagagccccgacccguucggggccguggcggcccagaaguucucccuggcccacagcaugcucgccaucuccggccaccuggacagcgacgacgacuccggcagcgggucccuggugggcaucgacaacaagaucgagcaggccauggaccucgucaagagccaccugauguucgcggugcgcgaggagguggagguccugaaggagcagauccgcgagcucgccgagcggaacgccgcccuggagcaggagaacgggcugcuccgcgcccuggcgagccccgagcagcuggcccagcuccccuccagcggcgugccccggcugggcccgcccgcccccaacgggcccuccguguga

SEQ ID NO: 38168 - RNA, 5424 nt, Artificial Sequence
  derived and/or modified sequence opt1 from TSC2__Homo_sapiens__NP_000539
auggccaagcccaccuccaaggacuccgggcugaaggagaaguucaagauccugcuggggcugggcacgccccgccccaacccccggagcgccgaggggaagcagaccgaguucaucaucaccgcggagauccuccgcgagcuguccauggagugcggccugaacaaccggauccgcaugaucgggcagaucugcgagguggccaagaccaagaaguucgaggagcacgccguggaggcccucuggaaggccguggcggaccugcugcagcccgagcggccccucgaggcccgccacgccgugcuggcccugcucaaggcgaucguccagggccagggcgagcggcugggggugcugcgcgcccucuucuucaaggugaucaaggacuaccccagcaacgaggaccugcacgagcggcuggaggucuucaaggcccucaccgacaacggccgccacaucaccuaccuggaggaggagcuggccgacuucgugcuccaguggauggacguggggcuguccagcgaguuccugcucguccuggugaaccuggugaaguucaacuccugcuaccucgacgaguacaucgcccggaugguccagaugaucugccugcugugcgugcgcaccgcgagcuccguggacaucgaggucagccuccaggugcuggacgccguggucugcuacaacugccugcccgccgagucccucccccuguucaucgugacccugugccggaccaucaacgugaaggagcucugcgagcccugcuggaagcugaugcgcaaccugcucggcacgcaccuggggcacagcgccaucuacaacaugugccaccugauggaggaccgggccuacauggaggacgcgccccuccugcgcggcgccgucuucuucgugggcauggcccuguggggcgcccaccggcucuacucccugcgcaacagccccaccuccgugcugcccagcuucuaccaggccauggcgugccccaacgaggucguguccuacgagaucguccucagcaucacccggcugaucaagaaguaccgcaaggagcuccaggugguggccugggacauccugcucaacaucaucgagcggcugcugcagcagcuccagacccuggacucccccgagcugcgcacgaucguccacgaccuccugaccaccguggaggagcugugcgaccagaacgaguuccacggcagccaggagcgcuacuucgagcucguggagcggugcgccgaccagcgccccgagagcucccugcugaaccucaucagcuaccgggcccaguccauccaccccgccaaggacggguggauccagaaccugcaggcgcugauggagcgcuucuuccggagcgagucccgcggcgccguccggaucaaggugcucgacgugcugagcuucguccugcucaucaaccgccaguucuacgaggaggagcugaucaacuccguggugaucagccagcugucccacauccccgaggacaaggaccaccagguccggaagcucgccacccagcugcugguggaccucgccgagggcugccacacgcaccacuucaacagccugcuggacaucaucgagaaggugauggcgcgcucccucuccccgccgcccgagcuggaggagcgggacgucgccgccuacuccgccagccuggaggacgugaagaccgccgugcucgggcugcuggucauccuccagaccaagcuguacacccugcccgcgucccacgccacgcgcguguacgagaugcucgugagccacauccagcugcacuacaagcacuccuacacccugcccaucgccagcuccauccggcuccaggccuucgacuuccugcugcuccugcgcgccgacagccugcaccggcucggccugcccaacaaggacggggucgugcgcuucagccccuacugcgugugcgacuacauggagccggagcggggcuccgagaagaagaccagcgggccccugagcccgcccaccggcccgcccggccccgcgcccgccgggcccgccguccgccucggcagcgugcccuacucccugcuguuccgggugcuccugcagugccugaagcaggagagcgacuggaagguccucaagcuggugcuggggcgccuccccgagucccugcgcuacaaggugcugaucuucacgagcccgugcuccgucgaccagcucugcagcgcccugugcuccaugcugagcggccccaagacccucgagcggcugcgcggggcccccgagggcuucucccggaccgaccugcaccucgcgguggugcccguccugaccgcccugaucagcuaccacaacuaccucgacaagacgaagcagcgcgagaugguguacugccuggagcagggccugauccaccggugcgccucccagugcguggucgcccucagcaucugcuccguggagaugccggacaucaucaucaaggcgcugcccgugcuggucgugaagcucacccacaucagcgccaccgccagcauggccgugccccugcuggaguuccucuccacccuggcccgccugccccaccucuaccggaacuucgcggccgagcaguacgccagcgucuucgccaucucccugccguacacgaaccccagcaaguucaaccaguacaucgugugccuggcccaccacgugaucgcgaugugguucauccgcugccggcuccccuuccgcaaggacuucguccccuucaucaccaaggggcugcgguccaacgugcugcucagcuucgacgacaccccggagaaggacuccuuccgcgcccggagcaccucccugaacgagcgccccaagagccugcggaucgcccggccgcccaagcagggccucaacaacuccccgcccgugaaggaguucaaggagagcuccgccgccgaggcguuccggugccgcagcaucuccgucagcgagcacguggugcggucccgcauccagacgagccugaccuccgccagccuggggagcgccgacgagaacuccgucgcccaggcggacgacagccucaagaaccugcaccuggagcugaccgagaccugccucgacaugauggcccgguacguguucuccaacuucaccgccguccccaagcgcagccccgugggcgaguuccugcuggccgggggccgcacgaagaccuggcucgugggcaacaagcuggucaccgugaccacguccguggggaccggcacccggagccugcucgggcuggacuccggcgagcugcagagcggcccggaguccagcuccagccccgggguccacgugcgccagaccaaggaggcccccgcgaagcucgagucccaggccggccagcaggucagccgcggggcccgcgaccggguccgcuccaugagcggcgggcacggccugcgggugggcgcccuggacgugccggccucccaguuccucgggagcgcgacgucccccggcccccgcaccgcccccgccgccaagccggagaaggccagcgcggggacccggguccccgugcaggagaagaccaaccuggccgccuacgugccccugcucacgcagggcugggccgagauccugguccgccggcccaccgggaacaccagcuggcugaugucccucgagaacccgcugagccccuucuccagcgacaucaacaacaugccccugcaggagcucuccaacgcccugauggcggccgagcgcuucaaggagcaccgggacaccgcccuguacaagagccucuccgugcccgccgcgagcacggccaagccgccgccccugccccgcuccaacaccguggccagcuucuccagccuguaccaguccagcugccagggccagcuccaccgguccgucagcugggccgacuccgccguggugauggaggagggcagcccgggggagguccccgugcugguggagccgcccggccuggaggacgucgaggcggcccucgggauggaccgccggaccgacgccuacucccgcagcagcuccgugagcucccaggaggagaagucccugcacgccgaggagcuggugggccgggggaucccgaucgagcgcgucguguccagcgagggcggccgccccuccguggaccucagcuuccagcccucccagccccugagcaaguccagcuccagcccggagcugcagacccuccaggacauccugggggaccccggcgacaaggccgacgucgggcggcugucccccgaggugaaggcgcgcagccaguccggcacgcucgacggggagagcgccgccugguccgccagcggcgaggacagccggggccagcccgaggggccgcugcccuccagcagcccccgcagcccguccggccugcggccccgcggguacaccaucagcgacuccgcccccagccggcgcggcaagcggguggagcgcgacgcgcucaagucccgggccaccgccagcaacgccgagaagguccccggcaucaacccguccuucguguuccugcagcuguaccacagccccuucuucggggacgaguccaacaagcccauccuccugcccaacgagagccaguccuucgagcgcagcgugcagcugcucgaccagaucccguccuacgacacccacaagaucgcgguccuguacgugggcgaggggcagagcaacuccgagcuggccauccucagcaacgagcacggcagcuaccgguacacggaguuccugaccgggcugggccgccucaucgagcugaaggacugccagcccgacaagguguaccugggcgggcucgacgucugcggcgaggacgggcaguucaccuacugcuggcacgacgacaucaugcaggccguguuccacaucgccacccugaugcccacgaaggacguggacaagcaccggugcgacaagaagcgccaccugggcaacgacuucgucuccaucguguacaacgacagcggggaggacuucaagcucggcaccaucaagggccaguucaacuucgugcacgucaucgugacgccccuggacuacgagugcaaccuggugucccuccagugccggaaggacauggaggggcuggucgacaccagcguggccaagaucguguccgaccgcaaccugccguucgucgcgcggcagauggcccuccacgccaacauggccagccaggugcaccacucccgcagcaaccccacggacaucuaccccuccaaguggaucgcccggcugcgccacaucaagcgccugcggcagcgcaucugcgaggaggcggccuacagcaaccccucccucccgcugguccacccgcccagccacuccaaggcccccgcccagaccccggccgagcccacccccggcuacgagguggggcagcggaagcgccugaucagcuccguggaggacuucaccgaguucgucuga

SEQ ID NO: 38169 - RNA, 1320 nt, Artificial Sequence
  derived and/or modified sequence opt1 from TSEN2__Homo_sapiens__NP_001138865
auggccgaggccguguuccacgcgcccaagcgcaagcggcgcgucuacgagaccuacgagagcccgcugcccauccccuucggccaggaccacgggccccucaaggaguucaagaucuuccgggccgagaugaucaacaacaacgugaucgugcgcaacgccgaggacaucgagcagcuguacggcaagggguacuucggcaaggggauccugucccggagccgcccguccuucaccaucagcgaccccaagcucgucgccaaguggaaggacaugaagacgaacaugcccaucaucaccuccaagcgguaccagcacagcguggagugggccgcggagcugaugcgccggcagggccaggacgaguccaccgugcgccggauccugaaggacuacaccaagccccucgagcacccgcccgucaagcgcaacgaggaggcccaggugcacgacaagcugaacagcggcaugguguccaacauggaggggacggccggcggggagcggcccagcgucgugaacggcgacuccggcaagagcgggggcgugggggacccccgcgagccgcugggcugccuccaggagggguccggcugccaccccaccaccgagagcuucgagaaguccguccgggaggacgccagcccccugccccacgugugcugcugcaagcaggacgcgcugauccuccagcgcggccugcaccacgaggacgggucccagcacaucggccugcuccacccgggggaccggggccccgaccacgaguacgugcuggucgaggaggccgagugcgccaugagcgagcgcgaggccgcccccaacgaggaggcguucuuccugguguacgcccucgggugccuguccaucuacuacgagaaggagccccugaccaucgugaagcucuggaaggccuucacggucgugcagccgaccuuccggaccaccuacauggccuaccacuacuuccgcagcaagggcugggugcccaaggucggccugaaguacgggacggaccugcuccuguaccggaagggcccgcccuucuaccacgccagcuacuccgugaucaucgagcugguggacgaccacuucgaggggagccuccgccgcccccuguccuggaagucccuggcggcccucagccgggucagcgugaacgucuccaaggagcugaugcugugcuaccucaucaagcccagcaccaugaccgacaaggagauggagucccccgagugcaugaagcgcaucaaggugcaggaggugauccugagccggugggucuccagccgcgagcgguccgaccaggacgaccuguga

SEQ ID NO: 38170 - RNA, 933 nt, Artificial Sequence
  derived and/or modified sequence opt1 from TSEN34__Homo_sapiens__NP_001269261
augcugguggucgagguggccaacggccgcagccucguguggggcgccgaggcgguccaggcccugcgggagcgccugggggucgggggccggaccgugggggcccucccccgcggcccgcggcagaacucccgccugggccugccccuccugcugaugcccgaggaggcccggcuccuggccgagaucggggcggugacccuggugagcgcgccccgcccggacucccggcaccacagccucgcccugacguccuucaagcgccagcaggaggagagcuuccaggagcaguccgcccuggccgccgaggcccgggagacccgccggcaggagcuccuggagaagaucaccgagggccaggccgccaagaagcagaagcuggagcaggcgagcggggccuccagcucccaggaggccggcagcucccaggccgccaaggaggacgagaccagcgacgggcaggcguccggcgagcaggaggaggccggccccagcuccagccaggccgggcccuccaacggcguggcgccccucccgcgcagcgcccugcugguccagcucgccacggcccggccccgccccgugaaggcccggccccuggacuggcgcgugcagagcaaggacuggccgcacgccgggcggcccgcccacgagcugcgcuacuccaucuaccgggaccucugggagcgcggcuucuuccugagcgcggccggcaaguucgggggcgacuuccuggucuaccccggggacccccuccgcuuccacgcccacuacaucgcccagugcugggcgccggaggacaccaucccccugcaggaccugguggccgccggccggcucgggaccuccgugcgcaagacccugcugcucugcagcccccagcccgacggcaaggucguguacacgucccugcagugggccagccugcaguga

SEQ ID NO: 38171 - RNA, 1581 nt, Artificial Sequence
  derived and/or modified sequence opt1 from TSEN54__Homo_sapiens__NP_997229
auggagcccgagccggagcccgccgccguggagguccccgcgggccgcgugcugagcgcccgggagcuguucgccgcccgcucccggagccagaagcugccccagcgcucccacgggccgaaggacuuccugcccgacggcagcgccgcgcaggccgagcggcuccgccggugccgcgaggagcuguggcagcugcucgccgagcagcggguggagcgccuggggucccuggucgccgcggaguggcggcccgaggagggcuucguggagcucaagagccccgccgggaaguucuggcagaccaugggcuucuccgagcagggccgccagcggcugcacccggaggaggcccuguaccuccuggagugcgggagcauccaccuguuccaccaggaccucccccuguccauccaggaggccuaccagcugcuccugaccgaccacacggugaccuuccugcaguaccaggucuucagccaccucaagcgccugggcuacguggugcggcgcuuccagcccuccagcguccugucccccuacgagcggcagcucaaccuggacgccagcgugcagcaccuggaggacggggacggcaagcgcaagcgguccagcuccagcccgcgcuccaucaacaagaaggcgaaggcccucgacaacagccugcagcccaagagccuggccgccuccagcccgccgcccugcucccagcccagccagugccccgaggagaagccccaggaguccagccccaugaaggggcccggcggccccuuccagcuccuggggucccugggccccagcccggggcccgcccgggagggcgugggcugcuccugggagagcgggcgcgcggagaacggcgucaccggggccggcaagcgccgguggaacuucgagcagaucuccuuccccaacauggccagcgacucccgccacacccuccugcgggcccccgccccggagcugcuccccgcgaacguggccgggcgcgagacggacgccgagagcuggugccagaagcugaaccagcggaaggagaagcugucccgccgggagcgcgagcaccacgccgaggccgcgcaguuccaggaggacgugaacgccgaccccgagguccagcggugcagcuccuggcgcgaguacaaggagcuccugcagcggcgccaggugcagcggagccagcgccgggccccgcaccuguggggccagcccgugacgccccuccugucccccggccaggccagcagcccggcggucgugcugcagcacaucuccgugcuccagaccacccaccuccccgacgggggcgcccgccugcucgagaaguccgggggccuggagaucaucuucgacgucuaccaggccgacgccguggccaccuuccggaagaacaaccccgggaagcccuacgcgcgcaugugcaucagcggcuucgacgagccggugcccgaccugugcagccugaagcggcucuccuaccagagcggcgacgucccccugaucuucgcccugguggaccacggggacaucuccuucuacagcuuccgcgacuucacccucccccaggacgucggccacuga

SEQ ID NO: 38172 - RNA, 504 nt, Artificial Sequence
  derived and/or modified sequence opt1 from TSFM__Homo_sapiens__NP_001166166
augagccugcuccgcucccugcggguguuccugguggcccgcaccggcagcuaccccgccgggucccuccugcggcagagcccgcagccccgccacaccuucuacgcgggcccccggcuguccgccagcgccuccagcaaggagcuccugaugaagcugcgccggaagacgggguacuccuucgugaacugcaagaaggcccucgagaccugcggcggggaccugaagcaggccgagaucuggcugcacaaggaggcgcagaaggagggcuggagcaaggccgccaagcuccagggccgcaagaccaaggaggggcugaucggccugcuccaggaggggaacaccacggugcuggucgaggugaacugcgagaccgacuucgugucccggaaccugaaguuccagcuccugguccagcaggucgcccugggcaccaugaugcacugccagacccucaaggaccagcccagcgcguacuccaaggagaacugggagaagacguga

SEQ ID NO: 38173 - RNA, 1173 nt, Artificial Sequence
  derived and/or modified sequence opt1 from TSG101__Homo_sapiens__NP_006283
auggccgugagcgagucccagcugaagaagauggucagcaaguacaaguaccgcgaccucaccgugcgggagaccgugaacgucaucacgcuguacaaggaccugaagcccgugcucgacuccuacguguucaacgacggcagcucccgcgagcugaugaaccugaccgggaccaucccgguccccuaccggggcaacaccuacaacauccccaucugccucuggcugcuggacacguaccccuacaacccgcccaucugcuucgugaagcccaccagcuccaugaccaucaagaccgggaagcacguggacgccaacggcaagaucuaccuccccuaccugcacgaguggaagcacccgcagagcgaccugcucgggcugauccaggucaugaucgugguguucggcgacgagccgcccgucuucucccgccccaucagcgcguccuacccgcccuaccaggccacgggcccgcccaacaccagcuacaugcccgggaugcccggcgggaucucccccuaccccagcggcuacccgcccaaccccuccggguaccccggcugccccuacccgcccggcgggcccuaccccgccaccaccagcucccaguaccccagccagcccccggugacgaccgugggccccucccgggacgggaccaucagcgaggacaccauccgcgccagccugaucuccgccgucagcgacaagcuccgguggcgcaugaaggaggagauggaccgggcgcaggccgagcugaacgcccugaagcgcacggaggaggaccucaagaagggccaccagaagcuggaggagauggugacccggcuggaccaggagguggccgaggucgacaagaacaucgagcuccugaagaagaaggacgaggagcuguccagcgcgcucgagaagauggagaaccaguccgagaacaacgacaucgacgaggugaucauccccaccgcgccccuguacaagcagauccugaaccucuacgccgaggagaacgccaucgaggacaccaucuucuaccugggcgaggcccugcgccgcggggugaucgaccucgacgucuuccugaagcacgugcggcugcucagccggaagcaguuccagcugcgcgcccugaugcagaaggcccggaagacggccggccucuccgaccuguacuga

SEQ ID NO: 38174 - RNA, 2097 nt, Artificial Sequence
  derived and/or modified sequence opt1 from TSGA10__Homo_sapiens__NP_878915
augaugcgcagccgguccaagagcccccgccggccgucccccaccgcccgcggcgccaacugcgacguggagcugcucaagaccacgacccgggaccgcgaggagcugaagugcaugcuggagaaguacgagcggcaccucgcggagauccaggggaacgucaaggugcucaagagcgagcgcgacaagaucuuccugcuguacgagcaggcccaggaggagaucacccggcugcgccgggagaugaugaaguccugcaagagccccaaguccaccacggcccacgccauccugcgccggguggagaccgagcgcgacgucgccuucaccgaccuccggcgcaugaccacggagcgggacagccugcgcgagcggcugaagaucgcgcaggagaccgccuucaacgagaaggcccaccucgagcagcgcaucgaggagcuggagugcaccgugcacaaccuggacgacgagcggauggagcagauguccaacaugacccucaugaaggagacgaucagcaccguggagaaggagaugaagucccuggcccgcaaggcgauggacaccgagagcgagcugggccgccagaaggccgagaacaacucccuccggcugcuguacgagaacaccgagaaggaccucagcgacacgcagcgccaccuggccaagaagaaguacgagcugcagcucacccaggagaagaucaugugccuggacgagaagaucgacaacuucacccggcagaacaucgcccagcgcgaggagaucuccauccucgggggcacccugaacgaccuggccaaggagaaggagugccugcaggcgugccucgacaagaaguccgagaacaucgccagccugggggagagccuggccaugaaggagaagacgaucuccggcaugaagaacaucaucgccgagauggagcaggccagccggcagugcaccgaggcgcucaucgucugcgagcaggacgugagccgcaugcggcgccagcuggacgagaccaacgacgagcuggcccagaucgcccgggagcgcgacauccucgcccacgacaacgacaaccugcaggagcaguucgccaaggcgaagcaggagaaccaggcccuguccaagaagcucaacgacacccacaacgagcugaacgacaucaagcagaaggugcaggacacgaaccuggaggucaacaagcucaagaacauccucaagagcgaggaguccgagaaccggcagaugauggagcagcugcgcaaggccaacgaggacgccgagaacugggagaacaaggcccggcagagcgaggcggacaacaacacccugaagcuggagcugaucaccgccgaggccgagggcaaccgccucaaggagaagguggacucccugaaccgggagguggagcagcaccugaacgccgagcgcagcuacaagucccagaucagcacccugcacaaguccgucgugaagauggaggaggagcuccagaaggugcaguucgagaaggucagcgcgcuggccgaccuguccagcacgcgggagcucugcaucaagcuggacuccagcaaggagcugcucaaccgccagcugguggccaaggaccaggagaucgagaugcgggagaacgagcuggacuccgcccacagcgagaucgagcuccugcgcucccagauggccaacgagcgcaucagcaugcagaaccuggaggcgcuccugguggccaaccgggacaaggaguaccagucccagaucgcccugcaggagaaggagagcgagauccagcuccugaaggagcaccugugccucgccgagaacaagauggccauccagagccgcgacgucgcgcaguuccggaacguggugacccagcuggaggccgaccuggacaucaccaagcgccagcucgggaccgagcgguucgagcgcgagcgggccguccaggagcugcgccggcagaacuacuccagcaacgccuaccacauguccagcacgaugaagcccaacaccaagugccacuccccggagcgcgcccaccaccggagccccgaccgcggccuggaccggucccucgaggagaaccugugcuaccgcgacuucuga

SEQ ID NO: 38175 - RNA, 2295 nt, Artificial Sequence
  derived and/or modified sequence opt1 from TSHR__Homo_sapiens__XP_005268094
augcgccccgccgaccugcuccagcuggugcugcuccuggaccugccccgggaccucggcgggaugggcugcagcuccccgcccugcgagugccaccaggaggaggacuuccgcgugaccugcaaggacauccagcggauccccagccugccgcccuccacccagacgcugaagcucaucgagacccaccuccgcaccauccccagccacgccuucuccaaccugcccaacaucagccggaucuacgucuccaucgacgugacccugcagcagcuggagagccacuccuucuacaaccugagcaaggucacgcacaucgagauccgcaacacccggaaccucaccuacaucgaccccgacgcgcugaaggagcugccccuccugaaguuccuggggaucuucaacaccggccucaagauguuccccgaccugacgaagguguacuccaccgacaucuucuucauccuggagaucaccgacaaccccuacaugaccagcaucccggugaacgccuuccaggggcucugcaacgagacgcugacccugaagcucuacaacaacggcuucaccuccguccagggcuacgccuucaacgggaccaagcuggacgccguguaccugaacaagaacaaguaccucacggugaucgacaaggacgccuucggcggggucuacagcggccccucccugcuggacgugagccagaccuccgugaccgcgcuccccagcaaggggcuggagcaccugaaggagcucaucgcccgcaacaccuggacgcugaagaagcugccccucucccugagcuuccugcaccucacccgggccgaccugagcuacccgucccacugcugcgccuucaagaaccagaagaagauccgcggcauccuggagagccucaugugcaacgaguccagcaugcagucccugcggcagcgcaagagcgucaacgcgcugaacagcccccuccaccaggaguacgaggagaaccugggcgacuccaucgugggguacaaggagaaguccaaguuccaggacacccacaacaacgcccacuacuacguguucuucgaggagcaggaggacgagaucaucggcuucgggcaggagcugaagaacccccaggaggagacccugcaggccuucgacagccacuacgacuacacgaucugcggcgacuccgaggacauggucugcacccccaagagcgacgaguucaacccgugcgaggacaucaugggcuacaaguuccuccggaucguggugugguucgucucccugcuggcccuccuggggaacguguucgugcugcucauccugcugaccagccacuacaagcucaacgucccccgcuuccugaugugcaaccuggccuucgcggacuucugcaugggcauguaccuccugcugaucgccuccguggaccucuacacccacagcgaguacuacaaccacgccaucgacuggcagacggggcccggcugcaacaccgccggguucuucaccguguucgccuccgagcugagcgucuacacccugacggugaucacccucgagcggugguacgcgaucaccuucgccaugcgccuggaccggaagauccgccugcggcacgccugcgccaucauggucggcggcugggugugcugcuuccuccuggcccugcucccccugguggggaucuccagcuacgcgaaggucagcaucugccugccgauggacaccgagacgccccucgcccuggccuacaucguguucgugcugacccucaacaucgucgccuucgugaucgugugcugcugcuacgucaagaucuacaucaccgugcgcaacccccaguacaaccccggcgacaaggacaccaagaucgccaagcggauggcggugcugaucuucaccgacuucaucugcauggccccgaucuccuucuacgcccugagcgccauccucaacaagccccugaucacggucuccaacagcaagauccugcucgugcuguucuacccccugaacuccugcgcgaacccguuccucuacgccaucuucaccaaggccuuccagcgcgacguguucauccugcugagcaaguucgggaucugcaagcgccaggcccaggccuaccggggccagcgcgucccgcccaagaacuccaccgacauccaggugcagaaggugacccacgagaugcggcaggggcuccacaacauggaggacgucuacgagcugaucgagaacagccaccugacgcccaagaagcagggccagaucuccgaggaguacaugcagaccgugcucuga

SEQ ID NO: 38176 - RNA, 3099 nt, Artificial Sequence
  derived and/or modified sequence opt1 from TSHZ1__Homo_sapiens__NP_005777
augugcaacgaggagaccgagaucaaggaggcccagagcuaccagaacucccccgugagcuccgccaccaaccaggacgcgggcuacgggagcccguucuccgagagcuccgaccagcuggcccacuucaagggcagcuccagccgcgaggagaaggaggacccccagugccccgacuccgucagcuacccccaggacucccucgcccagaucaaggccguguacgccaaccuguucagcgaguccugcuggagcucccuggcgcucgaccugaagaaguccgggagcacgaccagcaccaacgacgccagccagaaggaguccagcgccccgacccccacgcccccgaccugccccguguccaccaccggccccacgaccagcacccccuccaccagcugcuccagcuccacgagccacuccagcaccaccuccaccagcuccagcuccggguacgacuggcaccaggccgcgcuggccaagacgcuccagcagaccagcuccuacggccugcugcccgagccgagccucuucagcaccguccagcuguaccggcagaacaacaagcuguacggcuccguguucaccggggccagcaaguuccgcugcaaggacugcuccgccgccuacgacacgcucguggagcugaccguccacaugaacgagaccggccacuaccgggacgacaaccgcgacaaggacagcgagaagaccaagcggugguccaagccccgcaagcggagccugauggagauggaggggaaggaggacgcgcagaaggugcucaagugcauguacugcggccacuccuucgagagccugcaggaccuguccgugcacaugaucaagacgaagcacuaccagaaggucccccucaaggagcccgugccggccaucaccaagcuggugcccagcaccaagaagcgcgcccugcaggaccucgccccgcccugcucccccgagcccgccgggauggcggccgaggucgcccugagcgaguccgccaaggaccagaaggccgcgaaccccuacgugacccccaacaaccgguacggcuaccagaacggcgccagcuacacguggcaguucgaggcccgcaaggcccagauccugaagugcauggagugcggguccagccacgacacccuccagcagcugaccgcccacaugauggugaccggccacuuccugaaggucacgaccuccgcgagcaagaaggggaagcagcucgugcuggacccgguggucgaggagaagauccagagcaucccccugccgcccaccacccacacgcggcuccccgccuccagcaucaagaagcagcccgacucccccgccggcagcaccaccuccgaggagaagaaggagccggagaaggagaagccgcccguggccggcgacgcggagaagaucaaggaggagagcgaggacucccuggagaaguucgagcccagcacccuguaccccuaccuccgcgaggaggaccuggacgacucccccaagggcgggcuggacauccucaagagccuggagaacaccguguccacggccaucagcaaggcccagaacggggcccccuccuggggcggguaccccagcauccacgccgcguaccagcugccgggcaccgucaagccccuccccgccgccgugcaguccgugcagguccagcccagcuacgccggcggggugaagucccugagcuccgccgagcacaacgcgcugcuccacagcccgggcagccugaccccgccgccccacaaguccaacgucagcgccauggaggagcugguggagaaggugaccgggaaggucaacaucaagaaggaggagcggccgcccgagaaggagaaguccagccucgccaaggccgccucccccaucgcgaaggagaacaaggacuuccccaagacggaggaggugagcggcaagccccagaagaaggggcccgaggccgagaccggcaaggccaagaaggagggcccccuggacgugcacacccccaacgggaccgagccccugaaggccaaggucacgaacggcugcaacaaccucgggaucaucauggaccacucccccgagcccagcuucaucaacccgcuguccgcgcugcagagcaucaugaacacccaccugggcaagguguccaagcccgugagccccucccucgacccccuggccaugcuguacaagaucagcaacuccaugcucgacaagccggucuaccccgccacccccgugaagcaggccgacgccaucgaccgcuacuacuacgagaacagcgaccagcccaucgaccugaccaaguccaagaacaagccgcuggugagcuccgucgcggacagcguggccagcccccuccgggaguccgcccugauggacaucagcgacauggugaagaaccugacggggcgccucacccccaaguccagcacccccuccaccgucagcgagaaguccgacgccgacggcagcuccuucgaggaggcccuggacgagcugagcccggugcacaagcggaagggccgccaguccaacuggaacccccagcaccuccugauccugcaggcgcaguucgccagcucccuccgggagacgaccgaggggaaguacaucaugagcgaccugggcccccaggagcgcgugcacaucuccaaguucaccgggcugagcaugaccacgaucucccacuggcucgccaacgucaaguaccagcugcggcgcaccggcggcaccaaguuccugaagaaccucgacaccgggcaccccguguucuucugcaacgacugcgccagccaguuccgcacggccuccaccuacaucagccaccuggagacccaccugggcuucagccucaaggaccuguccaagcugccgcucaaccagauccaggagcagcagaacgugagcaagguccugaccaacaagacgcuggggccccucggcgcgaccgaggaggaccugggguccaccuuccagugcaagcugugcaaccggaccuucgccagcaagcacgccgugaagcuccaccuguccaagacgcacggcaagagccccgaggaccaccugaucuacgugaccgagcucgagaagcaguga

SEQ ID NO: 38177 - RNA, 3096 nt, Artificial Sequence
  derived and/or modified sequence opt1 from TSHZ2__Homo_sapiens__NP_001180350
augauggccgccgcgcugcuccacuacaccggcuacgcccaggaggagcagcugaaggaggaggaggagaucaaggaggaggaggaggaggaggacagcggguccguggcccagcugcagggcgggaacgacaccggcacggacgaggagcucgagaccgggcccgagcagaagggcugcuucagcuaccagaacuccccgggcagccaccuguccaaccaggacgccgagaacgagagccugcucuccgacgccagcgaccaggucuccgacaucaagagcgugugcgggcgcgacgcguccgacaagaaggcccacacccacgugcggcugcccaacgaggcccacaacugcauggacaagaugaccgccgucuacgcgaacauccugagcgacuccuacuggagcggccucgggcugggcuucaagcuguccaacagcgagcgccggaacugcgacacgcgcaacggguccaacaagagcgacuucgacuggcaccaggacgcccucuccaagagccugcagcagaaccugcccagccgguccgugagcaagcccucccucuucagcuccgugcagcuguaccgccagagcuccaagaugugcggcaccgucuucaccggcgccagccgguuccgcugccggcagugcuccgccgccuacgacacccugguggagcucacggugcacaugaacgagaccgggcacuaccaggacgacaaccgcaagaaggacaagcugcggccgaccagcuacuccaagccccgcaagcgggcguuccaggacauggacaaggaggacgcccagaagguccugaagugcauguucugcggcgacagcuucgacucccuccaggaccugagcgugcacaugaucaagaccaagcacuaccagaaggugccccugaaggagcccgucccgacgaucuccagcaagauggugacccccgccaagaagcgcguguucgacgucaaccggcccugcucccccgacagcaccaccggguccuucgccgacagcuucagcucccagaagaacgccaaccuccagcugagcuccaacaaccgcuacggcuaccagaacggcgcgagcuacacguggcaguucgaggccugcaagucccagauccugaagugcauggagugcgggagcucccacgacacccuccagcagcugaccacccacaugauggugacgggccacuuccugaaggugaccagcuccgccagcaagaaggggaagcagcucguccuggacccgcuggccguggagaagaugcagucccucagcgaggcccccaacuccgacagccuggcgcccaagcccuccagcaacuccgccagcgacugcaccgccagcaccacggagcugaagaaggaguccaagaaggagcggccggaggagaccagcaaggacgagaagguggucaaguccgaggacuacgaggacccccuccagaagccccuggaccccaccaucaaguaccaguaccugcgcgaggaggaccucgaggacggcagcaagggcgggggcgacauccugaagucccuggagaacaccgugacgaccgccaucaacaaggcccagaacggggcgccgagcugguccgccuaccccagcauccacgccgccuaccagcucuccgagggcaccaagccgccccugcccauggggagccaggugcugcagauccggcccaaccucaccaacaagcugcgccccaucgcgcccaaguggaaggucaugccgcugguguccaugcccacgcaccucgcccccuacacccaggucaagaaggagagcgaggacaaggacgaggccgugaaggagugcggcaaggaguccccgcacgaggaggccagcuccuucagccacuccgagggggacagcuuccggaaguccgagaccccgcccgaggccaagaagaccgagcugggcccccugaaggaggaggagaagcugaugaaggagggcagcgagaaggagaagccccagccccucgagcccacgagcgcgcuguccaacgggugcgcccuggccaaccacgcccccgcccucccgugcaucaacccccugagcgcgcugcaguccgugcucaacaaccaccugggcaaggccaccgagccccugcgcagccccuccugcagcuccccgagcuccagcaccaucuccauguuccacaagagcaaccucaacgucauggacaagcccgugcugucccccgccagcacccgcuccgccagcgugucccggcgcuaccuguucgagaacagcgaccagcccaucgaccucaccaaguccaagagcaagaaggccgagagcucccaggcgcagagcugcauguccccgccccagaagcacgcccugagcgacaucgccgacauggucaaggugcugcccaaggccacgacccccaagccggcguccagcucccgggugccgcccaugaagcucgagauggacguccgccgguucgaggacgugagcuccgaggugagcacccugcacaagcgcaaggggcggcaguccaacuggaacccccagcaccuccugauccugcaggcccaguucgccagcucccuguuccagaccagcgagggcaaguaccuccuguccgaccuggggccccaggagcgcaugcagaucagcaaguucacgggccucuccaugaccaccaucagccacuggcuggccaacgucaaguaccagcugcggaagaccggcgggacgaaguuccucaagaacauggacaagggccaccccaucuucuacugcuccgacugcgccagccaguuccgcacccccagcaccuacaucucccaccuggagagccaccugggguuccagaugaaggacaugacccggcucuccguggaccagcagagcaagguggagcaggagaucucccgcgucagcuccgcgcagcggagcccggagacgaucgccgccgaggaggacaccgacuccaaguucaagugcaagcugugcugccgcaccuucgugagcaagcacgccgugaagcugcaccucuccaagacccacagcaagucccccgagcaccacagccaguucgucacggacguggacgaggaguga

SEQ ID NO: 38178 - RNA, 3246 nt, Artificial Sequence
  derived and/or modified sequence opt1 from TSHZ3__Homo_sapiens__NP_065907
augccccgccggaagcagcaggccccgcgccgggccgcggccuacgugagcgaggagcugaaggccgccgcccucgucgacgagggccuggaccccgaggagcacaccgcggacggggagcccuccgccaaguacaugugccccgagaaggagcuggcccgcgccugcccgagcuaccagaacucccccgcggccgaguucagcugccacgagauggacuccgagagccacaucuccgagaccagcgaccggauggccgacuucgaguccggcagcaucaagaacgaggaggagacgaaggaggugaccgugccccucgaggacaccaccgucuccgacagccuggagcagaugaaggccguguacaacaacuuccuguccaacagcuacugguccaaccucaaccugaaccugcaccagcccagcuccgagaagaacaacgggagcuccagcagcuccagcuccagcuccagcuccugcggcagcggguccuucgacuggcaccagagcgccauggcgaagacgcuccagcaggugucccagagccgcaugcugccggagcccucccuguucagcaccguccagcucuaccggcaguccagcaagcuguacggcuccaucuucaccggcgccagcaaguuccgcugcaaggacugcuccgccgccuacgacacccugguggagcucacggugcacaugaacgagaccgggcacuaccgggacgacaaccacgagaccgacaacaacaaccccaagcgcuggagcaagccccggaagcgcagccugcuggagauggagggcaaggaggacgcccagaagguccucaagugcauguacugcgggcacuccuucgagagccugcaggaccuguccgugcacaugaucaagaccaagcacuaccagaaggugccgcucaaggagcccgucacgcccguggcggccaagaucauccccgccacccggaagaaggccagccuggagcuggagcucccguccagccccgacuccaccggcgggacccccaaggccacgaucagcgacaccaacgacgcgcugcagaagaacuccaaccccuacaucaccccgaacaaccgcuacggccaccagaacggcgccagcuacgccuggcacuucgaggcccggaagucccagauccugaagugcauggagugcgggagcucccacgacacccuccaggagcugacggcccacaugauggugaccggccacuucaucaaggucaccaacagcgcgaugaagaaggggaagcccaucguggagacccccgugacgcccaccaucaccacccugcucgacgagaagguccaguccgugccgcuggccgccacgaccuucaccagccccuccaacacccccgccagcaucagccccaagcugaacguggaggucaagaaggagguggacaaggagaaggcggugacggacgagaagccgaagcagaaggacaagcccggcgaggaggaggagaagugcgacaucuccagcaaguaccacuaccucaccgagaacgaccuggaggagucccccaagggcgggcuggacauccucaagagccuggagaacaccgucaccuccgccaucaacaaggcccagaacggcacgccgagcugggggggcuaccccuccauccacgccgccuaccagcugcccaacaugaugaagcucagccugggguccagcggcaaguccaccccccugaagccgauguucggcaacagcgagaucgugucccccaccaagaaccagacccucgucagcccccccuccagccagaccuccccgaugcccaagacgaacuuccacgcgauggaggagcuggugaagaaggugaccgagaaggucgccaagguggaggagaagaugaaggagcccgacgggaagcugagccccccgaagcgcgccacccccucccccugcagcagcgaggugggcgagcccaucaagauggaggccuccagcgacgggggcuuccggucccaggagaacagcccgucccccccccgcgacgggugcaaggacggcagcccccucgccgagccggucgagaacggcaaggagcuggugaagccccuggcguccagccucuccgggagcaccgccaucaucacggaccacccccccgagcagccguucgugaacccccuguccgcccugcagagcgucaugaacauccaccugggcaaggccgccaagcccucccucccggcgcuggaccccaugagcaugcuguucaagauguccaacagccucgccgagaaggccgccguggcgaccccccccccgcugcaguccaagaaggccgaccaccuggaccgguacuucuaccacgugaacaacgaccagcccaucgaccucaccaaggggaagagcgacaagggcugcucccuggggagcguccugcucagccccaccuccacggcccccgccaccagcuccagcaccgugaccacggccaagaccuccgcgguggucagcuucauguccaacagcccgcugcgcgagaacgcccuguccgacaucagcgacaugcucaagaaccugaccgagucccacaccagcaaguccagcacgcccuccagcaucuccgagaagagcgacaucgacggcgccacccuggaggaggccgaggaguccacccccgcccagaagcggaagggccgccagagcaacuggaacccccagcaccuccugauccugcaggcgcaguucgccgccagccuccgccagaccuccgaggggaaguacaucaugagcgaccuguccccgcaggagcggaugcacaucagccgcuucacgggccuguccaugaccaccaucagccacuggcucgccaacgugaaguaccagcugcggcgcaccgggggcacgaaguuccugaagaaccucgacaccggccaccccguguucuucugcaacgacugcgccucccagauccggacccccagcaccuacaucucccaccuggagagccaccugggguuccgccuccgggaccuguccaagcugagcacggagcagaucaacucccagaucgcgcagaccaagagccccuccgagaagauggucaccagcuccccggaggaggaccucggcaccagcuaccagugcaagcugugcaaccgcacguucgccuccaagcacgccgugaagcugcaccucagcaagacccacgggaagagccccgaggaccaccugcuguacguguccgagcucgagaagcaguga

SEQ ID NO: 38179 - RNA, 480 nt, Artificial Sequence
  derived and/or modified sequence opt1 from TSLP__Homo_sapiens__NP_149024
auguuccccuucgcccugcucuacgugcugagcguguccuuccgcaagaucuucauccugcagcucgugggccuggugcugaccuacgacuucaccaacugcgacuucgagaagaucaaggccgcguaccucagcacgaucuccaaggaccugaucaccuacaugagcgggaccaaguccaccgaguucaacaacacggucagcugcuccaaccggccgcacugccugaccgagauccagagccucaccuucaaccccaccgccggcugcgccucccuggccaaggagauguucgccaugaagacgaaggcggcccuggccaucuggugccccggguacagcgagacccagaucaacgccacccaggcgaugaagaagcgccggaagcgcaaggugaccacgaacaagugccucgagcaggucucccagcugcagggccuguggcggcgcuucaaccggccccuccugaagcagcaguga

SEQ ID NO: 38180 - RNA, 873 nt, Artificial Sequence
  derived and/or modified sequence opt1 from TSNAX__Homo_sapiens__NP_005990
augagcaacaaggagggcuccgggggcuuccgcaagcggaagcacgacaacuucccccacaaccagcgccgggaggggaaggacgugaacagcuccagcccggucaugcuggccuucaaguccuuccagcaggagcucgacgcccgccacgacaaguacgagcggcuggugaagcugagccgcgacaucaccguggaguccaagcggaccaucuuccuccugcaccgcaucacgagcgcgcccgacauggaggacauccugaccgaguccgagaucaagcucgacggcguccggcagaagaucuuccagguggcccaggagcugagcggggaggacaugcaccaguuccaccgcgccaucaccaccggccugcaggaguacguggaggccgucuccuuccagcacuucaucaagacgcggagccucaucuccauggacgagaucaacaagcagcugaucuucaccaccgaggacaacggcaaggagaacaagacccccagcuccgacgcccaggacaagcaguucgggacguggcgccugcgggugacccccguggacuaccuccugggcgucgcggaccugaccggggagcucaugcgcaugugcaucaacagcgugggcaacggggacaucgacaccccguucgaggugucccaguuccugcggcaggucuacgacggcuucagcuucaucggcaacacggggcccuacgagguguccaagaagcuguacacccucaagcagagccuggccaagguggagaacgccugcuacgcccugaagguccgcggcagcgagauccccaagcacaugcucgcggacguguucuccgugaagaccgagaugaucgaccaggaggaggggaucagcuga

SEQ ID NO: 38181 - RNA, 447 nt, Artificial Sequence
  derived and/or modified sequence opt1 from TSN__Homo_sapiens__NP_001248330
augagcguguccgagaucuucgucgagcugcagggcuuccuggccgccgagcaggacauccgcgaggagauccggaagguggugcagagccuggagcagaccgcgcgcgagauccugacccugcugcaggggguccaccagggcgccggguuccaggacauccccaagcggugccugaaggcccgcgagcacuucggcacggugaagacccaccucaccucccugaagaccaaguuccccgccgagcaguacuaccgguuccacgagcacuggcgcuucgugcugcagcggcucgucuuccuggccgcguucgugguguaccuggagacggagacccucgucacccgcgaggccgugaccgagauccuggggaucgaggccgugugccagcagcgggacugcuggcgccugcuccccacgccgccccaccuccaccuccaccaguga

SEQ ID NO: 38182 - RNA, 1182 nt, Artificial Sequence
  derived and/or modified sequence opt1 from TSPAN10__Homo_sapiens__NP_001277141
augcaccgccuggcccagggccggagccaggaccagcccuccagcccggccaccgaggagcccgcgaaccucucccgccggcugugcugggggcugagcgugcccgccucccgcauggaggagggcgagcggagcccccuccugucccaggagaccgccgggcagaagccgcugagcguccaccgcccgcccacguccggcugccucgggcccgugccccgggaggaccaggccgaggccuggggcugcagcugcugcccgcccgagaccaagcaccaggcgcuguccggcacccccaagaaggggcccgcccccagccugucccccggcagcuccugcgugaaguaccucaucuuccugagcaacuuccccuucucccugcucgggcugcuggcccucgccaucggccugugggggcuggcggucaagggcagccucggcuccgaccucgggggcccgcugcccgccgaccccaugcuggggcuggcccugggcggccucguggugagcgccgucagccuggccggguaccugggcgcgcucugcgagaacacgugccugcugcgcggguucuccggcgggauccucgccuuccuggugcuggaggccguggccggcgcccucgucguggcgcuguggggcccccugcaggacagccucgagcacacccugcggguggccaucgcccacuaccaggacgacccggaccugcgcuuccuccuggaccagguccagcuggggcuccggugcugcggcgccgccuccuaccaggacuggcagcagaaccuguacuucaacugcagcucccccggggugcaggcgugcagccugcccgccuccugcugcaucgacccccgcgaggacggcgccagcgugaacgaccagugcggguucggcguccuccggcuggacgccgacgccgcgcagcgcgugguguaccuggagggcugcgggccgccccuccggcgcuggcugcgggccaaccuggccgccuccggcggguacgcgaucgccgucgugcugcuccagggcgccgagcugcugcucgccgcccgccugcugggggcgcucgccgcccggcgcggcgccgccuacggccccggggcgcggggcgaggaccgcgccgggccccagagcccgucccccggcgcgcccccggccgccaagcccgcccgcggcuga

SEQ ID NO: 38183 - RNA, 762 nt, Artificial Sequence
  derived and/or modified sequence opt1 from TSPAN11__Homo_sapiens__XP_011518982
auggcccacuacaagaccgagcaggacgacuggcugaucaucuaccucaaguaccugcuguucguguucaacuucuucuucugggucggcggggccgcggugcucgccgugggcaucuggacccuggucgagaaguccggguaccugagcgugcucgccagcuccacguucgccgccagcgcguacauccugaucuucgccggcgugcuggucauggugaccggguuccucggcuucggcgccauccugugggagcgcaaggggugccuguccaccuacuucugccuccugcuggugaucuuccucgucgagcugguggccggcgugcuggcgcacgucuacuaccagcggcucagcgacgagcugaagcagcaccugaaccgcacccucgccgagaacuacgggcagcccggcgccacgcagaucaccgccuccguggaccggcugcagcaggacuucaagugcugcgggagcaacuccagcgccgacuggcagcacuccaccuacauccugcuccgcgaggcggagggccgccaggugccggacagcugcugcaagaccgucguggugcggugcggccagcgggcccaccccuccaacaucuacaaggucgagggcgggugccugacgaagcuggagcaguuccucgccgaccaccuccugcugaugggggccgugggcaucggcguggccugccugcagaucugcgggaugguccugaccugcugccuccaccagcgccugcagcggcacuucuacuga

SEQ ID NO: 38184 - RNA, 918 nt, Artificial Sequence
  derived and/or modified sequence opt1 from TSPAN12__Homo_sapiens__XP_011514296
auggcccgcgaggacagcgugaagugccugcggugccuccuguacgcccugaaccuccuguucuggcugauguccaucagcguccucgcgguguccgccuggaugcgcgacuaccugaacaacgugcugacccucaccgccgagacgcgggucgaggaggccgugauccugaccuacuuccccgugguccacccggugaugaucgccgugugcugcuuccugaucaucgucggcaugcucggguacugcggcaccgugaagcgcaaccugcugcuccuggcgugguacuucgggagccugcucgugaucuucugcgucgagcuggccugcggcguguggaccuacgagcaggagcugauggugcccguccagugguccgacauggugacgcucaaggcccggaugaccaacuacgggcugccccgcuaccgguggcugacccacgccuggaacuucuuccagcgcgaguucaagugcugcggcguggucuacuucaccgacuggcucgagaugacggagauggacuggcccccggacagcugcugcgugcgggaguuccccggcugcuccaagcaggcgcaccaggaggaccugagcgaccuguaccaggaggggugcggcaagaagauguacuccuuccuccgcgggaccaagcagcuccaggugcugcgguuccugggcaucagcaucggggucacccagauccuggccaugauccugaccaucacgcuccugugggcccuguacuacgaccgccgggagcccggcaccgaccagaugaugucccucaagaacgacaacagccagcaccuguccugccccagcguggagcugcucaagccgucccugagccgcaucuucgagcacaccuccauggccaacagcuucaacacccacuucgagauggaggagcuguga

SEQ ID NO: 38185 - RNA, 615 nt, Artificial Sequence
  derived and/or modified sequence opt1 from TSPAN13__Homo_sapiens__NP_055214
auggugugcggcggguucgccugcagcaagaacugccugugcgcccucaaccugcuguacacccucgugucccugcugcucaucggcaucgcggccugggggaucggcuucgggcugaucagcucccugcgcguggugggcgucgugaucgccgugggcaucuuccucuuccugaucgcccuggucgggcucaucggcgccgugaagcaccaccaggugcugcuguucuucuacaugaucauccuccugcuggucuucaucgugcaguucagcguguccugcgcgugccucgcccugaaccaggagcagcaggggcagcugcucgaggucggcuggaacaacaccgccagcgcccggaacgacauccagcgcaaccugaacugcugcggguuccgguccgugaaccccaacgacacgugccuggcgagcugcgugaaguccgaccacagcugcuccccgugcgcccccaucaucggcgaguacgccggcgagguccuccgcuucgucgggggcaucgggcuguucuucagcuucaccgagauccugggcguguggcucaccuaccgguaccgcaaccagaaggacccccgggccaaccccuccgccuuccuguga

SEQ ID NO: 38186 - RNA, 444 nt, Artificial Sequence
  derived and/or modified sequence opt1 from TSPAN14__Homo_sapiens__NP_001121781
augcacuacuaccgcuacagcaacgccaagguguccugcugguacaaguaccuccuguucagcuacaacaucaucuucuggaaccagugcugcggcgccuacgggcccgaggacugggaccugaacgucuacuucaacugcuccggcgcgagcuacucccgggagaagugcggggugccguucagcugcugcgugcccgaccccgcccagaaggucgugaacacccagugcggcuacgacgugcgcauccagcugaaguccaagugggacgagagcaucuucaccaaggggugcauccaggcccucgaguccuggcugccccggaacaucuacaucgucgccggcguguucaucgccaucagccugcuccagaucuucggcaucuuccuggcgcgcacgcugaucuccgacaucgaggccgugaaggccgggcaccacuucuga

SEQ ID NO: 38187 - RNA, 735 nt, Artificial Sequence
  derived and/or modified sequence opt1 from TSPAN16__Homo_sapiens__NP_001269438
auggccgagauccacacccccuacagcucccugaagaagcuccugagccugcucaacggcuucguggccgucuccgggaucauccuggugggccuggggaucggcgggaagugcggcggcgcgagccucaccaacgugcuggggcuguccagcgccuaccuccugcacgucggcaaccugugccucgugauggggugcaucacggugcugcugggcugcgccgggugguacggcgccaccaaggagucccgcggcacccuccuguucugcauccugagcauggucaucgugcucaucauggaggugaccgccgcgacggucgugcugcuguucuucccgaucgugggggacgucgcccucgagcacaccuucgugacccugcggaagaacuaccgcggcuacaacgagcccgacgacuacuccacccaguggaaccuggugauggagaagcucaagugcugcggggucaacaacuacacggacuucagcggcuccagcuucgagaugaccaccggccacaccuacccccgguccugcugcaagagcaucggguccgugagcugcgacggccgcgacgugucccccaacgucauccaccagaaggggugcuuccacaagcugcugaagaucacgaagacccagagcuucacccucuccggcagcagccugggggccgccgugauccagcugccgggcauccucgcgacccugcuccuguucaucaagcugggcuga

SEQ ID NO: 38188 - RNA, 777 nt, Artificial Sequence
  derived and/or modified sequence opt1 from TSPAN18__Homo_sapiens__XP_006718435
augcccgaggagcugccgcgcuggagcaccauggagggcgacugccucuccugcaugaaguaccugauguucguguucaacuucuucaucuuccucgggggcgccugccugcuggccaucgggaucugggucaugguggaccccaccggcuuccgggagaucguggcggccaacccccugcuccugacgggggccuacauccugcucgccaugggcggccugcuguuccuccugggguuccugggcugcugcggggccguccgcgagaacaagugccuccugcuguucuucuuccucuucauccugaucaucuuccuggcggagcucagcgccgccauccuggccuucaucuuccgggagaaccugacccgcgaguucuucaccaaggagcucaccaagcacuaccagggcaacaacgacacggacguguucuccgcgaccuggaacagcgugaugaucaccuucgggugcugcggcgucaacggccccgaggacuucaaguucgccuccguguuccggcugcugacccucgacagcgaggaggugccggaggccugcugccgccgggagccccagucccgcgacgggguccugcugagccgggaggagugccuccugggccgcucccuguuccucaacaagcaggggugcuacacggugauccugaacaccuucgagaccuacguguaccuggccggcgcccucgcgaucggcguccuggccaucgagcuguucgccaugaucuucgccaugugccucuuccgggggauccaguga

SEQ ID NO: 38189 - RNA, 633 nt, Artificial Sequence
  derived and/or modified sequence opt1 from TSPAN31__Homo_sapiens__NP_005972
auggugugcggcggguucgccugcagcaagaacgcccugugcgcgcucaacgucguguacaugcuggugucccugcuccugaucggcgucgccgccugggggaagggccuggggcucgugagcuccauccacaucaucggcggcgugaucgccgucgggguguuccugcugcucaucgccguggcgggccuggucggggccgugaaccaccaccaggugcuccuguucuucuacaugaucauccugggccuggucuucaucuuccaguucgugaucagcugcuccugccucgccaucaaccgcagcaagcagaccgacgugaucaacgccuccuggugggucaugagcaacaagacccgggacgagcuggagcgcuccuucgacugcugcgggcuguucaaccucacgacccuguaccagcaggacuacgacuucugcaccgcgaucugcaagagccaguccccgaccugccagaugugcggcgagaaguuccugaagcacagcgacgaggcccucaagauccugggcggggugggccuguucuucuccuucacggagauccucgggguguggcuggccaugcgguuccgcaaccagaaggacccccgggccaaccccagcgccuuccuguga

SEQ ID NO: 38190 - RNA, 963 nt, Artificial Sequence
  derived and/or modified sequence opt1 from TSPAN32__Homo_sapiens__NP_620591
augggccccuggagccgcgugcgggucgccaagugccagaugcuggugaccugcuucuucauccuccugcuggggcucuccguggccaccauggucacgcugaccuacuucggcgcgcacuucgccgugauccgccgggccagccuggagaagaacccguaccaggccgugcaccagugggccuucuccgcggggcucagccuggucggccugcucacccugggggccgugcuguccgccgccgcgaccgugcgcgaggcccagggccucauggccggcggguuccugugcuucagccuggccuucugcgcccagguccaggugguguucuggcggcuccacucccccacgcaggucgaggacgcgaugcuggacaccuacgaccugguguacgagcaggccaugaagggcaccagccacgugcgccggcaggagcucgccgccauccaggacgucuuccugugcugcgggaagaagucccccuucagccgccugggcuccaccgaggccgaccucugccagggggaggaggcggcccgggaggacugccugcagggcauccgcagcuuccugcggacgcaccagcaggucgccuccagccucaccuccaucggccuggcccugaccgugagcgcccuccuguucuccagcuuccugugguucgcgauccgcugcgggugcucccucgaccggaagggcaaguacacccugacgccccgcgccugcgggcggcagccgcaggagcccagccugcuccgcugcagccagggcggccccacccacugccugcacuccgaggccguggccaucgggccccggggcugcagcgggucccugcgcuggcuccaggagagcgacgccgcgccgcugccccuguccugccaccucgccgcccaccgggcccugcagggccgcagccgcgggggccuguccggcugccccgagcgggggcucagcgacuga

SEQ ID NO: 38191 - RNA, 852 nt, Artificial Sequence
  derived and/or modified sequence opt1 from TSPAN33__Homo_sapiens__NP_848657
auggcccgccggccccgcgccccggcggccagcggcgaggaguucuccuucgugagcccccuggucaaguaccuccuguucuucuucaacaugcuguucugggugaucuccauggugauggucgccguggggguguacgcccggcucaugaagcacgccgaggcggcccuggccugccuggccgucgaccccgcgauccuccugaucguggugggcguccugauguuccuccugaccuucugcgggugcaucggcagccugcgcgagaacaucugccuccugcagaccuucucccugugccucacggccguguuccugcugcagcucgccgccgggauccugggcuucguguucagcgacaaggcccggggcaaggucuccgagaucaucaacaacgcgaucgugcacuaccgcgacgaccuggaccuccagaaccugaucgacuucgggcagaagaaguucagcugcugcggcgggaucuccuacaaggacuggagccagaacauguacuucaacugcuccgaggacaaccccagccgggagcgcugcuccgugccguacagcugcugccugcccacccccgaccaggccgucaucaacaccaugugcggccaggggaugcaggccuucgacuaccucgaggccuccaaggugaucuacaccaacggcugcaucgacaagcuggugaacuggauccacagcaaccuguuccuccugggcggggucgcccugggccucgcgaucccccagcugguggggauccugcucucccagauccuggugaaccagaucaaggaccagaucaagcugcagcucuacaaccagcagcaccgggccgacccgugguacuga

SEQ ID NO: 38192 - RNA, 717 nt, Artificial Sequence
  derived and/or modified sequence opt1 from TSPAN4__Homo_sapiens__XP_005253159
auggcccgcgccugccugcaggcggugaaguaccucauguucgccuucaaccugcuguucuggcucggcgggugcggcguccugggggugggcaucuggcuggccgccacccaggggagcuucgccacccucuccagcuccuuccccagccuguccgcggccaaccugcucaucaucacgggcgccuucgugauggccaucggcuucgucgggugccugggcgcgaucaaggagaacaagugccugcuccugaccuucuuccugcuccugcugcucguguuccugcuggaggccaccaucgccauccucuucuucgccuacaccgacaagaucgaccgguacgcccagcaggaccugaagaaggggcugcaccucuacggcacgcaggggaacgugggccugaccaacgcguggagcaucauccagaccgacuuccgcugcugcggcgucuccaacuacaccgacugguucgagguguacaacgccacgcgggugccggacagcugcugccuggaguucuccgagagcugcgggcuccacgcccccggcaccugguggaaggcccccugcuacgagaccgucaagguguggcugcaggagaaccugcucgccguggggaucuucggccugugcaccgcgcugguccagauccucggccugacguucgccaugaccauguacugccagguggugaaggccgacaccuacugcgccuga

SEQ ID NO: 38193 - RNA, 738 nt, Artificial Sequence
  derived and/or modified sequence opt1 from TSPAN6__Homo_sapiens__NP_003261
auggccagccccucccgccggcugcagaccaagccggugaucacgugcuucaagagcguccuccugaucuacaccuucaucuucuggaucaccggcgugauccugcucgccguggggaucuggggcaaggucucccuggagaacuacuucagccugcucaacgagaaggcgaccaacgugcccuucgugcugaucgccaccgggaccgucaucauccugcucggcaccuucgggugcuucgcgaccugccgcgccuccgccuggaugcugaagcuguacgccauguuccucacccugguguuccugguggagcucgucgccgccaucgugggcuucguguuccggcacgagaucaagaacagcuucaagaacaacuacgagaaggcccugaagcaguacaacuccacgggcgacuaccgcagccacgcggucgacaagauccagaacacccugcacugcugcggggugaccgacuaccgggacuggaccgacacgaacuacuacuccgagaagggcuuccccaagagcugcugcaagcucgaggacugcacgccccagcgcgacgccgacaaggugaacaacgaggggugcuucaucaaggucaugaccaucaucgaguccgagaugggcgugguggccgggaucagcuucggcgucgccugcuuccagcugaucggcaucuuccuggccuacugccucucccgggcgaucaccaacaaccaguacgagaucguguga

SEQ ID NO: 38194 - RNA, 750 nt, Artificial Sequence
  derived and/or modified sequence opt1 from TSPAN7__Homo_sapiens__NP_004606
auggccagccgccggauggagaccaagcccgugaucacgugccugaagacccuccugaucaucuacuccuucgucuucuggaucaccggcgugauccugcucgccgugggggucuggggcaagcugacccuggggaccuacaucagccucaucgcggagaacuccacgaacgccccguacgugcugaucggcaccgggaccaccaucguggucuucggccuguucggcugcuucgccacgugccgcgggagccccuggaugcucaagcuguacgccauguuccugucccucguguuccuggccgagcugguggcgggcaucagcggguucgucuuccggcacgagaucaaggacaccuuccuccgcaccuacaccgacgccaugcagacguacaacggcaacgacgagcggucccgcgccguggaccacgugcagcggagccuguccugcugcgggguccagaacuacaccaacuggagcaccucccccuacuuccuggagcacggcaucccgcccagcugcugcaugaacgagaccgacugcaacccccaggaccuccacaaccugacgguggccgcgaccaaggugaaccagaagggcugcuacgaccuggucaccuccuucauggagaccaacauggggaucaucgccggcguggccuucgggaucgccuucagccagcucaucggcaugcugcuggccugcugccucucccgcuucaucacggcgaaccaguacgagaugguguga

SEQ ID NO: 38195 - RNA, 714 nt, Artificial Sequence
  derived and/or modified sequence opt1 from TSPAN8__Homo_sapiens__XP_006719646
auggccggcgugagcgccugcaucaaguacuccauguucaccuucaacuuccuguucuggcucugcgggauccugauccuggcgcucgccaucuggguccgcgugagcaacgacucccaggccaucuucggcagcgaggacgugggguccagcuccuacgucgccguggacauccugaucgccgugggcgcgaucaucaugauccugggguuccucggcugcugcggcgccaucaaggagagccggugcaugcugcuccuguucuucaucgggcugcugcucauccugcugcuccaggucgccaccggcauccugggggccguguucaaguccaagagcgaccgcaucgugaacgagacgcuguacgagaacaccaagcuccuguccgcgaccggcgagagcgagaagcaguuccaggaggccaucaucgucuuccaggaggaguucaagugcugcgggcuggugaacggcgccgccgacuggggcaacaacuuccagcacuaccccgagcucugcgccugccuggacaagcagcggccgugccaguccuacaacgggaagcaggucuacaaggagaccugcaucagcuucaucaaggacuuccuggcgaagaaccucaucaucgugaucggcaucuccuucgggcuggccgugaucgagauccugggccucguguucagcaugguccuguacugccagaucggcaacaaguga

SEQ ID NO: 38196 - RNA, 720 nt, Artificial Sequence
  derived and/or modified sequence opt1 from TSPAN9__Homo_sapiens__NP_001161792
auggcccgcggcugccugugcugccucaaguacaugauguuccuguucaaccugaucuucuggcucugcgggugcggccugcugggggugggcaucuggcucagcgucucccaggggaacuucgccaccuucagccccuccuucccgagccuguccgcggccaaccuggugaucgccaucggcaccaucgugauggucacgggcuuccucgggugccugggcgccaucaaggagaacaagugccugcuccugagcuucuucaucgugcugcucgugauccugcuggccgagcucauccugcugauccucuucuucgucuacauggacaaggugaacgagaacgcgaagaaggaccugaaggaggggcugcuccuguaccacaccgagaacaacgugggccugaagaacgccuggaacaucauccaggccgagaugcggugcugcggggucaccgacuacaccgacugguaccccgugcucggcgagaacacggugcccgaccgcugcugcauggagaacucccagggcugcgggcggaacgccaccacgccccuguggcgcaccggcugcuacgagaaggucaagaugugguucgacgacaacaagcacgugcuggggaccgugggcaugugcauccucaucaugcagauccugggcauggcguucagcaugacccuguuccagcacauccaccggaccgggaagaaguacgacgccuga

SEQ ID NO: 38197 - RNA, 1806 nt, Artificial Sequence
  derived and/or modified sequence opt1 from TSPEAR__Homo_sapiens__NP_001258966
augagcuuccccgccucccgcaucuucagccagugcgaccuguucccggaggaguucuccaucguggucacccuccgggugcccaaccugccgcccaagcgcaacgaguaccugcucaccguggucgccgaggagagcgaccugcugcuccugggccugcggcucucccccgcgcagcugcacuuccuguuccuccgcgaggacacggccggggccuggcagacccgggugagcuuccgcucccccgcccugguggacggccgguggcacacccugguccucgccgugagcgcggggguguucucccugaccacggacugcggccugcccgucgacaucauggccgacgugcccuucccggccacccucagcgugaagggggcccgcuucuucgucggcucccggcgccgggcgaagggccuguucauggggcuggugcgccagcucgugcugcugcccggcagcgacgccacgccccggcucugccccucccgcaacgccccgcuggccguccugagcaucccccgggugcuccaggcccugaccgggaagcccgaggacaacgaggugcugaaguaccccuacgagaccaacauccgcgucacccucggcccgcagccgcccugcaccgagguggaggacgcgcaguucugguucgacgccucccggaaggggcuguaccugugcgugggcaacgagugggucagcgugcucgccgccaaggagcgccuggacuacguggaggagcaccagaaccuguccaccaacagcgagacgcucggcaucgaggucuuccggaucccccagguggggcuguucgucgccaccgcgaaccgcaaggccaccuccgccguguacaaguggaccgaggagaaguucgugagcuaccagaacauccccacgcaccaggcccaggccuggcggcacuucaccaucggcaagaagaucuuccuggcggucgccaacuucgagcccgacgagaaggggcaggaguucagcgugaucuacaaguggucccaccgcaagcucaaguucacccccuaccagagcaucgccacccacuccgcccgcgacugggaggccuucgagguggacggcgagcacuuccuggcggucgccaaccaccgggagggcgacaaccacaacaucgacagcgugaucuacaaguggaaccccgccacgcgccuguucgaggccaaccagaccaucgcgaccuccggggccuacgacugggaguucuucagcgugggcccguacuccuuccucgucguggccaacaccuucaacgggacgagcaccaaggugcacucccaccuguacauccggcugcucggcagcuuccagcuguuccaguccuuccccaccuucggggccgccgacugggaggucuuccagaucggcgagcgcaucuuccuggcgguggccaacagccacuccuacgacguggagaugcagguccagaacgacagcuacgugaucaacuccgugaucuacgagcucaacgucaccgcccaggccuucgugaaguuccaggacauccugacgugcagcgcccuggacugggaguucuucuccgugggcgaggacuacuuccuggucguggcgaacagcuucgacgggcggaccuucuccgugaacagcaucaucuaccgcuggcagggcuacgagggguucgucgccgugcacagccuccccaccgugggcugccgggacugggaggccuucuccaccacggccggggccuaccugaucuacagcuccgcgaaggagccccugagccgcguccuccggcugcgcacccgguga

SEQ ID NO: 38198 - RNA, 513 nt, Artificial Sequence
  derived and/or modified sequence opt1 from TSPO2__Homo_sapiens__XP_011512699
augcgccugcagggcgccaucuucgugcuccugccccaccuggggccgauccucgucuggcuguucacccgggaccacaugagcggcuggugcgaggggccccgcaugcugagcuggugccccuucuacaaggugcuccugcuggugcagaccgccaucuacagcgucgugggcuacgcguccuaccucguguggaaggaccucgggggcggccugggguggccccucgcccugccgcugggccucuacgccguccagcugacgaucagcuggaccgugcuggugcuguucuucaccguccacaaccccgggcuggcccugcuccaccuccugcugcuguacggccuggugguguccaccgcccucaucuggcaccccaucaacaagcuggcggcccugcuccugcugcccuaccucgccuggcugacggucaccagcgcccugaccuaccaccucuggcgggacucccugugcccggugcaccagccccagcccaccgagaaguccgacuga

SEQ ID NO: 38199 - RNA, 510 nt, Artificial Sequence
  derived and/or modified sequence opt1 from TSPO__Homo_sapiens__NP_001243459
auggcgcccccgugggugcccgccaugggcuucacccuggcccccagccucgggugcuucgucggcucccgcuucgugcacggggagggccugcggugguacgccgggcugcagaagcccagcuggcacccgccccacugggugcucggccccgucuggggcacccuguacuccgccaugggguacggcagcuaccugguguggaaggagcucgggggcuucacggagaaggccguggucccccuggggcuguacaccggccagcucgcccugaacugggcguggccgcccaucuucuucggcgcccgccagauggggugggcccugguggaccuccugcugguguccggcgccgcggccgccaccaccgucgccugguaccaggugagcccccucgccgcgcggcugcuguaccccuaccucgccuggcuggccuucacgaccacccugaacuacugcguguggcgcgacaaccacggguggcggggcggccgccggcucccggaguga

SEQ ID NO: 38200 - RNA, 927 nt, Artificial Sequence
  derived and/or modified sequence opt1 from TSPY10__Homo_sapiens__NP_001269398
augcgccccgagggcagccugaccuaccgggugcccgagcgccuccggcagggguucugcggcgucgggcgcgccgcccaggcgcuggugugcgccuccgccaaggagggcaccgccuuccggauggaggccgugcaggagggggcggccggcgucgagagcgagcaggccgcccugggcgaggaggcggugcuccugcuggacgacaucauggccgagguggaggucguggccgaggaggaggggcucguggagcgccgggaggaggcccagcgcgcccagcaggcgguccccggccccgggcccaugacgccggaguccgcccuggaggagcugcucgccguccagguggagcuggagcccgugaacgcccaggcccggaaggcguucagccgccagcgggagaagauggagcgccggcgcaagccccaccuggaccggcgcggcgccgugauccaguccgugcccggguucugggccaacgucaucgccaaccacccgcagaugagcgcccucaucaccgacgaggacgaggacaugcuguccuacauggugagccuggagguggaggaggagaagcaccccguccaccucugcaagaucaugcuguucuuccgguccaaccccuacuuccagaacaaggugaucaccaaggaguaccuggugaacaucaccgaguaccgcgcgagccacuccacgcccaucgagugguacccggacuacgaggucgaggccuaccggcgccggcaccacaacagcucccucaacuucuucaacugguucagcgaccacaacuucgccggcuccaacaagaucgccgagauccugugcaaggaccuguggcgcaacccccuccaguacuacaagcgcaugaagccgcccgaggagggcaccgagaccagcggggacucccagcugcugagcuga

SEQ ID NO: 38201 - RNA, 927 nt, Artificial Sequence
  derived and/or modified sequence opt1 from TSPY1__Homo_sapiens__NP_003299
augcgccccgagggcagccugaccuaccgggugccggagcgccuccggcagggguucugcggcgucgggcgcgccgcccaggcgcuggugugcgccuccgccaaggagggcaccgccuuccggauggaggccgugcaggagggggcggccggcgucgagagcgagcaggccgcccugggcgaggaggcggugcuccugcuggacgacaucauggccgagguggaggucguggccgaggaggaggggcucguggagcgccgggaggaggcccagcgcgcccagcaggcgguccccggccccgggcccaugacgccggaguccgcccccgaggagcugcuggccguccagguggagcucgagcccgugaacgcccaggcccggaaggcguucagccgccagcgggagaagauggagcgccggcgcaagccccaccuggaccggcgcggcgccgugauccaguccgugccgggguucugggccaacgucaucgccaaccacccccagaugagcgcccugaucaccgacgaggacgaggacaugcucuccuacauggugagccuggaggugggcgaggagaagcaccccguccaccugugcaagaucaugcuguucuuccgguccaaccccuacuuccagaacaaggugaucaccaaggaguaccucgugaacaucaccgaguaccgcgcgagccacuccacgccgaucgagugguaccccgacuacgaggucgaggccuaccggcgccggcaccacaacagcucccugaacuucuucaacugguucagcgaccacaacuucgccggcuccaacaagaucgccgagauccucugcaaggaccuguggcgcaacccccugcaguacuacaagcgcaugaagcccccggaggaggggaccgagaccagcggcgacucccagcuccugagcuga

SEQ ID NO: 38202 - RNA, 867 nt, Artificial Sequence
  derived and/or modified sequence opt1 from TSPY3__Homo_sapiens__XP_011542306
augcgccccgagggcagccugaccuaccgggugccggagcgccuccggcagggguucugcggcgucgggcgcgccgcccaggcgcuggugugcgccuccgccaaggagggcaccgccuuccggauggaggccgugcaggagggggcggccggcgucgagagcgagcaggccgcccugggcgaggaggcggugcuccugcuggacgacaucauggccgagguggaggucguggccgaggaggaggggcucguggagcgccgggaggaggcccagcgcgcccagcaggcgguccccggccccgggcccaugacgccggaguccgcccuggaggagcugcucgccguccagguggagcuggagcccgugaacgcccaggcccggaaggcguucagccgccagcgggagaagauggagcgccggcgcaagccccaccuggaccggcgcggcgccgugauccaguccgugcccggguucugggccaacgucaucgccaaccacccgcagaugagcgcccucaucaccgacgaggacgaggacaugcuguccuacauggugagccuggagguggaggaggagaagcaccccguccaccucugcaagaucaugcuguucuuccgguccaaccccuacuuccagaacaaggugaucaccaaggaguaccuggugaacaucaccggccuccugaucccccugcagcucagcggcauccgcaucaugaaguggcggcgcaucgcggccgacacgaccaccgccgcccugaccuccagcacggggucccugaccaccaccagccaggaccucacgcggcugcugcgcuccuacguccggaccugcggcgccaucccgugcaacaccacccgcggguga

SEQ ID NO: 38203 - RNA, 945 nt, Artificial Sequence
  derived and/or modified sequence opt1 from TSPY4__Homo_sapiens__NP_001157943
augcgccccgagggcagccugaccuaccgggugcccgagcgccuccggcagggguucugcggcgucgggcgcgccgcccaggcgcuggugugcgccuccgccaaggagggcaccgccuuccggauggaggccgugcaggagggggcggccggcgucgagagcgagcaggccgcccugggcgaggaggcggugcuccugcuggacgacaucauggccgagguggaggucguggccgagguggaggucguggccgaggaggaggggcucguggagcgccgggaggaggcccagcgcgcgcagcaggccguccccggccccgggcccaugacgccggaguccgcccuggaggagcugcucgccguccagguggagcuggagcccgugaacgcccaggcgcggaaggccuucagccgccagcgggagaagauggagcgccggcgcaagccccaccuggaccggcgcggcgccgugauccaguccgugcccggguucugggccaacgucaucgccaaccacccgcagaugagcgcgcucaucaccgacgaggacgaggacaugcuguccuacauggugagccuggagguggaggaggagaagcaccccguccaccucugcaagaucaugcuguucuuccgguccaaccccuacuuccagaacaaggugaucaccaaggaguaccuggugaacaucaccgaguaccgcgccagccacuccacgcccaucgagugguacccggacuacgaggucgaggccuaccggcgccggcaccacaacagcucccucaacuucuucaacugguucagcgaccacaacuucgccggcuccaacaagaucgccgagauccugugcaaggaccuguggcgcaacccccuccaguacuacaagcgcaugaagccgcccgaggagggcaccgagaccagcggggacucccagcugcugagcuga

SEQ ID NO: 38204 - RNA, 1314 nt, Artificial Sequence
  derived and/or modified sequence opt1 from TSPYL1__Homo_sapiens__NP_003300
augagcggccuggacggggugaagcgcaccacgccccuccagacccacuccaucaucaucagcgaccaggucccguccgaccaggacgcccaccaguaccugcggcugcgcgaccagagcgaggccacccaggugauggcggagcccggcgagggcggguccgagaccguggcccucccgccgcccccgcccagcgaggagggcggggucccccaggacgccgccggccgcgggggcacgccccagauccggguggucgggggccgggggcacguggccaucaaggcgggccaggaggagggccagccgcccgccgaggggcuggccgccgcguccguggugauggccgccgaccgcagccugaagaagggcguccagggcggggagaaggcccucgagaucugcggcgcccagcgguccgcgagcgagcugaccgccggggccgaggccgaggccgaggaggugaagaccggcaagugcgcgaccguguccgccgccgucgccgagcgcgagagcgccgagguggugaaggaggggcuggcggagaaggaggucauggaggagcagauggagguggaggagcagccgcccgagggcgaggagaucgagguggccgaggaggaccggcucgaggaggaggcccgcgaggaggaggggcccuggccccugcacgaggcccugcggauggacccccucgaggccauccagcuggagcuggacaccgucaacgcgcaggccgaccgcgccuuccagcagcucgagcacaaguucggccggaugcgccggcacuaccuggagcgccggaacuacaucauccagaacauccccggcuucuggaugacggccuuccgcaaccacccccagcuguccgcgaugauccgggggcaggacgccgagaugcuccgcuacaucaccaaccuggaggugaaggagcugcggcacccccgcaccggcugcaaguucaaguucuucuuccgccggaaccccuacuuccgcaacaagcucaucgugaaggaguacgagguccggagcuccgggcgcguggugagccuguccacccccaucaucuggcggcgcggccacgagccccagagcuucauccggcgcaaccaggaccugaucugcuccuucuucacgugguucagcgaccacagccuccccgaguccgacaagaucgccgagaucaucaaggaggaccuguggcccaacccgcugcaguacuaccuccugcgggaggggguccgccgggcccgccggcgcccccugcgggagcccguggagaucccccgcccguucggcuuccagagcggcuga

SEQ ID NO: 38205 - RNA, 2082 nt, Artificial Sequence
  derived and/or modified sequence opt1 from TSPYL2__Homo_sapiens__NP_071400
auggaccgccccgacgagggcccgcccgccaagacccggcgccugagcuccagcgagagcccccagcgggacccgcccccgcccccgcccccgccgccccuccugcgccugccccucccgccgccccagcagcggccccgccugcaggaggagaccgaggccgcccaggugcuggccgacaugcgcggggucggccucgggcccgcccugccgcccccgccgcccuacgugauccuggaggagggcgggauccgggccuacuucacgcucggcgccgagugccccggcugggacuccaccaucgaguccggguacggcgaggcgcccccgcccaccgagagccuggaggcccugcccacccccgaggccuccgggggcagccucgagaucgacuuccaggugguccaguccagcuccuucgggggcgagggcgcccuggagacgugcagcgcgguggggugggcgccccagcggcugguggaccccaaguccaaggaggaggccaucaucaucgucgaggacgaggacgaggacgagcgcgagagcaugcgguccagccgccggcgccggcgccggcgccggcgcaagcagcggaaggugaagcgcgagucccgcgagcggaacgccgagcgcauggagagcauccuccaggcccuggaggacauccagcuggaccucgaggcggugaacaucaaggccggcaaggccuuccugcggcugaagcgcaaguucauccagaugcggcgccccuuccucgagcggcgcgaccugaucauccagcacauccccggguucugggucaaggccuuccugaaccacccccggaucuccauccucaucaaccgccgggacgaggacaucuuccgcuaccugaccaaccuccaggugcaggaccugcggcacaucagcaugggcuacaagaugaagcuguacuuccagaccaaccccuacuucaccaacauggugaucgucaaggaguuccagcgcaaccggagcggccgccuggugucccacagcacgcccauccgguggcaccgcgggcaggagccccaggcccggcgccacggcaaccaggacgcgucccacagcuucuucuccugguucagcaaccacucccuccccgaggccgaccgcaucgccgagaucaucaagaacgaccugugggugaacccccugcgguacuaccuccgcgagcgggggagccgcaucaagcggaagaagcaggagaugaagaagcgcaagacccggggccgcugcgaggucgugaucauggaggacgcccccgacuacuacgccguggaggacaucuucuccgagaucagcgacaucgacgagaccauccacgacaucaagaucuccgacuucauggagaccacggacuacuucgagaccaccgacaacgagaucaccgacaucaacgagaacaucugcgacagcgagaaccccgaccacaacgagguccccaacaacgagacgaccgacaacaacgaguccgcggacgaccacgagaccaccgacaacaacgagagcgccgacgacaacaacgagaaccccgaggacaacaacaagaacacggacgacaacgaggagaaccccaacaacaacgagaacaccuacgggaacaacuucuucaagggcggcuucugggggucccacggcaacaaccaggacagcuccgacagcgacaacgaggccgacgaggccuccgacgacgaggacaacgacgggaacgagggcgacaacgaggggagcgacgacgacggcaacgagggcgacaacgaggggagcgacgacgacgaccgggacaucgaguacuacgagaaggugaucgaggacuucgacaaggaccaggccgacuacgaggacgugaucgagaucaucuccgacgagagcgucgaggaggagggcaucgaggaggggauccagcaggacgaggacaucuacgaggagggcaacuacgaggaggagggguccgaggacgugugggaggagggcgaggacagcgacgacuccgaccuggaggacgugcugcagguccccaacggcugggcgaaccccgggaagcgcggcaagaccggguga

SEQ ID NO: 38206 - RNA, 1245 nt, Artificial Sequence
  derived and/or modified sequence opt1 from TSPYL4__Homo_sapiens__NP_067680
augagcggccuggacgggggcaacaagcucccccuggcccagaccgggggccuggccgcgccggaccacgccuccggggaccccgaccgcgaccagugccagggccuccgggaggagaccgaggccacccaggugauggccaacacgggcgggggcagccuggagaccgucgccgagggcggcgcgucccaggaccccguggacugcgggcccgcccugcgcgugccggucgccggcagccggggcggggccgcgaccaaggccggccaggaggacgccccgcccuccacgaaggggcucgaggccgccagcgcggccgaggccgccgacuccagccagaagaacggcugccagcugggcgagccccgcgggcccgccggccagaaggcgcuggaggccugcggggccggcgggcucggcucccagaugauccccggcaagaaggccaaggaggugaccaccaagaagcgggccaucagcgcggccguggagaaggagggggaggccggcgccgccauggaggagaagaaggucgugcagaaggagaagaagguggccgggggcgucaaggaggagacccgcccccgggcgcccaagaucaacaacugcauggacucccuggaggccaucgaccaggagcugagcaacgugaacgcccaggcggaccgcgccuuccuccagcuggagcggaaguucgggcgcaugcggcgccugcacaugcagcggcgcuccuucaucauccagaacaucccgggcuucugggugacggccuuccggaaccacccccagcucagccccaugaucuccggccaggacgaggacaugcugcgcuacaugaucaaccuggaggucgaggagcucaagcacccccgggccgggugcaaguucaaguucaucuuccagggcaacccguacuuccgcaacgaggggcuggugaaggaguacgagcggcgcagcuccggccggguggucagccuguccacccccauccgcuggcaccgcgggcaggacccccaggcccacauccaccggaaccgcgagggcaacaccauccccagcuucuucaacugguucagcgaccacucccuccuggaguucgaccggaucgcggagaucaucaagggcgagcuguggccgaacccccuccaguacuaccugaugggggagggcccccgccgggggauccgcgggcccccgcggcagcccguggagagcgcccgcuccuuccgguuccagagcggcuga

SEQ ID NO: 38207 - RNA, 1254 nt, Artificial Sequence
  derived and/or modified sequence opt1 from TSPYL5__Homo_sapiens__NP_277047
augagcggccgcucccgggggcgcaagagcucccgggccaagaaccgcggcaaggggcgggccaaggcgcgcgugcggcccgccccggacgacgcgccccgcgaccccgaccccagccaguaccagucccugggcgaggacacccaggccgcccagguccaggccggggccggcuggggcgggcucgaggccgccgcgagcgcccagcugcugcggcucggcgaggaggccgccugccgccugccgcuggacugcgggcucgcccugcgggcgcgcgccgccggcgaccacgggcaggccgccgcgcggcccggccccggcaaggccgccucccugagcgagcgccucgccgccgacaccguguucguggggacggcgggcaccgucgggcggcccaagaacgccccgcgcgugggcaaccggcgcggccccgccgggaagaaggcccccgagaccugcuccaccgccggccgggggccccaggugaucgcgggcgggcgccagaagaagggcgccgccggcgagaacacgagcgucuccgccggggaggagaagaaggaggagcgggacgcgggcagcgggccgcccgccaccgagggcuccauggacacccuggagaacgugcagcugaagcucgagaacaugaacgcccaggccgaccgcgccuaccugcgccugagccggaaguucgggcagcuccgccugcagcaccuggagcggcgcaaccaccucauccagaacauccccggcuucuggggccaggcguuccagaaccacccccagcuggccuccuuccugaacagccaggagaaggaggugcucuccuaccugaacagccuggaggucgaggagcucgggcuggcccggcugggcuacaagaucaaguucuacuucgaccgcaacccguacuuccagaacaaggugcucaucaaggaguacgggugcggccccuccggccagguggucagccggagcacccccauccaguggcugcccgggcacgaccugcagucccucagccagggcaacccggagaacaaccgcuccuucuucgggugguucagcaaccacuccagcaucgaguccgacaagaucguggagaucaucaacgaggagcuguggcccaacccccugcaguucuaccuccugagcgagggcgcccggguggagaaggggaaggagaaggagggccgccagggccccgggaagcagccgauggagacgacccagcccggcgucucccagagcaacuga

SEQ ID NO: 38208 - RNA, 2415 nt, Artificial Sequence
  derived and/or modified sequence opt1 from TSR1__Homo_sapiens__NP_060598
auggccgcccaccgccccggcccgcugaagcagcagaacaaggcgcacaagggcgggcggcaccgcgggcggggcagcgcccagcgcgacgggaagggccggcuggcccugaagacccuguccaagaaggugcgcaaggagcucagccgggucgaccagcgccaccgggccucccagcugcgcaagcagaagaaggaggccgugcuggcggagaagcggcagcucggcgggaaggacggcccgccccaccaggugcuggucgugccccugcacagccgcaucucccuccccgaggccaugcagcugcugcaggaccgggacaccgggacggugcaccucaacgagcugggcaacacccagaacuucaugcugcucugcccccgccugaagcaccggugguucuucaccagcgcccgccccggggaccugcacgucgugcucgacauggccaagguggcggacaccauccuguuccugcucgacccccuggagggcugggacuccacgggcgacuacugccugagcugccucuucgcccaggggcugccgaccuacacccuggccguccagggcaucuccgggcucccccugaagaagcagaucgacacccggaagaagcugagcaaggccguggagaagcgcuucccccacgacaagcuccugcugcucgacacgcagcaggaggccggcaugcugcugcggcagcucgcgaaccagaagcagcagcaccuggccuuccgcgaccggcgcgccuaccuguucgcccacgccguggacuucguccccuccgaggagaacaaccucgugggcacccugaagaucagcggguacgugcgcggccagacccugaacgucaaccggcuccugcacaucgugggguacggcgacuuccagaugaagcagaucgacgcgccgggggaccccuucccccugaacccccgcggcaucaagccgcagaaggaccccgacauggccauggagaucugcgccaccgacgccguggacgacauggaggagggccucaagguccugaugaaggccgaccccgggcggcaggagucccugcaggcggaggugauccccgacccgauggagggcgagcagacguggcccaccgaggaggagcucagcgaggccaaggacuuccugaaggaguccagcaagguggucaagaaggugcccaaggggaccuccagcuaccaggccgaguggauccuggacggcgggucccagagcggcggcgagggggacgaguacgaguacgacgacauggagcacgaggacuucauggaggaggagagccaggacgaguccagcgaggaggaggaggaguacgagaccaugacgaucggcgaguccgugcacgacgaccuguacgacaagaaggucgacgaggaggccgaggccaagaugcucgagaaguacaagcaggagcgccuggaggagauguuccccgacgagguggacaccccgcgggacgucgcggcccgcauccgguuccagaaguaccgcgggcucaagagcuuccggaccucccccugggaccccaaggagaaccucccccaggacuacgcccgcaucuuccaguuccagaacuucaccaacacgcgcaagagcaucuucaaggagguggaggagaaggagguggagggcgccgaggucgggugguacgugacccugcacguguccgaggucccggugagcguggucgagugcuuccggcagggcacgccccugaucgcguucucccuccugccccacgagcagaagaugagcgugcugaacauggugguccggcgcgacccgggcaacaccgagcccgugaaggccaaggaggagcucaucuuccacugcggguuccggcgcuuccgggccagcccccuguucagccagcacaccgccgccgacaagcacaagcugcagcgcuuccucaccgcggacauggcccugguggccaccgucuacgcccccaucaccuucccgcccgccuccgugcugcuguucaagcagaaguccaacggcaugcacucccugaucgcgacggggcaccugaugagcguggaccccgaccggauggucaucaagcgcguggugcucuccggccaccccuucaagaucuucaccaagauggccgucgugcgcuacauguucuucaaccgggaggacgugcugugguucaagccggucgagcugcgcaccaaguggggccggcgcgggcacaucaaggagccccucggcacccacgggcacaugaagugcagcuucgacggcaagcugaagucccaggacacggugcugaugaaccucuacaagcggguguuccccaaguggaccuacgaccccuacgucccggagcccgugcccuggcucaagagcgagaucagcuccaccgugccccagggcgggauggaguga

SEQ ID NO: 38209 - RNA, 1164 nt, Artificial Sequence
  derived and/or modified sequence opt1 from TSSC1__Homo_sapiens__NP_003301
auggaggacgacgcccccgugaucuacggccuggaguuccaggcccgcgcgcucaccccgcagaccgccgagacggacgccauccgguuccuggucgggacccagagccugaaguacgacaaccagauccacaucaucgacuucgacgacgagaacaacaucaucaacaagaacgugcuccugcaccaggccggcgagaucuggcacaucuccgccagccccgcggaccgcggggugcugacgaccugcuacaaccggaccuccgacagcaagguccugaccugcgccgccguguggcgcaugcccaaggagcucgaguccggcagccacgagucccccgacgacagcuccagcaccgcccagacccuggagcuccugugccaccuggacaacacggcgcacgggaacauggccugcguggucugggagccgaugggcgacggcaagaagaucaucucccucgccgacaaccacauccugcugugggaccuccaggagagcuccagccaggccgugcuggccuccagcgcgucccuggaggggaagggccagcucaaguucaccagcgggcgguggagcccccaccacaacugcacccagguggccaccgccaacgacacgacccugcgcggcugggacacccgguccaugagccagaucuacugcaucgagaacgcccacgggcagcugguccgcgaccucgacuucaaccccaacaagcaguacuaccuggccuccugcggcgacgacugcaaggugaaguucugggacacccggaacgugacggagcccgucaagacccuggaggagcacagccacuggguguggaacgugcgcuacaaccacucccacgaccagcucguccugaccggcagcuccgacagccgggugauccuguccaacauggugagcaucuccagcgagccguucgggcaccucgucgacgacgacgacaucuccgaccaggaggaccaccgcagcgaggagaaguccaaggagccccugcaggacaacgugaucgcgaccuacgaggagcacgaggacagcguguacgccgucgacugguccagcgccgaccccuggcuguucgccucccucagcuacgacggccggcuggugaucaaccgcgugccccgggcccugaaguaccacauccuccuguga

SEQ ID NO: 38210 - RNA, 1104 nt, Artificial Sequence
  derived and/or modified sequence opt1 from TSSK1B__Homo_sapiens__NP_114417
auggacgacgccgccgugcugaagcgccggggcuaccuccuggggaucaaccugggcgaggggagcuacgcgaaggucaaguccgccuacagcgagcgccucaaguucaacguggccaucaagaucaucgaccggaagaaggcccccgccgacuuccuggagaaguuccugccccgcgagaucgagauccucgcgaugcugaaccacugcuccaucaucaagaccuacgagaucuucgagaccagccacggcaagguguacaucgucauggagcuggccgugcagggggaccuccuggagcugaucaagacgcggggcgcccuccacgaggacgaggcccgcaagaaguuccaccagcugucccuggcgaucaaguacugccacgaccucgacgugguccaccgggaccugaagugcgacaaccugcuccuggacaaggacuucaacaucaagcugagcgacuucuccuucagcaagcgcugccuccgggacgacuccggccgcauggcccugagcaagaccuucugcgggucccccgccuacgccgcccccgaggugcugcagggcauccccuaccagccgaagguguacgacaucuggagccucggggucauccuguacaucauggugugcggcuccaugcccuacgacgacagcaacaucaagaagaugcugcggauccagaaggagcaccgcgugaacuucccccgguccaagcaccucaccggggagugcaaggaccugaucuaccacaugcugcagcccgacgucaaccgccggcuccacaucgacgagauccugagccacugcuggaugcagccgaaggcgcgcggcucccccagcguggccaucaacaaggagggcgaguccagccgggggaccgagccccuguggacgcccgagccgggcagcgacaagaaguccgccaccaagcucgagcccgagggggaggcccagccccaggcccagcccgagaccaagccggagggcaccgcgaugcagaugagccgccaguccgagauccugggcuuccccagcaagcccuccacgauggagaccgaggaggggcccccgcagcagccgcccgagacccgggcccaguga

SEQ ID NO: 38211 - RNA, 1077 nt, Artificial Sequence
  derived and/or modified sequence opt1 from TSSK2__Homo_sapiens__NP_443732
auggacgacgccaccgugcugcgcaagaagggcuacaucgucgggaucaaccucggcaaggggagcuacgccaaggugaaguccgcguacagcgagcggcugaaguucaacguggccgucaagaucaucgaccgcaagaagacccccacggacuucguggagcgguuccugccgcgcgagauggacauccucgccaccgugaaccacggcuccaucaucaagaccuacgagaucuucgagaccagcgacgggcggaucuacaucaucauggagcugggcguccagggcgaccugcucgaguucaucaagugccagggggcccugcacgaggacguggcccgcaagauguuccggcagcuguccagcgcggugaaguacugccacgaccucgacaucguccaccgcgaccugaagugcgagaaccugcuccuggacaaggacuucaacaucaagcuguccgacuucggcuucagcaagcggugccuccgcgacuccaacgggcggaucauccugagcaagacguucugcggcuccgccgccuacgccgcgcccgaggugcugcagagcauccccuaccagcccaagguguacgacaucuggucccucggggucauccuguacaucauggugugcggcagcaugccguacgacgacuccgacauccgcaagaugcugcggauccagaaggagcaccgcguggacuucccccggagcaagaaccugaccugcgagugcaaggaccucaucuaccgcaugcugcagcccgacgucucccagcggcuccacaucgacgagauccugagccacuccuggcugcagcccccgaagcccaaggccaccagcagcgccuccuucaagcgcgagggcgaggggaaguaccgggccgagugcaagcucgacaccaagacgggccugcgccccgaccaccggcccgaccacaagcugggggccaagacccagcaccgccuccugguggugccggagaacgagaaccgcauggaggaccggcuggcggagaccagccgcgccaaggaccaccacaucuccggcgccgaggucggcaaggccagcaccuga

SEQ ID NO: 38212 - RNA, 1017 nt, Artificial Sequence
  derived and/or modified sequence opt1 from TSSK4__Homo_sapiens__NP_001171668
augggcaagggggacgugcuggaggccgcccccaccaccacggcguaccacagccucauggacgaguacggcuacgaggucgggaaggccaucggccacggguccuacggcagcguguacgaggccuucuacaccaagcagaaggugauggucgccgugaagaucaucuccaagaagaaggccagcgacgacuaccugaacaaguuccugccgcgcgagauccaggugaugaagguccuccggcacaaguaccugaucaacuucuaccgcgcgaucgaguccaccagccggguguacaucauccuggagcucgcccagggcggggacgugcuggaguggauccagcgcuacggcgccugcuccgagccccuggccgggaagugguucagccagcucacccugggcaucgcguaccugcacuccaagagcaucguccaccggcucaugcccucccugagcgccgccgggcgcgaccugaagcucgagaaccugcugcucgacaagugggagaacgugaagaucuccgacuucggcuucgccaagauggugcccagcaaccagccggucggcugcucccccagcuaccgccaggugaacugcuucucccaccugagccagacguacugcggguccuucgccuacgcgugccccgagauccugcggggccuccccuacaacccguuccugagcgacaccuggagcaugggggugauccuguacacccucgucguggcccaccuccccuucgacgacaccaaccugaagaagcugcugcgggagacgcagaaggaggugaccuuccccgccaaccacaccaucucccaggagugcaagaaccugauccuccagaugcugcgccaggccaccaagcgggccacgauccuggacaucaucaaggacagcuggguccucaaguuccagcccgagcagccgacccacgagauccgccugcuggaggcgaugugccagcuccacaacaccaccaagcagcaccagucccugcagaucacgaccuga

SEQ ID NO: 38213 - RNA, 966 nt, Artificial Sequence
  derived and/or modified sequence opt1 from TSTA3__Homo_sapiens__NP_003304
augggcgagccccaggggagcaugcgcauccuggugaccggcggguccggccucgucgggaaggccauccagaaggugguggccgacggcgcgggccugccgggggaggacugggucuucgugagcuccaaggacgccgaccugaccgacacggcccagacccgggcccucuucgagaaggugcagcccacccacgucauccaccuggccgcgauggugggcgggcuguuccgcaacaucaaguacaaccucgacuucuggcggaagaacgugcacaugaacgacaacguccugcacagcgccuucgaggugggcgcccgcaagguggucuccugccugagcacgugcaucuuccccgacaagaccaccuaccccaucgacgagaccaugauccacaacgggccgccccacaacuccaacuucggcuacagcuacgccaagcggaugaucgacgugcagaaccgcgcguacuuccagcaguacggcugcaccuucacggccgugauccccaccaacgucuucgggccccacgacaacuucaacaucgaggacggccacgugcucccggggcugauccacaaggugcaccuggccaaguccagcggcuccgcccucaccgucuggggcaccgggaacccccggcgccaguucaucuacagccuggaccuggcccagcuguucaucugggugcuccgggaguacaacgagguggagcccaucauccuguccgucggcgaggaggacgaggugagcaucaaggaggcggccgaggccguggucgaggccauggacuuccacggggaggugacguucgacaccaccaaguccgacggccaguucaagaagaccgccagcaacuccaagcuccgcacguaccugcccgacuuccgguucaccccguucaagcaggcggucaaggagaccugcgccugguucaccgacaacuacgagcaggcccgcaaguga

SEQ ID NO: 38214 - RNA, 330 nt, Artificial Sequence
  derived and/or modified sequence opt1 from TSTD1__Homo_sapiens__NP_001106676
auggccggcgcccccaccgugagccugccggagcuccgcucccugcuggcgagcgggcgggcccgccucuucgacguccggucccgcgaggaggccgccgccggcaccauccccggggcgcugaacauccccgugagcgagcuggaguccgcccuccagauggagcccgccgccuuccaggcgcuguacagcgccgagaagccgaagcuggaggacgagcaccucguguucuucugccagaugggcaagcgggggcugcaggccacgcagcuggcccgcucccucggcuacaccggcuacggggaggucuggcugcuggccggccgguga

SEQ ID NO: 38215 - RNA, 894 nt, Artificial Sequence
  derived and/or modified sequence opt1 from TST__Homo_sapiens__NP_003303
auggugcaccagguccuguaccgcgcccucgugagcaccaaguggcuggccgaguccauccggaccggcaagcuggggcccggccuccgcgugcuggacgcgagcugguacuccccggggacgcgggaggcccgcaaggaguaccuggagcggcacguccccggcgccagcuucuucgacaucgaggagugccgcgacaccgccucccccuacgagaugaugcuccccagcgaggccggguucgcggaguacgugggccggcugggcaucuccaaccacacccacguggucguguacgacggggagcaccugggcagcuucuacgccccgcgcgugugguggauguuccgggucuucgggcaccgcaccguguccgugcucaacggcggguuccggaacuggcugaaggagggccaccccgucacgagcgagcccucccgccccgagccggccguguucaaggccacccuggaccggagccuccugaagaccuacgagcagguccuggagaaccucgaguccaagcgcuuccagcugguggacagccggucccagggccgcuuccuggggaccgagcccgagcccgacgcggugggccucgacagcgggcacauccggggcgccgugaacaugcccuucauggacuuccugacggaggacggcuucgagaaggggccggaggagcugcgcgcccucuuccagaccaagaaggucgaccugucccagccccugaucgcgaccugccggaagggcgugaccgccugccacguggcccucgccgccuaccugugcgggaagcccgacgucgccguguacgacggcagcugguccgagugguuccgccgggcgcccccggagagccgcgugagccaggggaaguccgagaaggccuga

SEQ ID NO: 38216 - RNA, 3966 nt, Artificial Sequence
  derived and/or modified sequence opt1 from TTBK1__Homo_sapiens__NP_115927
augcagugccuggccgccgcgcucaaggacgagaccaacaugagcggcgggggcgagcaggccgacauccugcccgccaacuacguggucaaggaccgcuggaaggugcugaagaagaucgggggcgggggcuucggcgagaucuacgaggccauggaccuccugacccgggagaacguggcccugaaggucgaguccgcgcagcagccgaagcaggugcucaagauggagguggccguccugaagaagcugcaggggaaggaccacgugugccgcuucaucggcugcgggcggaacgagaaguucaacuacguggucaugcagcuccagggccgcaaccuggccgaccugcggcgcagccagccccgggggacguucacccucuccaccacccugcgccugggcaagcagauccucgagagcaucgaggccauccacuccgugggcuuccugcaccgggacaucaagcccagcaacuucgcgauggggcgccugcccuccacguaccggaagugcuacaugcucgacuucggccuggcccgccaguacaccaacaccaccggggacgugcggccgccccgcaacgucgccggcuuccggggcacggugcgcuacgccagcgugaacgcccacaagaaccgggagauggggcgccacgacgaccuguggucccucuucuacaugcuggucgaguucgcggugggccagcugcccuggcggaagaucaaggacaaggagcagguggggaugaucaaggagaaguacgagcaccgcaugcuccugaagcacaugcccagcgaguuccaccuguuccucgaccacaucgccucccuggacuacuucaccaagccggacuaccagcugaucaugagcgucuucgagaacuccaugaaggagcggggcaucgccgagaacgaggccuucgacugggagaaggccgggaccgacgcgcuccugagcaccuccacgagcacccccccccagcagaacacccgccagaccgccgccauguucggcguggugaacgucacgcccgugccgggcgaccugcuccgcgagaacaccgaggacgugcugcagggggagcaccuguccgaccaggagaacgccccccccauccuccccggccggccgagcgaggggcugggccccuccccccaccuggucccccacccggggggccccgaggccgaggugugggaggagaccgacgucaaccgcaacaagcuccggaucaacaucggcaagagccccugcguggaggaggagcagagccgcgggaugggcgugcccuccagcccgguccgggcgccccccgacucccccaccacgccggugcgcagccugcgguaccgccgggugaacucccccgagagcgagcgccuguccaccgccgacgggcgggucgagcuccccgagcgccggagccgcauggaccugccgggcucccccagccggcaggccugcuccagccagcccgcccagaugcuguccguggacaccgggcacgccgaccgccaggcgagcggccggauggacguguccgccagcgucgagcaggaggcccucuccaacgccuuccgcagcgugccccuggcggaggaggaggacuucgacuccaaggagugggugaucaucgacaaggagaccgagcugaaggacuucccgcccggcgccgagcccagcacgagcgggaccaccgacgaggagcccgaggagcuccggccgcugcccgaggagggcgaggagcgccgccggcugggggccgagcccaccguccgcccccggggccgcuccaugcaggcccuggccgaggaggaccuccagcaccugccgccccagccccugcccccgcagcucagccagggcgacgggcgguccgagacgagccagccccccacccccggcuccccgagccacuccccccugcacagcgggccccgcccccggcgccgggaguccgacccgaccggcccccagcgccagguguucagcguggcgcccccguucgaggucaacgggcugccccgggccgugccccucucccugcccuaccaggacuucaagcgcgaccugagcgacuaccgggagcgcgcccggcuccugaaccgcgugcggcgcgucggcuucucccacaugcugcucaccacgccgcaggugccccuggcccccgugcagccccaggccaacggcaaggaggaggaggaggaggaggaggaggacgaggaggaggaggaggaggacgaggaggaggaggaggaggaggaggaggaggaggaggaggaggaggaggaggaggaggaggaggaggaggcggccgccgccgucgcccugggggaggugcucggcccgcggagcggguccagcuccgagggcagcgagcgcagcaccgaccggucccaggagggggcgcccagcacccugcuggccgacgaccagaaggagucccgcggccgcgccagcauggccgacggcgaccucgagcccgaggagggguccaagacccuggugcuggucagccccggcgacaugaagaaguccccggugacggcggagcucgcccccgaccccgaccuggggacccuggccgcccucaccccccagcacgagcggccgcagcccaccggcagccagcuggacguguccgagcccgggacccugagcuccguccucaagagcgagcccaagccgcccggccccggcgccgggcugggcgcggggacggugaccaccggcguggggggcgucgccgugaccuccagccccuucacgaagguggagcgcaccuucguccacaucgccgagaagacccaccugaacgugauguccagcggcgggcaggcccuccgguccgaggaguucagcgccggcggggagcugggccuggagcucgcguccgacggcggggccguggaggagggcgcccgcgccccgcuggagaacgggcuggcccucagcggccugaacggggcggagaucgagggcagcgcccuguccggcgccccccgggagacccccagcgagauggccacgaacucccuccccaacgggccggcgcuggccgacggccccgcccccgucagcccgcuggagcccucccccgagaagguggccaccaucagcccccgccggcacgccaugccggggucccgcccccggagccgcauccccgugcuccuguccgaggaggacaccggcagcgagcccuccgggagccuguccgcgaaggagcgguggagcaagcgcgcccggccgcagcaggaccucgcccgccuggucauggagaagcggcagggccgccugcuccugcggcuggccuccggcgccagcuccagcuccagcgaggagcagcgccgggcgagcgagacccucuccgggacgggcagcgaggaggacacccccgccuccgagcccgccgccgcccugccccgcaagagcgggcgcgcggccgccacccggucccgcaucccgcggcccaucggccugcgcaugcccaugcccguggccgcccagcagccggcgagccggucccacggggccgcccccgcccucgacaccgcgaucacgagccgccugcagcugcagaccccccccggcuccgccaccgccgccgaccuccggccgaagcagccccccggccgcgggcugggccccgggcgggcccaggcgggcgcccgcccgcccgccccccggagcccccgccugccggccuccaccagcgccgcgcggaacgccuccgccagcccccgcucccagagccucucccggcgcgagagccccuccccgagccaccaggcccggcccggcgugccccccccgcgcggggucccccccgcccgggcgcagcccgacggcacgccgagccccgggggcuccaagaaggggccccgcggcaagcugcaggcccagcgggccaccaccaagggccgcgccgggggcgcggaggggcgcgccggcgcccgguga

SEQ ID NO: 38217 - RNA, 3735 nt, Artificial Sequence
  derived and/or modified sequence opt1 from TTBK2__Homo_sapiens__NP_775771
augagcggcgggggcgagcagcuggacauccucuccguggggauccuggucaaggagcgcuggaaggugcugcggaagaucggcgggggcggcuucggggagaucuacgacgcccucgacaugcugacccgcgagaacguggcccugaaggucgagagcgcgcagcagcccaagcaggugcucaagauggagguggccguccugaagaagcugcagggcaaggaccacgugugccgguucaucgggugcggccgcaacgaccgguucaacuacguggucaugcagcuccaggggcgcaaccuggccgaccugcggcgcucccagagccggggcaccuucacgaucuccaccacccuccgccugggccggcagauccuggagagcaucgaguccauccacagcgugggguuccuccaccgcgacaucaagccguccaacuucgccaugggccgguuccccagcaccugccgcaagugcuacaugcuggacuucgggcuggcccggcaguucacgaacuccugcggcgacgugcgccccccccgggcggucgccggcuuccgcgggaccgugcgguacgccagcaucaacgcccaccgcaaccgggagaugggccgccacgacgaccucuggucccuguucuacaugcugguggaguucgucguggggcagcucccguggcgcaagaucaaggacaaggagcaggugggcagcaucaaggagcgguacgaccaccgccugaugcugaagcaccucccccccgaguucuccaucuuccuggaccacaucagcucccuggacuacuucaccaagcccgacuaccagcuccugaccagcgucuucgacaacuccaucaagacguucggggugaucgagagcgacccguucgacugggagaagaccggcaacgacggcagccugaccaccacgaccaccuccaccacgccccagcuccacacccggcugacccccgcggccaucgggaucgccaacgccacccccaucccgggcgaccugcuccgcgagaacacggacgagguguuccccgacgagcagcugagcgacggggagaacggcauccccgucggggugucccccgacaagcugccgggcagccucggccacccccggccccaggagaaggacgugugggaggagauggacgccaacaagaacaagaucaagcuggggaucugcaaggcggccaccgaggaggagaacucccacggccaggccaacgggcugcucaacgcccccagccugggcuccccgauccgcguccggagcgagaucacccagcccgaccgcgacaucccccuggugcggaagcuccgcuccauccacagcuucgagcuggagaagcggcugacccucgagcccaagccggacacggacaaguuccuggagaccugccuggagaagaugcagaaggacaccuccgccgggaaggagagcauccuccccgcgcugcugcacaagcccugcguccccgccgugucccgcaccgaccacaucuggcacuacgacgaggaguaccugccggacgccagcaagcccgccuccgccaacacgcccgagcaggcggacggcggcgggagcaacggcuucaucgccgugaaccucuccagcugcaagcaggagaucgacuccaaggagugggucaucguggacaaggagcaggaccugcaggacuuccggaccaacgaggccguggggcacaagaccaccggcagcccgagcgacgaggagcccgagguccugcaggugcucgaggccuccccccaggacgagaagcugcagcugggccccugggccgagaacgaccaccucaagaaggagacgagcggggugguccuggcgcuguccgccgagggcccgcccaccgccgccagcgagcaguacaccgaccgccucgagcugcagcccggggcggccucccaguucaucgccgccacccccacgagccugauggaggcccaggcggagggcccgcucaccgccaucaccaucccccggcccuccguggccagcacccaguccaccagcggguccuuccacugcggccagcagcccgagaagaaggaccugcagccgauggagcccacgguggagcuguacagcccccgcgagaacuucuccggccucgucgugaccgagggggagcccccgagcggcgggucccggaccgaccugggccugcagaucgaccacaucgggcacgacaugcuccccaacauccgcgagagcaacaagucccaggaccugggccccaaggagcugcccgaccacaaccggcucgugguccgcgaguucgagaaccugccgggcgagaccgaggagaagagcauccugcucgagagcgacaacgaggacgagaagcugucccgcgggcagcacugcaucgagaucagcucccugcccggcgaccucgugaucguggagaaggaccacagcgccacgaccgagccccuggacgucaccaagacccagacguucuccguggugcccaaccaggacaagaacaacgagaucaugaagcugcucaccgucgggaccagcgagaucuccagccgggacaucgacccgcacguggagggccagaucgggcagguggccgagaugcagaagaacaagaucuccaaggacgacgacaucaugagcgaggaccugcccggccaccagggcgaccuguccaccuuccuccaccaggaggggaagcgcgagaagaucacgccccggaacggcgagcuguuccacugcgucagcgagaacgagcacggggcgccgacccgcaaggacauggugcgguccagcuucgugacccgccacucccggauccccguccuggcccaggagaucgacagcacccucgaguccagcucccccgugagcgccaaggagaagcugcugcagaagaaggccuaccagcccgaccucgugaagcugcuggucgagaagcgccaguucaagagcuuccucggcgaccuguccagcgccuccgacaagcugcucgaggagaagcuggcgacggugccggcccccuucugcgaggaggaggugcugacccccuucagccggcucaccgucgacucccaccugagccgcuccgccgaggacagcuuccugucccccaucaucagccagucccggaagagcaagaucccgcgccccguguccugggugaacaccgaccaggucaacagcuccacgagcucccaguucuucccccggcccccgcccgggaagccccccacccgcccgggcguggaggcccggcuccgccgguacaaggugcugggcagcuccaacagcgacagcgaccuguucucccgccucgcgcagauccugcagaacgggagccagaagccccgguccaccacccagugcaagagccccggcuccccccacaacccgaagacgccccccaagagccccgucgugccgcgccggucccccagcgccuccccccgcagcuccagccugccccgcaccuccagcuccagcccgucccgggccgggcgcccccaccacgaccagcggagcuccagcccccaccucggccgcagcaaguccccgcccagccacuccggcagcuccagcucccggcgcagcugccagcaggagcacugcaagcccuccaagaacgggcugaagggcagcgggucccugcaccaccacagcgccuccaccaagaccccccagggcaagagcaagccggccuccaagcucagccgguga

SEQ ID NO: 38218 - RNA, 2118 nt, Artificial Sequence
  derived and/or modified sequence opt1 from TTC12__Homo_sapiens__NP_060338
auggacgccgacaaggagaaggaccugcagaaguuccucaagaacguggacgagaucagcaaccugauccaggagaugaacuccgacgaccccguggugcagcagaaggccgugcuggagaccgagaagcgccuccugcugauggaggaggaccaggaggaggacgagugccggaccacgcucaacaagaccaugaucagcccgccccagaccgcgaugaaguccgccgaggagaucaacagcgaggccuuccuggccuccgucgagaaggacgccaaggagcgcgcgaagcggcgccgggagaacaaggugcuggccgacgcccucaaggagaagggcaacgaggccuucgcggaggggaacuacgagaccgccauccugcgcuacagcgagggccuggagaagcucaaggacaugaaggugcuguacacgaaccgggcccaggccuacaugaagcuggaggacuacgagaaggcccucgucgacugcgagugggcgcugaagugcgacgagaagugcaccaaggccuacuuccacauggggaaggccaaccuggcccucaagaacuacuccgugagccgcgagugcuacaagaagauccuggagaucaaccccaagcugcagacccaggugaagggcuaccucaaccaggucgaccugcaggagaaggccgaccugcaggagaaggaggcgcacgagcuccuggacuccgggaagaacaccgccgugacgaccaagaaccugcucgagacccugagcaagcccgaccagaucccgcuguucuacgccggcggcaucgagauccucaccgagaugaucaacgagugcacggagcagacccuguuccggaugcacaacggguucuccaucaucagcgacaacgaggugauccgccggugcuucuccaccgccggcaacgacgccgucgaggagauggugugcgugagcguccugaagcucuggcaggcggugugcucccgcaacgaggagaaccagcgggugcuggucauccaccacgaccgcgcccggcugcucgccgcccugcugagcuccaaggugcucgccauccgccagcagagcuucgcgcugcugcuccaccuggcccagaccgaguccgggcggagccugaucaucaaccaccucgaccugacgcgccugcucgaggcccuggugagcuuccuggacuucuccgacaaggaggccaacaccgcgaugggccuguucaccgaccucgcccuggaggagcgguuccaggucugguuccaggccaaccugcccggggugcuccccgcccugaccggcgugcugaagacggaccccaaggucagcuccagcuccgcccucugccagugcaucgcgaucaugggcaaccugagcgccgagccgaccacccgccggcacauggccgccugcgaggaguucggggacggcugccugucccuccuggcccgcugcgaggaggacguggaccuguuccgcgaggucaucuacacccuccuggggcugaugaugaaccucugccugcaggcgcccuucgugagcgaggugugggccgucgaggugucccggcgcugccugagccuccugaacucccaggacggcggcauccugacgcgggccgccggggugcucagccgcacccuguccagcucccugaagaucgucgaggaggcccuccgggcgggcguggugaagaagaugaugaaguuccugaagaccgggggcgagaccgccagccgcuacgccaucaagauccuggccaucugcacgaacuccuaccacgaggcgcgggaggaggucauccgccucgacaagaagcugagcgugaugaugaagcugcucuccagcgaggacgaggugcuggucgggaacgccgcccugugccucggcaacugcauggaggugcccaacguggccagcucccugcugaagaccgaccuccugcagguccugcucaagcuggccggcagcgacacccagaagaccgcgguccaggugaacgccgggaucgcccugggcaagcucugcacggccgagccccgguucgccgcgcagcugcgcaagcugcacgggcucgagauccugaacuccaccaugaaguacaucagcgacuccuga

SEQ ID NO: 38219 - RNA, 3426 nt, Artificial Sequence
  derived and/or modified sequence opt1 from TTC17__Homo_sapiens__NP_060729
auggccgccgcggugggcguccgcgggcgguacgagcugcccccgugcagcggccccggguggcuccugucccugagcgcccuccuguccguggccgcccgcggcgccuucgcgaccacccacuggguggucacggaggacgggaagauccagcagcaggucgacagccccaugaaccugaagcacccccacgaccucgugauccugaugcggcaggaggccaccgugaacuaccugaaggagcucgagaagcagcugguggcccagaagauccacaucgaggagaacgaggaccgcgacaccggccuggagcagcggcacaacaaggaggacccggacugcaucaaggccaaggugccccucggcgaccuggaccuguacgacgggaccuacaucacgcucgaguccaaggacaucagccccgaggacuacaucgacaccgagucccccgucccgcccgaccccgagcagcccgacugcaccaagauccuggagcugccguacagcauccacgcguuccagcaccuccgcggcgugcaggagcgggugaaccuguccgcgccccugcuccccaaggaggaccccaucuucaccuaccugagcaagcgccuggggcgguccaucgacgacaucggccaccucauccacgaggggcugcagaagaacacgagcuccuggguccuguacaacauggccagcuucuacuggcgcaucaagaacgagccguaccaggugguggagugcgccaugcgggcccuccacuucuccagccgccacaacaaggacaucgcccuggucaaccuggccaacgugcuccaccgggcccacuucuccgccgacgccgcgguggucgugcacgccgcccuggacgacagcgacuucuucaccuccuacuacacccugggcaacaucuacgccaugcucggcgaguacaaccacagcgugcugugcuacgaccacgcccugcaggcgcgccccggguucgagcaggccaucaagcggaagcacgccguccucugccagcagaagcuggagcagaagcuggaggcccagcaccgcagccuccagcggacccugaacgagcugaaggaguaccagaagcagcacgaccacuaccuccgccagcaggagauccuggagaagcacaagcugauccaggaggagcagauccuccggaacaucauccacgagacgcagauggccaaggaggcgcagcugggcaaccaccagaucugccgccuggugaaccagcagcacucccuccacugccagugggaccagcccgugcgguaccaccgcggggacaucuucgagaacgucgacuacgugcaguucggcgaggacagcuccaccagcuccaugaugagcgucaacuucgacgugcaguccaaccagagcgacaucaacgacuccgucaagagcucccccguggcccacagcauccuguggaucuggggccgcgacuccgacgccuaccgggacaagcagcacauccuguggccgaagcgcgccgacugcaccgagagcuacccccgggugcccgucgggggcgagcugcccaccuacuuccucccgcccgagaacaaggggcugcgcauccacgagcuguccagcgacgacuacuccacggaggaggaggcgcagacccccgacugcagcaucaccgacuuccggaagucccacacccucagcuaccuggugaaggagcuggaggugcgcauggaccucaaggccaagaugcccgacgaccacgcccggaagauccugcugagccgcaucaacaacuacacgaucccggaggaggagaucggcuccuuccucuuccacgccaucaacaagcccaacgcccccaucuggcugauccugaacgaggcggggcucuacuggcgggccgugggcaacagcaccuucgccaucgccugccugcagcgcgcccugaaccucgcgccgcugcaguaccaggacgucccccuggugaaccucgccaaccugcugauccacuacggccuccaccuggacgccaccaagcugcuccugcaggcccuggccaucaacuccagcgagccccucaccuuccugucccuggggaacgcguaccucgcccugaagaacaucagcggcgcccuggaggccuuccggcaggcgcucaagcugacgaccaagugccccgagugcgagaacucccugaagcucauccgcugcaugcaguucuacccguuccuguacaacaucaccagcuccgugugcagcgggaccgucguggaggaguccaacggcagcgacgagauggagaacuccgacgagacgaagaugagcgaggagauccuggcccucguggacgaguuccagcaggccuggccccuggagggguucggcggcgcccuggagaugaaggggcggcgccucgaccugcagggcauccggguccugaagaaggggccccaggacggcguggcccgcuccagcugcuacggggacugccgguccgaggacgacgaggcgaccgaguggaucaccuuccaggugaagcgcgucaagaagcccaagggcgaccacaagaagaccccgggcaagaagguggagacggggcagaucgagaacggccaccgguaccaggccaaccucgagaucaccgggcccaagguggccagccccggcccccagggcaagaagcgcgacuaccagcgccugggguggccgagccccgacgagugccugaagcuccggugggucgagcugaccgccaucguguccaccuggcuggccgugagcuccaagaacaucgacaucacggagcacaucgacuucgcgacccccauccagcagcccgccauggagccgcucugcaacggcaaccugcccaccagcaugcacacccuggaccaccuccacggggucuccaaccgcgccagccugcacuacaccggcgagucccagcugacggaggugcuccagaaccuggggaaggaccaguacccccagcagagccuggagcagaucggcacccggaucgccaaggugcucgagaagaaccagaccuccuggguccugagcuccauggccgcgcuguacuggcgcgugaagggccaggggaagaaggccaucgacugccuccggcaggcccugcacuacgcgccccaccagaugaaggacgugccgcugaucagccucgccaacauccugcacaacgccaagcuguggaacgacgccgucaucguggccaccauggccguggagaucgcgccccacuucgccgucaaccacuucacgcucggcaacguguacguggccauggaggaguucgagaaggcccuggucugguacgaguccacccugaagcuccagcccgaguucgugcccgccaagaaccgcauccagaccauccagugccaccugaugcugaagaaggggcggcgcagcccguga

SEQ ID NO: 38220 - RNA, 1143 nt, Artificial Sequence
  derived and/or modified sequence opt1 from TTC19__Homo_sapiens__NP_060245
auguuccgccugcucagcuggucccugggccggggguuccugcgcgccgccggccggcgcugccgggggugcagcgcgcgccuccugcccggccuggccgggggcccgggccccgaggugcaggucccgcccucccggguggcgccccacgggcgcggccccgggcuccugccccugcucgccgcccuggccugguucagccggcccgccgccgccgaggaggaggagcagcagggcgcggacggggccgccgccgaggacggcgccgacgaggcggaggccgagaucauccagcugcucaagcgcgccaagcuguccaucaugaaggacgagccggaggaggccgagcugauccuccacgacgcccugcggcuggcguaccagaccgacaacaagaaggccaucaccuacacguacgaccucauggccaaccuggccuucauccgcggccagcuggagaacgccgagcagcuguucaaggcgaccaugagcuaccugcucgggggcgggaugaagcaggaggacaacgccaucaucgagaucucccucaagcuggccagcaucuacgccgcccagaaccggcaggaguucgcgguggccggcuacgaguucugcaucuccacccuggaggagaagaucgagcgcgagaaggagcucgccgaggacaucaugagcgucgaggagaaggccaacacccaccuccugcugggcaugugccuggacgcgugcgcccgguaccuccuguucuccaagcagcccagccaggcccagcgcauguacgagaaggcccugcagaucuccgaggagauccagggggagcggcacccccagacgaucgugcugaugagcgaccucgccaccacccuggacgcgcagggccgcuucgacgaggccuacaucuacaugcagcgggccuccgaccuggcccgccagaucaaccaccccgagcuccacauggugcugagcaaccuggccgcgguccucaugcaccgggagcgcuacacccaggccaaggagaucuaccaggaggcccugaagcaggccaagcugaagaaggacgagaucuccgugcagcacauccgcgaggagcucgccgagcugagcaagaagucccggccgcugacgaacagcgugaagcucuga

SEQ ID NO: 38221 - RNA, 879 nt, Artificial Sequence
  derived and/or modified sequence opt1 from TTC1__Homo_sapiens__NP_001269429
augggcgagaaguccgagaacugcggggugcccgaggaccugcucaacggccugaaggucaccgacacccaggaggccgagugcgccgggccgcccgugcccgaccccaagaaccagcacagccagagcaagcugcuccgcgacgacgaggcgcaccuccaggaggaccagggcgaggaggagugcuuccacgacugcuccgccagcuucgaggaggagccgggggccgacaagguggagaacaaguccaacgaggacgucaacagcuccgagcuggacgaggaguaccugaucgagcuggagaagaacaugagcgacgaggagaagcagaagcggcgcgaggaguccacgcggcugaaggaggagggcaacgagcaguucaagaagggcgacuacaucgaggccgagagcuccuacagccgcgcccucgagaugugccccuccugcuuccagaaggagcggagcauccuguucuccaaccgcgcggccgcccggaugaagcaggacaagaaggagauggccaucaacgacugcagcaaggcgauccagcugaaccccuccuacauccgcgccauccuccggcgcgccgagcuguacgagaagaccgacaagcuggacgaggcccucgaggacuacaagagcauccuggagaaggaccccuccauccaccaggcccgggaggcgugcaugcgccugccgaagcagaucgaggagcggaacgagcgccucaaggaggagaugcuggggaagcugaaggaccucggcaaccuggugcugcggcccuucgggcucagcaccgagaacuuccagaucaagcaggacagcuccaccggcagcuacuccaucaacuucgugcagaaccccaacaacaaccgcuga

SEQ ID NO: 38222 - RNA, 3951 nt, Artificial Sequence
  derived and/or modified sequence opt1 from TTC21B__Homo_sapiens__NP_079029
auggacagccaggagcugaagacccucaucaacuacuacugccaggagcgcuacuuccaccacgugcugcuggucgccuccgagggcaucaagcgguacgggagcgaccccguguuccgcuucuaccacgccuacggcacccucauggaggggaagacgcaggaggcgcugcgggaguucgaggccaucaagaacaagcaggacgugucccugugcagccuccuggcccugaucuacgcccacaagauguccccgaaccccgaccgcgaggccauccucgagagcgacgcgcgggucaaggagcagcgcaagggcgccggggagaaggcccuguaccacgccggccuguuccucuggcacaucggccggcacgacaaggcgcgcgaguacaucgaccggaugaucaagaucuccgacgggagcaagcagggccacgugcugaaggccuggcuggacaucacccgcgggaaggagcccuacaccaagaaggcccucaaguacuucgaggagggccugcaggacgggaacgacaccuucgcccugcucggcaaggcccagugccuggagaugcggcagaacuacuccggcgcgcuggagacggugaaccagaucaucgucaacuuccccagcuuccucccggccuucgugaagaagaugaagcugcagcuggcccuccaggacugggaccagaccguggagaccgcccagcgccugcugcuccaggacucccagaacgucgaggcccugcggaugcaggcgcuguacuacgugugccgcgagggggacaucgagaaggccagcaccaagcucgagaaccugggcaacacgcuggacgccauggagccccagaacgcccagcuguucuacaacaucacccuggccuucucccggaccugcgggcgcagccagcugauccuccagaagauccagacccugcuggagcgggcguucucccucaacccccagcagagcgaguucgccacggagcugggcuaccagaugauccugcagggccgcgugaaggaggcccucaagugguacaagaccgccaugacccuggacgagaccuccgucagcgcccuggugggguucauccagugccagcucaucgagggccagcugcaggacgcggaccagcagcuggaguuccucaacgagauccagcaguccaucggcaagagcgccgagcugaucuaccugcacgccgugcuggccaugaagaagaacaagcggcaggaggaggucaucaaccuccugaacgacgugcuggacacgcacuucagccagcucgaggggcugccccuggggauccaguacuucgagaagcucaacccggacuuccugcuggagaucgugauggaguaccucuccuucugccccaugcagcccgcgagccccggccagccgcugugcccccugcuccgccggugcaucuccguccuggagaccguggugcgcaccguccccggccugcuccagaccguguuccugaucgccaaggugaaguaccugagcggggacaucgaggccgccuucaacaaccuccagcacugccuggagcacaaccccuccuacgccgacgcgcaccuccuccuggcccaggucuaccugagccaggagaaggugaagcucugcucccagagccuggagcugugccucuccuacgacuucaagguccgcgacuacccgcuguaccaccugaucaaggcccagagccagaagaagaugggcgagaucgccgacgccaucaagacgcuccacauggcgaugucccugcccgggaugaagcggaucggcgccagcaccaaguccaaggaccgcaagaccgagguggacaccagccaccggcuguccaucuuccucgagcugaucgacgugcaccgccugaacggggagcagcacgaggccacgaagguccuccaggacgccauccacgaguucagcggcaccuccgaggaggugcgggugaccaucgccaacgcggaccuggcccuggcccagggcgacaucgagcgcgcccucagcauccugcagaacgucaccgcggagcagcccuacuucaucgaggcccgggagaagauggccgacaucuaccugaagcaccgcaaggacaagaugcucuacaucacgugcuuccgggagaucgccgagcgcauggccaacccccgguccuuccugcugcucggggacgcguacaugaacauccuggagccggaggaggccaucguggccuacgagcaggcccugaaccagaaccccaaggacggcacccucgccagcaagauggggaaggcgcugaucaagacccacaacuacagcauggccaucaccuacuacgaggccgcccugaagacgggccagaagaacuaccucugcuacgaccuggccgagcugcuccugaagcugaagugguacgacaaggcggagaaggugcuccagcacgcccuggcccacgagcccgucaacgagcuguccgcccucauggaggacgggcgcugccaggugcugcuggcgaagguguacagcaagauggagaagcucggcgacgccaucaccgcccugcagcaggcccgggagcugcaggcccgcguccucaagcgggugcagauggagcagcccgacgcggugccggcccagaagcaccuggccgccgagaucugcgccgagaucgcgaagcacuccgucgcccagcgcgacuacgagaaggccaucaaguucuaccgggaggcccuggugcacugcgagaccgacaacaagaucaugcucgagcuggcccgccuguaccucgcgcaggacgaccccgacagcugccugcggcagugcgcccugcuccugcaguccgaccaggacaacgaggccgccaccaugaugauggccgaccugauguuccgcaagcaggacuacgagcaggcgguguuccaccuccagcagcugcuggagcgcaagcccgacaacuacaugacgcucagccggcugaucgaccugcuccgccggugcggcaagcuggaggacgucccccgcuucuucuccauggccgagaagcggaacagccgcgccaagcuggagccgggguuccaguacugcaagggccucuaccugugguacaccggggagcccaacgacgcccugcggcacuucaacaaggcgcgcaaggaccgggacuggggccagaacgcccucuacaacaugaucgagaucugccugaaccccgacaacgagaccgugggcggggagguguucgagaaccuggacggcgaccucgggaacuccaccgagaagcaggagagcguccagcuggccgugcgcaccgccgagaagcugcugaaggagcucaagccgcagacggugcagggccacguccagcugcggaucauggagaacuacugccugauggccaccaagcagaaguccaacguggagcaggcgcucaacaccuucaccgagaucgccgccagcgagaaggagcacauccccgcccugcuggggauggccacggcguacaugauccucaagcagacgccccgcgcccggaaccagcugaagcgcaucgccaagaugaacuggaacgccaucgacgccgaggaguucgagaaguccuggcugcuccuggcggacaucuacauccagagcgccaaguacgacauggccgaggaccugcucaagcggugccugcgccacaaccgguccugcugcaaggccuacgaguacaugggcuacaucauggagaaggagcaggcguacaccgacgccgcccugaacuacgagauggccuggaaguacagcaaccgcaccaaccccgccgugggcuacaagcucgcguucaacuaccugaaggccaagcgguacgucgacuccaucgacaucugccaccaggugcuggaggcccacccgaccuaccccaagauccgcaaggacauccucgacaaggcccgggccagccugcgccccuga

SEQ ID NO: 38223 - RNA, 7446 nt, Artificial Sequence
  derived and/or modified sequence opt1 from TTC28__Homo_sapiens__NP_001138890
auggagcagagcccgccgcccgcccccgagcccacccagggccccacccccgcccgcucccggcgccggcgcgagcccgaguccccgcccgccuccgcccccaucccccuguucggggccgacaccaucggccagcggagccccgacgggcccgugcuguccaaggccgaguucguggagaaggugcgccagagcaaccaggccugccacgacggcgacuuccacaccgcgaucgugcuguacaacgaggcccuggccgucgacccccagaacugcauccucuacuccaaccggagcgccgcguacaugaagauccagcaguacgacaaggcccuggacgacgccaucaaggcccgccugcucaaccccaaguggcccaaggccuacuuccggcaggggguggcgcugcaguaccugggccgccacgccgacgcccucgccgccuucgcguccggccuggcccaggaccccaagucccugcagcuccugguggggauggucgaggccgccaugaagucccccaugcgggacagccuggagcccaccuaccagcagcuccagaagaugaagcuggacaagucccccuucgugguggucagcguggugggccaggagcugcucaccgccgggcaccacggcgcguccgucguggugcuggaggccgcccugaagaucgggacgugcagccucaagcugcgcggcuccgucuucagcgcccuguccagcgccuacuggagccucggcaacaccgagaaguccaccggguacaugcagcaggaccuggacguggcgaagacccugggcgaccagacgggggagugccgggcccacggcaaccucggcagcgccuucuucuccaaggggaacuaccgcgaggcccugaccaaccaccggcaccagcuggugcucgcgaugaagcugaaggaccgcgaggccgccagcuccgcccugagcucccucggccacgucuacaccgccaucggggacuacccgaacgcgcuggccagccacaagcagugcgugcugcucgccaagcaguccaaggacgagcugagcgaggcccgggagcugggcaacaugggggccguguacaucgcgaugggcgacuucgagaacgccguccagugccacgagcagcaccucaagaucgccaaggaccugggcaacaagcgcgaggaggcccgggccuacuccaaccuggggagcgcguaccacuaccgccggaacuucgacaaggccauguccuaccacaacuacgugcucgagcuggcccaggagcugauggagaaggccaucgagaugcgcgcguacgccggccucgggcacgccgcccgcugcaugcaggaccuggagcgggccaagcaguaccacgagcagcagcugggcaucgcggaggaccucaaggaccgcgccgccgaggggcgggccagcuccaaccugggcaucauccaccagaugaagggcgacuacgacaccgcccugaagcugcacaagacgcaccucugcaucgcgcaggagcugagcgacuacgccgcccaggggcgcgccuacggcaacauggggaacgccuacaacgcgcugggcauguacgaccaggccgugaaguaccaccggcaggagcuccagaucuccauggaggucaacgaccgcgccagccaggccuccacccacgggaaccuggcgguggccuaccaggcccugggcgcccacgaccgggcccuccagcacuaccagaaccaccugaacaucgcgcgcgagcugcgggacauccagagcgaggcccgcgcccucagcaaccugggcaacuuccacugcucccgcggggaguacguccaggccgcccccuacuacgagcaguaccugcgccucgcgcccgaccugcaggacauggagggcgaggggaaggugugccacaaccugggcuacgcccacuacugccucggcaacuaccaggaggccgugaaguacuacgagcaggaccuggcccuggccaaggaccuccacgacaagcugagccaggcgaaggccuacugcaaccuggggcucgccuucaaggcccugcugaacuucuccaaggccgaggagugccagaaguaccuccugagccuggcgcagucccucaacaacagccaggccaaguuccgggcccugggcaaccugggggacaucuucaucugcaagaaggacaucaacggcgccaucaaguucuacgagcagcagcucgggcuggcgcaccaggucaaggaccgccggcuggaggccuccgccuacgccgcccucggcaccgcguaccgcaugauccagaaguacgacaaggcccugggcuaccacacccaggagcuggagguguaccaggagcucagcgaccugcccggggagugccgggcccacggccaccuggccgccguguacauggcgcucgggaaguacacgauggccuucaagugcuacgaggagcagcuggaccugggccagaagcucaaggacccgucccuggaggcccaggucuacgggaacaugggcaucaccaagaugaacaugaacgugauggaggaggccaucggcuacuucgagcagcagcuggccaugcuccagcagcugagcgggaacgaguccgugcuggaccgcggccgggcguacgggaaccucggcgacugcuacgaggcccugggggacuacgaggaggccaucaaguacuacgagcaguaccugagcgucgcccagucccucaaccgcaugcaggaccaggcgaaggccuaccgcggccugggcaacgggcaccgggccaugggcagccugcagcaggcccucgugugcuucgagaagcgccugguggucgcccacgagcugggggaggcguucaacaaggcccaggccuacggcgagcucgggucccugcacagccagcugggcaacuacgagcaggccaucuccugccucgagcggcagcugaacaucgcccgcgacaugaaggaccgggcgcuggagagcgacgccgccugcggccucgggggcguguaccagcagaugggggaguacgacaccgcccugcaguaccaccagcuggaccuccagaucgccgaggagaccaacaaccccacgugccagggccgcgcguacggcaaccuggggcugaccuacgagagccucggcaccuucgagcgggccguggucuaccaggagcagcaccuguccaucgccgcccagaugaacgaccuggcggccaagaccgugagcuacuccagccucgggcgcacgcaccacgcccugcagaacuacucccaggccgugauguaccugcaggagggccuccggcuggccgagcagcuggggcgccgggaggacgaggcgaagauccgccacggccucggccugagccugugggccuccgggaaccucgaggaggcccagcaccagcuguaccgggccagcgcccuguucgagaccauccgccacgaggcgcagcucuccaccgacuacaagcugagccuguucgaccuccagaccuccagcuaccaggcccugcagcggguccuggugucccucggccaccacgacgaggcccuggccguggccgagcgcgggcggacgcgcgcguucgccgaccugcucgucgagcggcagaccggccagcaggacagcgaccccuacucccccgugaccaucgaccagauccuggagauggugaacgggcagcgcggccugguccuguacuacagccucgccgccggcuaccuguacuccuggcugcucgccccgggggcgggcaucgugaaguuccacgagcacuaccugggggagaacaccguggagaacagcuccgacuuccaggccagcagcuccgucacgcugcccaccgccaccggcagcgcccucgagcagcacaucgcguccgugcgggaggcccuggggguggagagccacuacucccgcgccugcgccagcuccgagaccgagagcgaggccggcgacaucauggaccagcaguucgaggagaugaacaacaagcugaacuccgucacggaccccaccggcuuccuccgcauggugcggcgcaacaaccuguucaaccggagcugccaguccaugaccagccuguucuccaacaccgugagcccgacccaggacgggacguccagccucccccgccggcaguccagcuucgcgaagccgccccugcgcgcccuguacgaccuccugaucgccccgauggagggcgggcugaugcacuccagcggccccgucggccggcaccgccagcucauccuggugcuggagggggagcucuaccugauccccuucgcccugcucaagggcagcuccagcaacgaguaccuguacgagcgguucgggcugcucgccgugcccuccauccgcagccuguccguccagagcaagucccaccuccggaagaacccgcccaccuacagcuccagcaccuccauggcggccgugaucggcaaccccaagcuccccagcgccgugauggaccgcuggcugugggggccgaugcccuccgccgaggaggaggccuacauggucagcgagcugcucggcugccagccccuggugggcuccguggcgaccaaggagcgggucaugagcgcccugacgcaggccgagugcgugcacuucgccacccacaucuccuggaagcucagcgcgcuggugcugacccccuccauggacgggaacccggccagcagcaaguccagcuucggccaccccuacaccauccccgagucccuccgcguccaggacgacgccagcgacggggaguccaucagcgacugcccgccgcugcaggagcugcuccugacggccgccgacgugcuggaccuccagcugcccgugaagcuggucgugcucggcuccagccaggaguccaacagcaaggugaccgcggacggggucaucgcccugacccgggccuuccuggccgccggcgcgcagugcgugcucgucucccuguggcccgugcccguggccgccagcaagauguucauccacgccuucuacuccagccugcucaacggccugaaggccuccgcggcccugggggaggccaugaaggucgugcagagcuccaaggccuucagccacccguccaacugggcgggcuucaugcucaucgggagcgacgugaagcugaacagccccuccagccugaucggccaggcccucaccgagauccugcagcaccccgagcgcgcccgggacgcccugcgcguccuccugcaccugguggagaagucccuccagcggauccagaacgggcagcgcaacgccauguacacgagccagcaguccguggagaacaaggucggcggcaucccgggguggcaggcgcugcugaccgccgugggcuuccgccucgacccgcccaccagcgggcugcccgccgccguguucuucccgaccuccgaccccggcgaccggcugcagcagugcagcuccacgcuccagagccugcuggggcuccccaaccccgcccugcaggcgcugugcaagcucaucaccgccuccgagaccggcgagcagcugaucagccgcgccgucaagaacauggugggcaugcugcaccaggugcucguccagcugcaggccggggagaaggagcaggaccuggccuccgcgccgauccaggugagcaucuccgugcagcucuggcggcugcccggcugccacgaguuccuggccgcccucggguucgaccugugcgaggucggccaggaggaggugauccugaagaccggcaagcaggccaaccgccggacggugcacuucgcccuccagagccugcugucccucuucgacagcaccgagcugcccaagcgccugucccucgacagcagcuccagccuggagucccuggcgagcgcccaguccgucagcaacgcccucccccugggguaccagcagccgcccuucucccccaccggcgccgacagcaucgcguccgacgccaucagcguguacucccugagcuccaucgccagcuccaugagcuucguguccaagcccgagggcgggagcgagggcgggggccccgggggccggcaggaccacgaccgcagcaagaacgccuaccugcagcgguccacccucccccgcagccagcugccgccccagacgcggccggccgggaacaaggacgaggaggaguacgagggcuucuccaucaucagcaacgagccccuggcgaccuaccaggagaaccgcaacacgugcuucucccccgaccacaagcagccccagccggggaccgccggcggcaugcgggucagcguguccagcaagggguccaucagcacgcccaacucccccgugaagaugacccucauccccagcccgaacucccccuuccagaaggucggcaagcuggccagcuccgacaccggggagagcgaccaguccagcaccgagacggacuccaccgucaagagccaggaggagagcaaccccaagcuggacccgcaggagcucgcccagaagauccuggaggagacccagucccaccugaucgccguggagcgccuccagcggagcggcgggcaggucuccaagagcaacaaccccgaggacggcgugcaggcgcccuccagcaccgccguguuccgcgccuccgagacgagcgccuucucccggcccguccugagccaccagaagucccagccgagccccgugaccgugaagcccaagcccccggcccgcuccagcucccugcccaaggucagcuccggcuacagcucccccaccaccagcgagaugagcaucaaggacucccccagccagcacuccgggcggccgagccccggcugcgacucccagaccagccagcucgaccagccccuguucaagcugaaguaccccuccagcccguacuccgcgcacaucagcaagagcccccggaacaugagccccuccagcgggcaccagucccccgccggcagcgccccgucccccgcccucagcuacuccagcgcggggagcgcccgguccagccccgccgacgcccccgacaucgacaagcugaagauggccgcgaucgacgagaaggugcaggccgugcacaaccugaagauguucuggcaguccacgccgcagcacagcaccggccccaugaagaucuuccgcggcgcccccgggaccaugaccuccaagcgcgacguccucagccugcugaaccucagcccccggcacaacaagaaggaggagggcguggacaagcuggagcugaaggagcucagccugcagcagcacgacggggccccgcccaaggcgccgcccaacggccacuggcgcacggagaccaccucccugggcagccucccccugcccgcggggccgcccgccaccgcccccgcccggccccugcgccuccccuccggcaacggguacaaguuccugagccccggccgguucuuccccuccagcaagugcuga

SEQ ID NO: 38224 - RNA, 1506 nt, Artificial Sequence
  derived and/or modified sequence opt1 from TTC29__Homo_sapiens__NP_001287690
augauccccauguucaccgugacccuggaggacagcggcacgcucuggaagucccugcacagcuccagcgaguccgagaugaccacccugccgccccuccccaugacccgccccaagcugacggcccuggcccggcagaagcucccgugcagcucccgcaagaucccccggagccagcugaucaaggagaaggacgacaucgaccacuaccuggaggucaacuucaaggggcucuccaaggaggagguggcggccuaccgcaacagcuacaagaagaacaucugcguggacaugcugcgggacggcuaccacaaguccuucaccgagcuguucgcccucauggagcgcugggacgcccugcgggaggccgcgcgcguccggagccuguucuggcuccagaagccccuggaggagcagcccgacaagcuggacuaccucuaccacuaccugacccgcgccgaggacgccgagcggaaggaguccuucgaggacgugcacaacaaccuguacgcccucgcgugcuacuucaacaacagcgaggacaagugggugcgcaaccacuucuacgagcggugcuucaagaucgcccagcugaucaagaucgacugcgggaagaaggaggccgaggcccacaugcacaugggccugcucuacgaggaggacgggcagcugcuggaggccgcggagcacuacgaggccuuccaccagcucacccagggccgcaucuggaaggacgagacgggccggucccugaaccugcucgccugcgagagccugcugcgcaccuaccggcuccuguccgacaagaugcuggagaacaaggaguacaagcaggccaucaagauccucaucaaggccagcgagaucgcgaaggagggguccgacaagaagauggaggccgaggccagcuacuaccugggccuggcccaccucgccgcggaggaguacgagaccgcccugaccguccuggacacguacugcaagaucagcaccgaccucgacgacgaccugucccuggggcgcggcuacgaggccaucgccaaggugcuccagagccagggggagaugaccgaggccaucaaguaccugaagaaguucgugaagaucgcgcggaacaacuuccagucccuggaccucguccgcgccagcaccaugcugggcgacaucuacaacgagaagggcuacuacaacaaggccuccgagugcuuccagcaggccuucgacacgaccguggagcugaugagcaugccgcugauggacgagaccaaggugcacuacgggaucgcgaaggcccaccagaugaugcucaccgucaacaacuacaucgaguccgccgaccugacgagccugaacuaccuccuguccuggaaggagagccggggcaacaucgagcccgaccccgugaccgaggaguuccgcggguccaccguggaggccgucagccagaacuccgagcgccuggaggagcucagccgguuccccggcgaccagaagaacgagaccuga

SEQ ID NO: 38225 - RNA, 4695 nt, Artificial Sequence
  derived and/or modified sequence opt1 from TTC37__Homo_sapiens__NP_055454
augagcuccaaggaggugaagaccgcccucaagagcgcccgcgacgcgauccggaacaaggaguacaaggaggcccucaagcacugcaagaccguccugaagcaggagaagaacaacuacaacgccuggguguucaucggcguggccgccgcggagcuggagcagcccgaccaggcccaguccgccuacaagaaggccgcggagcucgagccggaccagcugcuggccuggcaggggcucgccaaccuguacgagaaguacaaccacaucaacgccaaggacgaccugcccggcgucuaccagaagcuccuggaccuguacgagagcguggacaagcagaaguggugcgacgugugcaagaagcucgucgaccuguacuaccaggagaagaagcaccuggagguggcccgcacguggcacaagcucaucaagacccggcaggagcagggggcggagaacgaggagcugcaccagcuguggcgcaagcucacccaguuccuggccgaguccaccgaggaccagaacaacgagacgcagcagcugcuguucaccgccuucgagaacgcccugggccugagcgacaagauccccuccgaggaccaccaggugcucuaccggcacuucauccagagccuguccaaguucccccacgagagcgcccgccugaagaaggcgugcgaggggaugaucaacaucuacccgaccguccaguacccccucgaggugcugugccugcaccucaucgaguccggcaaccugaccgacgagggccagcaguacugcugccggcugguggagauggacagcaaguccgggcccggccucaucgggcugggcaucaaggcccugcaggacaagaaguacgaggacgccguccgcaaccucacggaggggcugaaggagagccccgugugcaccuccggcugguaccaccuggccgaggcccaggugaagaugcaccggccgaaggaggcgguccucagcugcucccaggcccugaagaucguggacaaccugggcgccagcgggaacucccucuaccagcgcaaccugugccugcaccucaaggccgaggcccugaucaagcugagcgacuacgacagcuccgaggaggcgauccggacccucgaccagaucagcgacgccgacaacauccccggccugcuggugcugaagucccucgccuaccgcaacaaggggagcuucgacgaggccgcgaagaucauggaggaccugcuguccagcuaccccgaccucgccgagguccacgcccuggaggcccugauccacuucaccaagaaggacuaccuccaggccgagaagugcuuccagcgggcgcuggagaaggacacggagguggccgaguaccacuaccagcugggccucaccuacugguucaugggcgaggagacccgcaaggacaagaccaaggcccugacgcacuuccugaaggccgcccggcucgacaccuacauggggaagguguucugcuaccugggccacuacuaccgcgacgucgugggggacaagaaccgggcgcgcggcugcuaccggaaggccuucgagcuggacgacaccgacgccgaguccggggccgccgcgguggaccucagcgucgagcuggaggacauggagauggcccuggccauccucaccacggugacccagaaggccuccgcgggcaccgccaagugggccuggcugcgccggggccuguacuaccucaaggccgggcagcacagccaggccgucgcggaccugcaggccgcccugcgcgccgaccccaaggacuucaacugcugggagucccucggcgaggccuaccugagccgcgggggcuacaccacggcgcugaaguccuucaccaaggccagcgagcucaacccggaguccaucuacagcguguucaagguggccgccauccagcagauccuggggaaguacaaggaggccgucgcgcaguaccagaugaucaucaagaagaaggaggacuacgugcccgcccugaagggccucggcgagugccaccugaugauggccaaggccgcgcugguggacuaccucgacgggaaggccgucgacuacaucgagaaggcccuggaguacuucacgugcgcccugcagcaccgggccgacguguccugccucuggaagcuggcgggcgacgccugcacgugccuguacgccguggcccccagcaaggucaacgugcacgugcucgggguccugcugggccagaaggaggggaagcagguccucaagaagaacgagcugcugcaccucggcggccgcugcuacgggcgggcccugaagcugauguccaccagcaacaccuggugcgaccucggcaucaacuacuaccgccaggcgcagcaccuggccgagaccgggagcaacaugaacgaccugaaggagcuccuggagaagucccugcacugccucaagaaggccgugcggcuggacagcaacaaccaccuguacuggaacgcccucggcgugguggccugcuacuccggcaucgggaacuacgcgcuggcccagcacugcuucaucaagagcauccaguccgagcagaucaacgccguggccuggaccaaccugggcguccucuaccugaccaacgagaacaucgagcaggcccacgaggcguucaagauggcccagagccuggaccccuccuaccucaugugcuggaucgggcaggcccugaucgccgaggcggugggcagcuacgacaccauggaccuguuccgccacaccaccgagcucaacaugcacacggagggggcccugggcuacgccuacugggugugcaccacccugcaggacaaguccaaccgggagaccgagcucuaccaguacaacauccugcagaugaacgccaucccggccgcgcaggucauccugaacaaguacguggagcgcauccagaacuacgcccccgccuucaccaugcucggcuaccugaacgagcaccuccagcucaagaaggaggccgccaacgcguaccagcgggccauccugcugcuccagacggccgaggaccaggacaccuacaacguggccauccgcaacuacgggcggcugcugugcagcaccggcgaguacgacaaggccauccaggcguucaaguccacgccccucgagguccuggaggacaucaucggguucgcccuggcccucuucaugaagggccuguacaaggagagcuccaaggccuacgagcgcgcgcugagcaucguggaguccgagcaggacaaggcccacauccucaccgcccuggccaucaccgaguacaagcaggggaagaccgacguggccaagacccugcuguucaagugcagcauccugaaggagcccacgaccgagucccugcaggcgcucugcgcccugggccuggccaugcaggacgccacccugagcaaggccgcgcucaacgagcugcugaagcacaucaagcacaaggacagcaacuaccagcggugccuccugaccuccgccaucuacgcccugcagggccgcagcgucgccgugcagaagcagaucuccaaggccgugcacagcaacccgggggaccccgcgcucuggucccugcugagccgggucguggcccaguacgcccagcgcaacgccaagggcgggguggucgcgggcaacguggcccacauccucgacuccaaccacgggaagaaggcccugcuguacacggccgugaaccagcucgccaugggcagcuccagcgcggaggacgagaagaacaccgcccugaagaccauccagaaggccgcccugcucucccccggcgaccccgccaucugggcggggcugauggccgccugccacgccgacgacaagcuggcccucgucaacaacacccagccgaagcggaucgaccuguaccuggcgcuccugagcgccguguccgccagcaucaaggacgagaaguucuucgagaacuacaaccagucccuggagaaguggagccucucccaggccgugacgggccugaucgacaccgggcgcaucagcgaggccgagacccugugcaccaagaaccucaaguccaaccccgaccagcccgcggucauccugcugcuccgccaggugcagugcaagccccugcuggagagccagaagccgcuccccgacgccgugcuggaggagcugcagaagacggucaugagcaacuccaccagcgugcccgccuggcaguggcucgcccacguguaccagucccagggcaugaugcgggcggccgagaugugcuaccgcaagagccugcagcuggccucccagcgggggagcugguccggcaagcucagcucccugcugcgccucgcccugcuggcccucaaggucugcauggcgaacaucagcaacgaccacuggccgucccuggugcaggaggccaccaccgaggcccugaagcucugcuucugcccccuggccgugcugcuccaggcccugcugcaguucaagcggaagaugggcgcgcgcgagacgcggcgccuccuggagcgggucguguaccagcccggguaccccaagagcaucgccuccaccgcccgcugguaccugcuccggcaccuguacgccaaggacgacuacgagcugaucgacgugcucgucaacaacgccaagacccacggcgacacccgcgcgcuggagcugaaccagcggcucagcucccaguga

SEQ ID NO: 38226 - RNA, 1734 nt, Artificial Sequence
  derived and/or modified sequence opt1 from TTC39A__Homo_sapiens__NP_001284592
augaccagcgccggcggggcccccggcgcgcugccggccgggacccccgaguccagccuccacgaggcccuggaccagugcaugacggcccuggaccucuuccugaccaaccaguucuccgaggcccugagcuaccucaagccccgcaccaaggaguccauguaccacagccugaccuacgcgacgauccuggagaugcaggccaugaugaccuucgacccccaggacauccuccuggccggcaacaugaugaaggaggcccagaugcugugccagcggcaccgccggaaguccagcgugaccgacuccuucagcucccucgucaaccgcccgacccuggggcaguucacggaggaggagauccacgcggaggugugcuacgccgagugccugcuccagcgggccgcccugaccuuccugcaggacgagaacauggugagcuucaucaagggcggcaucaagguccgcaacuccuaccagaccuacaaggagcucgacagccuggugcaguccagccaguacugcaagggggagaaccacccccacuucgagggcggggugaagcugggcgucggggccuucaaccucacccuguccaugcugcccacgcggauccuccgccugcuggaguucgugggcuucagcggcaacaaggacuacgggcuccugcagcuggaggagggcgcguccgggcacagcuuccggagcgugcucugcgucaugcugcugcucugcuaccacaccuuccugaccuucgugcugggcaccggcaacgugaacaucgaggaggccgagaagcuccugaagcccuaccugaaccgcuacccgaagggggccaucuuccucuucuucgccggccggaucgaggucaucaaggggaacaucgacgccgcgauccgccgguucgaggagugcugcgaggcccagcagcacuggaagcaguuccaccacaugugcuacugggagcugauguggugcuucacguacaagggccaguggaagauguccuacuucuacgccgaccugcucagcaaggagaacugcugguccaaggccaccuacaucuacaugaaggccgcguaccugagcauguucgggaaggaggaccacaagcccuucggcgacgacgagguggagcuguuccgcgccgugcccggccucaagcugaagaucgccgggaagucccugcccaccgagaaguucgccauccgcaagagccggcgguacuucuccagcaacccgaucucccuccccguccccgcccuggagaugauguacaucuggaacggcuacgcggugaucgggaagcagcccaagcugaccgacggcauccuggagaucaucacgaaggccgaggagaugcucgagaaggggccggagaacgaguacagcguggacgacgagugccuggucaagcugcucaagggccugugccugaaguaccucggccgcgugcaggaggccgaggagaacuuccgguccaucagcgccaacgagaagaagaucaaguacgaccacuaccugauccccaacgcgcugcucgagcuggcccugcuccugauggagcaggaccgcaacgaggaggccaucaagcugcucgaguccgccaagcagaacuacaagaacuacagcauggagucccggacccacuuccgcauccaggccgcgacccugcaggccaagagcucccuggagaacagcucccgcagcauggugagcuccgucagccucuga

SEQ ID NO: 38227 - RNA, 2010 nt, Artificial Sequence
  derived and/or modified sequence opt1 from TTC39B__Homo_sapiens__NP_001161812
auggacgccgugcuggccugccgccuccggggccgcgggaaccgggucgcggcccugcgcccccggccgcgccccggcgggagcgccggccccucccccuucgcccugcucugcgccgggcugagcccggagccccgggcgggcgugggcuccgaguuccccgccugguuccucgggggcagcucccagcgccggaacauggcccugcuggggagccgcgccgagcuggaggcggacgaggacguguucgaggacgcccucgagaccaucuccaucagcucccacagcgacauggccaccuccagccugcacuucgccuccugcgacacgcagcaggcgccccggcagcgcggcgccagcaccgucuccagcuccagcuccaccaagguggaccucaagagcgggcuggaggagugcgccguggcccugaaccuguuccucagcaacaaguucaccgacgcccuggagcugcuccggccgugggccaaggaguccauguaccacgcgcugggcuacagcacgaucgucgugcugcaggccgugcucaccuucgagcagcaggacauccagaacggcaucuccgccaugaaggacgcccugcagaccugccagaaguaccgcaagaaguacaccgucguggagagcuucuccagccugcucucccgggggagccuggagcagcuguccgaggaggagaugcacgccgagaucugcuacgcggagugccuccugcagaaggccgcccugacguucgugcaggacgagaacaugaucaacuucaucaagggcgggcucaagauccgcaccagcuaccagaucuacaaggagugccuguccauccugcacgagauccagaagaacaagcuccagcaggaguucuucuacgaguucgagggcggcgucaagcuggggagcggcgccuucaaccugaugcucucccugcugcccgcccggaucauccgccuccuggaguucaucggguucagcggcaaccgggagcuggggcuccugcagcugcgcgagggcgcguccggccggagcaugcgcuccgcccucugcugccugaccauccuggccuuccacaccuacaucagccucauccuggggacgggcgaggugaacguggccgaggcggagcgccugcuggcccccuuccuccagcaguuccccaacguccgguccguguuccagagcgcccaggagguguuccagaagugcaucagcguccaggaggaguggaagcaguuccaccaccugugcuacugggagcugauguggaucaacguguuccagcagaacuggaugcaggccuacuacuacuccgaccuccugugcaaggagagcaagugguccaaggccaccuacguguuccugaaggcggccauccucagcaugcugccggaggaggacgucguggccaccaacgagaacguggucacccuguuccgccagguggacucccucaagcagcggaucgccggcaagagcauccccacggagaaguucgccguccgcaaggcgcggcgcuacuccgccagccugcccgcccccgugaagcugauccucccggcccuggagaugauguacguguggaacggguucuccaucgucagcaagcggaaggaccuguccgagaaccuccuggugaccguggagaaggccgaggcggcccugcagagccagaacuucaacuccuucagcgucgacgacgagugccucgugaagcugcugaaggggugcugccucaagaaccugcagcgcccccugcaggccgagcucugcuacaaccacguggucgaguccgagaagcugcugaaguacgaccacuaccucgugcccuucacccuguucgagcuggccagccucuacaagucccagggcgagaucgacaaggcgaucaaguuccuggagaccgcccggaacaacuacaaggacuacagccuggagagccgccuccacuuccggauccaggccgcccugcaccuguggcgcaagcccuccagcgacuga

SEQ ID NO: 38228 - RNA, 6078 nt, Artificial Sequence
  derived and/or modified sequence opt1 from TTC3__Homo_sapiens__NP_001001894
auggacaacuucgccgagggcgacuucaccguggccgacuacgcgcugcuggaggacugcccccacgucgacgacugcguguucgccgccgaguucaugagcaacgacuacgugcgggucacccagcuguacugcgacggggugggcgugcaguacaaggacuacauccaguccgagcggaaccuggaguucgacaucugcagcaucuggugcuccaagcccaucagcguccuccaggacuacugcgacgccaucaagaucaacaucuucuggccccugcuguuccagcaccagaacuccagcgugaucucccgccuccaccccugcguggacgccaacaacagccgggcguccgagaucaaccugaagaagcugcagcaccucgagcugauggaggacaucgucgaccuggccaagaagguggccaacgacagcuuccucaucgggggccugcugcgcaucgggugcaagaucgagaacaagauccucgccauggaggaggcgcugaacuggaucaaguacgccggcgacgugaccauccugaccaagcucggcuccaucgacaacugcuggcccaugcugagcaucuucuucaccgaguacaaguaccacaucaccaagaucgucauggaggacugcaaccugcucgaggagcugaagacgcaguccugcauggacugcaucgaggagggggagcugaugaagaugaagggcaacgaggaguucagcaaggagcgguucgacaucgccaucaucuacuacacccgcgccaucgaguaccggccggagaacuaccuccuguacgggaaccgcgcccugugcuuccuccggaccggccaguuccgcaacgcgcugggggacggcaagcgggccaccauccugaagaacacguggcccaagggccacuaccgcuacugcgacgcccucuccaugcugggggaguacgacugggcccugcaggccaacaucaaggcgcagaagcucugcaagaacgaccccgagggcaucaaggaccugauccagcagcacgugaagcugcagaagcagaucgaggaccuccaggggcggaccgccaacaaggaccccaucaaggccuucuacgagaaccgcgccuacaccccgcggagccuguccgcccccaucuucaccacgagccugaacuucguggagaaggagcgcgacuuccggaagaucaaccacgagauggcgaacggcggcaaccagaaccucaaggucgccgacgaggcccugaagguggacgacugcgacugccaccccgaguucagcccgcccagcagccagccgcccaagcacaaggggaagcagaagucccgcaacaacgagagcgagaaguucuccagcuccagcccccugacccuccccgccgaccugaagaacauccuggagaagcaguucuccaagagcucccgggccgcgcaccaggacuucgccaacaucaugaagaugcuccgcagccugauccaggacggcuacauggcccugcucgagcagcggugccgcuccgccgcgcaggccuucaccgagcugcugaacgggcuggacccccagaagaucaagcagcucaaccuggccaugaucaacuacgugcuggucguguacggccucgccaucagccugcuggggaucggccagcccgaggagcucuccgaggccgagaaccaguucaagcgcaucaucgagcacuaccccagcgagggccuggacugccuggcguacugcgggaucggcaagguguaccucaagaagaaccgguuccuggaggcccugaaccacuucgagaaggcccgcacccucaucuaccggcugccggggguccugacguggcccaccuccaacgugaucaucgaggagagccagccccagaagaucaagaugcuccuggagaaguucguggaggagugcaaguucccgcccguccccgacgccaucugcugcuaccagaagugccacggcuacuccaagauccagaucuacaucaccgaccccgacuucaagggguucauccgcaucagcugcugccaguacugcaagaucgaguuccacaugaacugcuggaagaagcugaagaccacgaccuucaacgacaagaucgacaaggacuuccuccagggcaucugccugacccccgacugcgagggcgugaucuccaagaucaucaucuucagcagcgggggcgaggucaagugcgaguucgagcacaaggugaucaaggagaaggugccgccccggcccauccugaagcagaagugcuccagccucgagaagcugcgccugaaggaggacaagaagcucaagcggaagauccagaagaaggaggccaagaagcuggcgcaggagcgcauggaggaggaccugcgggaguccaacccgcccaagaacgaggagcagaaggagaccgucgacaacgugcagcgcugccaguuccucgacgaccggauccugcagugcaucaagcaguacgccgacaagaucaagagcgggauccagaacacggccaugcugcucaaggagcugcuguccuggaaggugcucagcaccgaggacuacacgaccugcuucuccagccgcaacuuccugaacgaggccgucgacuacgugauccggcaccugauccaggagaacaaccgcgugaagacgcggaucuuccuccacguccuguccgagcugaaggagguggagcccaagcucgccgcguggauccagaagcugaacagcuucggccuggacgccaccgggaccuucuucucccgcuacggcgccagccucaagcugcuggacuucuccaucaugaccuuccucuggaacgagaaguacggccacaagcuggacagcaucgaggggaagcagcuggacuacuucuccgagcccgccagccucaaggaggcgcggugccugaucuggcugcucgaggagcaccgcgacaaguucccggcccugcacuccgcccuggacgaguucuucgacaucauggacagccggugcacggugcuccgcaagcaggacagcggcgaggcccccuucuccagcaccaaggucaagaacaaguccaagaagaagaagcccaaggacagcaagcccaugcuggugggguccggcaccaccagcgugacguccaacaacgagaucaucaccagcuccgaggaccacagcaaccgcaacuccgacagcgccggcccguucgcgguccccgaccaccuccggcaggacguggaggaguucgaggcccucuacgaccagcacuccaacgaguacgugguccgcaacaagaagcugugggacaugaaccccaagcagaagugcagcacccuguacgacuacuucucccaguuccucgaggagcacgggccccuggacaugagcaacaagauguucuccgccgaguacgaguucuucccggaggagacccggcagauccuggagaaggccggcgggcucaagcccuuccugcugggcugcccccgcuucguggugaucgacaacugcaucgcccucaagaaggucgcgagccggcugaagaagaagcgcaagaagaagaacaucaagaccaagguggaggagaucuccaaggccggggaguacgugcgggucaagcugcagcucaaccccgccgcccgcgaguucaagccggacgucaagagcaagcccgugagcgacuccagcuccgcccccgcguucgagaacgucaagcccaagccggugagcgccaacucccccaagcccgccugcgaggacgugaaggccaagcccgucagcgacaacuccagccgccagguguccgaggacggccagccgaagggcgugagcuccaacagccccaagcccggguccgaggacgcgaacuacaagcgcgucagcugcaacuccccgaagcccgugcuggaggacgugaagcccacguacugggcccagagccaccuggucaccggcuacugcaccuaccuccccuuccagcgguucgacaucacccagacgccgcccgccuacaucaacgugcugcccgggcugccccaguacaccuccaucuacaccccgcucgccagccugucccccgaguaccagcugccccgcagcgugcccgucgugccgagcuucguggccaacgaccgggcggacaagaacgccgccgccuacuucgagggccaccaccucaacgccgagaacgucgcggggcaccagaucgccuccgagacccagauccuggagggcagccugggcaucuccgugaagucccacugcuccacgggggacgcccacaccgugcucagcgaguccaaccgcaacgacgagcacugcggcaacagcaacaacaagugcgaggucauccccgaguccaccagcgccgugaccaacaucccccacgugcagauggucgccauccagguguccuggaacaucauccaccaggaggugaacacggagcccuacaacccguucgaggagcggcagggggagaucagccgcaucgagaaggagcaccagguccugcaggaccagcugcaggagguguacgagaacuacgagcagaucaagcucaagggccuggaggagacccgggaccuggaggagaagcucaagcgccaccuggaggagaacaagaucuccaagaccgagcuggacugguuccuccaggaccuggagcgggagaucaagaaguggcagcaggagaagaaggagauccaggagcgccucaagagccucaagaagaagaucaagaaggucuccaacgcgagcgagauguacacccagaagaacgacgggaaggagaaggagcacgagcugcaccuggaccagucccuggagaucagcaacacgcucaccaacgagaagaugaagaucgaggaguacaucaagaagggcaaggaggacuacgaggagucccaccagcgggccguggccgccgaggugagcguccuggagaacuggaaggagagcgagguguacaagcugcagaucauggagucccaggccgaggcguuccucaagaagcugggccugaucagccgcgaccccgccgccuaccccgacauggaguccgacauccgcagcugggagcuguuccuguccaacgugaccaaggagaucgagaaggccaagagccaguucgaggagcagaucaaggcgaucaagaacgggucccggcugagcgagcucuccaagguccagaucagcgagcuguccuuccccgccugcaacaccgugcacccggagcugcuccccgagagcuccggcgacgacgggcagggccuggugacgagcgccuccgacgucaccgggaaccacgccgcccugcaccgcgaccccagcguguucuccgcgggcgacagccccggcgaggccccguccgcccuccugcccgggccgccgcccggccagcccgaggccacccagcugaccgggcccaagcgggccggccaggcggcccucagcgagcgcagccccguggccgaccggaagcagcccgugccgcccggccgcgccgcccgguccagccaguccccgaagaagcccuucaacagcaucaucgagcaccuguccgugguguuccccugcuacaacagcacggagcuggcgggguucaucaagaagguccgcuccaagaacaagaacagccucuccggccugagcaucgacgagaucgugcagcgggugaccgagcacauccuggacgagcagaagaagaagaagcccaacccggggaaggacaagcgcaccuacgagcccuccagcgccacccccgucacgcgguccagccagggcucccccagcgugguggucgccccgucccccaagaccaaggggcagaaggccgaggacgugcccgugcgcaucgcgcucggcgccagcuccugcgagaucugccacgaggucuucaagagcaagaacgugcgggugcugaagugcggccacaaguaccacaaggggugcuucaagcaguggcugaagggccagagcgccugccccgccugccaggggcgcgaccuccugaccgaggaguccccgagcggccggggguggcccucccagaaccaggagcugcccagcugcuccagccgcuga

SEQ ID NO: 38229 - RNA, 1323 nt, Artificial Sequence
  derived and/or modified sequence opt1 from TTC5__Homo_sapiens__NP_612385
augauggccgacgaggaggaggaggugaagcccauccugcagaagcuccaggagcuggucgaccagcuguacagcuuccgcgacugcuacuucgagacccacuccguggaggacgccggccggaagcagcaggacgugcagaaggagauggagaagacccuccagcagauggaggaggucguggggagcgugcagggcaaggcgcagguccugaugcugacggggaaggcccucaacgugaccccggacuacucccccaaggccgaggagcugcugagcaaggccgugaagcucgagcccgagcuggucgaggccuggaaccagcugggcgagguguacuggaagaagggggacguggcggccgcccacacgugcuucuccggcgcccucacccacugccgcaacaaggucagccugcagaaccuguccauggugcuccggcagcugcgcaccgacaccgaggacgagcacagccaccacgugauggacuccguccggcaggcgaagcuggccgugcagauggacgugcacgacggccgcagcugguacauccucgggaacuccuaccugagccuguacuucuccaccggccagaaccccaagaucagccagcaggcccucuccgccuacgcccaggcggagaaggucgaccggaaggccagcuccaacccggaccugcaccugaaccgcgccacccuccacaaguacgaggagagcuacggggaggcccuggagggcuucucccgggccgcggcccuggaccccgccuggcccgagccccgccagcgggagcagcagcuccuggaguuccuggaccgccucacgagccugcuggagagcaaggggaaggugaagaccaagaagcuccaguccaugcugggcagccugcggccggcccaccucggccccugcuccgacgggcacuaccagagcgccuccggccagaaggugacccuggagcugaagccccucagcacccugcagcccggggucaacuccggcgcggugauccugggcaagguggucuucagccucacgaccgaggagaaggugccguucaccuucgggcuggucgacuccgacggccccugcuacgccgugaugguguacaacaucguccagagcuggggcgugcugaucggggacuccguggccauccccgagcccaaccuccgccugcaccggauccagcacaaggggaaggacuacagcuucuccagcguccgcguggagaccccgcugcuccugguggucaacggcaagccccagggcuccagcucccaggccguggccacgguggcgagccggccccagugcgaguga

SEQ ID NO: 38230 - RNA, 3972 nt, Artificial Sequence
  derived and/or modified sequence opt1 from TTC6__Homo_sapiens__XP_011535733
auguacgccuaccccgaguucaccaagcuguucuggaacaccgccgcgccgaaguucagcgugcccgaguccgucaugaaggagacgcucuaccccaaguacgagagcgugcaggccucccgccugcugaccgacaagcucagcuacaaguccagcgugaucacccugcaccagcacucccggaccaacuucuggugcuuccugccccgcaagagcgccuccuucgagagcauccagaagugguucuccgcccagccgacgcagcuccggcgcgucaagagcuccguggaccugcggaaggagaagaucaucgcgccccuggagaucaagaacgacaugcagagcuccaucaaggaggugauguuccagaaggccaaggagcucaagcgccagcugcagcugaccaagcagaacaagaccgaggagcccaacuacgucaaggagagcaucgacgacaucuucgacaacaugugcgagaagcacucccuccggaaccugagccugacccucaucgaggccuccaagaaggccggcaucagcuacaucguguaccccaagaagaagaagaugcgcuggaagaagcggcugaagcagcagaagcugaucuucgugcacgaggagcucagcaagccgcccaagucccuggagcgcagcgccucccacgggauccugcccggccagaagaaguaccucuucaaggucccccuguacgagcggcagauccgcugcccgagccugccccucuaccugaacuucgagaaguucgugcaggcgaagggcgggauccccgagaacaucgacccccggacgugggcccuggaccgccucaucgaguacaaggacgccuccaucccggugaaggagaaggacgacaagaucagcguccccgaggacccgcccgagcgggugaaggagccgcccaagcugaagcugaacgacuacguggaguccgaccucccccaggaggucaucaaguacuacgagagcgaggugaagauccugaccgaggagaucaacgacaagaccaaguaccccgccuucgccuacugccgccgcggggcgaucuaccggaagcugggcaagcuccaguccgccaugaacgaccugcagcgggugauccugcucgagccccuguuccugaacgccuacuggcaccgccaccucaucuaccuguuccaggacaagaucaacgaggcccuggacgaccucaacuacauccacaaguacaacaagaacaacaccgaggccuaccugagcaaggcggagaucuaccggggcaagaaggacaucacgcuggccauccucaacuacacccaggccaucaaguccacccccaccgacgccgacaucuacuuccgccgcggggagauguacgagaucacgaacaagguccuggccaucgacgacuucagcaagugcaucuucuacgaccccaagcggaccgacgcgcugcucaagcgcggccuguucuacugcgagaacgagaacugguucgccgccaucgaggacuucaccgcccugcugaacaucgaccaccagaacucccaggcccggaccuaccgcgggaucgcguacgugaaguggaaguucuacaaggaggccacgcaggacuucagcgccgccauccaccucgaccccaacaacuggcuggcgcuguacuaccggggcugccucuuccgcaaguccaacccguuccgggcccugcaggacuacagcguguccgcccugaucaacgacggguacgagaaccucggcugcuuccugcaccgcggcaucgucuacgcccaccugaagcucuggcugcuggccaucugcgacuucgagaccgugaucagccucgagcggaccaucacccuggcguacgugaacaucgggcugauccaccuccugcaccuggacaacuacacggaggccaucuggcaguucuccgaggccauccgcaucgacccccucugcauccagagcuaccugugccgggccgagaccuacuucaagcugcacaagcucaagaaggccgucaacgagcugagccgcgcgauccaccuccagcccgacggcauccagcuguacauccggcgcgggcaguaccugcugaugaugaaguacuacgaccucgccaaguucaccaucuaccagaucgccgagauggacaagggccuguccgagcugagcccgaugcagcaggcccucaucuacuccuucugcgagaaccacgacaaggccaucgaggugcuggacggcaucagcuggaaccgggcggagaugaccaugugcgcccugcucgccaagguccagaugaaggccaagcgcacgaaggaggcgguggaggugcugaagaaggcccuggacgccaucucccacagcgacaaggggcccgacgccaccgccaucuccgcggacugccucuacaaccugggccugugcuacauggaggaggggaaccuccagauggccuucgacagcuucaccaaggccgucaaggccaaccccgacuucgccgaguccuucuaccagcggggccugugcaaggugaagcugcacaaggacagcuccauccucgacuucaaccgcgcgaucacccugaaccccaagcacuaccaggagaugcacaccgggggccugggcgccuaccucagccggguggccuucuacgggcugaagggccgcuacuccaaggccauccugaacugcaacaaggccaucaagaucuacccggagagcguccgcgcguaccucuaccgcggggugcugaaguacuacaacaagacguacaagcuggccaucaccgaccucaccacggccaucuccauggacaagaacagcuacaccgccuucuacaaccgggcgcugugcuacaccaagauccgggagcugcagauggcccucaccgacuacggcaucgugcugcugcucgacgccaccgagacggucaagcugaacaccuuccugaaccgcgggcucaucuacguggagcugggccaguacggcuucgcccuggaggacuucaagcaggccgcgcucaucucccggaccaacgggagccugugccacgccaccgccaugugccaccaccgcaucaacgaguucgaggaggccgugaacuucuucacgugggcccugaagaucaaccccugcuuccucgacgcguacgucggccgggggaacagcuacauggaguacggccacgacgaggccaccaagcaggcccagaaggacuuccugaaggcccugcacaucaaccccgccuacaucaaggcgcgcaucuccuucggguacaaccuccaggcccagggcaaguuccagaaggccuggaaccacuucaccaucgccaucgacaccgaccccaagaacuaccuggccuacgagggccgggcgguggugugccugcagauggggaacaacuucgccgccaugcaggacaucaacgccgcgaugaagaucagcacgaccgccgaguuccucaccaaccgcggcgucauccacgaguucauggggcacaagcagaacgccaugaaggacuaccaggacgccaucacccugaacccgaaguacucccuggccuacuucaacgcgggcaacaucuacuuccaccaccggcaguucagccaggccuccgacuacuucagcaaggcccucaaguucgaccccgagaacgaguacgugcugaugaaccgcgccaucacgaacaccauccugaagaaguacgaggaggccaaggaggacuucgcgaacgugaucgaguccugccccuucugggccgccgucuacuucaaccgggcccacuucuacuacugccucaagcaguacgagcuggccgaggaggaccugaacaaggcgcucagccugaagcccaacgacgcccugguguacaacuuccgcgccaaggugcggggcaagaucgggcucaucgaggaggccauggcggacuacaaccaggcccuggaccuggaggacuacgccuccgucaucuga

SEQ ID NO: 38231 - RNA, 2475 nt, Artificial Sequence
  derived and/or modified sequence opt1 from TTC7A__Homo_sapiens__NP_001275882
auggugcccagcuccagccgcaccccgggcuucaagcaguccagccaccaccuccggcuccccaagugcugggacuaccgcgacgacuucgggaagcugcugcucgccgaggcccugcuggagcagugccucaaggagaaccacgcgaagaucaaggacuccaugccccugcuggagaagaacgagcccaagaugagcgaggccaagaacuaccucuccagcauccugaaccacggccggcuguccccgcaguacaugugcgaggccaugcucauccuggggaagcugcacuacgucgagggcagcuaccgcgacgccaucuccauguacgcccgggcggggaucgacgacaugagcauggagaacaagccccucuaccagaugcgccugcuguccgaggccuucgugaucaagggccucagccuggagcggcugcccaacuccaucgccagccgcuuccggcucaccgagcgcgaggaggaggugaucacgugcuucgagcgggccuccuggaucgcgcaggucuuccugcaggagcuggagaagaccaccaacaacagcaccucccgccaccucaagggcugccacccccuggacuacgagcugacguacuuccucgaggccgcccugcagagcgccuacgugaagaaccugaagaaggggaacaucgugaagggcaugcgggagcuccgcgagguccugcggaccguggagaccaaggccacccagaacuucaaggugauggcggccaagcaccuggccgggguccuccugcacagccuguccgaggagugcuacuggagcccgcucucccacccccugcccgaguucaugggcaaggaggagagcuccuucgccacgcaggcccugcgcaagccccaccucuacgagggggacaaccuguacugcccgaaggacaacaucgaggaggcgcugcuccugcugcucaucagcgaguccauggccacccgggacguggugcugagccgcguccccgagcaggaggaggaccggaccgugucccugcagaacgccgccgccaucuacgaccuccugagcaucacccugggccgccggggccaguacgugaugcuguccgagugccucgagcgcgcgaugaaguucgccuucggggaguuccaccugugguaccaggucgcccugagcaugguggccugcggcaaguccgccuacgcggugagccuccugcgcgagugcgucaagcugcggcccuccgaccccacggugccgcucauggccgccaaggugugcaucgggagccugcgcuggcuggaggaggccgagcacuucgcgaugauggucaucucccucggcgaggaggccggcgaguuccugcccaagggguaccuggcccucggccugaccuacagccugcaggccaccgacgccacccucaaguccaagcaggacgagcugcaccggaaggcgcugcagacgcucgagcgcgcccagcagcuggcccccagcgacccccaggugauccuguacgugagccuccagcuggcccugguccggcagaucuccagcgccauggagcagcuccaggaggcgcugaaggugcgcaaggacgacgcccacgcccugcaccuccuggcccugcuguucuccgcccagaagcaccaccagcacgcgcuggacgucgugaacauggccaucaccgagcacccggagaacuucaaccugauguucaccaaggugaagcucgagcagguccugaaggggcccgaggaggcccuggugaccugccgccaggugcuccggcuguggcagacgcuguacagcuucucccagcucggcgggcuggagaaggacggcagcuucggcgaggggcugaccaugaagaagcaguccggcaugcaccucacccugcccgacgcccacgacgcggacagcgggucccggcgcgccagcuccaucgccgccagccggcuggaggaggccauguccgagcucaccaugcccagcuccguccugaagcagggcccgaugcagcuguggacgacccucgagcagaucuggcugcaggcggccgagcuguucauggagcagcagcaccucaaggaggccggguucugcauccaggaggccgccggccuguuccccaccagccacuccgugcuguacaugcgcggccggcucgcggaggugaaggggaaccuggaggaggccaagcagcuguacaaggaggcccucaccgucaaccccgacggcgugcgcaucaugcacagccuggggcugaugcucagccggcugggccacaagucccuggcccagaaggugcuccgcgacgccgucgagcggcagagcacgugccacgaggcguggcaggggcugggcgaggugcugcaggcccagggccagaacgaggccgccguggacugcuuccucaccgcgcuggagcuggaggccuccagccccguccucccguucuccaucaucccccgcgagcuguga

SEQ ID NO: 38232 - RNA, 2532 nt, Artificial Sequence
  derived and/or modified sequence opt1 from TTC7B__Homo_sapiens__NP_001010854
auggccaccaagaaggccggcagccgccuggagaccgagaucgagcggugccgcuccgagugccagugggagcggauccccgagcucgugaagcagcugagcgcgaagcugaucgccaacgacgacauggccgagcuccugcugggggaguccaagcucgagcaguaccugaaggagcacccgcugcgccagggcgccagcccccgggggcccaagccccagcucacggagguccgcaagcaccugaccgccgcgcuggaccggggcaaccucaaguccgaguuccugcaggagagcaaccugaucauggccaagcucaacuacguggagggggacuacaaggaggcccugaacaucuacgcccgcgugggccuggacgaccucccgcugaccgcggucccgcccuaccggcugcgcgugaucgccgaggccuacgccaccaagggccucugccuggagaagcugcccaucuccagcuccacgagcaaccuccacguggaccgggagcaggacgucaucacgugcuacgagaaggccggggacaucgcgcugcuguaccuccaggagaucgagcgcgugauccuguccaacauccagaaccggagccccaagcccggccccgcgccccacgaccaggagcugggguucuuccucgagaccggccugcagcgcgcccacgugcuguacuucaagaacgggaaccucacccggggcgucggccgcuuccgggagcugcugcgcgccguggagacccggaccacccagaaccuccgcaugaccaucgcccggcagcuggccgagauccugcuccgcgggaugugcgagcaguccuacuggaacccgcuggaggacccgcccugccagagcccccuggacgacccccuccgcaagggcgccaacacgaagaccuacacccugacccggcgcgcccggguguacuccggggagaacaucuucugcccccaggagaacacggaggaggcccugcuccugcugcucaucagcgaguccauggccaaccgcgacgcgguccugagccggauccccgagcacaaguccgaccgccugaucagccugcagagcgccuccgugguguacgaccuccugaccaucgcccugggccggcgcggccaguacgagaugcucagcgagugccuggagcgggccaugaaguucgccuucgaggaguuccaccugugguaccaguucgcgcucucccugauggccgccggcaagagcgcccgcgcggucaaggugcugaaggagugcauccggcucaagcccgacgacgccaccaucccgcugcuggccgccaagcucugcauggggucccugcacuggcuggaggaggccgagaaguucgcgaagaccguggucgacgugggggagaagacgagcgaguucaaggccaagggcuaccucgcccuggggcugaccuacucccuccaggccaccgacgccagccugcgcggcaugcaggaggugcugcagcggaaggcgcuccuggccuuccagcgcgcccacucccugagccccaccgaccaccaggccgccuucuaccucgcgcugcagcuggccaucucccggcagauccccgaggcccucggcuacguccgccaggcccugcagcugcagggggacgacgcgaacagccuccaccuccuggcccuccugcuguccgcccagaagcacuaccacgacgcccucaacaucaucgacauggcccugagcgaguaccccgagaacuucauccugcuguucuccaaggugaagcugcagagccugugccggggcccggacgaggcgcuccugacgugcaagcacaugcugcagaucuggaaguccugcuacaaccucaccaaccccagcgacuccgggcgcggcagcagccugcuggaccggaccaucgccgaccgccgccagcucaacaccaucacgcugcccgacuucuccgaccccgagaccgggagcgugcacgccaccuccgucgccgccagccggguggagcaggcgcuguccgaggucgccagcucccuccagagcuccgccccgaagcagggcccccugcaccccuggaugacccuggcccagaucuggcuccacgccgcggagguguacaucggcaucgggaagccggccgaggccacggccugcacccaggaggcggccaaccuguuccccaugagccacaacgugcuguacaugcgcggccagaucgccgagcuccggggguccauggacgaggcccgccggugguacgaggaggcccuggcgaucagccccacccacgucaaguccaugcagcgccuggcccucauccugcaccagcugggccgguacagccucgccgagaagauccugcgcgacgccguccaggugaacuccaccgcccacgagguguggaacgggcugggcgaggugcuccaggcgcagggcaacgacgccgccgccacggagugcuuccugaccgcccuggagcucgaggcgagcucccccgccgugccguucaccaucaucccccggguccuguga

SEQ ID NO: 38233 - RNA, 1596 nt, Artificial Sequence
  derived and/or modified sequence opt1 from TTC8__Homo_sapiens__NP_001275710
augagcagcgagauggagccccugcuccuggccuggagcuacuuccgccggcgcaaguuccagcugugcgccgaccucugcacccagaugcuggagaaguccccguacgaccaggcggccuggauccugaaggcccgggcccucaccgagaugguguacaucgacgagaucgacgucgaccaggagggcaucgccgagaugaugcuggacgagaacgcgaucgcccaggugccccgccccgggacgagccugaagcuccccggcaccaaccagaccgggggcccgucccaggccgugcggcccaucacccaggccgggcgccccaucacgggcuuccugcggcccagcacccaguccggccgcccggggaccauggagcaggcgauccggacgccccgcaccgccuacaccgcccggcccaucaccagcuccagcggccgcuucguccggcuggggaccgccuccaugcucacgagccccgacggcccguucaucaaccugucccgccugaaccucaccaaguacagccagaagcccaagcuggccaaggcgcuguucgaguacaucuuccaccacgagaacgacgugaagaccauccaccucgaggacgugguccugcaccuggggaucuaccccuuccuccugcggaacaagaaccacaucgagaagaacgcccuggaccucgccgcccuguccaccgagcacagccaguacaaggacuggugguggaaggugcagaucggcaagugcuacuaccgccugggcauguaccgggaggccgagaagcaguucaaguccgcgcucaagcagcaggagaugguggacacguuccuguaccuggccaaggucuacgugagccucgaccagcccgugaccgcccugaaccuguucaagcaggggcucgacaaguucccgggcgaggucacccugcugugcgggaucgcccgcaucuacgaggagaugaacaacauguccagcgccgcggaguacuacaaggaggugcucaagcaggacaacacccacguggaggccaucgccugcaucggcagcaaccacuucuacuccgaccagcccgagaucgcccugcgguucuaccgccggcugcuccagaugggcaucuacaacgggcagcuguucaacaaccugggccucugcugcuucuacgcccagcaguacgacaugacgcugaccagcuucgagcgcgcgcugucccucgccgagaacgaggaggaggccgccgacgucugguacaaccuggggcacguggcggugggcaucggggacaccaaccuggcccaccagugcuuccgccucgcccuggucaacaacaacaaccacgccgaggccuacaacaaccuggcggugcuggagaugcggaagggccacguggagcaggcccgcgcccuccugcagaccgccagcucccuggcgccccacauguacgagccccacuucaacuucgccacgaucagcgacaagaucggcgaccuccagcgguccuacgucgccgcccagaaguccgaggccgccuucccggaccacguggacacccagcaccugaucaagcagcugcgccagcacuucgcgaugcucuga

SEQ ID NO: 38234 - RNA, 720 nt, Artificial Sequence
  derived and/or modified sequence opt1 from TTC9B__Homo_sapiens__NP_689692
augcagcgcggcgcccugagccccgugcucaugcuguccgccgcgccggagcccccgccccggcccccgcccgcccugagcccgcccggguccggccccgggagcggcucccgccacgggagcgcccggcccggccccacccccgagcccuccggcagccucggggccgcccuggacuccagccugcgcgcggccgucgccuucaaggccgagggccagcggugcuaccgcgagaagaaguuccgggaggcgaucgggaaguaccaccgcgcccuccugcagcugaaggccgcccagggcgcccggcccuccgggcuccccgcgccggcccccggccccaccagcucccccggcccggcccgccugagcgaggagcagcggcgccugguggaguccacggagguggagugcuacgacagccucaccgccugccugcugcaguccgagcucgucaacuacgagcgggugcgcgaguacugccugaaggugcuggagaagcagcaggggaacuucaaggccaccuaccgggcgggcaucgccuucuaccaccucggggacuacgcccgcgcccugcgguaccugcaggaggcccgcagccgggagcccaccgacacgaacguccuccgcuacauccagcugacccagcugaagaugaaccggugcucccuccagcgcgaggacagcggcgcgggcagccagacccgcgacgugaucggguga

SEQ ID NO: 38235 - RNA, 516 nt, Artificial Sequence
  derived and/or modified sequence opt1 from TTC9C__Homo_sapiens__NP_776171
auggagaagcgccugcaggaggcccagcucuacaaggaggagggcaaccagcgguaccgcgaggggaaguaccgggacgccgugagccgcuaccaccgggcgcugcugcagcuccgcggccuggaccccucccugccgagcccccuccccaaccuggggccccagggcccggcccugacccccgagcaggagaacauccuccacaccacgcagaccgacugcuacaacaaccuggccgccugccugcuccagauggagcccgucaacuacgagcgggugcgcgaguacucccagaaggugcuggagcggcagcccgacaacgccaaggcgcuguaccgcgccggggucgccuucuuccaccuccaggacuacgaccaggcccggcacuaccugcuggcggccgugaaccgccagccgaaggacgccaacgugcggcgcuaccuccagcugacccagagcgagcuguccagcuaccaccggaaggagaagcagcucuaccugggcauguucggcuga

SEQ ID NO: 38236 - RNA, 669 nt, Artificial Sequence
  derived and/or modified sequence opt1 from TTC9__Homo_sapiens__NP_056166
auggagcgcaagggcagcgccgccggggcgaagggcaaccccuccccgcccgccgccggggagggccagcggcccccgccgccccugugcgugcccgggggcggcgggggcgcccccgcccgcgggcaggucggcgcggccgccgagcccgccgagcucauccggcgcgcgcacgaguucaagagccagggggcccagugcuacaaggacaagaaguuccgggaggccaucggcaaguaccaccgcgcccugcuggagcucaagggccugcugcccccgcccggggagcgggagcgcgacucccggcccgccagccccgcgggcgcccucaagcccgggcgccuguccgaggagcagagcaagaccguggaggccaucgagaucgacugcuacaacucccuggccgccugccuccugcaggcggagcuggugaacuacgagcgggucaaggaguacugccucaaggugcugaagaaggagggcgagaacuucaaggcccuguaccgcagcggcguggccuucuaccaccucggggacuacgacaaggcccuguacuaccugaaggaggcccggacccagcagcccacggacaccaacgucauccgcuacauccagcucaccgagaugaagcugucccggugcagccagcgcgagaaggaggcgauguga

SEQ ID NO: 38237 - RNA, 2718 nt, Artificial Sequence
  derived and/or modified sequence opt1 from TTF1__Homo_sapiens__XP_006717336
auggagggcgagagcucccgcuucgagauccacacccccgugagcgacaagaagaagaagaagugcuccauccacaaggagcggccgcagaagcacagccacgagaucuuccgcgacuccagccuggugaacgagcagucccagaucacccggcgcaagaagcggaagaaggacuuccagcaccugaucagcagcccccugaagaagucccgcaucugcgacgagacggccaacgccaccuccacccugaagaagcggaagaagcgccgguacagcgcgcucgagguggacgaggaggccggggugaccgucgugcugguggacaaggagaacaucaacaacacgcccaagcacuuccgcaaggacgucgacguggugugcgucgacauguccaucgagcagaagcugccccggaagccgaagaccgacaaguuccaggugcucgccaagagccacgcccacaaguccgaggcccugcacagcaaggugcgcgagaagaagaacaagaagcaccagcggaaggcggccuccugggagagccagcgcgcccgggacacccugccccaguccgagagccaccaggaggagagcuggcucuccgucggccccgggggcgagaucaccgagcugcccgccagcgcgcacaagaacaaguccaagaagaagaagaagaaguccagcaaccgcgaguacgagacgcuggccaugccggaggggagccaggccggccgggaggccggcaccgacaugcaggagucccagcccaccguggggcucgacgacgagacgccccagcugcugggccccacccacaagaagaaguccaagaagaagaagaagaagaaguccaaccaccaggaguucgaggcccucgcgaugccggaggggagccaggugggcagcgaggucggggccgacaugcaggagagccgccccgccgugggccugcacggcgagaccgccgggauccccgcccccgcguacaagaacaaguccaagaagaagaagaagaaguccaaccaccaggaguucgaggccguggccaugccggagagccuggagagcgccuaccccgagggcucccaggucgggagcgaggugggcaccguggagggcuccaccgcccucaagggguucaaggagagcaacagcacgaagaagaaguccaagaagcggaagcugaccagcgucaagcgcgcgcggguguccggcgacgacuucagcgugcccuccaagaacagcgaguccacccuguucgacagcgucgagggggacggcgccaugauggaggagggggugaagucccgcccccgccagaagaagacccaggccugccucgccagcaagcacguccaggaggccccgcggcuggagcccgcgaacgaggagcacaacguggagacggccgaggacuccgagauccgcuaccugagcgccgacuccggcgacgccgacgacagcgacgcggaccucggcuccgccgugaagcagcugcaggaguucauccccaacaucaaggaccgggccaccagcaccaucaagcgcauguaccgggacgaccuggagcgcuucaaggaguucaaggcccagggggucgccaucaaguucggcaaguucuccgugaaggagaacaagcagcucgagaagaacguggaggacuuccuggcgcugaccgggaucgagagcgccgacaagcuccuguacacggaccgguaccccgaggagaaguccgucaucaccaaccugaagcgccgguacagcuuccgccuccacaucggccggaacaucgcccgcccguggaagcugaucuacuaccgggccaagaagauguucgacgugaacaacuacaaggggcgcuacagcgagggcgacaccgagaagcugaagauguaccacucccuccugggcaacgacuggaagaccaucggggagaugguggcccggagcucccugagcgucgcgcucaaguucucccagaucagcucccagcgcaaccggggcgccuggagcaaguccgagacgcgcaagcugaucaaggccguggaggaggugauccugaagaagaugagcccccaggagcucaaggaggucgacuccaagcugcaggagaaccccgagagcugccuguccaucgugcgggagaagcucuacaaggggaucagcuggguggaggucgaggccaaggugcagacccgcaacuggaugcagugcaaguccaaguggaccgagauccugaccaagcgcaugacgaacggccggcgcaucuacuacgggaugaacgcccugcgggcgaaggugagccucaucgagcgccuguacgagaucaacgucgaggacaccaacgagaucgacugggaggaccuggccuccgccaucggcgacgugcccccgagcuacgugcagaccaaguucagccggcugaaggccgucuacgugcccuucuggcagaagaagaccuuccccgagaucaucgacuaccucuacgagacgacccugccgcugcucaaggagaagcuggagaagaugauggagaagaagggcaccaagauccagacccccgcggcccccaagcaggucuuccccuuccgcgacaucuucuacuacgaggacgacuccgagggggaggacaucgagaaggagagcgagggccaggccccgugcauggcccacgccugcaacuccagcacccucgggggccagggccgguggaucaucuga

SEQ ID NO: 38238 - RNA, 3453 nt, Artificial Sequence
  derived and/or modified sequence opt1 from TTF2__Homo_sapiens__XP_011540606
auggcccgcaucaaggagcgggccagcacgugcgcgggccagacccgcgccgccuccugcgggcccccgagcuccauccccgugagccacugccugcuccacgaggacuucgucguggagcugcagggccugcuccugccccaggacaagaaggaguaccggcuguucuuccgcugcauccgguccaaggccgaggggaagcgcuggugcggcagcauccccuggcaggacccggacuccaaggagcacagcguguccaacaagagccagcacgccuccgagaccuuccaccacagcuccaacuggcuccggaaccccuucaagguccuggacaagaaccaggagcccgcgcuguggaagcagcucaucaagggggagggcgaggagaagaaggccgacaagaagcagcgcgagaagggcgaccagcuguucgaccagaagaaggagcagaagcccgagaugauggagaaggaccugagcuccgggcucgugccgaagaagaagcagagcgugguccaggagaagaagcaggaggagggcgccgagauccagugcgaggccgagaccgggggcacccacaagcgggacuucuccgagaucaagagccagcagugccaggggaacgagcugacccgccccuccgcgagcagccaggagaaguccagcggcaagucccaggacgugcagcgggagagcgagccccugcgcgagaaggugacgcagcuccugccccagaacguccacucccacaacagcaucuccaagccgcagaagggcgggccccugaacaaggaguacaccaacugggaggccaaggagaccaaggccaaggacggccccagcauccaggccacccagaagucccucccccaggggcacuuccaggagcggccggagacgcacagcgugcccgcccccggcggccccgcggcccaggccgccccggccgcgcccgggcugucccugggcgaggggcgcgaggccgccaccagcuccgacgacgaggaggaggacgacguggucuucgugagcuccaagcccggcagcccccuccuguucgacuccacccuggaccucgagaccaaggagaaccugcaguucccggaccggagcgugcagcgcaaggucucccccgccagcggggugagcaagaagguggagcccuccgaccccgucgcccggcgcguguaccugacgacccagcucaagcagaagaaguccacccuggcgagcgugaacauccaggcccugccggacaagggccagaagcucaucaagcagauccaggagcuggaggagguccugagcggccucacccugucccccgagcaggggacgaacgagaaguccaacagccaggugccccagcagagccacuucaccaagaccaccacgggcccgccccaccuggugccgccccagccccucccccggcgcgggacccagcccgucggcucccuggagcucaagagcgccugccaggugaccgccgggggcuccagccagugcuaccggggcaacaccuaccuguacgccgggcacacgaaccaggaccacguccacgcgguguggaagaucaccuccgaggccaucggccagcugcaccgcagccuggaguccugccccggggagaccguggucgccgaggacccggccggccucaaggugccccugcugcuccaccagaagcaggcgcuggccuggcugcucuggcgcgagagccagaagccccagggcgggauccuggccgacgacaugggccuggggaagacccugacgaugaucgcccucauccugacccagaagaaccaggagaagaaggaggagaaggagaaguccaccgcccugaccuggcucagcaaggacgacagcugcgacuucacgucccacggcacccugaucaucugccccgcgagccugauccaccacuggaagaacgagguggagaagcgggucaacuccaacaagcuccgcguguaccuguaccacgggccgaaccgggacagccgcgcccgggugcuguccaccuacgacaucgucaucaccacguacagccucguggccaaggagauccccaccaacaagcaggaggccgagauccccggcgccaaccugaacguggagggcaccuccacgccccugcuccgcaucgcgugggcccggaucauccuggacgaggcccacaacgucaagaacccgcgcgugcagaccagcaucgccgugugcaagcugcaggccugcgcgcggugggccgucaccgggacccccauccagaacaaccuccuggacauguacucccugcucaaguuccugcgcugcagccccuucgacgaguucaaccuguggcggucccagguggacaacggcagcaagaagggcggggagcgccucuccauccugaccaagagccugcuccugcggcgcaccaaggaccagcuggacuccacggggcggccccucgugauccugccgcagcgcaaguuccagcugcaccaccucaagcugagcgaggacgaggagaccgucuacaacguguucuucgcccggucccgcagcgcccugcaguccuaccucaagcggcacgagagccgcggcaaccagagcggccgcucccccaacaaccccuucagccggguggcgcuggaguucggguccgaggagccccgccacagcgaggccgccgacuccccgcggagcuccaccguccacauccugagccagcuccugcgccugcggcagugcugcugccaccucucccugcucaagagcgcccuggaccccauggagcugaagggcgaggggcuggugcucucccuggaggagcagcugagcgcccucacccuguccgagcugcgcgacagcgagcccuccagcacggugucccucaacggcaccuucuucaagauggagcuguucgaggggaugcgggagagcaccaagaucuccagccugcucgcggagcuggaggccauccagcgcaacagcgccucccagaaguccgucaucgugagccaguggaccaacaugcugaagguggucgcccuccaccugaagaagcacggccugacguacgccaccaucgacggcagcgugaacccgaagcagcggauggaccucguggaggcguucaaccacucccgcgggccccaggucaugcugaucagccugcucgccggcggggugggccugaaccugaccgggggcaaccaccucuuccugcuggacaugcacuggaaccccucccucgaggaccaggccugcgaccggaucuaccgcgugggccagcagaaggacgucgugauccaccgguucgugugcgaggggaccgucgaggagaagauccugcagcugcaggagaagaagaaggaccucgccaagcagguccugagcggcuccggggagagcgugacgaagcugacccucgccgaccugcgcgugcuguucggcaucuga

SEQ ID NO: 38239 - RNA, 3270 nt, Artificial Sequence
  derived and/or modified sequence opt1 from TTI1__Homo_sapiens__NP_001290386
auggccguguucgacacccccgaggaggccuucggcguccugcgcccggugugcgugcagcucaccaagacgcagaccgucgagaacguggagcaccuccagacccggcugcaggcggugagcgacuccgcccugcaggagcugcagcaguacauccuguucccccuccgcuucacccugaagacgcccgggcccaagcgggagcgccugauccagagcgucguggagugccucaccuucgugcuguccagcacgugcgucaaggagcaggagcugcuccaggagcuguucuccgagcugagcgccugccucuacuccccgagcucccagaagcccgccgccgugagcgaggagcugaagcuggcggugauccagggccucuccacccugaugcacagcgccuacggggacaucauccugaccuucuacgagcccuccauccucccccggcugggcuucgccgucagccugcuccuggggcuggccgagcaggagaaguccaagcagaucaagaucgcggcccucaagugccuccaggugcugcugcugcagugcgacugccaggaccacccgcgcagccuggacgagcucgagcagaagcagcugggcgaccuguucgccuccuuccuccccggcaucagcaccgcccugacccggcugaucaccggggacuucaagcagggccacuccaucguggucagcagccucaagaucuucuacaagacgguguccuucaucauggccgacgagcagcugaagcgcaucagcaaggugcaggcgaagcccgccgucgagcaccggguggccgagcugaugguguaccgcgaggccgacugggucaagaagaccggggacaagcucaccauccugaucaagaagaucaucgagugcguguccgugcacccccacuggaagguccggcuggagcucguggagcuggucgaggaccugcuccugaagugcagccagucccugguggagugcgccggcccgcugcucaaggcgcugguggggcuggucaacgacgagagccccgagauccaggcccagugcaacaaggugcuccgccacuucgccgaccagaagguggucgugggcaacaaggcccuggccgacauccuguccgagagccuccacucccuggcgaccagccugccccggcucaugaacucccaggacgaccagggcaaguucagcacgcugucccugcuccugggguaccugaagcuccugggccccaagaucaacuucgugcugaacagcgucgcccaccuccagcgccuguccaaggcccugauccaggugcucgagcuggacguggccgacaucaagaucgucgaggagcggcgcuggaacagcgacgaccugaacgccuccccgaagaccagcgcgacccagcccuggaaccggauccagcgccgguacuuccgcuucuucaccgacgagcggaucuucaugcuccugcgccaggugugccagcugcucggguacuacggcaaccuguaccugcucguggaccacuucauggagcuguaccaccaguccgucguguaccgcaagcaggccgccaugauccugaacgagcucgugacgggcgccgcggggcuggaggucgaggaccugcacgagaagcacaucaagaccaaccccgaggagcuccgggagaucgugaccagcauccuggaggaguacaccagccaggagaacugguaccuggugacgugccucgagaccgaggagaugggcgaggagcugaugauggagcaccccgggcugcaggccaucaccuccggcgagcacacgugccaggucaccagcuuccucgccuucuccaagccgagccccaccaucugcuccaugaacagcaacaucuggcagaucugcauccagcuggaggggaucggccaguucgccuacgcccugggcaaggacuucugccuccugcugauguccgcgcucuaccccgugcuggagaaggccggggaccagacccugcucaucagccagguggccaccuccacgaugauggacgucugccgcgccugcggcuacgacagccugcagcaccugaucaaccagaacuccgacuaccucgugaacgggaucagccugaaccugcggcaccucgcccugcacccccacaccccgaaggugcuggaggucaugcuccgcaacuccgacgcgaaccugcugccccucguggccgacgugguccaggacgugcuggccacccuggaccaguucuacgacaagcgggccgccagcuucguguccguccuccacgcgcugauggccgcccuggcccagugguuccccgacaccggcaaccucgggcaccuccaggagcagagccugggcgaggagggcucccaccugaaccagcgccccgcggcccuggagaaguccacgaccaccgccgaggacaucgagcaguuccugcucaacuaccugaaggagaaggacguggccgacgggaacgugagcgacuucgacaacgaggaggaggagcagagcgucccgcccaagguggacgagaacgacacccggcccgacguggagccgccccugccccuccagauccagaucgccauggacgucauggagcgcugcauccaccuccugagcgacaagaaccugcagauccggcugaaggugcuggacgugcucgaccugugcgucguggugcugcagucccacaagaaccagcuccugccccuggcgcaccaggccuggccgagccucguccaccgccugacccgggacgcgccccuggccgugcuccgcgccuucaaggugcugcggacgcugggcuccaagugcggggacuuccugcgcagccgguucugcaaggacguccuccccaagcuggccggcucccuggugacccaggcccccaucagcgcccgcgccgggccgguguacucccacacccucgccuucaagcugcagcuggcgguccuccagggccugggcccccugugcgagcggcucgaccugggggagggcgaccugaacaagguggccgacgccugccucaucuaccugagcgucaagcagcccgugaagcugcaggaggccgcgcgcuccguguuccuccaccugaugaaggucgaccccgacagcaccugguuccugcucaacgagcuguacugcccggugcaguucacgccgccccaccccucccugcaccccgugcagcuccacggggccagcggccagcagaaccccuacaccaccaacguccugcagcugcucaaggagcugcaguga

SEQ ID NO: 38240 - RNA, 1527 nt, Artificial Sequence
  derived and/or modified sequence opt1 from TTI2__Homo_sapiens__NP_079391
auggagcuggacagcgcccucgaggcccccucccaggaggacagcaaccuguccgaggagcugagccacuccgcguucggccaggccuucagcaagauccuccacugccuggcccgcccggaggcccggcgcgggaacgugaaggacgccgugcugaaggaccucggcgaccugaucgaggcgaccgaguucgaccggcuguucgaggggaccggcgcccgccuccgggggaugcccgagacgcugggccagguggccaaggcccuggagaaguacgcggcccccuccaaggaggaggagggcgggggcgacgggcacagcgaggccgccgagaaggccgcccaggugggccuccuguuccugaagcuccuggggaaggucgagaccgcgaagaacucccuggugggccccgccuggcagaccggccuccaccaccuggccgggccgguguacaucuucgccaucacccacagccuggagcagcccuggacgacgccccgcucccgggaggucgcgcgcgaggugcucaccagccugcuccaggugaccgagugcggcuccgucgccggguuccugcacggcgagaacgaggacgagaagggccggcugagcgugauccuggggcuccugaagcccgaccuguacaaggaguccuggaagaacaacccggccaucaagcacguguucagcuggacccuccagcaggucacccgccccuggcugucccagcaccuggagcgggugcuccccgccagccuggugaucuccgacgacuaccagaccgagaacaagauccugggcguccacugccuccaccacaucgugcugaacgugcccgccgcggaccugcuccaguacaaccgcgcccagguccuguaccacgccaucagcaaccaccuguacaccccggagcaccaccucauccaggccgugcugcugugccuccuggaccuguuccccauccucgagaagacgcugcacuggaagggggacggcgcccggcccaccacccacugcgacgaggugcugcgccugauccucacccacauggagcccgagcaccggcugcugcuccgccggacguacgcgcgcaaccugccggccuucgucaaccggcuggggauccucaccgugcgccaccugaagcggcuggagcgcgugaucaucggcuaccucgaggucuacgacggccccgaggaggaggcccgccugaagauccuggagacccucaagcugcugaugcagcacaccuggccccgggugagcugccgccucgucgugcugcugaaggcccuccugaagcugaucugcgacguggcgcgggaccccaaccucacgccggaguccgucaagagcgcccugcugcaggaggccaccgacugccucauccugcuggaccgcugcucccaggggcgggugaagggccuccuggccaagaucccccagagcugcgaggaccgcaagguggucaacuacauccggaaggugcagcaggucuccgagggggcccccuacaacggcaccuga

SEQ ID NO: 38241 - RNA, 2574 nt, Artificial Sequence
  derived and/or modified sequence opt1 from TTK__Homo_sapiens__XP_011534401
auggagagcgaggaccuguccggccgcgagcucaccaucgacagcaucaugaacaaggugcgggacaucaagaacaaguucaagaacgaggaccugaccgacgagcugucccucaacaagaucagcgccgacacgaccgacaacuccgggaccgucaaccagaucaugaugauggccaacaaccccgaggacuggcugagccugcuccugaagcuggagaagaacuccgugccgcucagcgacgcgcugcugaacaagcucaucggccgcuacucccaggccaucgaggcccugccgcccgacaaguacgggcagaacgagagcuucgcccggauccaggugcgcuucgccgagcugaaggcgauccaggagcccgacgacgcccgggacuacuuccagauggcccgcgccaacugcaagaaguucgcguucguccacaucuccuucgcccaguucgagcucagccagggcaacgugaagaaguccaagcagcugcugcagaaggccguggagcgcggggccgucccccucgagaugcuggagaucgcccugcggaaccucaaccugcagaagaagcagcugcucagcgaggaggagaagaagaaccuguccgcgagcaccgugcugacggcccaggaguccuucagcggcucccucggccaccuccagaaccggaacaacagcugcgacagccgcgggcagaccaccaaggcccgguuccuguacggcgagaacaugccgccccaggacgccgagaucggguaccgcaacucccugcggcagaccaacaagacgaagcagagcugccccuucggccgcgugcccgucaaccugcugaacucccccgacugcgacgugaagaccgacgacagcgugguccccugcuucaugaagcggcagaccucccgcagcgagugccgggaccucguggugcccggguccaagccgagcggcaacgacuccugcgagcugcgcaaccucaagagcguccagaacucccacuucaaggagccccuggugagcgacgagaaguccagcgagcugaucaucaccgacuccaucacgcugaagaacaagaccgagagcucccuccuggccaagcuggaggagaccaaggaguaccaggagcccgaggugcccgagagcaaccagaagcaguggcaguccaagcgcaagagcgagugcaucaaccagaacccggcggccagcuccaaccacuggcagauccccgagcucgcccggaaggucaacaccgagcagaagcacacgaccuucgagcagcccguguucagcguguccaagcagagcccgcccaucuccaccagcaagugguucgaccccaaguccaucugcaagacccccagcuccaacacgcuggacgacuacaugagcugcuuccggacccccgucgugaagaacgacuucccgcccgccugccagcuguccacccccuacggccagcccgccugcuuccagcagcagcagcaccagauccucgcgaccccgcugcagaaccuccaggugcuggccagcuccagcgccaacgagugcaucuccgucaaggggcgcaucuacagcauccugaagcagaucggcuccgggggcagcagcaagguguuccagguccugaacgagaagaagcagaucuacgccaucaaguacgugaaccuggaggaggccgacaaccagacgcucgacuccuaccgcaacgagaucgcguaccugaacaagcugcagcagcacagcgacaagaucauccggcucuacgacuacgagaucaccgaccaguacaucuacauggugauggagugcggcaacaucgaccugaacuccuggcugaagaagaagaaguccaucgaccccugggagcgcaagagcuacuggaagaacaugcucgaggccguccacaccauccaccagcacgggaucgugcacagcgaccugaagcccgccaacuuccugaucguggacggcaugcucaagcugaucgacuucgggaucgccaaccagaugcagccggacaccacguccgucgugaaggacagccaggugggcaccgucaacuacaugccgcccgaggcgaucaaggacauguccagcucccgggagaacggcaagagcaaguccaagaucagccccaaguccgacguguggagccuggggugcauccucuacuacaugaccuacggcaagacccccuuccagcagaucaucaaccagaucuccaagcugcacgccaucaucgaccccaaccacgagaucgaguuccccgacauccccgagaaggaccugcaggacgugcucaagugcugccugaagcgcgacccgaagcagcggaucagcauccccgagcugcucgcccaccccuacguccagauccagacgcaccccgugaaccagauggccaaggggaccaccgaggagaugaaguacgugcugggccagcuggucgggcucaacuccccgaacagcauccugaaggccgcgaagacccuguacgagcacuacagcggcggggagucccacaacagcuccagcuccaagacguucgagaagaagcgcggcaagaaguga

SEQ ID NO: 38242 - RNA, 1134 nt, Artificial Sequence
  derived and/or modified sequence opt1 from TTL__Homo_sapiens__NP_714923
auguacaccuucgugguccgcgacgagaacagcuccguguacgccgaggugagccggcugcuccuggccaccggccacuggaagcgccugcggcgcgacaacccccgguucaaccucaugcugggggagcgcaaccggcugcccuucggccgccucgggcacgagcccggccugguccagcuggugaacuacuaccgcggggcggacaagcucugccggaaggccucccuggugaagcugaucaagacgagccccgagcucgccgaguccugcaccugguuccccgagagcuacgucaucuacccgaccaaccugaagacccccguggcccccgcccagaacggcauccagcccccgaucuccaacagccggacggacgagcgcgaguucuuccuggcguccuacaaccggaagaaggaggacggcgaggggaacguguggaucgccaagagcuccgccggcgccaagggggagggcauccucaucagcuccgaggcgagcgagcugcuggacuucaucgacaaccaggggcagguccacgugauccagaaguaccucgagcacccccugcugcucgagcccggccaccgcaaguucgacauccgguccugggugcuggucgaccaccaguacaacaucuaccuguaccgcgagggcgugcuccggaccgccagcgagcccuaccacguggacaacuuccaggacaagaccugccaccugaccaaccacugcauccagaaggaguacuccaagaacuacgggaaguacgaggagggcaacgagauguucuucaaggaguucaaccaguaccugacgagcgcccucaacaucacccuggaguccagcauccugcuccagaucaagcacaucauccgcaacugccugcugagcgucgagccggccaucuccaccaagcaccuccccuaccagagcuuccagcuguucggguucgacuucaugguggacgaggagcugaagguguggcucaucgaggucaacggcgcccccgcgugcgcccagaagcuguacgccgagcugugccagggcaucguggacaucgccaucuccagcguguucccgccgcccgacgucgagcagccccagacccagcccgccgcguucaucaagcucuga

SEQ ID NO: 38243 - RNA, 1578 nt, Artificial Sequence
  derived and/or modified sequence opt1 from TTLL10__Homo_sapiens__XP_011539472
auggaccacagcugcacccgcuucauccaccggcgcgggcccccgacccggacgcgcgccggcuucaagcggggcaagcgcccccggauccagcagcgcccccgggcccgcguguccgggaccauccccgcgagccggcugcacccggcccccgccucccagcccggccccugcccggcccccgggcacugccccgucggccccgcccacgagcgcccgaugggcagcucccaggaggaggggcuccggugccagcccagccagcccgaccacgacgcggacggccacugcgggcccgaccuggagggcgccgagcgcgccuccgccaccccggggccgcccggccugcucaacagccaccggcccgcggacuccgacgacaccaacgccgccggccccagcgccgcccugcuggaggggcuccugcugggcgggggcaagcccagcccccacagcacgcgccccggcccguucuucuacaucgggggcuccaacggggcgaccaucaucagcuccuacugcaagagcaagggcuggcagcggauccacgacucccgccgggacgacuacacccucaaguggugcgaggucaagagccgcgacuccuacgggagcuuccgggagggcgagcagcugcuguaccagcuccccaacaacaagcugcugaccacgaagaucggccuccugagcacccugcgcgggcgcgcccgggccauguccaaggccagcaaggugcccggcggggugcaggcccgccucgagaaggacgcggccgcccccgcccuggaggaccugccguggaccucccccggcuaccuccggccccagcgcgugcugcggauggaggaguucuucccggagaccuaccgccuggaccucaagcacgagcgggaggccuucuucacgcuguucgacgagacccagaucuggaucugcaagcccaccgcgagcaaccaggggaagggcaucuuccugcuccgcaaccaggaggagguggccgcccugcaggccaagacccgguccauggaggacgaccccauccaccacaagacgcccuuccgcggcccgcaggcccgggucgugcagcgcugcgggggcgggugccccgagggcuacauccagaacccccugcucguggacgggcggaaguucgacguccgcagcuaccugcugaucgcgugcaccacccccuacaugaucuucuucggccacggcuacgcccggcucacccugucccuguacgacccgcacagcuccgaccucgggggccaccugacgaaccaguucaugcagaagaaguccccgcuguacaugcuccugaaggagcacaccgugugguccauggagcaccugaaccgcuacaucagcgacaccuucuggaaggcccgggggcucgccaaggacuggguguucaccacgcugaagcgccugugcucccucagcuggcagugccugucccccgcggccagcaagggccccgacggcaagcccucccgggggagcgucggcaccucccccgccgggagccuggccgugggcagcggggacuccagcgccuccgugaccgcgaccauguga

SEQ ID NO: 38244 - RNA, 2403 nt, Artificial Sequence
  derived and/or modified sequence opt1 from TTLL11__Homo_sapiens__NP_001132914
auggccgccgcggccagcgugaccggccgcgucaccugggccgccucccccaugcggagccuggggcucggccgccggcugucccugcccgggccccgccucgacgccgugacggcggccgugaaccccagccuguccgaccacggcaacgggcugggccggggcacccgcgggagcggcugcuccgggggcagccucgucgccgacuggggcgggggcgccgcggccgccgccgccguggcgcuggcccuggcccccgcccucuccaccaugcggcgcgggagcuccgagagcgagcuggccgcgcggugggaggccgaggccguggccgccgcgaaggccgccgccaaggccgaggcggaggccaccgccgagacggucgccgagcagguccgcguggacgcgggcgccgccggggagccggagugcaaggccggcgaggagcagcccaagguccuggcccccgcgcccgcccagccguccgccgccgaggagggcaacacccaggugcuccagcggcccccgcccacccugccgcccagcaagcccaagcccgugcaggggcugugcccccacggcaagccccgcgacaaggggcgguccugcaagcgcagcuccggccacgggagcggcgagaacggcucccagcggcccgucaccguggacagcagcaaggcccgcacgucccucgacgcgcugaagaucagcauccggcagcugaaguggaaggaguuccccuucgggcgccggcucccgugcgacaucuacuggcacggcguguccuuccacgacaacgacaucuucagcggccaggugaacaaguuccccgggaugaccgagauggugcgcaagaucacccugucccgggccgugcgcaccaugcagaaccuguuccccgaggaguacaacuucuacccccgcagcuggauccucccggacgaguuccagcuguucgucgcccaggugcagauggugaaggacgacgaccccuccuggaagcccacguucaucgucaagcccgacgggggcugccagggcgacgggaucuaccugaucaaggacccgagcgacauccggcucgccggcacccugcagucccgccccgccguggugcaggaguacaucugcaagccccugcucaucgacaagcugaaguucgacauccggcuguacguccuccucaagagccuggacccgcuggagaucuacaucgcgaaggacgggcugucccgcuucugcaccgagcccuaccaggagcccacccccaagaaccugcaccggaucuucaugcaccucacgaacuacagccugaacauccacuccggcaacuucauccacagcgacuccgccagcaccggguccaagcgcaccuucagcuccauccugugccggcucagcagcaagggcguggacaucaagaaggucugguccgacaucaucagcguggugaucaagaccgucaucgcccugacgccggagcugaagguguucuaccaguccgacauccccaccggccgccccgggccgaccugcuuccagauccucggcuucgacauccugcugaugaagaaccucaagcccauccugcuggaggugaacgccaaccccagcaugcggaucgagcacgagcacgagcucucccccggggucuucgagaacgugcccagccugguggacgaggaggucaagguggcggugauccgcgacacccugcggcugauggacccgcucaagaagaagcgcgagaaccagucccagcagcuggagaagcccuucgccggcaaggaggacgcccuggacggcgagcucacgagcgcccccgacugcaacgccaaccccgaggcgcaccucccguccaucugccugaagcaggucuuccccaaguacgccaagcaguucaacuaccugcggcugguggaccgcauggccaaccuguucauccgguuccucgggaucaagggcaccaugaagcuggggcccaccggcuuccgcaccuucauccggagcugcaagcuguccagcuccagccucuccauggccgccguggacauccuguacaucgacaucacgcgccgguggaacagcaugacccuggaccagcgcgacuccgggaugugccuccaggcguucgucgaggccuucuucuuccuggcccagcgcaaguucaagaugcugccccuccacgagcaggucgccagccugaucgaccugugcgaguaccaccucagccugcuggacgagaagcggcucgugugcggccgcggcgugccguccgggggccggccgccccaccgcgggccgccccaggagcccagccccuccgcccagcccgcgggcgacaacccgccgccccggaccagcugcgccaacaagcugucccacccccgccacacccugagcuga

SEQ ID NO: 38245 - RNA, 1935 nt, Artificial Sequence
  derived and/or modified sequence opt1 from TTLL12__Homo_sapiens__NP_055955
auggaggccgagcgcggccccgagcggcgcccggccgagcggagcucccccgggcagacccccgaggagggcgcgcaggcccuggccgaguucgccgcccuccacgggcccgcgcugcgcgccagcggcgugccggagcgguacugggggcgccugcuccacaagcuggagcacgaggucuucgacgccggcgagguguucggcaucaugcaggucgaggagguggaggaggaggaggacgaggccgcgcgggaggugcgcaagcagcagcccaaccccgggaacgagcugugcuacaaggugaucgucacccgggaguccggccuccaggccgcccaccccaacagcaucuuccugaucgaccacgccuggacgugccgcguggagcacgcccggcagcagcugcagcaggucccggggcuccugcaccgcauggcgaaccugaugggcaucgaguuccacggggagcuccccuccaccgaggccguggcccuggugcuggaggagauguggaaguucaaccagaccuaccagcucgcccacggcaccgccgaggagaagaugcccgugugguacaucauggacgaguucggcagccggauccagcacgcggacguccccuccuucgccacggccccguucuucuacaugccccagcaggucgccuacacccugcuguggccccuccgcgaccuggacaccggggaggaggugacccgggacuucgccuacggcgagacggacccccugauccgcaagugcaugcuccugccgugggcgcccaccgacaugcuggaccucagcuccugcacccccgagcccccggccgagcacuaccaggccauccuggaggagaacaaggagaagcugccccucgacaucaaccccguggugcacccccacgggcacaucuucaagguguacaccgacguccagcaggucgccagcucccugacgcacccgcgguucacccugacccagagcgaggccgacgcggacauccucuucaacuucucccacuucaaggacuaccgcaagcugagccaggagcggcccggcgugcugcucaaccaguuccccugcgagaaccugcugaccgugaaggacugccucgccuccaucgcccgccgggccggcgggcccgagggcccgcccuggcugccccgcacguucaaccugcgcaccgagcucccgcaguucgugagcuacuuccagcagcgggagcgcuggggcgaggacaaccacuggaucugcaagcccuggaaccuggcgcggucccuggacacccacgugaccaagagccuccacuccaucauccgccaccgggagagcacgcccaaggucgugagcaaguacaucgagucccccguccuguuccugcgcgaggacguggggaaggugaaguucgacauccgguacaucguccuccugcgcagcgugcggccgcugcgccucuucguguacgacgucuucuggcugcgguucuccaaccgcgccuucgcccugaacgaccuggacgacuacgagaagcacuucaccgugaugaacuacgaccccgacgugguccucaagcagguccacugcgaggaguucauccccgaguucgagaagcaguaccccgaguucccguggaccgacgugcaggccgagaucuuccgggccuucaccgagcuguuccagguggcgugcgccaagcccccgccccuggggcucugcgacuaccccagcucccgcgccauguacgccguggaccugaugcugaagugggacaacggccccgacggccggcgcgugaugcagccccagauccucgaggucaacuucaaccccgacugcgagcgggccugccgcuaccacccgacguucuucaacgacguguucagcacccuguuccuggaccagcccgggggcugccacgugaccugccucgucuga

SEQ ID NO: 38246 - RNA, 1272 nt, Artificial Sequence
  derived and/or modified sequence opt1 from TTLL1__Homo_sapiens__NP_036395
auggccggcaaggugaagugggucaccgacaucgagaaguccgugcugaucaacaacuucgagaagcgcgggugggugcaggucaccgagaacgaggacuggaacuucuacuggaugagcgugcagacgauccggaacguguucagcgucgaggccggcuaccgccucuccgacgaccagaucgugaaccacuuccccaaccacuacgagcugacccggaaggaccugauggugaagaacaucaagcgcuaccggaaggagcucgagaaggaggggagcccccuggcggagaaggacgagaacggcaaguaccuguaccucgacuucguccccgugaccuacaugcugcccgccgacuacaaccuguucguggaggaguuccgcaagucccccagcuccaccuggaucaugaagccgugcgggaaggcccagggcaagggcaucuuccucaucaacaagcugagccagaucaagaaguggucccgggacagcaagacguccagcuucgucucccagagcaacaaggaggccuacgugaucucccuguacaucaacaacccccuccugaucgggggccgcaaguucgaccugcggcucuacgugcuggucagcaccuaccgcccccugcggugcuacauguacaagcucggguucugccgcuucugcaccgugaaguacacccccuccacgagcgagcuggacaacauguucgugcaccugaccaacgucgccauccagaagcacggcgaggacuacaaccacauccacgggggcaaguggaccguguccaaccuccggcuguaccuggagagcacccgcggcaaggaggugacgagcaagcuguucgacgagauccacuggaucaucguccagucccucaaggcgguggccccggugaugaacaacgacaagcacugcuucgagugcuacggguacgacaucaucaucgacgacaagcugaagcccuggcucaucgaggucaacgccagccccucccugaccagcuccaccgccaacgaccggauccugaaguacaaccucaucaacgacacccugaacaucgcggugcccaacggcgagaucccggacugcaaguggaacaagagcccgcccaaggagguccuggggaacuacgagauccucuacgacgaggagcuggcccagggcgacggcgccgaccgcgagcugcggucccgccaggggcagagccucggcccccgggccgggcgcucccgggacagcggccgcgccgugcugacgaccuggaaguga

SEQ ID NO: 38247 - RNA, 2748 nt, Artificial Sequence
  derived and/or modified sequence opt1 from TTLL3__Homo_sapiens__NP_001021100
augcagggccccgacgccccgcugcuccugagcgcccgcgagcuggggcccggccggcgcggguccgcgagcugguaccggcaggagggcggggccgugugcaacuggcuccgcaagccccagccccuggagccgcggaccuccuuccccagcgcccgccgguccgaguuccgcccgccccggcgccugcccugggccggccccgccagcgcgcaguccgaggagggccacgccgggggccggugccaggccgggagccccgcccccgcgcgccggcucuccggcgccuucaagacccuggugccggggacgcacgcccagggcgccagcgacacccacccccugggcccgccccacacccccgugcucgaccccagcccccaggacggguuccccgugcuguggcgcggcuccuccaaggccagccacaugaaccggcugcgcaacgcgaagaucuacgucgagcgggccgugaagcagaagaagaucuucaccauccaggggugcuacccggugauccgcugccuccugcggcgccggggcugggucgagaagaagauggugcaccgcuccggccccacgcugcucccgccccagaaggaccuggacagcuccgccaugggggacagcgacaccaccgaggacgaggacgaggacgaggacgaggaguuccagcccucccagcuguucgacuucgacgaccuccugaaguucgacgaccuggacggcacccacgcccucaugguggggcugugccugaaccuccgcaaccugcccugguucgacgaggucgacgccaacagcuucuucccccggugcuacugccugggcgcggaggacgacaagaaggccuucaucgaggacuucuggcucacggccgcccgcaacgugcugaagcugguggucaagagcgaguggaaguccuaccccauccaggccguggaggaggaggcgagcggggacaagcagccgaagaagcaggagaagaaccccgugcucgucucccccgaguucguggacgaggcccugugcgccugcgaggaguaccugagcaaccucgcccacauggacaucgacaaggaccuggaggccccgcuguaccucacccccgagggcuggucccuguuccugcagcgguacuaccaggugguccacgagggcgcggagcuccgccaccuggacacccaggugcagcggugcgaggacauccugcagcagcuccaggccguggucccccagaucgacauggagggggaccgcaacaucuggaucgugaagcccggcgccaagagccgggggcgcggcaucaugugcauggaccaccuggaggagaugcugaagcucgugaacgggaacccggucgugaugaaggacggcaagugggucgugcagaaguacaucgagcggccccugcugaucuucggcaccaaguucgaccuccgccagugguuccuggugacggacuggaacccccugaccgucugguucuaccgggacuccuacauccgcuucagcacccagcccuucucccugaagaaccucgacaacagcgugcaccugugcaacaacuccauccagaagcaccuggagaacagcugccaccggcacccgcuccugccgcccgacaacaugugguccagccagcgcuuccaggcccaccuccaggagaugggggcgcccaacgccugguccaccaucaucgugcccggcaugaaggacgccgucauccacgcccugcagacgagccaggacaccgugcagugccggaaggccuccuucgagcuguacggggcggacuucguguucggcgaggacuuccagcccuggcugaucgagaucaacgccagccccaccauggcccccuccaccgccgucacggcccgccucugcgcgggggugcaggccgacacccugcggguggucaucgaccgcaugcuggaccggaacugcgacaccggcgccuucgagcucaucuacaagcagccggccguggaggugccccaguacgucggcauccgccugcugguggagggguucaccaucaagaagcccauggccaugugccaccgccggaugggcgugcgccccgcggucccgcuccugacgcagcgggggagcggcgaggcccgccaccacuuccccagccugcacaccaaggcccagcuccccagcccccacgugcugcggcaccagggccaggugcugcgccggcagcacuccaagcucgucgggaccaaggcccuguccaccacgggcaaggcgcugcgcacccucccgaccgccaagguguucaucagccugccgcccaaccuggacuucaagguggcccccuccauccucaagccccggaaggcccccgcccugcugugccuccgcgggccccagcuggaggucccgugcugccugugcccccucaagagcgagcaguuccuggcgcccgugggccggucccgccccaaggccaacagccggccggacugcgacaagccccgcgccgaggccugccccaugaagcggcugagcccccucaagccgcugccccugguggggaccuuccagcgccggcgcggccucggcgacaugaagcuggggaagccccugcuccgguuccccacggcccugguccuggacccgacccccaacaagaagaagcaggucaaguaccucggccuggacuccaucgcggucgggggcucccgcguggacggggcccggcccugcacccccggcagcaccgcccgcgccuga

SEQ ID NO: 38248 - RNA, 3600 nt, Artificial Sequence
  derived and/or modified sequence opt1 from TTLL4__Homo_sapiens__NP_055455
auggccagcgccggcacccagcacuacuccaucgggcugcgccagaagaacagcuucaagcaguccggccccagcgggaccgugccggcgacgccgcccgagaagcccuccgagggccgggucuggccccaggcccaccagcaggucaagcccaucuggaagcucgagaagaagcaggucgagacccugagcgccgggcugggccccggccuccugggggugcccccgcagcccgccuacuucuucugccccuccacccugugcagcuccggcaccacggccgugaucgcggggcacagcuccagcugcuaccuccacucccugcccgaccuguucaacagcacccuccuguaccgccgguccagcuaccgccagaagccguaccagcagcuggaguccuucugccuccggagcucccccagcgagaagucccccuucagccugccccagaagucccugccggugagccucaccgccaacaaggccaccagcuccaugguguucagcauggcccagcccauggcguccagcuccacggagcccuaccugugccuggccgccgccggcgagaaccccagcgggaagucccucgccagcgcgaucuccggcaagaucccgagcccccuguccagcuccuacaagcccaugcugaacaacaacagcuucauguggcccaacuccaccccggugccccuccugcagaccacccagggccugaagcccgugagcccgcccaagauccagcccgucagcuggcaccacuccgggggcacgggggacugcgcgccccagccgguggaccacaaggugcccaagagcaucggcaccguccccgccgacgccuccgcccacaucgcccucagcaccgccuccagccacgacaccuccacgaccagcguggccuccagcugguacaaccgcaacaaccuggccaugcgggccgagccccuguccugcgcgcucgacgacagcuccgacagccaggacccgaccaaggagauccgcuucaccgaggccgugcggaagcugacggcccgcggcuucgagaagaugccccggcaggggugccagcuggagcaguccagcuuccucaaccccuccuuccaguggaacguccugaaccgcagccggcgcuggaagcccccggccgugaaccagcaguucccccaggaggacgccggcagcgugcggcgcguccugcccggggcguccgacacccucggccuggacaacaccguguucugcaccaagcggaucagcauccaccuccucgccucccacgccagcgggcugaaccacaaccccgccugcgaguccgugaucgacagcuccgcguucggcgagggcaaggccccggggccgcccuucccccagacgcugggcaucgccaacgucgccacccgccucagcuccauccagcuggggcagagcgagaaggagcggcccgaggaggcccgcgagcuggacuccagcgaccgggacaucuccagcgcgaccgaccuccagcccgaccaggccgagaccgaggacacggaggaggagcugguggacggccuggaggacugcugcucccgcgacgagaacgaggaggaggagggggacagcgagugcuccagccucuccgccgugagccccagcgaguccgucgccaugaucagccgcuccugcauggagauccugaccaagccccugagcaaccacgagaaggugguccggccggcccucaucuacucccuguuccccaacgugccgcccaccaucuacuucggcacccgcgacgagcggguggagaagcugcccugggagcagcgcaagcugcuccgguggaagaugagcacggucacccccaacaucgugaagcagaccaucggccgcucccacuucaagaucagcaagcggaacgacgacuggcuggggugcuggggccaccacaugaagucccccagcuuccgcuccauccgggagcaccagaagcugaaccacuucccggggagcuuccagaucggccgcaaggaccggcucuggcgcaaccugucccggaugcagagccgcuucgggaagaaggaguucuccuucuucccccagagcuucauccugccccaggacgcgaagcuccugcggaaggccugggaguccagcucccgccagaaguggaucgugaagcccccggccagcgcccggggcaucggcauccaggucauccacaaguggagccagcugcccaagcgccggccccuccuggugcagcgcuaccugcacaagcccuaccucaucuccgggagcaaguucgaccugcgcaucuacguguacgucaccuccuacgacccgcugcggaucuaccucuucagcgacggccuggugcgcuucgccuccugcaaguacagccccuccaugaagucccuggggaacaaguucaugcaccucacgaacuacagcgugaacaagaagaacgcggaguaccaggccaacgccgacgagauggccugccagggccacaagugggcgcugaaggcccuguggaacuaccucagccagaagggcgucaacuccgacgccaucugggagaagaucaaggacgugguggucaagaccaucaucagcuccgagcccuacgugaccagccugcugaagauguacgugcggcgccccuacuccugccacgagcuguucggguucgacaucaugcuggacgagaaccugaagccguggguccucgaggugaacaucagccccucccugcacagcuccagcccccuggacaucagcaucaagggccagaugauccgggaccuccugaaccuggccggguucgugcuccccaacgccgaggacaucaucuccagcccguccagcugcuccagcuccaccaccagccugcccacgucccccggcgacaagugccgcauggcgcccgagcacgucaccgcccagaagaugaagaaggccuacuaccugacccagaagaucccggaccaggacuucuacgccagcgugcucgacgugcugacccccgacgacguccggauccugguggagauggaggacgaguucucccgccgggggcaguucgagcgcaucuuccccagccacaucuccagccgguaccuccgcuucuucgagcagccccgguacuucaacauccugacgacccagugggagcagaaguaccacggcaacaagcugaagggcguggaccuccugcgcuccuggugcuacaagggguuccacaugggcgucgugagcgacuccgccccgguguggagccugcccaccucccuccugaccaucagcaaggacgacgucauccugaacgcguucagcaaguccgagacgagcaagcucgggaagcaguccagcugcgaggugucccugcugcucagcgaggacggcaccacccccaaguccaagaagacccaggccgggcugagccccuacccgcagaagcccuccagcuccaaggacagcgaggacacguccaaggagcccagccuguccacccagacccucccggugaucaagugcagcggccagaccucccggcugagcgccuccagcacguuccagagcaucuccgacagccugcucgccgucucccccuga

SEQ ID NO: 38249 - RNA, 3846 nt, Artificial Sequence
  derived and/or modified sequence opt1 from TTLL5__Homo_sapiens__NP_055887
augcccaucgugauggcccgcgaccuggaggagaccgccagcuccagcgaggacgaggaggucaucucccaggaggaccacccgugcaucauguggaccggcgggugccggcgcauccccgugcucguguuccacgcggacgccauccugacgaaggacaacaacauccgggucaucggcgagcgcuaccaccugagcuacaagaucgugcggaccgacucccgccucgugcggagcauccugaccgcccacggguuccacgagguccaccccuccagcaccgacuacaaccugauguggacgggcucccaccucaagcccuuccugcugcgcacccucagcgaggcccagaaggugaaccacuucccgcgguccuacgagcugacccgcaaggaccggcuguacaagaacaucauccgcaugcagcacacccacggguucaaggccuuccacauccucccccagacguuccugcugcccgcggaguacgccgaguucugcaacagcuacuccaaggaccggggccccuggaucgugaagccggucgccagcucccgcggccgcgggguguaccucaucaacaaccccaaccagaucagccuggaggagaacauccuggugucccgguacaucaacaacccccuccugaucgacgacuucaaguucgacguccggcuguacgugcucgugaccagcuacgacccccuggucaucuaccuguacgaggagggccucgcccgcuucgcgaccgugcgguacgaccagggggccaagaacauccgcaaccaguucaugcaccugaccaacuacuccgugaacaagaaguccggcgacuacgucagcugcgacgacccggagguggaggacuacgggaacaaguggagcaugagcgccaugcugcgguaccucaagcaggagggccgcgacacgaccgcccugauggcccacguggaggaccugaucaucaagaccaucaucuccgcggagcucgccaucgccaccgccugcaagacguucgucccccaccgcagcuccugcuucgagcuguacggcuucgacgugcugaucgacagcacccucaagcccuggcugcuggaggugaaccucucccccagccuggccugcgacgcgccgcuggaccucaagaucaaggccuccaugaucagcgacauguucaccgucgugggguucgucugccaggaccccgcccagcgggccuccacccgccccaucuaccccacguucgagagcucccggcgcaacccguuccagaagccccagcggugccgcccccugagcgccuccgacgcggagaugaagaaccuggugggcagcgcccgggagaaggggcccggcaagcucggcggguccgugcugggccugagcauggaggagaucaagguccuccgccgggugaaggaggagaacgaccgccgcgggggcuucauccggaucuucccgaccuccgagaccugggagaucuacgggagcuaccuggagcacaagaccagcaugaacuacaugcuggccacgcgccucuuccaggaccggaugaccgccgacggcgcccccgagcugaagaucgagucccugaacagcaaggcgaagcugcacgccgcccucuacgagcggaagcugcugucccucgaggugcgcaagcggcgccggcgcagcucccgccugcgggccaugcgccccaaguaccccgucaucacccagccggcggagaugaacgugaagaccgagacggagagcgaggaggaggaggagguggcccuggacaacgaggacgaggagcaggaggccucccaggaggagagcgccggcuuccuccgggagaaccaggccaaguacacccccucccugaccgcgcuggucgagaacacccccaaggagaacagcaugaaggugcgcgaguggaacaacaagggcgggcacugcugcaagcucgagacgcaggagcuggagccgaaguucaaccugaugcagauccuccaggacaacgggaaccuguccaagaugcaggcccggaucgccuucagcgccuaccugcagcacgugcagauccgccucaugaaggacuccggcgggcagaccuucagcgccuccugggcggccaaggaggacgagcagauggagcuggucgugcgguuccugaagcgcgccagcaacaaccuccagcacucccugcggauggugcugcccagccgccggcucgcccugcuggagcgccggcgcauccucgcccaccagcugggcgacuucaucaucgucuacaacaaggagaccgagcagauggcggagaagaaguccaagaagaagguggaggaggaggaggaggacggcgugaacauggagaacuuccaggaguucauccggcaggccagcgaggccgagcuggaggagguccucaccuucuacacgcagaagaacaagagcgccuccguguuccuggggacccacagcaagaucuccaagaacaacaacaacuacagcgacuccggcgcgaagggggaccaccccgagaccaucauggaggaggugaagaucaagcccccgaagcagcagcagaccaccgagauccacagcgacaagcugucccgcuucacgaccagcgccgagaaggaggccaagcucgucuacuccaacagcuccagcggccccaccgccacccugcagaagauccccaacacgcaccuguccagcgugaccaccuccgaccucagccccgggccgugccaccacuccagccugagccagauccccuccgccauccccagcaugccccaccagccgaccauccugcucaacacgguguccgcgagcgccucccccugccugcaccccggcgcccagaacauccccagcccgaccggccugccccggugccgcuccgggagccacaccaucggccccuucuccagcuuccaguccgccgcccacaucuacagccagaagcucucccggcccagcuccgcgaaggccgggagcugcuaccugaacaagcaccacuccggcaucgccaagacccagaaggagggcgaggacgccagccuguacuccaagcgcuacaaccagagcauggucacggccgagcuccagcggcuggcggagaagcaggccgcccgccaguacagcccguccagccacaucaaccugcucacccagcaggucaccaaccugaaccuggccaccgggaucaucaaccgcuccagcgcguccgccccgcccacgcuccggcccaucaucagccccuccggccccaccuggagcacccaguccgacccccaggccccggagaaccacagcuccagccccgggucccgcagccugcagaccggcggguucgccugggagggcgagguggagaacaacguguacucccaggccacgggcguggugccccagcacaaguaccaccccaccgcggggagcuaccagcugcaguucgcccuccagcagcuggagcagcagaagcugcagucccggcagcuccuggaccagagccgcgcccggcaccaggccaucuucggcucccagacccugccgaacagcaaccucuggaccaugaacaacggggccggcugccgcaucagcuccgcgacggccagcgggcagaagcccaccacccugccccagaaggucgugcccccgcccuccagcugcgccucccuggugcccaagcccccgcccaaccacgagcagguccuccggcgcgccaccagccagaaggccuccaagggcagcuccgcggagggccagcugaacgggcugcagagcucccucaaccccgccgccuucgugcccaucacgagcuccaccgacccggcccacaccaagaucuga

SEQ ID NO: 38250 - RNA, 2676 nt, Artificial Sequence
  derived and/or modified sequence opt1 from TTLL6__Homo_sapiens__NP_001124390
augggcgcccugcuccugcaccccagccgccgggggccggccggcguggucgcguccuggaccagcucccccgccgggcgcgacggcggggugggcaucgccggcgccugguacuucccccgggccagcucccaggcgcgcgagaugccccagugcccgacccuggagagccaggagggggagaacuccgaggagaagggcgacagcuccaaggaggaccccaaggagacgguggcccucgccuucguccgggagaaccccggggcccagaacggccugcagaacgcgcagcagcaggggaagaagaagcgcaagaagaagcggcuggugaucaaccucagcuccugccgcuacgagagcgugcggcgcgccgcccagcaguacggcuuccgggagggcggggaggacgacgacuggacccuguacuggaccgacuacuccgucagccuggagcgcgugauggagaugaaguccuaccagaagaucaaccacuuccccggcaugagcgagaucugccggaaggaccuccuggcccgcaacaugucccggaugcugaagauguucccgaaggacuuccgcuucuucccccggaccuggugccuccccgccgacuggggcgaccugcagacguacagccgcucccggaagaacaagaccuacaucugcaagcccgacagcgggugccagggcaaggggaucuucaucacccgcaccgugaaggagaucaagccgggcgaggacaugaucugccagcuguacaucagcaagcccuucaucaucgacggguucaaguucgaccuccggaucuacguccuggugacguccugcgacccccugcgcaucuucguguacaacgagggccucgcgcgcuucgccaccaccagcuacucccggcccugcaccgacaaccuggacgacaucugcaugcaccugacgaacuacagcaucaacaagcacuccagcaacuucucccgcgacgcccacagcggguccaagcggaagcucagcaccuucuccgccuaccuggaggaccacagcuacaacgucgagcagaucuggcgcgacaucgaggacgugaucaucaagacccugaucuccgcccacccgaucauccggcacaacuaccacacgugcuuccccaaccacacccucaacagcgcgugcuucgagauccugggcuucgacauccugcucgaccacaagcugaagcccuggcugcucgaggugaaccacucccccagcuucuccaccgacagccgccuggacaaggaggucaaggacggccugcucuacgacacccuggugcugaucaaccucgaguccugcgacaagaagaaggugcuggaggaggagcggcagcgcgggcaguuccugcagcagugcugcagccgggagaugcgcaucgaggaggccaagggcuuccgggccguccagcucaagaagaccgagacguacgagaaggagaacugcgggggcuuccgccugaucuacccgagccugaacuccgagaaguacgagaaguucuuccaggacaacaacagccucuuccagaacaccguggccucccgggcccgcgaggaguacgcgcggcagcugauccaggagcugcgccucaagcgggagaagaagcccuuccagaugaagaagaagguggagaugcagggggagagcgccggcgagcagguccgcaagaagggcaugcggggguggcagcagaagcagcagcagaaggacaaggccgccacccaggccuccaagcaguacauccagccccugacccuggugagcuacacgcccgaccuccugcuguccgugcgcggcgagcgcaagaacgagaccgacagcucccugaaccaggaggcgccgaccgaggaggccagcuccgucuuccccaagcucaccagcgccaagcccuucuccagccugcccgaccugcggaacaucaaccucuccagcuccaagcuggagccgagcaagcccaacuucagcaucaaggaggccaaguccgcgagcgccgugaacgucuucacggggaccgugcaccugaccuccguggagaccacgcccgagagcaccacccagcucuccaucagcccgaaguccccgcccacccuggccgucacggccagcuccgaguacagcggccccgagaccgaccgcgugguguccuucaagugcaagaagcagcagaccccgccccaccugacccagaagaagaugcucaagagcuuccugcccaccaaguccaagagcuucugggagucccccaacacgaacuggacccugcucaagagcgacaugaacaagccccaccugaucuccgagcugcucaccaagcugcagcugagcgggaagcucuccuucuuccccgcccacuacaaccccaagcugggcaugaacaaccugagccagaaccccagccucccgggcgagugccacucccggagcgacuccagcggggagaagcgccagcuggacgucuccagccugcuccugcagagcccccaguccuacaacgugacccugcgggaccuccuggugaucgcgacgcccgcccagcuggacccccgcccgugccggucccacgccagcgccaugcgcgaccccugcaugcaggaccaggaggccuacucccacugccucaucagcggccagaaggggugcgagcgguccuga

SEQ ID NO: 38251 - RNA, 2490 nt, Artificial Sequence
  derived and/or modified sequence opt1 from TTLL7__Homo_sapiens__XP_011540457
augcccagccugccgcaggagggcgugauccaggggcccagcccccucgaccugaacaccgagcugcccuaccaguccaccaugaagcgcaagguccggaagaagaagaagaagggcacgaucaccgccaacguggccgggaccaaguucgagaucgugcgccucgucaucgacgagaugggcuucaugaagaccccggacgaggacgagacguccaaccugaucuggugcgacagcgcggugcagcaggagaagaucuccgagcugcagaacuaccagcggaucaaccacuuccccgggaugggcgagaucugccgcaaggacuuccucgcccggaacaugaccaagaugaucaagagccgcccccuggacuacaccuucgugccccggaccuggaucuucccggccgaguacacgcaguuccagaacuacgucaaggagcugaagaagaagcgcaagcagaagaccuucaucgugaagcccgccaacggcgccauggggcacggcaucucccucauccggaacggggacaagcugcccagccaggaccaccugaucgugcaggaguacaucgagaagcccuuccucauggagggcuacaaguucgaccugcgcaucuacauccuggucaccuccugcgacccgcucaagaucuuccuguaccacgacgggcuggugcggaugggcaccgagaaguacaucccgcccaacgagagcaaccucacgcagcuguacaugcaccugaccaacuacuccgugaacaagcacaacgagcacuucgagcgcgacgagaccgagaacaagggcagcaagcgguccaucaagugguucaccgaguuccuccaggcgaaccagcacgacgucgccaaguucuggagcgacaucuccgagcugguggugaagacgcugaucgucgccgagccccacgugcuccacgccuaccgcaugugccggcccgggcagccgcccggcagcgaguccgugugcuucgagguccugggguucgacauccugcucgaccgcaagcugaagcccuggcugcucgagaucaaccgggcgcccagcuucggcaccgaccagaagaucgacuacgacgugaagcgcggcgugcugcugaacgcccucaagcugcugaacauccggaccuccgacaagcgccggaaccucgccaagcagaaggccgaggcccagcgccgccuguacgggcagaacagcaucaagcggcugcuccccggcagcuccgacugggagcagcagcgccaccagcuggagcggcgcaaggaggagcugaaggagcggcucgcgcagguccgcaagcagaucagccgggaggagcacgagaaccgccacauggggaacuaccggcgcaucuacccgcccgaggacaaggcccugcuggagaaguacgagaaccuccuggccguggccuuccagaccuuccuguccggccgggccgcgagcuuccagcgcgagcucaacaacccccugaagcggaugaaggaggaggacauccuggaccugcucgagcagugcgagaucgacgacgagaagcugauggggaagacgaccaagacccgcggccccaagccccugugcuccaugcccgagagcaccgagaucaugaagcggccgaaguacugcuccagcgacuccagcuacgacuccagcuccagcuccagcgaguccgacgagaacgagaaggaggaguaccagaacaagaagcgcgagaagcaggucacguacaaccucaagcccagcaaccacuacaagcugauccagcagcccuccagcauccggcgcagcguguccugcccgcggagcaucuccgcccagagccccuccagcggcgacacccgccccuucuccgcccagcagaugaucagcgugucccgccccaccagcgccucccggagccacucccugaaccgcgccagcuccuacaugcggcaccucccgcacagcaacgacgcgugcuccaccaacagccaggucagcgagucccugcgccagcugaagacgaaggagcaggaggacgaccucaccagccagacccuguucgugcugaaggacaugaagauccgguuccccgggaaguccgacgccgagagcgagcuccugaucgaggacaucaucgacaacuggaaguaccacaagaccaagguggccuccuacuggcugaucaagcucgacagcgucaagcagcgcaaggugcuggacaucgugaagacguccauccggaccguccugccccgcaucuggaaggugcccgacguggaggaggucaaccucuaccggaucuucaaccgcguguucaaccggcugcuguggagccgcggccaggggcucuggaacugcuucugcgacuccggcuaccugcugccggggagcacccaguucuuccuccggacccccacguacaaccugaaguacaacucccccggcaugacccgcagcaacgugcuguucaccucccgguacggccaccucuga

SEQ ID NO: 38252 - RNA, 2424 nt, Artificial Sequence
  derived and/or modified sequence opt1 from TTLL8__Homo_sapiens__XP_011529043
augaagaccagccgccuguggaagguggcccgguccgagggccccgggggcgccgggguccgcggcgcgaaggggaagcucagcgaggccuccauggagcccgagcggaagggccugagccuggccuccagcuccgacggcgacgggcgcgaggagaacaagcucaagcagggcaucagccaggaccuggccuccagcucccggcuggaccgcuacaagaucgcccggcagcucaccgagaaggcgaucaaggagaagaagaucuucagcaucuacgggcacuaccccguggugcgcgccgcccugcggcgcaagggcugggucgagaagaaguuccacuuccugcccaaggugauccccgacguggaggacgagggggcccgggucaacgacgacacgugcgcgaaggugaaggagaaccaggagauggcccucgagaagaccgacaacauccacgacgugaugucccgccuggucaagaacgagaugccguaccugcucuggaccaucaagcgggacaucaucgacuaccacagccugaccuacgaccagaugcugaaccacuacgccaagacggccuccuucaccaccaagaucggccucugcgugaacaugcgcagccugcccugguacgugcccgccaaccccgacuccuucuucccgcggugcuacagccugugcaccgaguccgagcagcaggaguuccucgaggacuuccgccggacgauggcgagcagcauccugaagugggucgugucccaccagagcugcucccgcagcucccggagcaagccccgcgaccagcgggaggaggccggcuccagcgaccuguccagccgccaggacgccgagaacgccgaggccaagcuccgcgggcugcccggccagcugguggacaucgcgugcaaggucugccaggccuaccucgggcagcuggagcacgaggacaucgacaccuccgccgacgccguggaggaccugaccgaggccgagugggaggaccucacccagcaguacuacagccuggugcacggcgacgcguucaucuccaacagccggaacuacuucucccagugccaggcccugcucaaccgcaucacgagcgucaacccccagaccgacaucgacggccugcggaacaucuggaucaucaagccggccgccaagucccgcgggcgggacaucgugugcauggaccgcguggaggagauccuggagcucgccgcggccgaccacccccugagccgggacaacaagugggucgugcagaaguacaucgagacgccccugcucaucugcgacaccaaguucgacauccgccagugguuccuggugaccgacuggaacccccugaccaucugguucuacaaggaguccuaccuccgguucagcacccagcgcuucagccuggacaagcuggacuccgccauccaccucugcaacaacgccguccagaaguaccugaagaacgacgugggccggagcccgcugcuccccgcgcacaacauguggaccuccacgcgcuuccaggaguaccugcagcggcaggggcgcggcgccgucugggggagcgugaucuaccccuccaugaagaaggccaucgcccacgccaugaagguggcgcaggaccacgucgagccccggaagaacagcuucgagcuguacggcgccgacuucgugcucggccgcgacuuccggccguggcugaucgagaucaacuccagccccaccaugcaccccuccacccccgugaccgcccagcugugcgcccagguccaggaggacacgaucaagguggccguggaccgcagcugcgacaucgggaacuucgagcugcucuggcggcagccggucguggagcccccgcccuucuccggcagcgaccugugcguggcgggggucuccgugcgccgcgcccggcgccaggugcugcccgucugcaaccucaaggccagcgccucccugcuggacgcccagccccucaaggcgcggggccccagcgccaugccggaccccgcccaggggccgcccucccccgcccugcagcgcgaccugggccucaaggaggagaagggccugccccuggcgcuccuggcgccccugcgcggggccgccgagagcggcggggccgcccagcccacccggaccaaggccgccggcaagguggagcucccggccugccccugccggcacguggacagccaggcccccaacaccgggguccccguggcgcagccggccaaguccugggaccccaaccagcugaacgcccacccccuggagcccgugcuccgcggccugaagacggccgagggcgcccugcggccgccgcccgggggcaaggggcaccagcgcgaggcggccggcggccucgcccagugccagaucaccaugcugaagcggaaggaccugcucugccuguga

SEQ ID NO: 38253 - RNA, 1320 nt, Artificial Sequence
  derived and/or modified sequence opt1 from TTLL9__Homo_sapiens__NP_001008409
auggugcccagccgcgaggcccugcucggcccggggaccaccgccauccggugccccaagaagcugcagaaccagaacuacaagggccacgggcuguccaagggcaaggagcgcgagcagcgggcgagcauccgcuucaagacgacccucaugaacacccugauggacguccugcggcaccgccccggguggguggaggugaaggacgagggcgagugggacuucuacuggugcgacgucuccuggcuccgggagaacuucgaccacaccuacauggacgagcacgugcgcaucagccacuuccggaaccacuacgagcugacgcgcaagaacuacauggugaagaaccugaagcgguuccgcaagcagcucgagcgggaggccggcaagcuggaggccgccaagugcgacuucuuccccaagaccuucgagaugccgugcgaguaccaccuguucgucgaggaguuccgcaagaaccccgggaucaccuggaucaugaagcccguggcccggucccagggcaaggggaucuuccucuuccgccggcugaaggacaucguggacuggcgcaaggacacccggagcuccgacgaccagaaggacgacauccccgucgagaacuacguggcgcagcgcuacaucgagaacccguaccugaucggcgggcggaaguucgaccuccgcguguacguccuggugaugagcguguucgccgagugccugcucugguccggccaccgccggcaggacguccaccugacgaacguggccgugcagaagaccagccccgacuaccaccccaagaagggcugcaaguggacccugcagcgcuuccggcaguaccucgccuccaagcacgggcccgaggcggucgagacccuguuccgcgacaucgacaacaucuucgucaagagccugcaguccgugcagaaggugaucaucagcgacaagcacugcuucgagcucuacggcuacgacauccugaucgaccaggaccugaagccguggcuccuggaggugaacgccucccccagccugacggccuccagccaggaggacuacgagcucaagaccugccugcuggaggacacccuccacguggucgacauggaggcccggcugaccgggcgcgagaagcgggugggcggcuucgaccugauguggaacgacgggcccgucucccgcgaggagggcgcccccgaccucagcgggaugggcaacuucgugacgaacacccaccuggggugcgugaacgaccggaagaagcagcugcgccagcuguucugcagccuccagguccagaagaaggcguccagcuga

SEQ ID NO: 38254 - RNA, 837 nt, Artificial Sequence
  derived and/or modified sequence opt1 from TTPA__Homo_sapiens__NP_000361
auggccgaggcccgcagccagcccuccgcgggcccgcagcugaacgcccuccccgaccacagcccccugcugcagcccgggcucgccgcccugcggcgccgggcccgcgaggcgggcgugccgcuggcgccccucccccugaccgacuccuuccugcuccgguuccugcgcgcccgggacuucgaccuggaccucgccuggcgccugcugaagaacuacuacaaguggcgggccgagugccccgagaucagcgccgaccuccacccgcgcuccaucaucgggcugcugaaggccggcuaccacgggguccuccggagccgcgaccccaccggcuccaaggugcugaucuaccggaucgcccacugggaccccaagguguucacggccuacgacgucuuccgcgugagccugaucaccuccgagcucaucgugcaggaggucgagacccagcggaacggcaucaaggcgaucuucgaccuggagggguggcaguucagccacgccuuccagaucacccccuccguggccaagaagaucgccgccgugcugacggacagcuucccgcucaagguccgcggcauccaccugaucaacgagcccgugaucuuccacgcgguguucuccaugaucaagcccuuccugaccgagaagaucaaggagcggauccacaugcacgggaacaacuacaagcagagccuccugcagcacuuccccgacauccugccgcucgaguacggcggggaggaguucuccauggaggacaucugccaggaguggaccaacuucaucaugaaguccgaggacuaccugagcagcaucuccgagagcauccaguga

SEQ ID NO: 38255 - RNA, 444 nt, Artificial Sequence
  derived and/or modified sequence opt1 from TTR__Homo_sapiens__NP_000362
auggccagccaccgccugcuccugcugugccucgccggccugguguucgucuccgaggcggggcccaccggcaccggggagagcaagugcccgcugauggugaaggugcucgacgccguccggggcucccccgccaucaacguggccgugcacgucuuccgcaaggccgcggacgacacgugggagcccuucgccagcgggaagaccuccgagagcggcgagcugcacggccugaccaccgaggaggaguucguggaggggaucuacaagguggagaucgacacgaaguccuacuggaaggcccucggcaucagccccuuccacgagcacgccgaggucguguucaccgcgaacgacuccgggccgcggcgcuacaccaucgccgcccugcugagccccuacuccuacagcaccacggccguggucaccaaccccaaggaguga

SEQ ID NO: 38256 - RNA, 1383 nt, Artificial Sequence
  derived and/or modified sequence opt1 from TTYH1__Homo_sapiens__NP_001005367
augggcgcgcccccgggguaccgccccagcgccugggugcaccuccugcaccagcugccccgggccgacuuccagcugcgccccgucccguccguguucgcgccccaggagcaggaguaccagcaggcccuccugcugguggccgcccucgccggccuggggcugggccucagccugaucuucaucgccgucuaccugauccgguucugcugcugccgcccgcccgagccgcccggguccaagauccccagccccggcggcgggugcgugaccugguccugcaucguggcccuccuggccggcugcaccgggaucggcaucggguucuacggcaacagcgagacguccgacggcgucagccagcuguccagcgcgcuccugcacgccaaccacacccuguccaccaucgaccaccucgugcuggagaccguggagcggcugggggaggccguccgcacggagcucaccacccuggaggaggugcuggagccccggaccgagcucguggccgccgcgcgcggcgcccggcgccaggccgaggccgccgcgcagcagcugcaggggcuggccuucuggcagggcgucccccucagcccccuccagguggccgagaacguguccuucgucgaggaguaccgguggcuggccuacgugcugcugcugcuccuggagcugcucgugugccuguucacgcugcucggccuggccaagcagagcaaguggcuggucaucgugaugaccgugaugucccuccugguccuggugcucagcuggggguccaugggccuggaggcggccaccgccguggggcugagcgacuucugcuccaaccccgacccguacguccucaaccugacccaggaggagacgggccugagcagcgacauccuguccuacuaccuccugugcaaccgcgccgugagcaaccccuuccagcagcggcugacccucucccagcgcgcccuggcgaacauccacagccagcugcucgggcuggagcgggaggccgucccccaguuccccuccgcccagaagccgcugcucagccuggaggagacccugaacgugaccgagggcaacuuccaccagcucguggcccugcugcacugccgcucccuccacaaggacuacggcgcggcccugcgggggcugugcgaggacgcccucgagggccugcuguuccuccugcuguucagccuccuguccgccggggcccuggcgacggcccucugcagccugccccgcgccugggcccuguucccgccccggaaccccuccgcccucugcagcggcucccgccugagcgagccccugcuccccgcggggcuggagcccggcuccccgcugcggagcuuccccggcugccgccgccggccccacuga

SEQ ID NO: 38257 - RNA, 1605 nt, Artificial Sequence
  derived and/or modified sequence opt1 from TTYH2__Homo_sapiens__NP_116035
augcaggccgcccgcguggacuacaucgcgcccuggugggucguguggcugcacagcgugccccacgucggccugcggcugcagcccgugaacuccaccuucagccccggggacgaguccuaccaggagagccuccuguuccugggccugguggccgccgucugccucgggcugaaccugaucuuccucguggccuaccuggugugcgccugccacugccgccgggacgacgcgguccagaccaagcagcaccacuccugcugcaucacguggaccgccgugguggccggccugaucugcugcgccgcggucggggugggcuucuacggcaacagcgagaccaacgacggggccuaccagcucauguacucccuggacgacgccaaccacaccuucagcggcaucgacgcccugguguccgggacgacccagaagaugaaggucgaccucgagcagcaccuggcccgccugagcgagaucuucgcggcccggggcgacuaccuccagacccugaaguucauccagcagauggccggguccguggugguccagcugagcggccuccccguguggcgcgaggugaccauggagcugacgaagcuguccgaccagaccggcuacgucgaguacuaccgguggcucagcuaccugcuccuguucauccuggaccuggugaucugccucaucgccugccuggggcuggccaagcgcuccaagugccuccuggcgagcaugcugugcugcggcgcccucucccugcugcucagcugggccucccuggccgccgacgggagcgcggccguggccaccagcgacuucugcgucgccccggacaccuucauccugaacgugacggagggccagaucuccaccgaggucacccgguacuaccucuacugcagccaguccggcagcucccccuuccagcagacccugacgaccuuccagcgcgcccugaccaccaugcagauccagguggcggggcuccugcaguucgccgugccccuguucagcacggccgaggaggaccuccuggccauccagcugcugcucaacuccagcgaguccagccugcaccagcugaccgcgauggucgacugccggggccuccacaaggacuaccuggacgcccuggccgggaucugcuacgacggccuccaggggcugcuguaccucggccuguucuccuuccuggccgcccucgcguucagcaccaugaucugcgccggcccccgcgccuggaagcacuucaccacgcggaaccgcgacuacgacgacaucgacgacgacgacccguucaacccccaggccuggcggauggccgcgcacuccccgccccgcgggcagcugcacagcuucugcuccuacagcuccggccuggggagccagaccucccuccagccgcccgcccagaccaucagcaacgcccccgugagcgaguacaugaaccaggccaugcuguucggccggaacccccgcuacgagaacgugccccugaucgggcgggccuccccgccgcccaccuacagccccuccaugcgcgcgacguaccucagcgucgccgacgagcaccuccggcacuacggcaaccaguuccccgccuga

SEQ ID NO: 38258 - RNA, 1356 nt, Artificial Sequence
  derived and/or modified sequence opt1 from TUBA1A__Homo_sapiens__NP_001257328
augcgcgagugcaucagcauccacgugggccaggccgggguccagaucggcaacgccugcugggagcuguacugccucgagcacgggauccagcccgacggccagaugccguccgacaagaccaucgggggcggcgacgacagcuucaacaccuucuucuccgagacgggggcgggcaagcacgugccccgggccguguucgucgaccuggagcccaccgugaucgacgaggugcgcaccgggaccuaccggcagcuguuccaccccgagcagcucaucacgggcaaggaggacgccgccaacaacuacgcccgcgggcacuacaccaucggcaaggagaucaucgaccugguccuggaccggauccgcaagcucgcggaccagugcaccggccugcagggguuccugguguuccacagcuucggcgggggcaccggcuccggguucacgagccuccugauggagcggcuguccguggacuacggcaagaaguccaagcucgaguucagcaucuacccggcgccccaggucagcaccgccgugguggagcccuacaacuccauccugaccacccacacgacccuggagcacagcgacugcgccuucauggucgacaacgaggccaucuacgacaucugccgccggaaccucgacaucgagcgccccaccuacaccaaccugaaccggcugaucgggcagaucguguccagcaucacggccucccuccgcuucgacggcgcccugaacguggaccugaccgaguuccagaccaaccucgucccguacccccggauccacuucccccuggccaccuacgcccccgugaucagcgcggagaaggccuaccacgagcagcuguccguggccgagaucacgaacgccugcuucgagccggccaaccagauggucaagugcgacccccgccacgggaaguacauggcgugcugccuccuguaccggggcgacguggugcccaaggacgucaacgccgccaucgccaccaucaagaccaagcgcaccauccaguucguggacuggugccccacgggcuucaagguggggaucaacuaccagccgcccaccgucgugcccggcggggaccuggccaagguccagcgggcggugugcaugcucagcaacaccaccgccaucgccgaggccugggcccgccuggaccacaaguucgaccugauguacgcgaagcgggccuucgugcacugguacgucggcgaggggauggaggagggcgaguucuccgaggcccgcgaggacauggccgcgcucgagaaggacuacgaggaggugggcguggacagcgucgagggggagggcgaggaggagggggaggaguacuga

SEQ ID NO: 38259 - RNA, 1356 nt, Artificial Sequence
  derived and/or modified sequence opt1 from TUBA1B__Homo_sapiens__NP_006073
augcgcgagugcaucagcauccacgugggccaggccgggguccagaucggcaacgccugcugggagcuguacugccucgagcacgggauccagcccgacggccagaugccguccgacaagaccaucgggggcggcgacgacagcuucaacaccuucuucuccgagacgggggcgggcaagcacgugccccgggccguguucgucgaccuggagcccaccgugaucgacgaggugcgcaccgggaccuaccggcagcuguuccaccccgagcagcucaucacgggcaaggaggacgccgccaacaacuacgcccgcgggcacuacaccaucggcaaggagaucaucgaccugguccuggaccggauccgcaagcucgcggaccagugcaccggccugcagggguuccugguguuccacagcuucggcgggggcaccggcuccggguucacgagccuccugauggagcggcuguccguggacuacggcaagaaguccaagcucgaguucagcaucuacccggcgccccaggucagcaccgccgugguggagcccuacaacuccauccugaccacccacacgacccuggagcacagcgacugcgccuucauggucgacaacgaggccaucuacgacaucugccgccggaaccucgacaucgagcgccccaccuacaccaaccugaaccggcugaucucccagaucgugagcuccaucacggccagccuccgcuucgacggggcccugaacguggaccugaccgaguuccagaccaaccucgucccguacccccggauccacuucccccuggccaccuacgcccccgugaucuccgcggagaaggccuaccacgagcagcugagcguggccgagaucacgaacgccugcuucgagccggccaaccagauggucaagugcgacccccgccacggcaaguacauggcgugcugccuccuguaccgcggggacguggugcccaaggacgucaacgccgccaucgccaccaucaagaccaagcgguccauccaguucguggacuggugccccaccggcuucaaggugggcaucaacuaccagccgcccacggucgugcccgggggcgaccuggccaagguccagcgggcggugugcaugcucagcaacaccaccgccaucgccgaggccugggcccgccuggaccacaaguucgaccugauguacgcgaagcgggccuucgugcacugguacgucggggagggcauggaggagggggaguucagcgaggcccgcgaggacauggccgcgcucgagaaggacuacgaggaggugggcguggacuccgucgagggcgagggggaggaggagggcgaggaguacuga

SEQ ID NO: 38260 - RNA, 1245 nt, Artificial Sequence
  derived and/or modified sequence opt1 from TUBA1C__Homo_sapiens__NP_001290046
augcccagcgacaagaccaucggcgggggcgacgacuccuucaacaccuucuucagcgagacgggggccggcaagcacgugccgcgcgccgucuucguggaccuggagcccaccgugaucgacgagguccggaccgggaccuaccgccagcuguuccaccccgagcagcucaucacgggcaaggaggacgcggccaacaacuacgcccggggccacuacaccaucgggaaggagaucaucgaccuggugcucgaccgcauccggaagcuggccgaccagugcaccggccugcagggguuccucguguuccacuccuucggcgggggcaccggcagcggguucacgucccugcugauggagcgccucagcgucgacuacggcaagaaguccaagcuggaguucagcaucuaccccgccccgcaggucuccaccgcggugguggagcccuacaacagcauccugaccacccacacgacccucgagcacuccgacugcgccuucaugguggacaacgaggccaucuacgacaucugccggcgcaaccuggacaucgagcggcccaccuacaccaaccugaaccgccucaucagccagaucguguccagcaucacggccucccugcgguucgacggggcgcugaacgucgaccucaccgaguuccagaccaaccuggugcccuacccgcgcauccacuucccccuggccaccuacgcccccgugaucagcgccgagaaggccuaccacgagcagcucacggucgcggagaucaccaacgccugcuucgagcccgccaaccagauggugaagugcgacccgcggcacggcaaguacauggccugcugccugcuguaccgcggcgacgugguccccaaggacgugaacgccgcgaucgccaccaucaagaccaagcggacgauccaguucguggacuggugccccaccggguucaaggucggcaucaacuaccagcccccgaccguggugcccgggggcgaccucgccaagguccagcgcgccgugugcaugcuguccaacaccacggccgucgcggaggccugggcccggcuggaccacaaguucgaccucauguacgccaagcgcgccuucgugcacugguacgugggggagggcauggaggagggcgaguucagcgaggcgcgggaggacauggccgcccuggagaaggacuacgaggaggucggggccgacuccgcggacggcgaggacgagggggaggaguacuga

SEQ ID NO: 38261 - RNA, 1353 nt, Artificial Sequence
  derived and/or modified sequence opt1 from TUBA3D__Homo_sapiens__NP_525125
augcgcgagugcaucagcauccacgugggccaggccgggguccagaucggcaacgccugcugggagcuguacugccucgagcacgggauccagcccgacggccagaugccguccgacaagaccaucgggggcggcgacgacagcuucaacaccuucuucuccgagacgggggcgggcaagcacgugccccgggccguguucgucgaccuggagcccaccgugguggacgagguccgcaccgggaccuaccggcagcuguuccaccccgagcagcucaucacgggcaaggaggacgccgccaacaacuacgcccgcgggcacuacaccaucggcaaggagaucguggaccuggugcuggaccggauccgcaagcucgcggaccugugcaccggccugcagggguuccucaucuuccacagcuucggcgggggcaccggcuccggguucgccagccugcugauggagcggcucuccgucgacuacggcaagaaguccaagcuggaguucgccaucuacccggcgccccaggugagcacggccguggucgagcccuacaacagcauccugaccacccacaccacgcucgagcacuccgacugcgccuucaugguggacaacgaggccaucuacgacaucugccgccggaaccuggacaucgagcgccccaccuacaccaaccugaaccggcucaucgggcagaucgugagcuccaucaccgccagccugcgcuucgacggcgcccugaacgucgaccucacggaguuccagaccaaccuggugccguacccccggauccacuucccccuggcgaccuacgcccccgugaucuccgccgagaaggccuaccacgagcagcucagcgucgccgagaucaccaacgcgugcuucgagccggccaaccagauggugaagugcgacccccgccacgggaaguacauggccugcugcaugcuguaccggggcgacgugguccccaaggacgugaacgccgccaucgcgacgaucaagaccaagcgcaccauccaguucguggacuggugccccaccggcuucaaggucgggaucaacuaccagccgcccacggugguccccggcggggaccuggccaaggugcagcgggccgugugcaugcucuccaacaccaccgccaucgccgaggcgugggcccgccuggaccacaaguucgaccugauguacgccaagcgggccuucguccacugguacgugggcgaggggauggaggagggcgaguucagcgaggcgcgcgaggaccucgccgcccuggagaaggacuacgaggaggugggcgucgacuccguggaggccgaggccgaggagggggaggaguacuga

SEQ ID NO: 38262 - RNA, 1302 nt, Artificial Sequence
  derived and/or modified sequence opt1 from TUBA4A__Homo_sapiens__NP_001265481
augggcaacgccugcugggagcuguacugccucgagcacgggauccagcccgacggccagaugccgagcgacaagaccaucgggggcggggacgacuccuucaccacguucuucugcgagaccggcgccggcaagcacgugccccgcgcggucuucguggaccuggagcccaccgugaucgacgagauccggaacgggcccuaccgccagcuguuccacccggagcagcucaucaccggcaaggaggacgccgccaacaacuacgcccgggggcacuacacgaucggcaaggagaucaucgaccccguccuggaccgcauccggaagcugagcgaccagugcaccgggcuccagggcuuccugguguuccacuccuucggcgggggcaccgggagcggcuucaccucccugcucauggagcgccugagcguggacuacggcaagaaguccaagcuggaguucagcaucuaccccgcgccccaggucuccacggccgugguggagccguacaacagcauccucaccacccacaccacgcuggagcacuccgacugcgccuucauggucgacaacgaggccaucuacgacaucugccggcgcaaccuggacaucgagcggcccaccuacaccaaccucaaccgccugaucagccagaucguguccagcaucaccgccucccugcgguucgacggggcgcucaacguggaccugacggaguuccagaccaaccugguccccuacccccgcauccacuucccgcucgccaccuacgcccccgugaucagcgccgagaaggccuaccacgagcagcuguccguggcggagaucaccaacgccugcuucgagcccgccaaccagauggucaagugcgacccccggcacggcaaguacauggccugcugccugcucuaccgcggggacguggugccgaaggacgucaacgccgcgaucgccgccaucaagacgaagcggagcauccaguucguggacuggugccccaccggcuucaagguggggaucaacuaccagccgcccaccgucgugcccggcggcgaccuggccaaggugcagcgcgccgucugcaugcuguccaacaccacggcgaucgccgaggccugggcccggcucgaccacaaguucgaccugauguacgccaagcgcgcguucgugcacugguacgucggggagggcauggaggagggggaguucagcgaggcccgggaggacauggccgcccuggagaaggacuacgaggaggugggcaucgacagcuacgaggacgaggacgagggggaggaguga

SEQ ID NO: 38263 - RNA, 1152 nt, Artificial Sequence
  derived and/or modified sequence opt1 from TUBA8__Homo_sapiens__NP_001180343
augaucgaccuggagcccaccguggucgacgaggugcgcgccggcaccuaccggcagcuguuccaccccgagcagcucaucacggggaaggaggacgccgcgaacaacuacgcccgcggccacuacaccguggggaaggagagcaucgaccugguccucgaccggauccgcaagcugaccgacgccugcuccggccugcagggguuccucaucuuccacagcuucggcggcgggaccggcuccggguucacgagccugcugauggagcggcucucccuggacuacggcaagaaguccaagcuggaguucgccaucuaccccgcgccccaggugagcaccgccguggucgagcccuacaacagcauccucaccacccacacgacccuggagcacuccgacugcgccuucaugguggacaacgaggccaucuacgacaucugccgccggaaccuggacaucgagcgcccgaccuacaccaaccucaaccggcugaucagccagaucguguccagcaucacggccucccugcgcuucgacggggcgcucaacgucgaccugaccgaguuccagaccaaccuggugcccuacccccggauccacuucccccucgugaccuacgccccgaucaucagcgccgagaaggccuaccacgagcagcuguccgucgccgagaucacgagcuccugcuucgagcccaacagccagauggugaagugcgacccccgccacggcaaguacauggcgugcugcaugcuguaccggggcgacgugguccccaaggacgugaacguggccaucgccgccaucaagaccaagcgcaccauccaguucgucgacuggugcccgaccggguucaaggugggcaucaacuaccagccgcccacggugguccccgggggcgaccucgccaaggugcagcgggcggugugcaugcuguccaacaccaccgccaucgccgaggccugggcccgccuggaccacaaguucgaccucauguacgcgaagcgggccuucguccacugguacgugggcgaggggauggaggagggcgaguucagcgaggcccgcgaggaccuggccgcccuggagaaggacuacgaggaggucgggaccgacagcuucgaggaggagaacgagggcgaggaguucuga

SEQ ID NO: 38264 - RNA, 1356 nt, Artificial Sequence
  derived and/or modified sequence opt1 from TUBB1__Homo_sapiens__NP_110400
augcgcgagaucgugcacauccagaucggccagugcgggaaccagaucggcgccaaguucugggagaugaucggggaggagcacggcaucgaccuggccgggagcgaccggggcgcguccgcccuccagcuggagcgcaucagcgucuacuacaacgaggccuacggccggaaguacgugccccgcgccgugcuggucgaccucgagcccgggaccauggacuccauccggagcuccaagcugggcgcccuguuccagcccgacagcuucgugcacgggaacuccggcgcggggaacaacugggccaagggccacuacaccgagggcgccgagcucaucgagaacgugcuggaggucgugcgccacgagagcgaguccugcgacugccugcagggguuccagaucgugcacagccucggcgggggcacgggcuccgggaugggcacccugcugaugaacaagauccgggaggaguaccccgaccgcaucaugaacagcuucuccgucaugcccagcccgaagguguccgacaccguggucgagcccuacaacgccgugcucagcauccaccagcugaucgagaacgcggacgccugcuucugcaucgacaacgaggcccuguacgacaucugcuuccggacccucaagcugacgacccccaccuacggggaccugaaccaccucgugucccugaccaugagcggcaucacgaccucccugcgcuuccccgggcagcucaacgccgaccugcggaagcuggccgucaacauggugccguucccccgccuccacuucuucaugcccggcuucgcgccccugaccgcccagggcagccagcaguaccgggcccugagcguggccgagcucacccagcagauguucgacgcccgcaacacgauggcggccugcgaccugcggcgcgggcgguaccugaccgucgccugcaucuuccgcggcaagauguccaccaaggagguggaccagcagcuccugagcgugcagacccggaacuccagcugcuucgucgaguggaucccgaacaacgugaagguggccgucugcgacaucccgccccgcgggcuguccauggccgcgacguucaucggcaacaacaccgccauccaggagaucuucaaccgggugagcgagcacuucuccgccauguucaagcgcaaggccuucguccacugguacaccagcgaggggauggacaucaacgaguucggcgaggccgagaacaacauccacgaccucguguccgaguaccagcaguuccaggacgcgaaggccgugcuggaggaggacgaggaggucaccgaggaggccgagauggagcccgaggacaagggccacuga

SEQ ID NO: 38265 - RNA, 1338 nt, Artificial Sequence
  derived and/or modified sequence opt1 from TUBB2A__Homo_sapiens__NP_001060
augcgcgagaucgugcacauccaggccggccagugcgggaaccagaucggcgccaaguucugggaggucaucagcgacgagcacgggaucgaccccaccggcuccuaccacggggacagcgaccugcagcucgagcggaucaacguguacuacaacgaggcggccggcaacaaguacgugccccgcgccauccuggucgaccuggagcccggcaccauggacuccgugcggagcgggcccuucggccagaucuuccgccccgacaacuucguguucgggcaguccggcgccgggaacaacugggccaagggccacuacacggagggcgcggagcucgucgacagcgugcuggacgugguccggaaggaguccgagagcugcgacugccugcagggguuccagcucacccacucccugggcgggggcaccggcagcgggaugggcacccugcucaucuccaagauccgcgaggaguacccggaccggaucaugaacacguucagcgugaugcccucccccaaggugagcgacaccgucguggagcccuacaacgccacccuguccgugcaccagcuggucgagaacaccgacgagacguacagcaucgacaacgaggcccucuacgacaucugcuuccgcacccugaagcugaccaccccgacguacggggaccucaaccaccugguguccgccaccaugagcggcgugacgaccugccugcgguuccccgggcagcucaacgcggaccugcgcaagcuggccgucaacauggugcccuucccccggcuccacuucuucaugccgggcuucgcgccccugaccucccgcggcagccagcaguaccgggcccugaccgugcccgagcucacccagcagauguucgacagcaagaacaugauggccgccugcgacccccgccacgggcgguaccugaccgucgccgccaucuuccgcggccggauguccaugaaggagguggacgagcagaugcugaacgugcagaacaagaacagcuccuacuucgucgaguggaucccgaacaacgugaagacggccgucugcgacaucccgccccgcgggcucaagaugagcgccaccuucaucggcaacuccaccgcgauccaggagcuguucaagcggaucagcgagcaguucaccgccauguuccgccggaaggccuuccugcacugguacacgggggagggcauggacgagauggaguucaccgaggccgaguccaacaugaacgaccucgugagcgaguaccagcaguaccaggacgccaccgcggacgagcagggcgaguucgaggaggaggagggggaggacgaggccuga

SEQ ID NO: 38266 - RNA, 1338 nt, Artificial Sequence
  derived and/or modified sequence opt1 from TUBB2B__Homo_sapiens__NP_821080
augcgcgagaucgugcacauccaggccggccagugcgggaaccagaucggcgccaaguucugggaggucaucagcgacgagcacgggaucgaccccaccggcuccuaccacggggacagcgaccugcagcucgagcggaucaacguguacuacaacgaggcgaccggcaacaaguacgugccccgcgccauccuggucgaccuggagcccggcacgauggacuccgugcggagcgggcccuucggccagaucuuccgccccgacaacuucguguucgggcaguccggcgccgggaacaacugggccaagggccacuacaccgagggcgccgagcucgucgacagcgugcuggacgugguccggaaggaguccgagagcugcgacugccugcagggguuccagcucacccacucccugggcgggggcaccggcagcgggaugggcacgcugcucaucuccaagauccgcgaggaguacccggaccggaucaugaacaccuucagcgugaugcccucccccaaggugagcgacaccgucguggagcccuacaacgcgacccuguccgugcaccagcuggucgagaacacggacgagaccuacugcaucgacaacgaggcccucuacgacaucugcuuccgcacccugaagcugaccacgccgaccuacggggaccucaaccaccuggugagcgccaccauguccggcgugaccacgugccugcgguuccccgggcagcucaacgccgaccugcgcaagcuggcggucaacauggugcccuucccccggcuccacuucuucaugccgggcuucgcgccccugaccagccgcggcucccagcaguaccgggcccugaccgugcccgagcucacccagcagauguucgacagcaagaacaugauggccgccugcgacccccgccacgggcgguaccugacggucgccgccaucuuccgcggccggaugagcaugaaggagguggacgagcagaugcugaacgugcagaacaagaacuccagcuacuucgucgaguggaucccgaacaacgugaagaccgccgucugcgacaucccgccccgcgggcucaagauguccgccaccuucaucggcaacagcaccgccauccaggagcuguucaagcggaucuccgagcaguucacggcgauguuccgccggaaggccuuccugcacugguacaccggggagggcauggacgagauggaguucaccgaggccgagagcaacaugaacgaccucguguccgaguaccagcaguaccaggacgccaccgccgacgagcagggcgaguucgaggaggaggagggggaggacgaggcguga

SEQ ID NO: 38267 - RNA, 1137 nt, Artificial Sequence
  derived and/or modified sequence opt1 from TUBB3__Homo_sapiens__NP_001184110
auggacagcgugcgcuccggcgccuucgggcaccuguuccggcccgacaacuucaucuucggccagagcggggccggcaacaacugggcgaaggggcacuacaccgagggcgccgagcucgucgacuccgugcuggacgugguccgcaaggagugcgagaacugcgacugccugcagggcuuccagcucacccacagccucgggggcgggacgggcuccgggaugggcacccugcugaucagcaaggugcgggaggaguaccccgaccgcaucaugaacaccuucuccgugguccccagccccaagguguccgacaccguggucgagcccuacaacgccacgcugagcauccaccagcugguggagaacaccgacgagaccuacugcaucgacaacgaggcccucuacgacaucugcuuccggacccugaagcuggccacgccgaccuacggcgaccucaaccaccugguguccgcgaccaugagcggggucaccacgucccugcgcuuccccggccagcucaacgccgaccugcggaagcuggccgugaacauggugcccuucccccgccuccacuucuucaugccgggguucgcgccccugaccgcccggggcagccagcaguaccgcgcccugaccguccccgagcucacccagcagauguucgacgccaagaacaugauggccgccugcgacccccggcacggccgcuaccugacgguggcgaccguguuccgggggcgcauguccaugaaggaggucgacgagcagaugcuggccauccagagcaagaacuccagcuacuucguggaguggaucccgaacaacgugaaggucgccgugugcgacaucccgccccggggccucaagauguccagcaccuucaucgggaacagcaccgccauccaggagcuguucaagcgcaucuccgagcaguucacggccauguuccggcgcaaggcguuccugcacugguacaccggcgaggggauggacgagauggaguucaccgaggccgagagcaacaugaacgaccucguguccgaguaccagcaguaccaggacgccaccgccgaggaggagggcgagauguacgaggacgacgaggaggagagcgaggcccagggccccaaguga

SEQ ID NO: 38268 - RNA, 1470 nt, Artificial Sequence
  derived and/or modified sequence opt1 from TUBB4A__Homo_sapiens__NP_001276056
augcgccggggcgccgccgaccgcgagaccgaggggcccugcagcgcgguguccgccgccagcuccacccuggccgccgcggccgccccgcgggcccgcgcgacggccgccgccagcacccucuccgccaccgcgaugcgggagaucguccaccuccaggccggccagugcgggaaccagaucggcgccaaguucugggaggugaucagcgacgagcacgggaucgaccccaccggcacguaccacggcgacuccgaccugcagcuggagcgcaucaacguguacuacaacgaggccaccgggggcaacuacgucccccgggccgugcugguggaccuggagcccgggaccauggacagcguccgcuccggcccguucgggcagaucuuccggcccgacaacuucguguucggccagagcggcgcggggaacaacugggccaagggccacuacaccgagggggccgagcucguggacgccguccuggacguggugcgcaaggaggccgaguccugcgacugccugcagggcuuccagcucacgcacagccugggcgggggcaccggguccggcauggggacccugcucaucagcaagauccgggaggaguuccccgaccgcaucaugaacaccuucuccgucgugcccagcccgaagguguccgacacggucguggagcccuacaacgcgacccugagcgugcaccagcuggucgagaacaccgacgagaccuacugcaucgacaacgaggcccucuacgacaucugcuuccggacgcugaagcugaccacccccaccuacggcgaccucaaccaccugguguccgccacgaugagcggcgugacgaccugccugcgcuuccccgggcagcucaacgccgaccugcggaagcuggccgucaacauggugccguucccccgccuccacuucuucaugcccggcuucgcgccccugaccagccgggggucccagcaguaccgcgcccugaccgugccggagcucacccagcagauguucgacgccaagaacaugauggccgcgugcgacccccggcacggccgcuaccugaccgucgccgccguguuccgggggcgcaugagcaugaaggaggucgacgagcagaugcuguccgugcagagcaagaacuccagcuacuucguggaguggauccccaacaacgucaagaccgccgugugcgacaucccgccccgcggccucaagauggccgcgacguucaucggcaacuccaccgccauccaggagcuguucaagcggaucagcgagcaguucaccgccauguuccgccggaaggccuuccugcacugguacaccggggagggcauggacgagauggaguucacggaggccgaguccaacaugaacgaccucgugagcgaguaccagcaguaccaggacgcgaccgccgaggagggggaguucgaggaggaggccgaggaggaggucgccuga

SEQ ID NO: 38269 - RNA, 1338 nt, Artificial Sequence
  derived and/or modified sequence opt1 from TUBB4B__Homo_sapiens__NP_006079
augcgcgagaucgugcaccuccaggccggccagugcgggaaccagaucggcgccaaguucugggaggucaucagcgacgagcacgggaucgaccccaccggcaccuaccacggggacuccgaccugcagcuggagcggaucaacguguacuacaacgaggcgacgggcggcaaguacgugccccgcgccguccugguggaccucgagcccgggaccauggacagcgugcgguccggccccuucgggcagaucuuccgccccgacaacuucgucuucggccagagcggggccggcaacaacugggccaagggccacuacaccgagggggccgagcugguggacuccgugcuggacgucgugcggaaggaggcggagagcugcgacugccuccagggcuuccagcugacccacucccucgggggcggcacggggagcggcauggggacccugcugaucuccaagauccgcgaggaguacccggaccggaucaugaacaccuucagcgugguccccucccccaaggugagcgacaccguggucgagcccuacaacgccacgcuguccgugcaccagcucguggagaacaccgacgagaccuacugcaucgacaacgaggcccuguacgacaucugcuuccgcacccugaagcucacgaccccgaccuacggcgaccugaaccaccuggucagcgccaccauguccggggugacgaccugccuccgguuccccggccagcugaacgcggaccugcgcaagcucgccgugaacaugguccccuucccccggcugcacuucuucaugccgggcuucgcgccccugaccagccgcgggucccagcaguaccgggcccucaccgugcccgagcugacgcagcagauguucgacgccaagaacaugauggccgccugcgacccccgccacggccgguaccugaccguggccgccgucuuccgcgggcggaugagcaugaaggagguggacgagcagaugcucaacguccagaacaagaacuccagcuacuucguggaguggaucccgaacaacgugaagaccgccgucugcgacaucccgccccgcggccugaagaugagcgcgaccuucaucgggaacuccacggccauccaggagcuguucaagcggaucagcgagcaguucaccgccauguuccgccggaaggccuuccuccacugguacaccggcgagggcauggacgagauggaguucaccgaggccgaguccaacaugaacgaccuggugagcgaguaccagcaguaccaggacgcgacggccgaggaggagggggaguucgaggaggaggccgaggaggagguggccuga

SEQ ID NO: 38270 - RNA, 1230 nt, Artificial Sequence
  derived and/or modified sequence opt1 from TUBB6__Homo_sapiens__NP_001290455
augcgcgagaucgugcacauccaggccggccagugcgggaaccagaucggcaccaaguucugggaggucaucagcgacgagcacgggaucgaccccgccggcggguacgugggcgacuccgcgcugcagcucgagcggaucaacguguacuacaacgagagcuccugccagaccggcgccgggaacaacugggccaagggccacuacacggagggggccgagcuggucgacgccgugcuggacgugguccgcaaggagugcgagcacugcgacugccuccagggcuuccagcugacccacagccucgggggcggcaccggguccggcauggggacccugcugaucagcaagauccgggaggaguuccccgaccgcaucaugaacacguucuccgugaugcccagccccaagguguccgacaccgucguggagcccuacaacgcgacccugagcgugcaccagcucgucgagaacaccgacgagacguacugcaucgacaacgaggcccuguacgacaucugcuuccggacccugaagcucaccaccccgacguacggcgaccugaaccaccugguguccgccaccaugagcggcgugaccaccucccuccgcuuccccgggcagcugaacgccgaccugcggaagcucgcggucaacauggugcccuucccccgccugcacuucuucaugccgggcuucgcgccccugacgagccgggggucccagcaguaccgcgcccucaccgugcccgagcugacccagcagauguucgacgcccggaacaugauggccgccugcgacccccgccacggccgguaccugaccgucgccacgguguuccgcgggccgaugagcaugaaggagguggacgagcagaugcucgccauccaguccaagaacagcuccuacuucgucgaguggauccccaacaacgugaagguggccgucugcgacaucccgccccggggccugaagauggccagcaccuucaucggcaacagcaccgcgauccaggagcuguucaagcgcaucuccgagcaguucagcgccauguuccggcgcaaggccuuccuccacugguucaccggggagggcauggacgagauggaguucacggaggccgaguccaacaugaacgaccuggugagcgaguaccagcaguaccaggacgccaccgcgaacgacggggaggaggccuucgaggacgaggaggaggagaucgacggcuga

SEQ ID NO: 38271 - RNA, 729 nt, Artificial Sequence
  derived and/or modified sequence opt1 from TUBB__Homo_sapiens__NP_001280142
augcgcgagaucgugcacauccaggccggccagugcgggaaccagaucggcgccaaguucugggaggucaucagcgacgagcacgggaucgaccccaccggcaccuaccacggggacuccgaccugcagcucgaccggaucagcguguacuacaacgaggcgacgggcggcaaguacgugccccgcgccauccuggucgaccuggagcccgggaccauggacuccgugcggagcggccccuucgggcagaucuuccgccccgacaacuucguguucggccaguccggggccggcaacaacugggccaagggccacuacaccgagggggccgagcucgucgacagcgugcuggacgugguccggaaggagguggacgagcagaugcugaacgugcagaacaagaacuccagcuacuucgucgaguggaucccgaacaacgugaagaccgcggugugcgacaucccgccccgcggccucaagauggccgucacguucaucgggaacuccaccgccauccaggagcuguucaagcggaucagcgagcaguucaccgccauguuccgccggaaggcguuccugcacugguacaccggcgagggcauggacgagauggaguucacggaggccgaguccaacaugaacgaccucgugagcgaguaccagcaguaccaggacgccaccgccgaggaggaggaggacuucggggaggaggccgaggaggaggcguga

SEQ ID NO: 38272 - RNA, 1197 nt, Artificial Sequence
  derived and/or modified sequence opt1 from TUBD1__Homo_sapiens__NP_001180538
augagcaucgugaccguccagcugggccagugcgggaaccagaucggcuucgagguguucgacgcccuccuguccgacagccacuccagccaggggcugugcuccaugcgcgagaacgaggccuaccaggcgagcugcaaggagcgguucuucuccgaggaggagaacggcgugcccaucgcccgcgccguccucguggacauggagcccaaggugaucaaccagaugcugagcaaggccgcccaguccgggcaguggaaguacggccagcacgcgugcuucugccagaagcagggcagcgggaacaacugggccuacggcuacuccguccacgggccccggcacgaggagagcaucaugaacaucauccgcaaggagguggagaagugcgacuccuucagcggcuucuucaucaucauguccauggccgggggcaccggcagcgggcugggcgccuucgugacgcagaaccucgaggaccaguacuccaacagccugaagaugaaccagaucaucuggcccuacgggaccggcgaggucaucgugcagaacuacaacuccauccugacccucagccaccuguaccggagcuccgacgcgcugcuccugcacgagaacgacgccauccacaagaucugcgccaagcugaugaacaucaagcagaucagcuucuccgacaucaaccaggugcucgcccaccagcugggcagcgucuuccagcccaccuacuccgccgagagcuccuuccacuaccgccggaacccgcuggggaucgaccgccacguguggccgccccucagcggccugccgccccuguccaagaugagccucaacaaggaccugcacuucaacacguccaucgcgaaccuggugauccuccgggggaaggacguccagagcgccgacguggagggcuucaaggaccccgcccuguacaccuccuggcugaagcccgugaacgccuucaacgucuggaagacccagcgcgccuucagcaaguacgagaaguccgcggugcucgugagcaacucccaguuccuggucaagccccuggacaugaucguggggaaggccuggaacauguucgccagcaaggccuacauccaccaguacaccaaguucggcaucgaggaggaggacuuccucgacuccuucacgagccuggagcaggucguggccagcuacugcaaccuguga

SEQ ID NO: 38273 - RNA, 1428 nt, Artificial Sequence
  derived and/or modified sequence opt1 from TUBE1__Homo_sapiens__NP_057346
augacccagagcguggucguccaggugggccagugcgggaaccagaucggcugcugcuucugggaccuggcccuccgcgagcacgccgcggugaaccagaaggggaucuacgacgaggccaucuccagcuucuuccggaacguggacacccgcguggucggcgacgggggcuccaucagcaagggcaagaucugcucccugaaggcccgggccgugcugaucgacauggaggaggggguggucaacgagauccuccagggcccccugcgcgacguguucgacacgaagcagcugaucaccgacaucagcggguccggcaacaacugggccguggggcacaaggucuucggcagccucuaccaggaccagauccuggagaaguuccggaaguccgcggagcacugcgacugccugcagugcuucuucaucauccacagcaugggcgggggcaccggguccggccucggcaccuuccugcugaaggugcucgaggacgaguucccggagguguaccgcuucgucacgagcaucuaccccuccggggaggacgacgugaucaccagccccuacaacuccauccuggccaugaaggagcugaacgagcacgccgacugcgugcuccccaucgacaaccagagccuguucgacaucaucuccaagaucgaccugauggucaacagcggcaagcucgggaccaccgugaagccgaagucccuggugacgagcagcuccggcgcccugaagaagcagcacaagaagcccuucgacgcgaugaacaacaucgucgccaaccuccugcugaaccucaccagcuccgcccgguucgaggggagccugaacauggaccugaacgagaucuccaugaaccucgugcccuucccccagcugcacuaccuggugagcucccucaccccgcuguacacccugacggacgucaacaucccgccccgccggcucgaccagauguucagcgacgccuucuccaaggaccaccagcugcugcgcgccgaccccaagcacagccucuaccuggcgugcgcccugauggugcggggcaacguccagaucuccgaccuccgccggaacaucgagcgccugaagcccagccugcaguucguguccuggaaccaggagggcuggaagaccagccucugcuccgugccgcccgucgggcacagccacucccugcuggcccucgccaacaacacgugcgugaagcccaccuucauggagcugaaggagcgguucaugcgccuguacaagaagaaggcccaccuccaccacuaccuccagguggagggcauggaggagagcugcuucaccgaggcggucuccagccugagcgcccugauccaggaguacgaccagcuggacgccaccaagaacaugcccgugcaggaccugccccggcuguccaucgccauguga

SEQ ID NO: 38274 - RNA, 1356 nt, Artificial Sequence
  derived and/or modified sequence opt1 from TUBG1__Homo_sapiens__NP_001061
augccccgcgagaucaucacccugcagcucggccagugcgggaaccagaucggcuucgaguucuggaagcagcugugcgccgagcacgggaucagcccggagggcaucguggaggaguucgccaccgaggggacggaccggaaggacgucuucuucuaccaggcggacgacgagcacuacaucccccgcgccgugcugcucgaccuggagccccgggugauccacuccauccugaacagccccuacgccaagcucuacaacccggagaacaucuaccuguccgagcacggcggcggggccggcaacaacugggccagcggguucucccagggcgagaagauccacgaggacaucuucgacaucaucgaccgcgaggcggacgggagcgacucccuggagggcuucguccucugccacagcaucgccggcgggaccggcuccgggcugggcagcuaccugcucgagcggcugaacgaccgcuaccccaagaagcuggugcagaccuacuccguguuccccaaccaggacgagaugagcgacgucguggugcagcccuacaacucccuccugacccugaagcggcucacgcagaacgccgacugcgucguggugcuggacaacaccgcccugaaccgcaucgcgaccgaccggcuccacauccagaacccgagcuucucccagaucaaccagcuggucagcaccaucauguccgccagcacgaccacccugcgcuaccccggcuacaugaacaacgaccucaucgggcugaucgccucccugauccccacgccccggcuccacuuccugaugacgggcuacaccccgcugaccaccgaccagagcguggccagcgugcgcaagacgaccguccucgacgugaugcggcgccugcugcagcccaagaacgugauggucuccaccgggcgggaccgccagaccaaccacugcuacaucgccauccucaacaucauccagggcgagguggaccccacccaggugcacaagagccugcagcggauccgcgagcggaagcuggcgaacuucauccccugggggccggccuccauccaggucgcccucagccgcaagucccccuaccugcccagcgcccaccggguguccggccugaugauggccaaccacaccagcaucuccagccucuucgagcggaccugccgccaguacgacaagcugcgcaagcgcgaggcguuccuggagcaguuccggaaggaggacauguucaaggacaacuucgacgagauggacaccucccgcgagaucgugcagcagcucaucgacgaguaccacgccgccacgcggcccgacuacaucagcuggggcacccaggagcaguga

SEQ ID NO: 38275 - RNA, 1356 nt, Artificial Sequence
  derived and/or modified sequence opt1 from TUBG2__Homo_sapiens__NP_057521
augccccgcgagaucaucacccugcagcucggccagugcgggaaccagaucggcuucgaguucuggaagcagcugugcgccgagcacgggaucagcccggagggcaucguggaggaguucgccaccgaggggacggaccggaaggacgucuucuucuaccaggcggacgacgagcacuacaucccccgcgccgugcugcucgaccuggagccccgggugauccacuccauccugaacagccccuacgccaagcucuacaacccggagaacaucuaccuguccgagcacggcggcggggccggcaacaacugggccagcggguucucccagggcgagaagauccacgaggacaucuucgacaucaucgaccgcgaggcggacgggagcgacucccuggagggcuucguccucugccacagcaucgccggcgggaccggcuccgggcugggcagcuaccugcucgagcggcugaacgaccgcuaccccaagaagcuggugcagaccuacuccguguuccccuaccaggacgagaugagcgacgucguggugcagcccuacaacucccuccugacccugaagcggcucacgcagaacgccgacugcgucguggugcuggacaacaccgcccugaaccgcaucgcgaccgaccggcuccacauccagaacccgagcuucucccagaucaaccagcuggucagcaccaucauguccgccagcacgaccacccugcgcuaccccggcuacaugaacaacgaccucaucgggcugaucgccucccugauccccacgccccggcuccacuuccugaugacgggcuacaccccgcugaccaccgaccagagcguggccagcgugcgcaagacgaccguccucgacgugaugcggcgccugcugcagcccaagaacgugauggucuccaccgggcgggaccgccagaccaaccacugcuacaucgccauccucaacaucauccagggcgagguggaccccacccaggugcacaagagccugcagcggauccgcgagcggaagcuggcgaacuucauccccugggggccggccuccauccaggucgcccucagccgcaagucccccuaccugcccagcgcccaccggguguccggccugaugauggccaaccacaccagcaucuccagccucuucgaguccagcugccagcaguucgacaagcugcgcaagcgcgacgcguuccuggagcaguuccggaaggaggacauguucaaggacaacuucgacgagauggaccgcucccgggaggugguccaggagcucaucgacgaguaccacgccgccacccagcccgacuacaucagcuggggcacccaggagcaguga

SEQ ID NO: 38276 - RNA, 2793 nt, Artificial Sequence
  derived and/or modified sequence opt1 from TUBGCP2__Homo_sapiens__NP_001243546
augagcgaguuccgcauccaccacgacgugaacgagcugcucucccugcugcggguccacggcggggacggcgccgagguguacaucgaccuccugcagaagaaccgcacccccuacgugaccacgaccgucagcgcccacuccgcgaaggugaagaucgccgaguucagccggaccccggaggacuuccugaagaaguacgacgagcucaaguccaagaacacccgcaaccuggacccccugguguaccuccugagcaagcugacggaggacaaggagacccuccaguaccugcagcagaacgccaaggagcgggccgagcuggccgcggccgccgucggguccagcaccaccuccaucaacgugcccgccgcggccagcaagaucuccaugcaggagcucgaggagcugcgcaagcagcugggcagcguggccacgggguccacccuccagcagagccuggagcugaagcggaagaugcuccgcgacaagcagaacaagaagaacuccggccagcaccuccccaucuucccggccugggucuacgagcggcccgcccugaucggcgacuuccucaucggggcgggcaucagcaccgacaccgcccugcccaucgugcugcuccgcuggaaccuggcccugagcccccggcucaagugcagcggggugaucuccgcccacugcaaccugcaccucccgggcacgcugccccuggccagccaggagagcgcggucguggaggaccugcucuacgugcuggucgggguggacggccgcuacguguccgcccagccccuggccggccggcagagccgcaccuuccucgucgaccccaaccuggaccuguccauccgggagcucgugcaccgcauccugccgguggccgccagcuacuccgcggucacccgguucaucgaggagaaguccuccuucgaguacggccaggugaaccacgcccuggccgccgccaugcgcacccucgugaaggagcaccugauccuggucagccagcucgagcagcugcaccggcagggccugcugucccuccagaagcugugguucuacauccagcccgcgaugcgcacgauggacauccuggccagccucgccaccuccguggacaagggggagugccugggcggcagcacccugucccuccugcacgaccggagcuucuccuacaccggggacagccaggcccaggagcugugccucuaccugacgaaggcggccuccgcccccuacuucgagguccuggagaaguggaucuaccgcggcaucauccacgaccccuacagcgaguucaugguggaggagcacgagcuccgcaaggagcggauccaggaggacuacaacgacaaguacugggaccagcgcuacaccaucgugcagcagcagaucccguccuuccugcagaagauggccgacaagauccugagcaccgggaaguaccucaacgucgugcgggagugcggccacgacgugaccugccccgucgccaaggagaucaucuacacgcugaaggagcgcgcguacguggagcagaucgagaaggccuucaacuacgccagcaaggugcugcucgacuuccugauggaggagaaggagcuggucgcccaccuccgguccaucaagcgcuacuuccugauggaccagggggacuucuucgugcacuucauggaccuggccgaggaggagcuccggaagcccguggaggacaucacgcccccgcgccuggaggcgcugcucgagcuggcccugcggaugagcaccgccaacaccgaccccuucaaggacgaccucaagaucgaccugaugccccacgaccugaucacccagcuccugcgcguccuggccaucgagaccaagcaggagaaggccauggcgcacgccgaccccaccgagcucgcccuguccggccuggaggccuucagcuucgacuacaucgugaaguggccgcucucccugaucaucaaccggaaggcgcugacccgcuaccagaugcuguuccggcacauguucuacugcaagcacguggagcgccagcugugcagcgucuggaucuccaacaagacggccaagcagcacagccugcacuccgcccagugguucgccggcgccuucacccuccggcagcgcaugcugaacuucgugcagaacauccaguacuacaugauguucgaggugauggagcccaccuggcacauccuggagaagaaccucaagagcgcguccaacaucgacgacguccuggggcaccacaccggcuuccuggacacgugccucaaggacugcaugcugaccaaccccgagcugcucaagguguucagcaagcugauguccgugugcgucauguucaccaacugcaugcagaaguucacccagagcaugaagcuggacggggagcucggcgggcagacccuggagcacuccacggugcugggccuccccgccggcgccgaggagcgggcccgcaaggagcuggcccggaagcaccuggcggagcacgccgacaccgugcagcucgucagcggguucgaggccaccaucaacaaguucgacaagaacuucuccgcccaccuccuggaccugcuggcccgccugagcaucuacagcaccuccgacugcgagcacggcauggcgagcgugaucucccgccucgacuucaacggguucuacacggagcggcuggagcgccugagcgccgagcggucccagaaggccaccccgcagguccccgugcuccgcgggcccccggcccccgcgccccggguggccgugaccgcccaguga

SEQ ID NO: 38277 - RNA, 2724 nt, Artificial Sequence
  derived and/or modified sequence opt1 from TUBGCP3__Homo_sapiens__NP_006313
auggccacccccgaccagaaguccccgaacgugcugcuccagaaccugugcugccgcauccugggccgguccgaggccgacgucgcgcagcaguuccaguacgccgugcgcgugaucgggagcaacuucgcccccaccgucgagcgggacgaguuccucguggccgagaagaucaagaaggagcugauccgccagcggcgcgaggccgacgcggcccuguucuccgagcuccaccggaagcugcacagccagggcgugcugaagaacaagugguccauccucuaccugcugcucagccuguccgaggacccccgccggcagcccagcaaggucuccagcuacgccacgcuguucgcccaggcgcucccgcgcgacgcccacuccacccccuacuacuacgcccggccccagacccugccccugagcuaccaggaccgcuccgcccagagcgcccaguccagcggguccgugggcagcuccgggaucagcagcaucggccucugcgcgcuguccggcccggcccccgcgccccagagccugcuccccgggcaguccaaccaggccccgggcgugggggacugccugcggcagcagcugggcagccgccucgccuggacccugacggccaaccagcccuccagccaggccaccaccuccaaggggguccccagcgccgugucccggaacaugacccgcagccggcgcgagggcgacacgggcgggaccauggagaucaccgaggccgcccuggugcgggacauccucuacgucuuccagggcaucgacgggaagaacaucaagaugaacaacaccgagaacugcuacaagguggagggcaaggcgaaccugucccgcagccugcgggacacggccgugcgccucuccgagcugggcuggcugcacaacaagauccgccgguacaccgaccagcgcagccucgaccgguccuucgggcuggucggccagagcuucugcgccgcccugcaccaggagcuccgcgaguacuaccggcugcuguccgugcuccacagccagcugcagcuggaggacgaccagggggugaaccucggccuggaguccagccugacccuccgccggcugcuggucuggaccuacgaccccaagauccgccucaagacgcuggccgcgcugguggaccacugccaggggcggaagggcggcgagcuggccagcgccgugcacgccuacaccaagaccggggacccguacaugcgcucccucguccagcacauccugagccuggugucccaccccgugcucagcuuccuguaccgguggaucuacgacggcgagcuggaggacaccuaccacgaguucuucgucgcguccgaccccacggugaagaccgaccgccucuggcacgacaaguacacccugcgcaagagcaugauccccuccuucaugaccauggaccagagccggaagguccugcucaucgggaaguccaucaacuuccugcaccaggugugccacgaccagacgccgaccaccaagaugaucgccgugaccaagagcgccgagagcccccaggacgccgccgaccuguucacggaccucgagaacgcguuccagggcaagaucgacgccgccuacuucgagaccagcaaguaccugcuggacguccucaacaagaaguacucccugcuggaccacaugcaggccaugcggcgcuaccuccugcuggggcagggcgacuucauccggcaccucauggaccugcugaagcccgagcucgugcgccccgccaccacccuguaccagcacaaccugacgggcauccucgagaccgcggugcgggccaccaacgcccaguucgacagcccggagauccugcgccgccuggacguccggcuccuggaggugucccccggggacaccggcugggacguguucagccuggacuaccacgucgacgggcccaucgccacgguguucacccgcgagugcaugucccacuaccuccggguguucaacuuccuguggcgcgccaagcggauggaguacauccugaccgacauccgcaagggccacaugugcaacgcgaagcuccugcggaacaugcccgaguucagcgggguccugcaccagugccacauccucgccagcgagauggugcacuucauccaccagaugcaguacuacaucaccuucgaggugcuggagugcuccugggacgagcuguggaacaagguccagcaggcccaggaccucgaccacaucaucgccgcgcacgagguguuccuggacaccaucaucagccgcugccugcucgacuccgacagccgggcccugcugaaccagcuccgcgccguguucgaccagaucaucgagcugcagaacgcccaggacgccaucuaccgggcggcccuggaggagcuccagcgccggcugcaguucgaggagaagaagaagcagcgcgagaucgagggccaguggggcgucacggccgccgaggaggaggaggagaacaagcggaucggggaguucaaggaguccaucccgaagaugugcagccagcugcgcauccucacccacuucuaccagggcaucgugcagcaguuccuggugcugcucaccaccuccagcgacgagucccugcgguuccugagcuuccgccucgacuucaacgagcacuacaaggcccgggagccccgccugcgggucucccuggggacgcgcggccgccggagcucccacaccuga

SEQ ID NO: 38278 - RNA, 2004 nt, Artificial Sequence
  derived and/or modified sequence opt1 from TUBGCP4__Homo_sapiens__NP_001273343
augauccacgagcugcuccuggcccugagcggcuaccccggguccaucuucaccuggaacaagcgcagcggccuccaggugucccaggacuucccguuccugcaccccagcgagaccuccguccugaaccggcucugccgccuggggacggacuacauccgguucaccgaguucaucgagcaguacaccggccacgugcagcagcaggaccaccaccccagccagcaggggcagggcggccugcacgggaucuaccuccgcgccuucugcaccggccuggacuccgugcugcagcccuaccggcaggcgcuccuggaccuggagcaggaguuccucggggacccgcaccugagcaucucccacgucaacuacuuccuggaccaguuccagcuccuguuccccagcgugaugguggucguggagcagaucaagucccagaagauccacggcugccagauccuggagacgguguacaagcacagcugcgggggccucccgcccguccgcuccgcccuggagaagauccuggccgugugccacggcgugauguacaagcagcucagcgccuggaugcugcacgggcugcuccuggaccagcacgaggaguucuucaucaagcagggccccuccagcgggaacgucuccgcccagcccgaggaggacgaggaggaccugggcaucggcgggcucaccggcaagcagcugcgggagcugcaggaccuccgccugaucgaggaggagaacaugcuggcgcccagccucaagcaguucucccugcggguggagauccugcccagcuacaucccggugcgcgucgccgagaagauccucuucgugggggagagcgugcagauguucgagaaccagaacgucaaccugacccggaagggcuccauccugaagaaccaggaggacaccuucgccgccgagcuccaccgccugaagcagcagccccuguucagccucguggacuucgagcaggucguggaccggauccgcuccacgguggcggagcaccuguggaagcugaugguggaggagagcgaccuccuggggcagcugaagaucaucaaggacuucuaccugcucggccggggcgagcuguuccaggccuucaucgacaccgcccagcacaugcugaagaccccgcccaccgccgucacggagcacgacgugaacgucgccuuccagcaguccgcgcacaaggugcuccuggacgacgacaaccugcucccccugcugcaccucaccaucgaguaccacgggaaggagcacaaggccgacgccacccaggcccgcgagggccccagccgggagaccagcccccgcgaggcccccgcguccgggugggccgcccugggccuguccuacaaggugcaguggccgcuccacauccuguucacgcccgccguccuggagaaguacaacgugguguucaaguaccuccugagcguccggcgcgugcaggccgagcugcagcacugcugggcgcuccagaugcagcggaagcaccugaaguccaaccagaccgacgccaucaaguggcgccugcgcaaccacauggccuuccucguggacaaccugcaguacuaccugcaggucgacgugcucgagagccaguucucccagcugcugcaccagaucaacagcacccgggacuucgaguccauccgccucgcccacgaccacuuccugagcaaccugcucgcccaguccuucauccugcugaagcccguguuccacugccucaacgagauccuggaccugugccacagcuucugcucccucgucagccagaaccuggggccccuggacgagcggggcgcggcccagcucagcauccuggugaagggcuucucccgccagagcucccuccuguucaagauccugagcuccgugcggaaccaccagaucaacagcgaccuggcccagcuccugcugcgccucgacuacaacaaguacuacacccaggccgggggcacgcugggguccuucggcauguga

SEQ ID NO: 38279 - RNA, 3075 nt, Artificial Sequence
  derived and/or modified sequence opt1 from TUBGCP5__Homo_sapiens__NP_001096080
auggcccgccacgggcccccguggagccggcuggacgcccagcaggagcgcgacgugcgggagcucguccgcggcguggcgggccugcaggacgaggccgaccccaacuuccagcuggcccucaacuucgccugguccaacuuccgguuccaccgcuuccuggacgugaacagccacaagaucgagaagaccaucgaggggaucuacgagaaguucgucauccacuccgaccugagcaaggccgcguccuggaagcggcucaccgaggaguuccugaacgcgccccugcccagcaucaaggagaucaagacggacgcccacuacuccauccucagccugcugcucugccuguccgacagcccguccaacagcuccuacguggagacgccccgcaacaaggagguggagaagaaggacgacuucgacuggggcaaguaccugauggaggacgaggagauggacaucgggcccuacauggacacccccaacuggagcgaggaguccgaggaggagaacgaccagcagccgcucagccgggaggacuccggcauccaggucgaccgcacgccccuggaggagcaggaccagaaccggaagcuggaccccugcaucagcuggaaggacgagcccgacgaccgcuccuggcucgagcaccacguggugcaccaguacuggaccgcccggccgagccaguucccccacagccugcaccuccacuccaaccuggccgccgucugggaccagcaccuguacagcuccgacccccuguacgugcccgacgaccgcgugcucgucaccgagacccaggugauccgggagacccuguggcugcucagcggcgugaagaagcuguucaucuuccagcugaucgacgggaaggucacggugcgcaacaacaucaucgugacccaccucacccacuccugccugcggagcguccuggagcagaucgccgccuacggccaggugguguuccgccuccaggaguucaucgacgaggucauggggcacuccagcgaguccaugcugccgggcagcggguccgugcccaagaaguccaccgaggcccccuuccggacguaccaggcguucaugugggcccuguacaaguacuucaucagcuucaaggaggagcucgccgagaucgagaagugcaucaucaacaacgacaccaccaucacccuggccaucguggucgacaagcuggcgccccgccucagccagcugaaggugcugcacaaggucuucuccacgggcguggccgaggugccgcccgacacccggaacgucgugcgcgccagccaccuccugaacacccuguacaaggccauccucgaguacgacaacgugggcgaggccuccgagcagaccgucagccugcuguucucccucuggguggagacggugcgccccuaccugcagaccgucgacgaguggaucgugcacgggcaccugugggacggcgcccgggaguucaucauccagcgcaacaagaacgugcccgucaaccaccgggacuucugguacgcgaccuacacccuguacagcgugagcgagaagacggagaacgaggagaagauguccgacaacgccagcgccuccagcggguccgaccagggcccgagcucccgccagcacaccauggugagcuuccucaagcccguccugaagcagaucaucauggccggcaaguccaugcagcugcucaagaaccugcagugcgccgagagcacgaccugccaggcgggggcccgggacgccgagcgcaagucccuguacacccucuuccuggagagcgugcagucccggcugcgccacggcgaggacagcacgccccaggugcucaccgagcagcaggccaccaaggagaaccugaugaagaugcaguccaucgcggagagccaccuggagcucgacgacguccacgacccccugcuggccaucaacuucgcccggauguaccucgagcaguccgacuuccacgagaaguucgccgggggcgacgugugcguggaccgcagcagcgaguccgugaccugccagaccuucgagcugacccugcggagcugccucuacccgcacaucgacaagcaguaccuggacugcugcgggaaccugaugcagacccucaagaaggacuaccgccuggucgaguaccugcaggccaugcggaacuucuuccucauggagggcggcgacaccauguacgacuucuacaccuccaucuucgacaagauccgcgagaaggagaccuggcagaacgugagcuuccugaacguccagcugcaggaggcgguggggcagcgguaccccgaggacuccagccgccucuccaucagcuucgagaacguggacaccgccaagaagaagcugcccguccacauccuggacggccucacccuguccuacaaggugccguggcccguggacaucgucaucagccuggagugccagaagaucuacaaccagguguuccuccugcugcuccagaucaagugggccaaguacucccuggacgugcuccuguucggggagcuggucagcacggccgagaagccccggcugaaggagggccucauccacgagcaggacaccguggcccaguucgggccccagaaggagccggugcgccagcagauccaccggauguuccugcugcgcgucaagcucaugcacuucgugaacucccugcacaacuacaucaugacccgcauccugcacagcaccggccucgaguuccagcaccagguggaggaggcgaaggaccuggaccagcugaucaagauccacuaccgguaccucuccacgauccacgaccgcugccugcugcgggagaaggucagcuucgugaaggaggccaucaugaaggugcucaaccuggcccugauguucgccgacggcuggcaggccgggcucggcaccuggcgcauggaguccaucgagaagauggagagcgacuucaagaacugccacauguuccuggucaccauccugaacaaggcggugugccggggguccuucccccacugcgaguacaucaugcucaaguacuucuaccugugcaucagccuguga

SEQ ID NO: 38280 - RNA, 5460 nt, Artificial Sequence
  derived and/or modified sequence opt1 from TUBGCP6__Homo_sapiens__NP_065194
auggccagcaucacccagcuguucgacgaccugugcgaggcccugcugcccgccgccaagacccaccucggccagcgcuccgugaaccggaagcgcgccaagcggagccugaagaaggucgccuacaacgcccuguucaccaaccucuuccaggacgagacccagcagcugcagcccgacauguccaagcugcccgcgcgcaacaagauccucaugcugagcuucgaccugcgggugggcggccucgggcccaaggccgaccgccuggaggagcugguggaggagcucgaggccgcccccugcugcccccugcuggaggucggcuccgugcucgaccugcuggugcagcucgcggggagcgggccgccccagguccugccccggaagcgcgacuacuuccugaacaacaagcacgugggccggaacgugcccuacuccggguacgacugcgacgaccucagcgucuucgagauggacgugcagucccugaucagccgcgaggagugccugugccacuccaugauccaggagacccuccaggugauggaggccgcccccggcaccgggcugcccaccgucggccuguucagcuucggggaccccugcggcgaccgguucgagcgcgacacccgggugucccucuucggcgcccuggugcacagccgcaccuacgacauggacguccggcuggggcucccgcccgugcccgacaacgccgaccuguccggccuggcgaucaaggugccgcccagcgucgaccagugggaggacgagggguuccaguccgccagcaaccucacccccgacucccagagcgagcccagcgugacgcccgacguggaccugugggaggccgcccugaccuacgaggccuccaagcgccggugcugggagcgcgucggcugcccgcccggccaccgggaggagcccuaccucaccgaggcggggcgcgacgccuucgacaaguucugccggcugcaccagggcgagcugcagcuccuggccgggggcgugcugcaggcgccccagcccgugcucgucaaggagugcgagcuggugaaggacguccugaacgugcucaucgggguggucagcgccaccuucucccugugccagcccgcgcaggccuucguggugaagcgcggcguccacgugagcggcgccucccccgagagcaucuccagccugcuguccgagguggccgaguacgggacgugcuacacccgccucagccacuucucccugcagcccguccuggacagccucuacuccaagggccugguguuccaggccuucaccagcgggcugcggcgcuaccuccaguacuaccgggcgugcgugcuguccaccccgcccacgcugagccuccugaccaucggcuuccuguucaagaagcucgggcgccagcugcgguaccuggccgagcucugcggcgucggcgccgugcugcccgggaccugcggcgggggcccgcgcgccgcguuccccaccggggugaagcugcucuccuaccuguaccaggaggcccugcacaacugcagcaacgagcacuaccccguccuccugucccugcucaagacgagcugcgagcccuacacccgguucauccacgacuggguguacagcggcguguuccgcgacgccuacggcgaguucaugauccaggucaaccacgaguaccuguccuuccgggacaagcuguacuggacccacggguacgugcucaucagcaaggagguggaggacugcgucccgguguuccugaagcacaucgcccacgacaucuacgugugcggcaagaccaucaaccugcucaagcugugcugcccccgccacuaccugugcugguccgacguccccgugccccggaucagcgugaucuucucccucgaggagcugaaggagaucgagaaggacugcgccgucuacguggggcgcauggagcggguggcgcgccacagcuccgucagcaaggaggagaaggagcugcggauggagaucgccaagcaggagcucaucgcccacgcccgcgaggccgcgucccgggugcugagcgcccuguccgaccgccagaugagcgagcggauggcccucgacgcccgcaagcgcgagcaguuccagcggcugaaggagcaguucgugaaggaccaggagcgccggcaggccgcgcgccaggaggagcuggacgacgacuucuccuacgcccgggagcuccgcgaccgggagcgccggcucaagucccuggaggaggagcucgagcgcaaggcccggcaggcccuggucgaccacuacuccaagcugagcgcggaggccgcccgccgggagcagaaggcccucuggcgcauccagcggcaccgccuggaguccgcccggcugcgcuuccuccuggaggacgagaagcacauccaggagaugcugaaggcggugagcgaggcccaccagccccaggagccgcccgacgugcuccugagcguccacccccaggugacguccccgggccccgagcaccccgagggcgggcagggcugcgacagcggguccgccgagcagcacagccccgccugggacggcuggaaccggccggggcugcucacgccccagccccugaagccccuggccgugggcgcgggcgggcgcggccuccagcaggccgagggggcccggccguucuccgacagccuguccaucggcgacuuccugcccgucgggcccggcgccgagcccagcgugcagaccggcauggugccgcuccuggaggucgcccugcagaccaucaaccucgaccugccgcccuccgcgccgggggaggcccccgccgccgcgagcacgcagcccucccgcccccaggaguacgacuucagcaccgugcugcgcccggccguggccaccucccccgcccccggcccccuccaggccgcggagugcagccugggguccagcggccugcagcucugggaggacuccugcgggaagauggacgccugcggcagcgccucccgggagacccugcugccgagccacccgccccgccgggccgcccucgaggagggcagcucccagcccacggagcgccuguucgggcaggucagcggcgggggccugccgaccggggacuacgcguccgagaucgcccccacccggccccgcuggaacacccacggccacgugagcgacgccuccauccgggugggcgagaacgucagcgacguggcccccacgcagccgcgcuggaacacccacgggcacguguccaacgccagcaucucccucggcgagagcgucuccgacguggcgcccacccggccccgcuggaacauccacgggcacgucagcaacgccuccauccgggugggcgagaacgugagcgacgucgcccccacccgcccgcgguggaacacccacggccacguguccaacgccagcauccgcgugggggagaacgucuccgacguggcccccacgcggccccgcuggaacacccacggccacgugagcgacgcguccaucagccugggggagagcgucuccgacauggcccccgcccggccgcgcuggaacacccacggccacgugagcgacgccuccaucagccugggggaguccgugagcgacauggcgcccacccggccccgcuggaacacgcacggccacgucuccgacaccagcauccgcgugggcgagaacguguccgacgucgcccccauccggagccgcugcaacacccacgggcacguguccgacgccagcaucucccucggcgagccggugagcgacgucguguccacccggccccgcuggaacacgcacgugcccaucccgccgccccacaugguccugggggcccugagccccgaggccgagccgaacacgccccggccccagcagagcccgcccggccacaccagccaguccgcgcucagccugggggcccagagcaccgugcuggacugcggcccccgccuccccguggaggucggccccucccugagcucccccagcuccgggugcggcgaggggagcaucuccgugggcgagaacgugagcgacgucgcccccacgcagcccugguggcccaacaccccgggggacuccgugagcgaggagcugggccccggccgguccggggacaccgaggaccucagccccaacuggccccugaacucccaggaggacaccgccgcccagagcuccccgggccgcggggaggaggcggaggccagcgccgccgaggcccagggcggcgagcaggcguaccuggccgggcucgccggccaguaccaccuggagcgguaccccgacuccuacgagagcauguccgagccgcccaucgcccaccuccugcgcccggugcucccccgggcguucgccuuccccgucgacccccaggugcagagcgccgccgacgagacggccgugcagcugagcgagcugcucacccugccgguccugaugaagcgcuccaucaccgcgccccucgccgcccacaucagccuggugaacaaggccgccguggacuacuucuucgucgagcugcaccucgaggcgcacuacgaggcccugcggcacuuccugcucauggaggacggggaguucgcccagucccugagcgaccuccuguucgagaagcugggcgccgggcagacccccggcgagcugcucaacccgcuggugcugaacuccgugcucagcaaggcccugcagugcucccugcacggcgacacgccccacgcgagcaaccucucccuggcccugaaguaccuccccgaggucuucgcccccaacgccccggacgugcugagcugccuggagcuccgcuacaagguggacuggccccugaacaucgucaucaccgaggggugccuguccaaguacagcggcguguucuccuuccuccugcagcugaagcucaugaugugggcgcugaaggacgugugcuuccaccugaagcggaccgcccuccugagccacauggccggguccguccaguuccgccagcugcagcuguucaagcacgagaugcagcacuucgugaaggugauccagggcuacaucgccaaccagauccugcacgucaccuggugcgaguuccgggcccgccuggcgacggugggggaccucgaggagauccagcgggcccacgccgaguaccugcacaaggccguguuccgcggccugcucaccgagaaggccgcgcccgucaugaacgugauccacagcaucuucucccugguccugaaguuccggagccagcucaucucccaggccuggggcccgcccgggggcccccgcggggccgagcaccccaacuucgcccugaugcagcagagcuacaacaccuucaaguacuacagccacuuccuguucaagguggugaccaagcucgucaaccgcggcuaccagccccaccuggaggacuuccugcuccggaucaacuucaacaacuacuaccaggacgccuga

SEQ ID NO: 38281 - RNA, 1686 nt, Artificial Sequence
  derived and/or modified sequence opt1 from TUB__Homo_sapiens__NP_003311
augggcgcccgcacgccccugccgagcuucuggguguccuucuucgccgagaccgggauccucuuccccggcgggacccccuggcccaugggcagccagcacuccaagcagcaccggaagccggggccccugaagcgcggccaccggcgcgaccggcgcaccacccggcgcaaguacuggaaggagggccgggagaucgcgcgcguccuggacgacgaggggcggaaccuccgccagcagaagcuggaccggcagcgcgcccugcucgagcagaagcagaagaagaagcggcaggagccccugauggugcaggccaacgccgacggccgcccccggagccgccgggcccgccaguccgaggagcaggcgccgcugguggagagcuaccucuccagcuccgggagcaccuccuaccagguccaggaggccgacagccuggccuccgugcagcugggcgccacgcggcccaccgcgcccgccagcgccaagcgcaccaaggccgccgcgaccgccgggggccagggcggggccgcccgcaaggagaagaagggcaagcacaaggggacguccggccccgccgcgcucgccgaggacaagagcgaggcccagggcccggugcagauccugaccgucgggcaguccgaccacgcccaggacgccggcgagaccgcggccgggggcggggagcggcccagcggccaggaccugcgcgccaccaugcagcggaagggcaucuccagcagcauguccuucgacgaggacgaggaggacgaggaggagaacagcuccagcuccagccagcucaacuccaacacgcgccccagcuccgccaccagccggaaguccgugcgcgaggccgcgagcgcccccuccccgaccgcccccgagcagcccguggacgucgaggugcaggaccuggaggaguucgcccugcggcccgcgccgcaggggaucaccaucaagugccgcaucacgcgggacaagaagggcauggaccgcgggauguaccccaccuacuuccuccaccuggaccgggaggacggcaagaagguguuccugcucgccgggcgcaagcggaagaaguccaagaccagcaacuaccugaucagcgucgaccccaccgaccugucccgcggcggcgacagcuacaucgggaagcuccgguccaaccugaugggcacgaaguucaccguguacgacaacggggugaacccccagaaggccagcagcuccacccuggagagcggcacccuccgccaggagcuggccgccgucugcuacgagacgaacgugcugggguucaagggcccgcggaagauguccgugaucguccccggcaugaacauggugcacgagcgcgugagcauccggccccgcaacgagcacgagacccuccuggcgcgcuggcagaacaagaacaccgaguccaucaucgagcugcagaacaagacccccgucuggaacgacgacacgcagagcuacgugcucaacuuccacgggcgggugacccaggccuccgucaagaacuuccagaucauccacggcaacgacccggacuacaucgugaugcaguucgggcgcgucgccgaggacguguucaccauggacuacaacuacccccugugcgcccugcaggccuucgcgaucgcccucagcuccuucgacagcaagcuggccugcgaguga

SEQ ID NO: 38282 - RNA, 1368 nt, Artificial Sequence
  derived and/or modified sequence opt1 from TUFM__Homo_sapiens__NP_003312
augaccaccauggccgccgcgacgcugcuccgcgccacgccccacuucagcggccuggccgccgggcggaccuuccugcuccagggccugcugcgccuccugaaggccccggcgcugccccuccugugccgggggcuggccguggaggccaagaagaccuacguccgcgacaagccccacgugaacgugggcaccaucgggcacgucgaccacggcaagaccacccucaccgccgcgaucacgaagauccuggccgagggcgggggcgccaaguucaagaaguacgaggagaucgacaacgcccccgaggagcgggcccgcgggaucaccaucaacgcggcccacguggaguacuccaccgccgcccggcacuacgcccacaccgacugcccgggccacgcggacuacgugaagaacaugaucacggggaccgcgccccuggacggcugcauccucgucguggccgccaacgacggccccaugccccagacccgcgagcaccuccugcuggcccggcagaucgggguggagcacgucgugguguacgucaacaaggccgacgccgugcaggacagcgagaugguggagcuggucgagcuggagauccgcgagcuccugaccgaguucggcuacaagggggaggagacgccggugaucgugggcuccgcccugugcgcccucgagggccgggaccccgagcuggggcucaagagcguccagaagcugcuggacgccguggacaccuacauccccgugcccgcgcgcgaccuggagaagccguuccuccugcccgucgaggccguguacuccgugcccggccgggggaccgucgugaccggcacgcuggagcgcgggauccucaagaagggcgacgagugcgagcugcugggccacagcaagaacauccggaccgucgugaccgggaucgagauguuccacaagucccucgagcgcgccgaggccggcgacaaccugggggcgcuggugcggggccucaagcgcgaggaccugcggcgcgggcuggucauggugaagcccggcagcaucaagccgcaccagaagguggaggcccaggucuacauccucuccaaggaggagggcgggcggcacaagcccuucgugagccacuucaugcccgugauguucucccugaccugggacauggccugccgcaucauccugcccccggagaaggagcucgccaugcccggcgaggaccugaaguucaaccugauccuccgccagcccaugauccuggagaaggggcagcgguucacgcugcgcgacggcaaccggaccaucgggaccggccuggucaccaacacgcucgccaugaccgaggaggagaagaacaucaaguggggcuga

SEQ ID NO: 38283 - RNA, 1098 nt, Artificial Sequence
  derived and/or modified sequence opt1 from TUFT1__Homo_sapiens__NP_001119809
augaacggcacccgcaacuggugcacccugguggacguccaccccgaggaccaggccgccgcggggcggaagacguacgccauggugagcucccacagcgccggccacucccucgccagcgagcugguggagucccacgacgggcacgaggagaucaucaaggucuaccugaagggccgcagcggggacaagaugauccacgagaagaacaucaaccagcucaaguccgaggugcaguacauccaggaggcccggaacugccugcagaagcugcgcgaggacaucagcuccaagcucgaccggaaccugggcgacagccugcaccgccaggagauccaggugguccucgagaagccgaacggcuucucccagagccccaccgcgcuguacuccagcccgcccgagguggacacgugcaucaacgaggacguggagucccugcggaagaccguccaggaccuccuggccaagcugcaggaggccaagcgccagcaccagagcgacugcguggccuucgaggugacccucucccgguaccagcgcgaggcggagcagagcaacgucgcccugcagcgggaggaggaccgcguggagcagaaggaggccgaggugggggagcugcagcggcgccuccugggcauggagaccgagcaccaggcccugcucgccaagguccgggagggggagguggcgcuggaggagcugcgcuccaacaacgccgacugccaggccgagcgggagaaggccgccacccucgagaaggagguggcgggccugcgcgagaagauccaccaccuggacgacaugcucaagagccagcagcggaagguccgccagaugaucgagcagcugcagaacagcaaggccgugauccaguccaaggacgccaccauccaggagcugaaggagaagaucgccuaccucgaggccgagaaccuggagaugcacgaccggauggagcaccugaucgagaagcagaucagccacgggaacuucuccacgcaggcgcgcgccaagaccgagaaccccggcagcauccgcaucuccaagccgcccagccccaagcccaugcccgugauccgggucguggagaccuga

SEQ ID NO: 38284 - RNA, 1470 nt, Artificial Sequence
  derived and/or modified sequence opt1 from TULP1__Homo_sapiens__NP_001276324
augccccugcgcgacgagacccuccgggaggugugggccagcgacuccggccacgaggaggagagccuguccccggaggcgccccgccggcccaagcagcgccccgccccggcccagcggcugcgcaagaagcggaccgaggcccccgagagccccugccccacgggguccaagccgcgcaagcccggcgaggaggaggaggaggaggaggacgaggaggacgaggaggaggaggccgaggagaagaaggagaagauccuccugccgcccaagaagccccugcgggagaaguccagcgccgaccucaaggagcgccgggcgaaggcccaggggccccgcggcgaccuggggagccccgacccgccgcccaagccccugcggguccgcaacaaggaggcccccgccggcgagggcaccaagaugcggaagaccaagaagaagggguccggcgaggcggacaaggaccccagcgggucccccgccagcgcccgcaagucccccgccgccauguuccucgugggcgaggggagccccgacaagaaggcgcugaagaagaagggcaccccgaagggcgcccggaaggaggaggaggaggaggaggaggccgccacggugaucaagaaguccaaccagaaggggaaggccaagggcaaggggaagaagaaggcgaaggaggagcgcgcccccagcccgcccgucgagguggacgagccccgggaguucgugcugcgccccgcgccccagggccggaccguccgcugccgccucacccgggacaagaagggcauggaccgcgggauguacccguccuacuuccugcaccuggacaccgagaagaagguguuccuccuggccggccggaagcgcaagcggagcaagacggccaacuaccugaucuccaucgaccccaccaaccucagccgcgggggcgagaacuucaucgggaagcugcggagcaaccugcucggcaaccgcuucaccguguucgacaacggccagaacccccagcggggguacuccaccaacgucgccagccugcgccaggagcuggccgccgugaucuacgagacgaacgugcucggcuuccgggggccccgccggaugaccgucaucaucccgggcauguccgccgagaacgagcgcgugcccauccggccccgcaacgccagcgacgggcugcuggugcgguggcagaacaagacccucgagucccugaucgagcugcacaacaagcccccggucuggaacgacgacagcggcuccuacacccucaacuuccagggccgcgugacgcaggcgagcgugaagaacuuccagaucguccacgccgacgaccccgacuacaucgugcugcaguucgggcggguggccgaggacgccuucacccuggacuaccgcuacccccucugcgcgcugcaggccuucgccaucgcccuguccagcuucgacggcaagcucgccugcgaguga

SEQ ID NO: 38285 - RNA, 1563 nt, Artificial Sequence
  derived and/or modified sequence opt1 from TULP2__Homo_sapiens__NP_003314
augagccaggacaacgacacccugaugcgcgacauccucggccacgagcuggccgccaugcggcugcagaagcucgagcagcagcgccggcuguucgagaagaagcagcgccagaagcggcaggagcugcucauggugcaggcgaaccccgacgccuccccguggcuguggcgcagcugccugcgggaggagcgccuccugggggaccggggccuggggaaccccuuccuccgcaagaaggucuccgaggcccaccuccccagcggcauccacuccgcccuggggaccgugagcugcggcggcgacgggcggggcgagcgcgggcugcccacgccgcggaccgaggccguguuccgcaaccugggccugcagucccccuuccucagcuggcugcccgacaacuccgacgcggagcuggaggaggucagcguggagaacggguccgugagcccgccgcccuucaagcagagcccccggauccgccggaagggcuggcaggcccaccagcgccccggcacccgggccgagggggaguccgacucccaggacaugggcgacgcccacaagagccccaacauggggcccaaccccggcauggacggcgacugcgucuacgagaaccucgcguuccagaaggaggaggaccuggagaagaagcgcgaggccuccgagagcaccgggacgaacuccagcgccgcccacaacgaggagcugagcaaggcccucaagggcgagggcgggaccgacuccgaccacaugcggcacgaggcgagccuggccauccgcucccccugcccggggcuggaggaggacauggaggccuacgugcuccgccccgcccugcccggcaccaugaugcagugcuaccugacccgggacaagcacggcguggacaagggccucuucccccuguacuaccuguaccucgagacgagcgacucccugcagcgcuuccugcucgccgggcggaagcgccggcgcagcaagaccuccaacuaccugaucagccuggacccgacccaccucucccgggacggggacaacuucgucggcaaggugcgcagcaacguguucuccaccaaguucacgaucuucgacaacggggucaaccccgaccgggagcaccugacccgcaacaccgcgcggauccgccaggagcugggcgccgugugcuacgagcccaacgugcucggcuaccuggggccccggaagaugaccgucauccugccgggcacgaacagccagaaccagcgcaucaacgugcagccccucaacgagcaggagucccugcugagccgguaccagcgcggggacaagcagggccuccugcugcugcacaacaagacccccuccugggacaaggagaacgggguguacacccucaacuuccacggccgggucacccgcgccagcgugaagaacuuccagaucguggaccccaagcaccaggagcaccugguccugcaguucggccggguggggccggacacguucaccauggacuucugcuuccccuucagcccccuccaggccuucuccaucugccuguccagcuucaacuga

SEQ ID NO: 38286 - RNA, 1506 nt, Artificial Sequence
  derived and/or modified sequence opt1 from TULP3__Homo_sapiens__NP_001153880
auggaggccagccgcugccggcugucccccagcggcgacuccguguuccacgaggagaugaugaagaugcgccaggccaagcucgacuaccagcggcugcugcucgagaagcgccagcggaagaagcgccuggagcccuucaugguccagcccaaccccgaggcgcggcugcgccgggccaagccccgcgccagcgacgagcagaccccgcucgugaacugccacacgccccacuccaacgugauccugcacgggaucgacggccccgccgccguccugaagcccgacgaggugcacgcgccgagcguguccagcuccgucguggaggaggacgccgagaacaccguggacaccgccagcaagcccgggcuccaggagcggcugcagaagcacgacaucuccgagagcgucaacuucgacgaggagaccgacggcaucucccagagcgccugccuggagcgccccaacuccgcgagcucccagaacagcaccgacacggggaccuccggcagcgccaccgccgcccagcccgccgacaaccuccugggcgacaucgacgaccuggaggacuucguguacagcccggcgccccagggggugaccguccggugccgcaucauccgggacaagcgcggcauggaccggggccucuuccccacguacuacauguaccuggagaaggaggagaaccagaagaucuuccugcucgccgcccgcaagcggaagaaguccaagaccgccaacuaccugaucagcaucgaccccguggaccugucccgcgagggggagagcuacguggggaagcuccgguccaaccugaugggcaccaaguucaccgucuacgaccgcggcaucugcccgaugaaggggcgcggccuggugggggccgcgcacacgcggcaggagcucgccgccaucagcuacgagaccaacgugcugggcuucaagggcccccgcaagauguccgucaucauccccgggaugacccugaaccacaagcagauccccuaccagccgcagaacaaccacgacagccuccugucccgguggcagaaccgcaccauggagaaccugguggagcuccacaacaaggcccccguguggaacagcgacacgcaguccuacguccugaacuuccggggccgcgugacccaggccagcgugaagaacuuccagaucguccacaagaacgaccccgacuacaucgugaugcaguucgggcgggucgcggacgacguguucacccuggacuacaacuacccccucugcgccgugcaggccuucggcaucgggcuguccagcuucgacaagugcauccagacccugcgcaugcaggagcucugcgagcugcaccggcagcaccacuccgccgccagccugguccaccgcacggugugccagcggugggugggccacccguggcgccuccugccccagaccucccugcucuggaccgaccugagcccgccgcccgucgugcccgcgccccaccagaucuccauguga

SEQ ID NO: 38287 - RNA, 2037 nt, Artificial Sequence
  derived and/or modified sequence opt1 from TULP4__Homo_sapiens__NP_001007467
auguacgccgccguggagcacggccccguccugugcagcgacuccaacauccucugccugagcuggaaggggcgcgugccgaaguccgagaaggagaagcccgugugccggcgccgguacuacgaggagggcuggcuggcgaccgggaacggccgcggggucgugggcgugaccuucacgagcucccacugccggcgcgaccggagcacgccccagcgcaucaacuucaaccuccggggccacaacuccgaggucgugcuggugcgcuggaacgagcccuaccagaagcuggcgaccugcgacgccgacgggggcaucuucgucuggauccaguacgaggggcgguggagcguggagcucgugaacgaccgcggcgcccaggucuccgacuucaccuggagccacgacgggacccaggcccugaucuccuaccgggacggcuucgugcuggugggcagcgucuccgggcagcgccacuggagcuccgagaucaaccucgagagccagaucacgugcggcaucuggaccccggacgaccagcagguccuguucgggaccgccgacggccaggugaucgugauggacugccacggccggaugcuggcccacgugcuccugcacgaguccgacggggugcugggcaugagcuggaacuaccccaucuuccucgucgaggacuccagcgagagcgacaccgacuccgacgacuacgccccgccccaggacgggcccgccgcguaccccauccccgugcagaacaucaagccccugcugaccgugagcuucaccuccggcgacaucagccucaugaacaacuacgacgaccuguccccgaccgucauccgcagcgggcugaaggagguggucgcccaguggugcacgcagggcgaccuccuggccguggccggcauggagcggcagacccagcugggggagcuccccaacggcccccugcugaaguccgccauggugaaguucuacaacguccgcggggagcacaucuucacccucgacacccuggugcagcggcccaucaucagcaucugcuggggccaccgcgacucccggcugcucauggcgagcgggccggcccuguacgugguccgcguggagcaccgcguguccagccugcagcuccugugccagcaggccaucgccuccacgcugcgggaggacaaggacgucagcaagcucacccugccgccccgccugugcuccuaccucagcaccgccuucauccccaccaucaagccgcccauccccgaccccaacaacaugcgggacuucguguccuaccccagcgcgggcaacgagcgccugcacugcacgaugaagcggaccgaggacgaccccgaggugggcgggcccugcuacacccuguaccucgaguaccugggcgggcugguccccauccucaagggccgccggaucuccaagcugcgcccggaguucgugaucauggacccccggaccgacagcaagcccgacgagaucuacgggaacagccugaucuccacggugaucgacagcugcaacugcuccgacagcuccgacaucgagcucagcgacgacugggccgccaagaaguccccgaagaucagccgcgccuccaagagccccaagcugccccggaucuccaucgaggcccgcaagagccccaagcugccgcgggcggcccaggagcugucccgcagcccccggcucccccugcgcaagcccuccgucggcagcccgucccugacccggcgcgaguuccccuucgaggacaucacccagcacaacuaccucgcccaggugaccagcaacaucuggggcacgaaguucaagaucguggggcuggccgccuuccugcccaccaaccucggcgcggucaucuacaagaccagccugcugcaccuccagccccggcagaugaccaucuaccugccggaggugcgcaagaucuccauggacuacaucaaccugcccguguucaaccccaacgucuucagcgaggacgaggacgaccuccccggggacgccguguggacggacuga

SEQ ID NO: 38288 - RNA, 639 nt, Artificial Sequence
  derived and/or modified sequence opt1 from TUSC1__Homo_sapiens__NP_001004125
augggccccauguggcgcaugcgcgggggcgccacccggcgggggagcugcugcggcggggacggcgccgcggacggccgcgggccgggccgguccgggcgcgcccggggcgggggcagccccuccggcgggggcgggggcgugggcuggcgcgggcgggccgacggcgcccgccagcagcuggaggagcgguucgccgaccucgcggccagccaccuggaggccauccgcgcccgggacgagugggaccgccagaacgcgcggcugcgccaggagaacgcccggcuccgccuggagaaccggcgccugaagcgggagaaccgcucccucuuccgccaggcccugcggcugcccggggagggcgggaacggcacccccgccgaggcccgccgggucccggaggaggcgagcacgaaccgccgggcccgcgacuccggccgggaggacgagcccgggagcccccgcgcccuccgggcccgccuggagaagcuggaggccauguaccggcgcgcgcuccugcagcugcaccucgagcagcggggcccccgcccguccggggacaaggaggagcagccccugcaggagcccgacagcggccugcggucccgcgacagcgagcccuccgggccguggcucuga

SEQ ID NO: 38289 - RNA, 333 nt, Artificial Sequence
  derived and/or modified sequence opt1 from TUSC2__Homo_sapiens__NP_009206
augggcgccagcggguccaaggcccgcggccuguggcccuucgcgagcgccgccgggggcgggggcuccgaggccgccggcgcggagcaggcccucgugcggccgcgcgggcgggccgucccgcccuucguguucacccgccggggcagcauguucuacgacgaggacggggaccuggcccacgaguucuacgaggagaccaucgugacgaagaacggccagaagcgcgcgaagcugcggcgcguccacaagaaccucaucccccaggggaucgugaagcuggaccacccccggauccacguggacuuccccgucauccuguacgagguguga

SEQ ID NO: 38290 - RNA, 1047 nt, Artificial Sequence
  derived and/or modified sequence opt1 from TUSC3__Homo_sapiens__NP_006756
augggcgcccgcggggcccccagccggcgccggcaggcgggccgccggcugcgcuaccuccccaccggguccuuccccuuccugcugcuccugcugcuccugugcauccagcugggcgggggccagaagaagaaggagaaccuccuggccgagaagguggagcagcugauggaguggagcucccggcgcagcaucuuccggaugaacggcgacaaguuccgcaaguucaucaaggccccgccccggaacuacuccaugaucgucauguucaccgcccuccagccccagcgccagugcagcgugugccggcaggccaacgaggaguaccagauccuggcgaacuccuggcgcuacagcuccgccuucugcaacaagcuguucuucagcaugguggacuacgacgaggggacggacgucuuccagcagcucaacaugaacuccgcccccaccuucaugcacuucccgcccaagggccggcccaagcgcgccgacaccuucgaccugcagcggaucggguucgcggccgagcagcuggccaaguggaucgccgaccgcaccgacgugcacauccggguguuccgcccgcccaacuacagcggcacgaucgcccucgcgcugcuggucucccucgucgggggccugcuguaccuccggcgcaacaaccuggaguucaucuacaacaagaccggcugggccauggugagccugugcaucguguucgccaugaccuccgggcagauguggaaccacauccgcggcccgcccuacgcccacaagaacccccacaacggccaggugagcuacauccacggguccagccaggcccaguucguggcggagucccacaucauccucguccugaacgccgccaucaccaugggcauggugcugcucaacgaggccgccacgagcaagggggacgugggcaagcggcgcaucaucugccuggucgggcugggccucgugguguucuucuucagcuuccugcuguccaucuuccggagcaaguaccacggguaccccuacuccgaccucgacuucgaguga

SEQ ID NO: 38291 - RNA, 534 nt, Artificial Sequence
  derived and/or modified sequence opt1 from TUSC5__Homo_sapiens__NP_758955
auggcccaccccgugcagagcgaguucccguccgcccaggagcccggcagcgcggccuuccuggaccuccccgagauggagauccugcugaccaaggccgagaacaaggacgacaagacccucaaccuguccaagacgcugagcgggccccucgaccuggagcagaacucccagggccugccguucaaggccaucagcgaggggcaccucgaggcgccccugccccgcucccccagccgggccuccagccgccgggccuccagcaucgccaccaccuccuacgcccaggaccaggaggcgccgcgcgacuaccugauccucgccgucguggccugcuucugccccguguggccccugaaccugaucccccucaucaucagcaucaugucccggagcuccaugcagcagggcaacgucgacggggcccgccggcugggccgccuggcccggcuccugagcaucacccugaucaucaugggcaucgugaucaucaugguggcggucacggugaacuucaccgugcagaagaaguga

SEQ ID NO: 38292 - RNA, 2739 nt, Artificial Sequence
  derived and/or modified sequence opt1 from TUT1__Homo_sapiens__NP_073741
augagccugcccaucggcuccgccgagguggccagcgagcgcgucgagcucuggcgguccggguuccgcugguggcagcggugccugugcuucugccgcuaccggcgcguggcgauggccgccguggacagcgacgucgagucccugccgcggggcggguuccgcugcugccucugccacgugaccaccgccaaccggcccagccuggacgcccaccugggcgggcgcaagcaccggcaccucguggagcugcgcgcggcccggaaggcccagggccugcgcuccgucuucgugagcggcuucccccgggacguggacuccgcccagcucagcgaguacuuccuggcguucgggcccgucgccuccguggugauggacaaggacaagggcgucuucgccaucguggagaugggggacgugggcgcccgcgaggccguccugagccagucccagcacagccucgggggccaccggcugcgcgugcggccgcgcgagcagaaggaguuccagucccccgcgagcaagucccccaagggcgccgcccccgacagccaccagcuggccaaggcccucgcggaggccgccgacgugggggcccagaugaucaagcuggucggccugcgggagcucuccgaggccgagcgccagcugcgcagccuggugguggcgcucaugcaggaggucuucacggaguucuucccggggugcguggugcaccccuucggcagcuccaucaacagcuucgacguccacggcugcgaccuggaccuguuccucgaccugggggaccuggaggagccccagcccgugccgaaggcccccgagucccccagccucgacuccgcccuggccagcccccuggacccgcaggcccucgcgugcacccccgccuccccgcccgacagccagccgcccgccagcccccaggacuccgaggcccuggacuucgagacccccuccagcucccuggcgccccagacccccgacagcgcccucgccuccgagacgcuggccagcccccagucccugcccccggccagcccccuccuggaggaccgggaggagggcgaccuggggaaggcguccgagcucgccgagacccccaaggaggagaaggccgagggcgccgccaugcuggagcuggucgggagcauccuccgcggcugcgugccgggcguguaccggguccagaccgugcccagcgcgcgccggcccguggucaaguucugccaccgccccuccgggcugcacggcgacgugagccuguccaaccggcucgcccugcacaacagccgcuuccugucccucugcagcgagcuggacgggcgggugcgcccgcuggucuacacccugcggugcugggcccagggccgcgggcucuccggcagcggcccccugcuguccaacuacgcccucacgcugcuggugaucuacuuccuccagacccgggacccgcccgugcugcccaccgucagccagcugacccagaaggccggggagggcgagcaggucgagguggacgggugggacugcuccuucccccgcgacgcgagccggcucgagcccuccaucaacguggagccccugagcucccugcucgcccaguucuucagcugcguguccugcugggaccugcgcggcagccugcucagccugcgggaggggcaggcccugccgguggccggcggccuccccuccaaccugugggaggggcugcgccucggcccccugaaccugcaggaccccuucgaccucagccacaacgucgcggccaacgugacgucccggguggccgggcgccugcagaacugcugccgcgccgccgcgaacuacugccggagccugcaguaccagcgccgguccagccgcggccgggacuggggccuccugccgcugcuccagcccuccagccccuccagccugcuguccgccacccccaucccgcucccccuggcccccuucacccagcugaccgccgcccucguccagguguuccgcgaggcgcuggggugccacaucgagcaggccacgaagcggacccgcagcgagggcgggggcaccggggaguccagccagggcggcaccuccaagcggcugaagguggacgggcagaagaacugcugcgaggagggcaaggaggagcagcaggggugcgccggcgacgggggcgaggaccgcgucgaggagauggugaucgaggugggcgagaugguccaggacugggccaugcagagccccgggcagccgggcgaccucccccugacgaccgggaagcacggcgcccccggggaggagggccagccgucccacgcggcccuggccgagcggggccccaaggggcacgaggccgcgcaggaguggagccagggcgaggccgggaagggcgccucccuccccagcagcgccuccuggcgcugcgcccuguggcaccggguguggcaggggcgccggcgcgcgcggcgccggcugcagcagcagaccaaggagggcgccggcgggggcgccgggacccgcgccggcuggcucgccacggaggcccaggugacccaggagcugaagggccugagcgggggcgaggagcggcccgagaccgagccgcuccuguccuucgucgcgagcgugucccccgccgaccgcaugcugaccgugacgccccuccaggacccccaggggcuguucccggaccugcaccacuuccuccaggucuuccugccccaggccauccgccaccugaaguga

SEQ ID NO: 38293 - RNA, 618 nt, Artificial Sequence
  derived and/or modified sequence opt1 from TVP23B__Homo_sapiens__NP_057162
augcugcagcaggacagcaacgacgacaccgaggacgugucccucuucgacgccgaggaggagaccacgaaccgcccccggaaggccaagauccgccacccggucgcgagcuucuuccaccuguucuuccggguguccgccaucaucguguaccugcucugcggccugcugagcuccagcuucaucacgugcauggucaccaucauccuccugcuguccugcgacuucugggccgugaagaacgugaccgggcgccucauggucggccugcggugguggaaccacaucgacgaggacggcaagagccacuggguguucgagucccgcaaggagagcucccaggagaacaagaccgugagcgaggccgagucccggaucuucuggcuggggcucaucgccugccccguccugugggugaucuucgcguucagcgcccuguucuccuuccgcgugaaguggcucgccgucgugaucaugggggugguccugcagggcgccaaccuguacggcuacauccggugcaaggugcgcagccggaagcaccucaccuccauggcgaccagcuacuucgggaagcaguuccugcgccagaacaccggcgacgaccagacguccuga

SEQ ID NO: 38294 - RNA, 1074 nt, Artificial Sequence
  derived and/or modified sequence opt1 from TWF1__Homo_sapiens__NP_001229326
augagccaccagaccggcauccaggccuccgaggacgugaaggagaucuucgcccgcgcgcggaacgggaaguaccgccugcucaagaucagcaucgagaacgagcagcuggucaucggcuccuacagccagcccuccgacagcugggacaaggacuacgacuccuucgugcugccgcuccuggaggacaagcagcccugcuacauccuguuccggcucgacagccagaacgcccagggguacgaguggaucuucaucgccuggucccccgaccacagccacgugcgccagaagaugcuguacgccgccacccgggcgacgcugaagaaggaguucggcgggggccacaucaaggacgaggucuucggcaccgugaaggaggacgugucccuccacggguacaagaaguaccugcugagccaguccagccccgccccgcucaccgccgccgaggaggagcugcgccagaucaagaucaacgagucccccgaggaccacaucggcguccagaccgacguggggguggacacgaagcaccagacccugcagggcgucgcguuccccaucagccgggaggccuuccaggcccucgagaagcugaacaaccgccagcugaacuacgugcagcucgagaucgacaucaagaacgagaucaucauccuggccaacaccaccaacacggagcugaaggaccuccccaagcggaucccgaaggacuccgcccgcuaccacuucuuccuguacaagcacagccacgagggggacuaccuggaguccaucguguucaucuacagcaugcccggcuacacgugcagcauccgggagcgcaugcucuacuccagcugcaagucccggcugcuggagaucgucgagcgccagcuccagauggacgugauccggaagaucgagaucgacaacggcgacgagcugaccgcggacuuccuguacgaggaggugcaccccaagcagcacgcccacaagcagagcuucgccaagcccaaggggccggccggcaagcgcgggauccggcgccucauccggggccccgccgagaccgaggcgaccaccgacuga

SEQ ID NO: 38295 - RNA, 609 nt, Artificial Sequence
  derived and/or modified sequence opt1 from TWIST1__Homo_sapiens__XP_011513798
augaugcaggacgugagcuccagccccgucuccccggccgacgacagccuguccaacagcgaggaggagcccgaccgccagcagccgcccuccggcaagcgcgggggccggaagcggcgcagcucccggcgcagcgccgggggcggggcgggccccggcggggccgccggcgggggcgucgggggcggcgacgagcccgggucccccgcccagggcaagcgggggaagaaguccgccggcugcggcgggggcgggggcgccgggggcggcgggggcagcagcuccgggggcgggagcccccaguccuacgaggagcuccagacccagcgcgugauggcgaacgugcgggagcgccagcggacccagagccugaacgaggccuucgccgcgcugcgcaagaucaucccgacgcuccccuccgacaagcugagcaagauccagacccugaagcucgccgcccgguacaucgacuuccuguaccaggugcugcagagcgacgagcucgacuccaagauggccagcugcuccuacguggcccacgagcgccugagcuacgcguucuccgucuggcggauggagggcgccuggagcauguccgccagccacuga

SEQ ID NO: 38296 - RNA, 483 nt, Artificial Sequence
  derived and/or modified sequence opt1 from TWIST2__Homo_sapiens__NP_001258822
auggaggagggcagcuccagccccguguccccggucgacagccuggggaccuccgaggaggagcucgagcgccagcccaagcgguucggccgcaagcggcgcuacagcaagaaguccagcgaggacgggucccccacccccggcaagcgggggaagaagggcagcccguccgcccagagcuucgaggagcugcagucccagcgcauccuggccaacgugcgggagcgccagcggacgcagagccucaacgaggcguucgccgcccugcgcaagaucauccccacccugcccuccgacaagcucagcaagauccagacccugaagcuggccgcccgguacaucgacuuccucuaccaggugcugcaguccgacgagauggacaacaagaugaccagcugcuccuacgucgcgcacgagcgccugagcuacgccuucagcguguggcggauggagggcgccugguccaugagcgccucccacuga

SEQ ID NO: 38297 - RNA, 672 nt, Artificial Sequence
  derived and/or modified sequence opt1 from TWSG1__Homo_sapiens__NP_065699
augaagcugcacuacguggccguccucacccuggccauccugauguuccucaccuggcugcccgagagccuguccugcaacaaggcgcucugcgccagcgacguguccaagugccugauccaggagcugugccagugccgcccgggcgaggggaacugcagcugcugcaaggagugcaugcucugccugggcgcccugugggacgagugcugcgacugcguggggaugugcaacccccggaacuacuccgacacgccgcccaccagcaaguccaccgucgaggagcuccacgagcccauccccagccuguuccgcgcccugaccgagggcgacacgcagcucaacuggaacaucguguccuuccccguggccgaggagcugagccaccacgagaaccuggucuccuuccucgagaccgugaaccagccccaccaccagaacgugagcgucccguccaacaacgugcacgcgcccuacagcuccgacaaggagcacaugugcaccguggucuacuucgacgacugcaugagcauccaccagugcaagaucuccugcgagagcaugggggccuccaaguaccggugguuccacaacgccugcugcgagugcaucggccccgagugcaucgacuacggcagcaagaccgugaagugcaugaacugcauguucuga

SEQ ID NO: 38298 - RNA, 1584 nt, Artificial Sequence
  derived and/or modified sequence opt1 from TXK__Homo_sapiens__NP_003319
augauccugagcuccuacaacaccauccagagcguguucugcugcugcugcugcugcuccguccagaagcgccagaugcggacccagaucagccucuccacggacgaggagcugcccgagaaguacacccagcgccggcgcccguggcugagccagcucuccaacaagaagcagagcaacaccggccgggugcagcccuccaagcgcaagccccugcccccgcugccgcccagcgagguggccgaggagaagauccaggucaaggcccucuacgacuuccugccccgggagcccugcaaccuggcgcuccgccgggccgaggaguaccugauccuggagaaguacaacccccacugguggaaggcccgcgaccggcucgggaacgagggccugauccccuccaacuacgugaccgagaacaagaucacgaaccuggagaucuacgagugguaccaccgcaacaucacccggaaccaggccgagcaccuccugcgccaggagagcaaggagggggccuucaucgugcgggacucccgccaccugggcagcuacaccaucuccgucuucaugggggcgcggcgcagcaccgaggccgccaucaagcacuaccagaucaagaagaacgacuccggccagugguacguggccgagcggcacgcguuccagagcauccccgagcucaucugguaccaccagcacaacgccgccggccugaugacgcgccugcgguacccgguggggcucaugggcuccugccugcccgccaccgccggguucagcuacgagaagugggagaucgaccccagcgagcuggcguucaucaaggagaucggcuccgggcaguucggcgucgugcaccucggcgaguggcgcagccacauccagguggccaucaaggccaucaacgagggguccaugagcgaggaggacuucaucgaggaggccaaggucaugaugaagcugucccacagcaagcuggugcagcucuacggcgugugcauccagcgcaagccccuguacaucgucaccgaguucauggagaacgggugccugcucaacuaccugcgggagaacaagggcaagcugcgcaaggagaugcuccuguccgugugccaggacaucugcgagggcauggaguaccuggagcggaacggguacauccaccgcgaccucgccgcgcggaacugccuggugagcuccacgugcaucgucaagaucagcgacuucggcaugacccgcuacgugcuggacgacgaguacguguccagcuucggggccaaguucccgaucaagugguccccgcccgaggucuuccucuucaacaaguacagcuccaagagcgacgugugguccuucggcgugcugaugugggaggucuucaccgaggggaagaugcccuucgagaacaagagcaaccuccagguggucgaggccaucuccgagggcuuccggcuguaccgcccccaccuggcccccaugagcaucuacgaggugauguacagcugcuggcacgagaagcccgagggccggcccaccuucgccgagcugcuccgcgcggugaccgagaucgccgagacgugguga

SEQ ID NO: 38299 - RNA, 1191 nt, Artificial Sequence
  derived and/or modified sequence opt1 from TXLNG__Homo_sapiens__NP_001162154
auggccacccgcguggaggaggccgcgcggggccgcgggggcggggccgaggaggccaccgaggccggccgcgggggccggcggcgcagcccccggcagaagcuggaggagucccgcagcguccagaagcagaugaagauccuccagaagaagcaggcccagaucgugaaggagaaggugcaccuccaguccgagcacagcaaggcgauccuggcccgguccaagcuggagagccugugccgcgagcugcagcggcacaacaagacgcucaaggaggagaacaugcagcaggcccgcgaggaggaggagcggcgcaaggaggccaccgcgcacuuccagaucacccugaacgagauccaggcccagcuggagcagcacgacauccacaacgccaagcuccggcaggagaacaucgagcugggcgagaagcugaagaagcucaucgagcaguacgcccugcgcgaggagcacaucgacaaggucuucaagcacaaggagcugcagcagcagcucguggacgccaagcugcagcagaccacgcagcugaucaaggaggcggacgagaagcaccagcgggagcgcgaguuccuccugaaggaggccaccgagucccggcacaaguacgagcagaugaagcagcaggaggugcagcugaagcagcagcucagccuguacauggacaaguucgaggaguuccagaccaccauggccaaguccaacgagcuguucacgaccuuccgccaggagauggagaagaugaccaagaagaucaagaagcucgagaaggagaccaucaucuggcggacgaagugggagaacaacaacaaggcccugcugcagauggccgaggagaagaccguccgcgacaaggaguacaaggcgcuccagaucaagcuggagcgccuggagaagcucugccgggcccugcagaccgagcgcaacgagcugaacgagaagguggaggugcucaaggagcaggucagcaucaaggccgccaucaaggccgcgaaccgggaccuggccaccccggugaugcagcccugcacggcccuggacucccacaaggagcucaacaccagcuccaagcgcgcccugggggcccaccuggaggcggagcccaagagccagcgguccgccgugcagaagcccccgagcaccggcuccgcccccgccaucgagagcgucgacuga

SEQ ID NO: 38300 - RNA, 594 nt, Artificial Sequence
  derived and/or modified sequence opt1 from TXN2__Homo_sapiens__XP_005261565
auguacgugcccccgcgcggcagcgacgaccggcgcgcccuggaccggcagggcgggcucgggugcgccucccugcgcagccacugccgggagauggcgcagcgccugcuccugcggcgcuuccuggccuccgucaucagccggaagcccucccagggccaguggccgccccucaccagccgcgcccugcagacgccccagugcucccccgggggccugaccgugacccccaaccccgcccggaccaucuacaccacgcgcaucagccucaccaccuucaacauccaggacggcccggacuuccaggaccggguggucaacuccgagacccccgugguggucgacuuccacgcccaguggugcgggcccugcaagauccugggcccccgccuggagaagaugguggcgaagcagcacgggaagguggucauggccaagguggacaucgacgaccacacggaccucgccaucgaguacgaggugagcgccgucccgaccgugcuggcgaugaagaacggcgacguggucgacaaguucguggggaucaaggacgaggaccagcuggaggccuuccucaagaagcugaucggcuga

SEQ ID NO: 38301 - RNA, 1083 nt, Artificial Sequence
  derived and/or modified sequence opt1 from TXNDC15__Homo_sapiens__NP_078991
auggugcccgccgccggccgccggccgccccgcgucaugcggcugcucgggugguggcagguccugcugugggugcucggccugcccguccgcgggguggagguggcggaggagagcggccggcugugguccgaggagcagcccgcccacccgcuccaggucggggccguguaccugggcgaggaggagcugcuccacgaccccaugggccaggaccgcgccgccgaggaggcgaacgccgugcuggggcuggacacccagggcgaccacauggucaugcucagcgugauccccggggaggccgaggacaagguguccagcgagcccuccggcgugaccugcggggccggcggcgcggaggacagccggugcaacgugcgcgagucccuguucagccuggacggggccggcgcccacuucccggaccgggaggaggaguacuacacggagcccgagguggccgaguccgacgccgcgcccaccgaggacagcaacaacaccgagucccucaagagccccaaggucaacugcgaggagcgcaacaucaccgggcuggagaacuucacgcugaagauccucaacaugucccaggaccugauggacuuccugaacccgaacggcagcgacugcacccucgugcuguucuacacccccuggugccgguucuccgccagccuggcgccccacuucaacucccucccccgcgccuucccggcccugcacuuccuggcccucgacgccagccagcacuccagccugagcacccgguucggcacgguggccguccccaacauccuccuguuccagggggccaagcccauggcccgcuucaaccacaccgaccggacccuggagacccugaagaucuucaucuucaaccagacgggcaucgaggcgaagaagaacgugguggucacccaggccgaccagaucgggccccucccguccacccugaucaagagcguggacuggcugcucguguucucccuguucuuccugaucagcuucaucauguacgccaccauccgcacggaguccauccgguggcucauccccggccaggagcaggagcacgucgaguga

SEQ ID NO: 38302 - RNA, 2478 nt, Artificial Sequence
  derived and/or modified sequence opt1 from TXNDC16__Homo_sapiens__NP_065835
auguucagcggcuucaacguguuccgcgucgggaucuccuucgugaucaugugcaucuucuacaugcccaccgugaacagccugccggagcucagcccccagaaguacuucuccacccugcagcccggcaaggccucccuggccuacuucugccaggcggacagcccccggacguccgucuuccucgaggagcugaacgaggccgugcgcccgcugcaggacuacgggaucagcguggccaaggucaacugcgugaaggaggagaucucccgguacugcggcaaggagaaggaccucaugaaggccuaccuguucaaggggaacauccugcuccgcgaguuccccaccgacacccuguucgacgugaacgccaucgucgcgcacgugcuguucgcccuccuguucagcgaggugaaguacaucaccaaccuggaggaccuccagaacaucgagaacgcccugaagggcaaggccaacaucaucuucuccuacguccgggcgaucggcauccccgagcaccgcgccgugauggaggccgccuucguguacgggacgaccuaccaguucguccugaccaccgagaucgcccuccuggagagcaucggcuccgaggacguggaguacgcgcaccuguacuucuuccacugcaagcucgugcuggaccugacgcagcagugccggcgcacccucauggagcagccccugaccacccugaacauccaccucuucaucaagacgaugaaggccccgcugcugaccgaggucgccgaggacccccagcaggucagcaccgugcaccuccagcuggggcugccccucguguucaucgugucccagcaggccaccuacgaggccgaccggcgcacggcggaguggguggccuggcggcugcugggcaaggccgggguccuccugcugcuccgcgacagccuggaggugaacaucccccaggacgccaacgucguguucaagcgggccgaggagggcgugccggucgaguuccuggugcuccacgacguggaccugaucaucucccacgucgagaacaacaugcacaucgaggagauccaggaggacgaggacaacgacauggagggccccgacaucgacgugcaggacgacgagguggcggagaccgucuuccgcgaccggaagcgcaagcugccccucgagcugaccguggagcugaccgaggagacguucaacgccaccgugauggccagcgacuccaucguccucuucuacgccggguggcaggccgugagcauggcguuccugcagagcuacaucgacguggccgucaagcugaagggcaccuccaccaugcugcucacgcggaucaacugcgccgacuggagcgacgugugcaccaagcagaacgugaccgaguuccccaucaucaagauguacaagaagggggagaacccggucuccuacgccggcaugcugggcaccgaggaccugcucaaguucauccagcugaaccgcaucagcuaccccgugaacaucacguccauccaggaggcggaggaguaccugagcggggagcucuacaaggaccugauccuguacuccagcguguccguccucggccuguucagccccaccaugaagaccgccaaggaggacuucuccgaggccgggaacuaccugaagggcuacgugaucaccgggaucuacagcgaggaggacgugcuccugcuguccacgaaguacgccgccagccuccccgcgcugcugcucgcccggcacaccgagggcaagaucgaguccaucccgcuggccagcacccacgcccaggacaucguccagaucaucaccgacgcccugcucgagauguuccccgagaucacgguggagaaccugcccuccuacuuccgccugcagaagccccuccugauccuguucagcgacggcaccgugaacccgcaguacaagaaggcgauccucacccuggucaagcagaaguaccuggacuccuucacccccugcuggcucaaccugaagaacacccccguggggcggggcauccugcgcgccuacuucgacccccucccgccccugccccugcucgugcuggucaaccugcacagcgggggccagguguucgccuucccgagcgaccaggccaucaucgaggagaaccucgugcuguggcugaagaagcucgaggccgggcuggagaaccacaucacgauccugcccgcgcaggaguggaagccgccccuccccgccuacgacuuccuguccaugaucgacgccgccaccagccagcgcggcacccggaagguccccaagugcaugaaggagaccgacgugcaggagaacgacaaggagcagcacgaggacaaguccgcggugcgcaaggagcccaucgagacgcugcggaucaagcacuggaaccgcagcaacugguucaaggaggccgagaaguccuuccggcgcgacaaggagcucggcugcagcaaggucaacuga

SEQ ID NO: 38303 - RNA, 372 nt, Artificial Sequence
  derived and/or modified sequence opt1 from TXNDC17__Homo_sapiens__NP_116120
auggcccgcuacgaggaggugagcgucuccggcuucgaggaguuccaccgggccguggagcagcacaacgggaagaccaucuucgcguacuucaccggcagcaaggacgccgggggcaaguccuggugccccgacugcgugcaggccgagccggucgugcgcgaggggcucaagcacaucagcgagggcugcguguucaucuacugccaggucggcgagaagcccuacuggaaggaccccaacaacgacuuccggaagaaccucaaggugacggccgugcccacccugcugaaguacgggaccccgcagaagcucgucgaguccgagugccugcaggccaaccugguggagaugcuguucagcgaggacuga

SEQ ID NO: 38304 - RNA, 975 nt, Artificial Sequence
  derived and/or modified sequence opt1 from TXNDC5__Homo_sapiens__NP_001139021
auggaggacgccaagguguacgucgccaagguggacugcaccgcgcacagcgacgugugcuccgcccagggcguccgcggguaccccacccugaagcuguucaagccgggccaggaggccgugaaguaccaggggccccgggacuuccagacgcucgagaacuggaugcugcagacccucaacgaggagcccgugacccccgagccggaggucgagccgcccagcgcccccgagcugaagcagggccuguacgagcucuccgccagcaacuucgagcugcacguggcgcagggggaccacuucaucaaguucuucgcccccuggugcggccacugcaaggcccuggcccccaccugggagcagcucgcgcugggccuggagcacuccgagacggugaagaucgggaaggucgacugcacccagcacuacgagcucugcagcggcaaccaggugcgcggguaccccacccugcugugguuccgggacggcaagaagguggaccaguacaaggggaagcgcgaccucgagucccugcgggaguacgucgagagccagcugcagcgcaccgagacgggcgccaccgagaccgugacccccuccgaggccccggugcucgccgccgagcccgaggcggacaagggcacgguccuggcccugaccgagaacaacuucgacgacaccaucgccgaggggaucaccuucaucaaguucuacgcccccuggugcggccacugcaagacgcucgcccccaccugggaggagcugagcaagaaggaguucccggggcuggcgggcgugaagaucgccgagguggacugcaccgccgagcggaacaucugcuccaaguacagcguccgcggcuaccccacccuccugcuguuccgcgggggcaagaagguguccgagcacagcgggggccgggaccucgacucccugcaccgguucgugcugagccaggccaaggacgagcucuga

SEQ ID NO: 38305 - RNA, 258 nt, Artificial Sequence
  derived and/or modified sequence opt1 from TXN__Homo_sapiens__NP_001231867
auggugaagcagaucgagagcaagaccgccuuccaggaggcccuggacgcggccggcgacaagcucgucgugguggacuucuccgccaccuggugcgggcccugcaagaugaucaagccguucuuccacgacgucgccagcgagugcgaggugaagugcaugcccacguuccaguucuucaagaagggccagaaggugggggaguucuccggcgccaacaaggagaagcuggaggcgaccaucaacgagcuggucuga

SEQ ID NO: 38306 - RNA, 870 nt, Artificial Sequence
  derived and/or modified sequence opt1 from TXNL1__Homo_sapiens__NP_004777
auggugggcgucaagcccguggggagcgacccggacuuccagcccgagcuguccggcgccgggagccgccucgccguggucaaguucaccaugcggggcugcgggcccugccugcgcaucgcgcccgccuucuccagcauguccaacaaguacccgcaggccguguuccuggagguggacguccaccagugccagggcaccgccgccacgaacaacaucagcgcgacccccaccuuccucuucuuccggaacaaggugcgcaucgaccaguaccagggcgccgacgccguggggcuggaggagaagaucaagcagcaccuggagaacgaccccggcuccaacgaggacaccgacauccccaagggguacauggaccucaugccguucaucaacaaggccggcugcgagugccugaacgagagcgacgagcacggguucgacaacugccugcggaaggacacgaccuuccucgaguccgacugcgacgagcagcugcugaucaccgucgcguucaaccagcccgugaagcucuacagcaugaaguuccagggccccgacaacggccaggggcccaaguacgugaagaucuucaucaaccugccgcgcuccauggacuucgaggaggccgagcggagcgagcccacccaggcccuggagcucacggaggacgacaucaaggaggacggcaucgucccccugcgcuacgugaaguuccagaacgugaacuccgucaccaucuucgugcagagcaaccagggggaggaggagaccacccggaucuccuacuucacguucaucggcacccccgugcaggccaccaacaugaacgacuucaagcgcgucgugggcaagaagggggagagccacuga

SEQ ID NO: 38307 - RNA, 1017 nt, Artificial Sequence
  derived and/or modified sequence opt1 from TXNRD2__Homo_sapiens__NP_001269441
auggccgccauggcgguggcccugcgcggccucgggggccgguuccgcuggcggacccaggccgucgccgggggcgugcgcggggccgcgcggggcgccgccgccggccagcgcgacuacgaccugcugguggucgggggcgggagcggcgggcucgcgugcgccaaggaggccgcccagcugggccggaagguggccguggucgacuacguggagcccuccccgcagggcacccgcugggggcugggcgggacgugcgugaacgucggcugcauccccaagaagcucaugcaccaggcggcccugcugggcgggcucauccaggacgcccccaacuacggcugggagguggcccagcccgugccgcacgacuggcggaagauggccgaggcgguccagaaccacgucaagagccugaacugggggcaccgcgugcagcugcaggaccggaaggugaaguacuucaacaucaaggccuccuucguggacgagcacaccgugugcggcgucgccaagggcgggaaggagauccuccugagcgccgaccacaucaucaucgccaccggcgggcgcccccgguaccccacccacaucgagggcgcgcuggaguacgggaucacguccgacgacaucuucuggcucaaggagagccccggcaagacccugguggugggggccuccuacgucgcccuggagugcgccggcuuccucaccggcaucgggcuggacaccacgaucaugaugcgcagcaucccgcugcggggcuucgaccagcagauguccagcauggugaucgagcacauggccucccacgggacccgcuuccuccggggcugcgcgcccagccgcgugcggcgccugcccgacgggcagcugcaggucaccugggaggacuccaccacgggcaaggaggacaccggcaccuucgacaccgugcucugggccaucgcccccugcaucagcgccugccugccgacgaccgucgggcacgcgggcaagaaccagcggcgcgacuga

SEQ ID NO: 38308 - RNA, 402 nt, Artificial Sequence
  derived and/or modified sequence opt1 from TXNRD3NB__Homo_sapiens__NP_001034872
augcgcgaccugagcgagcggcgccucggccagcccgagcugaaggccgagcagcagaugccgcuggagcccgugcgggcccgccucuccgucgggcuggcgugcugcugcagccacaccaccgccgaggccuccagccuggagcacggcgacaagguguucgggcagggcuuccccagcccccucgaggagaucaagcggcugcugaagaucucccgcgcccuccaggcccgguccgugccgagcacgcaggagaaggcgaagugccuguccggggagcccggccagcccgagggcaaggggcaggagaccuaccccggcccggggaaggucgagggcaaggccgagcccgccaugcgcaaggacgacgugugccccgggaugaagugcaucagcggcuga

SEQ ID NO: 38309 - RNA, 3564 nt, Artificial Sequence
  derived and/or modified sequence opt1 from TYK2__Homo_sapiens__XP_011526547
augccccugcgccacuggggcauggcccgggggagcaagccggugggcgacggggcccagcccauggcggccaugggcgggcucaagguccugcugcacugggccggccccggcgggggcgagcccugggugaccuucuccgagagcucccucaccgccgaggaggugugcauccacaucgcccacaaggucgggaucacgccgcccugcuucaaccuguucgcgcuguucgacgcccaggcccagguguggcucccgcccaaccacauccuggagaucccccgcgacgccagccugaugcucuacuuccggauccgcuucuacuuccggaacuggcacggcaugaacccccgcgagcccgcgguguaccggugcgggcccccgggcaccgaggccuccagcgaccagaccgcccagggcaugcagcugcuggaccccgccuccuucgaguaccucuucgagcaggggaagcacgaguucgucaacgacguggccagccugugggagcuguccaccgaggaggagauccaccacuucaagaacgagagccucggcauggcguuccugcaccugugccaccucgcccugcgccacgggaucccccuggaggagguggccaagaagacguccuucaaggacugcaucccccggagcuuccgccggcacauccgccagcacuccgcccucacccggcugcgccugcggaacgucuuccgccgguuccuccgcgacuuccagccgggccggcugagccagcagauggugauggugaaguaccuggccacccucgagcgccuggcgccccgguucggcaccgagcgcguccccgugugccaccuccgccugcuggcccaggccgagggggagcccugcuacauccgggacuccggcguggccccgacggaccccgggcccgagagcgccgcggggcccccgacccacgagguccuggugaccgggaccggcggcauccagugguggcccguggaggaggaggucaacaaggaggagggguccagcggcuccagcgggcgcaacccccaggccagccucuucggcaagaaggccaaggcccacaaggccguggggcagcccgcggaccggccgcgcgagccccugugggccuacuucugcgacuuccgggacaucacgcacgugguccugaaggagcacugcguguccauccaccgccaggacaacaagugccucgagcugagccugcccucccgggccgccgcgcucagcuucgugucccuggucgacggcuacuuccgccugaccgccgacagcucccacuaccucugccacgagguggccccgccccggcuggucaugagcauccgcgacggcauccacgggccccugcucgagcccuucgugcaggccaagcugcggccggaggacggccuguaccucauccacugguccaccagccaccccuaccgccugauccugaccguggcccagcggucccaggcgcccgacgggaugcagagccugcgccuccggaaguuccccaucgagcagcaggacggcgccuucguccuggagggguggggccgcuccuucccgagcgugcgggagcugggcgccgcccuccaggggugccugcugcgcgccggcgacgacugcuucucccuccggcgcugcugccugccccagcccggggagacgagcaaccugaucaucaugcgcggcgcgcgggccagcccccgcacccucaaccugucccagcuguccuuccaccggguggaccagaaggagaucacccagcucagccaccugggccaggggacccgcacgaacgucuacgagggccggcugcgcguggaggggagcggcgacccggaggaggggaagauggacgacgaggacccccucgugcccggccgggaccgcggccaggagcugcgggucgugcugaaggugcucgaccccucccaccacgacaucgcccuggccuucuacgagaccgccagccugaugucccaggucagccacacccaccucgcguucgugcacggggugugcguccgcggcccggagaacaucauggugaccgaguacguggagcacgggccccuggacgucuggcugcggcgcgagcggggccacgugcccauggccuggaagaugguggucgcccagcagcucgccuccgcgcugagcuaccuggagaacaagaaccucgugcacgggaacgugugcggccgcaacauccugcuggcccggcucggccuggccgaggggacgucccccuucaucaagcugagcgacccgggcgucgggcucggcgcccugucccgcgaggagcggguggagcgcauccccuggcuggcccccgagugccuccccgggggcgcgaacagccuguccaccgccauggacaaguggggcuucggggccacccugcucgagaucugcuucgacggcgaggccccgcugcagagccggucccccagcgagaaggagcacuucuaccagcgccagcaccggcugcccgagccguccugcccccagcucgccacccugacgagccagugccugaccuacgagcccacccagcgccccuccuuccgcaccauccuccgggaccugacgcgccugcagccgcacaaccucgcggacgugcugaccgucaaccccgacagccccgccagcgaccccaccguguuccacaagcgguaccugaagaagauccgcgaccucggggagggccacuucgggaaggugucccuguacugcuacgacccgaccaacgacggcacgggcgagauggucgccgugaaggcccugaaggccgacugcgggccccagcaccggagcggcuggaagcaggagaucgacauccuccgcacccuguaccacgagcacaucaucaaguacaaggggugcugcgaggaccagggcgagaagucccugcagcucgugauggaguacgucccccugggcagccugcgggacuaccucccccgccacuccaucgggcuggcgcagcugcuccuguucgcccagcagaucugcgagggcauggccuaccugcacgcccagcacuacauccaccgggaccucgcggcccgcaacgugcugcuggacaacgaccggcucgugaagaucggggacuucggccuggccaaggccgucccggaggggcacgaguacuaccgcgugcgggaggacggcgacagccccguguucugguacgcccccgagugccugaaggaguacaaguucuacuacgcguccgacgucuggagcuucggcgugacccucuacgagcugcugacccacugcgacuccagccaguccccgcccaccaaguuccucgagcugaucgggaucgcccagggccagaugacggugcugcgccucaccgagcugcuggagcggggcgagcgccucccccggcccgacaagugccccugcgaggucuaccaccugaugaagaacugcugggagaccgaggccagcuuccgcccgaccuucgagaaccugauccccauccucaagacggugcacgagaaguaccagggccaggcccccuccguguucagcgucugcuga

SEQ ID NO: 38310 - RNA, 1449 nt, Artificial Sequence
  derived and/or modified sequence opt1 from TYMP__Homo_sapiens__NP_001107227
auggccgcccugaugacccccggcaccggggcgccgcccgcccccggcgacuucagcggggagggcucccaggggcuccccgacccgagccccgagcccaagcagcugcccgagcugauccgcaugaagcgggacggcggccgccucuccgaggccgacauccggggguucguggccgccgucgugaacggcagcgcgcagggggcccagaucggcgccaugcugauggccauccgccugcgggggauggaccucgaggagacguccgugcugacccaggcgcuggcccagagcggccagcagcucgaguggccggaggccuggcgccagcagcuggucgacaagcacuccaccggcggggugggcgacaaggugagccugguccucgcccccgcccuggcggccugcgggugcaaggugcccaugaucuccggccggggccuggggcacaccggcgggacgcucgacaagcuggagagcauccccggcuucaacgugauccaguccccggagcagaugcagguccugcucgaccaggccgggugcugcaucgugggccagagcgagcagcuggugcccgccgacggcauccuguacgccgcgcgcgacgucaccgccaccguggacucccucccccugaucaccgccagcauccuguccaagaagcucguggaggggcugagcgcccuggucguggacgugaaguucggcggggccgcggucuuccccaaccaggagcaggcccgggagcucgccaagacgcuggugggcgugggggccucccugggccuccgcgucgccgcggcccugaccgccauggacaagccgcugggccggugcguggggcacgcccucgagguggaggaggcgcugcugugcauggacggcgccgggccgcccgaccuccgcgaccuggucaccacccugggcggggcccuccuguggcugagcggccacgccggcacgcaggcccagggggcggcccggguggccgccgcccucgacgacggcuccgcgcuggggcgcuucgagcggaugcuggccgcccagggcgucgaccccggccucgcccgcgcccugugcagcgggagccccgcggagcggcgccagcugcucccccgggcccgcgagcaggaggagcugcuggcccccgccgacggcaccguggagcuggugcgggcgcucccccuggcccugguccuccacgagcugggggccggccgcucccgcgccggggagccgcugcggcucggcgugggcgccgagcugcugguggacgucgggcagcgccuccggcgcggcacccccuggcugcgggugcaccgcgacgggcccgcgcugagcggcccccagucccgggcccuccaggaggcccuggugcugagcgaccgcgccccguucgccgcgcccucccccuucgccgagcucguccugccgccccagcaguga

SEQ ID NO: 38311 - RNA, 942 nt, Artificial Sequence
  derived and/or modified sequence opt1 from TYMS__Homo_sapiens__NP_001062
augcccguggccggcagcgagcugccgcgccggccccucccgcccgccgcgcaggagcgcgacgccgagccccggccgccccacggggagcugcaguaccugggccagauccagcacauccuccgcugcgggguccggaaggacgaccgcaccggcaccgggacgcuguccguguucggcaugcaggcccgguacagccugcgcgacgaguucccccuccugaccaccaagcggguguucuggaagggcguccuggaggagcuccugugguucaucaagggguccaccaacgccaaggagcugagcuccaagggcgugaagaucugggacgccaacgggagccgcgacuuccucgacucccugggcuucagcacgcgggaggagggggaccugggccccguguacggcuuccaguggcgccacuucggggcggaguaccgggacauggaguccgacuacagcggccagggggucgaccagcuccagcgcgugaucgacaccaucaagaccaaccccgacgaccggcgcaucaucaugugcgccuggaacccccgggaccugccccugauggcccucccgcccugccacgcccugugccaguucuacguggucaacuccgagcugagcugccagcucuaccagcgcuccggcgacaugggccugggggugcccuucaacaucgcgagcuacgcccugcucaccuacaugaucgcccacaucacgggccugaagcccggggacuucauccacacccugggcgacgcccacaucuaccucaaccacaucgagccgcugaagauccagcugcagcgggagccccgccccuuccccaagcuccggauccugcgcaagguggagaagaucgacgacuucaaggccgaggacuuccagaucgagggguacaacccgcaccccaccaucaagauggagauggcggucuga

SEQ ID NO: 38312 - RNA, 1590 nt, Artificial Sequence
  derived and/or modified sequence opt1 from TYR__Homo_sapiens__NP_000363
augcugcucgccgugcuguacugccugcucuggagcuuccagaccuccgccggccacuucccccgcgcgugcgucagcuccaagaaccugauggagaaggagugcugcccgcccuggagcggggaccggucccccugcggccagcugagcgggcgcggcuccugccagaacauccuccugagcaacgcgccccuggggccgcaguuccccuucaccggcguggacgaccgggaguccuggcccagcguguucuacaaccgcacgugccagugcuccggcaacuucaugggguucaacugcggcaacugcaaguucggguucuggggccccaacugcaccgagcggcgccuccugguccggcgcaacaucuucgaccugagcgccccggagaaggacaaguucuucgccuaccucacccuggccaagcacaccaucuccagcgacuacgugauccccaucgggacguacggccagaugaagaacggcuccacccccauguucaacgacaucaacaucuacgaccuguucguguggaugcacuacuacgucagcauggacgcccuccucgggggcuccgagaucuggcgggacaucgacuucgcccacgaggcccccgccuuccugccguggcaccgccuguuccugcugcggugggagcaggagauccagaagcucaccggggacgagaacuucaccauccccuacugggacuggcgcgacgcggagaagugcgacaucugcacggacgaguacaugggcggccagcaccccaccaaccccaaccugcugagcccggccuccuucuucagcagcuggcagaucgugugcucccggcucgaggaguacaacagccaccagucccugugcaacgggacccccgagggcccccugcgccggaaccccgggaaccacgacaagagccgcaccccgcggcuccccuccagcgccgacguggaguucugccugucccugacgcaguacgagagcggcuccauggacaaggccgccaacuucagcuuccgcaacacccucgagggguucgcgagcccccugaccggcaucgccgacgccucccaguccagcaugcacaacgcccugcacaucuacaugaacggcaccaugucccagguccaggggagcgccaacgaccccaucuuccuccugcaccacgcguucguggacuccaucuucgagcaguggcugcggcgccaccggccgcuccaggagguguaccccgaggccaacgcccccaucggccacaaccgcgagagcuacaugguccccuucaucccgcuguaccgcaacggggacuucuucaucuccagcaaggaccugggcuacgacuacagcuaccuccaggacuccgaccccgacagcuuccaggacuacaucaaguccuaccuggagcaggccagccggaucugguccuggcugcucggggccgcgauggugggcgccgugcugacggcccugcucgccggccuggucagccugcucugccgccacaagcggaagcagcugcccgaggagaagcagccgcugcugauggagaaggaggacuaccacucccucuaccagagccaccuguga

SEQ ID NO: 38313 - RNA, 2673 nt, Artificial Sequence
  derived and/or modified sequence opt1 from TYRO3__Homo_sapiens__NP_006284
auggcccugcgccggagcaugggccgccccgggcucccgccccugccccugcccccgccgccccggcucggccugcugcucgccgcgcuggccucccugcuccugcccgagagcgccgccgccgggcugaagcucaugggcgcgcccgugaagcugaccgucucccaggggcagcccgugaagcugaacugcagcguggagggcauggaggagcccgacauccagugggucaaggacggcgccguggugcagaaccucgaccagcuguacauccccgucuccgagcagcacuggaucggguuccugagccucaaguccguggagcgcagcgacgccggccgguacuggugccagguggaggacgggggcgagaccgagaucucccagccggucuggcugacgguggagggggugcccuucuucaccgucgagcccaaggaccuggccgugcccccgaacgcgcccuuccagcucagcugcgaggccgugggcccgcccgagcccgucaccaucgugugguggcgcggcaccacgaagaucgggggccccgcccccucccccagcgugcugaacgucaccggggugacccaguccaccauguucagcugcgaggcccacaaccugaagggccucgccuccagccggacggcgaccgugcaccuccaggcccugccggccgcccccuucaacaucaccgucaccaagcuguccagcuccaacgccagcguggcguggaugcccggcgccgacgggcgcgcccugcugcagagcugcacggugcaggucacccaggcccccggcgggugggaggugcucgccgucguggugccggucccgcccuucacgugccugcugcgggaccucgugcccgcgaccaacuacucccugcgcgugcggugcgccaacgcccugggccccagccccuacgccgacuggguccccuuccagaccaaggggcucgccccggcguccgcgccccagaaccugcacgccauccgcaccgacagcggccugauccucgagugggaggaggugauccccgaggcgccccuggagggcccgcuggggcccuacaagcucuccugggugcaggacaacggcacccaggacgagcugaccgucgaggggacgcgggccaaccugaccggcugggacccccagaaggaccucaucgugcgcgugugcgucagcaacgccguggggugcggccccuggucccagccgcugguggucagcucccacgaccgggccggccagcaggggccgccccacagccgcaccuccugggugcccgugguccugggcgugcucaccgcccuggugacggccgccgcccuggcccugauccuccugcggaagcgccggaaggagacccgcuucgggcaggccuucgacagcgucauggcccggggcgagcccgcggugcacuuccgcgccgcccgcuccuucaaccgggagcgccccgagcggaucgaggccacccuggacagccucgggaucuccgacgagcugaaggagaagcuggaggacgugcucauccccgagcagcaguucacccugggccgcaugcugggcaagggggaguucggcagcguccgggaggcccagcucaagcaggaggacggguccuucgugaagguggcggucaagaugcugaaggccgacaucaucgccagcuccgacaucgaggaguuccugcgcgaggccgcgugcaugaaggaguucgaccacccccacguggccaagcucgugggcgucagccugcggagccgcgccaagggccggcugccgauccccauggugauccuccccuucaugaagcacggggaccugcacgccuuccugcucgccucccgcaucggcgagaaccccuucaaccugccgcugcagacgcucauccgguucaugguggacaucgcgugcgggauggaguaccugagcucccgcaacuucauccaccgggaccuggccgcccgcaacugcaugcucgccgaggacaugaccgucugcguggccgacuucggccugagccggaagaucuacuccggggacuacuaccgccagggcugcgcgagcaagcugcccgugaaguggcucgcccuggagucccuggccgacaaccucuacaccguccagagcgacgugugggccuucggcgugaccaugugggagaucaugacgcgggggcagacccccuacgccggcaucgagaacgcggagaucuacaacuaccugaucgggggcaaccgccugaagcagccgcccgagugcauggaggacgucuacgaccucauguaccagugcugguccgccgaccccaagcagcggcccagcuucacgugccugcgcauggagcuggagaacauccucgggcagcuguccgugcugagcgccucccaggacccgcucuacaucaacaucgagcgcgccgaggagcccaccgcgggcggcagccuggagcugcccgggcgggaccagcccuacuccggcgccggggacggcagcgggaugggcgccgugggcgggaccccguccgacugccgcuacauccucacccccggcgggcuggccgagcagcccggccaggccgagcaccagcccgagagcccgcugaacgagacccagcggcuccugcugcuccagcaggggcugcugccccacagcuccugcuga

SEQ ID NO: 38314 - RNA, 309 nt, Artificial Sequence
  derived and/or modified sequence opt1 from TYROBP__Homo_sapiens__NP_001166985
augggcgggcuggagcccugcagccgccuccugcugcucccgcugcugcucgccguguccgacugcagcugcuccaccgucagccccggcgugcuggccgggaucgugaugggcgaccugguccucaccgugcugaucgcgcuggccguguacuuccucgggcggcuggucccccgcggccggggcgccgccgaggccgcgacgcgcaagcagcggaucaccgagaccgagucccccuaccaggagcugcaggggcagcgcagcgacguguacuccgaccucaacacccagcggccguacuacaaguga

SEQ ID NO: 38315 - RNA, 1614 nt, Artificial Sequence
  derived and/or modified sequence opt1 from TYRP1__Homo_sapiens__NP_000541
augagcgcccccaagcugcucucccugggcugcaucuucuucccgcugcuccuguuccagcaggcccgcgcgcaguucccccggcagugcgccaccguggaggcccugcgcagcgggaugugcugccccgaccucucccccgucagcggcccggggaccgaccggugcggcuccagcuccgggcgcggccggugcgaggccgugacggccgacagccgcccccacagcccccaguacccccacgacggccgggacgaccgcgagguguggccgcugcgguucuucaaccggaccugccacugcaacgggaacuucuccggccacaacugcgggaccugccgccccggcuggcgcggggcggccugcgaccagcggguccugaucgugcgccggaaccuccuggaccuguccaaggaggagaagaaccacuucgugcgcgcccucgacauggccaagcggaccacgcacccccuguucgucaucgcgacccgccggagcgaggagauccugggccccgacggcaacaccccgcaguucgagaacaucuccaucuacaacuacuucguguggacccacuacuacagcgugaagaagacguuccucggggucggccaggaguccuucggggagguggacuucagccacgagggccccgccuuccugaccuggcaccgcuaccaccuccugcggcuggagaaggacaugcaggagaugcugcaggagcccuccuucagccuccccuacuggaacuucgccaccggcaagaacgugugcgacaucugcaccgacgaccugauggggucccgcagcaacuucgacagcacgcugaucuccccgaacagcgucuucucccaguggcgcguggugugcgacagccucgaggacuacgacacccugggcacccugugcaacuccaccgaggacgggcccauccggcgcaaccccgccggcaacgucgcccggcccauggugcagcgccucccggagccccaggacguggcgcagugccuggaggucgggcuguucgacacgccgcccuucuacagcaacuccaccaacagcuuccggaacaccguggagggcuacuccgaccccaccggcaaguacgaccccgccgugcgcagccuccacaaccuggcccaccuguuccucaacgggacgggcgggcagacccaccugucccccaacgaccccaucuucguccugcuccacaccuucaccgacgccguguucgacgaguggcugcggcgcuacaacgccgacaucagcacguucccgcuggagaacgcgcccaucggccacaaccggcaguacaacauggugcccuucuggccgcccgucaccaacaccgagauguucgugaccgcccccgacaaccucggguacacguacgagauccaguggcccucccgcgaguucagcgucccggagaucaucgccaucgccguggugggcgcccugcugcucgucgcgcugaucuucggcaccgccuccuaccugauccgggcccgccggagcauggacgaggccaaccagccccuccugaccgaccaguaccagugcuacgccgaggaguacgagaagcugcagaaccccaaccaguccgugguguga

SEQ ID NO: 38316 - RNA, 1197 nt, Artificial Sequence
  derived and/or modified sequence opt1 from TYSND1__Homo_sapiens__NP_001035363
augcgccggcaguggggcagcgccaugcgcgccgccgagcaggccgggugcaugguguccgccagccgggccggccagcccgaggccgggccgugguccugcagcggcgucauccugucccgcagccccgggcucgugcugugccacggcggcaucuucgugcccuuccugcgggcgggguccgagguccucaccgccgccggcgccguguuccugcccggggacagcugccgcgacgaccugcggcuccacgugcagugggcgccgaccgccgccggccccgggggcggcgccgagcgcgggcggcccggccugugcacgccccagugcgccucccuggagccggggccgcccgcgcccagccgcggccggccccuccagccccgccugcccgccgagcugcuccugcugcucuccugccccgccuucugggcccacuucgcccggcuguucggcgacgaggcggccgagcaguggcgcuucagcuccgccgcccgggacgacgaggucagcgaggacgaggaggccgaccagcugcgcgcgcucgggugguucgcccugcugggcgugcggcucgggcaggaggagguggaggaggagcgcggcccggccauggccgucagcccccugggggccgugcccaagggcgcgccccugcucgugugcggcuccccguucggggccuucugccccgacaucuuccugaacacccuguccugcggcguccucagcaacguggccgggccccugcugcucaccgacgcccggugccugcccggcaccgagggcgggggcguguucacggcgcgcccggccggggcccuggucgcccucgugguggcgccccugugcuggaaggccggcgagugggucggguucacccugcucugcgccgccgcgccccuguuccgggccgcccgcgacgcccugcaccgccucccccacuccaccgccgcccuggccgcgcugcucccgcccgaggugggcgugcccugggggcugccgcugcgggacagcggcccccucugggccgccgccgcgguccugguggagugcggcaccgugugggggagcggcgucgccguggcgccccgccuggucgugacgugccggcacgugagcccccgcgaggccgcccggguccucgugcgcuccaccaccccgaagcacaaccaccagcagcaccccgggcaguga

SEQ ID NO: 38317 - RNA, 1833 nt, Artificial Sequence
  derived and/or modified sequence opt1 from TYW1B__Homo_sapiens__XP_011514532
auggaccccagcgccgacaccugggaccuguccagcccgcucaucucccuguggaucaaccgcuucuacaucuaccugggcuucgccgugagcaucucccucuggaucugcguccagaucgugaucgagaugcagggguucgcgaccgugcuggccgaggccgucacgagccuggaccuccccguggccaucaucaaccugaaggaguacgaccccgacgaccaccugaucgaggaggugaccuccaagaacgucugcguguuccucguggccaccuacaccgacggccugcccacggagagcgcggagugguucugcaaguggcuggaggaggccuccaucgacuuccgguucgggaagaccuaccucaagggcaugcgcgacgccgucuucgggcugggcaacagcgccuacgcgucccacuucaacaaggugggcaagaacguggacaaguggcuguggaugcucgggguccaccgggugaugagccgcggcgagggggacugcgacguggucaaguccaagcacggcagcaucgaggccaacuuccgggccuggaagaccaaguucaucucccagcugcaggcccugcagaagggggagcgcaagaaguccugcggcggccacugcaagaaggggaagugcgagagccaccagcacggcagcgaggagcgggaggaggggucccaggagcaggacgagcuccaccaccgcgacaccaaggaggaggagccguucgagagcagcuccgaggaggaguucggcggcgaggaccaccagagccugaacuccaucguggacguggaggaccuggggaagaucauggaccacgucaagaaggagaagcgggagaaggagcagcaggaggagaaguccggccucuuccgcaacauggggcggaacgaggacggcgagcgccgggccaugaucacgcccgcgcugcgcgaggcccugaccaagcaggucgacgcgccccgggagcgcagccuccugcagacccacauccuguggaacgagagccaccggugcauggagaccacgcccucccucgccugcgccaacaagugcguguucugcugguggcaccacaacaacccgguggggaccgaguggcuguggaagauggaccagcccgagaugauccugaaggaggccaucgagaaccaccagaacaugaucaagcaguucaagggcgugcccggcgugaaggccgagcgcuucgaggaggggaugaccgucaagcacugcgcccucagccuggugggcgagcccaucauguacccggagaucaaccgguuccugaagcuccugcaccagugcaagaucuccagcuuccuggucaccaacgcccaguuccccgccgagauccgcaaccucgagcccgugacgcagcuguacguguccgucgacgcgagcaccaaggacucccugaagaagaucgaccggccccucuucaaggacuucuggcagcaguuccuggacagccugaaggcccucgccgugaagcagcagcgcaccguguaccgccugaugcuggucaaggccuggaacguggacgagcuccaggccuacgcgcagcuggugucccuggggaacccggacuucaucgaggucaagggcgugaccuacugccgggagagcuccgccagcucccucacgauggcccacgugcccuggcacgaggaggucgugcaguucgugcgcgagcuggucgaccugauccccgaguacgagaucgccugcgagcacgagcacagcaacugccugcucaucgcgcaccggaaggaccuggggcgccugccccgggccgaggacgagggccacgugagcuga

SEQ ID NO: 38318 - RNA, 504 nt, Artificial Sequence
  derived and/or modified sequence opt1 from U2AF1__Homo_sapiens__NP_001020375
augcaggagcacuacgacgaguucuucgaggagguguucaccgagauggaggagaaguacggcgaggucgaggagaugaacgugugcgacaaccugggggaccaccucgugggcaacgucuacgugaaguuccgccgggaggaggacgccgagaaggccgugaucgaccugaacaaccgcugguucaacgggcagcccauccacgcggagcugagcccggucaccgacuuccgggaggccugcugccgccaguacgagaugggcgagugcacgcgcgggggcuucugcaacuucaugcaccucaagcccaucucccgggagcugcggcgcgagcuguacggccggcgccggaagaagcaccgcagccggucccgcagccgggagcgccggucccgcagccgggaccgcgggcggggcgggggcgggggcggcgggggcgggggcggcgggcgcgagcgcgaccggcgccggucccgcgaccgggagcgcagcggccgguucuga

SEQ ID NO: 38319 - RNA, 1416 nt, Artificial Sequence
  derived and/or modified sequence opt1 from U2AF2__Homo_sapiens__NP_001012496
augagcgacuucgacgaguucgagcgccagcugaacgagaacaagcaggagcgggacaaggagaaccgccaccggaagcgcucccacagccggucccgcagccgggaccgcaagcggcgcucccggagccgcgaccggcgcaaccgggaccagcgcuccgccagccgggaccgccggcgccgguccaagccccucacccgcggcgccaaggaggagcacgggggccugauccgcagcccgcggcacgagaagaagaagaaggugcgcaaguacugggacgucccgccgcccggguucgagcacaucacccccaugcaguacaaggcgaugcaggccgccggccagauccccgccacggcccugcuccccaccaugacccccgacgggcuggcggugacccccacgcccgugcccgucgugggcucccagaugacccggcaggcccgccggcuguacgugggcaacauccccuucgggaucaccgaggaggccaugauggacuucuucaacgcccagaugcgccucggcgggcugacccaggcgccgggcaaccccguccuggccgugcagaucaaccaggacaagaacuucgccuuccucgaguuccggagcguggacgagacgacccaggccauggccuucgacgggaucaucuuccagggccagucccugaagauccgccggccccacgacuaccagccccugccgggcaugagcgagaaccccuccgucuacgugcccgggguggucagcaccguggugcccgacuccgcgcacaagcuguucaucggcgggcugccgaacuaccugaacgacgaccaggucaaggagcuccugaccagcuucggcccccugaaggccuucaaccucgugaaggacuccgccacgggccugagcaagggguacgccuucugcgaguacguggacaucaacgucaccgaccaggccaucgcgggccugaacgggaugcagcucggcgacaagaagcugcuggugcagcgcgccagcgugggggccaagaacgccacccucuccaccaucaaccagacgcccgucacccuccaggugcccggccugaugagcucccaggugcagaugggcgggcacccgaccgagguccucugccugaugaacauggugcugcccgaggagcuccuggacgacgaggaguacgaggagaucgucgaggacgugcgggacgagugcagcaaguacggccuggugaaguccaucgagaucccccgccccgucgacgggguggaggugccgggcugcgggaagaucuucgucgaguucaccagcguguucgacugccagaaggccaugcagggccucacgggccggaaguucgcgaaccgcguggucgugaccaaguacugcgaccccgacuccuaccaccggcgcgacuucugguga

SEQ ID NO: 38320 - RNA, 4212 nt, Artificial Sequence
  derived and/or modified sequence opt1 from UACA__Homo_sapiens__NP_001008225
augaugaacugcugguucagcugcacccccaagaaccgccacgccgccgacuggaacaaguacgacgaccggcugaugaaggcggccgagcgcggcgacguggagaaggucaccuccauccucgccaagaagggggugaacccgggcaagcuggacguggaggggcggagcgucuuccacguggugacguccaagggcaaccuggagugccucaacgccauccugauccacggggucgacaucaccaccagcgacaccgccggccgcaacgcgcugcaccucgccgccaaguacggccacgcccugugccugcagaagcuccugcaguacaacugccccacggagcacgcggaccugcaggggcggaccgcccuccacgacgccgccauggccgacugccccuccagcauccagcugcugugcgaccacggcgcguccgugaacgccaaggacguggacgggcgcacgccccucguccuggccacccagaugagccggccgaccaucugccagcugcucaucgaccgcggcgccgacgugaacucccgggacaagcagaaccgcaccgcccugaugcuggggugcgaguacggcugccgggacgcgguggagguccucaucaagaacggcgccgacaucagccugcuggacgcccucgggcacgacuccagcuacuacgcccgcaucggcgacaaccuggacauccugacccuccugaagaccgccuccgagaacacgaacaaggggcgggagcuguggaagaagggccccagccuccagcagcgcaaccugacccacaugcaggacgaggugaacgugaagucccaccagcgggagcaccagaacauccaggaccuggagaucgagaacgaggaccucaaggagcgccugcggaagauccagcaggagcagcgcauccugcucgacaaggucaacggccugcagcugcagcucaacgaggaggugaugguggcggacgaccuggagagcgagcgggagaagcugaagucccuccuggccgccaaggagaagcagcacgaggagagccugcgcaccaucgaggcccucaagaaccgguucaaguacuucgaguccgaccaccuggggagcggcagccacuucuccaaccgcaaggaggacaugcugcucaagcaggggcagauguacauggccgacagccagugcaccucccccggcauccccgcgcacaugcagagccgcuccaugcugcggccgcuggagcugagccuccccucccagacgagcuacuccgagaacgagauccugaagaaggagcuggaggccaugcgcaccuucugcgagagcgccaagcaggaccggcucaagcugcagaacgagcuggcccacaaggucgcggagugcaaggcccucgcccuggagugcgagcgcgugaaggaggacuccgacgagcagaucaagcagcuggaggacgcccucaaggacgugcagaagcggauguacgagagcgaggggaaggucaagcagaugcagacccacuuccuggcccugaaggagcaccucaccuccgaggcggccagcggcaaccaccgccugacggaggagcugaaggaccagcucaaggaccugaaggugaaguacgagggcgccuccgccgagguggggaagcugcggaaccagaucaagcagaacgagaugaucgucgaggaguucaagcgcgacgagggcaagcucaucgaggagaacaagcggcugcagaaggagcugagcaugugcgagauggagcgcgagaagaaggggcggaaggugaccgagauggagggccaggccaaggagcucuccgcgaagcuggcccugagcauccccgccgagaaguucgagaacaugaaguccagccucagcaacgaggucaacgagaaggccaagaagcugguggagauggagcgcgagcacgagaagucccugagcgagauccggcagcucaagcgcgagcuggagaacgugaaggccaagcuggcgcagcacgucaagcccgaggagcacgagcaggucaagucccggcucgagcagaaguccggggagcugggcaagaagaucaccgagcugacccucaagaaccagacgcugcagaaggagaucgagaagguguaccuggacaacaagcuccugaaggagcaggcccacaaccugaccaucgagaugaagaaccacuacgugccgcucaaggugagcgaggacaugaagaagucccacgacgccaucaucgacgaccugaaccgcaagcugcucgacgugacccagaaguacaccgagaagaagcuggagauggagaagcugcuccuggagaacgacagccugagcaaggacgucucccggcucgagacgguguucgugccgcccgagaagcacgagaaggagaucaucgcccucaagagcaacaucgucgagcugaagaagcagcuguccgagcugaagaagaagugcggcgaggaccaggagaagauccacgcgcugaccagcgagaacaccaaccucaagaagaugauguccaaccaguacgugcccgugaagacccacgaggaggucaagaugacgcugaacgacacccuggccaagaccaaccgcgagcuccuggacgugaagaagaaguucgaggacaucaaccaggaguucgugaagaucaaggacaagaacgagauccugaagcggaaccucgagaacacccagaaccagaucaaggccgaguacaucagccuggccgagcacgaggccaagauguccagccugucccagagcaugcgcaagguccaggacagcaacgcggagauccucgccaacuaccgcaaggggcaggaggagaucgugacgcugcacgccgagaucaaggcccagaagaaggagcuggacaccauccaggagugcaucaaggugaaguacgcccccaucgucuccuucgaggagugcgagcggaaguucaaggcgaccgagaaggagcucaaggaccagcugagcgagcagacccagaaguacuccgugagcgaggaggaggugaagaagaacaagcaggagaacgacaagcugaagaaggagaucuucacccuccagaaggaccugcgcgacaagacgguccugaucgagaagucccacgagauggagcgggcccucagccgcaagaccgacgagcugaacaagcagcugaaggaccucucccagaaguacaccgaggugaagaacgugaaggagaagcuggucgaggagaacgccaagcagaccagcgagauccuggccgugcagaaccuccugcagaagcagcacgugccccuggagcaggucgaggcccucaagaagucccugaacggcacgaucgagaaccugaaggaggagcucaagagcaugcagcggugcuacgagaaggagcagcagaccgugaccaagcugcaccagcugcucgagaaccagaagaacuccagcgugccccuggcggagcaccuccagaucaaggaggccuucgagaaggaggucgggaucaucaaggccucccugcgcgagaaggaggaggagagccagaacaagauggaggagguguccaagcugcagagcgaggugcagaacaccaagcaggcccugaagaagcucgagacgcgggaggucguggaccuguccaaguacaaggcgaccaagagcgaccuggagacccagaucuccagccugaacgagaagcucgccaaccugaaccgcaaguacgaggaggugugcgaggagguccugcacgccaagaagaaggagaucagcgccaaggacgagaaggagcuccugcacuucuccaucgagcaggagaucaaggaccagaaggagcggugcgacaagagccugaccacgaucaccgagcuccagcgccggauccaggaguccgccaagcagaucgaggcgaaggacaacaagaucaccgagcugcugaacgacguggagcgccucaagcaggcccugaacggccugagccagcucaccuacacguccgggaaccccaccaagcggcagagccagcugaucgacacccugcagcaccaggugaagucccucgagcagcagcuggccgacgccgaccgccagcaccaggaggucaucgccaucuaccggacccaccuccugagcgcggcccagggccacauggacgaggacgugcaggaggcccugcugcagaucauccagaugcgccagggccucgugugcuga

SEQ ID NO: 38321 - RNA, 1518 nt, Artificial Sequence
  derived and/or modified sequence opt1 from UAP1__Homo_sapiens__NP_003106
augaacaucaacgaccugaagcucacccugagcaaggccggccaggagcaccuccuccgcuucuggaacgagcuggaggaggcccagcaggucgagcuguacgcggagcuccaggccaugaacuucgaggagcugaacuucuucuuccagaaggccaucgagggguucaaccaguccagccaccagaagaacguggacgcccggauggagcccgugccgcgcgaggugcugggcuccgccacccgggaccaggaccagcuccaggcgugggagagcgaggggcuguuccagaucucccagaacaaggucgccgugcugcuccuggccggcgggcagggcacgcgccugggcguggccuaccccaaggggauguacgacgucggccuccccagccggaagacccuguuccagauccaggcggagcgcauccugaagcuccagcaggucgccgagaaguacuacgggaacaagugcaucauccccugguacaucaugaccuccggccggaccauggagagcacgaaggaguucuucaccaagcacaaguacuucgggcugaagaaggagaacgugaucuucuuccagcagggcaugcugccggccauguccuucgacggcaagaucauccucgaggagaagaacaaggugagcauggcccccgacgggaacggcgggcuguaccgcgcccuggcggcccagaacaucguggaggacauggagcagcggggcaucugguccauccacguguacugcgucgacaacauccucgugaagguggccgacccccgcuucaucggcuucugcauccagaagggggccgacugcggcgccaaggucguggagaagaccaaccccaccgagccggugggggucgugugccggguggacggcgucuaccaggugguggaguacagcgagaucucccuggcgacggcccagaagcgcagcuccgacgggcggcugcuguucaacgccggcaacaucgccaaccacuucuucaccguccccuuccugcgcgacguggucaacguguacgagccccagcugcagcaccacguggcccagaagaagauccccuacgucgacacccagggccagcucaucaagccggacaagcccaacgggaucaagauggagaaguucguguucgacaucuuccaguucgcgaagaaguucguggucuacgaggugcugcgggaggacgaguucagcccccugaagaacgccgacucccagaacggcaaggacaaccccaccacggcccgccacgcccucaugagccugcaccacugcugggugcugaacgccgggggccacuucaucgacgagaacgggucccggcucccggcgaucccccgccugaaggacgccaacgacguccccauccagugcgagaucagcccccugaucagcuacgccggcgagggccucgaguccuacguggccgacaaggaguuccacgcgccgcugaucaucgacgagaacggggugcacgagcuggucaagaacggcaucuga

SEQ ID NO: 38322 - RNA, 3261 nt, Artificial Sequence
  derived and/or modified sequence opt1 from UBA1__Homo_sapiens__XP_011542255
augcugacccucgagaaccugcaguucggcgacagcggguccaugcugugcgugaucuaccaccucgacaaccccgucggcaagaugagcuccagcccgcuguccaagaagcgccgggugagcgggcccgaccccaagcccggcuccaacugcagcccggcccaguccgugcugagcgagguccccuccgugcccaccaacgggauggccaagaacggcagcgaggcggacaucgacgagggccucuacucccgccagcuguacgugcuggggcacgaggccaugaagcggcuccagacgagcuccguccuggugagcggccugcgcgggcucggcguggagaucgccaagaacaucauccucgggggcgucaaggccgugacccugcacgaccagggcaccgcccagugggcggaccuguccagccaguucuaccugcgggaggaggacaucgggaagaaccgcgccgaggugucccagccccggcuggccgagcucaacagcuacgucccggugaccgccuacacgggcccccugguggaggacuuccugagcggguuccaggucguggugcucaccaacacgccccuggaggaccagcugcgcgucggcgaguucugccacaaccggggcaucaagcucgugguggcggacacccgcgggcuguucggccagcuguucugcgacuucggggaggagaugauccucaccgacuccaacggcgagcagccccugagcgccauggucuccauggugaccaaggacaacccggggguggugaccugccuggacgaggcccggcacggcuucgagagcggcgacuucgucuccuucagcgagguccaggggaugguggagcucaacggcaaccagcccauggagaucaaggugcuggggcccuacaccuucuccaucugcgacacgagcaacuucuccgacuacauccgcggcgggaucgucagccaggugaaggugcccaagaagaucuccuucaagagccuggucgccucccucgccgagccggacuucguggugaccgacuucgcgaaguucagccggcccgcccagcugcacaucggcuuccaggcccugcaccaguucugcgcccagcacggccgcccgccccggccccgcaacgaggaggacgccgcggagcucgucgcccuggcccaggccgugaacgcccgggcgcugcccgccgugcagcagaacaaccucgacgaggaccugauccgcaagcuggccuacgucgccgccggggaccucgcgcccaucaacgccuucaucggcgggcuggccgcccaggaggugaugaaggcgugcuccggcaaguucaugcccaucaugcaguggcuguacuucgacgcccucgagugccugccggaggacaaggaggugcugaccgaggacaagugccuccagcggcagaaccgcuacgacgggcaggucgccguguucggcagcgaccugcaggagaagcugggcaagcagaaguacuuccuggugggggccggcgccaucgggugcgagcuccugaagaacuucgcgaugaucggccugggcugcggggagggcggggagaucaucgucaccgacauggacacgaucgagaaguccaaccucaaccggcaguuccuguuccgccccugggacgugaccaagcucaagagcgacaccgccgccgccgccgugcgccagaugaacccccacauccgggucaccucccaccagaaccgcgugggccccgacacggagcggaucuacgacgacgacuucuuccagaaccuggacgggguggcgaacgcccuggacaacgucgacgcccgcauguacauggaccggcgcugcguguacuaccggaagccgcugcucgagagcggcacccugggcaccaaggggaacgugcaggucgugauccccuuccugaccgagagcuacuccagcucccaggacccgcccgagaaguccauccccaucugcacgcucaagaacuuccccaacgccaucgagcacacccugcagugggcccgcgacgaguucgagggccuguucaagcagcccgcggagaacgugaaccaguaccucaccgacccgaaguucgucgagcggacccugcgccuggccgggacgcagccccucgaggugcuggaggccgugcagcggagccugguccuccagcgcccccagaccugggccgacugcgugaccugggcgugccaccacuggcacacccaguacagcaacaacauccggcagcugcugcacaacuucccgcccgaccagcucacguccagcggcgcccccuucugguccgggcccaagcgcugcccccacccgcugaccuucgacgugaacaacccccugcaccucgacuacgucauggccgccgccaaccuguucgcgcagaccuacggccugaccggcagccaggaccgggccgccguggccacguuccuccaguccgugcagguccccgaguucacccccaagagcggggugaagauccacguguccgaccaggagcugcagagcgccaacgcguccgucgacgacagccgccuggaggagcucaaggccacccugccgucccccgacaagcugcccggcuucaagauguaccccaucgacuucgagaaggacgacgacagcaacuuccacauggacuucaucguggccgccagcaaccuccgggccgagaacuacgacaucccguccgcggaccgccacaagagcaagcugaucgccgggaagaucauccccgccaucgccaccaccacggcggccguggucggccuggugugccucgagcuguacaaggugguccaggggcaccggcagcuggacuccuacaagaacggcuuccucaaccuggcccugcccuucuucggcuucagcgagccccucgccgccccgcgccaccaguacuacaaccaggaguggacccugugggaccgcuucgaggugcaggggcugcagcccaacggcgaggagaugacccucaagcaguuccuggacuacuucaagaccgagcacaagcuggagaucacgaugcucucccagggggugagcaugcuguacuccuucuucaugcccgcggccaagcugaaggagcggcucgaccagccgaugaccgagaucgucagccgcguguccaagcggaagcugggccgccacguccgggcccuggugcucgagcugugcugcaacgacgagagcggggaggacguggagguccccuacgugcgcuacaccauccgguga

SEQ ID NO: 38323 - RNA, 1923 nt, Artificial Sequence
  derived and/or modified sequence opt1 from UBA2__Homo_sapiens__NP_005490
auggcccugagccgcggccucccccgggagcuggccgaggcgguggccgggggccgcguccugguggugggggccggcgggaucggcugcgagcuccugaagaaccugguccucaccggcuucucccacaucgaccugaucgaccuggacaccaucgacgugagcaaccucaaccggcaguuccuguuccagaagaagcacguggggcgcuccaaggcccaggucgccaaggagagcgugcugcaguucuacccgaaggcgaacaucguggccuaccacgacuccaucaugaaccccgacuacaacgucgaguucuuccggcaguucauccucgugaugaacgcccuggacaaccgcgccgcgcggaaccacgugaaccgcaugugccuggccgccgacgucccccucaucgagagcggcacggccggguaccugggccaggugaccaccaucaagaagggggugaccgagugcuacgagugccaccccaagccgacgcagcggaccuuccccggcugcaccauccgcaacacccccuccgagcccauccacugcaucgucugggccaaguaccuguucaaccagcuguucggcgaggaggacgcggaccaggaggugagcccggaccgggccgaccccgaggccgccugggagcccacggaggccgaggcgcgcgcccgggccuccaacgaggacggggacaucaagcgcaucagcaccaaggagugggccaaguccaccggcuacgaccccgugaagcuguucaccaagcuguucaaggacgacauccgguaccuccucacgauggacaagcuguggcgcaagcggaagccgcccgucccccucgacugggccgaggugcagagccagggggaggagaccaacgcguccgaccagcagaacgagccccagcugggccugaaggaccagcagguccucgacgucaagagcuacgcccgccuguucuccaagagcaucgagacccugcgggugcaccucgccgagaagggcgacggggccgagcugaucugggacaaggacgacccguccgccauggacuucgugaccagcgcggccaaccugcgcaugcacaucuucuccaugaacaugaagucccgguucgacaucaagagcauggccggcaacaucauccccgccaucgcgacgaccaacgccgugaucgccgggcucaucgugcuggagggccugaagauccucagcgggaagaucgaccagugccgcaccaucuuccugaacaagcagcccaacccccgcaagaagcugcucgucccgugcgcccuggacccgcccaaccccaacugcuacgugugcgccagcaagcccgaggugaccguccggcugaacgugcacaaggugacgguccucacccugcaggacaagaucgugaaggagaaguucgcgaugguggcccccgacguccagaucgaggacggcaagggcaccauccugaucuccagcgaggagggggagaccgaggccaacaaccacaagaagcucuccgaguucggcauccgcaacgggagccggcugcaggccgacgacuuccugcaggacuacacgcuccugaucaacauccugcacuccgaggaccugggcaaggacguggaguucgagguggucggggacgcccccgagaaggugggccccaagcaggcggaggacgccgccaagagcaucaccaacggcuccgacgacggggcccagccgagcaccuccaccgcccaggagcaggacgacgugcucaucgucgacagcgacgaggaggacuccagcaacaacgcggacguguccgaggaggagcgcagccggaagcgcaagcuggacgagaaggagaaccuguccgccaagcggagccgcaucgagcagaaggaggagcucgacgacgugaucgcccuggacuga

SEQ ID NO: 38324 - RNA, 1392 nt, Artificial Sequence
  derived and/or modified sequence opt1 from UBA3__Homo_sapiens__NP_003959
auggccgacggcgaggagcccgagaagaagcgccggcgcaucgaggagcugcucgccgagaagauggcgguggacgggggcugcggggacaccggcgacugggaggggcgguggaaccacgucaagaaguuccuggagcgcagcggcccguucacccaccccgacuucgagcccuccacggagagccugcaguuccuccuggacacgugcaaggugcuggugaucggcgccgggggccucgggugcgagcugcugaagaaccucgcccuguccggcuuccggcagauccacgucaucgacauggacaccaucgacgugagcaaccugaaccgccaguuccucuuccggcccaaggacaucgggcgcccgaaggccgagguggccgcggaguuccugaacgaccggguccccaacugcaacguggugccccacuucaacaagauccaggacuucaacgacaccuucuaccgccaguuccacaucaucgucugcggccuggacuccaucaucgcccggcgcuggaucaacggcaugcucaucagccugcugaacuacgaggacggggugcucgaccccuccagcaucgugccgcugaucgacggcgggaccgagggcuucaagggcaacgcccgggucauccugcccgggaugaccgccugcaucgagugcacccucgagcuguacccgccccaggugaacuuccccaugugcaccaucgcguccaugccccgccugcccgagcacugcaucgaguacgugcggaugcuccaguggcccaaggagcagccguucggcgagggggucccccuggacggcgacgaccccgagcacauccaguggaucuuccagaagucccuggagcgcgccagccaguacaacauccgcggggugacguaccggcucacccagggcguggucaagcggaucauccccgccguggccagcaccaacgccgugaucgcggccgucugcgccaccgagguguucaagaucgccacguccgccuacaucccgcugaacaacuaccugguguucaacgacgucgacggccucuacaccuacaccuucgaggcggagcgcaaggagaacugccccgccugcagccagcugccccagaacauccaguucucccccagcgccaagcugcaggaggugcucgacuaccugaccaacuccgccagccugcagaugaaguccccggccaucacggcgacccucgaggggaagaaccggacccuguaccugcagagcgucaccagcaucgaggagcgcacgcgccccaaccucuccaagacccugaaggagcugggccucguggacgggcaggagcuggccguggccgacgucaccacgccccagaccgugcuguucaagcuccacuucaccagcuga

SEQ ID NO: 38325 - RNA, 3039 nt, Artificial Sequence
  derived and/or modified sequence opt1 from UBA7__Homo_sapiens__NP_003326
auggacgcccuggacgccagcaagcuccuggacgaggagcuguacucccgccagcucuacgugcugggcagccccgcgaugcagcggauccagggggcccgcguccugguguccggccuccaggggcugggcgccgagguggccaagaaccugguccucaugggggugggcagccugacccugcacgacccgcacccgaccugcugguccgaccucgccgcgcaguuccugcugagcgagcaggaccucgagcggucccgcgccgaggccagccaggagcugcuggcccagcucaaccgggcggugcaggucguggugcacacgggcgacaucaccgaggaccugcugcucgacuuccaggucguggugcugaccgccgccaagcuggaggagcagcucaaggucgggacccugugccacaagcacggcgugugcuuccuggccgccgacacgcgcgggcucgugggccagcuguucugcgacuucggggaggacuucaccguccaggaccccaccgaggcggagccccugaccgccgccauccagcacaucucccagggcagccccggcauccucacgcugcggaagggggccaacacccacuacuuccgcgacggcgaccuggugaccuucuccgggaucgagggcaugguggagcucaacgacugcgacccccggagcauccacguccgcgaggacggcucccuggagaucggggacaccacgaccuucagccgguaccugcgcggcggggccaucaccgaggugaagcggcccaagaccgugcgccacaagucccucgacacggcgcugcugcagccccacgucguggcccagagcucccaggaggugcaccacgcccacugccuccaccaggccuucugcgcccugcacaaguuccagcaccuccacggccggccgccccagcccugggaccccgucgacgcggagaccguggucgggcuggcccgcgaccuggagccgcugaagcggaccgaggaggagccccucgaggagccccuggacgaggcccuggugcgcaccguggcccucagcuccgccggcguccugagccccaugguggcgaugcugggcgccguggccgcccaggagguccugaaggcgaucagccggaaguucaugccgcucgaccaguggcuguacuucgacgcccuggacugccuccccgaggacggggagcugcugcccucccccgaggacugcgcccuccgcggcagccgguacgacgggcagaucgccguguucggcgccggguuccaggagaagcugcgccgccagcacuaccugcucgugggcgcgggcgccaucgggugcgagcugcugaaggucuucgcccucgugggccugggggccggcaacuccgggggccugacgguggucgacauggaccacaucgagcggagcaaccucucccgccaguuccuguuccggagccaggacgugggccgcccgaaggccgagguggcggccgccgccgcccgggggcugaaccccgaccuccaggucaucccccugaccuacccccuggacccgaccaccgagcacaucuacggcgacaacuucuucucccgcguggacgggguggcggccgcccucgacagcuuccaggcccggcgcuacgucgcggcccggugcacgcacuaccugaagccccugcucgaggccggcaccuccggcaccugggggagcgccaccguguucaugccccacgugacggaggccuaccgcgcgcccgccuccgccgccgccagcgaggacgcgccguaccccgucugcaccgugcgguacuuccccuccaccgccgagcacacccugcagugggcccgccacgaguucgaggagcuguuccggcucagcgccgagacgaucaaccaccaccagcaggcccacaccucccuggcggacauggacgagccgcagacccugacccuccugaagcccgugcugggcguccuccgcgugcggccccagaacuggcaggacugcguggccugggcccuggggcacuggaagcugugcuuccacuacggcaucaagcagcuccugcgccacuucccgcccaacaagguccuggaggacgggacgcccuucuggagcggccccaagcagugcccccagccgcucgaguucgacaccaaccaggacacccaccuccuguacgugcuggccgcggccaaccuguacgcccagaugcacggccugcccgggucccaggacuggaccgcccuccgggagcugcugaagcuccugccccagcccgacccgcagcagauggcccccaucuucgcgagcaaccuggagcucgccuccgccagcgccgaguucggccccgagcagcagaaggagcugaacaaggcccuggagguguggagcgucgggcccccgcucaagccccugauguucgagaaggacgacgacuccaacuuccacguggacuucguggucgcggccgccagccugcgcugccagaacuacggcaucccgcccgugaaccgggcccaguccaagcgcaucguggggcagaucauccccgccaucgcgaccacgaccgccgccgucgccggccuccugggccuggagcucuacaagguggugagcgggccccgcccccgguccgccuuccgccacagcuaccugcaccuggcggagaacuaccucauccgguacaugcccuucgccccggccauccagaccuuccaccaccugaaguggaccuccugggaccgccugaagguccccgccggccagcccgagcggacgcucgagagccugcuggcgcaccuccaggagcagcacgggcugcgcgugcggauccugcuccacggcuccgcccugcuguacgccgccggguggagcccggagaagcaggcccagcaccucccccugcgcgugaccgagcugguccagcagcucaccggccaggcgcccgcccccggccagcgggugcuggugcuggagcucuccugcgagggggacgacgaggacaccgccuucccgccccugcacuacgagcuguga

SEQ ID NO: 38326 - RNA, 1218 nt, Artificial Sequence
  derived and/or modified sequence opt1 from UBAC1__Homo_sapiens__NP_057256
auguucgugcaggaggagaagaucuucgccggcaagguccugcgccuccacaucugcgccagcgacggggcggaguggcuggaggaggccaccgaggacaccuccguggagaagcugaaggagcggugccucaagcacugcgcccacggcagccuggaggaccccaaguccaucacgcaccacaagcugauccacgccgccagcgagcgcgugcucuccgacgcgcggaccauccuggaggagaacauccaggaccaggacguccugcuccugaucaagaagcgcgccccgagcccccugcccaagauggccgacguguccgccgaggagaagaagaagcaggaccagaaggcgcccgacaaggaggccauccuccgggccaccgccaaccugccgagcuacaacauggaccgcgccgcggugcagaccaacaugcgggacuuccagacggagcugcgcaagauccucgucucccugaucgagguggcccagaagcugcucgcccugaaccccgacgccguggagcuguucaagaaggccaacgcgaugcucgacgaggacgaggacgagcgggucgacgaggccgcccugcgccagcugaccgagaugggguuccccgagaaccgggccaccaaggcccuccagcugaaccacaugagcgugccccaggcgauggaguggcugaucgagcacgccgaggacccgaccaucgacacgccccuccccggccaggcgcccccggaggccgagggggccaccgccgccgccuccgaggccgcggccggcgccagcgccaccgacgaggaggcccgcgacgagcugaccgagaucuucaagaagauccggcgcaagcgggaguuccgcgcggacgcccgggccgugaucucccugauggagaugggcuucgacgagaaggaggucaucgacgcccuccgcgugaacaacaaccagcagaacgccgcgugcgaguggcugcugggggaccggaagcccagccccgaggagcucgacaagggcaucgaccccgacuccccgcuguuccaggccauccuggacaaccccgugguccagcucgggcugacgaaccccaagacccugcucgccuucgaggacaugcuggagaacccccugaacagcacccaguggaugaacgacccggagaccggccccgugaugcuccagaucucccgcaucuuccagacgcugaaccggaccuga

SEQ ID NO: 38327 - RNA, 1035 nt, Artificial Sequence
  derived and/or modified sequence opt1 from UBAC2__Homo_sapiens__NP_001137544
auguucaccagcaccggcuccagcgggcuguacaaggcgccccucuccaagagccugcugcucgugcccuccgcccugagccugcuccuggcccugcuccugccccacugccagaagcuguucgucuacgaccuccacgccgugaagaacgacuuccagaucuggcgccugaucugcggccggaucaucugccuggaccucaaggacacguucugcuccagccugcugaucuacaacuuccgcaucuucgagcggcgcuacgggucccggaaguucgccagcuuccuccugggcuccugggugcugagcgcccucuucgacuuccugcugaucgaggccaugcaguacuucuucgggaucaccgcggccuccaaccuccccagcggcuuccuggcccccgucuucgcccuguucgugccguucuacugcuccaucccccgcgugcaggucgcgcagauccucggcccccugagcaucaccaacaagacccugaucuacauccucgggcugcagcuguucacguccggcagcuacaucuggaucguggccaucuccgggcucaugagcggccugugcuacgacagcaagauguuccaggugcaccagguccugugcauccccuccuggauggccaaguucuucagcuggacccucgagccgaucuucuccagcuccgagcccaccagcgaggcccggaucgggaugggcgccacccuggacauccagcgccagcagcggauggagcugcucgaccgccagcugauguucucccaguucgcgcagggccggcgccagcggcagcagcagggcgggaugaucaacuggaaccgccuguucccgccccuccggcagcgccagaacgugaacuaccagggcgggcggcagagcgagcccgccgccccgccccuggagguguccgaggagcaggucgcccgccugauggagaugggcuucagccgcggggacgcccucgaggcgcugcgggccuccaacaacgaccugaacguggccacgaacuuccuccugcagcacuga

SEQ ID NO: 38328 - RNA, 1701 nt, Artificial Sequence
  derived and/or modified sequence opt1 from UBAP1__Homo_sapiens__NP_001164672
augagcggcgccgugcgcgggcggcgccgggaggucggccugcagcacgggggcugcgggaccggcggcggguacggcgacgggcucgcccgcuccggccagagcuggcggugguggcgcucccugagccugggggcggugggcuccagcgccggcaccgagcccgggcggccggccggcgccuccacguuccgccuccugcggcgccggcagcagcgccacagcgggaccuucuccuaccuggacgacgugcccuucaagaccggcgacaaguucaagacccccgccaaggucggccuccccaucggguucagccugccggacugccuccagguggugcgggagguccaguacgacuucucccucgagaagaagacgaucgagugggcggaggagaucaagaagaucgaggaggccgagcgcgaggccgagugcaagaucgccgaggcggaggccaaggugaacagcaaguccggccccgagggggacagcaagauguccuucagcaagacccacuccaccgccaccaugcccccgcccaucaaccccauccuggccagccugcagcacaacuccauccucacgcccacccgggugagcagcuccgccaccaagcagaagguccugagcccgccccacaucaaggcggacuucaaccuggccgacuucgagugcgaggaggaccccuucgacaaccucgagcugaagaccaucgacgagaaggaggagcugcgcaacauccucgugggcacgaccgggcccaucauggcccagcugcuggacaacaaccucccccggggcggcuccgggagcgugcugcaggacgaggagguccuggccucccucgagcgcgccacccuggacuucaagccgcugcacaagcccaacggcuucaucacccucccccagcuggggaacugcgagaagaugagccuguccagcaaggugucccugcccccgauccccgcggugagcaacaucaagucccugagcuuccccaagcuggacuccgacgacagcaaccagaagacggccaagcucgccuccaccuuccacagcaccuccugccugcggaacggcaccuuccagaacagccugaagcccuccacgcagagcagcgccuccgagcucaacgggcaccacacccugggccugagcgcccucaaccuggacuccggcaccgagaugccggcgcugaccagcucccagaugcccagccucuccguccugagcgugugcacggaggaguccagcccgcccaacaccgggcccaccgugaccccgcccaacuucuccgucagccaggugcccaacaugcccuccugcccccaggccuacagcgagcugcagaugcucucccccagcgagcgccagugcguggagacggucgugaacaugggcuacuccuacgagugcgugcugcgggccaugaagaagaagggggagaacaucgagcagauccuggacuaccucuucgcccacggccagcugugcgagaagggguucgacccgcugcuggucgaggaggcccucgagaugcaccagugcagcgaggagaagaugauggaguuccugcagcugaugagcaaguucaaggagaugggcuucgagcucaaggacaucaaggaggugcugcugcuccacaacaacgaccaggacaacgcgcuggaggaccugauggcccgcgccggcgccuccuga

SEQ ID NO: 38329 - RNA, 2559 nt, Artificial Sequence
  derived and/or modified sequence opt1 from UBAP2__Homo_sapiens__NP_001269458
auggacagcaagggccuggggcgcauccucuggaaguccggccagcagaagaccgggcugaagaucaucgaccugguggcccuccugcagaagcccgucccgcacagccaggccuccgaggcgaacagcuucgagaccucccagcagcagggcuucgggcaggcccugguguucacgaacagccagcacaacaaccagauggcccccggcaccggcuccagcaccgccgugaacuccugcagcccccagucccucagcuccguccuggggagcggcuucggggagcuggcgcccccgaagauggccaacaucaccuccagccagauccucgaccagcugaaggcccccucccugggccaguucacgaccacccccagcacccagcagaacuccacgagccaccccaccaccaccacgagcugggaccucaagccgcccaccucccagagcuccgugcugagccaccuggacuucaagucccagcccgagcccagcccggugcucucccagcugagccagcggcagcagcaccagucccaggccgucaccgugcccccgcccgggcuggagagcuuccccucccaggccaagcuccgcgagagcacccccggcgacucccccagcacggugaacaagcugcugcagcuccccuccaccaccaucgagaacaucagcgucuccgugcaccagccgcagcccaagcacaucaagcuggcgaagcggcgcaucccgcccgccagcaagauccccgccuccgccguggagaugcccggcagcgccgacgucaccgggcugaacgugcaguucggcgcgcucgaguucgggagcgagcccucccugagcgaguucggcuccgcccccagcuccgagaacagcaaccagaucccgaucucccuguacagcaagucccucagcgagccccugaacacgucccugagcaugaccuccgccgugcagaacagcaccuacaccacguccgucaucaccagcugcucccucaccagcagcucccugaacagcgccucccccguggccaugagcuccagcuacgaccaguccagcgugcacaaccggaucccguaccagucccccgucagcuccagcgaguccgcgcccggcaccaucaugaacgggcacggcgggggccgcagccagcagacgcuggacacccccaagaccaccgggccgcccuccgcccuccccagcguguccagccugcccuccacgaccagcugcaccgcccugcucccgagcaccucccagcacacgggcgaccugaccagcagcccccugucccagcucuccagcucccugagcucccaccagagcucccugagcgcccacgccgcgcucuccagcuccaccagccacacccacgccuccguggagagcgccuccagccaccagagcuccgccaccuucagcacggccgcgaccuccgucagcuccagcgccuccagcggcgugucccugagcuccagcaugaacaccgccaacucccugugccucgggggcacccccgccagcgcguccagcuccagcucccgggccgcgccccuggugacgagcgggaaggccccgcccaaccugccccagggcgugcccccgcuccugcacaaccaguaccuggucgggcccggcggccugcuccccgccuaccccaucuacggguacgacgagcugcagaugcugcagagccgccucccggucgacuacuacggcauccccuucgccgcccccaccgcccuggccucccgggacgggagccuggccaacaaccccuacccgggcgacgugaccaaguucgggcgcggcgacuccgcgagccccgcccccgccaccacgccggcccagccccagcagucccagagccagacccaccacaccgcccagcagcccuucgugaaccccgcgcucccgcccggcuacuccuacaccgggcugcccuacuacacgggcaugcccagcgccuuccaguacgggccgaccauguucgucccgcccgccuccgccaagcagcacggcgugaaccugagcacccccaccccgcccuuccagcaggcguccggcuacgggcagcacggcuacagcacgggguacgacgaccucacccagggcaccgccgccggggacuacuccaagggcggcuacgccgggagcucccaggcccccaacaagagcgcgggcuccgggcccggcaagggggugagcgucuccagcagcaccacgggccugcccgacaugaccggcuccguguacaacaagacccagaccuucgacaagcagggguuccacgccggcacgcccccgcccuucagccugcccuccgugcucgggagcaccggcccccuggccuccggggccgcccccggcuacgcgcccccgcccuuccugcacauccuccccgcccaccagcagccccacagccagcugcugcaccaccaccucccgcaggacgcccaguccggcagcgggcagcggucccagcccagcucccugcagcccaagagccaggccuccaagccggccuacggcaacagccccuacuggaccaacuga

SEQ ID NO: 38330 - RNA, 1872 nt, Artificial Sequence
  derived and/or modified sequence opt1 from UBASH3A__Homo_sapiens__NP_001001895
auggccgccggcgagacccagcuguacgcgaaggugagcaacaagcucaagucccgcagcucccccagccugcuggagccccuccuggccaugggguuccccguccacaccgcccugaaggcccucgccgcgacgggccggaagaccgccgaggaggcccuggccuggcugcacgaccacugcaacgaccccucccucgacgaccccaucccgcaggaguacgcgcuguuccugugccccaccgggccccuccuggagaagcugcaggaguucuggcgcgagagcaagcggcagugcgccaagaaccgcgcccacgagguguucccccacgugacccucugcgacuucuucacgugcgaggaccagaaggucgagugccuguacgaggcccugaagcgggccggcgaccgccuccugggguccuucccgaccgcggugccccuggcccuccacagcuccaucagcuaccugggcuucuucguguccggcagccccgccgacgucauccgggaguucgccaugaccuucgccaccgaggcgucccugcucgccgacugcagcgugaagcccugcacgaagcagcugcaccugacccucgcccacaaguucuacccgcaccaccagcgcacccuggagcagcuggcccgggccaucccccucgggcacuccugccaguggaccgcggcccuguacagccgcgacaugcgguucgugcacuaccagacgcugcgcgcccucuuccaguacaagccccagaacgucgacgagcugacccugucccccggcgacuacaucuucguggacccgacccagcaggacgaggccagcgaggggugggugaucggcaucucccagcggaccgggugccgcggcuuccuccccgagaacuacacggaccgggccagcgagagcgacaccugggucaagcaccgcauguacaccuucucccuggcgaccgaccugaacagccggaaggacggcgaggccuccagccgcugcuccggggaguuccucccccagacggcccggagccuguccagccugcaggcccuccaggcgaccguggcccgcaaguccgugcuggucgugcggcacggcgagcgcguggaccagaucuucgggaaggccuggcugcagcagugcagcacccccgacggcaaguacuaccgcccggaccucaacuuccccugcucccugccccggcgcagccggggcaucaaggacuucgagaacgacccgccccuguccagcugcgggaucuuccagucccgcaucgccggcgacgcccuccuggacagcgggauccggaucuccagcgucuucgcgucccccgcccugcgcugcgugcagaccgccaagcugauccucgaggagcugaagcuggagaagaagaucaagauccggguggagcccggcaucuucgaguggacgaagugggaggccgggaagaccacccccacccucaugagccuggaggagcugaaggaggccaacuucaacaucgacacggacuaccgcccggcguucccccucagcgcccugaugcccgccgaguccuaccaggaguacauggaccggugcaccgccagcaugguccagaucgugaacacgugcccgcaggacaccggcgugauccugaucgucucccacggcagcacccucgacuccugcacccgcccccugcuggggcucccgccccgggagugcggcgacuucgcccagcuggugcgcaagauccccagccuggggaugugcuucugcgaggagaacaaggaggagggcaagugggagcucgucaacccgcccgugaagacccugacccacggggcgaacgccgccuucaacuggcggaacuggaucuccggcaacuga

SEQ ID NO: 38331 - RNA, 1950 nt, Artificial Sequence
  derived and/or modified sequence opt1 from UBASH3B__Homo_sapiens__NP_116262
auggcccaguacggccaccccagcccgcuggggauggccgcgcgcgaggagcucuacuccaaggugacgccccggcgcaaccggcagcagcgccccggcaccaucaagcacgggagcgcccuggacguccugcucuccaugggcuucccccgggcccgcgcccagaaggcccuggcgagcaccgggggccgguccgugcaggccgccugcgacuggcuguucagccacgugggcgacccguuccucgacgacccccugccccgcgaguacguccuguaccuccggcccaccgggccgcuggcccagaagcuguccgacuucuggcagcagagcaagcagaucugcggcaagaacaaggcgcacaacaucuucccccacaucacccucugccaguucuucaugugcgaggacuccaagguggacgcccugggggaggcccugcagaccacggugagccgcuggaagugcaaguucuccgcgccccucccccuggagcuguacaccagcuccaacuucaucggccucuucgucaaggaggacagcgccgaggugcugaagaaguucgccgccgacuucgccgccgaggccgcguccaagaccgaggugcacgucgagccgcacaagaagcagcugcacgugacccucgccuaccacuuccaggccagccaccuccccacgcuggagaagcuggcccagaacaucgacgugaagcuggggugcgacugggucgccaccaucuucucccgggacauccgcuucgcgaaccacgagacccuccaggugaucuaccccuacacgccccagaacgacgacgagcuggagcuggugccgggcgacuucaucuucaugagccccauggagcagaccuccaccagcgagggcuggaucuacgggaccagccugaccacgggcugcuccgggcuccugcccgagaacuacaucaccaaggccgacgagugcagcaccuggaucuuccacggcuccuacagcauccugaacaccuccagcuccaacagccucacguucggcgacgggguccuggagcggcgccccuacgaggaccagggccugggggagaccaccccgcucaccaucaucugccagcccaugcagccccugcgggugaacucccagcccggcccgcagaagcgcugccuguucgugugccggcacggggagcgcauggacgucguguucggcaaguacuggcucagccagugcuucgacgccaagggccgguacauccgcacgaaccugaacaugccccacucccugccccagcggagcgggggcuuccgcgacuacgagaaggacgcccccaucaccguguucgggugcaugcaggcccgccucgucggcgaggcgcugcuggaguccaacaccaucaucgaccacguguacugcagcccgucccuccggugcgugcagaccgcccacaacauccugaaggggcugcagcaggagaaccaccucaagauccgcgucgagcccggccuguucgaguggacgaaguggguggccggcagcacccugcccgccuggaucccgcccuccgagcuggcggccgccaaccucagcgucgacaccaccuaccggccccacauccccaucuccaagcugguggugagcgagagcuacgacacguacaucucccgcagcuuccaggucaccaaggagaucaucuccgagugcaagagcaaggggaacaacauccugaucguggcccacgccuccagccucgaggcgugcacgugccagcugcagggccuguccccgcagaacagcaaggacuucgugcagaugguccggaagauccccuaccucggguucugcuccugcgaggagcugggcgagaccgggaucuggcagcugaccgacccgcccauccucccccugacccacggccccaccggcggguucaacuggcgcgagacccugcuccaggaguga

SEQ ID NO: 38332 - RNA, 690 nt, Artificial Sequence
  derived and/or modified sequence opt1 from UBB__Homo_sapiens__NP_001268647
augcagaucuucgugaagacccugaccggcaagacgaucacccucgaggucgagcccagcgacaccaucgagaacgugaaggccaagauccaggacaaggaggggaucccgcccgaccagcagcgccugaucuucgccggcaagcagcuggaggacgggcggacccucuccgacuacaacauccagaaggagagcacgcugcaccuggugcuccgccugcggggcgggaugcagaucuucgucaagacccugaccggcaagaccaucacgcucgagguggagcccuccgacaccaucgagaacgugaaggcgaagauccaggacaaggagggcauccccccggaccagcagcgccugaucuucgccgggaagcagcuggaggacggccggacccucagcgacuacaacauccagaaggaguccacccugcaccugguccuccgccugcgggggggcaugcagaucuucgugaagacgcugaccgggaagaccaucacccucgagguggagcccagcgacacgaucgagaacgucaaggccaagauccaggacaaggagggcaucccccccgaccagcagcgccugaucuucgccggcaagcagcuggaggacgggcggacccucuccgacuacaacauccagaaggagagcacccugcaccuggugcuccgccugcggggcgggugcuga

SEQ ID NO: 38333 - RNA, 2058 nt, Artificial Sequence
  derived and/or modified sequence opt1 from UBC__Homo_sapiens__NP_066289
augcagaucuucgugaagacccugaccggcaagacgaucacccucgaggucgagcccagcgacaccaucgagaacgugaaggccaagauccaggacaaggaggggaucccgcccgaccagcagcgccugaucuucgccggcaagcagcuggaggacgggcggacccucuccgacuacaacauccagaaggagagcacgcugcaccuggugcuccgccugcggggcgggaugcagaucuucgucaagacccugaccggcaagaccaucacgcucgagguggagcccuccgacaccaucgagaacgugaaggcgaagauccaggacaaggagggcauccccccggaccagcagcgccugaucuucgccgggaagcagcuggaggacggccggacccucagcgacuacaacauccagaaggaguccacccugcaccugguccuccgccugcgggggggcaugcagaucuucgugaagacgcugaccgggaagaccaucacccucgagguggagcccagcgacacgaucgagaacgucaaggccaagauccaggacaaggagggcaucccccccgaccagcagcgccugaucuucgccggcaagcagcuggaggacgggcggacccucuccgacuacaacauccagaaggagagcacccugcaccuggugcuccgccugcggggcgggaugcagaucuucgugaagacccugacgggcaagaccaucacccucgaggucgagccguccgacaccaucgagaacgugaaggccaagauccaggacaaggagggcaucccccccgaccagcagcgccugaucuucgcggggaagcagcuggaggacggccggacgcucagcgacuacaacauccagaaggaguccacccugcaccuggugcuccgccugcgggggggcaugcagaucuucgucaagacccugaccgggaagacgaucacccucgagguggagcccagcgacaccaucgagaacgugaaggccaagauccaggacaaggagggcaucccgcccgaccagcagcgccugaucuucgccggcaagcagcuggaggacgggcggacccucuccgacuacaacauccagaaggagagcacgcugcaccugguccuccgccugcggggcgggaugcagaucuucgugaagacccugaccggcaagaccaucacgcucgagguggagcccuccgacaccaucgagaacgucaaggccaagauccaggacaaggaggggauccccccggaccagcagcgccugaucuucgcgggcaagcagcuggaggacggccggacccucagcgacuacaacauccagaaggaguccacccugcaccuggugcugcgccuccgcgggggcaugcagaucuucgugaagacccugacggggaagaccaucacccuggaggucgagcccagcgacaccaucgagaacgugaaggccaagauccaggacaaggagggcaucccccccgaccagcagcggcucaucuucgccgggaagcagcuggaggacggccgcacgcuguccgacuacaacauccagaaggagagcacccuccaccugguccugcggcuccgcggcgggaugcagaucuucgugaagacccugaccggcaagacgaucacccuggagguggagccgagcgacaccaucgagaacgucaaggccaagauccaggacaaggaggggaucccccccgaccagcagcggcucaucuucgccggcaagcagcuggaggacggccgcacccuguccgacuacaacauccagaaggagagcacgcuccaccuggugcugcggcuccgcgggggcaugcagaucuucgugaagacccugaccgggaagaccaucacgcuggaggucgagcccuccgacaccaucgagaacgugaaggcgaagauccaggacaaggagggcaucccgcccgaccagcagcggcucaucuucgccgggaagcagcuggaggacggccgcacccugagcgacuacaacauccagaaggaguccacccuccaccuggugcugcggcuccgcggcggggucuga

SEQ ID NO: 38334 - RNA, 498 nt, Artificial Sequence
  derived and/or modified sequence opt1 from UBD__Homo_sapiens__NP_006389
auggcccccaacgccagcugccugugcguccacguccgcuccgaggagugggaccucaugaccuucgacgcgaacccguacgacagcgugaagaagaucaaggagcacgugcgguccaagaccaagguccccgugcaggaccaggugcugcugcucggcagcaagauccugaagccccgccggucccugagcuccuacgggaucgacaaggagaagacgauccaccucacccugaaggucgugaagcccagcgacgaggagcugccgcuguuccugguggaguccggcgacgaggccaagcgccaccuccuccagguccggcgcagcuccagcguggcccaggugaaggccaugaucgagaccaagaccgggaucauccccgagacgcagaucgugaccugcaacggcaagcggcuggaggacgggaagaugauggccgacuacggcauccgcaagggcaaccuccuguuccuggcgugcuacugcaucgggggcuga

SEQ ID NO: 38335 - RNA, 360 nt, Artificial Sequence
  derived and/or modified sequence opt1 from UBE2A__Homo_sapiens__NP_001269090
augguguggaacgccgucaucuucggccccgaggggaccccguucgaggacggcaccuucaagcugacgaucgaguucaccgaggaguaccccaacaagccgcccaccgugcgcuucgugagcaagauguuccaccccaacgucuacgccgacggguccaucugccucgacauccugcagaaccgguggagccccaccuacgacguguccagcauccugacguccauccagagccuccuggacgagcccaaccccaacuccccggcgaacagccaggccgcccagcuguaccaggagaacaagcgcgaguacgagaagcggguguccgccaucgucgagcagagcuggcgcgacugcuga

SEQ ID NO: 38336 - RNA, 459 nt, Artificial Sequence
  derived and/or modified sequence opt1 from UBE2B__Homo_sapiens__NP_003328
augagcacccccgcccgccggcgccugaugcgggacuucaagcgccuccaggaggacccgcccgugggcgucuccggggcccccagcgagaacaacaucaugcaguggaacgcggugaucuucggccccgaggggaccccguucgaggacggcacguucaagcuggugaucgaguucuccgaggaguaccccaacaagccgcccaccguccgguuccugagcaagauguuccaccccaacguguacgccgacggguccaucugccucgacauccugcagaaccgcuggagccccaccuacgacguguccagcauccugaccuccauccagagccuccuggacgagcccaaccccaacuccccggccaacagccaggccgcccagcuguaccaggagaacaagcgggaguacgagaagcgcgucuccgcgaucguggagcagagcuggaacgacuccuga

SEQ ID NO: 38337 - RNA, 240 nt, Artificial Sequence
  derived and/or modified sequence opt1 from UBE2C__Homo_sapiens__NP_001268671
auggccagccagaaccgcgaccccgccgcgaccuccguggccgccgcccggaagggcgccgagccgagcgggggcgcggcccgcgggcccgucggcaagcggcugcagcaggagcucaugacccugaugauguccggggacaagggcaucagcgccuuccccgaguccgacaaccuguucaagugggugggcacgauccacggggccgcgggcaccaaccccacccucaucgugccguga

SEQ ID NO: 38338 - RNA, 444 nt, Artificial Sequence
  derived and/or modified sequence opt1 from UBE2D1__Homo_sapiens__NP_003329
auggcccugaagcgcauccagaaggagcucagcgaccugcagcgggacccgcccgcccacugcuccgcgggccccgugggggacgaccuguuccacuggcaggccaccaucaugggcccgcccgacagcgccuaccagggcggggucuucuuccucaccgugcacuuccccacggacuaccccuucaagccgcccaagaucgccuucaccaccaagaucuaccaccccaacaucaacuccaacgggagcaucugccuggacauccugcgcucccaguggagccccgcccucaccguguccaagguccugcugagcaucugcucccuccugugcgaccccaaccccgacgacccgcuggugcccgacaucgcgcagaucuacaagagcgacaaggagaaguacaaccggcacgcccgcgaguggacgcagaaguacgccauguga

SEQ ID NO: 38339 - RNA, 444 nt, Artificial Sequence
  derived and/or modified sequence opt1 from UBE2D2__Homo_sapiens__NP_003330
auggcccugaagcgcauccacaaggagcucaacgaccuggcccgggacccgcccgcgcagugcagcgccggccccgugggggacgacauguuccacuggcaggccaccaucaugggccccaacgacucccccuaccagggcggggucuucuuccugaccauccacuucccgacggacuaccccuucaagccgcccaagguggccuucaccacccgcaucuaccaccccaacaucaacagcaacggguccaucugccucgacauccugcggagccaguggucccccgcccugaccaucagcaaggugcuccuguccaucugcagccugcucugcgaccccaaccccgacgacccgcugguccccgagaucgcgcgcaucuacaagacggaccgggagaaguacaaccgcaucgcccgggaguggacccagaaguacgccauguga

SEQ ID NO: 38340 - RNA, 444 nt, Artificial Sequence
  derived and/or modified sequence opt1 from UBE2D3__Homo_sapiens__NP_003331
auggcccugaagcgcaucaacaaggagcucagcgaccuggcccgggacccgcccgcgcagugcuccgccggccccgugggggacgacauguuccacuggcaggccaccaucaugggccccaacgacagccccuaccagggcggggucuucuuccugaccauccacuucccgacggacuaccccuucaagccgcccaagguggccuucaccacccgcaucuaccaccccaacaucaacuccaacgggagcaucugccucgacauccugcggucccaguggagccccgcccugaccaucuccaaggugcuccugagcaucugcucccugcucugcgaccccaaccccgacgacccgcugguccccgagaucgcgcgcaucuacaagacggaccgggacaaguacaaccgcaucagccgggaguggacccagaaguacgccauguga

SEQ ID NO: 38341 - RNA, 483 nt, Artificial Sequence
  derived and/or modified sequence opt1 from UBE2E1__Homo_sapiens__NP_001189405
augaaggaggugggccgcccccgggagguccgcgggcggcccggcaagagccgcauccagaaggagcuggccgacaucacccucgacccgccgcccaacugcuccgccgggcccaagggcgacaacaucuacgaguggcggagcaccauccuggggccgcccggcuccguguacgagggcgggguguucuuccuggacaucacguucacccccgaguaccccuucaagccgcccaaggucaccuuccgcacccggaucuaccacugcaacaucaacagccagggcgugaucugccucgacauccugaaggacaacuggucccccgcgcugacgaucagcaaggugcuccuguccaucugcagccugcucaccgacugcaaccccgccgacccccuggucggguccaucgccacccaguacaugaccaaccgcgccgagcacgaccggauggcccgccaguggacgaagcgguacgcgaccuga

SEQ ID NO: 38342 - RNA, 606 nt, Artificial Sequence
  derived and/or modified sequence opt1 from UBE2E2__Homo_sapiens__NP_689866
augagcaccgaggcccagcgcguggacgacucccccagcaccuccggcgggagcuccgacggcgaccagcgggagagcguccagcaggagcccgagcgcgagcagguccagcccaagaagaaggaggggaagaucuccagcaagacggccgcgaagcuguccaccagcgccaagcggauccagaaggagcucgccgagaucacccuggacccgccgcccaacugcuccgccggccccaagggggacaacaucuacgaguggcgcagcaccauccugggcccgcccggcuccguguacgagggcgggguguucuuccucgacaucacguucagccccgacuaccccuucaagccgcccaaggugaccuuccggacccgcaucuaccacugcaacaucaacucccagggggugaucugccuggacauccugaaggacaacuggagccccgcccucaccaucuccaagguccugcugagcaucugcucccuccugacggacugcaaccccgcggacccccuggugggcagcaucgccacccaguacaugaccaaccgggccgagcacgaccgcauggcccggcaguggaccaagcgcuacgcgacguga

SEQ ID NO: 38343 - RNA, 624 nt, Artificial Sequence
  derived and/or modified sequence opt1 from UBE2E3__Homo_sapiens__NP_006348
augagcuccgaccgccagcggagcgacgacgagucccccagcaccuccagcggcuccagcgacgccgaccagcgcgaccccgccgcgcccgagcccgaggagcaggaggagcggaagcccuccgccacccagcagaagaagaacacgaagcugagcuccaagaccaccgccaagcucagcaccuccgccaagcgcauccagaaggagcuggccgagaucacgcuggacccgccgcccaacugcagcgcggggcccaagggcgacaacaucuacgaguggcgguccaccauccucgggccgcccggcagcguguacgagggcggggucuucuuccuggacaucaccuucuccagcgacuaccccuucaagccgcccaaggugaccuuccgcacgcggaucuaccacugcaacaucaacucccagggcgugaucugccuggacauccucaaggacaacuggagccccgcccugaccaucagcaagguccugcucuccaucugcagccugcugaccgacugcaaccccgccgacccccucgugggguccaucgccacccaguaccugacgaaccgcgcggagcacgaccggaucgcccgccaguggaccaagcgguacgccaccuga

SEQ ID NO: 38344 - RNA, 513 nt, Artificial Sequence
  derived and/or modified sequence opt1 from UBE2G1__Homo_sapiens__NP_003333
augaccgagcugcagagcgcccuccugcugcggcggcagcucgccgagcugaacaagaaccccguggagggcuucuccgcggggcugaucgacgacaacgaccucuaccgcugggagguccugaucaucggcccgcccgacacccuguacgagggcgggguguucaaggcccaccucacguuccccaaggacuacccccugcggccgcccaagaugaaguucaucaccgagaucuggcaccccaacguggacaagaacggggacgucugcaucagcauccugcacgagcccggcgaggacaaguacggcuacgagaagccggaggagcgcuggcuccccauccacaccguggagaccaucaugaucuccgugaucagcaugcuggccgaccccaacggggacucccccgccaacgucgacgccgcgaaggaguggcgggaggaccgcaacggcgaguucaagcggaagguggcccgcugcgugcgcaagagccaggagacggccuucgaguga

SEQ ID NO: 38345 - RNA, 498 nt, Artificial Sequence
  derived and/or modified sequence opt1 from UBE2G2__Homo_sapiens__NP_003334
auggccggcaccgcccugaagcgccucauggcggaguacaagcagcugacccugaaccccccggaggggaucguggccggccccaugaacgaggagaacuucuucgagugggaggcccucaucauggggcccgaggacacgugcuucgaguucggcgucuuccccgccauccugagcuucccgcuggacuacccccucuccccccccaagaugcgguucaccugcgagauguuccacccgaacaucuaccccgacgggcgcgugugcaucagcauccugcacgcccccggcgacgaccccaugggcuacgaguccagcgcggagcggugguccccggugcagagcgucgagaagauccugcucuccguggugagcaugcuggccgagcccaacgacgaguccggggccaacgucgacgccagcaagauguggcgcgacgaccgggagcaguucuacaagaucgcgaagcagaucgugcagaagucccugggccucuga

SEQ ID NO: 38346 - RNA, 552 nt, Artificial Sequence
  derived and/or modified sequence opt1 from UBE2H__Homo_sapiens__NP_003335
augagcucccccagcccgggcaagcgccggauggacaccgacguggucaagcugaucgaguccaagcacgaggugaccauccucgggggccugaacgaguucguggucaaguucuacgggccccagggcacgcccuacgagggcgggguguggaaggugcgcgucgaccugcccgacaaguacccguucaagagccccuccaucggcuucaugaacaagaucuuccaccccaacaucgacgaggccagcgggaccgugugccucgacgugaucaaccagaccuggaccgcccuguacgaccugacgaacaucuucgaguccuuccucccccagcugcuggcguacccgaaccccaucgacccccucaacggcgacgccgccgccauguaccugcaccggcccgaggaguacaagcagaagaucaaggaguacauccagaaguacgccaccgaggaggcgcugaaggagcaggaggaggggaccggcgacagcuccagcgaguccagcauguccgacuucagcgaggacgaggcccaggacauggagcucuga

SEQ ID NO: 38347 - RNA, 477 nt, Artificial Sequence
  derived and/or modified sequence opt1 from UBE2I__Homo_sapiens__NP_003336
augagcggcaucgcccugucccgccucgcccaggagcggaaggcguggcgcaaggaccaccccuucggguucguggccgucccgaccaagaaccccgacggcaccaugaaccugaugaacugggagugcgccauccccgggaagaagggcacgcccugggagggcgggcuguucaagcuccggaugcuguucaaggacgacuacccgagcuccccgcccaagugcaaguucgagccgccccuguuccaccccaacguguaccccagcggcaccgugugccucuccauccuggaggaggacaaggacuggcgccccgccaucaccaucaagcagauccugcucgggauccaggagcugcugaacgagcccaacauccaggaccccgcccaggcggaggccuacaccaucuacugccagaaccgggucgaguacgagaagcgcgugcgggcccaggccaagaaguucgcgcccagcuga

SEQ ID NO: 38348 - RNA, 957 nt, Artificial Sequence
  derived and/or modified sequence opt1 from UBE2J1__Homo_sapiens__NP_057105
auggagacccgcuacaaccucaagagccccgccgugaagcggcugaugaaggaggccgcggagcugaaggacccgaccgaccacuaccacgcccagccccuggaggacaaccucuucgaguggcacuucacgguccgcggcccgcccgacuccgacuucgacgggggcguguaccacgggcggaucgugcugccgcccgaguaccccaugaagcccccgagcaucauccugcucaccgccaacggccgcuucgaggucgggaagaagaucugccuguccaucagcggccaccaccccgagaccuggcagcccuccuggagcauccggaccgcccugcucgccaucaucggcuucaugcccacgaagggggagggcgcgaucgggucccuggacuacacccccgaggagcgccgggcccuggccaagaagucccaggacuucugcugcgagggcugcgggagcgccaugaaggacgugcuccugccccucaagagcggcuccgacagcucccaggcggaccaggaggccaaggagcuggcccgccagaucagcuucaaggccgaggugaacuccagcggcaagaccaucuccgagagcgaccugaaccacuccuucagccugaccgaccuccaggacgacauccccacgaccuuccagggggccaccgcgagcaccuccuacggccugcagaacagcuccgccgccagcuuccaccagcccacgcagccggucgccaagaacaccuccaugagcccccggcagcgccgggcccagcagcagucccagcgccggcugagcaccucccccgacgugauccaggggcaccagccccgcgacaaccacaccgaccacggcggcagcgcggugcucaucgucauccugacgcuggcccucgccgcccugaucuuccggcgcaucuaccuggccaacgaguacaucuucgacuucgagcucuga

SEQ ID NO: 38349 - RNA, 474 nt, Artificial Sequence
  derived and/or modified sequence opt1 from UBE2K__Homo_sapiens__NP_001104582
auggccaacaucgccgugcagcgcaucaagcgggaguucaaggagguccucaagagcgaggagaccuccaagaaccagaucaagguggaccugguggacgagaacuucaccgagcugcgcggcgagaucgcggggcccccggacacgcccuacgagggcgggcgguaccagcuggagaucaagauccccgagaccuaccccuucaacccgcccaagguccgcuucaucaccaagaucuggcaccccaacaucagcuccgugaccggcgccaucugccucgacauccugaaggaccagugggccgccgccaugacgcugcggaccgugcuccugagccugcaggcgcuccuggccgccgccgagcccgacgacccgcaggacgcggucguggccaaccagaacgccgugaucgucgcccuguccagcaaguccugggacguggagaccgccaccgagcuccugcugagcaacuga

SEQ ID NO: 38350 - RNA, 639 nt, Artificial Sequence
  derived and/or modified sequence opt1 from UBE2L3__Homo_sapiens__NP_001243284
augcaggucgccgccggcacccgcggggacacccggcugcaggagguggcgcuccugccccagcuguucgaccuccuggugcugggccagcgccgggcccgccuccugcgccaggugccgagcgcccuggccgggaaggaccucgcccagcugcaggcgggcgccacgcuggccggguaccggcgggcccacggccccgaggagcucgaggagauccgcaagugcggcaugaagaacuuccggaacauccaggucgacgaggcgaaccugcugaccuggcaggggcucaucgugcccgacaacccgcccuacgacaagggcgccuuccgcaucgagaucaacuuccccgccgaguaccccuucaagcccccgaagaucaccuucaagaccaagaucuaccaccccaacaucgacgagaagggccaggugugccugcccgucaucuccgccgagaacuggaagcccgccacgaagaccgaccaggugauccagagccugaucgcgcucgugaacgacccgcagcccgagcacccccugcgggccgaccuggccgaggaguacuccaaggaccgcaagaaguucugcaagaacgccgaggaguucaccaagaaguacggggagaagcggcccgucgacuga

SEQ ID NO: 38351 - RNA, 462 nt, Artificial Sequence
  derived and/or modified sequence opt1 from UBE2L6__Homo_sapiens__NP_004214
augauggccagcaugcgcguggucaaggagcuggaggaccuccagaagaagcccccgcccuaccugcggaaccuguccagcgacgacgccaacgugcucguguggcacgcgcugcugcuccccgaccagcccccguaccaccugaaggccuucaaccugcgcaucuccuucccgcccgaguaccccuucaagccgcccaugaucaaguucaccaccaagaucuaccaccccaacgucgacgagaacggccagaucugccuccccaucaucagcuccgagaacuggaagcccugcacgaagaccugccaggugcuggaggcccugaacgugcucgucaaccggcccaacauccgcgagccccugcggauggaccuggccgaccuccugacccagaaccccgagcuguuccgcaagaacgccgaggaguucacccuccgguucgggguggaccgcccgagcuga

SEQ ID NO: 38352 - RNA, 552 nt, Artificial Sequence
  derived and/or modified sequence opt1 from UBE2M__Homo_sapiens__NP_003960
augaucaagcuguucagccucaagcagcagaagaaggaggaggaguccgccggcgggaccaagggcagcuccaagaaggccagcgcggcccagcugcgcauccagaaggacaucaacgagcugaaccuccccaagaccugcgacaucuccuucagcgacccggacgaccugcugaacuucaagcucgugaucugccccgacgagggguucuacaaguccggcaaguucgucuucagcuucaagguggggcagggcuacccccacgacccgcccaaggugaagugcgagacgauggucuaccaccccaacaucgaccuggagggcaacgugugccugaacauccuccgggaggacuggaagcccgugcugaccaucaacuccaucaucuacgggcugcaguaccucuuccuggagcccaacccggaggacccccugaacaaggaggccgccgagguccuccagaacaaccgccggcuguucgagcagaacgugcagcgcagcaugcggggcggguacaucggcuccaccuacuucgagcgcugccugaaguga

SEQ ID NO: 38353 - RNA, 459 nt, Artificial Sequence
  derived and/or modified sequence opt1 from UBE2N__Homo_sapiens__NP_003339
auggccggccugccccgccggaucaucaaggagacccagcgccuccuggccgagccggugcccgggaucaaggcggagcccgacgagagcaacgcccgguacuuccacgucgugaucgccggcccccaggacuccccguucgagggcgggaccuucaagcuggagcuguuccuccccgaggaguaccccauggccgcccccaaggugcgcuucaugacgaagaucuaccacccgaacgucgacaagcuggggcggaucugccucgacauccugaaggacaaguggagccccgcgcugcagauccgcaccgugcuccuguccauccaggcccugcucagcgcccccaaccccgacgacccgcuggccaacgacguggcggagcaguggaagaccaacgaggcccaggccaucgagaccgcccgggccuggacgcgccuguacgcgaugaacaacaucuga

SEQ ID NO: 38354 - RNA, 1080 nt, Artificial Sequence
  derived and/or modified sequence opt1 from UBE2Q2__Homo_sapiens__NP_001138807
augcgcauggacagccugaccgaggagaagcucgagugccggcuguggugcugccuguccgaccccagcccgcccggccucgccgcccgcugcugcgugcuggagcgguccaucguccccagccugcgccaggaguccuaccccagcuccagcccgaucugguucguggacuccgaggaccccaaccucaccagcgugcuggagcggcuggaggacacgaagaacaacaaccuccugcgccagcagcugaaguggcucaucugcgagcugugcucccuguacaaccuccccaagcaccuggacgucgagaugcuggaccagccccucccgaccgggcagaacggcaccaccgaggaggugacgagcgaggaggaggaggaggaggaggagauggcggaggacaucgaggaccuggaccacuacgagaugaaggaggaggagcccaucuccgggaagaaguccgaggacgagggcaucgagaaggagaaccuggccauccucgagaagauccggaagacccagcgccaggaccaccugaacggggccguguccggcagcguccaggccuccgaccggcugaugaaggagcuccgcgacaucuaccggagccaguccuacaagaccggcaucuacagcguggagcugaucaacgacagccuguacgacuggcacgugaagcuccagaaggucgaccccgacagcccccugcacagcgaccugcagauccucaaggagaaggaggggaucgaguacauccugcugaacuucuccuucaaggacaacuuccccuucgacccgcccuucgugcgcgugguccuccccgugcugagcggcggguacgugcugggcgggggcgcccucugcauggagcugcugaccaagcagggcugguccagcgcguacuccaucgagagcgucaucaugcagaucaacgccacgcucgugaaggggaaggcccgggugcaguucggcgccaacaagaaccaguacaaccuggcgcgcgcccagcaguccuacaacagcaucguccagauccacgagaagaacgggugguacaccccgcccaaggaggacggcuga

SEQ ID NO: 38355 - RNA, 486 nt, Artificial Sequence
  derived and/or modified sequence opt1 from UBE2QL1__Homo_sapiens__NP_001138633
augaaggagcugcaggacaucgcccgccucagcgaccgguucaucuccguggagcuggucgacgagagccuguucgacuggaacgugaagcuccaccagguggacaaggacuccguccuguggcaggacaugaaggagaccaacaccgaguucauccugcucaaccugacguuccccgacaacuuccccuucagcccgcccuucaugcgcgugcugagcccccggcucgagaacggcuacgugcuggacgggggcgccaucugcauggagcugcucacgccccgcggguggagcuccgcguacaccgucgaggccgugaugcggcaguucgccgccagccuggugaagggccaggggcgcaucugccggaaggccggcaaguccaagaaguccuucucccgcaaggaggcggaggccaccuucaagagccuggucaagacccacgagaaguacggcugggugaccccgcccguguccgacggguga

SEQ ID NO: 38356 - RNA, 717 nt, Artificial Sequence
  derived and/or modified sequence opt1 from UBE2R2__Homo_sapiens__NP_060281
auggcccagcagcagaugaccagcucccagaaggcccugaugcucgagcucaagagccugcaggaggagcccguggagggcuuccgcaucacccuggucgacgaguccgaccuguacaacugggagguggcgaucuucgggccgcccaacacgcuguacgagggcggguacuucaaggcccacaucaaguuccccaucgacuaccccuacagcccgcccaccuuccgguuccucaccaagauguggcaccccaacaucuacgagaacggcgacgugugcaucuccauccugcacccgcccgucgacgacccccagagcggggagcugcccuccgagcgcuggaaccccacccagaacgugcggacgauccuccugagcgugaucucccugcucaacgagccgaacaccuucagccccgccaacgucgacgccuccgugauguuccgcaaguggcgggacagcaagggcaaggacaaggaguacgccgagaucauccgcaagcaggucuccgcgaccaaggccgaggccgagaaggacggcgugaaggugcccaccacgcuggccgaguacugcaucaagaccaaggugcccagcaacgacaacuccagcgaccugcucuacgacgaccuguacgacgacgacaucgacgacgaggacgaggaggaggaggacgcggacugcuacgacgacgacgacuccgggaacgaggagagcuga

SEQ ID NO: 38357 - RNA, 669 nt, Artificial Sequence
  derived and/or modified sequence opt1 from UBE2S__Homo_sapiens__NP_055316
augaacagcaacguggagaaccugcccccgcacaucauccgccucgucuacaaggaggugaccacccugacggccgacccgcccgacggcaucaagguguuccccaacgaggaggaccugaccgaccuccaggucaccaucgaggggcccgagggcacccccuacgccgggggccuguuccggaugaagcugcuccuggggaaggacuuccccgcguccccgcccaagggcuacuuccugacgaagaucuuccaccccaacgugggcgccaacggggagaucugcgugaacguccucaagcgcgacuggaccgccgagcugggcauccggcacgugcugcucaccaucaagugccugcugauccaccccaaccccgagagcgcccucaacgaggaggccgggcgccugcugcucgagaacuacgaggaguacgcggcccgggcccgccugcugaccgagauccacggcggggccggcggcccguccgggcgggcggaggccggccgcgcccucgccagcgggacggaggccuccagcaccgaccccggcgcgcccggcgggcccggcggggccgagggcccgauggccaagaagcacgccggggagcgggacaagaagcuggccgcgaagaagaagaccgacaagaagcgcgcccugcggcgccucuga

SEQ ID NO: 38358 - RNA, 594 nt, Artificial Sequence
  derived and/or modified sequence opt1 from UBE2T__Homo_sapiens__NP_054895
augcagcgcgccagccggcugaagcgcgagcuccacaugcuggccaccgagcccccgcccggcaucacgugcuggcaggacaaggaccagauggacgaccugcgggcgcagauccucgggggcgccaacacccccuacgagaaggggguguucaagcuggaggucaucauccccgagcgcuacccguucgagccgccccagauccgguuccugacccccaucuaccaccccaacaucgacuccgccggccgcaucugccucgacgugcugaagcugccgcccaagggggccuggcggcccagccucaacaucgccaccgugcugaccuccauccagcugcucaugagcgagcccaaccccgacgacccccugauggcggacaucuccagcgaguucaaguacaacaagcccgccuuccugaagaacgcccgccaguggacggagaagcacgcccggcagaagcagaaggcggacgaggaggagaugcucgacaaccugccggaggccggcgacucccgcguccacaacagcacccagaagcggaaggccucccagcuggugggcaucgagaagaaguuccaccccgacguguga

SEQ ID NO: 38359 - RNA, 954 nt, Artificial Sequence
  derived and/or modified sequence opt1 from UBE2U__Homo_sapiens__XP_011539067
augcacggccgcgccuaccugcuccugcaccgggacuucugcgaccugaaggagaacaacuacaaggggaucaccgccaagcccgugagcgaggacaugauggagugggaggucgagaucgagggccuccagaacuccguguggcaggggcugguguuccagcugaccauccacuucacgagcgaguacaacuacgcgccgcccgucgugaaguucaucaccauccccuuccaccccaacguggacccgcacaccggccagcccugcaucgacuuccucgacaaccccgagaaguggaacaccaacuacacgcuguccagcauccugcucgcccugcaggucaugcuguccaaccccgugcucgagaacccggugaaccuggaggccgcccgcauccuggucaaggacgagagccucuaccggaccauccugcgccuguucaaccggccccuccagaugaaggacgacucccaggagcugcccaaggacccccgcaagugcauccggccgaucaagaccaccagcuucuccgacuacuaccagacguggagccgcaucgccaccuccaaggcgaccgaguacuaccggacgccccugcucaaggugcccaacuucaucgggcaguacuacaaguggaagaagauggaccugcagcaccagaaggaguggaaccugaaguacagcgugaucaagugcuggcucgcccgcaagcggaugccccacgaggucacccacuccauggaggagaucaagcugugcccgacccugaacgagaucuuccucgagagccccaccgccaucaacuccaucaccgacaucuacgagacggaggaggagggcuggaaguccgacaccagccuguacgagaacgacaccgacgagccccgcgaggaggagguggaggaccugaucagcuggaccaacacgcucaacaccaacaccuccgaggacuga

SEQ ID NO: 38360 - RNA, 444 nt, Artificial Sequence
  derived and/or modified sequence opt1 from UBE2V1__Homo_sapiens__NP_001027459
auggccgccaccaccggcagcggggugaaggucccccgcaacuuccggcugcucgaggagcuggaggagggccagaagggggugggcgacgggacgguguccuggggccuggaggacgacgaggacaugacccucacccgcuggaccggcaugaucaucgggccgccccggacgaucuacgagaaccgcaucuacagccugaagaucgagugcggccccaaguaccccgaggcgccgcccuucguccgguucgugaccaagaucaacaugaacggggugaacuccagcaacggcgucguggacccccgcgccaucuccgugcuggccaaguggcagaacagcuacuccaucaaggucgugcuccaggagcugcggcgccugaugaugagcaaggagaacaugaagcucccccagccgcccgaggggcagugcuacuccaacuga

SEQ ID NO: 38361 - RNA, 438 nt, Artificial Sequence
  derived and/or modified sequence opt1 from UBE2V2__Homo_sapiens__NP_003341
auggccgugagcaccggcgucaaggugccccgcaacuuccggcugcucgaggagcuggaggaggggcagaagggcgugggggacggcaccgucuccugggggcuggaggacgacgaggacaugacgcucacccgcuggaccggcaugaucaucggcccgccccggaccaacuacgagaaccgcaucuacagccugaagguggagugcgggcccaaguaccccgaggccccgcccuccgugcgguucgucacgaagaucaacaugaacggcaucaacaacagcuccgggaugguggacgcgcgcagcauccccgugcuggccaaguggcagaacuccuacagcaucaaggucgugcuccaggagcugcggcgccugaugauguccaaggagaacaugaagcucccccagccgcccgagggccagaccuacaacaacuga

SEQ ID NO: 38362 - RNA, 1065 nt, Artificial Sequence
  derived and/or modified sequence opt1 from UBE2Z__Homo_sapiens__NP_075567
auggccgagagccccaccgaggaggccgcgaccgccggcgccggggccgccggcccgggggcguccagcguggccggcgucguggggguguccggcagcggcgggggcuucgggccgcccuuccugcccgacgucugggccgccgcggccgccgccggcggggccggcggccccggguccggccucgcgccccugcccgggcugcccccgagcgccgccgcccacggcgccgcgcuccugucccacugggaccccacgcugagcuccgacugggacggcgagcgcaccgcgccccagugccuccugcggaucaagcgcgacaucaugagcaucuacaaggagcccccgcccgggauguucguggugcccgacaccgucgacaugaccaagauccacgcccugaucacgggccccuucgacaccccguacgagggcggguucuuccucuucguguuccggugcccgcccgacuaccccauccacccgccccgcgugaagcugaugaccaccgggaacaacacgguccgguucaaccccaacuucuaccgcaacggcaaggugugccuguccauccucggcaccuggaccgggcccgccuggagccccgcccaguccaucagcuccgugcugaucagcauccagucccugaugaccgagaaccccuaccacaacgagcccggcuucgagcaggagcggcaccccggggacagcaagaacuacaacgagugcauccgccacgagacgauccgggucgccgugugcgacaugauggagggcaagugcccgugccccgagccccuccgcggggugauggagaaguccuuccuggaguacuacgacuucuacgaggucgccugcaaggaccggcugcaccuccagggccagaccaugcaggacccguucggcgagaagcgcgggcacuucgacuaccagagccugcugaugcggcucggccugauccgccagaaggugcuggagcggcuccacaacgagaacgccgagauggacagcgacuccagcuccagcgggaccgagaccgaccugcacggcucccugcgcguguga

SEQ ID NO: 38363 - RNA, 2559 nt, Artificial Sequence
  derived and/or modified sequence opt1 from UBE3A__Homo_sapiens__XP_005268328
augaagcgcgccgccgcgaagcaccugaucgagcgguacuaccaccagcucaccgagggcugcgggaacgaggccugcaccaacgaguucugcgccagcugccccacguuccugcgcauggacaacaacgccgccgcgaucaaggcccuggagcucuacaagaucaacgccaagcugugcgacccgcaccccuccaagaagggcgccagcuccgcguaccuggagaacagcaagggggcccccaacaacuccugcagcgagaucaagaugaacaagaagggcgcccggaucgacuucaaggacgugaccuaccucaccgaggagaaggucuacgagauccuggagcugugccgcgagcgggaggacuacagcccccucauccgcgugaucgggcggguguucuccuccgccgaggcccugguccagagcuuccgcaaggugaagcagcacaccaaggaggagcugaagucccuccaggcgaaggacgaggacaaggacgaggacgagaaggagaaggccgccugcagcgccgccgcgauggaggaggacuccgaggccagcuccagccggaucggcgacuccagccagggcgacaacaaccugcagaagcuggggccggacgacguguccgucgacaucgacgccauccgccggguguacacgcgccuccugagcaacgagaagaucgagaccgccuuccugaacgcccucguguaccugagccccaacgucgagugcgaccugaccuaccacaacguguacucccgggaccccaacuaccucaaccuguucaucaucgugauggagaaccgcaaccugcacagccccgaguaccucgagauggcgcugccgcuguucugcaaggccauguccaagcucccccuggccgcccagggcaagcugauccggcucuggagcaaguacaacgccgaccagauccgccggaugauggagaccuuccagcagcugaucacguacaaggucaucuccaacgaguucaacagccgcaaccuggugaacgacgacgacgcgaucguggccgccuccaagugccucaagauggucuacuacgccaacguggucgggggcgagguggacaccaaccacaacgaggaggacgacgaggagcccauccccgagagcuccgagcugacccugcaggagcuccugggggaggagcggcgcaacaagaagggcccgcggguggacccccuggagaccgagcucggcgugaagacgcuggacugccgcaagccccugauccccuucgaggaguucaucaacgagccgcucaacgagguccuggagauggacaaggacuacaccuucuucaagguggagaccgagaacaaguucagcuucaugaccugccccuucauccugaacgcggugacgaagaaccucgggcuguacuacgacaaccgcauccggauguacuccgagcgccggaucaccguccuguacagccucgugcagggccagcagcugaaccccuaccugcgccugaagguccggcgcgaccacaucaucgacgacgcccucgugcggcuggagaugaucgccauggagaaccccgccgaccugaagaagcagcucuacguggaguucgagggggagcagggcgucgacgagggcgggguguccaaggaguucuuccagcugguggucgaggagaucuucaacccggacaucggcauguucaccuacgacgagagcaccaagcuguucugguucaaccccuccagcuucgagacggaggggcaguucacccucaucggcaucgugcuggggcuggccaucuacaacaacugcauccucgacgugcacuuccccauggucguguaccgcaagcugaugggcaagaagggcaccuuccgggaccugggggacucccaccccgugcucuaccagagccugaaggaccugcucgaguacgagggcaacgucgaggacgacaugaugaucaccuuccagaucucccagacggaccuguucgggaacccgaugauguacgaccugaaggagaacggcgacaagauccccaucaccaacgagaaccgcaaggaguucgugaaccucuacagcgacuacauccugaacaagagcguggagaagcaguucaaggcguuccggcgcggguuccacauggucaccaacgagagcccccugaaguaccucuuccggcccgaggagaucgagcugcugaucugcggcucccgcaaccucgacuuccaggcccuggaggagaccacggaguacgacggcggguacacccgggacuccgugcugauccgcgaguucugggagaucgugcacagcuucaccgacgagcagaagcgccucuuccugcaguucaccacgggcaccgaccgggccccggucgggggccuggggaagcucaagaugaucaucgccaagaacggccccgacaccgagcggcugcccaccucccacacgugcuucaacgugcugcuccugccggaguacagcuccaaggagaagcugaaggagcgccuccugaaggccaucaccuacgcgaagggcuucgggaugcuguga

SEQ ID NO: 38364 - RNA, 735 nt, Artificial Sequence
  derived and/or modified sequence opt1 from UBE3B__Homo_sapiens__NP_001257380
auguucacccugagccagaccucccgcgccugguucaucgaccgggcccgccaggcgcgggaggagcgccucgugcagaaggagcgggagcgcgccgccgucgugauccaggcccacgugcggagcuuccugugccgcucccggcugcagcgcgacauccggcgcgagaucgacgacuucuucaaggccgacgaccccgagagcacgaagcgguccgcgcucugcaucuucaagaucgcccgcaagcugcuguuccucuuccggaucaaggaggacaacgagcgcuucgagaagcugugccggagcauccuguccagcauggacgccgagaacgagccgaaggucugguacgugucccucgccugcagcaaggaccugacccugcucuggauccagcagaucaagaacauccugugguacugcugcgacuuccugaagcagcucaagcccgagauccugcaggacucccgccugaucacccucuaccugaccaugcuggugacguucaccgacaccagcaccuggaagauccuccggggcaagggggagucccugcgccccgcgaugaaccacaucugcgccaacaucaugggccaccugaaccagcacggguucuacagcguccuccagugcugcgacggccuguuccccgaccugguguccuacgccccgcacaacaaccccgugcgguggagcgucgggcgcuccugguacgacuggcagcucagccgcuga

SEQ ID NO: 38365 - RNA, 3252 nt, Artificial Sequence
  derived and/or modified sequence opt1 from UBE3C__Homo_sapiens__NP_055486
auguucagcuucgagggcgacuucaagacccgccccaaggugucccuggggggcgccagccggaaggaggagaaggccucccuccugcaccgcacccaggaggagcggcgcaagcgggaggaggagcgccggcgccugaagaacgcgaucaucauccagagcuucauccggggguaccgcgaccggaagcagcaguacuccauccagcgcagcgccuucgaccggugcgccacgcucucccagagcggcggggccuucccgaucgccaacggccccaaccugacccugcucguccgccagcugcuguucuucuacaagcagaacgaggacuccaagcggcucaucuggcuguaccagaaccugaucaagcacagcucccucuucgugaagcagcuggacggcagcgagcgccugaccugccucuuccagaucaagcggcugaugucccugugcugccgccuccugcagaacugcaacgacgacagccugaacguggcgcuccccaugcggaugcuggaggucuucuccagcgagaacaccuaccugcccgugcuccaggacgccuccuacguggucagcgugaucgagcagauccugcacuacaugauccacaacggguacuaccgcucccuguaccuccugaucaacagcaagcugccgagcuccaucgaguacagcgaccucucccgggugcccaucgccaagauccugcuggagaacguccucaagccccugcacuucacguacaacagcugccccgagggcgcccgccagcagguguucaccgcguucaccgaggaguuccuggccgccccguucaccgaccagaucuuccacuucaucauccccgcccucgccgacgcgcagacgguguuccccuacgagcccuuccugaacgcccugcuccugaucgagucccgcugcagccggaaguccgggggcgccccguggcuguucuacuucguccucaccgugggggagaacuaccugggcgcccugagcgaggagggccuccugguguaccugcgcguccuccagaccuuccugucccagcugcccgugagccccgccuccgcgagcugccacgacuccgccagcgacuccgaggaggagagcgaggaggccgacaagcccuccagcccggaggacgggcggcuguccgugagcuacaucaccgaggagugccucaagaagcuggacacgaagcagcagaccaacacccugcucaaccuggucuggcgcgacagcgccuccgaggagguguucaccacgauggccagcgugugccacacccugaugguccagcaccggaugauggugcccaaggugcgccuccuguacucccuggcguucaacgcccgguuccuccgccaccugugguuccugaucagcuccaugagcacccggaugaucaccggcuccauggucccccuccugcaggugaucagccgcgggucccccaugagcuucgaggacuccagccggaucaucccgcuguucuaccucuucuccagccuguucucccacagccugaucuccauccacgacaacgaguucuucggcgaccccaucgaggucgugggccagcgccagagcagcaugaugcccuucacgcucgaggagcugaucaugcugucccggugccuccgcgacgccugccuggggaucaucaagcuggccuaccccgagaccaagccggaggugcgggaggaguacaucaccgccuuccagagcaucggcgucaccacguccagcgagaugcagcagugcauccagauggagcagaagcgcuggauccagcucuucaaggugaucaccaaccuggugaagaugcugaagucccgggacacccgccggaacuucugcccccccaaccacuggcucagcgagcaggaggacaucaaggcggacaaggucacccagcuguacgugcccgccucccgccacguguggcgcuuccggcgcauggggcggaucggcccgcugcagagcacgcucgacgucgggcuggagucccccccccugagcguguccgaggagcgccagcucgccgugcugaccgagcugccguucgucgugcccuucgaggagcgggugaagaucuuccagcgccucaucuacgccgacaagcaggagguccagggcgacggccccuuccuggacgggaucaacgugaccauccggcgcaacuacaucuacgaggacgcguacgacaagcugagccccgagaacgagccggaccucaagaagcggauccgcgugcaccugcugaacgcccacggccucgacgaggccgggaucgacggcgggggcaucuuccgggaguuccugaacgagcugcucaaguccggcuucaaccccaaccagggguucuucaagaccacgaacgagggccugcuguaccccaaccccgccgcccagaugcucgucggggacagcuucgcgcgccacuacuacuuccugggccggaugcuggggaaggcccucuacgagaacaugcugguggagcugccguucgccggcuucuuccucuccaagcugcugggcaccagcgccgacguggacauccaccaccucgccucccuggaccccgaggucuacaagaaccugcucuuccugaagagcuacgaggacgacguggaggagcuggggcucaacuucaccguggucaacaacgaccugggcgaggcgcaggugguggagcugaaguucgggggcaaggacauccccgucaccuccgccaaccgcaucgccuacauccaccucguggccgacuaccggcugaaccgccagauccggcagcacugccuggccuuccgccagggccucgcgaacguggucagccuggaguggcugcggauguucgaccagcaggagauccaggugcucaucagcggggcccaggugcccaucucccuggaggaccugaagagcuucacgaacuacuccggcggguacagcgccgaccacccggucaucaagguguucuggcgcguggucgagggcuucaccgacgaggagaagcggaagcuccugaaguucgugaccuccugcagccgccccccccugcucggguucaaggagcuguaccccgccuucugcauccacaacggcggcuccgaccuggagcgccucccgaccgcgagcaccugcaugaaccugcugaagcuccccgaguucuacgacgagacgcugcugcgguccaagcuccuguacgccaucgagugcgccgccggguucgagcugagcuga

SEQ ID NO: 38366 - RNA, 3201 nt, Artificial Sequence
  derived and/or modified sequence opt1 from UBE4A__Homo_sapiens__NP_001191006
augaccgaccaggagaacaacaacaacaucagcuccaaccccuucgccgcccuguucggcagccucgcggacgccaagcaguucgccgccauccagaaggagcagcugaagcagcaguccgacgagcugccggccagccccgacgacuccgacaacagcguguccgagagccucgacgaguucgacuacuccgucgcggagaucagccgcuccuuccggagccagcaggagaucugcgagcagcugaacaucaaccacaugauccagcgcaucuuccugaucacccucgacaacuccgaccccagccugaaguccgggaacggcauccccagccggugcguguaccuggaggagauggccguggagcucgaggaccaggacuggcuggacauguccaacgucgagcaggcccuguucgcccgccuccugcugcaggacccggggaaccaccucaucaacaugacgagcuccaccacccugaaccugagcgcggaccgggacgccggcgagcgccacaucuucugcuaccucuacagcugcuuccagcgggccaaggaggagaucaccaaggugcccgagaaccugcugcccuucgccgugcagugccgcaaccucacggucuccaacacccggaccgugcugcugacccccgagaucuacguggaccagaacauccacgagcagcucgucgaccugaugcuggaggccauccagggggcgcacuucgaggacgugacggaguuccucgaggaggugaucgaggcccugauccuggacgaggagguccgcaccuucccggaggugaugauccccguguucgacauccuccugggccggaucaaggaccuggagcucugccagauccugcuguacgccuaccucgacauccugcuguacuucacccgccagaaggacauggccaaggucuucguggaguacauccagcccaaggaccccaccaacggccagauguaccagaagacgcuccugggggugauccugagcaucuccugccuccugaagaccccgggcgucguggagaaccacggguacuuccugaaccccagccgguccagcccccaggagaucaaggugcaggaggccaacauccaccaguucauggcgcaguuccacgagaagaucuaccagaugcucaagaaccugcugcagcucucccccgagaccaagcacugcauccugagcuggcugggcaacugccugcacgccaacgccgggcgcaccaagaucugggccaaccagaugccggagaucuucuuccagauguacgccuccgacgcguucuuccucaaccugggcgccgcccugcucaagcugugccagcccuucugcaagccccggagcucccgccugcucacguucaaccccaccuacugcgcccugaaggagcugaacgacgaggagcggaagaucaagaacguccacaugcgcggccucgacaaggagaccugccugaucccggccgugcaggagcccaaguucccccagaacuacaaccuggugaccgagaaccucgcgcugacggaguacacccuguaccucggguuccaccggcugcacgaccagauggucaagaucaaccagaaccugcaccgccuccagguggccuggcgggacgcccagcagagcuccagccccgccgcggacaaccugcgcgagcaguucgagcgccugaugaccaucuaccucuccaccaagacggccaugaccgagccgcagaugcugcagaacugccugaaccuccaggucagcauggccgugcugcuggugcagcucgccaucggcaacgaggggucccagcccaucgagcugaccuucccccugcccgacggcuacagcucccucgccuacgucccggaguucuucgcggacaaccugggcgacuuccugaucuuccuccggcgcuucgccgacgacauccuggagaccagcgccgacagccuggagcacgugcuccacuucaucacgaucuucaccggguccaucgagcggaugaagaacccccaccuccgcgccaagcuggccgaggugcuggaggcggucaugccccaccuggaccagaccccgaacccccuggugagcuccguguuccaccggaagcgcgucuucugcaacuuccaguacgcgccccagcucgccgaggcccugaucaagguguucguggacaucgaguucaccggcgacccccaccaguucgagcagaaguucaacuaccggcgcccgauguaccccauccugcgguacaugugggggacggacaccuaccgcgagagcaucaaggaccucgccgacuacgccuccaagaaccuggaggccaugaacccgccccuguuccuccgguuccugaaccugcucaugaacgacgccaucuuccugcuggacgaggccauccaguaccucagcaagaucaagauccagcagaucgagaaggaccgcggcgagugggacucccugacccccgaggcgcggcgcgagaaggaggccgggcugcagauguucggccagcucgcccgguuccacaacaucaugagcaacgagaccaucggcacgcuggccuuccugaccuccgagaucaagagccucuucguccaccccuuccuggccgagcgcaucaucuccaugcugaacuacuuccuccagcaccugguggggcccaagaugggcgcgcugaaggugaaggacuucagcgaguucgacuucaagccccagcagcucgucuccgacaucugcaccaucuaccugaaccugggggacgaggagaacuucugcgccaccgugccgaaggacggccggagcuacucccccacccucuucgcccagacggugcgcguccugaagaagaucaacaagcccgggaacaugaucauggccuucagcaaccuggccgagcggaucaagucccucgcggaccugcagcagcaggaggaggagaccuacgccgacgccugcgacgaguuccuggaccccaucaugagcacccucaugugcgacccgguggugcugcccagcucccgcgucaccguggaccgcagcacgaucgcccggcaccuccuguccgaccagaccgaccccuucaaccgcagcccccugaccauggaccagauccggccgaacaccgagcugaaggagaagauccagcgcuggcucgccgagcggaagcagcagaaggagcagcuggaguga

SEQ ID NO: 38367 - RNA, 3519 nt, Artificial Sequence
  derived and/or modified sequence opt1 from UBE4B__Homo_sapiens__XP_011538792
auggaggagcugagcgccgacgagauccgccggcgccggcucgcccgccuggcgggcgggcagaccucccagcccaccacgccgcugaccagcccccagcgggagaacccgcccggcccgcccaucgccgccuccgcccccgggcccagccagucccucggccugaacgugcacaacaugacccccgccaccagccccaucggggcguccggcgucgcccaccgcagccaguccagcgagggcguguccagccuguccagcucccccagcaacucccucgagacgcagagccagucccugagccggagccaguccauggacaucgacggggugagcugcgagaaguccaugagccaggucgacguggacuccggcaucgagaacauggagguggacgagaacgaccgccgggagaagcgcagccuguccgacaaggagcccagcuccgggccggaggucagcgaggagcaggcccuccagcuggugugcaagaucuuccggguguccuggaaggaccgcgaccgggacgucaucuuccugagcucccucagcgcccaguucaagcagaaccccaaggagguguucuccgacuucaaggaccugaucggccagauccugauggaggugcucaugaugagcacccagacccgcgacgagaaccccuucgcgucccugaccgccacgagccagcccaucgccgccgccgcgcgguccccggaccgcaaccugcuccugaacaccgggagcaaccccggcaccagccccauguucugcuccgucgccagcuucggcgccuccagccuguccagccucuacgaguccagccccgccccgacccccuccuucuggagcuccgugcccgugauggggcccagccuggccuccccgagccgggcggccucccagcuggccguccccagcacgccccucagcccccacuccgccgccagcggcaccgcggccgggucccagccgagcagcccccgcuaccggcccuacaccgugacccacccgugggccuccuccggcgugagcauccuguccagcucccccagcccgcccgcccuggccuccagcccccaggcgguccccgccuccagcucccgccagcggcccagcuccacggggcccccgcucccgcccgccagccccuccgccaccagccgccgccccagcucccugcggaucagccccuccauguacgacaaccccuucagcuuccuguuccucgcgcuguccggcgacagcuccgacgaggaggacgaggaggaggacgacgacgacggcgacggggacgacgagggcgggggcggcggggacgacuucagcugcgugcaguucggcuccagccugggggccuccggcggggccagcaacugggacuccuacagcgaccacuucaccaucgagaccugcaaggagacggacaugcucaacuaccugaucgagugcuucgaccgcgugggcaucgaggagaagaaggcccccaagaugugcucccagccggccgucagccagcugcucuccaacauccggagccagugcaucucccacaccgcgcuggugcugcagggcagccucacccagccccgcagccugcagcagcccuccuuccuggugcccuacaugcucugccggaaccugccguacggguucauccaggagcugguccgcaccacgcaccaggacgaggagguguucaagcagaucuucauccccauccuccagggccuggcccuggccgccaaggagugcagccucgacuccgacuacuucaaguacccccugauggcccugggggagcugugcgagaccaaguucggcaagacccaccccgucugcaaccucguggcgagccugcggcuguggcucccgaagucccugagccccgggugcggccgcgagcugcagcggcucuccuaccugggcgccuucuucagcuucuccguguucgccgaggacgacgucaaggugguggagaaguacuucagcgggcccgccaucacccuggagaacacgcgcgucgugucccagagccuccagcacuaccuggagcugggccggcaggagcuguucaagauccuccacuccauccugcucaacggggagacccgcgaggccgcgcugagcuacauggccgccguggucaacgccaacaugaagaaggcgcagaugcagaccgacgaccggcugguguccaccgacggcuucaugcucaacuuccugugggugcugcagcagcucagcacgaagaucaagcuggagaccgucgacccgaccuacaucuuccacccccgcugccggaucacccugcccaacgacgagacgcgcgugaacgccaccauggaggacgugaacgacuggcucaccgagcuguacggcgaccagcccccguucuccgagcccaaguuccccaccgagugcuucuuccugacccuccacgcccaccaccugagcauccugcccuccugccggcgcuacauccggcgccuccgcgccauccgggagcugaaccgcacggucgaggaccugaagaacaacgagagccaguggaaggacagcccgcucgccacccggcaccgcgagaugcugaagcggugcaagacccagcugaagaagcucgugcgcugcaaggcgugcgccgacgccgggcugcuggacgaguccuuccuccggcgcugccugaacuucuacggccugcucauccagcugcugcuccggauccuggaccccgccuaccccgacaucacccugccccucaacagcgacgugccgaaggucuucgccgcgcugcccgaguucuacguggaggacguggccgaguuccuguucuucaucguccaguacagcccccaggcccucuacgagcccugcacgcaggacaucgugauguuccugguggucaugcugugcaaccagaacuacauccgcaacccguaccucguggccaagcugguggaggucauguucaugaccaaccccgccgugcagccccggacccagaaguucuucgagaugaucgagaaccacccccuguccaccaagcuccuggugccgucccugaugaaguucuacacggacgucgagcacaccggggcgaccagcgaguucuacgacaaguucaccauccgcuaccacaucuccacgaucuucaagagccucuggcagaacaucgcccaccacggcaccuucauggaggaguucaacuccgggaagcaguucgugcgguacaucaacaugcugaucaacgacaccaccuuccugcucgacgagagccuggagucccugaagcgcauccacgaggugcaggaggagaugaagaacaaggagcagugggaccagcucccccgggaccagcagcaggcccgccagagccagcuggcccaggacgagcgggucucccgcagcuaccuggcgcucgccacggagaccguggacauguuccacauccugaccaagcagguccagaagcccuuccugcggccccacgagcucuccuacuacccggugaucagcuga

SEQ ID NO: 38368 - RNA, 540 nt, Artificial Sequence
  derived and/or modified sequence opt1 from UBIAD1__Homo_sapiens__XP_011539606
auggccgccagccaggugcugggcgagaagaucaacauccucuccggggagaccgucaaggcgggcgaccgcgacccccuggggaacgacugcccggagcaggaccggcugccccagcgcagcuggcggcagaagugcgccuccuacgugcucgcccugcgccccuggagcuucuccgccagccugacccccguggcccucggcuccgcgcuggccuaccggagccacgggguccuggacccgcgccuccuggugggcugcgccguggccguccuggcggugcacggcgccgggaaccucgugaacacguacuacgacuucuccaagggcaucgaccacaagaaguccgacgaccggacccuggucgaccgcauccuggagccccaggacguggugcgguucggggucuuccucuacacccugggcugcgugugcgccgccugccuguacuaccucagcccccugaagcuggagcaccucgcccugaucuacuucgggggccugagcggcuccuuccucuacaccggggugcugaucuga

SEQ ID NO: 38369 - RNA, 354 nt, Artificial Sequence
  derived and/or modified sequence opt1 from UBL3__Homo_sapiens__NP_009037
augagcuccaacgugcccgccgacaugaucaaccugcgccucauccuggucagcggcaagaccaaggaguuccuguucuccccgaacgacagcgccuccgacaucgcgaagcacguguacgacaacuggcccauggacugggaggaggagcaggucagcucccccaacauccuccggcugaucuaccaggggcgcuuccugcacggcaacgugacccucggggcccugaagcugcccuucggcaagacgaccgugaugcaccucguggcccgggagacccugccggagcccaacagccaggggcagcgcaaccgggagaagaccggcgaguccaacugcugcgucauccuguga

SEQ ID NO: 38370 - RNA, 474 nt, Artificial Sequence
  derived and/or modified sequence opt1 from UBL4A__Homo_sapiens__NP_055050
augcagcugaccgugaaggcccuccagggccgcgagugcagccugcagguccccgaggacgagcugguguccacccucaagcagcuggugagcgagaagcugaacgucccggugcggcagcagcgccuccuguucaaggggaaggcccuggcggacggcaagcggcucuccgacuacagcaucgggcccaacuccaagcugaaccugguggucaagccccucgagaaggugcugcuggaggagggcgaggcccagcgccucgccgacagccccccgccccagguguggcagcugaucuccaagguccuggcccggcacuucagcgccgcggacgccucccgcgugcucgagcagcugcagcgggacuacgagcgcagccugucccggcucacgcuggacgacaucgagcgccuggccagccgguuccuccaccccgaggugaccgagaccauggagaagggguucuccaaguga

SEQ ID NO: 38371 - RNA, 222 nt, Artificial Sequence
  derived and/or modified sequence opt1 from UBL5__Homo_sapiens__NP_001041706
augaucgagguggucugcaacgaccgccugggcaagaaggugcgggugaagugcaacaccgacgacaccaucggggaccucaagaagcugaucgccgcccagacgggcacccgcuggaacaagaucguccugaagaagugguacaccaucuucaaggaccacgugagccucggggacuacgagauccacgacggcaugaaccuggagcuguacuaccaguga

SEQ ID NO: 38372 - RNA, 1143 nt, Artificial Sequence
  derived and/or modified sequence opt1 from UBL7__Homo_sapiens__NP_001273669
augagccuguccgacuggcaccucgccgugaagcuggccgaccagccccugacccccaagagcauccuccgccugccggagaccgagcugggcgaguacucccucgggggcuacagcaucuccuuccugaagcagcugaucgcggggaagcuccaggagagcguccccgaccccgagcugaucgaccugaucuacugcggccggaagcucaaggacgaccagacgcuggacuucuacgggauccagccgggcuccaccgugcacgugcugcgcaagagcuggcccgagcccgaccagaagcccgagccggucgacaagguggccgccaugcgggaguuccgcgugcuccacaccgcccugcacuccagcuccagcuaccgggaggccgucuucaagaugcuguccaacaaggagagccucgaccagaucaucguggcgacccccggccuguccagcgaccccaucgcccugggggugcuccaggacaaggaccuguucuccgucuucgccgaccccaacaugcuggacacgcucgugccggcccaccccgcgcuggugaacgccaucguccuggugcuccacagcguggccggcuccgcccccaugcccgggaccgacagcagcucccgcagcaugccguccagcuccuaccgggacaugcccggcggguuccuguucgagggccugagcgacgacgaggacgacuuccaccccaacacccgcuccacccccagcuccagcacgccguccagccggcccgccucccucggcuacagcggggcggccggcccccgccccaucacccaguccgagcuggccaccgcccuggcccucgcgagcaccccggaguccagcucccacacgcccacccccgggacccagggccacagcagcggcaccucccccaugagcuccgggguccagagcggcacgccgaucaccaacgaccuguucucccaggcccugcagcacgcccuccaggccagcgggcagcccucccugcagagccaguggcagccccagcugcagcagcuccgggacaugggcauccaggacgacgagcugucccugcgcgcccuccaggcgaccgggggcgacauccaggccgcccuggagcugaucuucgccggcggggccccguga

SEQ ID NO: 38373 - RNA, 957 nt, Artificial Sequence
  derived and/or modified sequence opt1 from UBLCP1__Homo_sapiens__NP_659486
auggcccugcccaucaucgugaaguggggcgggcaggaguacagcgucaccacccucuccgaggacgacacggugcuggaccugaagcaguuccucaagacccugaccggcgugcugccggagcgccagaagcuccuggggcugaaggucaagggcaagcccgccgagaacgacgugaagcucggggcgcugaagcugaagcccaacaccaagaucaugaugaugggcacgcgggaggagagccucgaggacgugcuggggcccccgcccgacaacgacgacgucgugaacgacuucgacaucgaggacgagguggucgagguggagaaccgcgaggagaaccugcucaagaucucccggcgcgugaaggaguacaaggucgagauccugaacccgccccgggagggcaagaagcugcucgugcuggacguggacuacacccuguucgaccaccgcagcugcgccgagaccggcgucgagcucaugcggcccuaccugcacgaguuccugaccuccgccuacgaggacuacgacaucgugaucuggagcgccacgaacaugaaguggaucgaggccaagaugaaggagcucgggguguccaccaacgcgaacuacaagaucaccuucaugcuggacagcgccgccaugaucaccguccacacgccccgccggggccugaucgacgugaagccccucggggugaucuggggcaaguucuccgaguucuacagcaagaagaacaccaucauguucgacgacaucggccgcaacuuccugaugaacccccagaacgggcugaagauccggccguucaugaaggcccaccucaaccgcgacaaggacaaggagcugcugaagcucacccaguaccugaaggagaucgcgaagcuggacgacuuccucgaccugaaccacaaguacugggagcgguaccuguccaagaagcagggccaguga

SEQ ID NO: 38374 - RNA, 3405 nt, Artificial Sequence
  derived and/or modified sequence opt1 from UBN1__Homo_sapiens__NP_001072982
augagcgagccccaccgcgugcaguucaccucccugccgggcagccucaaccccgccuuccugaagaagucccggaaggaggaggccggggcgggcgagcagcaccaggacugcgagcccgccgccgccgccguccgcaucacccugacgcucuucgagcccgaccacaagcggugcccggaguucuucuaccccgagcuggugaagaacauccgcgggaaggugaagggccugcagcccggggacaagaagaaggaccucagcgaccccuucaacgacgaggagaaggagcggcacaaggucgaggcgcuggcccgcaaguucgaggagaaguacggcggcaagaagcggcgcaaggaccggauccaggaccugaucgacaugggguacggcuacgacgaguccgacagcuucaucgacaacuccgaggccuacgacgagcucgugccggccagccugaccaccaaguacgggggcuucuacaucaacuccgggacccugcaguuccgccaggcgagcgaguccgaggacgacuucaucaaggagaagaagaagaagagccccaagaagcggaagcucaaggagggcggcgagaagaucaagaagaagaagaaggacgacacguacgacaaggagaagaaguccaagaagagcaaguucuccaaggccggguucaccgcccugaacgccagcaaggagaagaagaagaagaaguacuccggcgcccugagcgugaaggagaugcucaagaaguuccagaaggagaaggaggcgcagaagaagcgcgaggaggagcacaagcccgucgccgugcccuccgccgaggcccaggggcugcgggagcuggagggcgccagcgacccgcuccugagccuguucggcuccaccagcgacaacgaccuccugcaggcggccaccgccauggacucccugacggaccucgaccuggagcaccugcucagcgagucccccgaggggagccccuuccgcgacauggacgacggcuccgacagccugggggugggccuggaccaggaguuccggcagcccuccagccucccggaggggcugcccgccccccuggagaagcgcgucaaggagcucgcccaggcggcccgggccgccgagggcgagucccgccagaaguucuucacccaggacaucaacggcauccugcuggacaucgaggcccagacccgggagcucagcucccaggugcgcagcgggguguacgcguaccuggccuccuuccugcccugcagcaaggacgcccuccugaagcgggcccgcaagcugcaccucuacgagcagggcgggcgccugaaggagccgcugcagaagcucaaggaggcgaucggccgggccaugcccgagcagauggccaaguaccaggacgagugccaggcccacacccaggccaaggucgcgaagaugcuggaggaggagaaggacaaggagcagcgcgaccggaucugcuccgacgaggaggaggacgaggagaaggggggccgccggaucaugggcccccgcaagaaguuccaguggaacgacgagauccgggagcugcucugccagguggugaagaucaagcuggagagccaggaccuggagcgcaacaacaaggcccaggccugggaggacugcgucaagggguuccuggacgccgaggugaagccccucuggccgaagggcuggaugcaggcccggacgcuguucaaggagucccgccgggggcacggccaccugaccagcauccucgcgaagaagaaggugauggcccccagcaagaucaaggucaaggaguccagcaccaagcccgacaagaagguguccgugcccagcgggcagaucggcggcccgaucgcccugcccuccgaccaccagaccgggggccugagcaucggggccuccagccgcgagcuccccucccaggccagcggcggccuggcgaacccgccccccgucaaccuggaggacucccucgacgaggaccugauccggaaccccgccagcuccguggaggccgugagcaaggagcuggccgcgcucaacucccgcgccgccgggaacagcgaguucacgcugccggcccccuccaaggcccccgcggagaaggucggcggggugcugugcaccgaggagaagcggaacuucgccaagcccagcccgagcgcccccccccccgccuccagccuccaguccccgcugaacuuccuggccgagcaggcgcucgcccugggccagagcucccaggagaagaagcccgagagcuccggguacaaggagcugagcugccaggccccccucaacaagggccugcccgagguccaccaguccaaggccaagcaccacagccugccgcgcaccucccacggcccccagguggccgugcccguccccgggccgcaggugaagguguuccacgcgggcacccagcagcagaagaacuucacgccccccagccccuucgccaacaagcuccaggggccgaaggccucccccacccagugccaccggagccugcugcagcucgucaagaccgccgcgaagggccagggguuccaccccuccgccccggccaccagcggcggccuguccgccagcuccagcagcucccacaagacgcccgccagcuccagcuccgcgcugagccaccccgccaagccccacuccgugagcuccgccgggagcuccuacaagaacaacccguucgccagcuccaucagcaagcacggcguguccagcggguccagcuccagcggcgggacccccguccagagcuccgugagcggcucccucgugcccggcauccagcccccgagcgucgggcaggccaccucccgccccgugcccagcuccgcgggcaagaagaugcccgugagccagaagcugacccuggucgccccgcccgggggccccaacggggacuccagcggcggcacgcaggggguggccaagcuccugaccucccccagccugaagccguccgccgugagcuccgucaccagcuccaccagccucuccaagggcgccagcgggacggugcugcuggcgggcagcucccucauggccagccccuacaaguccagcucccccaagcugagcggcgccauguccagcaacucccuggggaucaucacccccgugccgauccccguccacgugcucagcuucuccgccgacagcuccgccaaggcgggcgugagcaaggacgccaucgucaccgggcccgcccccggcuccuuccaccacgggcugggccacagccugcucgccggccugcacuccagcccgccccacgcggccccccugccccacgccgccgugccgacccacaucccccagucccuccccggggccagccagcugcacggcaaggggccggcggugccccggaagcuguga

SEQ ID NO: 38375 - RNA, 1539 nt, Artificial Sequence
  derived and/or modified sequence opt1 from UBOX5__Homo_sapiens__NP_001254513
auggugaucaaccugugccucccccaguuccgcccgcggauccacugcaacaagaucagcgccgacggcuacgaggucgagaaccugaucuccgaggaccugaccaagcgcagccacggguuccggaccgaguacuucaucaagccgcccguguacgugacggucuccuuccccuucaacguggagaucugccgcaucaacaucgaccucaccgccggcgggggccagaacgugaccgggcuggagauguacaccagcgcguccagcucccgggucagcuggaacacgccccagugccgcacccugggccccgccgagcccuccgugcccgacaaggaggccuucacccucgugggcaagguccugcugaagaaccagagccaggugguguucucccaccggggguucaaggcccgcccgcccuucggcgccauggaggcgacccuccccagccccgccgucguggcccaggagcuguggaacaagggggcccugucccucagccacguggcgcaccuccggaucugcaucacgcacgucaccggcgggggcaucccgugcaucaagcgccuggagguguggggccagcccgccaagaccugcucccaggaggugaucgacagcauccugcuggucaccuccgagaaccugccccaggacguggcccuccaggcccccgcccugccgauggagagcgacugcgaccccggggaccagcccgagucccagcaggcgcccagcagccugcagaagcucgccgagaucauccaggacgugccggaggaguuccuggaccccaucacgcuggagaucaugcccugccccaugcuccugccguccggcaaggucaucgaccagagcacccuggagaagugcaaccgguccgaggccaccugggggcgcgugcccagcgaccccuucaccggcguggccuucacgccccacucccagccgcucccccaccccagccugaaggcccggaucgaccacuuccugcuccagcacuccaucccgggcugccaccuccuggggcgcgcgcagaccgcccuggccgucauccccagcuccaucgugcugcccagccagaagcggaagaucgagcaggccgagcacguccccgacuccaacuucggcgugaacgccagcugcuucuccgcgaccagcccgcuggugcuccccaccacguccgagcacaccgccaagaagaugaaggccaccaacgagcccagccugacccacauggacugcuccacggggccccugagccacgagcagaagcucucccagagccuggagaucgcccuggccagcacccucggcuccaugccgagcuucaccgcgcgccugacccgggggcagcugcagcaccucggcacgcgcggcuccaacaccagcuggcggcccgggaccggcuccgccugggagcaccccgggccccgcaugugccugcugcagaaguccaucuucagccuccugcagaagggcgccggggucccggccgcgcugcggcccccgcccgugcccacccugcccggcuga

SEQ ID NO: 38376 - RNA, 1515 nt, Artificial Sequence
  derived and/or modified sequence opt1 from UBP1__Homo_sapiens__NP_001121632
auggccugggugcugaagauggacgaggucaucgagagcggccucgugcacgacuucgacgccucccugagcgggaucggccaggagcugggggcgggcgccuacuccaugagcgacgugcucgcccugcccaucuucaagcaggaggacuccagccugccgcucgacggggagaccgagcacccgcccuuccaguacgucaugugcgccgccaccucccccgcggugaagcugcacgacgagacgcugaccuaccucaaccagggccagagcuacgagauccgcaugcuggacaaccggaagaugggcgacaugcccgagaucaacgggaagcuggugaaguccaucauccgcgucguguuccacgaccggcgccuccaguacaccgagcaccagcagcuggagggcuggaaguggaaccggcccggggaccgccugcucgaccuggacauccccaugagcgugggcaucaucgacacccggacgaaccccucccagcugaacgccgucgaguuccucugggacccggccaagcgcaccagcgccuucauccaggugcacugcaucuccaccgaguucacgccccggaagcacgggggcgagaagggcgugcccuuccgcauccaggucgacaccuucaagcagaacgagaacggggaguacaccgaccaccuccacagcgcguccugccagaucaagguguucaagcccaagggcgccgaccggaagcagaagaccgaccgcgagaagauggagaagcggaccgcccacgagaaggagaaguaccagccgagcuacgacacgaccauccugaccgagugcucccccuggcccgacgcccccaccgccuacgugaacaacagcccgucccccgcgcccacguucaccagcccccagcagagcacgugcuccgucccggacagcaacuccagcucccccaaccaccagggggacggcgccagccagaccuccggcgagcagauccagcccagcgccaccauccaggagacccagcaguggcugcugaagaaccgcuucuccagcuacacccggcuguucuccaacuucagcggggccgaccuccugaagcugaccaaggaggaccucgugcagaucugcggcgccgcggacgggauccgccuguacaacucccucaagagccgguccgugcgcccccggcugacgaucuacgucugccgcgagcagccgagcuccaccgugcugcagggccagcagcaggccgccagcuccgccagcgagaacgggagcggcgcccccuacguguaccacgcgaucuaccuggaggagaugaucgccuccgaggucgcccggaagcucgcccugguguucaacaucccccugcaccagaucaaccagguguaccgccagggccccaccgggauccacauccucgucagcgaccagauggugcagaacuuccaggacgaguccugcuuccuguucagcaccgucaaggccgaguccagcgacggcauccacaucauccugaaguga

SEQ ID NO: 38377 - RNA, 1770 nt, Artificial Sequence
  derived and/or modified sequence opt1 from UBQLN1__Homo_sapiens__NP_038466
auggccgagagcggcgaguccgggggcccgcccgggagccaggacuccgccgcgggcgccgagggggccggcgcccccgccgcggccgccagcgccgagcccaagaucaugaaggugaccgucaagacccccaaggagaaggaggaguucgcggugccggagaacuccagcgugcagcaguucaaggaggagaucuccaagcgcuucaagagccacacggaccagcugguccucaucuucgccggcaagauccugaaggaccaggacacccugucccagcacgggauccacgacggccucaccgugcaccuggugaucaagacccagaaccggccccaggaccacagcgcccagcagacgaacaccgccggguccaacgucaccaccagcuccacgcccaacagcaacuccaccagcggcuccgccaccagcaaccccuucgggcugggcggccucgggggccuggcggggcuguccagccucggccugaacaccacgaacuucagcgagcugcagucccagaugcagcgccagcuccugagcaacccggagaugauggugcagaucauggagaaccccuucgugcaguccaugcugagcaaccccgaccucaugcggcagcugaucauggccaacccccagaugcagcagcugauccagcgcaacccggagaucucccacaugcucaacaaccccgacaucaugcggcagacccuggagcuggcccgcaaccccgccaugaugcaggagaugaugcggaaccaggaccgcgcccucagcaaccuggaguccauccccggcggguacaacgcgcugcggcgcauguacaccgacauccaggagccgaugcucagcgccgcccaggagcaguucggcgggaaccccuucgccucccuggucagcaacaccuccagcggcgaggggucccagcccagccggacggagaaccgcgacccccugccgaaccccugggcgccccagaccucccagagcuccagcgccuccagcggcaccgccagcaccgugggcgggacgaccggcuccaccgccagcgggaccuccggccagagcacgaccgcccccaaccucgugccgggggucggcgccuccauguucaacacccccggcaugcagagccugcugcagcagaucaccgagaacccccagcucaugcagaacaugcuguccgcgcccuacaugcggagcaugaugcagucccugagccagaacccggaccucgccgcccagaugaugcugaacaacccccuguucgccgggaacccccagcuccaggagcagaugcgccagcagcugccgacguuccugcagcagaugcagaaccccgacacccucuccgcgaugagcaacccccgggccaugcaggcccugcugcagauccagcagggccuccagacccuggccaccgaggcccccgggcugaucccgggcuucacgcccgggcucggcgcgcugggcuccaccgggggcagcuccgggaccaacggcagcaacgccacccccuccgagaacacgagccccaccgccggcaccaccgagccggggcaccagcaguucauccagcagaugcugcaggcccucgccggcgugaacccccagcugcagaaccccgaggugcgcuuccagcagcagcuggagcagcugagcgcgaugggguuccucaaccgggaggccaaccugcaggcccugaucgccaccggcggggacaucaacgccgcgaucgagcgccuccugggcucccagcccagcuga

SEQ ID NO: 38378 - RNA, 1875 nt, Artificial Sequence
  derived and/or modified sequence opt1 from UBQLN2__Homo_sapiens__NP_038472
auggccgagaacggcgagagcuccgggcccccgcgccccagccggggccccgccgcggcccagggguccgccgccgcccccgcggagccgaagaucaucaaggugaccgucaagacccccaaggagaaggaggaguucgccgugcccgagaacagcuccgugcagcaguucaaggaggccaucagcaagcgcuucaagucccagacggaccagcugguccucaucuucgccggcaagauccugaaggaccaggacacccugauccagcacgggauccacgacggccucaccgugcaccuggugaucaagagccagaaccggccccagggccaguccacccagccgagcaacgcggccgggacgaacaccaccuccgccagcacgccccgcuccaacagcacccccaucuccaccaacagcaaccccuucggccuggggucccucggcgggcuggccggccugagcucccucggccugagcagcaccaacuucuccgagcugcagagccagaugcagcagcagcucauggccuccccggagaugaugauccagaucauggagaaccccuucguccagagcaugcuguccaaccccgaccugaugcggcagcucaucauggcgaacccccagaugcagcagcugauccagcgcaacccggagaucagccaccuccugaacaaccccgacaucaugcggcagacccuggagaucgcccgcaaccccgccaugaugcaggagaugaugcggaaccaggaccuggcccucuccaaccuggagagcauccccgggggcuacaacgcccugcgccggauguacacggacauccaggagccgaugcucaacgcggcccaggagcaguucgggggcaaccccuucgccuccgugggcagcuccagcuccagcggggagggcacccagcccucccgcaccgagaaccgggacccccugccgaaccccugggccccgccgcccgccacccagagcuccgcgacgaccagcaccaccacguccaccgggagcggcagcgggaacuccagcuccaacgccaccggcaacaccguggccgccgccaacuacgucgcgagcaucuucuccacgcccggcaugcagagccugcuccagcagaucaccgagaacccccagcugauccagaacaugcuguccgcccccuacaugcgcagcaugaugcagucccucagccagaaccccgaccuggccgcccagaugaugcugaacagcccccucuucaccgcgaacccccagcugcaggagcagaugcggccgcagcugcccgccuuccuccagcagaugcagaaccccgacacccuguccgccauguccaacccccgcgccaugcaggcccugaugcagauccagcaggggcuccagacgcuggcgaccgaggccccgggccugauccccagcuucacccccggggugggcguggggguccucggcaccgccaucggccccguggggccggugacgcccaucggccccaucgggcccaucgucccguucacccccaucggccccaucgggcccaucggcccgaccggccccgccgccccgcccggguccaccggcagcgggggccccacgggccccaccguguccagcgcggcccccagcgagaccaccuccccgaccagcgaguccgggcccaaccagcaguucauccagcagauggugcaggcccuggccggcgccaacgcgccccagcugcccaacccggagguccgguuccagcagcagcucgagcagcugaacgccaugggguuccugaaccgcgaggccaaccuccaggcccugaucgcgacgggcggggacaucaacgccgccaucgagcggcugcugggcagccagcccuccuga

SEQ ID NO: 38379 - RNA, 1428 nt, Artificial Sequence
  derived and/or modified sequence opt1 from UBQLNL__Homo_sapiens__NP_659490
auguggcacgccaucagccgcaccucccggaugagccaguccggcugccccagcgggcugcucgccgacaagaacaucuccagcuccgcgacccgcgugaucgucaagacggccggcaaccagaaggacuucaugguggccgacgacaucagcgugcggcaguucaaggagaugcugcuggcccacuuccagugccagauggaccagcucguccugguguucauggggugccugcucaaggaccacgacacccugucccagcgcggcaucauggacgggcacaccaucuaccuggugaucaagagcaagcagggcucccggagccucgcccacuccuuccgcgaccugcccaccaacgaccccugccaccgggaccgcaacacgaagggcaacagcucccggguccaccagcccaccgggaugaaccaggcgcccguggagcuggcccacuucgugggcagcgacgccccgaagguccacacccagaaccucgaggugucccaccccgagugcaaggcccagaugcuggagaaccccagcauccagcgccugcucuccaacauggaguucauguggcaguucaucagcgagcaccuggacacccagcagcugaugcagcagaaccccgaggugagccggcuccugcuggacaacuccgagauccuccugcagacgcuggagcucgcgcgcaaccuggccaugauccaggagaucaugcagauccagcagccgagccagaaccuggaguacccccucaacccccagcccuaccuggggcuggagaccaugccgggcgggaacaacgcccucggccagaacuacgccgacaucaacgaccagaugcugaacuccaugcaggaccccuucggcgggaaccccuucaccgcccugcucgcgggccagguccuggagcagguccagagcuccccgccgcccccgccgcccagccaggagcagcaggaccagcugacccagcaccccgccacgcgggugaucuacaacuccagcgggggcuucuccagcaacaccuccgccaacgacacccucaacaaggugaaccacaccagcaaggccaacacggccaugaucuccaccaagggccagagccacaucugcgcgacccgccagcccgccuggauccccgcccugcccuccaucgagcugacccagcagcuccaggaggaguacaaggacgccacggugagccuguccagcucccggcagacccugaagggggaccuccagcugagcgacgagcagagcuccagccagaucaccggcgggaugaugcagcugcucaugaacaaccccuaccuggccgcgcagaucaugcuguucaccuccaugccccagcucagcgagcaguggcgccagcagcugcccacguuccugcagcagacccagaucuccgaccugcucagcgccuga

SEQ ID NO: 38380 - RNA, 5250 nt, Artificial Sequence
  derived and/or modified sequence opt1 from UBR1__Homo_sapiens__NP_777576
auggccgacgaggaggccggcgggaccgagcgcauggagaucagcgcggagcugccccagaccccgcagcggcucgccuccuggugggaccagcagguggacuucuacacggccuuccugcaccaccuggcccagcucguccccgagaucuacuucgccgagauggaccccgaccuggagaagcaggaggagagcgugcagauguccaucuucaccccccuggagugguaccucuucggcgaggacccggacaucugccuggagaagcugaagcacagcggggcguuccagcucugcggccgcguguucaaguccggggagaccaccuacagcugccgggacugcgccaucgaccccacgugcguccugugcauggacugcuuccaggacuccgugcacaagaaccaccgcuacaagaugcacaccagcaccggcggcggguucugcgacugcggcgacaccgaggccuggaagacggggcccuucugcgugaaccacgagcccggccgggccgggaccaucaaggagaacucccgcugcccgcugaacgaggaggucaucgugcaggcgcggaagaucuuccccagcgugaucaaguacgucguggagaugaccaucugggaggaggagaaggagcucccccccgagcugcagauccgcgagaagaacgagcgguacuacugcgugcuguucaacgacgagcaccacuccuacgaccacgucaucuacagccuccagcgcgcccuggacugcgagcuggccgaggcccagcuccacaccacggccaucgacaaggagggccggcgcgcggugaaggccggcgccuacgccgccugccaggaggcgaaggaggacaucaagucccacagcgagaacgugucccagcacccgcugcacgucgaggugcugcacagcgagaucauggcccaccagaaguucgcccuccggcugggguccuggaugaacaagaucaugagcuacuccagcgacuuccgccagaucuucugccaggccugccugcgggaggagcccgacagcgagaaccccugccucaucucccgccugaugcugugggacgccaagcucuacaagggcgcgcggaagauccugcacgagcugaucuucagcuccuucuucauggagauggaguacaagaagcucuucgccauggaguucgugaaguacuacaagcagcugcagaaggaguacaucagcgacgaccacgaccgcuccaucagcaucaccgcccuguccguccagauguucaccgugcccacccucgcccggcaccugaucgaggagcagaacgugaucagcgucaucacggagacccugcucgaggugcugccggaguaccuggaccgcaacaacaaguucaacuuccagggguacucccaggacaagcucggccggguguacgccgucaucugcgaccugaaguacauccugaucagcaagcccaccaucuggaccgagcgccuccgcaugcaguuccuggagggcuuccgguccuuccugaagauccucacgugcaugcaggggauggaggagauccgccggcaggugggccagcacaucgaggucgaccccgacugggaggcggccaucgccauccagaugcagcugaagaacauccugcucauguuccaggaguggugcgccugcgacgaggagcugcugcugguggcguacaaggagugccacaaggccgugaugcgcugcagcaccuccuucaucagcuccagcaagaccgucgugcaguccugcgggcacagccucgagaccaaguccuaccgggugagcgaggaccuggucagcauccaccugccccucucccgcacgcuggccggccugcacgugcggcucagccgccugggggccgugucccggcugcacgaguucgucagcuucgaggacuuccagguggaggugcucgucgaguacccgcugcgcugccuggugcucguggcccaggucguggcggagauguggcggcgcaacggccugucccugaucagccagguguucuacuaccaggacgucaagugccgggaggagauguacgacaaggacaucaucaugcuccagaucggcgccucccugauggaccccaacaaguuccugcuccuggugcugcagcgcuacgagcucgccgaggccuucaacaagaccaucagcaccaaggaccaggaccugaucaagcaguacaacacccugaucgaggagaugcuccaggugcugaucuacaucgucggggagcgguacgugcccggcguggggaacgucacgaaggaggaggugaccaugcgcgagaucauccaccugcucugcaucgagcccaugccgcacuccgccaucgcgaagaaccugcccgagaacgagaacaacgagaccggccuggagaacgugaucaacaaggucgccaccuucaagaagcccggggugagcggccacggcguguacgagcucaaggacgagucccugaaggacuucaacauguacuucuaccacuacagcaagacgcagcacuccaaggccgagcacaugcagaagaagcggcgcaagcaggagaacaaggacgaggcccugcccccgccccccccgcccgaguucugccccgccuucagcaaggucaucaaccuccugaacugcgacaucaugauguacauccugcggaccguguucgagcgcgcgaucgacaccgacuccaaccucuggaccgaggggaugcugcagauggccuuccacauccuggcccucggccugcuggaggagaagcagcagcuccagaaggcccccgaggaggaggugacguucgacuucuaccacaaggcgagccgccugggguccagcgccaugaacauccagaugcugcucgagaagcugaagggcaucccgcagcuggaggggcagaaggacaugaucaccuggauccuccagauguucgacaccgucaagcggcugcgcgagaagagcugccugaucguggccaccaccuccggcagcgaguccaucaagaacgacgagaucacgcacgacaaggagaaggccgagcggaagcgcaaggccgaggcggcccggcuccaccgccagaagaucauggcccagaugagcgcccugcagaagaacuucaucgagacccacaagcugauguacgacaacaccuccgagaugcccggcaaggaggacagcaucauggaggaggaguccacccccgccgugagcgacuacucccggaucgcgcucgggcccaagcgcggcccgagcgucacggagaaggaggugcugaccugcauccugugccaggaggagcaggaggugaagaucgagaacaacgccaugguccucuccgccugcgugcagaagagcaccgcccugacccagcaccgggggaagcccaucgagcuguccggcgaggcccucgacccccuguucauggaccccgaccuggcguacggcacguacaccgggagcugcggccacgugaugcacgccgucugcuggcagaaguacuucgaggccgugcagcucuccagccagcagcgcauccacguggaccuguucgaccuggaguccggggaguaccucugcccgcugugcaagagccugugcaacaccgucauccccaucaucccccuccagccccagaagaucaacuccgagaacgccgacgcgcuggcccagcugcucacccuggcccgguggauccagacggugcuggcccgcaucagcggcuacaacauccggcacgccaagggggagaacccgauccccaucuucuucaaccagggcaugggcgacagcacccucgaguuccacuccauccugagcuucgggguggaguccagcaucaaguacuccaacagcaucaaggagauggucauccuguucgcgaccaccaucuaccgcaucggccucaaggugccccccgacgagcgggacccgcgcgugcccaugcugacgugguccaccugcgccuucaccauccaggccaucgagaaccugcucggggacgagggcaagccccuguucggggcccugcagaaccggcagcacaacggccucaaggcccugaugcaguucgcggucgcccagcgcaucaccugcccccaggugcugauccagaagcaccucguccggcugcugagcguggugcucccgaacaucaaguccgaggacacgcccugccugcugagcaucgaccucuuccacguccuggugggcgccgugcuggccuuccccucccuguacugggacgacccggucgaccuccagcccagcuccgugagcuccagcuacaaccaccuguaccuguuccaccucaucaccauggcccacaugcugcagauccugcucaccguggacaccgggcugccccuggcgcagguccaggaggacuccgaggaggcccacagcgccuccagcuucuucgccgagaucagccaguacacguccggcagcaucgggugcgacauccccggcugguaccucugggugucccugaagaacgggaucaccccguaccugcgcugcgccgcgcucuucuuccacuaccugcugggcgugaccccccccgaggagcuccacaccaacagcgccgagggcgaguacuccgcccugugcagcuaccugucccuccccacgaaccuguuccugcucuuccaggaguacugggacaccguccggccgcugcugcagcgcuggugcgccgaccccgcgcuccugaacugccugaagcagaagaacaccguggugcgcuacccccggaagcgcaacagccucaucgagcugcccgacgacuacuccugccugcucaaccaggccagccacuuccggugcccgcgcuccgccgacgacgagcggaagcaccccguccugugccuguucugcggggccauccucugcagccagaacaucugcugccaggagaucgugaacggcgaggaggugggggccugcaucuuccacgcgcugcacugcggcgccggggucugcaucuuccugaagauccgcgagugccggguggugcucgucgagggcaaggcccgcggcugcgccuaccccgcccccuaccuggacgaguacggggagaccgacccgggccugaagcgggggaacccccuccaccugucccgcgagcgguaccgcaagcugcaccucguguggcagcagcacugcaucaucgaggagaucgcgcggagccaggagacgaaccagaugcuguucggcuucaacuggcagcugcucuga

SEQ ID NO: 38381 - RNA, 5667 nt, Artificial Sequence
  derived and/or modified sequence opt1 from UBR3__Homo_sapiens__NP_742067
auggccgccgcggccgccgccgccgugggcgggcagcagcccagccagcccgagcugcccgcgcccgggcuggcccuggacaaggccgccaccgcggcccaccugaaggccgcccugagccgccccgacaaccgggccggggcggaggagcugcaggcccugcucgagcgcguccugagcgccgagcggccccuggccgccgcggccggcggggaggacgccgccgccgcgggcggcgggggcgggcccggcgccgccgaggaggaggcccucgaguggugcaagugccugcuggccgggggcggcggguacgacgaguucugcgcggccgugcgcgccuacgaccccgccgcgcucugcggccugguguggaccgccaacuucgucgccuaccggugccggaccugcgggaucagccccugcaugagccugugcgccgagugcuuccaccagggcgaccacaccggccacgacuucaacauguuccgcagccaggccgggggcgcgugcgacugcggggacagcaacgugaugcgcgaguccggcuucugcaagcggcaccagaucaagagcuccagcaacaucccgugcgugcccaaggaccuccugaugauguccgaguucguccugccccgcuucaucuucugccucauccaguaccugcgggagggguacaacgagcccgccgccgacggcccgagcgagaaggaccugaacaaggugcuccagcugcuggagccccagaucuccuuccucgaggaccugaccaagaugggcggggccaugcgcagcgugcugacccagguccucaccaaccagcagaacuacaaggaccugaccuccggccugggggagaacgccugcgugaagaagucccacgagaaguaccucaucgcgcugaaguccagcggccugaccuaccccgaggacaagcucguguacgggguccaggagcccuccgccggcaccagcagccuggccgugcagggcuucaucggggccacgggcacccugggccagguggacuccagcgacgaggacgaccaggacggcucccaggggcucggcaagcggaagcgcgucaagcugagcuccggcaccaaggaccagagcaucauggacgugcugaagcacaaguccuuccucgaggagcugcuguucuggaccaucaaguacgaguucccgcagaagauggugacguuccuccugaacaugcugcccgaccaggaguacaaggucgccuucaccaagaccuucgugcagcacuacgcguucaucaugaagacccucaagaagucccacgaguccgacacgaugagcaaccggaucgugcacaucuccguccagcuguucagcaacgaggagcuggcccgccaggugaccgaggagugccagcuccuggacaucauggugaccguccugcuguacaugauggaguccugccucaucaagagcgagcugcaggacgaggagaacucccugcacguggucgugaacugcggggaggcccuccugaagaacaacaccuacuggccccuggugagcgacuucaucaacauccucucccaccagagcgucgccaagcgguuccuggaggaccacggccugcucgugacguggaugaacuucguguccuucuuccaggggaugaaccugaacaagcgcgagcugaacgagcacgucgaguucgagagccagaccuacuacgcggccuucgccgccgagcucgaggccugcgcgcagcccauguggggccugcugagccacugcaaggugcgggagacccaggaguacacccgcaacgugguccgguacugccucgaggcccugcaggacugguucgacgccaucaacuucguggacgagccggcccccaaccaggugacguuccaccucccccuccaccgcuacuacgccauguuccuguccaaggcggucaagugccaggagcuggaccucgacagcgugcugcccgaccaggagaugcugaugaagcucaugauccacccgcugcagauccaggccucccuggccgagauccacagcaacaugugggugcgcaacggccuccagaucaaggggcaggccaugaccuacguccagucccacuucugcaacagcaugaucgaccccgacaucuaccugcuccaggugugcgccucccggcucgaccccgacuacuucaucagcuccguguucgagcgcuucaaggucguggaccugcugaccauggcgagccagcaccagaacaccgugcucgacgccgagcacgagcgguccaugcuggagggcgcccugacguuccucgucauccugcugagccuccgccugcaccuggggauguccgacgacgagauccuccgggccgagaugguggcgcagcugugcaugaacgaccgcacccacagcucccugcucgaccugauccccgagaacccgaaccccaagagcggcaucauccccggguccuacagcuucgagagcgugcuguccgccgucgccgacuucaaggccccgguguucgagcccggcggcagcaugcagcaggggauguacacccccaaggccgaggugugggaccaggaguucgaccccgucauggugauccuccggaccguguaccgccgggacguccaguccgcgauggaccgcuacacggccuuccugaagcagagcggcaaguucccggggaaccccuggccgcccuacaagaagcggaccucccugcacccgagcuacaagggccucaugcgccugcugcacugcaagacccuccacaucgugcuguucacccugcucuacaagauccugauggaccaccagaaccuguccgagcacgugcucugcaugguccuguaccugaucgagcucgggcuggagaacagcgccgaggaggaguccgacgaggaggccagcgugggcggccccgagcggugccacgacuccugguuccccgggagcaaccugguguccaacaugcgccacuucaucaacuacguccgggugcgcgugcccgagacggccccggaggucaagcgggacagccccgcguccaccagcuccgacaaccucggcagccugcagaacuccgggaccgcccagguguucagccugguggccgagcgccggaagaaguuccaggagaucaucaaccgcagcuccagcgaggccaaccaggucgugcgccccaagaccuccagcaagugguccgcccccggcagcgcgccgcagcucaccacggccauccuggagaucaaggaguccauccugagccuccugaucaagcugcaccacaagcucuccgggaagcagaacagcuacuacccgcccuggcuggacgacaucgagauccugauccagcccgagaucccgaaguacucccacggcgacggcaucaccgccguggagcggauccuccugaaggccgccagccagucccgcaugaacaagcggaucaucgaggagaucugccgcaaggucacgccgcccgugcccccgaagaaggugaccgcggccgagaagaagacgcuggacaaggaggagcggcgccagaaggcccgggagcgccagcagaagcuccuggccgaguucgcgagccggcagaaguccuucauggagaccgccauggacgucgacagccccgagaacgacauccccauggagaucaccaccgccgagccccagguguccgaggccguguacgacugcgucaucugcgggcagagcggccccuccagcgaggaccgccccacggggcuggugguccuccugcaggccagcuccgugcugggccagugccgggacaacguggagcccaagaagcucccgaucagcgaggaggagcagaucuaccccugggacacgugcgcggccguccacgacgugcgccugucccugcuccagcgguacuucaaggacagcuccugccugcuggccgugagcaucgggugggagggcggcgucuacgugcagaccugcgggcacacccuccacaucgacugccacaaguccuacauggagagccugcgcaacgaccaggugcugcagggcuucuccgucgacaagggggaguucacgugcccccugugccggcaguucgccaacagcgugcuccccugcuacccgggcuccaacguggagaacaaccccuggcagcgccccagcaacaaguccauccaggaccugaucaaggaggucgaggagcugcagggccggcccggggccuucccgagcgagaccaaccucuccaaggagauggagagcgugaugaaggacaucaagaacaccacccagaagaaguaccgcgacuacuccaagacccccggcagccccgacaacgacuuccuguucauguacuccguggcgcggaccaaccuggagcucgagcugauccaccgcgggggcaaccugugcagcgggggcgccagcaccgccggcaagcgguccugccucaaccagcuguuccacguccuggcccuccacaugcgccuguacagcaucgacuccgaguacaaccccuggcgcaagcugacccagcucgaggagaugaacccgcagcugggguacgaggagcagcagcccgaggugcccauccuguaccacgacgugacgagccuccugcugauccagauccucaugaugccccagccgcugcggaaggaccacuucacgugcaucgucaaggugcuguucacccuccuguacacccaggcccuggcggcccucuccgugaagugcagcgaggaggaccgcuccgccuggaagcacgccggcgcgcugaagaaguccacgugcgacgccgagaaguccuacgagguccugcucagcuucgugaucuccgagcuguucaaggggaagcuguaccacgaggagggcacccaggagugcgccauggugaaccccaucgccuggagccccgaguccauggagaagugccuccaggacuucugccugcccuuccugcggaucaccagccuccugcagcaccaccuguucggggaggaccucccguccugccaggaggaggaggaguucagcguccuggccuccugccugggccuccugcccaccuucuaccagacggagcaccccuucaucagcgcguccugccuggacuggcccgugccggccuucgacaucaucacccaguggugcuucgagaucaagagcuucaccgagcgccacgccgagcagggcaaggcccuccugauccaggagagcaaguggaagcugccccaccuccugcagcugcccgagaacuacaacaccaucuuccaguacuaccaccggaagacgugcuccgugugcaccaaggucccgaaggaccccgccgugugccucgugugcgggaccuucgucugccugaagggccugugcugcaagcagcagagcuacugcgagugcgugcuccacucccagaacugcggggcgggcaccgggaucuuccugcugaucaacgccagcgugaucaucaucauccgcggccaccgguucugccucuggggcuccgucuaccuggacgcccacggggaggaggaccgcgaccugcggcgcggcaagccccucuacaucugcaaggagcgguacaaggugcuggagcagcaguggaucagccacacguucgaccacaucaacaagcgcugggggccccacuacaacggccuguga

SEQ ID NO: 38382 - RNA, 15705 nt, Artificial Sequence
  derived and/or modified sequence opt1 from UBR4__Homo_sapiens__XP_011539410
auggccaccuccggcggggaggaggccgccgccgccgcccccgcccccggcacccccgccaccggggccgacaccacccccggcugggagguggccgugcgcccccugcucuccgccuccuacuccgccuucgagaugaaggagcugccccagcugguggccuccgugaucgaguccgaguccgagauccuccaccacgagaagcaguacgagcccuucuacuccagcuucguggcccuguccacccacuacaucaccaccgugugcagccugaucccccggaaccagcuccaguccguggccgccgcgugcaaggugcugaucgaguucagccugcuccgccuggagaaccccgacgaggccugcgccgugucccagaagcaccugauccuccugaucaaggggcugugcaccggcugcagccggcucgaccgcaccgagaucaucaccuucaccgccaugaugaaguccgccaagcugccccagaccgugaagacccugagcgacguggaggaccagaaggagcucgcgucccccgugagccccgagcugcggcagaaggaggugcagaugaacuuccugaaccagcucacguccguguucaacccccgcaccguggccagccagcccaucagcacccagacccugguggagggcgagaacgacgagcaguccagcacggaccaggccuccgccaucaagaccaagaacguguucaucgcccagaacguggcgagccugcaggagcucgggggcuccgagaagcugcugcgggugugccucaaccugcccuacuuccugcgcuacaucaaccgguuccaggacgccguccucgccaacagcuucuucaucaugcccgccaccguggccgacgcgaccgccgugcgcaacggguuccacucccuggucaucgacgugacgauggcccuggacacccucagccugcccgugcuggagccccucaaccccucccggcugcaggacgucaccgugcugagccucuccugccuguacgccggcgucagcguggcgaccugcauggccauccugcacgugggguccgcccagcagguccgcacgggcagcaccuccagcaaggaggacgacuacgaguccgacgccgccaccaucgugcagaagugccucgagaucuacgacaugaucggccaggcgaucagcuccagccggcgcgccgggggcgagcacuaccagaacuuccagcugcugggggccuggugccuccugaacagccuguuccucauccugaaccugucccccaccgcccuggccgacaagggcaaggagaaggacccccucgcggcccugcgggugcgcgacauccugagccggacgaaggagggcgucgggucccccaagcucggccccgggaagggccaccagggguucggcgugcugagcgugauccuggccaaccacgccaucaagcuccugaccucccuguuccaggaccuccaggucgaggcccugcacaagggcugggagaccgacgggccgcccgcggcccugagcaucauggcccaguccaccagcauccagcgcauccagcggcucaucgacuccgugccccugaugaaccugcuccugacgcugcucagcaccuccuaccgcaaggccugcgugcugcagcggcagcgcaagggcagcauguccagcgacgcguccgccagcaccgacuccaacaccuacuacgaggacgacuucagcagcacggaggaggacuccagccaggacgacgacuccgagcccauccuggggcagugguucgaggagaccaucagccccuccaaggagaaggccgcgcccccgcccccgcccccgcccccgccccucgagagcagcccccgggucaagagccccuccaagcaggcccccggcgagaaggggaacauccuggcgagccggaaggaccccgagcuguuccucggccuggccuccaacauccugaacuucaucaccagcuccaugcucaacagccgcaacaacuucauccggaacuaccuguccgugagccuguccgagcaccacauggccacccucgccagcaucaucaaggagguggacaaggacggccugaagggguccagcgacgaggaguucgccgcggcccuguaccacuucaaccacagccucgucaccuccgaccugcagagccccaaccugcagaacacgcuccugcagcagcugggcguggcccccuucuccgaggggcccuggccgcucuacauccacccccagagccuguccgugcugagccgccuccugcugaucuggcagcacaaggccuccgcccagggcgaccccgacguccccgagugccucaaggugugggaccgguuccugagcaccaugaagcagaacgcgcugcaggggguggucccguccgagaccgaggaccucaacguggagcaccuccagaugcugcuccugaucuuccacaacuucaccgagacgggccgccgggccauccugagccucuucgugcagaucauccaggagcuguccgucaacauggacgcccagaugcgcuucgugccccugauccucgcccggcugcugcucaucuucgacuaccugcugcaccaguacagcaaggcgcccguguaccucuucgagcagguccagcacaaccugcugagcccgcccuucggcugggccagcgggucccaggacagcaacucccgccgggccaccacgccccuguaccacggcuucaaggagguggaggagaacuggagcaagcacuucuccagcgacgccgugccccacccccgcuucuacugcguccugagccccgaggccuccgaggacgaccugaaccggcucgacagcguggcgugcgacgugcuguucuccaagcuggucaaguacgacgagcucuacgccgcccugaccgcccugcucgccgcggggagccagcuggacacggugcgccggaaggagaacaagaacgugaccgcccuggaggccugcgcccuccaguacuacuuccugauccuguggcgcauccucggcauccugccgcccuccaagaccuacaucaaccagcugagcaugaacuccccggagaugagcgagugcgacauccuccacacccugcggugguccagccgccugcggaucuccagcuacgucaacuggaucaaggaccaccucaucaagcagggcaugaaggccgagcacgcguccagccugcuggagcucgccuccacgaccaagugcagcuccgugaaguacgacguggagaucgucgaggaguacuucgcccgccagaucagcuccuucugcagcaucgacugcaccaccauccugcagcugcacgagauccccagccuccaguccaucuacacgcuggacgccgccaucagcaagguccaggugucccuggacgagcacuucagcaagauggcggccgagaccgacccccacaaguccagcgagaucaccaagaaccugcuccccgccacccugcagcugaucgacacguacgccuccuucacccgcgcguaccuccugcagaacuucaacgaggaggggaccaccgagaagccgagcaaggagaagcugcagggcuucgccgccguccucgccaucggguccagccggugcaaggccaacacgcugggccccacccuggugcagaaccuccccuccagcgugcagaccgucugcgaguccuggaacaacaucaacaccaacgaguuccccaacaucgggagcuggcgcaacgcguucgccaacgacacgaucccguccgagagcuacaucuccgccgugcaggccgcccaccugggcacccugugcagccagucccucccccuggcggccagccugaagcacacccuccugagccuggugcggcucaccggcgaccugaucgucugguccgacgagaugaacccgccccaggugauccgcacgcugcucccgcugcugcucgagagcuccaccgagagcguggccgagaucuccagcaacucccuggagcggauccuggggcccgccgagagcgacgaguuccucgcccgcgucuacgagaagcugaucaccggcugcuacaacauccuggcgaaccacgccgaccccaacuccgggcucgacgagagcauccuggaggagugccugcaguaccucgagaagcagcuggaguccagccaggcccggaaggccauggaggaguucuucuccgacagcggcgagcuggugcagaucaugauggcgaccgccaacgagaaccucuccgccaaguucugcaaccgcguccugaaguucuucacgaagcuguuccagcucaccgagaagucccccaacccgucccugcugcaccucugcgggagccuggcccagcuggccugcguggagcccgugcggcuccaggcguggcugacccgcaugaccaccagcccgcccaaggacagcgaccagcuggacgucauccaggagaaccggcagcuccugcagcugcucacgaccuacaucgugcgcgagaacagccaggugggcgagggcgucugcgccgugcugcuggggacccucaccccgauggccacggagaugcuggccaacggcgacgggaccggcuuccccgagcugaugguggucauggccacccucgcguccgccgggcagggcgccggccaccuccagcugcacaacgccgccguggacuggcucagccggugcaagaaguaccugucccagaagaacguggucgagaagcugaacgcgaacgugaugcacgggaagcacgugaugauccucgagugcacgugccacaucaugagcuaccuggccgacgucacgaacgcccugucccagagcaacggccaggggcccucccaccucagcguggacggcgaggagcgcgccaucgagguggacuccgacugggucgaggagcuggcgguggaggaggaggacagccaggccgaggacuccgacgaggacagccugugcaacaagcucugcaccuucaccaucacccagaaggaguucaugaaccagcacugguaccacugccacacgugcaagaugguggacggggucggcgugugcaccgugugcgccaaggucugccacaaggaccacgagaucuccuacgccaaguacggcagcuucuucugcgacugcggggccaaggaggacggcuccugccuggcgcuggugaagcggacccccagcuccgggaugagcagcaccaugaaggaguccgccuuccagagcgagccgcgcaucuccgagagccucgugcggcacgccuccacgagcucccccgccgacaaggccaaggucaccaucagcgacggcaagguggcggacgaggagaagcccaagaaguccagccugugccgcaccguggagggcugccgggaggagcugcagaaccaggccaacuucuccuucgcgccccugguccuggacaugcugaacuuccucauggacgccauccagaccaacuuccagcaggccagcgcggugggguccagcucccgcgcccagcaggcccugagcgagcugcacacgguggagaaggccgucgagaugaccgaccagcucauggugccgacccugggcucccaggagggggccuucgagaacgugcggaugaacuacagcggcgaccaggggcagaccauccgccagcugaucuccgcgcacguccuccgccggguggccaugugcgugcugagcagcccccacggccgccggcagcaccuggccgucucccacgagaagggcaagaucacggugcuccagcugagcgcccugcucaagcaggcggacuccagcaagcgcaagcugacccugacccggcucgccuccgcccccgugccguucaccguccugagccugacggggaaccccugcaaggaggacuaccucgccgugugcggccugaaggacugccacgugcugaccuucuccagcuccgggagcgucuccgaccaccucgugcugcacccccagcuggccaccggcaacuucaucaucaaggcgguguggcugcccgggagccagaccgagcucgccaucgucacggccgacuucgugaagaucuacgaccugugcguggacgcccuguccccgaccuucuacuuccuccugcccagcuccaagauccgcgacgucaccuuccuguucaacgaggagggcaagaacaucaucgugaucaugagcuccgccggcuacaucuacacccagcucauggaggaggcgagcuccgcccagcaggggcccuucuacgucacgaacgugcuggagaucaaccacgaggaccugaagcaggacagcaacagccagguggccggcgggggcgucuccguguacuacagccacgugcuccagaugcuguucuucuccuacugccaggggaaguccuucgccgccaccaucucccggaccacccuggagguccuccagcuguuccccaucaacaucaagagcuucguggugugcuccagcaacggcggcuccaagaccagcccggcgcugugccagugguccgaggucaugaaccaccccgggcucgugugcugcgugcagcagacgaccggcgucccccugguggugauggucaagcccgacaccuuccugauccaggagaucaagacccucccggccaaggccaagauccaggacaugguggccauccgccacacggcgugcaacgagcagcagcggaccaccaugauccugcugugcgaggacgggagccuccgcaucuacauggccaacguggagaacaccuccuacuggcugcagcccagccugcagcccuccagcgucaucuccaucaugaagcccgugcggaagcgcaagacggccaccaucaccacccggacgagcucccaggugaccuucccgaucgacuucuucgagcacaaccagcagcucaccgacgucgaguucggcggcaacgaccugcuccagguguacaacgcccagcagaucaagcaccgccucaacagcaccgggauguacguggccaacacgaagcccggcggguucaccaucgagaucagcaacaacaacuccaccauggucaugaccggcaugcggauccagaucgggacgcaggcgaucgagcgcgcccccagcuacaucgagaucuucggccggaccaugcagcugaaccugucccgcagccggugguucgacuuccccuucacccgcgaggaggcccuccaggccgacaagaagcugaaccuguucaucggcgccuccguggacccggcgggggugaccaugaucgacgccgucaagaucuacggcaagacgaaggagcaguucggguggcccgacgagccgcccgaggaguucccgagcgccuccgugagcaacaucugccccuccaaccucaaccagagcaacggcaccggggacuccgacagcgccgcccccaccaccacguccggcaccgugcuggagagcuccgagaccgagagccugaccaagcucgaccgccuggucguguccagccuggaggcgcucgaguccugcuucgccgugggccccaucaucgagaaggagcggaacaagaacgccgcccaggagcuggcgacgcugcuccugagccugccggcccccgccagcguccagcagcaguccaagagccuccuggccucccugcacaccagccgcuccgccuaccacagccacaaggaccaggcgcuccuguccaaggccgugcagugccugaacaccagcuccaaggaggggaaggaccucgaccccgagguguuccagcggcuggucaucaccgcccgcagcaucgccaucaugcggccgaacaaccuggugcacuucacggaguccaagcucccccagauggagaccgacugcuucuucccccgcugcgccugcuggagccugggcaucguggggauccugaucggcgcgccccucgagaccccgucccccgaggggauggacgagggcaaggagccccagaagcagcuggagggcgacugcugcagcuucaucacccagcuggucaaccacuucuggaagcuccacgccuccaagcccaagaacgccuuccuggccccggccugccugcccgggcucacgcacaucgaggcgaccgugaacgcccugguggacaucauccacggcuacugcacgugcgagcuggacugcaucaacaccgccagcaagaucuacaugcagaugcuccugugccccgaccccgccgucuccuucagcugcaagcaggcccugauccgggugcuccgcccgcggaacaagcgccggcacgugacccugcccuccagcccccgcagcaacacccccaugggggacaaggacgacgacgacgacgacgacgcggacgagaagaugcaguccagcggcaucccgaacgggggccacauccggcaggagucccaggagcagagcgaggucgaccacggcgacuucgagaugguguccgagagcauggugcuggagaccgccgagaacgucaacaacgggaaccccagcccccuggaggcccugcuggccggcgcggagggguucccgcccaugcucgacaucccgcccgacgccgacgacgagaccaugguggagcuggccaucgcccugagccuccagcaggaccagcagggcuccagcuccagcgcccugggccugcagucccucgggcugagcggccaggcgcccuccagcuccagccuggacgccgggacccucagcgacacgaccgccuccgcccuggugacccugagcgcccccgcguccgacgacgagggcagcaccgccgccacggacggguccacccuccgcaccagccccgccgaccacggcggcuccgucgggagcgaguccggcgggagcgccguggacuccgucgcgggcgagcacagcguguccgggcggagcuccgccuacggcgacgccaccgccgagggccaccccgcggggccgggcagcguguccagcuccacgggggccaucagcaccaccaccggccaccaggagggggacggcagcgagggcgagggggagggcgagacggagggggacguccacaccuccaaccgccugcacauggugcggcugaugcuccuggagcgccugcuccagacccugccccagcugcggaacgugggcgggguccgcgccauccccuacaugcaggucauccucaugcugaccacggaccuggacggcgaggacgagaaggacaagggcgcccuggacaaccuccugagccagcugaucgccgagcucgggauggacaagaaggacguguccaagaagaacgagcggagcgcgcugaacgagguccaccugguggugaugcgccuccuguccgucuucaugagccgcaccaaguccggcagcaaguccagcaucugcgaguccagcucccugaucagcuccgccaccgccgccgcccuccugagcuccggggcgguggacuacugccugcacgugcucaagagccugcuggaguacuggaagucccagcagaacgacgaggagcccgucgccaccagccagcuccugaagccgcacacgaccagcagcccgcccgacaugagccccuucuuccugcggcaguacgugaagggccacgccgccgacguguucgaggccuacacccagcuccugaccgagaugguccugcgccucccguaccagaucaagaagaucacggacaccaacucccggaucccgccgcccguguucgaccacagcugguucuacuuccuguccgaguaccugaugauccagcagaccccguucgugcgccggcagguccgcaagcuccugcuguucaucugcggcagcaaggagaaguaccggcagcuccgcgaccugcacacccuggacucccacgugcgggggaucaagaagcuccuggaggagcagggcaucuuccugcgcgcgagcguggucacggccuccagcggguccgcccuccaguacgacacccugaucagccugauggagcaccucaaggccugcgccgagaucgcggcccagcggaccaucaacuggcagaaguucugcaucaaggacgacuccgugcuguacuuccugcuccaggugagcuuccuggucgacgagggcgugucccccgugcugcuccagcugcugagcugcgcccucugcggguccaagguccuggccgcgcuggccgccagcuccggcagcagcuccgccagcuccagcuccgcccccguggcggccagcuccggccaggccaccacgcagagcaaguccagcaccaagaaguccaagaaggaggagaaggagaaggagaaggacggggagaccagcggcucccaggaggaccagcucugcaccgcccuggugaaccagcugaacaaguucgccgacaaggagacccucauccaguuccugcgcugcuuccugcucgagagcaacuccagcuccguccgguggcaggcgcacugccugacgcugcacaucuaccgcaacagcuccaagagccagcaggagcuccugcuggaccucauguggagcaucuggcccgagcugccggccuacgggcggaaggccgcccaguucguggaccugcucggcuacuucucccugaagacgccccagaccgagaagaagcugaaggaguacagccagaaggccguggagauccuccgcacccagaaccacauccugacgaaccaccccaacuccaacaucuacaacacccugagcgggcucgucgaguucgacggcuacuaccuggaguccgaccccugccuggugugcaacaacccggaggugcccuucugcuacaucaagcucagcuccaucaaggucgacacccgguacaccacgacccagcaggucgugaagcugaucggcagccacaccaucuccaaggucaccgugaagaucggggaccugaagcgcacgaagauggugcggaccaucaaccucuacuacaacaaccgcaccguccaggcgaucguggagcugaagaacaagcccgcccgcuggcacaaggccaagaaggugcagcugacccccggccagacggaggucaagaucgaccucccgcugcccaucguggccagcaaccugaugaucgaguucgcggacuucuacgagaacuaccaggccuccaccgagacccuccagugcccccggugcagcgccuccgugcccgccaacccgggggucugcggcaacugcggggagaacguguaccagugccacaagugccgcagcaucaacuacgacgagaaggaccccuuccugugcaacgccugcggcuucugcaaguacgcgcgguucgacuucaugcuguacgccaagcccugcugcgccgucgacccgaucgagaacgaggaggaccgcaagaaggccguguccaacaucaacacccuccuggacaaggccgaccggguguaccaccagcugaugggccaccgcccccagcucgagaaccugcugugcaaggucaacgaggcggcccccgagaagccccaggacgacagcgggacggccggcgggaucuccagcaccuccgccagcgugaaccgguacauccuccagcuggcccaggaguacugcggcgacugcaagaacagcuucgacgagcuguccaagaucauccagaagguguucgcgagccgcaaggagcuccuggaguacgaccugcagcagcgggaggccgccaccaaguccagccgcaccuccguccagccgacguucaccgccagccaguaccgggcgcuguccgugcucggcugcgggcacaccagcuccaccaagugcuacggcugcgccagcgccgugacggagcacugcaucacccugcugcgcgcccucgccaccaaccccgcgcugcggcacauccuggucucccaggggcucauccgcgagcuguucgacuacaaccugcggcgcggcgccgccgccaugcgggaggaggugcgccagcucaugugccugcugacccgggacaaccccgaggccacgcagcagaugaacgaccucaucaucgggaaggugagcaccgcgcugaagggccacugggccaaccccgaccuggccuccagccuccaguacgagaugcugcugcucaccgacuccaucagcaaggaggacuccugcugggagcugcgccugcggugcgcccucagccuguuccugauggccgucaacaucaagaccccggugguggucgagaacaucacgcucaugugccugcgcauccugcagaagcucaucaagccgcccgcgcccaccagcaagaagaacaaggacgugccgguggaggcccugaccaccgucaagcccuacugcaacgagauccacgcccaggcccagcuguggcucaagcgcgaccccaaggccuccuacgacgcguggaagaagugccugcccauccggggcaucgacgggaacggcaaggccccgagcaaguccgagcugcgccaccucuaccugaccgagaaguacguguggcgguggaagcaguuccugagccgccgggggaagcgcacgagcccccuggaccugaagcugggccacaacaacuggcuccgccaggugcuguucacccccgccacccaggccgcgcgccaggccgccugcaccaucgucgaggcccuggccacgauccccagccggaagcagcagguccucgaccugcugaccuccuaccucgacgagcugagcaucgcgggggagugcgccgccgaguaccuggcccucuaccagaagcugaucaccuccgcccacuggaagguguaccuggcggcccgcggcguccucccguacgugggcaaccugaucaccaaggagaucgcccggcugcucgcccuggaggaggccacgcugagcaccgaccuccagcagggguacgcgcugaagucccugaccggccuccugagcuccuucguggaggucgagagcaucaagcgccacuucaagucccggcugguggggaccgugcucaacggcuaccugugccugcgcaagcucgucgugcagcggacgaagcugaucgacgagacccaggacaugcugcucgagaugcuggaggacaugaccaccgggacggagagcgagaccaaggccuucauggccgugugcaucgagaccgccaagcgcuacaaccuggacgacuaccggacccccgucuucaucuucgagcgccucugcuccaucaucuaccccgaggagaacgaggugacggaguucuucgugacccuggagaaggacccccagcaggaggacuuccugcagggccggaugccgggcaaccccuacagcuccaacgagcccgggaucggcccccucaugcgcgacaucaagaacaagaucugccaggacugcgaccuggucgcgcugcucgaggacgacagcgggauggagcugcuggugaacaacaagaucaucagccucgaccugccgguggccgaggucuacaagaagguguggugcaccaccaacgagggcgagcccaugcgcaucguguaccggaugcgcgggcugcucggcgacgccacggaggaguucaucgagucccuggacagcaccaccgacgaggaggaggacgaggaggaggucuacaagauggccggcgugauggcccagugcgggggccuggagugcaugcucaaccggcuggcggggauccgcgacuucaagcagggccggcaccuccucaccgugcugcugaagcuguucuccuacugcgucaaggugaaggugaaccgccagcagcuggucaagcuggagaugaacacgcucaacgugaugcugggcacccugaaccuggcccucguggccgagcaggagagcaaggacuccgggggcgccgccgucgcggagcagguccugagcaucauggagaucauccuggacgaguccaacgccgagccccucagcgaggacaaggggaaccugcugcucaccggcgacaaggaccagcuggucaugcugcucgaccagaucaacuccaccuucgugcggagcaacccguccgugcugcaggggcugcuccgcaucauccccuaccugagcuucggcgaggucgagaagaugcagauccugguggagcgguucaagcccuacugcaacuucgacaaguacgacgaggaccacuccggcgacgacaagguguuccucgacugcuucugcaagaucgccgccgggaucaagaacaacagcaacggccaccagcugaaggaccugauccuccagaaggggaucacgcagaacgcccuggacuacaugaagaagcacauccccuccgcgaagaaccuggacgccgacaucuggaagaaguuccucagccgcccggcccugcccuucauccugcggcuccugcgcggccuggccauccagcaccccgggacccagguccucaucggcaccgacuccauccccaaccugcacaagcuggagcaggucagcuccgacgagggcaucgggacccucgcggagaaccugcuggaggcccuccgggagcacccggacgugaacaagaagaucgacgccgcccgccgggagacgcgcgccgagaagaagcggauggcgauggccaugcgccagaaggcccugggcacccuggggaugaccaccaacgagaagggccaggucgugaccaagacggcccuccugaagcagauggaggagcugaucgaggagcccgggcugaccugcugcaucugccgggagggcuacaaguuccagcccaccaaggugcugggcaucuacaccuucacgaagcgcgucgcccuggaggagauggagaacaagccccggaagcagcagggguacagcaccgugagccacuucaacaucgugcacuacgacugccaccucgcggccguccgccuggcccgcggccgggaggagugggaguccgccgcccugcagaacgcgaacaccaagugcaacgggcuccugccgguguggggcccccacgugcccgagagcgccuucgcgaccugccuggcccgccacaacacguaccuccaggagugcaccggccagcgggagcccaccuaccagcugaacauccacgacaucaagcuccucuuccugcgcuucgccauggagcaguccuucagcgcggacaccgggggcgggggccgggaguccaacauccaccugaucccguacaucauccacacgguccucuacgugcugaacaccacccgcgccaccagccgggaggagaagaaccugcagggguuccucgagcagcccaaggagaaguggguggaguccgccuucgaggucgacggccccuacuacuucacggugcuggcccugcacauccucccgcccgagcaguggcgcgcgacccggguggagauccugcgccggcugcucgucaccagccaggcccgcgccguggcccccggcggggccacccggcugacggacaaggcggugaaggacuacuccgccuaccgcagcucccuccucuucugggcccuggucgaccugaucuacaacauguucaagaaggugcccaccagcaacaccgagggcgggugguccugcagccucgccgaguacauccggcacaacgacaugcccaucuacgaggccgcggacaaggcccugaagaccuuccaggaggaguucaugcccguggagacguucuccgaguuccuggacgucgccggccuccugagcgagaucaccgaccccgaguccuuccugaaggaccuccugaacagcgugcccuga

SEQ ID NO: 38383 - RNA, 8397 nt, Artificial Sequence
  derived and/or modified sequence opt1 from UBR5__Homo_sapiens__NP_001269802
augaccagcauccacuucguggugcacccccugccgggcaccgaggaccagcucaacgaccgccugcgggagguguccgagaagcugaacaaguacaaccucaacagccacccgccccucaacgugcuggagcaggccaccaucaagcagugcgucguggggcccaaccacgccgccuuccuccuggaggacggccgcgugugccggaucggguucuccguccagcccgaccgccuggagcucggcaagcccgacaacaacgacgggagcaagcugaacuccaacagcggcgccggccggaccucccgccccgggcggaccagcgacucccccugguuccugagcggcuccgagacccucgggcgccuggccggcaacacccuggggagccggugguccagcggcgugggcggguccggcgggggcagcuccggccgcagcuccgccggggcccgggacagccgccggcagacccgcgugauccggaccggccgcgaccgggggagcggccuccuggggucccagccgcagcccgucauccccgccagcgugauccccgaggagcugaucucccaggcccaggugguccuccagggcaagagccgcuccgugaucauccgggagcugcagcgcaccaaccuggacgugaaccucgccgucaacaaccugcugagccgggacgacgaggacggcgacgacggggacgacaccgccuccgagagcuaccucccgggcgaggaccugaugucccugcucgacgcggacauccacagcgcccaccccuccgugaucaucgacgccgacgccauguucagcgaggacaucuccuacuucggguaccccagcuuccgccgcuccagccugucccggcugggcagcucccgcgugcuccugcugccccucgagcgggacagcgagcugcugcgcgagcgggagagcguccuccgccugcgggagcgccgguggcuggacggggccuccuucgacaacgagcgcggcagcaccuccaaggagggcgagccgaaccucgacaagaagaacacccccgugcagagccccgugucccugggggaggaccugcagugguggcccgacaaggacggcaccaaguucaucugcaucggggcgcucuacagcgagcugcuggccgucuccagcaagggcgagcucuaccaguggaagugguccgagagcgagccguaccggaacgcccagaaccccucccugcaccacccccgcgccacguuccuggggcucaccaacgagaagaucgugcugcugagcgccaacuccauccgggcgaccguggccaccgagaacaacaaggucgccacguggguggacgagacccugagcuccgucgccagcaagcucgagcacaccgcccagaccuacuccgagcugcagggcgagcgcaucgugagccugcacugcugcgcgcucuacacgugcgcccagcuggagaacagccuguacugguggggcgugguccccuucucccagcggaagaagaugcucgagaaggcccgcgccaagaacaagaagcccaaguccuccgccgggaucagcuccaugcccaacaucaccgugggcacccaggugugccugcggaacaacccccuguaccacgcgggggccgucgccuucagcaucuccgccggcauccccaaggugggcgugcucauggagagcgucuggaacaugaacgacuccugccgcuuccagcugcggagcccggagucccugaagaacauggagaaggcgagcaagaccacggaggccaagcccgaguccaagcaggagcccgugaagaccgagauggggccgccgcccagccccgccagcacgugcagcgacgccuccagcaucgccuccagcgcgagcaugccguacaagcgccgccgguccacccccgcccccaaggaggaggagaaggugaacgaggagcaguggagccuccgcgaggucguguucguggaggacgucaagaacgugcccgugggcaagguccugaagguggacggggccuacguggccgucaaguucccgggcaccuccagcaacaccaacugccagaacuccagcgggcccgacgccgaccccuccagccugcuccaggacugccggcugcugcgcaucgacgagcuccagguggugaagaccggcggcacccccaaggucccggacugcuuccagcggacgcccaagaagcugugcauccccgagaagaccgagauccuggcggugaacguggacuccaaggggguccacgccgugcucaagaccggcaacugggugcgcuacugcaucuucgaccuggccaccgggaaggccgagcaggagaacaacuuccccacgagcuccaucgccuuccugggccagaacgagcggaacgucgcgaucuucaccgccgggcaggagagcccgaucauccuccgcgacggcaacggcaccaucuaccccauggccaaggacugcaugggcgggauccgggaccccgacuggcuggaccugcccccgaucuccagccucgggaugggcgugcacucccugaucaaccugcccgccaacagcaccaucaagaagaaggcggccgugaucaucauggccgucgagaagcagacccucaugcagcacauccugcgcugcgacuacgaggccugccggcaguaccugaugaaccucgagcaggccguggugcuggagcagaaccugcagaugcuccagacguucaucucccaccgcugcgacgggaaccggaacauccugcacgcgugcgucagcgugugcuuccccaccuccaacaaggagaccaaggaggaggaggaggccgagcgcagcgagcggaacaccuucgccgagcgccugagcgccguggaggccaucgcgaacgccaucuccgucgugagcuccaacggccccggcaaccgggccgggagcuccagcucccgcagccuccggcugcgcgagaugaugcggcgcucccugcgcgccgccggccucgggcggcacgaggcgggcgccagcuccagcgaccaccaggacccggugagcccgcccaucgccccgcccagcuggguccccgacccgcccgccauggaccccgacggggacaucgacuucauccuggcgcccgccgugggcucccugacgaccgccgccaccggcaccgggcagggccccagcacguccaccauccccgggcccagcaccgagcccuccguggucgagagcaaggaccgcaaggccaacgcgcacuucauccucaagcugcugugcgacagcguggugcuccagcccuaccugcgggagcugcucuccgccaaggacgcccgcggcaugaccccguucaugagcgccgucuccggccgggccuaccccgcggccaucacgauccuggagaccgcccagaagaucgccaaggccgagaucagcuccagcgagaaggaggaggacguguucauggggauggugugccccuccggcaccaaccccgacgacagcccgcuguacguccucugcugcaacgacacgugcuccuucacguggaccggggcggagcacaucaaccaggacaucuucgagugccggaccugcggccugcuggagagccucugcugcugcaccgagugcgcccgggugugccacaaggggcacgacugcaagcugaagcgcacgucccccaccgccuacugcgacugcugggagaagugcaagugcaagacccugaucgccggccagaaguccgcccggcucgaccugcuguaccgccuccugaccgcgacgaaccuggucacccuccccaacucccggggcgagcaccuccugcuguuccuggugcagaccguggcccgccagaccgucgagcacugccaguaccggcccccgcgcauccgggaggaccgcaaccggaagacggccagccccgaggacuccgacaugcccgaccacgaccuggagcccccgcgcuucgcccagcucgcgcuggagcgggugcugcaggacuggaacgcccucaagagcaugaucauguucgggucccaggagaacaaggacccccugagcgccuccagccgcaucggccaccuccugcccgaggagcaggucuaccugaaccagcagagcgggaccauccgccuggacugcuucacccacugccugaucgucaagugcaccgccgacauccugcugcucgacacgcugcugggcacccucgugaaggagcugcagaacaaguacacccccgggcggcgcgaggaggccaucgcggugaccaugcgguuccugcgcuccgucgcccggguguucgugauccucagcgucgagauggccuccagcaagaagaagaacaacuucaucccgcagcccaucggcaagugcaagcgcguguuccaggcccugcugcccuacgccguggaggagcucugcaacgucgcggagucccugaucgugccggugcggaugggcaucgcccgccccacggcccccuucacccuggccagcaccuccaucgacgccaugcaggggagcgaggagcuguucuccgucgagccccucccgccccggcccagcuccgaccagagcuccagcuccagccagucccagagcuccuacaucauccgcaacccccagcagcggcgcaucagccagagccagccggugcggggccgcgacgaggagcaggacgacaucguguccgcggacgucgaggagguggagguggucgaggggguggccggcgaggaggaccaccacgacgagcaggaggagcacggggaggagaacgccgaggccgagggccagcacgacgagcacgacgaggacggcagcgacauggagcuggaccugcucgcggccgccgagaccgaguccgacagcgaguccaaccacagcaaccaggacaacgccuccgggcggcgcagcguggucaccgccgcgacggccggcuccgaggccggggccagcuccgugcccgccuucuucagcgaggacgacucccagagcaacgacuccagcgacuccgacagcagcuccagccaguccgacgacaucgagcaggagaccuucaugcuggacgagccccuggagcggaccaccaacagcucccacgcgaacggcgccgcccaggcgccccgcagcaugcagugggccgugcggaacacgcagcaccagcgcgcggccuccaccgccccgagcuccaccagcacccccgccgcguccagcgccggccucaucuacaucgaccccuccaaccugcggcgcagcgggacgaucuccaccagcgccgccgccgcggccgccgcccuggaggccuccaacgcgagcuccuaccucaccagcgccagcucccuggcccgcgccuacagcaucgucauccggcagaucuccgaccugaugggccucauccccaaguacaaccaccugguguacagccagaucccggccgcggugaagcugaccuaccaggacgccgucaaccuccagaacuacguggaggagaagcugauccccacguggaacuggaugguguccaucauggacagcaccgaggcccagcugcgcuacggguccgcccucgccagcgcgggcgaccccgggcaccccaaccacccgcugcacgccucccagaacagcgcccggcgcgagcggaugaccgcccgcgaggaggcgucccugcggacccucgagggccgccggcgcgccacgcugcugagcgcccggcagggcaugauguccgcccgcggggacuuccucaacuacgcccugagccugaugcggucccacaacgacgagcacagcgacguccuccccgugcuggacgugugcucccugaagcacgucgcguacguguuccaggcccucaucuacuggaucaaggccaugaaccagcagaccacccuggacacgccccagcuggagcgcaagcggacgcgcgagcuccuggagcugggcaucgacaacgaggacagcgagcacgagaacgacgacgacaccaaccaguccgccacccucaacgacaaggacgacgacagccugcccgccgagaccgggcagaaccacccguucuuccggcgcagcgacuccaugacguuccugggcugcaucccgcccaaccccuucgaggugccgcucgcggaggccaucccccuggccgaccagccccaccuccugcagccgaacgcccggaaggaggaccuguucgggcgccccagccagggccuguacuccagcuccgccagcuccggcaagugccucauggaggucaccguggaccgcaacugccuggaggugcugcccaccaagaugagcuacgcggccaaccucaagaacgucaugaacaugcagaaccggcagaagaaggagggggaggagcagcccgugcugccggaggagaccgaguccagcaagcccggccccuccgcccacgaccuggccgcgcagcucaagagcucccugcuggccgagaucgggcucacggagagcgaggggccgccccugaccuccuuccgcccccagugcagcuucauggggauggugaucucccacgacaugcugcucggccgguggcgccugagccuggagcuguucggccgggucuucauggaggacgugggggccgagcccggcuccauccugaccgagcucggcggguucgaggugaaggagagcaaguuccgccgggagauggagaagcuccgcaaccagcagagccgggaccugucccuggaggucgaccgcgaccgggaccuccugauccagcagaccaugcgccagcugaacaaccacuucgggcggcgcugcgccacgacccccauggccgugcaccgggucaaggugaccuucaaggacgagcccggggagggcagcgggguggcgcgcuccuucuacaccgccaucgcccaggccuuccucagcaacgagaagcugcccaaccuggagugcauccagaacgccaacaagggcacgcacaccucccucaugcagcggcugcgcaaccgcggggagcgcgaccgggagcgcgagcgcgagcgggagaugcgccggagcuccggccugcgcgcgggcagccggcgcgaccgggaccgcgacuuccggcgccagcucuccaucgacacccggcccuuccgccccgccagcgaggggaacccguccgacgaccccgagccccugcccgcccaccggcaggcccugggcgagcgccucuacccgcggguccaggccaugcagcccgcguucgccagcaagaucaccgggaugcugcuggagcucucccccgcccagcugcugcuccugcuggccagcgaggacucccuccgcgcgcggguggacgaggccauggagcugaucaucgcccacggccgcgagaacggggccgacagcauccuggaccucggccugguggacuccagcgagaagguccaggagaaccggaagcgccacggcuccagccgcagcgugguggacauggaccuggacgacaccgacgacggggacgacaacgcgccccuguucuaccagccgggcaagcggggguucuacacgccccgccccggcaagaacaccgaggcgcggcugaacugcuuccgcaacaucgggcggauccugggccucugccugcugcagaacgagcucugcccgaucacccugaaccgccacgucaucaaggugcugcugggccggaaggugaacuggcacgacuucgccuucuucgaccccgucauguacgagucccuccgccagcugauccuggccagccaguccagcgacgccgacgccguguucuccgcgauggaccucgccuucgccaucgaccugugcaaggaggagggcggcggccagguggagcugauccccaacggcgucaacauccccgugaccccgcagaacguguacgaguacguccggaaguacgccgagcaccgcaugcucgugguggccgagcagccccugcacgcgaugcggaaggggcugcucgacguccugcccaagaacagccuggaggaccucacggccgaggacuuccgccugcuggugaacggcugcggcgaggugaacguccagaugcucaucuccuucaccagcuucaacgacgaguccggggagaacgccgagaagcugcugcaguucaagcggugguucuggagcaucguggagaagauguccaugaccgagcgccaggaccucguguacuucuggaccagcucccccagccugccggccuccgaggagggcuuccagcccaugcccagcaucacgauccggcccccggacgaccagcaccuccccaccgccaacacgugcaucucccgccucuacgucccccuguacagcuccaagcagauccugaagcagaagcuccugcuggcgaucaagaccaagaacuucggguucguguga

SEQ ID NO: 38384 - RNA, 1278 nt, Artificial Sequence
  derived and/or modified sequence opt1 from UBR7__Homo_sapiens__NP_786924
auggccggcgccgagggggcggccggccgccagagcgagcuggagcccguggucucccucguggacgugcuggaggaggacgaggagcuggagaacgaggccugcgccguccucgggggcagcgacuccgagaagugcagcuacucccaggggagcgugaagcggcaggcccuguacgcgugcuccacgugcaccccggagggcgaggagcccgccggcaucugccuggccugcagcuacgagugccacgggucccacaagcuguucgagcucuacaccaagcgcaacuuccggugcgacugcggcaacagcaaguucaagaaccuggagugcaagcuccugcccgacaaggccaaggugaacuccgggaacaaguacaacgacaacuucuucggccuguacugcaucugcaagcgccccuacccggaccccgaggacgagauccccgacgagaugauccagugcgucgugugcgaggacugguuccacgggcggcaccucggcgcgaucccgcccgagagcggcgacuuccaggagauggugugccaggccugcaugaagcgcugcuccuuccugugggccuacgccgcccagcuggcggucaccaagaucagcaccgaggacgacgggcucgugcggaacaucgacggcaucggggaccaggaggugaucaagcccgagaacggcgagcaccaggacuccacccugaaggaggacguccccgagcagggcaaggacgacgugcgcgaggugaaggucgagcagaacagcgagcccugcgccggguccagcuccgagagcgaccugcagacgguguucaagaacgagagccucaacgccgaguccaagagcggcugcaagcugcaggagcugaaggccaagcagcucaucaagaaggacaccgccaccuacuggccgcugaacuggcgguccaagcugugcacgugccaggacugcaugaagauguacggggaccucgacgugcuguuccugaccgacgaguacgacaccguccucgcguacgagaacaagggcaagaucgcccaggccaccgaccgcagcgacccccugauggacacccuguccagcaugaaccgggugcagcaggucgagcucaucugcgaguacaacgaccugaagacggagcugaaggacuaccucaagcgcuucgccgacgaggggaccguggugaagcgggaggacauccagcaguucuucgaggaguuccaguccaagaagcgccggcgcguggacggcaugcaguacuacugcagcuga

SEQ ID NO: 38385 - RNA, 705 nt, Artificial Sequence
  derived and/or modified sequence opt1 from UBTD2__Homo_sapiens__NP_689490
augggcgggugcgugggcgcccagcacgacagcuccgggagccugaacgagaacuccgagggcaccggggucgcccucggccgcaaccagccccugaagaaggagaagccgaaguggaaguccgacuaccccaugaccgacggccagcugcggagcaagcgcgacgaguucugggacacggcgcccgccuucgaggggcggaaggagaucugggacgcccucaaggccgccgcgcacgccuucgagagcaacgaccacgagcuggcccaggccaucaucgacggcgcgaacaucacccugccccacggggcccucaccgagugcuacgacgagcugggcaaccgcuaccagcugccgguguacugccucgccccgcccaucaacaugaucgaggagaaguccgacaucgagacccuggacauccccgagcccccgcccaacagcggguacgagugccagcugcggcuccgccuguccacgggcaaggaccugaagcucgugguccggagcaccgacaccguguuccacaugaagcgccggcugcacgccgccgagggcguggagcccgggucccagcgcugguucuucagcggccggccccugaccgacaagaugaaguucgaggagcucaagauccccaaggacuacgucguccaggugaucgugucccagcccgugcagaaccccacgccgguggagaacuga

SEQ ID NO: 38386 - RNA, 2184 nt, Artificial Sequence
  derived and/or modified sequence opt1 from UBTF__Homo_sapiens__NP_001070151
augaacggcgaggccgacugccccaccgaccuggagauggccgcgccgaaggggcaggaccgcuggagccaggaggacaugcucacccugcuggagugcaugaagaacaaccuccccuccaacgacagcuccaaguucaagacgaccgagagccacauggacugggagaagguggccuucaaggacuucuccggcgacaugugcaagcugaagugggucgagaucagcaacgaggugcggaaguuccgcacccugaccgagcucauccuggacgcccaggagcacgugaagaaccccuacaaggggaagaagcugaagaagcaccccgacuucccgaagaagccccucacgcccuacuuccgguucuucauggagaagcgcgccaaguacgccaagcugcaccccgagauguccaaccuggaccucaccaagauccugagcaagaaguacaaggagcugccggagaagaagaagaugaaguacauccaggacuuccagcgggagaagcaggaguucgagcgcaaccucgcgcgguuccgcgaggaccaccccgaccugauccagaacgccaagaaguccgacauccccgagaagcccaagaccccgcagcagcugugguacacccacgagaagaaggucuaccucaaggugcggcccgacgagaucaugcgcgacuacauccagaagcaccccgagcugaacaucagcgaggagggcaucacgaaguccacccugaccaaggccgagcggcagcucaaggacaaguucgacgggcgccccaccaagccgccgcccaacagcuacucccuguacugcgccgagcugauggcgaacaugaaggacgugcccagcacggagcggaugguccucugcucccagcaguggaagcugcugagccagaaggagaaggacgccuaccacaagaagugcgaccagaagaagaaggacuacgagguggagcuccugcgcuuccuggagucccuccccgaggaggagcagcagcgggugcugggcgaggagaagaugcugaacaucaacaagaagcaggccaccagccccgccuccaagaagcccgcccaggagggcgggaagggcgggagcgagaagcccaagcgcccggucagcgcgauguucaucuucuccgaggagaagcggcgccagcuccaggaggagcggcccgagcugagcgaguccgagcugacccgccuccuggcccggauguggaacgaccugagcgagaagaagaaggccaaguacaaggcccgcgaggccgcgcucaaggcccaguccgagcgcaagcccggcggggagcgggaggagcgcggcaagcugcccgagagcccgaagcgggccgaggagaucuggcagcaguccgugaucggcgacuaccuggcccgcuucaagaacgaccgggugaaggcccucaaggcgauggagaugaccuggaacaacauggagaagaaggagaagcugauguggaucaagaaggccgccgaggaccagaagcgcuacgagcgggagcugagcgagaugcgcgccccgcccgccgcgacgaacuccagcaagaagaugaaguuccagggggagcccaagaagccgcccaugaacggcuaccagaaguucucccaggagcuccugagcaacggggagcugaaccaccucccccugaaggagcggauggucgagaucggcucccgcuggcagcggaucagccagucccagaaggagcacuacaagaagcuggccgaggagcagcagaagcaguacaaggugcaccuggaccucugggugaagucccugagcccccaggaccgcgccgccuacaaggaguacaucagcaacaagcggaaguccaugaccaagcugcgcggccccaaccccaagagcagccggaccacccuccaguccaagagcgaguccgaggaggacgacgaggaggacgaggacgacgaggacgaggacgaggaggaggaggacgacgagaacggggacagcuccgaggacggcggggacagcuccgagagcuccagcgaggacgaguccgaggacggcgacgagaacgaggaggacgacgaggacgaggacgacgacgaggacgacgacgaggacgaggacaacgagagcgagggguccagcuccagcuccagcagcuccggcgacagcuccgacagcgacuccaacuga

SEQ ID NO: 38387 - RNA, 894 nt, Artificial Sequence
  derived and/or modified sequence opt1 from UBXN1__Homo_sapiens__NP_001273006
auggccgagcugaccgcccucgagagccugaucgagaugggcuucccccgcgggcgggcggagaaggcccuggcccucaccggcaaccaggggaucgaggccgccauggacuggcugauggagcacgaggacgacccggacguggacgagccccuggagacgccccucggccacauccuggggcgcgagcccaccuccagcgagcagggcggccuggagggguccggcagcgcggccggggagggcaagccggcccucuccgaggaggagcggcaggagcagaccaagcgcaugcuggagcuggucgcccagaagcagcgggagcgcgaggagcgggaggagcgcgaggcgcucgagcgggagcgccagcggcgccggcaggggcaggagcugagcgccgcccgccagcggcugcaggaggacgagaugcgccgggccgccgaggagcgccggcgcgagaaggcggaggagcucgccgcccggcagcgcgugcgcgagaagaucgagcgggacaaggccgagcgcgccaagaaguacggcggcuccguggggagccagcccccgcccgucgcgcccgagcccggccccgugcccuccagcccgucccaggagccgcccaccaagcgggaguacgaccagugccgcauccaggugcggcugcccgacgggacgagccugacccagaccuuccgcgcccgggagcagcucgccgccguccgccuguacguggagcugcaccggggcgaggagcucggcgggggccaggaccccgugcagcugcuguccggguucccccgccgggccuucagcgaggcggacauggagcgcccccuccaggagcugggccugguccccuccgccgugcucaucguggccaagaagugcccgagcuga

SEQ ID NO: 38388 - RNA, 780 nt, Artificial Sequence
  derived and/or modified sequence opt1 from UBXN2A__Homo_sapiens__NP_859064
augaaggacguggacaaccucaagagcaucaaggaggagugggucugcgagaccggcuccgacaaccagccccuggggaacaaccagcagagcaacugcgaguacuucguggacucccuguucgaggaggcccagaaggugagcuccaagugcgucagcccggccgagcagaagaagcaggucgacgugaacaucaagcuguggaagaacggcuucaccgugaacgacgacuuccgcuccuacagcgacggggcgucccagcaguuccucaacagcaucaagaagggcgagcugcccuccgagcugcaggggaucuucgacaaggaggagguggacgugaaggucgaggacaagaagaacgagaucugccucagcacgaagcccguguuccagcccuucuccggccagggccaccggcuggggagcgccaccccgaagaucguguccaaggccaagaacaucgaggucgagaacaagaacaaccugagcgccgugccccucaacaaccuggagcccaucaccaacauccagaucuggcuggccaacggcaagcgcaucgugcagaaguucaacaucacccaccgggucucccacaucaaggacuucaucgagaaguaccaggggagccagcgcuccccgcccuucagccucgcgacggcccugcccgugcugcggcuccuggacgagacccugacccucgaggaggccgaccugcagaacgccgugaucauccagcgccugcagaagaccgcgagcuuccgggagcucuccgagcacuga

SEQ ID NO: 38389 - RNA, 996 nt, Artificial Sequence
  derived and/or modified sequence opt1 from UBXN2B__Homo_sapiens__NP_001071087
auggccgagggcgggggccccgagccgggggagcaggagcgccggagcuccggcccccgcccgcccagcgcccgggaccugcagcucgcgcuggccgagcuguacgaggacgaggugaagugcaaguccagcaaguccaaccgccccaaggccaccgucuucaagagcccccggaccccgccccagcgcuucuacuccagcgagcacgaguacuccgggcucaacaucgugcggcccagcacgggcaagaucgugaacgagcuguucaaggaggcccgcgagcacggcgccgucccccugaacgaggcgacccgggccuccggggacgacaagagcaaguccuucaccggcgggggcuaccgccucgggagcuccuucugcaagcggagcgaguacaucuacggcgagaaccagcugcaggacgugcagauccugcucaagcugugguccaacggcuucagccuggacgacggggagcuccgccccuacaacgagcccaccaacgcccaguuccuggaguccgugaagcggggcgagaucccgcuggagcuccagcgccugguccacgggggccaggugaaccuggacauggaggaccaccaggaccaggaguacaucaagccccggcuccgcuucaaggccuucagcggcgaggggcagaagcugggcagccugacgcccgagaucguguccacccccagcuccccggaggaggaggacaagagcauccucaacgcggucgugcugaucgacgacuccgugcccaccaccaagauccagauccggcuggccgacgggagccgccucauccagcgguucaacuccacgcaccgcauccuggacguccggaacuucaucgugcagagccgccccgaguucgccgcccuggacuucauccucgugaccuccuuccccaacaaggagcugaccgacgagagccugacccuccuggaggccgacauccugaacacgguccuccugcagcagcugaaguga

SEQ ID NO: 38390 - RNA, 1527 nt, Artificial Sequence
  derived and/or modified sequence opt1 from UBXN4__Homo_sapiens__NP_055422
augcugugguuccagggcgccauccccgccgcgaucgccaccgccaagcgcagcggggccguguucgucguguucguggccggcgacgacgagcaguccacccagauggcggccagcugggaggacgacaaggucacggaggccuccagcaacuccuucguggccaucaagaucgacaccaagagcgaggcgugccuccaguucucccagaucuaccccguggucugcgugcccagcuccuucuucaucggggacagcggcaucccccuggaggugaucgccggguccgucagcgccgacgagcuggugacccggauccacaaggugcgccagaugcaccuccugaaguccgagaccagcgucgccaacggcucccagagcgaguccagcguguccacgcccagcgccagcuucgagcccaacaacacgugcgagaacucccagagccggaacgcggagcugugcgagaucccgcccaccuccgacaccaagagcgacaccgccaccggcggggaguccgccggccacgccaccagcucccaggagcccagcgggugcuccgaccagcgccccgccgaggaccucaacauccggguggagcgccugaccaagaagcuggaggagcggcgcgaggagaagcggaaggaggaggagcagcgcgagaucaagaaggagaucgagcggcgcaagacgggcaaggagaugcucgacuacaagcggaagcaggaggaggagcugaccaagcgcaugcuggaggagcggaaccgcgagaaggcggaggaccgggccgcccgcgagcggaucaagcagcagaucgcccucgaccgcgccgagcgggcggcccgcuucgccaagaccaaggaggaggucgaggccgccaaggcggccgcccugcuggccaagcaggcggagauggaggugaagcgcgagagcuacgcccgggagcgcuccaccguggcccggauccaguuccgccuccccgacgggagcuccuucacgaaccaguuccccagcgacgcgccccuggaggaggcccggcaguucgccgcccagaccgucggcaacaccuacggcaacuucucccuggccaccauguucccgcgccgggaguucacgaaggaggacuacaagaagaagcuccuggaccuggagcucgcccccagcgccuccguggugcugcugcccgcggggcgccccaccgccagcaucguccacuccagcagcggcgacaucuggacccuccuggggaccgugcuguacccguuccucgccaucuggcggcugaucuccaacuuccuguucagcaacccgccgcccacgcagaccuccgugcgcgucaccagcuccgagccgcccaaccccgccagcuccagcaaguccgagaagcgggagcccgugcgcaagcggguccucgagaagcgcggcgacgacuucaagaaggagggcaagaucuaccggcugcgcacccaggacgacggggaggacgagaacaacacguggaacggcaacagcacccagcagauguga

SEQ ID NO: 38391 - RNA, 672 nt, Artificial Sequence
  derived and/or modified sequence opt1 from UCHL1__Homo_sapiens__NP_004172
augcagcugaagcccauggagaucaacccggagaugcucaacaaggugcugagccgccugggcgucgccgggcaguggcgguucguggacgugcucggccuggaggaggagucccuggggagcguccccgcccccgcgugcgcccuccugcuccuguucccccugaccgcccagcacgagaacuuccgcaagaagcagaucgaggagcugaagggccaggagguguccccgaagguguacuucaugaagcagaccaucgggaacagcugcggcacgaucggccucauccacgccgucgccaacaaccaggacaagcugggguucgaggacggcuccgugcugaagcaguuccucagcgagaccgagaagaugucccccgaggaccgggcgaagugcuucgagaagaacgaggccauccaggccgcccacgacgcgguggcccaggaggggcagugccgcgucgacgacaaggugaacuuccacuucauccuguucaacaacguggacggccaccuguacgagcucgacgggcggaugcccuuccccgucaaccacggcgccagcuccgaggacacccugcugaaggacgccgccaaggugugccgcgaguucaccgagcgggagcagggcgaggugcgcuucagcgcggucgcccucugcaaggccgccuga

SEQ ID NO: 38392 - RNA, 693 nt, Artificial Sequence
  derived and/or modified sequence opt1 from UCHL3__Homo_sapiens__NP_005993
auggagggccagcgcuggcugccccucgaggccaacccggaggugaccaaccaguuccugaagcagcuggggcuccaccccaacuggcaguucgucgacguguacggcauggaccccgagcugcugagcauggugccccggccggucugcgccgugcuccugcuguuccccaucaccgagaaguacgagguguuccgcacggaggaggaggagaagaucaagucccaggggcaggacgucaccagcuccguguacuucaugaagcagaccaucagcaacgcgugcggcaccaucgggcucauccacgccaucgccaacaacaaggacaagaugcacuucgaguccggcagcacgcugaagaaguuccuggaggaguccgugagcaugucccccgaggagcgggcccgcuaccucgagaacuacgacgccauccgggucacccacgagaccagcgcgcacgagggccagaccgaggcccccuccaucgacgagaagguggaccugcacuucaucgcccuggugcacgucgacgggcaccucuacgagcuggacggccgcaagccguuccccaucaaccacggggagacgagcgacgagacccugcucgaggacgccaucgaggugugcaagaaguucauggagcgggaccccgacgagcugcgcuucaacgcgaucgcccuguccgccgccuga

SEQ ID NO: 38393 - RNA, 987 nt, Artificial Sequence
  derived and/or modified sequence opt1 from UCHL5__Homo_sapiens__NP_001186190
augaccggcaacgccggggaguggugccugauggagagcgaccccggcguguucaccgagcucaucaagggguucggcugccgcggggcccaggucgaggagaucuggucccuggagccggagaacuucgagaagcugaagcccgugcacggccucaucuuccuguucaaguggcagcccggcgaggagcccgcggggagcgugguccaggacucccggcuggacacgaucuucuucgccaagcaggucaucaacaacgccugcgccacccaggccaucgugagcgugcuccugaacugcacccaccaggacgugcaccugggcgagacccucuccgaguucaaggaguucagccaguccuucgacgcggccaugaaggggcuggcccugagcaacuccgacgugauccgccagguccacaacagcuucgcccggcagcagauguucgaguucgacacgaagaccuccgcgaaggaggaggacgccuuccacuucgugagcuacgugccggucaacggccgccucuacgagcuggacgggcugcgggagggccccaucgaccucggcgccugcaaccaggacgacuggaucuccgccgugcgccccgugaucgagaagcggauccagaaguacagcgagggggagauccgcuucaaccugauggccaucgucuccgaccggaagaugaucuacgagcagaagaucgcggagcugcagcgccagcucgccgaggagcccauggacaccgaccagggcaacagcaugcuguccgccauccagagcgagguggccaagaaccagaugcugaucgaggaggaggugcagaagcucaagcgguacaagaucgagaacauccgccggaagcacaacuaccugccguucaucauggagcugcucaagacccuggccgagcaccagcagcugaucccccucgucgagaaggcgaaggagaagcagaacgccaagaaggcccaggagacgaaguga

SEQ ID NO: 38394 - RNA, 606 nt, Artificial Sequence
  derived and/or modified sequence opt1 from UCK1__Homo_sapiens__NP_001129426
auggccagcgccggcggggaggacugcgagucccccgcgccggaggccgaccgcccccaccagcggcccuuccugaucggcgugagcgggggcaccgccuccggcaagagcaccgucugcgagaagaucauggagcuccuggggcagaacgagguggagcagcgccagcggaagguggucauccugucccaggaccgcuucuacaaggugcucacggccgagcagaaggccaaggcgcugaagggccaguacaacuucgaccaccccgacgccuucgacaacgaccugaugcaccggacccucaagaacaucguggaggggaagaccgucgaggugccgaccuacgacuucgugacgcacagccgccugcccgagaccaccgucguguaccccgccgacgugguccuguucgagggcauccucguguucuacucccaggagauccgggacauguuccaccuccgccuguucguggacaccgacagcgacguccggcugucccgccgggacaaggaggugugccgcugcgaccaccccgcccggagcgggcaguacggcugccaccagccggaccgcgcggcccaccccgggcacuccgagugguga

SEQ ID NO: 38395 - RNA, 786 nt, Artificial Sequence
  derived and/or modified sequence opt1 from UCK2__Homo_sapiens__NP_036606
auggccggcgacagcgagcagacccugcagaaccaccagcagcccaacgggggcgagccguuccucaucgggguguccggcgggaccgccagcggcaaguccagcgucugcgcgaagaucgugcagcugcugggccagaacgagguggacuaccgccagaagcaggucgugauccucucccaggacagcuucuaccgggugcugacguccgagcagaaggccaaggcccugaaggggcaguucaacuucgaccaccccgacgccuucgacaacgagcucauccugaagacccugaaggagaucaccgagggcaagaccguccagauccccguguacgacuucgugagccacucccgcaaggaggagacggucaccguguaccccgccgacgugguccucuucgaggggauccuggcguucuacagccaggaggugcgggaccuguuccagaugaagcuguucguggacaccgacgccgacacccgccucucccggcgcguccugcgggacaucagcgagcgcggccgggaccucgagcagauccugucccaguacaucacguucgugaagccggccuucgaggaguucugccugcccaccaagaaguacgccgacgugaucaucccccgcggggcggacaaccucgucgccaucaaccugaucgugcagcacauccaggacauccugaacggcggccccagcaagcggcagaccaacgggugccucaacggcuacaccccgucccgcaagcggcaggccagcgaguccagcucccgcccccacuga

SEQ ID NO: 38396 - RNA, 1602 nt, Artificial Sequence
  derived and/or modified sequence opt1 from UCKL1__Homo_sapiens__NP_001180308
augagcagcccgcccgccuaccccggcauccgcaucuccgggugccgggcccugggcgcggagggguccagcaacgccgagucccucgaccgccugcugccgcccgugggcaccgggcggagcccccgcaagcggaccacgucccagugcaagagcgagccgccccuccugcgcaccuccaagcggaccaucuacaccgccggccgcccgcccugguacaacgagcacggcacgcagagcaaggaggccuucgccaucgggcugggcgggggcuccgcgagcgggaagaccaccgucgcccggaugaucaucgaggcccucgacgugcccugggugguccugcuguccauggacagcuucuacaaggugcucaccgagcagcagcaggagcaggccgcgcacaacaacuucaacuucgaccaccccgacgccuucgacuucgaccugaucaucuccacgcugaagaagcucaagcagggcaagagcgugaagguccccaucuacgacuucaccacccacucccgcaagaaggacuggaagacccuguacggcgccaacgugaucaucuucgaggggaucauggccuucgccgacaagacgcugcucgagcugcuggacaugaagaucuucguggacaccgacagcgacauccggcucguccgccggcugcgccgggacaucuccgagcgcggccgggacaucgagggggugaucaagcaguacaacaaguucgugaagcccagcuucgaccaguacauccagcccaccaugcgccuggcggacaucgucgugccccggggcagcggcaacaccguggccaucgaccucaucguccagcacgugcacucccagcuggaggagcgcgagcugagcgugcgggccgcccucgccuccgcgcaccagugccacccccugccgcgcacgcugagcguccucaaguccacgccccaggugcgcgggaugcacaccaucauccgggacaaggagaccagccgcgacgaguucaucuucuacuccaagcggcugaugcgccugcucaucgagcacgcccugagcuuccugcccuuccaggacugcgugguccagacgccccagggccaggacuacgccgggaagugcuacgccggcaagcagaucaccgggguguccauccuccgggccggcgagaccauggagccggcgcugcgcgccgugugcaaggacguccggaucggcaccauccugauccagaccaaccagcucaccggggagcccgagcugcacuaccugcgccuccccaaggacaucagcgacgaccacgugauccugauggacugcaccgucuccaccggcgccgccgccaugauggcggugcgggugcugcucgaccacgacguccccgaggacaagaucuuccugcugagccuccugauggccgagaugggggugcacuccguggccuacgccuucccgcgcguccggaucaucacgaccgcgguggacaagcgcgugaacgaccuguuccggaucauccccggcaucgggaacuucggcgaccgcuacuucggcaccgacgccguccccgacgggagcgacgaggaggagguggccuacaccggcuga

SEQ ID NO: 38397 - RNA, 417 nt, Artificial Sequence
  derived and/or modified sequence opt1 from UCMA__Homo_sapiens__NP_660357
augaccuggcgccaggccgugcugcucagcugcuucuccgccgucgugcugcugagcaugcuccgggagggcaccuccgugagcgucgggacgaugcagauggcgggcgaggaggccuccgaggacgccaagcagaagaucuucaugcaggagagcgacgccuccaacuuccugaagcgccgggggaagcgcagccccaagucccgggacgaggugaacguggagaaccgccagaagcugcgggucgacgagcuccgccgggaguacuacgaggagcagcgcaacgaguucgagaacuucguggaggagcagaacgacgagcaggaggagcggagccgcgaggccguggagcaguggcggcaguggcacuacgacggccugcacccguccuaccuguacaaccgccaccacaccuga

SEQ ID NO: 38398 - RNA, 339 nt, Artificial Sequence
  derived and/or modified sequence opt1 from UCN2__Homo_sapiens__NP_149976
augacccgcugcgcccugcuccugcugauggugcucaugcugggccggguccugguggugcccgucaccccgauccccacguuccagcuccgcccccagaacagcccccagaccaccccgcggcccgccgcguccgagagccccuccgccgcccccaccuggccgugggccgcccagagccacugcucccccacgcgccaccccgggagccggaucgugcugucccuggacgugcccaucggccuccugcagauccugcucgagcaggcgcgcgcccgggccgcccgcgagcaggcgaccaccaacgcccggauccuggcccgcgucgggcacugcuga

SEQ ID NO: 38399 - RNA, 486 nt, Artificial Sequence
  derived and/or modified sequence opt1 from UCN3__Homo_sapiens__NP_444277
augcugaugcccgugcacuuccuccugcugcuccugcugcuccugggcgggccgcgcaccggccugccccacaaguucuacaaggccaagcccaucuucagcugccucaacaccgcccuguccgaggcggagaaggggcagugggaggacgccagccugcucuccaagcggagcuuccacuaccugcgcucccgggacgccagcuccggcgaggaggaggaggggaaggagaagaagacguuccccaucagcggcgcccgcggcggggcccggggcacccgcuaccgguacgucucccaggcgcagccgcgcgggaagccccggcaggacaccgccaagagcccccaccgcaccaaguucacgcugucccucgacgugcccaccaacaucaugaaccugcuguucaacaucgccaaggccaagaaccuccgggcgcaggccgccgccaacgcccaccugauggcgcagaucggccgcaagaaguga

SEQ ID NO: 38400 - RNA, 375 nt, Artificial Sequence
  derived and/or modified sequence opt1 from UCN__Homo_sapiens__NP_003344
augcgccaggccggccgggccgcgcugcucgccgcccugcugcuccuggugcagcugugccccgggagcucccagcgcagcccggaggccgccggcguccaggaccccucccuccgguggagccccggggcgcgcaaccagggcgggggcgcccgggcccugcugcuccugcuggccgagcgcuucccccggcgcgcgggcccggggcggcucggccuggggaccgccggcgagcgcccccggcgcgacaaccccucccugagcaucgaccucaccuuccaccuccugcggacgcugcuggagcuggcccgcacccagucccagcgggagcgcgccgagcagaaccggaucaucuucgacagcguggggaaguga

SEQ ID NO: 38401 - RNA, 924 nt, Artificial Sequence
  derived and/or modified sequence opt1 from UCP1__Homo_sapiens__NP_068605
augggcgggcugaccgccagcgacgugcaccccacccucggcguccagcuguucuccgccgggaucgcggccugccuggccgacgugaucacguucccgcucgacaccgccaaggugcgccugcagguccagggcgagugccccaccagcuccgugauccgguacaagggggugcugggcaccaucacggccgucgugaagaccgagggccgcaugaagcucuacagcgggcugcccgcgggccugcagcggcagaucuccagcgccucccuccgcaucgggcuguacgacaccgugcaggaguuccugaccgccggcaaggagacggcccccagccucggguccaagauccuggcgggccugaccaccggcggggucgccguguucaucggccagccgaccgagguggucaaggugcggcuccaggcccagagccaccuccacgggaucaagccccgcuacacgggcaccuacaacgccuaccggaucaucgccaccaccgagggccugacggggcuguggaagggcaccacccccaaccugaugcgcuccgugaucaucaacugcaccgagcuggucacguacgaccucaugaaggaggcguucgugaagaacaacauccuggccgacgacgugcccugccaccuggucagcgcccucaucgccggguucugcgccaccgcgauguccagcccgguggacguggucaagacccgguucaucaacuccccgcccggccaguacaagagcgugcccaacugcgccaugaagguguucaccaacgaggggcccacggccuucuucaagggccugguccccuccuuccugcgccucggcagcuggaacgugaucauguucgucugcuucgagcagcugaagcgggagcuguccaagagccgccagaccauggacugcgccaccuga

SEQ ID NO: 38402 - RNA, 930 nt, Artificial Sequence
  derived and/or modified sequence opt1 from UCP2__Homo_sapiens__NP_003346
auggugggcuucaaggccaccgacgugcccccgaccgccacggucaaguuccugggggcgggcaccgccgccugcaucgccgaccucaucaccuucccccuggacaccgccaaggugcgccugcagauccagggggagagccagggccccguccgggcgacggccuccgcccaguaccgcggggugaugggcaccauccucaccauggugcggaccgagggcccccgcagccuguacaacgggcuggucgccggccuccagcggcagauguccuucgcgagcgugcgcaucgggcuguacgacuccgugaagcaguucuacacgaagggcagcgagcacgccuccaucgggagccggcugcucgccggcuccaccaccggcgcccuggccgucgcgguggcccagccgaccgacguggucaaggugcgcuuccaggcccaggcccgggccgggggcgggcgccgguaccagagcacggugaacgcguacaagaccaucgcccgcgaggagggcuuccggggccuguggaaggggaccucccccaacgucgcccgcaacgccaucgugaacugcgccgagcucgugaccuacgaccugaucaaggacgcgcugcucaaggccaaccugaugacggacgaccugcccugccacuucaccagcgccuucggcgccggguucugcaccaccgucaucgccucccccguggacguggucaagacgcgguacaugaacagcgcgcucggccaguacuccagcgccgggcacugcgcccugaccaugcugcagaaggagggcccgcgcgccuucuacaagggcuucaugcccuccuuccuccggcuggggagcuggaacguggugauguucgucaccuacgagcagcugaagcgcgcgcucauggccgccugcaccucccgggaggcccccuucuga

SEQ ID NO: 38403 - RNA, 939 nt, Artificial Sequence
  derived and/or modified sequence opt1 from UCP3__Homo_sapiens__NP_003347
auggugggccugaagcccagcgacgucccgcccaccauggccgugaaguuccucggggccggcaccgcggccugcuucgccgaccuggugacguucccccuggacaccgccaagguccgccuccagauccagggggagaaccaggccgugcagaccgcgcggcuggugcaguaccgcggcguccuggggaccauccucacgauggugcggaccgagggccccugcuccccguacaacggccugguggccgggcugcagcgccagaugagcuucgccuccauccggaucggccucuacgacagcgucaagcaggucuacacccccaagggggccgacaacuccagccugaccacgcgcauccuggcgggcugcaccaccggggccauggccgugaccugcgcccagcccacggacguggugaaggugcgguuccaggccuccauccaccucggccccagccgcuccgaccggaaguacagcggcaccauggacgcguaccgcaccaucgcccgggaggaggggguccgcggccuguggaaggggacccugccgaacaucaugcggaacgccaucgugaacugcgccgagguggucacguacgacauccucaaggagaagcugcuggacuaccaccuccugaccgacaacuuccccugccacuucguguccgccuucggcgcgggcuucugcgccaccguggucgccagccccguggacguggucaagacccgcuacaugaacuccccgcccgggcaguacuucagcccccuggacugcaugaucaagaugguggcccaggagggccccacggccuucuacaagggguucacccccuccuuccuccggcugggcagcuggaacgucgugauguucgugaccuacgagcagcugaagcgcgcgcucaugaagguccagaugcugcgggaguccccguucuga

SEQ ID NO: 38404 - RNA, 1416 nt, Artificial Sequence
  derived and/or modified sequence opt1 from UEVLD__Homo_sapiens__NP_001035787
auggaguucgacugcgagggccugcgccggcuccuggggaaguacaaguuccgcgaccugaccguggaggagcuccggaacgucaacguguucuucccccacuucaaguacagcauggacaccuacguguucaaggacuccagccagaaggaccugcugaacuucacgggcaccaucccggucauguaccaggggaacaccuacaacauccccauccgcuucuggauccucgacucccaccccuucgcgcccccgaucugcuuccugaagcccaccgccaacaugggcauccugguggggaagcacguggacgcccagggccggaucuaccuccccuaccugcagaacuggagccaccccaaguccgucaucgugggccugaucaaggagaugaucgccaaguuccaggaggagcucccgauguacagccuguccagcuccgacgaggcccgccagguggaccugcucgccuacaucgccaagaucacggagggggucagcgacaccaacuccaagagcugggcgaaccacgagaacaagaccgugaacaagaucaccguggucggcgggggcgagcuggggaucgccugcacgcuggccaucuccgccaagggcaucgcggaccggcucgugcugcuggaccucagcgagggcaccaagggggccaccauggaccuggagaucuucaaccugcccaacguggagaucuccaaggaccucagcgccuccgcccacagcaaggucgugaucuucaccgugaacucccugggcagcagccaguccuaccuggacgucgugcagagcaacguggacauguuccgcgcccucguccccgcgcuggggcacuacucccagcacagcgugcugcucguggccucccagcccgucgagaucaugacguacgugaccuggaagcugagcaccuucccggccaaccgggucaucggcaucggcugcaaccuggacucccagcgccuccaguacaucaucaccaacgugcugaaggcccagacgagcgggaaggaggugugggucaucggcgagcagggggaggacaaggugcugaccugguccggccaggaggagguggucagccacaccucccaggugcagcucagcaaccgggccauggagcugcugcgcgugaaggggcagcgguccuggagcgucggccucuccguggcggacaugguggacagcaucgucaacaacaagaagaaggugcacuccgugagcgcccuggccaagggcuacuacgacaucaacuccgaggucuuccugagccuccccugcauccuggggaccaacggcgugagcgaggugaucaagacgacccugaaggaggacaccgucaccgagaagcuccaguccagcgccuccagcauccacucccugcagcagcagcugaagcucuga

SEQ ID NO: 38405 - RNA, 801 nt, Artificial Sequence
  derived and/or modified sequence opt1 from UFD1L__Homo_sapiens__NP_001030324
auguucagcuucaacauguucgaccaccccaucccgcgcguguuccagaaccgguucuccacccaguaccgcugcuucagcgucuccaugcuggccggccccaacgaccggagcgacguggagaagggcgggaagaucaucaugccgcccuccgcccucgaccagcugagccgccugaacaucaccuaccccaugcuguucaagcugacgaacaagaacuccgaccggaugacccacugcggggugcuggaguucgucgcggacgagggcaucugcuaccucccccacuggaugaugcagaaccugcugcucgaggagggcgggcugguccagguggagagcgugaaccuccagguggccaccuacuccaaguuccagccccagagccccgacuuccucgacaucaccaacccgaaggccgugcuggagaacgcccugcgcaacuucgccugccucacgaccggcgacgucaucgcgaucaacuacaacgagaagaucuacgagcugcgggugauggagaccaagcccgacaaggccguguccaucaucgagugcgacaugaacgucgacuucgacgcgccccugggguacaaggagcccgagcgccaggugcagcacgaggagagcaccgagggcgaggccgaccacuccggguacgccggcgagcucggguuccgggccuucagcggcuccggcaaccgccuggacgggaagaagaagggcguggagccgagccccucccccaucaagcccggggacaucaagcggggcaucccgaacuacgaguucaagcugggcuga

SEQ ID NO: 38406 - RNA, 2385 nt, Artificial Sequence
  derived and/or modified sequence opt1 from UFL1__Homo_sapiens__NP_056138
auggccgacgccugggaggagauccgccggcuggcggccgacuuccagcgcgcccaguucgccgaggccacccagcggcucagcgagcgcaacugcaucgagaucgugaacaagcugaucgcgcagaagcagcuggaggucgugcacacccucgacggcaaggaguacaucacgcccgcccagaucuccaaggagaugcgggacgagcugcacgugcgcgggggccgggucaacaucguggaccugcagcaggucaucaacguggaccucauccacaucgagaaccgcaucggggacaucaucaagagcgagaagcacgugcagcuggugcugggccagcucaucgacgagaacuaccuggaccggcuggccgaggaggucaacgacaagcuccaggaguccggccaggugaccaucagcgagcugugcaagaccuacgaccugccggggaacuuccucacccaggcccugacgcagcgccugggccggaucaucuccgggcacaucgaccucgacaaccgcggcgugaucuucaccgaggcguucgucgcccggcacaaggcccgcauccgggggcuguucagcgccaucacccgccccaccgccgugaacucccugaucagcaaguacggcuuccaggagcagcuccuguacuccgugcuggaggagcucgucaacagcgggcggcugcgcggcacgguggugggcgggcggcaggacaaggcggucuucgugcccgacaucuacucccgcacccagagcaccuggguggacuccuucuuccggcagaacggcuaccuggaguucgacgcccucagccgccuggggauccccgacgccgucuccuacaucaagaagcgcuacaagaccacgcagcugcuguuccugaaggccgccugcgugggccagggccugguggaccaggucgaggcgagcguggaggaggccaucuccagcgggaccugggucgacaucgccccgcuccugcccaccucccugagcguggaggacgccgccauccuccugcagcaggucaugcgggcguucagcaagcaggccuccaccgugguguucagcgacacgguggucguguccgagaaguucaucaacgacugcaccgagcuguuccgcgagcucaugcaccagaaggccgagaaggagaugaagaacaaccccgugcaccugaucaccgaggaggaccugaagcagaucagcacccucgaguccgucagcacguccaagaaggacaagaaggacgagcggcgccggaaggccaccgagggcagcggguccaugcgcggcgggggcggcgggaacgcccgggaguacaagaucaagaaggugaagaagaagggccgcaaggacgacgacagcgacgacgagucccagagcucccacaccgggaagaagaagcccgagaucagcuucauguuccaggacgagaucgaggacuuccugcggaagcacauccaggacgcgccggaggaguucaucuccgagcuggccgaguaccucaucaagccccugaacaagaccuaccuggaggugguccgcagcguguucauguccagcacgaccuccgccagcggcaccgggcggaagcgcaccaucaaggaccuccaggaggaggugagcaaccuguacaacaacauccggcuguucgagaagggcaugaaguucuucgccgacgacacgcaggcggcccugaccaagcaccuccugaaguccgucugcaccgacaucaccaaccugaucuucaacuuccucgccagcgaccugaugauggccguggacgaccccgccgcgaucacguccgagauccgcaagaagauccugagcaagcucuccgaggagaccaagguggcccugaccaagcugcacaacagccucaacgagaaguccaucgaggacuucaucagcugccuggacuccgccgccgaggccugcgacaucauggucaagcggggcgacaagaagcgcgagcggcagauccuguuccagcaccgccaggcgcucgccgagcagcugaaggugaccgaggaccccgcccugauccuccaccugacgagcgugcuccucuuccaguucuccacccacagcaugcugcacgccccggggcggugcgucccccagaucaucgccuuccugaacuccaagauccccgaggaccagcacgcgcuccuggugaaguaccagggccugguggucaagcagcucgugagccaguccaagaagaccgggcagggcgacuacccccugaacaacgagcuggacaaggagcaggaggacguggccagcaccacccgcaaggagcuccaggagcuguccagcagcaucaaggaccugguccucaagucccgcaagagcuccgugacggaggaguga

SEQ ID NO: 38407 - RNA, 312 nt, Artificial Sequence
  derived and/or modified sequence opt1 from UFM1__Homo_sapiens__NP_001273633
augauccgcgccuuccccaccaccacgccgcggagccugcaccucuucaccuccagcaccuuccuggcccgcgcgcugcccggcgccuuccccaccggggccugcgaggagcggcucuccgugcccgagagcacgccguucaccgccguccugaaguucgccgcggaggaguucaaggugcccgccgccaccuccgccaucaucaccaacgacggcaucgggaucaaccccgcgcagacggccggcaacguguuccugaagcacgggagcgagcuccgcaucaucccccgggaccgcgucggcuccugcuga

SEQ ID NO: 38408 - RNA, 1185 nt, Artificial Sequence
  derived and/or modified sequence opt1 from UGCG__Homo_sapiens__NP_003349
auggcccugcucgaccuggcccuggagggcauggcgguguucggguucguccucuuccuggugcuguggcucaugcacuucauggccaucaucuacacccgccugcaccugaacaagaaggccaccgacaagcagcccuacagcaagcucccgggcgugucccugcugaagccccucaagggggucgaccccaaccugaucaacaaccuggagacguucuucgagcucgacuaccccaaguacgaggugcugcugugcgugcaggaccacgacgacccggccaucgacgucugcaagaagcuccugggcaaguaccccaacguggacgcccggcuguucaucgggggcaagaaggugggcaucaaccccaagaucaacaaccucaugcccggguacgaggucgcgaaguacgaccugaucuggaucugcgacagcggcauccgcgugaucccggacacccugaccgacauggugaaccagaugaccgagaaggucgggcucgugcacggccugcccuacguggccgaccggcagggguucgccgccacgcuggagcaggucuacuucggcaccucccacccccgcuacuacaucagcgcgaacgugaccggcuucaagugcgugaccgggauguccugccucaugcggaaggacguccuggaccaggccggcgggcugaucgccuucgcccaguacaucgccgaggacuacuucauggcgaaggccaucgccgaccgcggcuggcgguucgccaugagcacccagguggccaugcagaacuccggcagcuacuccaucagccaguuccagucccgcaugauccgguggacgaagcuccgcaucaacaugcugcccgcgaccaucaucugcgagccgaucagcgagugcuucguggccucccugaucaucgggugggccgcccaccacgucuuccggugggacaucaugguguucuucaugugccacugccucgccugguucaucuucgacuacauccagcugcgcggcgugcagggcgggacccugugcuucagcaagcucgacuacgcggucgccugguucauccgggaguccaugacgaucuacaucuuccugagcgcccugugggaccccaccaucuccuggcgcaccgggcgguaccgccuccggugcggcggcaccgccgaggagauccuggacguguga

SEQ ID NO: 38409 - RNA, 1284 nt, Artificial Sequence
  derived and/or modified sequence opt1 from UGDH__Homo_sapiens__NP_001171629
auguucgagaucaagaagaucugcugcaucggcgccggguacgugggcgggccgaccugcagcgucaucgcccacaugugccccgagauccgcgugaccguggucgacgugaacgagucccggaucaacgcguggaacagccccacgcugcccaucuacgagcccggccucaaggagguggucgaguccugccgcgggaagaaccuguucuucagcaccaacaucgacgacgccaucaaggaggccgaccugguguucaucuccgugcucagcaaccccgaguuccuggccgagggcaccgccaucaaggaccugaagaaccccgaccggguccucaucggcggggacgagacccccgagggccagcgcgcggugcaggcccugugcgccguguacgagcacugggucccccgggagaagauccugacgaccaacaccugguccagcgagcucuccaagcuggccgcgaacgccuuccuggcccagcgcaucagcuccaucaacagcaucuccgcccucugcgaggccaccggggcggacguggaggagguggccacggccaucggcauggaccagcggaucgggaacaaguuccugaaggccagcgucggcuucggcggguccugcuuccagaaggacgugcugaaccucguguaccugugcgaggcccugaaccucccggaggucgcgcgcuacuggcagcaggucaucgacaugaacgacuaccagcggcgccgguucgccagccgcaucaucgacucccuguucaacaccgugaccgacaagaagaucgccauccugggcuucgccuucaagaaggacaccggggacacgcgggagagcuccagcaucuacaucagcaaguaccucauggacgagggcgcccaccuccacaucuacgaccccaaggugccccgcgagcagaucgugguggaccugucccaccccggcgucagcgaggacgaccaggugucccggcuggucaccaucagcaaggacccguacgaggcgugcgacggggcccacgccguggugaucugcaccgagugggacauguucaaggagcuggacuacgagcgcauccacaagaagaugcugaagcccgccuucaucuucgacggccggcgcguccucgacgggcugcacaacgagcugcagaccaucggcuuccagaucgagacgaucgggaagaagguguccagcaagcggauccccuacgcccccuccggcgagaucccgaaguucagccuccaggacccgcccaacaagaagcccaagguguga

SEQ ID NO: 38410 - RNA, 4668 nt, Artificial Sequence
  derived and/or modified sequence opt1 from UGGT1__Homo_sapiens__NP_064505
augggcugcaagggggacgccagcggcgccugcgcggccggggcccugcccgugaccggcgucugcuacaagaugggggugcucgugguccugaccgugcuguggcucuucuccagcgugaaggccgacuccaaggccaucacgaccagccugaccaccaagugguucuccacgccgcugcuccuggaggcgagcgaguuccuggccgaggacucccaggagaaguucuggaacuucgucgaggccagccagaacaucggcuccagcgaccacgacggcaccgacuacuccuacuaccacgccauccucgaggcggccuuccaguuccugagcccccugcagcagaaccucuucaaguucugccugucccugcgcagcuacuccgccaccauccaggccuuccagcagaucgccgcggacgagccccccccggaggggugcaacagcuucuucuccgugcacggcaagaagaccugcgagagcgacacgcucgaggcccugcugcucaccgccuccgagcggcccaagccccugcuguucaagggggaccaccgcuaccccagcagcaacccggagucccccguggucaucuucuacagcgagaucggcuccgaggaguucagcaacuuccaccggcagcucaucuccaagagcaacgccgggaagaucaacuacguguuccgccacuacaucuucaacccccggaaggagcccguguaccuguccggcuacggcgucgagcuggccaucaagagcaccgaguacaaggcgaaggacgacacccaggugaaggggacggaggugaacaccaccgucaucggcgagaacgacccgaucgacgaggugcagggguuccucuucggcaagcugcgcgaccugcaccccgaccucgagggccagcugaaggagcugcggaagcaccucguggaguccaccaacgagauggccccccugaaggucuggcagcugcaggaccucagcuuccagacggccgcccgcauccuggccucccccguggagcuggcgcucguggucaugaaggaccugagccagaacuucccgaccaaggcccgggccaucaccaagaccgccguguccagcgagcugcgcacggagguggaggagaaccagaaguacuucaaggggacccucggccugcagcccggggacuccgcccuguucaucaacggccuccacauggaccuggacacccaggacaucuucagccuguucgacguccuccggaacgaggcgcgcgugauggaggggcugcaccggcugggcaucgagggccucucccugcacaacguccugaagcugaacauccagcccagcgaggccgacuacgccguggacauccgcucccccgccaucagcugggugaacaaccucgaggucgacagccgguacaacuccuggccgagcucccugcaggagcugcuccgccccaccuuccccggggugauccggcagauccgcaagaaccugcacaacaugguguucaucgucgaccccgcgcacgagacgaccgccgagcugaugaacaccgccgagauguuccucagcaaccacaucccgcugcggaucggcuucaucuucguggugaacgacuccgaggacgucgacgggaugcaggacgccggcguggccgugcugcgcgcguacaacuacgucgcccaggagguggacgacuaccacgccuuccagacccucacgcacaucuacaacaaggugcggaccggggagaaggucaagguggagcacguggucagcgugcuggagaagaaguaccccuacguggaggucaacuccauccugggcaucgacagcgccuacgaccgcaaccgcaaggaggcccggggcuacuacgagcagaccggggugggcccccuccccgugguccuguucaacgggaugccguucgagcgcgagcagcuggaccccgacgagcucgagaccaucacgaugcacaagauccuggagaccaccaccuucuuccagcgggcgguguaccugggcgagcucccccacgaccaggacguggucgaguacaucaugaaccagccgaacguggugccccgcaucaacucccggauccugacggccgagcgcgacuaccuggaccucaccgccagcaacaacuucuucgucgacgacuacgcccgguucaccauccuggacucccaggggaagaccgccgcgguggccaacagcaugaacuaccugaccaagaagggcauguccagcaaggagaucuacgacgacuccuucauccgccccgugacguucuggaucgucggcgacuucgacagccccuccgggcggcagcuccuguacgacgccaucaagcaccagaagagcagcaacaacgugcgcaucuccaugaucaacaacccggccaaggagaucagcuacgagaacacccagaucucccgggcgaucugggccgcccugcagacccagaccagcaacgccgccaagaacuucaucacgaagauggcgaaggagggcgccgccgaggcccucgccgcgggggccgacaucgccgaguucuccgugggcggcauggacuucagccuguucaaggaggucuucgaguccagcaagauggacuucauccugucccacgccguguacugccgcgacgugcucaagcugaagaaggggcagcgggccgucaucagcaacggccgcaucaucgggccccuggaggacuccgagcucuucaaccaggacgacuuccaccugcuggagaacaucauccucaagaccagcggccagaagaucaagucccacauccagcagcugcggguggaggaggacguggcgagcgaccuggucaugaagguggacgcccuccuguccgcccagcccaagggggacccccgcaucgaguaccaguucuucgaggaccggcacagcgccaucaagcugcgcccgaaggagggcgagaccuacuucgacguggucgcggugguggaccccgucacccgggaggcccagcgccucgccccccugcugcucgugcuggcccagcugaucaacaugaaccuccgcguguucaugaacugccaguccaagcugagcgacaugccccugaaguccuucuaccgguacguccucgagccggagaucagcuucacgagcgacaacuccuucgccaagggccccaucgcgaaguuccuggacaugccccagagcccccuguucacccucaaccugaacaccccggaguccuggaugguggagagcguccgcacccccuacgaccuggacaacaucuaccucgaggagguggacuccguggucgccgccgaguacgagcuggaguaccugcuccuggaggggcacugcuacgacaucacgaccggccagcccccccgggggcugcaguucacccucggcaccagcgccaacccggugaucguggacacgaucgucauggccaaccugggguacuuccagcugaaggcgaaccccggcgccuggauccuccgccugcggaagggccgcuccgaggacaucuaccggaucuacagccacgacgggaccgacuccccccccgacgccgacgagguggugaucguccugaacaacuucaagagcaagaucaucaaggugaaggugcagaagaaggccgacauggucaacgaggaccuccuguccgacggcaccagcgagaacgaguccggguucugggacagcuucaaguggggcuucaccgggcagaagacggaggaggugaagcaggacaaggacgacaucaucaacaucuucuccguggccagcggccaccuguacgagcgcuuccuccggaucaugaugcuguccguccugaagaacaccaagaccccggugaaguucugguuccucaagaacuaccugagccccaccuucaaggaguucauccccuacauggcgaacgaguacaacuuccaguacgagcuggugcaguacaaguggccgcgcuggcuccaccagcagacggagaagcagcggaucaucuggggcuacaagauccuguuccuggacguccucuucccccuggugguggacaaguuccuguucgucgacgccgaccagaucgugcgcaccgaccucaaggagcugcgggacuucaaccuggacggggcccccuacggcuacacccccuucugcgacucccgccgggagauggacggguaccgcuucuggaagagcggcuacugggccagccaccucgccgggcggaaguaccacaucuccgcgcuguacguggucgaccugaagaaguuccgcaagaucgccgccggcgaccggcuccgcggccaguaccaggggcugagccaggacccgaacucccugagcaaccucgaccaggaccugcccaacaacaugauccaccaggugcccaucaagucccugccccaggaguggcuguggugcgagaccuggugcgacgacgccagcaagaagcgggcgaagacgaucgaccucugcaacaacccgaugaccaaggagcccaagcuggaggccgccgugcgcaucguccccgaguggcaggacuacgaccaggagaucaagcagcugcagauccgcuuccagaaggagaaggagaccggcgcccucuacaaggagaagaccaaggagcccucccgggaggggccgcagaagcgcgaggagcuguga

SEQ ID NO: 38411 - RNA, 4551 nt, Artificial Sequence
  derived and/or modified sequence opt1 from UGGT2__Homo_sapiens__NP_064506
auggcccccgccaaggcgaccaacgugguccgccugcuccugggcagcaccgcccuguggcucucccagcuggggagcggcacgguggccgccuccaagagcgugaccgcccaccuggcggccaaguggccggagacgccccuccugcuggaggccuccgaguucauggccgaggagagcaacgagaaguucuggcaguuccucgagaccguccaggagcuggcgaucuacaagcagaccgaguccgacuacagcuacuacaaccugauccucaagaaggccgggcaguuccuggacaaccugcacaucaaccuccugaaguucgccuucuccauccgggccuacagccccgccauccagauguuccagcagaucgcggccgacgagcccccgcccgacggcugcaacgccuucguggugauccacaagaagcacacgugcaagaucaacgagaucaagaagcugcucaagaaggccgccucccgcacccggcccuaccuguucaagggggaccacaaguuccccaccaacaaggagaaccugccggucgugauccucuacgcggagaugggcacccgcaccuucagcgccuuccacaaggugcuguccgagaaggcccagaacgaggagauccuguacguccuccggcacuacauccagaagcccagcucccgcaagauguaccugagcggcuacgggguggagcuggccaucaaguccaccgaguacaaggcccucgacgacacccaggugaagacggucaccaacaccaccguggaggacgagacggagaccaacgaggugcagggcuuccuguucgggaagcugaaggagaucuacagcgaccuccgggacaaccugaccgcguuccagaaguaccugaucgaguccaacaagcagaugaugccccucaaggucugggagcugcaggaccugagcuuccaggccgccagccagaucauguccgcccccguguacgacagcaucaagcucaugaaggacaucucccagaacuucccgaucaaggcccgcagccugacccggaucgcggugaaccagcacaugcgcgaggagaucaaggagaaccagaaggaccugcagguccgguucaagauccagcccggcgacgcccgccucuucaucaacgggcugcggguggacauggacguguacgacgccuucuccauccuggacaugcucaagcuggagggcaagaugaugaacggccugcgcaaccucgggaucaacggcgaggacaugagcaaguuccugaagcugaacucccacaucugggaguacacguacguccucgacauccggcacagcuccaucauguggaucaacgaccuggagaacgacgaccuguacaucaccuggcccaccagcugccagaagcugcucaagcccguguucccgggguccgugcccagcauccgccggaacuuccacaaccugguccuguucaucgaccccgcccaggaguacacccucgacuucaucaagcuggcggacguguucuacucccacgaggucccccugcgcaucggcuucguguucauccucaacacggacgacgagguggacggcgccaacgacgccggggucgcccuguggcgggccuucaacuacaucgcggaggaguucgacaucagcgaggccuucaucuccaucgugcacauguaccagaaggugaagaaggaccagaacauccugaccgucgacaacgucaagagcgugcuccagaacaccuucccgcacgccaacaucugggacauccugggcauccacuccaaguacgacgaggagcgcaaggccggggccagcuucuacaagaugaccggccuggggccccucccccaggcgcuguacaacggcgagcccuucaagcacgaggagaugaacaucaaggagcugaagauggccgugcuccagcggaugauggacgccuccguguaccugcagcgcgagguguuccugggcacgcucaacgaccgcaccaacgccaucgacuuccugauggaccggaacaacgucgugccgcgcaucaacacccugauccuccggaccaaccagcaguaccugaaccugaucagcacgagcgugaccgccgacgucgaggacuucuccaccuucuucuuccucgacagccaggacaaguccgcggugaucgccaagaacauguacuaccugacccaggacgacgagagcaucaucuccgccgugacgcuguggaucaucgccgacuucgacaagcccagcgggcgcaagcuccuguucaacgcgcugaagcacaugaagaccuccguccacagccggcucggcaucaucuacaaccccaccuccaagaucaacgaggagaacaccgccaucagccgcgggauccuggccgccuuccugacccagaagaacauguuccuccgguccuuccugggccagcuggccaaggaggagaucgcgacggccaucuacagcggggacaagaucaagaccuuccucaucgagggcauggacaagaacgccuucgagaagaaguacaacaccgugggcgugaacaucuuccgcacccaccagcuguucugccaggacguccugaagcuccggcccggggagaugggcaucguguccaacgggcgcuuccugggcccgcuggacgaggacuucuacgccgaggacuucuaccuccuggagaagaucacguucagcaaccugggggagaagaucaagggcaucguggagaacaugggcaucaacgccaacaacauguccgacuucaucaugaaggucgacgcgcucaugagcuccgugcccaagcgggccagccgcuacgacgugaccuuccugcgggagaaccacagcgucaucaagaccaacccccaggagaacgacauguucuucaacgugaucgccaucguggacccgcugacccgcgaggcccagaagauggcccagcuccuggucgugcuggggaagaucaucaacaugaagaucaagcuguucaugaacugccggggccgccuguccgaggcgccccuggagagcuucuaccgguucgugcucgagcccgagcugauguccggggccaacgacgucagcucccugggccccguggccaaguuccucgacaucccggagagcccccugcugauccucaacaugaucacgcccgagggcuggcugguggagaccguccacuccaacugcgaccuggacaacauccaccucaaggacaccgagaagaccgugacggccgaguacgagcuggaguaccugcuccuggaggggcagugcuucgacaaggugaccgagcagcccccgcgcggccugcaguucacccucgggaccaagaacaagcccgcggucguggacacgaucgugauggcccaccacggcuacuuccagcugaaggccaaccccggggccuggauccugcggcuccaccagggcaagagcgaggacaucuaccagaucgucggccacgaggggaccgacucccaggccgaccuggaggacaucaucguggugcugaacagcuucaaguccaagauccucaaggucaaggugaagaaggagaccgacaagaucaaggaggacauccugaccgacgaggacgagaagacgaagggccugugggacagcaucaaguccuucaccgugagccuccacaaggagaacaagaaggagaaggacguccugaacaucuucuccguggcgagcgggcaccuguacgagcgcuuccuccgcaucaugaugcuguccgugcugcggaacaccaagacccccgucaaguucuggcuccugaagaacuaccugagcccgacguucaaggaggugaucccccacauggccaaggaguacggcuuccgcuacgagcucguccaguaccgguggccccgcuggcugcggcagcagaccgagcgccagcggaucaucuggggguacaagauccuguuccucgacgugcuguucccccuggccguggacaagaucaucuucgucgacgccgaccagaucgugcgccacgaccucaaggagcugcgggacuucgaccuggacggcgccccguacggcuacacccccuucugcgacucccgccgggagauggacggguaccgcuucuggaagaccggcuacugggcgagccaccuccuccggcgcaaguaccacaucagcgcccuguacguggucgaccugaagaaguuccggcgcaucggggccggcgaccggcuccgcucccaguaccaggcccugagccaggaccccaacucccugagcaaccucgaccaggaccugcccaacaacaugaucuaccagguggccaucaagucccugccgcaggacuggcucuggugcgagacguggugcgacgacgagagcaagcagcgggcgaagaccaucgaccugugcaacaaccccaagaccaaggaguccaagcugaaggccgccgcccgcaucgugcccgagugggucgaguacgacgccgagauccggcagcuccuggaccaccuggagaacaagaagcaggacaccauccucacgcacgacgagcuguga

SEQ ID NO: 38412 - RNA, 1527 nt, Artificial Sequence
  derived and/or modified sequence opt1 from UGP2__Homo_sapiens__NP_006750
augagccgcuucgugcaggaccuguccaaggccaugagccaggacggcgccucccaguuccaggaggucauccggcaggagcucgagcugagcgugaagaaggagcuggagaagauccucaccaccgcguccagccacgaguucgagcacacgaagaaggaccuggacggguuccgcaagcuguuccaccgguuccuccaggagaagggccccuccguggacugggggaagauccagcgcccgcccgaggacagcauccagcccuacgagaagaucaaggcccggggccugcccgacaacaucuccagcguccugaacaagcucgugguggucaagcugaacgggggccugggcaccuccauggggugcaagggccccaagagccucaucggggugcgcaacgagaacaccuuccuggaccugaccgugcagcagaucgagcaccucaacaagacguacaacaccgacgucccccuggugcugaugaacuccuucaacaccgacgaggacaccaagaagauccuccagaaguacaaccacugccgggugaagaucuacacguucaaccagagccgcuacccccggaucaacaaggagucccugcugcccgucgccaaggacgugagcuacuccggcgagaacaccgaggccugguacccgcccgggcacggcgacaucuacgccagcuucuacaacuccggccuccuggacaccuucaucggggagggcaaggaguacaucuucgugagcaacaucgacaaccugggggcgaccgucgaccucuacauccugaaccaccugaugaacccgcccaacggcaagcgcugcgaguucgugauggaggugacgaacaagacccgggccgacgucaagggcgggacccucacccaguacgagggcaagcugcgccugguggagaucgcccaggugcccaaggcccacgucgacgaguucaagagcguguccaaguucaagaucuucaacacgaacaaccucuggaucagccuggcggccgugaagcggcugcaggagcagaacgccaucgacauggagaucaucgucaacgccaagacccucgacgggggccugaacgugauccagcuggagaccgccgucggggcggccaucaaguccuucgagaacagccucggcaucaacgugccccgcucccgguuccugcccgugaagaccacgagcgaccugcuccuggucauguccaaccuguacagccucaacgccggcucccugaccaugagcgagaagcgcgaguuccccaccgugccgcuggugaagcucggguccagcuucaccaagguccaggacuaccugcggcgcuucgaguccauccccgacaugcuggagcucgaccaccugacggugagcggcgacgugaccuucgggaagaacgucucccugaagggcaccgugaucaucaucgccaaccacggggaccggaucgacaucccgcccggcgccgugcuggagaacaagaucgucagcggcaaccuccgcauccuggaccacuga

SEQ ID NO: 38413 - RNA, 1593 nt, Artificial Sequence
  derived and/or modified sequence opt1 from UGT1A10__Homo_sapiens__NP_061948
auggcccgcgccggcuggaccagccccgugccgcugugcgucugccuccugcugaccugcggguucgcggaggccggcaagcuccugguggugcccauggacgggucccacugguucacgaugcagagcgucguggagaagcugauccuccggggccacgagguggucguggugaugcccgaggucuccuggcagcuggagcgcagccugaacugcaccgugaagaccuacuccaccagcuacacgcucgaggaccagaaccgggaguucaugguguucgcccacgcccaguggaaggcccaggcgcaguccaucuucagccugcugauguccagcuccagcggguuccucgaccuguucuucucccacugccgcagccuguucaacgaccggaagcucgucgaguaccugaaggaguccagcuucgacgccguguuccuggaccccuucgacacgugcggccucaucguggccaaguacuucucccugccgagcgucguguucacccgcggcaucuucugccaccaccuggaggagggggcccagugccccgcgccccucuccuacgugcccaacgaccugcugggcuucagcgacgccaugaccuucaaggagcgggucuggaaccacaucgugcaccucgaggaccaccuguucugccaguaccuguuccgcaacgcccucgagaucgccagcgagauccugcagaccccggugaccgccuacgaccuguacucccacaccagcaucuggcuccugcggaccgacuucguccuggacuaccccaagcccgugaugcccaacaugaucuucaucgggggcaucaacugccaccaggggaagccgcuccccauggaguucgaggcguacaucaacgccuccggcgagcacggcaucguggucuucagccugggguccauggugagcgagauccccgagaagaaggccauggccaucgccgacgcgcugggcaagaucccccagacgguccucuggcgcuacaccgggacccggccguccaaccuggccaacaacaccauccuggugaaguggcucccccagaacgaccugcugggccaccccaugacgcgcgccuucaucacccacgccggcagccacgggguguacgaguccaucugcaacggcguccccauggugaugaugccccucuucggggaccagauggacaacgccaagcggauggagaccaagggcgcgggggugacccugaacguccuggagaugacgagcgaggaccucgagaacgcccugaaggccgugaucaacgacaaguccuacaaggagaacaucaugcgccugagcucccuccacaaggaccggcccguggagccccuggaccuggccgucuucuggguggaguucgugaugcgccacaagggcgccccgcaccuccggccggcggcccacgaccugaccugguaccaguaccacagccuggacgucaucggcuuccugcucgccguggugcugaccgucgccuucaucaccuucaagugcugcgcguacggguaccgcaagugccugggcaagaaggggcgggugaagaaggcccacaaguccaagacgcacuga

SEQ ID NO: 38414 - RNA, 1602 nt, Artificial Sequence
  derived and/or modified sequence opt1 from UGT1A1__Homo_sapiens__NP_000454
auggccguggagagccagggcgggcgcccccugguccucggccugcugcucugcgugcuggggccgguggucucccacgccggcaagauccugcucauccccguggacgggagccacuggcuguccaugcugggcgcgauccagcagcuccagcagcggggccacgagaucgugguccuggcccccgacgccagccuguacauccgcgacggggccuucuacacccucaagaccuaccccgugccguuccagcgggaggacgugaaggaguccuucgucagccugggccacaacguguucgagaacgacuccuuccugcagcgcgugaucaagacguacaagaagaucaagaaggacagcgccaugcuccuguccgggugcagccaccuccuccacaacaaggagcugauggcgucccuggccgagagcuccuucgacgucaugcucaccgaccccuuccugcccugcagccccaucguggcccaguaccugucccucccgaccguguucuuccugcacgcccugcccugcagccucgaguucgaggcgacccagugccccaaccccuucuccuacgucccgcggccccugagcucccacagcgaccacaugacguuccugcagcgcgugaagaacaugcucaucgccuucagccagaacuuccugugcgacguggucuacucccccuacgccacccuggccagcgaguuccuccagcgggaggugaccgugcaggaccugcuguccagcgccuccgucuggcuguuccgcagcgacuucgugaaggacuacccccggccgaucaugcccaacaugguguucgucggcgggaucaacugccugcaccagaacccccugucccaggaguucgaggcguacaucaacgccagcggcgagcacggcaucguggucuucucccucgggagcaugguguccgagauccccgagaagaaggccauggccaucgccgacgcgcugggcaagaucccgcagaccgugcuguggcgcuacacggggacccggcccagcaaccucgccaacaacaccauccuggucaaguggcugccccagaacgaccuccugggccaccccaugacccgcgccuucaucacgcacgccggcucccacgggguguacgagagcaucugcaacggcgugccgauggucaugaugccccuguucggggaccagauggacaacgccaagcggauggagaccaagggcgcgggggugacccucaacgugcuggagaugaccuccgaggaccuggagaacgcccugaaggccgucaucaacgacaagagcuacaaggagaacaucaugcgccucuccagccugcacaaggaccggcccguggagccccuggaccucgccguguucugggucgaguucgugaugcgccacaagggcgccccgcaccuccggcccgcggcccacgaccugacgugguaccaguaccacucccuggacgugaucggcuuccugcuggccgucgugcucaccguggccuucaucaccuucaagugcugcgcguacggguaccgcaagugccugggcaagaaggggcgggucaagaaggcccacaagagcaagacccacuga

SEQ ID NO: 38415 - RNA, 1605 nt, Artificial Sequence
  derived and/or modified sequence opt1 from UGT1A3__Homo_sapiens__NP_061966
auggccaccggccuccaggugccccucccguggcuggccaccgggcugcuccugcugcucagcguccagcccugggcggaguccggcaaggugcuggugguccccaucgacgggagccacuggcuguccaugcgcgaggugcuccgggagcugcacgcccgcggccaccaggccgugguccugacgcccgaggugaacaugcacaucaaggaggagaacuucuucacccucaccaccuacgccaucagcuggacgcaggacgaguucgaccggcacgugcuggggcacacccagcuguacuucgagaccgagcacuuccucaagaaguucuuccgcuccauggccaugcugaacaacaugagccuggucuaccaccgguccugcguggagcuccugcacaacgaggcgcugauccgccaccucaacgccaccagcuucgacgugguccugacggacccggugaaccugugcgccgccgugcucgcgaaguaccuguccauccccaccgucuucuuccugcggaacauccccugcgaccucgacuucaagggcacccagugccccaacccgagcuccuacaucccccgccugcugaccacgaacagcgaccacaugaccuucaugcagcgggugaagaacaugcucuacccccuggcccuguccuacaucugccacgccuucagcgcccccuacgccucccucgcgagcgagcuguuccagcgcgagguguccgucguggacauccugagccacgccuccguguggcuguuccggggcgacuucgucauggacuacccgcgccccaucaugcccaacaugguguucaucgggggcaucaacugcgccaaccggaagccccugagccaggaguucgaggccuacaucaacgccagcggggagcacggcaucguggucuucucccuggggagcaugguguccgagaucccggagaagaaggcgauggccaucgccgacgcccucggcaagaucccccagaccguccuguggcgcuacaccggcacgcggcccagcaaccuggccaacaacaccauccucgugaaguggcugccccagaacgaccugcucgggcacccgaugacccgcgcguucaucacccacgccggcucccacgggguguacgagagcaucugcaacggcguccccauggugaugaugccccuguucggcgaccagauggacaacgccaagcggauggagacgaagggggccggcgugacccugaacguccucgagaugaccuccgaggaccuggagaacgcccugaaggcggugaucaacgacaagagcuacaaggagaacaucaugcgccuguccagccuccacaaggaccggcccguggagccgcuggaccuggccgucuucuggguggaguucgugaugcgccacaagggggcgccccaccuccggcccgccgcccacgaccugaccugguaccaguaccacucccuggacgucaucggcuuccuccuggccguggugcugacggucgccuucaucaccuucaagugcugcgccuacggguaccgcaagugccucggcaagaagggccgcgugaagaaggcccacaagagcaagacccacuga

SEQ ID NO: 38416 - RNA, 1605 nt, Artificial Sequence
  derived and/or modified sequence opt1 from UGT1A4__Homo_sapiens__NP_009051
auggcccgcggccuccaggugccccucccgcggcuggccaccgggcugcuccugcugcucagcguccagcccugggcggaguccggcaaggugcuggugguccccaccgacgggagccccuggcuguccaugcgcgaggcccuccgggagcugcacgcccgcggccaccaggccguggugcugacgccggaggucaacaugcacaucaaggaggagaaguucuucacccucaccgccuacgcggugcccuggacccagaaggaguucgaccgggugacgcugggguacacccagggcuucuucgagaccgagcaccuccugaagcgcuacagccgguccauggccaucaugaacaacgucagccuggcccugcaccgcugcugcguggagcuccugcacaacgaggcccugauccggcaccucaacgcgaccuccuucgacgugguccugacggaccccgugaaccugugcggcgccgugcucgccaaguaccugagcauccccgccgucuucuucuggcgcuacaucccgugcgaccuggacuucaaggggacccagugccccaaccccuccagcuacauccccaagcuccugaccaccaacuccgaccacaugacguuccugcagcgggugaagaacaugcucuacccgcuggcccugagcuacaucugccacaccuucuccgcgcccuacgccagccucgccuccgagcuguuccagcgcgaggugagcgucguggaccugguguccuacgccagcgucuggcuguuccggggcgacuucgugauggacuacccccgccccaucaugccgaacaugguguucaucgggggcaucaacugcgccaacgggaagccccugucccaggaguucgaggcguacaucaacgccagcggcgagcacggcaucgucguguucagccugggguccauggucagcgagauccccgagaagaaggccauggccaucgccgacgcgcucggcaagaucccccagaccgugcuguggcgguacaccgggacgcgcccguccaaccuggccaacaacaccauccucgugaaguggcugccccagaacgaccugcucggccaccccaugacccgggccuucaucacccacgccggcagccacggggucuacgaguccaucugcaacggcgugcccauggugaugaugccgcuguucggggaccagauggacaacgccaagcgcauggagacgaagggcgcgggggucacccugaacgugcucgagaugaccagcgaggaccuggagaacgcccugaaggccgugaucaacgacaaguccuacaaggagaacaucaugcggcugagcucccuccacaaggaccgccccgucgagccccuggaccuggccguguucuggguggaguucgucaugcggcacaagggcgcgccccaccuccgcccggccgcccacgaccugaccugguaccaguaccacagccuggacgugaucggcuuccuccuggccgugguccugacgguggccuucaucaccuucaagugcugcgcguacggguaccgcaagugccucggcaagaaggggcgggugaagaaggcccacaaguccaagacccacuga

SEQ ID NO: 38417 - RNA, 1605 nt, Artificial Sequence
  derived and/or modified sequence opt1 from UGT1A5__Homo_sapiens__NP_061951
auggccaccggccuccaggugccccugccgcagcuggccaccgggcugcuccugcugcucagcguccagcccugggcggaguccggcaaggugcuggugguccccacggacgggagccacuggcuguccaugcgcgaggcccuccgggaccugcacgcccgcggccaccagguggugguccugacccucgaggugaacauguacaucaaggaggagaacuucuucacccugaccacguacgccaucagcuggacccaggacgaguucgaccggcugcuccuggggcacacccaguccuucuucgagaccgagcaccuccugaugaaguucagccgccggauggccaucaugaacaacaugucccugaucauccaccgcagcugcguggagcugcuccacaacgaggcgcugauccggcaccuccacgccacguccuucgacgucgugcugaccgaccccuuccaccugugcgccgccgugcuggcgaaguaccucagcaucccggccgucuucuuccugcgcaacauccccugcgaccuggacuucaagggcacccagugccccaaccccuccagcuacaucccgcggcuccugaccacgaacuccgaccacaugaccuuccugcagcgcgugaagaacaugcucuacccccuggcccugagcuaccucugccacgccguguccgcccccuacgcgagccuggccuccgagcuguuccagcgggaggucagcgugguggaccucgucucccacgccagcguguggcuguuccgcggcgacuucgugauggacuacccccggccgaucaugcccaacauggucuucaucgggggcaucaacugcgccaacgggaagccccugagccaggaguucgaggccuacaucaacgcguccggcgagcacgggaucgugguguucagccucggcuccauggucagcgagauccccgagaagaaggccauggccaucgccgacgcccugggcaagaucccgcagaccgugcuguggcgcuacaccgggacgcggcccuccaaccucgcgaacaacaccauccuggucaaguggcugccccagaacgaccuccugggccaccccaugacccgcgccuucaucacccacgccgggagccacggcguguacgaguccaucugcaacggcgugccgauggucaugaugccccuguucggggaccagauggacaacgccaagcggauggagacgaagggcgccggggugacccugaacgugcucgagaugaccagcgaggaccuggagaacgcgcugaaggccgucaucaacgacaaguccuacaaggagaacaucaugcgccucagcucccugcacaaggaccggcccguggagccccuggaccucgccguguucugggucgaguucgugaugcgccacaagggcgccccgcaccuccggcccgcggcccacgaccugaccugguaccaguaccacagccuggacgugaucggguuccugcuggccgucgugcucacgguggccuucaucaccuucaagugcugcgccuacggcuaccgcaagugccugggcaagaaggggcgcgucaagaaggcgcacaaguccaagacccacuga

SEQ ID NO: 38418 - RNA, 1599 nt, Artificial Sequence
  derived and/or modified sequence opt1 from UGT1A6__Homo_sapiens__NP_001063
auggccugccugcuccgcagcuuccagcggaucuccgccggcguguucuuccuggcgcugugggggauggucgugggcgacaagcuccugguggucccccaggacgggagccacuggcuguccaugaaggacaucguggaggugcucagcgaccgcggccacgagaucgucgugguggucccggaggugaaccugcugcucaaggaguccaaguacuacacccggaagaucuaccccgugcccuacgaccaggaggagcugaagaaccgcuaccagagcuucgggaacaaccacuucgccgagcgguccuuccugaccgcgccccagacggaguaccgcaacaacaugaucgucaucggccucuacuucaucaacugccagagccugcugcaggaccgggacacccucaacuucuucaaggaguccaaguucgacgcccuguucaccgacccggcccugcccugcggcgugauccucgccgaguaccuggggcugcccagcguguaccucuuccgcggcuuccccugcucccuggagcacaccuucagccgguccccggaccccgucagcuacaucccccgcugcuacacgaaguucuccgaccacaugaccuucagccagcggguggccaacuuccuggugaaccuccuggagcccuaccuguucuacugccucuucuccaaguacgaggagcuggccagcgccguccugaagcgcgacguggacaucaucacccucuaccagaagguguccgucuggcugcugcgguacgacuucgugcucgaguacccgcgccccgugaugcccaacauggucuucaucgggggcaucaacugcaagaagcggaaggaccugagccaggaguucgaggcguacaucaacgccagcggggagcacggcaucguggucuucucccugggcagcaugguguccgagauccccgagaagaaggccauggccaucgccgacgcgcucgggaagaucccgcagaccgugcuguggcgcuacacgggcacccggcccagcaaccuggccaacaacaccauccucgucaaguggcugccccagaacgaccugcucgggcaccccaugacccgcgccuucaucacgcacgccggcucccacggcguguacgagagcaucugcaacggggugccgauggucaugaugccccuguucggcgaccagauggacaacgccaagcggauggagaccaagggggcgggcgugacccugaacgugcucgagaugaccuccgaggaccuggagaacgcccugaaggccgucaucaacgacaagagcuacaaggagaacaucaugcgccucuccagccugcacaaggaccggcccguggagccccuggaccuggccguguucugggucgaguucgugaugcgccacaagggggccccgcaccuccgccccgcggcccacgaccugacgugguaccaguaccacucccuggacgugaucggcuuccuccuggccgucgugcugaccguggccuucaucaccuucaagugcugcgccuacggcuaccggaagugccucgggaagaagggccgcgucaagaaggcgcacaagagcaagacccacuga

SEQ ID NO: 38419 - RNA, 1593 nt, Artificial Sequence
  derived and/or modified sequence opt1 from UGT1A7__Homo_sapiens__NP_061950
auggcccgcgccggcuggaccgggcugcucccccuguacgugugccugcuccugaccugcggcuucgcgaaggccgggaagcugcucgucgugccgauggacggcagccacugguucacgaugcaguccguggucgagaagcugauccugcgggggcacgaggugguggucgugaugcccgaggugagcuggcagcucggccgcucccugaacugcaccgucaagaccuacagcaccuccuacacgcuggaggaccaggaccgggaguucaugguguucgccgacgcccgcuggaccgcgccccuccggagcgccuucucccugcugaccagcuccagcaacggcaucuucgaccucuucuucuccaacugccgcagccuguucaacgaccggaagcugguggaguaccucaaggaguccugcuucgacgccgucuuccuggaccccuucgacgccugcgggcugaucguggccaaguacuucagccucccguccguggucuucgcgcgcggcaucuucugccacuaccuggaggagggggcccagugccccgcgccccugagcuacgugccccggcuccugcugggcuucuccgacgccaugaccuucaaggagcgcguguggaaccacaucaugcaccucgaggagcaccuguucugcccguacuucuucaagaacguccuggagaucgccagcgagauccuccagacgcccgugaccgccuacgaccuguacucccacaccagcaucuggcugcuccggaccgacuucgugcuggaguaccccaagcccgucaugccgaacaugaucuucaucgggggcaucaacugccaccagggcaagcccgugcccauggaguucgaggccuacaucaacgccagcggggagcacggcaucguggucuucucccuggggagcaugguguccgagauccccgagaagaaggccauggccaucgcggacgcccucggcaagaucccgcagacgguccuguggcgcuacaccggcacccggcccagcaaccuggccaacaacaccauccucgugaaguggcugccccagaacgaccugcucgggcaccccaugacgcgcgccuucaucacccacgccggcucccacgggguguacgagagcaucugcaacggcgucccgauggugaugaugccccuguucggggaccagauggacaacgcgaagcggauggagaccaagggcgccggcgugacccugaacguccucgagaugacguccgaggaccuggagaacgcccugaaggccgugaucaacgacaagagcuacaaggagaacaucaugcgccucuccagccugcacaaggaccggcccguggagccccuggaccuggccgucuucuggguggaguucgugaugcgccacaagggggcgccgcaccuccggcccgccgcccacgaccugaccugguaccaguaccacucccuggacgucaucggcuuccuccuggccguggugcugaccgucgcguucaucaccuucaagugcugcgccuacggguaccgcaagugccucggcaagaaggggcgggugaagaaggcccacaagagcaagacgcacuga

SEQ ID NO: 38420 - RNA, 1593 nt, Artificial Sequence
  derived and/or modified sequence opt1 from UGT1A8__Homo_sapiens__NP_061949
auggcccgcaccggcuggaccagccccaucccgcugugcgugucccuccugcugacgugcggguucgccgaggcgggcaagcuccuggucgugcccauggacgggagccacugguucaccaugcaguccguggucgagaagcugauccuccggggccacgaggugguggucgugaugcccgaggugagcuggcagcuggggaagucccugaacugcaccgucaagaccuacagcacguccuacacccucgaggaccuggaccgcgaguucauggacuucgccgacgcccaguggaaggcccaggugcggagccuguucucccucuuccugagcuccagcaacggcuucuucaaccuguucuucucccacugccgcagccucuucaacgaccggaagcugguggaguaccugaaggaguccagcuucgacgccgucuuccucgaccccuucgacgcgugcggccugaucguggccaaguacuucucccugccgagcguggucuucgcccgcgggaucgccugccacuaccucgaggagggcgcgcagugccccgccccgcuguccuacgugccccggauccugcucggguucagcgacgccaugaccuucaaggagcgcgugcggaaccacaucaugcaccuggaggagcaccuguucugccaguacuucagcaagaacgcccucgagaucgccuccgagauccugcagaccccggucacggcguacgaccuguacagccacaccuccaucuggcuccugcgcaccgacuucgugcuggacuaccccaagcccgugaugcccaacaugaucuucaucggcgggaucaacugccaccagggcaagccgcuccccauggaguucgaggccuacaucaacgccagcggcgagcacgggaucgucguguucucccugggcagcaugguguccgagauccccgagaagaaggccauggccaucgcggacgcccuggggaagaucccccagaccguccucuggcgguacacgggcacccgcccgagcaaccuggccaacaacaccauccuggugaaguggcucccccagaacgaccugcugggccaccccaugacccgggccuucaucacgcacgccgggucccacggcgucuacgagagcaucugcaacggggugcccauggugaugaugccccucuucggcgaccagauggacaacgcgaagcgcauggagaccaagggggccggcgucacccugaacgugcuggagaugaccuccgaggaccucgagaacgcccugaaggccgugaucaacgacaagagcuacaaggagaacaucaugcggcuguccagccuccacaaggaccgccccgucgagccccuggaccuggccguguucuggguggaguucgucaugcggcacaagggcgcgccccaccuccgcccggccgcccacgaccugacgugguaccaguaccacucccuggacgugaucggguuccugcucgccgugguccugaccguggcguucaucaccuucaagugcugcgccuacggcuaccggaagugccuggggaagaagggccgcgugaagaaggcccacaagagcaagacccacuga

SEQ ID NO: 38421 - RNA, 1593 nt, Artificial Sequence
  derived and/or modified sequence opt1 from UGT1A9__Homo_sapiens__NP_066307
auggccugcaccggcuggaccagcccccugccgcucugcgugugccugcugcucacgugcggguucgccgaggcgggcaagcugcuggucgugcccauggacgggucccacugguucaccaugcgcagcguggucgagaagcucauccugcggggccacgaggugguggucgugaugcccgagguguccuggcagcuggggcgcagccucaacugcaccgucaagaccuacuccacgagcuacacccuggaggaccuggaccgggaguucaaggccuucgcccacgcccaguggaaggcccaggugcgcuccaucuacagccuccugaugggcuccuacaacgacaucuucgaccuguucuucagcaacugccggucccucuucaaggacaagaagcugguggaguaccugaaggagagcuccuucgacgcggucuuccucgaccccuucgacaacugcggccugaucguggccaaguacuucagccugccguccguggucuucgcccgcgggauccucugccacuaccuggaggagggcgcccagugccccgcgccccugagcuacgugccccggauccuccugggguucuccgacgccaugaccuucaaggagcgcgugcggaaccacaucaugcaccuggaggagcaccuccugugccaccgcuucuucaagaacgcccuggagaucgccagcgagauccuccagaccccggucacggaguacgaccuguacucccacaccagcaucuggcugcuccggaccgacuucgugcuggacuaccccaagcccgugaugcccaacaugaucuucaucggcgggaucaacugccaccagggcaagccgcugcccauggaguucgaggccuacaucaacgcgagcggcgagcacgggaucgucguguucucccucggcagcaugguguccgagauccccgagaagaaggccauggccaucgccgacgcccuggggaagaucccccagaccguccuguggcgcuacacgggcacccggccgagcaaccucgcgaacaacaccauccuggugaaguggcugccccagaacgaccuccugggccaccccaugacccgcgccuucaucacgcacgccgggucccacggcgucuacgagagcaucugcaacggggugcccauggugaugaugccgcuguucggcgaccagauggacaacgccaagcggauggagaccaagggggccggcgucacccucaacgugcuggagaugaccuccgaggaccuggagaacgcgcucaaggccgugaucaacgacaagagcuacaaggagaacaucaugcgccuguccagccugcacaaggaccggcccgucgagccccuggaccucgccguguucuggguggaguucgucaugcgccacaagggcgcgccccaccuccggccggccgcccacgaccugacgugguaccaguaccacucccuggacgugaucggguuccugcuggccgugguccucaccguggccuucaucaccuucaagugcugcgccuacggcuaccgcaagugccuggggaagaagggccgggugaagaaggcgcacaagagcaagacccacuga

SEQ ID NO: 38422 - RNA, 2082 nt, Artificial Sequence
  derived and/or modified sequence opt1 from UGT2A1__Homo_sapiens__NP_001239203
augcugaacaaccuccugcuguucagccuccagaucucccugaucggcaccacccucgggggcaacgugcugaucuggcccauggaggggagccacuggcugaacgucaagaucaucaucgacgagcugaucaagaaggagcacaacgugacggugcucgucgccuccggcgcccuguucaucaccccgaccagcaaccccucccugaccuucgagaucuacaaggugcccuucgggaaggagcgcaucgagggcgugaucaaggacuucguccucacguggcuggagaaccggcccagcccguccaccaucuggcgcuucuaccaggagauggcgaaggugaucaaggacuuccacauggugagccaggagaucugcgacggcguccugaagaaccagcagcucauggccaagcugaagaaguccaaguucgaggugcuggugagcgaccccgucuuccccugcggggacaucguggcccucaagcugggcauccccuucauguacucccugcgguucagcccggccuccaccguggagaagcacugcgggaagguccccuacccgcccagcuacgugcccgccgugcucuccgagcugaccgaccagaugagcuucacggaccgcauccggaacuucaucuccuaccaccuccaggacuacauguucgagacccuguggaaguccugggacagcuacuacagcaaggcgcuggacggcagccacuggcugaacaucaagaucauccucgaggagcugauccagcgcaaccacaacgucaccgugcuggccuccagcgccacccucuucaucaacuccaaccccgacagccccgugaacuucgaggucauccccguguccuacaagaaguccaacaucgacagccugaucgagcacaugaucaugcuguggaucgaccaccggccgacgccccucaccaucugggccuucuacaaggagcuggggaagcugcucgacaccuucuuccagaucaacauccagcugugcgacggcgugcugaagaaccccaagcucauggcgcgccugcagaagggcggguucgacguccugguggccgaccccgucaccaucugcggcgaccucguggcccugaagcuggggaucccguucauguacacgcuccgguucagccccgccuccaccguggagcgccacugcggcaagauccccgcccccgucagcuacgugccggcggcccuguccgagcugaccgaccagaugaccuucggcgagcggaucaagaacacgaucagcuacucccuccaggacuacaucuuccagagcuacuggggcgaguggaacuccuacuacagcaagauccuggggcgccccaccacccugugcgagaccauggggaaggccgagaucuggcugauccggacguacugggacuucgaguucccccgccccuaccucccgaacuucgaguucgugggcgggcugcacugcaagcccgccaagccccugccgaagguccucuggcgguacaagggcaagaagcccgccacccugggcaacaacacccagcuguucgacuggaucccccagaacgaccuccuggggcaccccaagaccaaggcguucaucacgcacggcgggaccaacggcaucuacgaggccaucuaccacggggugccgauggugggcguccccauguucgccgaccagcccgacaacaucgcccacaugaaggccaagggcgcggccguggaggugaaccugaacaccaugaccuccgucgaccuccugagcgcccugcgcacggugaucaacgagcccuccuacaaggagaacgccaugcggcucagccgcauccaccacgaccagccggugaagccccuggaccgggccgucuucuggaucgaguucgugaugcgccacaagggggcgaagcaccuccggguggccgcccacgaccugaccugguuccaguaccacagccuggacgucaucggcuuccugcucgugugcgugaccaccgccaucuuccuggucauccagugcugccuguucuccugccagaaguucgggaagaucggcaagaagaagaagcgcgaguga

SEQ ID NO: 38423 - RNA, 1611 nt, Artificial Sequence
  derived and/or modified sequence opt1 from UGT2A2__Homo_sapiens__NP_001099147
auggugagcauccgcgacuucaccaugcccaagaaguucguccagaugcugguguucaaccucacccugacggaggugguccuguccggcaacgugcucaucuggccgaccgacgggagccacuggcugaacaucaagaucauccuggaggagcucauccagcggaaccacaacgugaccguccuggccuccagcgccacccuguucaucaacuccaaccccgacagccccgugaacuucgaggugauccccgucuccuacaagaaguccaacaucgacagccucaucgagcacaugaucaugcuguggaucgaccaccgcccgacgccccugaccaucugggcguucuacaaggagcucggcaagcugcuggacaccuucuuccagaucaacauccagcucugcgacggggugcugaagaaccccaagcugauggcccggcuccagaagggcggguucgacgugcuggucgccgaccccgugaccaucugcggcgaccugguggcccucaagcugggcaucccguucauguacacgcugcgcuucagccccgccuccaccgucgagcggcacugcgggaagauccccgcgcccgugagcuacgugccggccgcccucuccgagcugaccgaccagaugaccuucggcgagcgcaucaagaacacgaucagcuacucccugcaggacuacaucuuccagagcuacuggggcgaguggaacuccuacuacagcaagauccucgggcggcccaccacccugugcgagaccauggggaaggccgagaucuggcugauccgcacguacugggacuucgaguucccccggcccuaccucccgaacuucgaguucgucggcggccugcacugcaagcccgcgaagccccugcccaaggagauggaggaguucauccaguccagcgggaagaacggcgugguggucuucagccucggguccauggugaagaaccugaccgaggagaaggccaaccugaucgccagcgcccucgcccagaucccgcagaaggugcuguggcgcuacaagggcaagaagcccgcgacccugggcaacaacacccagcuguucgacuggaucccccagaacgaccuccuggggcaccccaagacgaaggccuucaucacccacggcgggaccaacggcaucuacgaggccaucuaccacggggucccgauggugggcguccccauguucgccgaccagcccgacaacaucgcccacaugaaggcgaagggcgccgccguggaggugaaccucaacaccaugacguccgucgaccugcugagcgcccuccggaccgugaucaacgagcccuccuacaaggagaacgccaugcgccugagccggauccaccacgaccagccggugaagccccuggaccgcgcggucuucuggaucgaguucgugaugcggcacaagggggccaagcaccuccgcguggccgcccacgaccugaccugguuccaguaccacucccuggacgucaucggcuuccugcucgugugcgugaccacggccaucuuccuggucauccagugcugccuguucagcugccagaaguucgggaagaucggcaagaagaagaagcgggaguga

SEQ ID NO: 38424 - RNA, 1584 nt, Artificial Sequence
  derived and/or modified sequence opt1 from UGT2A3__Homo_sapiens__NP_079019
augcgcagcgacaaguccgcccugguguuccuccugcugcagcuguucugcgucggcugcggguucugcggcaaggugcugguguggcccugcgacaugagccacuggcugaacgucaaggugauccucgaggagcugaucgugcgggggcacgaggucaccgugcugacccacuccaagccgagccucaucgacuaccgcaagcccuccgcccugaaguucgaggugguccacaugccccaggaccggacggaggagaacgagaucuucguggaccuggcgcucaacgugcugcccggccugagcaccuggcaguccgucaucaagcucaacgacuucuucguggagauccgcgggacccugaagaugaugugcgagagcuucaucuacaaccagacccugaugaagaagcuccaggagacgaacuacgacgugaugcugaucgacccggucauccccugcggcgaccugauggccgagcuccuggccgugcccuucgugcugacccuccggaucuccgucggcgggaacauggagcgcagcugcggcaagcugcccgccccgcuguccuacgugcccgugcccaugaccgggcucaccgaccggaugacguuccuggagcgcgucaagaacagcaugcuguccguccucuuccacuucuggauccaggacuacgacuaccacuucugggaggaguucuacagcaaggcccugggccggcccaccacccugugcgagaccguggggaaggcggagaucuggcucauccgcacguacugggacuucgaguucccgcagcccuaccagcccaacuucgaguucgugggcggccugcacugcaagcccgccaaggcccugccgaaggagauggagaacuucgugcaguccagcggggaggacggcaucgucguguucucccucgggagccuguuccagaacgugaccgaggagaaggccaacaucaucgcguccgcccuggcccagaucccccagaagguccucuggcgguacaagggcaagaagcccagcacccugggcgccaacacccgccuguacgacuggaucccccagaacgaccuccuggggcacccgaagacgaaggccuucaucacccacggcgggaugaacggcaucuacgaggcgaucuaccacggggugcccauggugggcguccccaucuucggcgaccagcuggacaacaucgcccacaugaaggccaagggggccgccguggagaucaacuucaagaccaugaccagcgaggaccuccugcgggcgcugcgcacggugaucaccgacuccagcuacaaggagaacgccaugcggcucucccgcauccaccacgaccagcccgucaagccgcuggaccgggccguguucuggaucgaguucgugaugcgccacaagggcgccaagcaccuccggagcgccgcgcacgaccugaccugguuccagcacuacuccaucgacgucaucggguuccuccuggccugcguggccaccgccaucuuccuguucacgaagugcuuccucuucagcugccagaaguucaacaagacccgcaagaucgagaagcgggaguga

SEQ ID NO: 38425 - RNA, 1587 nt, Artificial Sequence
  derived and/or modified sequence opt1 from UGT2B10__Homo_sapiens__NP_001066
auggcccugaaguggaccaccgugcuccugauccagcugagcuucuacuucuccagcggcuccugcgggaagguccucgugugggccgcggaguacagccuguggaugaacaugaagacgauccugaaggagcucgugcagcgcggccacgaggucaccgugcuggccuccagcgccuccauccuguucgaccccaacgacagcuccacccucaagcuggagguguacccgaccagccugacgaagaccgaguucgagaacaucaucaugcagcucgucaagcggcuguccgagauccagaaggacaccuucuggcugcccuucagccaggagcaggagauccucugggccaucaacgacaucauccgcaacuucugcaaggacgugguguccaacaagaagcugaugaagaagcugcaggagagccgguucgacaucgucuucgccgacgcguaccuccccugcggggagcugcuggccgagcuguucaacauccccuucguguacucccacagcuucuccccgggcuacagcuucgagcgccacuccgggggcuucaucuucccgcccagcuacgugcccgucgugaugagcaagcucuccgaccagaugaccuucauggagcgggugaagaacaugcuguacguccucuacuucgacuucugguuccagaucuucaacaugaagaagugggaccaguucuacagcgaggugcugggccgcccgacgacccuguccgagaccaugcggaaggccgacaucuggcucaugcgcaacagcuggaacuucaaguucccccaccccuuccugcccaacguggacuucgucgggggccugcacugcaagccggccaagccccuccccaaggagauggaggaguucgugcaguccagcggggagaacggcguggucguguucucccuggggagcaugguguccaacaugaccgaggagcgggcgaacgucaucgccacggcccuggccaagaucccccagaaggugcucuggcgcuucgacggcaacaagccggacgcccugggccugaacacccggcucuacaaguggaucccccagaacgaccugcuggggcaccccaagacccgcgcguucaucacccacggcggggccaacggcaucuacgaggccaucuaccacggcauccccauggucgggaucccccucuucuucgaccagcccgacaacaucgcccacaugaaggccaagggcgcggccgugcggguggacuucaacacgaugagcuccaccgaccugcugaacgcccucaagaccgucaucaacgaccccagcuacaaggagaacaucaugaagcugucccgcauccagcacgaccagcccgugaagccgcuggaccgggccguguucuggaucgaguucgucaugcgccacaagggggccaagcaccuccggguggcggcccacaaccugaccugguuccaguaccacagccuggacgugaucggcuuccuccuggccugcgucgccacggugcuguucaucaucaccaagugcugccuguucugcuucuggaaguucgcccgcaaggggaagaagggcaagcgggacuga

SEQ ID NO: 38426 - RNA, 1590 nt, Artificial Sequence
  derived and/or modified sequence opt1 from UGT2B11__Homo_sapiens__NP_001064
augacccugaaguggaccagcgugcuccugcugauccaccucuccugcuacuucagcuccggcagcugcgggaagguccuggugugggccgccgaguacucccacuggaugaacaugaagacgauccugaaggagcucgugcagcgcggccacgaggucaccgugcuggcgagcuccgccagcauccuguucgaccccaacgacgccuccacccucaaguucgagguguacccgaccagccugacgaagaccgaguucgagaacaucaucaugcagcaggucaagcggugguccgacauccgcaaggacagcuucuggcuguacuucucccaggagcaggagauccucugggagcuguacgacaucuuccggaacuucugcaaggacguggugagcaacaagaaggucaugaagaagcugcaggagucccgcuucgacaucguguucgccgacgccguguuccccugcggggagcuccuggcggcccugcucaacauccgguucgucuacagccugcgcuucacccccggcuacaccaucgagcggcacuccgggggccugaucuucccgcccagcuacauccccaucgugauguccaagcucagcgaccagaugacguucauggagcgcgugaagaacaugaucuacguccuguacuucgacuucugguuccagaugagcgacaugaagaagugggaccaguucuacuccgaggugcugggccggcccaccacccucuucgagaccauggggaaggccgacaucuggcugaugcgcaacagcugguccuuccaguucccccacccguuccugcccaacguggacuucgucggcggguuccacugcaagcccgccaagccccucccgaaggagauggaggaguucgugcagagcuccggcgagaacgggguggucguguucagccugggcuccgugaucagcaacaugacggcggagcgggccaacgucaucgccaccgcccuggccaagaucccccagaaggugcucuggcgcuucgacggcaacaagcccgacgcgcuggggcugaacacccggcucuacaaguggaucccccagaacgaccugcugggccacccgaagacccgcgccuucaucacgcacgggggcgccaacggcaucuacgaggccaucuaccacgggauccccauggucggcaucccccucuucuucgaccagcccgacaacaucgcccacaugaaggcgaagggggccgccgugcggcuggacuucaacaccauguccagcaccgaccugcucaacgcccugaagaccgugaucaacgacccgcuguacaaggagaacaucaugaagcucucccgcauccagcacgaccagcccgucaagccccuggaccgggccguguucuggaucgaguucgugaugccccacaagggcgcgaagcaccuccgcgucgccgcccacgaccugacgugguuccaguaccacagccuggacgugaucggguuccugcucgccugcguggccaccgucaucuucaucaucaccaaguucugccuguucugcuucuggaaguucgcgcggaagggcaagaagggcaagcgcgacuga

SEQ ID NO: 38427 - RNA, 1593 nt, Artificial Sequence
  derived and/or modified sequence opt1 from UGT2B15__Homo_sapiens__NP_001067
augagccugaaguggaccuccguguuccuccugauccagcugagcugcuacuucuccagcggcuccugcgggaagguccucguguggcccaccgaguacagccacuggaucaacaugaagacgauccuggaggagcuggugcagcgcggccacgaggucaccgugcucaccuccagcgccuccacccuggugaacgccagcaaguccagcgcgaucaagcuggaggucuacccgacgucccucaccaagaacuaccuggaggacagccugcucaagauccuggaccgguggaucuacgggguguccaagaacaccuucuggagcuacuucucccagcugcaggagcucugcugggaguacuacgacuacagcaacaagcugugcaaggacgccgugcugaacaagaagcucaugaugaagcugcaggaguccaaguucgacgucauccuggccgacgcccucaaccccugcggcgagcugcuggccgagcuguucaacauccccuuccucuacagccugcgcuucagcgugggguacaccuucgagaagaacggcggcggguuccucuucccgcccuccuacgugcccgucgugaugagcgagcuguccgaccagaugaucuucauggagcggaucaagaacaugauccacaugcuguacuucgacuucugguuccagaucuacgaccucaagaagugggaccaguucuacagcgaggugcugggccgccccacgacccuguucgagaccauggggaaggcggagauguggcucauccggaccuacugggacuucgaguucccccgcccguuccugcccaacgucgacuucgugggcgggcugcacugcaagcccgccaagccccucccgaaggagauggaggaguucgugcaguccagcggcgagaacggcaucgucguguucucccuggggagcaugaucuccaacaugagcgaggaguccgccaacaugaucgccagcgcgcuggcccagaucccccagaaggugcucuggcgguucgacggcaagaagcccaacacgcugggguccaacacccgccuguacaaguggcucccccagaacgaccugcugggccacccgaagaccaaggccuucaucacccacggcgggacgaacggcaucuacgaggccaucuaccacgggauccccauggucggcaucccccucuucgccgaccagcacgacaacaucgcgcacaugaaggccaagggggccgcccugagcguggacauccggaccauguccagccgcgaccugcucaacgcccugaaguccgugaucaacgaccccgucuacaaggagaacgugaugaagcugagccggauccaccacgaccagccgaugaagccccuggaccgcgcggucuucuggaucgaguucgugaugcggcacaagggcgccaagcaccuccgcguggccgcccacaaccugaccuggauccaguaccacucccuggacgucaucgccuuccuccuggcgugcguggccaccgugaucuucaucaucacgaaguucugccuguucugcuuccggaagcucgccaagaagggcaagaagaagaagcgcgacuga

SEQ ID NO: 38428 - RNA, 1008 nt, Artificial Sequence
  derived and/or modified sequence opt1 from UGT2B28__Homo_sapiens__NP_001193933
auggcccugaaguggaccagcgugcuccugcugauccaccucggcugcuacuucuccagcggguccugcggcaagguccugguguggaccggggaguacagccacuggaugaacaugaagacgauccugaaggagcucgugcagcgcggccacgaggucaccgugcuggccuccagcgcguccauccuguucgaccccaacgacgccuucacccucaagcuggagguguacccgaccagccugacgaagaccgaguucgagaacaucaucaugcagcaggucaagcggugguccgacauccagaaggacagcuucuggcucuacuucucccaggagcaggagauccugugggaguuccacgacaucuuccgcaacuucugcaaggacguggugagcaacaagaaggucaugaagaagcugcaggagucccgguucgacaucaucuucgccgacgccuucuuccccugcggggagcuccuggccgcgcugcucaacauccccuucguguacagccugugcuucacccccggcuacaccaucgagcgccacuccggcgggcugaucuucccgcccagcuacauccccguggucauguccaagcucagcgaccagaugacguucauggagcgggugaagaacaugaucuacgugcuguacuucgacuucugguuccagaugugcgacaugaagaagugggaccaguucuacuccgagguccugggccgccccaccacccucuucgagaccauggggaaggccgacaucuggcugaugcggaacagcuggagcuuccaguucccgcaccccuuccugcccaacaucgacuucgugggcgggcuccacugcaagcccgccaagccgcugcccaaggagauggaggaguucgugcaguccagcggcgagaacggcgucgugguguucucccuggggagcgucaucuccaacaugacggccgagcgcgcgaacgugaucgccaccgcccucgccaagaucccccagaagaucuga

SEQ ID NO: 38429 - RNA, 1110 nt, Artificial Sequence
  derived and/or modified sequence opt1 from UGT2B4__Homo_sapiens__NP_001284544
augagcaugaaguggaccuccgcccugcuccugauccagcugagcugcuacuucuccagcggcuccugcgggaaggugcucgucuggcccaccgaguucagccacuggaugaacaucaagacgauccuggacgagcuggugcagcgcggccacgaggugaccguccucgccuccagcgcguccaucagcuucgacccgaacucccccagcacccugaaguucgagguguaccccgugucccugaccaagacggaguucgaggacaucaucaagcagcucgucaagcggugggccgagcugcccaaggacaccuucuggagcuacuucucccaggugcaggagaucauguggaccuucaacgacauccugcgcaaguucugcaaggacaucgugagcaacaagaagcucaugaagaagcugcaggagucccgguucgacgucgugcuggccgacgccguguucccguucggggagcuccuggccgagcugcucaagauccccuucgucuacagccugcgcuucucccccggcuacgcgaucgagaagcacagcgggggccuccuguucccgcccagcuacgugcccguggucauguccgagcugagcgaccagaugaccuucaucgagcgggugaagaacaugaucuacgugcuguacuucgaguucugguuccagaucuucgacaugaagaagugggaccaguucuacuccgagguccucggccgccccacgacccugagcgagaccauggccaaggccgacaucuggcugauccggaacuacugggacuuccaguucccccacccgcuccugcccaacguggaguucgucgggggccugcacugcaagcccgccaagccccucccgaaggagauggaggaguucgugcaguccagcggggagaacggcgugguggucuucucccuggggagcaugguguccaacaccagcgaggagcgcgcgaacgucaucgccuccgcccuggccaagaucccccagaaggugcucuggcgguucgacggcaacaagcccgacacgcugggccugaacacccgccucuacaaguggaucccccagaacgaccugcuggacaucaagcggaugcucuga

SEQ ID NO: 38430 - RNA, 1590 nt, Artificial Sequence
  derived and/or modified sequence opt1 from UGT2B7__Homo_sapiens__NP_001065
augagcgugaaguggaccuccgucauccugcucauccagcugagcuucugcuucuccagcggcaacugcgggaaggugcuggugugggccgccgaguacucccacuggaugaacaucaagaccauccucgacgagcugauccagcgcggccacgaggucacggugcuggcgagcuccgccagcauccucuucgaccccaacaacuccagcgcccugaagaucgagaucuacccgaccucccugaccaagaccgagcucgagaacuucaucaugcagcagaucaagcgguggagcgaccugcccaaggacacguucuggcuguacuucucccaggugcaggagaucaugagcaucuucggggacaucacccgcaaguucugcaaggacgucguguccaacaagaaguucaugaagaaggugcaggagagccgguucgacgucaucuucgccgacgccaucuuccccugcuccgagcuccuggcggagcuguucaacauccccuucguguacagccucuccuucagcccgggcuacaccuucgagaagcacagcgggggcuucaucuucccgcccuccuacgugcccgucgugaugagcgagcugaccgaccagaugacguucauggagcgcgugaagaacaugaucuacguccuguacuucgacuucugguucgagaucuucgacaugaagaagugggaccaguucuacuccgaggugcucggccggccgaccacccugagcgagaccauggggaaggccgacguguggcugauccgcaacuccuggaacuuccaguuccccuacccccuccugcccaacgucgacuucgugggcgggcugcacugcaagccggccaagccccuccccaaggagauggaggacuucgugcagagcuccggcgagaacggggucgugguguucagccugggcuccauggucagcaacaugacggaggagcgggccaacgugaucgcguccgcccuggcccagaucccccagaagguccucuggcgcuucgacggcaacaagccggacacccuggggcugaacacccggcucuacaaguggaucccccagaacgaccugcugggccaccccaagacccgcgccuucaucacgcacgggggcgccaacggcaucuacgaggcgaucuaccacgggauccccauggugggcaucccccucuucgccgaccagcccgacaacaucgcccacaugaaggcccgcggggccgcggugcgggucgacuucaacaccaugagcuccaccgaccugcugaacgcccucaagcgggugaucaacgaccccagcuacaaggagaacgugaugaagcugucccgcauccagcacgaccagcccgucaagccgcuggaccgggccguguucuggaucgaguucgugaugcgccacaagggcgccaagcaccuccgggucgccgcgcacgaccugaccugguuccaguaccacagccuggacgugaucggguuccuccuggugugcgucgccacggugaucuucaucgugaccaagugcugccuguucugcuucuggaaguucgcccgcaaggccaagaagggcaagaacgacuga

SEQ ID NO: 38431 - RNA, 1470 nt, Artificial Sequence
  derived and/or modified sequence opt1 from UGT3A2__Homo_sapiens__NP_001161788
auggccggccagcgcgugcugcuccuggucggguuccugcuccccggcgugcugcugagcgaggccgcgaagauccucaccaucuccaccguggacuucaagaaggaggagaaguccuaccaggucaucagcuggcuggccccggaggaccaccagcgggaguucaagaaguccuucgacuucuuccuggaggagacgcucgggggccgcgggaaguucgagaaccugcugaacgugcucgaguaccuggcccugcagugcagccacuuccucaaccggaaggacaucauggacagccugaagaacgagaacuucgacauggugaucgucgagaccuucgacuacugccccuuccugaucgccgagaagcucggcaagcccuucguggccauccuguccaccagcuucggcucccuggaguucgggcuccccaucccgcugagcuacgugcccgucuuccgcucccugcucaccgaccacauggacuucuggggccgggugaagaacuuccugauguucuucagcuucugccgccggcagcagcacaugcaguccacguucgacaacaccaucaaggagcacuucaccgaggggagccgccccgugcugucccaccuccugcugaaggcggagcucugguucaucaacagcgacuucgccuucgacuucgcccggccccugcugccgaacaccgucuacgugggcgggcucauggagaagcccaucaagcccgugccccaggaccuggagaacuucaucgccaaguucggcgacuccggcuucguccuggugacgcucgggagcauggugaacacgugccagaacccggagaucuucaaggagaugaacaacgcguucgcccaccucccccagggcgucaucuggaagugccagugcucccacuggcccaaggacgugcaccuggccgccaacgugaagaucgucgacuggcugccccagagcgaccugcuggcccacccgagcauccgccucuucgugacccacgggggccagaacuccaucauggaggcgauccagcacggcgugcccauggucgggaucccccuguucggcgaccagcccgagaacauggugcgggucgaggccaagaaguucggggugagcauccagcugaagaagcucaaggccgagacccuggcccugaagaugaagcagaucauggaggacaagcgcuacaaguccgccgcgguggccgccagcgucauccuccggucccacccgcugagccccacccagcgccuggugggcuggaucgaccacgugcugcagaccgggggcgccacccaccucaagcccuacgucuuccagcagcccuggcacgagcaguaccugcuggacguguucguguuccuccugggccugacccucgggacgcuguggcugugcggcaagcuccuggggauggccgucugguggcugcggggcgcgcgcaaggugaaggagaccuga

SEQ ID NO: 38432 - RNA, 1626 nt, Artificial Sequence
  derived and/or modified sequence opt1 from UGT8__Homo_sapiens__NP_001121646
augaaguccuacacccccuacuucauccugcucuggagcgccgugggcaucgccaaggcggccaagaucaucaucgucccgcccaucauguucgagagccacauguacaucuucaagacccuggccuccgcccugcacgagcgcgggcaccacacgguguuccuccugagcgagggccgggacaucgcccccuccaaccacuacagccugcagcgcuaccccgggaucuucaacuccaccaccagcgacgcguuccuccaguccaagaugcggaacaucuucagcggccgccugaccgccaucgagcuguucgacauccucgaccacuacacgaagaacugcgaccugaugguggggaaccacgcccugauccagggccucaagaaggagaaguucgaccugcugcucgucgacccgaacgacaugugcggcuucgugaucgcccaccuccugggggugaaguacgcggucuucuccaccggccugugguaccccgccgaggugggggcccccgcgccccuggccuacgugccggaguucaacagccugcucaccgaccggaugaaccugcugcagcgcaugaagaacaccggcgucuaccucaucucccggcugggggugagcuuccuggugcuccccaaguacgagcgcaucaugcagaaguacaaccugcugcccgagaaguccauguacgaccucguccacggcagcucccuguggaugcugugcacggacguggcccucgaguucccccggccgacccugcccaacguggucuacgugggcgggauccugaccaagcccgccagcccccucccggaggaccugcagcgcugggugaacggcgccaacgagcacggguucguccugguguccuucggcgccggcgugaaguaccucagcgaggacaucgccaacaagcuggcgggggcccugggccggcucccccagaaggucaucuggcgcuucagcgggcccaagcccaagaaccugggcaacaacaccaagcugaucgaguggcucccgcagaacgaccugcuggggcacuccaagaucaaggccuuccucagccacggcggccugaacuccaucuucgagacgauguaccacggggugcccguggucggcaucccccuguucggggaccacuacgacaccaugacccgggugcaggccaagggcauggggauccugcucgaguggaagaccgucacggagaaggagcuguacgaggcccuggugaaggugaucaacaaccccagcuaccgccagcgggcgcagaagcucuccgagauccacaaggaccagccgggccaccccgucaaccgcaccaucuacuggaucgacuacaucauccggcacaacggcgcccaccaccuccgcgccgccgugcaccagaucagcuucugccaguacuuccugcuggacaucgccuucgugcugcugcucggggcggcccugcuguacuuccuccuguccugggucaccaaguucaucuaccggaagaucaagagccuguggucccgcaacaagcacagcaccgugaacggccacuaccacaacgggauccucaacggcaaguacaagcggaacgggcacaucaagcacgagaagaaggugaaguga

SEQ ID NO: 38433 - RNA, 1038 nt, Artificial Sequence
  derived and/or modified sequence opt1 from UHMK1__Homo_sapiens__NP_001171692
auguuccugacccgccccaaggugugcgucgaccucaaccggcgcgugacccuguacggcguguucacgauccacuucagcccgaacguccccucccggugccugcuccuggagcugcucgacgugagcguguccgagcugcugcucuacagcucccaccaggggugcagcauguggaugauccagcacugcgcccgcgacguccuggaggcccuggcguuccuccaccacgagggcuacgugcacgccgaccugaagccccggaacauccugugguccgccgagaacgagugcuucaagcucaucgacuucgggcugagcuucaaggagggcaaccaggacgugaaguacauccagaccgacggguaccgcgcccccgaggccgagcugcagaacugccucgcgcaggccggccugcaguccgacaccgagugcaccagcgccgucgaccuguggucccucggcaucauccugcuggagauguucagcgggaugaagcucaagcacacggugcggucccaggaguggaaggccaacagcuccgcgaucaucgaccacaucuucgccagcaaggccguggucaacgccgccaucccggcguaccaccuccgcgaccugaucaaguccaugcugcacgacgaccccagccggcgcauccccgccgagauggcccugugcucccccuucuucagcaucccguucgcgccccacaucgaggaccuggugaugcuccccacccccgugcugcggcugcucaacguccuggacgacgacuaccuggagaacgaggaggaguacgaggacgugguggaggacgucaaggaggagugccagaaguacggcccgguggugagccuccugguccccaaggagaaccccgggcgcggccagguguucguggaguacgccaacgccggggacuccaaggccgcccagaagcugcucaccggccggauguucgacggcaaguucgucguggccaccuucuacccccugagcgccuacaagcgcggguaccuguaccagacgcuccuguga

SEQ ID NO: 38434 - RNA, 4323 nt, Artificial Sequence
  derived and/or modified sequence opt1 from UHRF1BP1__Homo_sapiens__NP_060224
auggccggcaucaucaagaagcagauccugaagcaccucagccgcuucaccaagaaccugucccccgacaagaucaaccugagcacccucaagggggagggccagcugacgaaccuggagcucgacgaggaggugcugcagaacguccuggagcucccgaccuggcuggccaucacccggguguacugcaaccgcgcguccauccggauccaguggaccaagcugaagacgcaccccaucugccucugccuggacaagguggaggucgagaugaagaccugcgaggacccccgccccccgaacgggcagagccccaucgcccuggccuccggccagagcgaguacggguucgccgagaaggugguggagggcauguucaucaucgucaacuccaucaccaucaagauccacagcaaggccuuccacgcguccuucgagcucuggcagcugcagggcuacagcgugaaccccaacuggcagcaguccgaccugcggcucacccgcaucacggaccccugccggggggaggugcugaccuucaaggagaucaccuggcagacccugcgcaucgaggccgacgccacggacaacggcgaccaggacccggucaccaccccccuccggcugaucaccaaccaggggcgcauccagaucgcccugaagcggcgcacgaaggacugcaacgugaucagcuccaagcucauguuccugcuggacgaccuccugugggugcugaccgacagccagcucaaggcgaugaugaaguacgccgagucccugagcgaggccauggagaaguccgcccaccagcggaagagccuggcccccgagcccguccagaucaccccgcccgcgcccuccgcccagcagagcugggcccaggccuucggcgggagccagggcaacuccaacagcuccagcucccgccucagccaguacuucgagaaguucgacgugaaggaguccagcuaccaccugcugaucucccggcucgaccugcacaucugcgacgacagccagucccgcgagcccggcgugagcgccaaccggcugauggggggcgcgaugcagcucaccuuccgcaagauggccuucgacuacuacccguuccacugggccggggacuccugcaagcacuggguccggcacugcgaggccauggagacgcgcggccagugggcccagaagcuggugauggaguuccagagcaagauggagaaguggcacgaggagaccggccugaagccccccuggcaccucgggguggacucccuguuccggcgcaaggcggacagccuguccagcccccgcaagaacccgcucgagcggucccccagccagggccgccagcccgccuuccagcccccggccuggaaccggcugcgcagcuccugcauggucgugcggguggacgaccuggacauccaccaggucagcaccgccgggcagcccuccaagaagcccagcacccuccuguccugcagccgcaagcugcacaaccugcccacgcagguguccgccauccacaucgaguucaccgaguacuacuucccggacaaccaggagcuccccgugcccugcccgaaccuguacauccagcugaacggccucaccuucaccauggaccccgucagccugcugugggggaaccucuucugccuggaccuguaccggucccucgagcaguucaaggcgaucuacaagcuggaggacagcucccagaaggacgagcaccuggacauccgccucgacgccuucuggcugaaggugagcuucccccuggagaagcgggagcgcgccgagcuccaccggccccaggcccuggucuucuccgcgagcggcaugaucgccacgaacacccgccacgccccgcacugcuccugcagcgaccugcagucccucuuccggggcuucgccgccgcggaguucuuccacagcaacuacgaccacuuccccaaggugcccgggggcuucagccugcugcacaugcucuuccugcaccacgccuuccagauggacuccugccugccccagccgaacacccuccccccccagcgccccaaggccagcugggaccugugguccgugcacuucacccagaucagccuggacuucgaggggacggagaacuucaagggccacacccucaacuucgucgccccguucccccuguccaucugggccugccugccccuccgguggcagcaggcgcaggcccgcaagcugcugcucgccagcgaggggcggcugaagcccuccgccagcuucggcuccccggugcagagcgaggcccuggcgcccgacuccaugagccacccccgcuccaagaccgagcacgaccucaagagccuguccggccugaccgaggugauggagauccucaaggaggggagcuccggcauggacaacaaggggccccugacggagcuggaggacgucgccgacgugcacaugcucgugcacagcccggcccacguccgggugcgccuggaccacuaccaguaccuggcccuccugcgccugaaggaggugcuccagcggcugcaggagcagcugaccaaggacaccgaguccaugaccggcagcccccuccagaaccagaccgcgugcaucgggguccuguuccccagcgccgagguggcccugcucaugcaccccgccccgggcgccguggacgcggacuccgccggcagcgacuccacgagccuggucgacuccgagcugagccccuccgaggaccgcgagcucaagagcgacgccuccagcgaccaggggcccgccuccccggagaaggugcuggaggagagcuccaucgagaaccaggacgugagccaggagcggccccacuccaacggcgagcugcaggacagcgggccccucgcccagcagcuggcgggcaagggccacgaggccgucgagucccugcaggccaagaagcucagccgcacccaggccuccagcagccccgccgcgcugaagccgcccgccgggcgggagaccgccgugaacggccagggggagcugaucccccucaagaacaucgagggcgagcuguccagcgccauccacaugaccaaggacgcgacgaaggaggcccugcacgccaccauggaccucaccaaggaggccgugucccugaccaaggacgccuucagccuggggcgcgaccggaugacguccaccaugcacaagaugcucagccugcccccggcgaaggagcccauggccaagaccgacgagggcgucgccgcccccguguccggcggggccgcgcgccugcgguucuucagcaugaagcgcaccgugucccagcagagcuucgacggcgucucccucgacagcuccgggcccgaggaccggaucagcguggacuccgacggcagcgacuccuucgugaugcugcuggagagcgaguccgggccggagagcgucccccccggcagccucuccaacgugagcgacaacgccggcgugcagggguccccccuggucaacaacuacggccaggggagcccggccgccaacuccagcgugucccccagcggcgaggaccugaucuuccaccccguguccguccucgugcugaaggugaacgaggucagcuucgggaucgaggugcgcggcgaggaccugacgguggcccuccaggcggaggagcugacccugcagcagcucggcaccgucgggcuguggcaguuccugcacggccagugccccgggaccugcuuccaggaguccagcacgcucaagaccggccacauccggccggccguggggcugcgcuucgaggugggccccggcgccgccguccacuccccccuggccagccagaacggguuccuccaccugcugcugcacggcugcgaccucgagcugcugaccuccgugcucagcgggcugggccccuuccuggaggacgaggagaucccgguggucgugcccaugcagaucgagcuccugaacuccagcaucacccugaaggacgacaucccccccaucuacccgacgucccccggccccaucccgaucacccucgcgauggagcacgugguccugaagcggagcgacgacgggguguuccacaucggcgccgccgcccaggacaagcccagcgcggaggugcugaaguccgagaagcgccagccccccaaggagcaggucuuccucgugccgaccggggaggucuucgagcagcaggugaaggagcugcccauccugcagaaggagcucaucgagaccaagcaggcccuggccaacgccaaccaggacaaggagaagcugcuccaggagauccggaaguacaaccccuucuucgagcuguga

SEQ ID NO: 38435 - RNA, 2382 nt, Artificial Sequence
  derived and/or modified sequence opt1 from UHRF1__Homo_sapiens__NP_001276980
auguggauccaggugcgcaccauggacggccggcagacccacacggucgacagccugucccgccucaccaagguggaggagcugcggcgcaagauccaggagcuguuccacguggagcccgggcuccagcggcuguucuaccgcggcaagcagauggaggacgggcacacccuguucgacuacgagguccggcucaacgacaccauccagcugcuggugcgccagagccucgugcugccgcacuccacgaaggagcgggacagcgagcuguccgacaccgacagcggcugcugccucgggcaguccgagagcgacaaguccagcacccacggcgaggccgccgcggagaccgacucccgccccgccgacgaggacaugugggacgagacggagcugggccuguacaaggucaacgaguacguggacgcccgggacaccaacaugggggccugguucgaggcccaggugguccgcgugacccggaaggcgcccagccgcgacgagcccugcuccagcaccucccggccggcccucgaggaggacgugaucuaccacgucaaguacgacgacuaccccgagaacggcguggugcagaugaacagccgcgacguccgggcccgcgcccggacgaucaucaaguggcaggaccuggaggugggccagguggucaugcugaacuacaaccccgacaaccccaaggagcgcggguucugguacgacgcggagaucucccggaagcgcgagacccgcaccgcccgggagcucuacgccaacguggugcugggggacgacagccugaacgacugccgcaucaucuucgucgacgagguguucaagaucgagcggccgggcgagggcucccccaugguggacaaccccaugcgccggaaguccgggcccagcugcaagcacugcaaggacgacgucaaccgccucugccgggugugcgccugccaccugugcggcgggcgccaggacccggacaagcagcugaugugcgacgagugcgacauggccuuccacaucuacugccucgacccgccccuguccagcguccccuccgaggacgagugguacugccccgagugccggaacgacgcgagcgagguggugcuggccggcgagcgccuccgggaguccaagaagaaggccaagauggccagcgccaccuccagcucccagcgcgacuggggcaaggggauggcgugcgucggccggacgaaggagugcaccaucgugcccagcaaccacuacgggcccauccccggcaucccgguggggaccauguggcgcuuccggguccagguguccgagagcggcgugcaccgcccccacgucgccggcauccacgggcgguccaacgacggcgccuacagccuggugcuggccgggggcuacgaggacgacguggaccacgggaacuucuucaccuacacgggcuccggcgggcgcgaccucagcggcaacaagcggaccgccgagcaguccugcgaccagaagcugaccaacaccaaccgcgcgcuggcccucaacugcuucgcccccaucaacgaccaggagggggccgaggccaaggacuggcgcagcggcaagcccguccggguggugcgcaacgucaagggcgggaagaacuccaaguacgcgccggccgagggcaaccgguacgacgggaucuacaagguggugaaguacuggcccgagaagggcaagagcggguuccuggucuggcgcuaccugcuccggcgcgacgacgacgagcccggccccuggacgaaggagggcaaggaccggaucaagaagcuggggcugaccaugcaguacccggagggcuaccucgaggcccuggccaaccgcgagcgggagaaggagaacagcaagcgcgaggaggaggagcagcaggagggcggguucgcgagcccccggaccgggaagggcaaguggaagcgcaagagcgccggcgggggccccucccgggccgggagcccgcgccggaccuccaagaagacgaagguggagcccuacagccugaccgcccagcaguccagccucauccgcgaggacaaguccaacgccaagcuguggaacgaggugcuggcgagccucaaggaccggcccgccuccggcagccccuuccagcuguuccuguccaaggucgaggagaccuuccagugcaucugcugccaggagcucguguuccgcccgaucaccacggugugccagcacaacgucugcaaggacugccuggaccggagcuuccgcgcccagguguucuccugccccgccugccgguacgaccuggggcgcagcuacgccaugcaggucaaccagccccugcagaccgugcucaaccagcuguuccccggcuacggcaacgggcgcuga

SEQ ID NO: 38436 - RNA, 2409 nt, Artificial Sequence
  derived and/or modified sequence opt1 from UHRF2__Homo_sapiens__NP_690856
auguggauccaggugcgcaccaucgacggcagcaagaccugcacgaucgaggacgucucccggaaggccaccaucgaggagcugcgcgagcgggugugggcccucuucgacgugcgccccgagugccagcggcuguucuaccgcgggaagcagcuggagaacggcuacacccucuucgacuacgacgucgggcugaacgacaucauccagcugcucgugcggccggaccccgaccaccuccccggcaccagcacgcagaucgaggcgaagcccugcuccaacagcccgcccaaggugaagaaggcgccccgcgucgggcccuccaaccagccgagcaccuccgcccgggcccgccugaucgaccccggcuucggcaucuacaaggugaacgagcugguggacgcccgggacgucgggcugggcgccugguucgaggcccacauccacagcgugacccgcgccuccgacgggcagagccggggcaagacgccccugaagaacggguccagcugcaagcgcaccaacggcaacaucaagcacaaguccaaggagaacaccaacaagcucgacagcgugcccuccaccagcaacuccgacugcgucgccgcggacgaggacgugaucuaccacauccaguacgacgaguacccggagagcggcacccuggagaugaacgugaaggaccugcggccccgcgcccggacgauccucaaguggaacgagcugaacgucggggacguggugauggucaacuacaacguggagucccccggccagcgcggguucugguucgacgccgagaucaccacccugaagaccaucagccggacgaagaaggagcuccgcgugaagaucuuccugggcggcagcgaggggacccugaacgacugcaagaucaucuccgucgacgagaucuucaagaucgagcggcccggcgcccacccgcucagcuucgccgacgggaaguuccugcgccgcaacgaccccgagugcgaccugugcggcggggaccccgagaagaagugccacuccugcagcugccgggugugcggcggcaagcacgagcccaacaugcagcuccugugcgacgagugcaacguggcguaccacaucuacugccugaacccgccccucgacaagguccccgaggaggaguacugguacugccccuccugcaagaccgacagcuccgagguggucaaggccggggagcgccugaagaugagcaagaagaaggccaagaugccguccgccagcaccgagucccggcgcgacuggggccgggggauggccugcgugggccgcacgcgggagugcaccaucgugcccagcaaccacuacgggcccauccccggcaucccggucggcuccaccuggcgcuuccggguccaggugagcgaggcgggggugcaccgcccccacgugggcgggauccacggccgguccaacgacggggccuacagccuggugcucgccggcggcuucgccgacgaggucgaccgcggggacgaguucaccuacacgggcuccgggggcaagaaccuggccggcaacaagcggaucggggcgcccagcgccgaccagacccugaccaacaugaaccgcgcccucgcccugaacugcgacgccccgcuggacgacaagaucggcgcggagucccggaacuggcgcgccgggaagcccgugcgggugauccgcagcuucaagggccggaagaucagcaaguacgcccccgaggaggggaaccgcuacgacggcaucuacaaggucgugaaguacuggcccgagaucuccagcucccacggcuuccucguguggcgcuaccugcugcggcgcgacgacgucgagccggcccccuggaccagcgaggggaucgagcggucccgccggcucugccugcgccugcaguaccccgcgggcuaccccagcgacaaggaggggaagaagccgaagggccaguccaagaagcagcccagcgggacgaccaagcggcccaucuccgacgacgacugccccagcgccuccaagguguacaaggccagcgacuccgccgaggccaucgaggcguuccagcucaccccgcagcagcagcaccugauccgcgaggacugccagaaccagaagcugugggacgaggugcucagccaccuggucgagggccccaacuuccugaagaagcucgagcaguccuucaugugcgugugcugccaggagcugguguaccagcccgucaccacggagugcuuccacaacgugugcaaggacugccugcagcggagcuucaaggcccagguguucuccugccccgccugccgccacgaccugggccagaacuacaucaugaucccgaacgagauccuccagacccugcuggaccucuucuuccccggguacagcaagggccgguga

SEQ ID NO: 38437 - RNA, 2160 nt, Artificial Sequence
  derived and/or modified sequence opt1 from UIMC1__Homo_sapiens__NP_057374
augccccgccggaagaagaaggugaaggaggucagcgagucccgcaaccuggagaagaaggacguggagaccaccagcuccgugagcgucaagcggaagcgccggcucgaggacgccuucaucgugaucuccgacagcgacggcgaggagccgaaggaggagaacgggcugcagaagacgaagaccaagcaguccaaccgcgccaagugccuggcgaagcggaagaucgcccagaugaccgaggaggagcaguucgcccucgcccugaagaugagcgagcaggaggcccgcgaggugaacucccaggaggaggaggaggaggagcugcuccggaaggcgaucgccgagagccugaacuccugccgccccagcgacgccuccgccacccggagccgcccccuggcgacgggccccuccagccagucccaccaggagaagaccaccgacagcgggcucaccgagggcaucuggcagcuggucccgcccucccuguucaaggggagccacaucagccagggcaacgaggccgaggagcgggaggagcccugggaccacacggagaagaccgaggaggagcccguguccggcagcuccgggagcugggaccaguccagccagccgguguucgagaacgucaacgugaaguccuucgaccgcugcaccggccacagcgccgagcacacccagugcgggaagccccaggaguccacgggccgggggagcgccuuccucaaggccgugcagggcuccggcgacaccagccgccacugccugcccacccuggcggacgccaaggggcuccaggacaccggcgggacggucaacuacuucuggggcauccccuucugcccggacggcguggaccccaaccaguacaccaaggugauccugugccagcuggaggucuaccagaagucccucaagauggcccagcggcagcugcugaacaagaagggguucggcgagcccgugcucccccgcccgcccagccugauccagaacgagugcgggcagggcgagcaggccuccgagaagaacgagugcaucagcgaggacaugggggacgaggacaaggaggagcggcaggagucccgcgccagcgacuggcacuccaagaccaaggacuuccaggagagcagcaucaagucccugaaggagaagcuccugcuggaggaggagcccaccacgagccacggccaguccagccagggcaucguggaggagaccuccgaggaggggaacagcguccccgcgucccagagcguggccgcccucaccuccaagcggagccuggugcugaugccggaguccagcgccgaggagaucaccgucugccccgagacgcagcucuccagcuccgagaccuucgaccuggagcgcgaggugagccccggcucccgcgacauccuggacggggugcggaucaucauggccgacaaggaggucggcaacaaggaggacgcggagaaggagguggccaucagcaccuucagcuccagcaaccaggucuccugcccccucugcgaccagugcuucccgcccaccaagaucgagcgccacgccauguacugcaacgggcugauggaggaggacacggugcugacccggcgccagaaggaggccaagaccaagagcgacuccggcaccgccgcgcagacgagccucgacaucgacaagaacgagaagugcuaccugugcaagucccuggugcccuuccgggaguaccagugccacgucgacagcugccuccagcuggccaaggccgaccagggcgacgggcccgagggcuccgggcgcgccugcagcaccguggagggcaaguggcagcagcggcugaagaacccgaaggagaaggggcacuccgagggccgccuccugagcuuccuggagcaguccgagcacaagaccagcgacgcggacaucaaguccagcgagaccggcgccuuccgggugcccucccccgggauggaggaggccggcugcagccgcgagaugcaguccagcuucacgcggcgcgaccucaacgagagcccggucaaguccuucgugagcaucuccgaggccaccgacugccugguggacuucaagaagcaggucaccgugcagcccgggagccggacccgcaccaaggccggccggggccgccggcgcaaguucuga

SEQ ID NO: 38438 - RNA, 735 nt, Artificial Sequence
  derived and/or modified sequence opt1 from ULBP1__Homo_sapiens__NP_079494
auggccgccgcggccagccccgccuuccugcucugccugccgcugcuccaccuccuguccggcuggagccgcgccggguggguggacacccacugccugugcuacgacuucaucaucacccccaagucccggcccgagccccaguggugcgagguccagggccugguggacgagcgcccguuccugcacuacgacugcgugaaccacaaggccaaggcguucgccagccucgggaagaaggucaacgugacgaagaccugggaggagcagaccgagacccugcgggacguggucgacuuccugaagggccagcuccuggacauccagguggagaaccugauccccaucgagccccucacgcugcaggcccgcauguccugcgagcacgaggcccacgggcacggccggggcagcuggcaguuccuguucaacgggcagaaguuccuccuguucgacuccaacaaccgcaaguggaccgcgcugcaccccggcgccaagaagaugaccgagaagugggagaagaaccgggacgugaccauguucuuccagaagaucagccucggggacugcaagauguggcuggaggaguuccugauguacugggagcagaugcucgacccgacgaagccgcccucccuggcccccggcaccacccagcccaaggccauggccaccacgcugagccccuggucccuccugaucaucuuccugugcuucauccucgcggggcgcuga

SEQ ID NO: 38439 - RNA, 741 nt, Artificial Sequence
  derived and/or modified sequence opt1 from ULBP2__Homo_sapiens__NP_079493
auggccgccgcggccgccaccaagauccugcucugccugccccugcuccugcugcucagcggcuggucccgcgccgggcgggccgacccgcacagccugugcuacgacaucaccgugauccccaaguuccgccccggcccccgguggugcgcgguccagggccagguggacgagaagacguuccugcacuacgacugcgggaacaagaccgugaccccggucagcccccucgggaagaagcugaacgugaccacggccuggaaggcccagaaccccgugcugcgcgaggucguggacauccucaccgagcagcugcgggacauccagcuggagaacuacacccccaaggagccgcucacccugcaggcccgcauguccugcgagcagaaggcggagggccacuccagcggcuccuggcaguucagcuucgacgggcagaucuuccuccuguucgacuccgagaagcggauguggacgaccgugcaccccggcgcccgcaagaugaaggagaagugggagaacgacaaggucguggccaugagcuuccacuacuucuccaugggggacugcaucggcuggcuggaggacuuccugauggggauggacagcacccucgagcccuccgccggcgcgccccuggccaugagcuccggcaccacgcagcugcgggccaccgccaccacccucauccugugcugccugcucaucauccugccgugcuucauccugcccgggaucuga

SEQ ID NO: 38440 - RNA, 735 nt, Artificial Sequence
  derived and/or modified sequence opt1 from ULBP3__Homo_sapiens__NP_078794
auggccgccgcggccagccccgccauccugccgcgccucgccauccugcccuaccugcuguucgacugguccggcaccgggcgggccgacgcgcacagccugugguacaacuucaccaucauccaccucccccgccacggccagcaguggugcgaggugcagucccaggucgaccagaagaacuuccucagcuacgacugcggguccgacaaggugcugagcaugggccaccuggaggagcagcucuacgccacggacgccugggggaagcagcuggagaugcugcgggaggugggccagcgccuccggcuggagcuggccgacaccgagcucgaggacuucacccccuccggcccgcugacccugcagguccgcaugagcugcgagugcgaggcggacggguacauccggggcuccuggcaguucagcuucgacgggcgcaaguuccuccuguucgacuccaacaaccggaaguggacgguggugcacgccggcgcccgccggaugaaggagaagugggagaaggacagcgggcugaccaccuucuucaagauggucuccaugcgcgacugcaagagcuggcuccgggacuuccugaugcaccgcaagaagcggcuggagcccaccgccccgcccacgauggcccccggccucgcgcagcccaaggccaucgccaccacccugucccccuggagcuuccugaucauccucugcuucauccugcccggcaucuga

SEQ ID NO: 38441 - RNA, 3153 nt, Artificial Sequence
  derived and/or modified sequence opt1 from ULK1__Homo_sapiens__NP_003556
auggagcccggccgcgggggcaccgagaccguggggaaguucgaguucagccggaaggaccugaucggccacggggccuucgccgucguguucaagggccgccaccgggagaagcacgaccucgagguggcggucaagugcaucaacaagaagaaccuggccaagucccagacgcugcucggcaaggagaucaagauccugaaggagcugaagcacgagaacaucguggcccucuacgacuuccaggagauggccaacagcguguaccuggucauggaguacugcaacgggggcgaccuggccgacuaccuccacgcgaugcgcacccuguccgaggacaccauccggcuguuccuccagcagaucgccggggccaugcgccugcugcacagcaagggcaucauccaccgggaccucaagccgcagaacauccugcuguccaaccccgccgggcgccgggcgaaccccaacagcauccgcgugaagaucgccgacuucggcuucgcccgguaccuccaguccaacaugauggccgccacccugugcggcagccccauguacauggcgccggaggugaucaugucccagcacuacgacgggaaggccgaccuguggagcaucggcacgaucgucuaccagugccucaccgggaaggcccccuuccaggccuccagcccccaggaccugcgccuguucuacgagaagaacaagacccucgugcccaccaucccgcgggagacguccgcgccccugcgccagcugcuccuggcccugcuccagcggaaccacaaggaccgcauggacuucgacgaguucuuccaccaccccuuccuggacgccagccccuccgugcgcaagagcccgcccguccccgugcccuccuacccgagcuccggcagcggcagcuccagcuccagcuccagcaccucccaccuggccagcccgcccucccucggggagaugcagcagcugcagaagacccuggccagccccgccgacaccgcgggcuuccuccacuccagccgcgacuccgggggcagcaaggacuccagcugcgacacggacgacuucgugaugguccccgcccaguuccccggggaccugguggccgaggcccccuccgccaagcccccgcccgacagccugaugugcuccggcagcagccucguggcguccgccggccuggagagccacgggcggacccccucccccagcccgcccugcuccagcucccccagcccguccggccgggccgggcccuucagcuccagccggugcggcgccuccguccccauccccgugccgacccaggugcagaacuaccagcgcaucgagcgcaaccugcagagccccacccaguuccagacgccccgguccagcgcgauccgccgguccgggagcaccagcccccucggcuucgcccgcgccuccccgagcccgcccgcccacgccgagcacggcgggguccuggcgcggaagaugucccugggcgggggccgccccuacacccccagcccccagguggggaccauccccgagcggcccggcugguccggcacgccgagcccccagggggccgagaugcgcggcgggcggagcccccgccccggcuccuccgccccggagcacagcccccggaccuccggccucgggugccgccugcacagcgcccccaaccuguccgaccuccacgugguccggcccaagcugccgaagccgcccaccgacccccugggcgccguguucagcccgccccaggcguccccgccccagcccagccacgggcugcaguccugccgcaaccuccggggcagccccaagcugcccgacuuccugcagcgcaacccccucccgcccauccuggggucccccaccaaggccguccccagcuucgacuuccccaagacgcccagcucccagaaccugcucgcccugcuggcccggcagggcguggugaugacgcccccgcgcaaccggacccuccccgaccugagcgaggucggccccuuccacgggcagccccugggcccggggcuccgccccggcgaggaccccaaggggcccuucggccgcuccuucagcaccucccggcugaccgaccugcuccugaaggccgcguucggcacccaggccccggaccccgggagcaccgagucccugcaggagaagcccauggagaucgcccccagcgccggcuucgggggcucccuccacccgggggcgcgcgccggcggcaccagcucccccagccccgugguguucacggucggguccccgcccagcggcuccaccccgccccaggggccccggacccgcauguucagcgccggccccaccggguccgccagcuccagcgcccggcaccuggugcccggccccugcagcgaggcgccggcccccgagcugcccgcccccggccacgggugcuccuucgccgacccgaucgccgcgaaccucgagggcgccgugacguucgaggcccccgaccugcccgaggagacccugauggagcaggagcacaccgagauccuccgcgggcugcgguucacccuccuguucguccagcacgugcuggagaucgccgcccugaagggcagcgcguccgaggccgccggcgggcccgaguaccagcuccaggagagcguggucgccgaccagaucucccugcugagccgcgaguggggcuucgcggagcagcucgugcuguaccugaagguggccgagcuccuguccagcgggcugcaguccgccaucgaccagauccgggccggcaagcucugccugagcuccaccgucaagcaggucgugcgccggcugaacgagcucuacaaggccagcgugguguccugccaggggcugagccugcgccuccagcgguucuuccuggacaagcagcgccugcucgaccggauccacuccaucacggcggagcgccugaucuucagccacgccgugcagaugguccaguccgccgcccuggacgagauguuccagcaccgggagggcugcgugccgcgcuaccacaaggcccuccugcugcucgagggccugcagcacaugcugagcgaccaggcggacaucgagaacgugaccaagugcaagcucugcaucgagcggcgccuguccgcccugcucaccgggaucugcgccuga

SEQ ID NO: 38442 - RNA, 3111 nt, Artificial Sequence
  derived and/or modified sequence opt1 from ULK2__Homo_sapiens__NP_001136082
auggagguggucggcgacuucgaguacagcaagcgcgaccugguggggcacggcgccuucgccguggucuuccgggggcgccaccggcagaagaccgacugggagguggcgaucaaguccaucaacaagaagaaccucagcaagucccagauccugcugggcaaggagaucaagauccucaaggagcugcagcacgagaacaucguggcccuguacgacguccaggagcuccccaacagcguguuccuggugauggaguacugcaacgggggcgaccuggccgacuaccuccaggccaagggcacccuguccgaggacacgauccgcgucuuccugcaccagaucgccgcggccaugcggauccuccacagcaaggggaucauccaccgcgaccugaagccccagaacauccugcucuccuacgccaaccggcgcaagagcuccgugagcggcauccggaucaagaucgccgacuucggguucgcgcgcuaccugcacuccaacaugauggccgccacccugugcggcagccccauguacauggcccccgaggugaucaugucccagcacuacgacgccaaggcggaccucuggagcaucgggaccgucaucuaccagugccuggugggcaagcccccguuccaggccaacagcccccaggaccugcggauguucuacgagaagaaccgcagccucaugcccuccaucccccgggagaccagcccguaccuggccaaccugcuccugggccugcuccagcgcaaccagaaggaccggauggacuucgaggccuucuucucccaccccuuccuggagcaggggcccgugaagaaguccugccccgucccggugcccauguacagcggcuccgugagcggguccagcugcggcuccagccccuccugccgcuucgccagcccgcccucccugcccgacaugcagcacauccaggaggagaaccucagcuccccgccccugggcccgcccaacuaccugcaggucagcaaggacuccgcgagcacguccagcaagaacuccagcugcgacaccgacgacuucgugcucgugccccacaacaucagcagcgaccacagcugcgacaugcccgucgggaccgccggccggcgcgccuccaacgaguuccuggugugcgggggccagugccagccgaccgugagcccccacuccgagacggcccccauccccgucccgacccagauccggaacuaccagcgcaucgagcagaaccugaccagcaccgccuccagcgggacgaacgugcacggcagcccccggagcgcggucgugcgccgcuccaacaccagccccaugggcuuccuccggccgggguccugcagccccgugcccgccgacaccgcccagaccgucggccgccggcuguccacggggagcucccgccccuacagcccgagcccccuggugggcaccauccccgagcaguucucccagugcugcugcgggcacccccagggccacgacagccggucccgcaacagcuccggcagcccggugccccaggcccagagcccccagucccuccuguccggggcccggcugcagagcgcgcccacccucaccgacaucuaccagaacaagcagaagcugcgcaagcagcacuccgacccggucugccccagccacacgggcgccggguacuccuacagcccccagcccucccggccgggcagccuggggaccucccccaccaagcaccucggcagcagcccccgcuccuccgacugguucuucaagacgccccugccgaccaucaucggcagccccaccaagaccaccgcccccuucaagauccccaagacgcaggccagcuccaaccugcucgcgcuggugacccggcacgggccggccgaggagcagagcaaggacggcaacgagccccgcgagugcgcccacugccugcuggugcagggguccgagcggcagcgcgccgagcagcagagcaaggccgucuucggccgguccgugagcaccggcaagcucuccgaccagcaggggaagacccccaucugccgccaccagggcagcacggacucccugaacaccgagcggccgauggacaucgcgcccgccggggccugcggcggggugcuggccccgcccgccggcaccgcggccagcuccaaggccguccucuucaccgugggcagcccgccccacuccgccgccgcgcccacgugcacccacauguuccugcgcacccggaccaccagcguggggcccuccaacagcggcgggucccugugcgccaugagcggccgcgucugcgugggguccccgcccggccccggcuucgggagcuccccgcccggcgccgaggccgcgcccucccuccgcuacgugcccuacggggccuccccgcccucccuggagggccugaucacguucgaggcccccgagcuccccgaggagacccugauggagcgggagcacaccgacacccugcgccaccucaacgucaugcugauguucacggagugcgugcuggaccucaccgccaugcgcgggggcaaccccgagcugugcaccagcgccgugucccuguaccagauccaggagagcgucgugguggaccagaucucccagcucagcaaggacuggggccgggucgagcagcuggugcuguacaugaaggcggcccagcuccuggccgccucccugcaccucgccaaggcgcagaucaagagcgggaagcugucccccagcaccgccgugaagcaggucgugaagaaccugaacgagcgguacaaguucugcaucacgaugugcaagaagcucaccgagaagcugaaccgcuucuucuccgacaagcagcgguucaucgacgagaucaacagcgugaccgccgagaagcugaucuacaacugcgccgucgagauggugcaguccgccgcgcucgacgagauguuccagcagaccgaggacaucguguaccgcuaccacaaggccgcccugcugcucgagggccugagccggauccugcaggaccccgccgacaucgagaacguccacaaguacaagugcuccaucgagcgccggcucagcgcgcugugccacuccacggccaccguguga

SEQ ID NO: 38443 - RNA, 1419 nt, Artificial Sequence
  derived and/or modified sequence opt1 from ULK3__Homo_sapiens__NP_001092906
auggccggccccggguggggcccgccccgccuggacggguucauccucaccgagcggcugggcagcgggaccuacgccacgguguacaaggcguacgccaagaaggacacccgcgaggucguggccaucaagugcguggccaagaagucccugaacaaggccagcgucgagaaccuccugaccgagaucgagauccugaagggcauccggcacccccacaucgugcagcucaaggacuuccagugggacuccgacaacaucuaccugaucauggaguucugcgcgggcggggaccugagccgcuucauccacacccggcgcauccuccccgagaagguggcccgggucuucaugcagcagcuggccuccgcccugcaguuccuccacgagcgcaacaucagccaccuggaccugaagccccagaacauccuccuguccagccuggagaagccccaccucaagcuggcggacuucggcuucgcccagcacaugucccccugggacgagaagcacgugcugcgggggagcccccucuacauggccccggagauggugugccagcgccaguacgacgcccgggucgaccugugguccaugggcgugauccuguacgaggcccucuucgggcagccgcccuucgcgagccgcuccuucagcgagcuggaggagaagauccgguccaaccgcgugaucgagcugccccuccggccccugcugagccgcgacugccgggaccuccugcagcgccugcucgagcgggaccccucccgccggaucagcuuccaggacuucuucgcccaccccugggucgaccuggagcacaugcccuccggcgagagccugggccgcgccacggcccucguggugcaggccgucaagaaggaccaggagggggacagcgcggccgcccugucccuguacugcaaggcccucgacuucuucgugccggcccugcacuacgagguggacgcgcagcgcaaggaggccaucaaggccaaggucggccaguacgugagccgggccgaggagcugaaggccaucguguccagcuccaaccaggcgcuccugcgccaggggaccagcgcccgggaccugcuccgcgagauggcccgggacaagccccgccugcuggccgcgcucgaggucgccuccgccgccauggccaaggaggaggcggccggcggcgagcaggacgcccuggaccuguaccagcacagccugggggagcuccugcugcuccuggccgccgagccgcccggccggcgccgggagcugcuccacaccgaggugcagaaccugauggcgcgcgccgaguaccugaaggagcaggucaagaugcgggagucccgcugggaggccgacacccucgacaaggaggggcugagcgaguccgugcggagcuccugcacgcugcaguga

SEQ ID NO: 38444 - RNA, 3828 nt, Artificial Sequence
  derived and/or modified sequence opt1 from ULK4__Homo_sapiens__NP_060356
auggagaacuucauccuguacgaggagaucggccgcgggagcaagaccguggucuacaagggccggcgcaaggggaccaucaacuucguggccauccucugcacggacaagugcaagcggcccgagaucaccaacugggugcgccugacccgggagaucaagcacaagaacaucgucaccuuccacgagugguacgagacguccaaccaccuguggcucgugguggagcugugcaccggcgggagccugaagaccgucaucgcccaggacgagaaccucccggaggacguggugcgcgaguucggcaucgaccugaucuccggccugcaccaccuccacaagcuggggauccuguucugcgacaucagcccccggaagauccuccuggagggccccgggacccugaaguucuccaacuucugccucgcgaaggucgagggcgagaaccuggaggaguucuucgcccugguggccgccgaggagggcgggggcgacaacggggagaacgugcucaagaaguccaugaagucccgcgucaagggcagccccguguacacggccccggaggugguccgcggggcggacuucuccaucagcuccgaccuguggagccugggcugccuccuguacgagauguucuccggcaagccgcccuucuucagcgaguccaucagcgagcugaccgagaagauccucugcgaggacccccugccgcccauccccaaggacuccagccggcccaaggccuccagcgacuucaucaaccugcucgacgggcugcugcagcgggacccccagaagcgccucaccuggacccggcugcugcagcacagcuucuggaagaaggccuucgccggcgcggaccaggaguccagcguggaggaccucucccugagccgcaacacgauggagugcuccgggccccaggacagcaaggagcugcuccagaacucccagagccggcaggccaagggccacaaguccgggcagccccugggccacagcuuccgccuggagaaccccaccgaguuccggccgaaguccacccucgagggccagcugaacgagagcauguuccugcucuccagccgccccacgccccggaccuccaccgccguggaggucagccccggggaggacaugacccacugcuccccgcagaagaccagcccccugacgaagaucaccuccggccaccugagccagcaggaccucgagagccagaugcgcgagcugaucuacaccgacuccgaccugguggugacccccaucaucgacaaccccaagaucaugaagcagccgcccgucaaguucgacgccaagauccuccaccuccccacguacagcguggacaagcugcuguuccugaaggaccaggacuggaacgacuuccugcagcaggucugcucccagaucgacagcaccgagaaguccaugggggccagccgggcgaagcugaaccuccugugcuaccugugcgugguggccggccaccaggaggucgccacccgccuccugcacagcccccuguuccagcuccugauccagcaccuccgcaucgccccgaacugggacauccgggccaagguggcgcacgugaucgggcugcuggccagccacaccgccgagcugcaggagaacacgcccgucguggaggccaucgugcuccugaccgagcugauccgcgagaacuuccggaacuccaagcucaagcagugccugcugcccacccucggcgagcugaucuaccuggucgccacccaggaggagaagaagaagaacccgcgcgagugcugggcggugccccucgccgccuacacggugcugaugcggugccugcgcgagggcgaggagcgggucgugaaccacauggccgccaagaucaucgagaacgugugcaccaccuucagcgcgcagucccagggguucaucaccggcgagaucgggcccauccucugguaccuguuccgccacagcacggccgacucccugcggaucaccgccgucagcgcccucugccgcaucacccggcacucccccaccgcguuccagaacgugaucgagaaggugggccugaacagcgucaucaacucccuggccagcgccaucugcaaggugcagcaguacaugcucacccuguucgccgccaugcugagcugcgggauccaccuccagcgccugauccaggagaagggcuucguguccacgaucauccggcugcucgacagcccguccacgugcauccgcgcgaaggccuuccugguccugcucuacauccugaucuacaaccgggagaugcugcuccugagcugccaggcccgccuggugauguacaucgagcgggacucccgcaagaccacccccggcaaggagcagcagagcgggaacgaguaccucuccaagugccuggaccugcucaucugccacaucgugcaggagcugccccggauccugggcgacauccucaacagccuggccaacgucuccgggcgcaagcaccccagcaccguccaggugaagcagcugaagcucugccugccgcugaugcccguggugcuccaccuggugaccucccaggucuuccgcccccagguggugaccgaggaguuccuguucagcuacggcaccauccucucccacaucaagagcgucgacuccggcgagacgaacaucgacggggccaucggccugaccgcgagcgaggaguucaucaagaucacccuguccgccuucgaggccaucauccaguaccccauccuccugaaggacuaccggagcaccgugguggacuacauccugccgccccucgucucccuggugcagagccagaacguggaguggcgccuguucagccuccggcugcuguccgagacgaccagccuccuggucaaccaggaguucggggacggcaaggagaaggccuccguggacagcgacuccaaccugcucgcccugauccgcgacgugcugcucccccaguacgagcacauccugcuggagcccgacccgguccccgcguacgcccucaagcugcugguggccaugaccgagcacaaccccaccuucacgcggcucguggaggagagcaagcugaucccccugaucuucgaggucacccucgagcaccaggaguccauccuggggaacaccaugcagagcgugaucgcccugcucuccaaccugguggcgugcaaggacagcaacauggagcugcuguacgagcagggccucgucucccacaucugcaaccugcugaccgagacggccacccucugccuggacguggacaacaagaacaacaacgagauggccgccccgcuccuguucagccugcuggacauccuccacuccaugcugaccuacaccagcggcaucgugcgccuggcccuccaggcgcagaaguccgggagcggcgaggacccccaggccgccgaggaccugcugcuccugaaccggccccugacggaccucaucucccugcugaucccccuccugccgaacgaggaccccgagaucuucgacgucagcuccaagugccugagcauccucgugcagcuguacgggggcgagaaccccgacagccuguccccggagaacguggagaucuucgcccaccuccugaccagcaaggaggaccccaaggagcagaagcugcuccugcgcauccugcggcgcaugaucaccuccaacgagaagcaccucgagagccugaagaacgccgggucccugcuccgggcgcuggagcgccuggcccccggcagcggcuccuucgccgacagcgccgucgcgccccucgcccuggagauccugcaggccguggggcacuga

SEQ ID NO: 38445 - RNA, 1923 nt, Artificial Sequence
  derived and/or modified sequence opt1 from UMOD__Homo_sapiens__NP_001008390
augggccagcccagccugaccuggaugcucaugguggucguggccuccugguucaucaccacggccgcgaccgacaccagcgaggcccgcuggugcuccgagugccacagcaacgcgaccugcacggaggacgaggccgugacgaccugcacgugccaggagggguucaccggcgacgggcugaccugcgucgaccuggacgagugcgccauccccggcgcccacaacugcuccgccaacagcuccugcgugaacacccccgggagcuucuccugcgugugccccgagggcuuccggcucagccccggccuggggugcaccgacgucgacgagugcgccgagccgggccugucccacugccacgcccucgcgaccugcgugaacguggucgggagcuaccugugcgugugccccgccggcuaccgcggggacggcuggcacugcgagugcucccccggcagcugcgggcccggccuggacugcgugccggagggggacgcccucgucugcgccgaccccugccaggcccaccggacccuggacgaguacuggcgcuccaccgaguacggcgagggcuacgcgugcgacaccgaccugcgggggugguaccgcuucgugggccagggcggggcccggauggccgagacgugcgugcccguccuccgcugcaacaccgccgcccccauguggcugaacgggacccacccgagcuccgacgagggcaucgugagccggaaggcgugcgcccacugguccggccacugcugccugugggacgccagcgugcaggucaaggccugcgccgggggcuacuacguguacaaccucaccgcgccgcccgagugccaccuggccuacugcacggaccccagcuccguggaggggaccugcgaggagugcagcaucgacgaggacugcaaguccaacaacggccgcuggcacugccagugcaagcaggacuucaacaucaccgacaucagccugcucgagcaccggcuggagugcggggccaacgacaugaaggucucccugggcaagugccagcucaagagccugggcuucgacaagguguucauguaccuguccgacagccgcugcuccggguucaacgaccgggacaaccgcgacugggugagcgucgugacccccgcccgggacggccccugcgggacgguccucacccgcaacgagacccacgccaccuacuccaacacgcuguaccuggcggacgagaucaucauccgggaccucaacaucaagaucaacuucgccugcagcuacccccuggacaugaaggugucccugaagaccgcccuccagcccauggugagcgcccugaacauccgcgucggcgggaccggcauguucaccgugcggauggcgcuguuccagacgccguccuacacccagcccuaccagggcagcuccgugacccucagcaccgaggccuuccuguacgucgggacgaugcuggacggcggggaccucucccgcuucgcccugcugaugaccaacugcuacgccacccccagcagcaacgccaccgacccccucaaguacuucaucauccaggaccggugcccgcacacccgcgacuccacgauccaggugguggagaacggcgagagcucccagggccgcuucagcguccagauguuccgguucgcggggaacuacgaccugguguaccugcacugcgagguguaccucugcgacaccaugaacgagaagugcaagccgaccugcuccggcacccgcuuccggagcggguccgucaucgaccagagccgcgugcugaaccugggccccaucacgcggaagggggugcaggccaccgucucccgcgccuucagcucccucggccugcugaagguguggcucccccugcugcugagcgccacccucacccugacguuccaguga

SEQ ID NO: 38446 - RNA, 3957 nt, Artificial Sequence
  derived and/or modified sequence opt1 from UMODL1__Homo_sapiens__NP_001004416
augcugcgcaccagcggccucgcccugcuggcccucguguccgcggucgggcccagccaggccuccggcuucaccgagaaggggcugagccugcucggcuaccagcugugcucccaccgggugacgcacaccgugcagaaggucgaggccgugcagaccagcuacaccuccuacgugagcugcgggggcuggaucccguggcgccggugccccaagauggucuaccgcacgcaguaccuggugguggagguccccgagucccggaacgugaccgacugcugcgagggcuacgagcagcucgggcuguacugcgugcugccccucaaccagagcggccaguucaccucccgcccgggggccugccccgccgagggccccgagcccagcaccuccccgugcagccuggacaucgacugccccgggcuggagaagugcugccccugguccggcggccgguacugcauggcgcccgccccgcaggcccccgagcgcgaccccgucgggagcugguacaacgugacgauccucgugaagauggacuucaaggagcugcagcaggucgacccccggcugcucaaccacaugcgccugcugcacucccucgugaccagcgcccugcagccgauggcguccaccgugcaccaccuccacagcgcccccggcaacgccagcaccacggucucccggcugcugcuggggcucccccgcccccugccgguggccgacgugagcacccugcucggcgacaucgccaagcgggucuacgaggugaucuccgugcagguccaggacgugaacgagugcuucuacgaggagcugaacgcgugcagcggccgcgagcugugcgccaaccucgagggguccuacuggugcgucugccaccaggaggcccccgccaccagcccccggaagcugaaccuggagugggaggacugcccgcccguguccgacuacgugguccucaacgugaccagcgacuccuuccaggugagcuggcgccugaacuccacgcagaaccacaccuuccacguccggguguaccgcggcauggagcugcuccggagcgcccgcacccagucccaggcgcuggccguggccgggcuggaggccggcguccucuaccgggugaagaccagcuaccaggggugcggcgccgacguguccacgacccugaccaucaagaccaacgcgcaggucuucgaggugacgaucaagaucgugaaccacaaccugaccgagaagcuccugaaccgcagcuccgucgaguaccaggacuucagccgccagcugcuccacgagguggaguccagcuucccgcccguggucagcgaccuguaccgguccggcaagcugcgcaugcagaucgugagccugcaggccggguccguggucgugcggcucaagcugaccgugcaggaccccggcuuccccauggggaucagcacccuggcccccauccuccagccccugcuggccuccacggucuuccagaucgaccgccagggcacccgggugcaggacugggacgagugcguggacagcgccgagcacgacugcuccccggcggccuggugcaucaaccucgaggggagcuacacgugccagugccgcaccacccgggacgccacccccucccgcgccggccgggcgugcgagggcgaccuggucagccccaccgggggcgggcuguccgccgccaccggcgugacggugcccgggcucggcaccggcaccgccgcccuggggcuggagaacuucacccucagcccgucccccggcuacccccaggggacccccgcggccggccaggccuggacgccggagcccagcccccgccggggcggguccaacgucgugggcuacgaccgcaacaacaccgggaagggcguggagcaggagcugcaggggaacagcaucauggagcccccguccuggcccagccccaccgaggaccccaccggccacuuccuguggcacgccacgcggagcacccgcgagacccuccugaacccgaccuggcugcggaacgaggacuccggccccagcggguccgucgaccucccccugacgagcacccugaccgcccucaagacccccgcgugcgugccgguguccaucggccgcaucauggucagcaacgugacguccaccggguuccaccuggccugggaggccgaccuggccauggacagcaccuuccagcucacccugacguccauguggagccccgccgugguccuggagaccuggaacaccuccgugacccucagcggccuggagcccggggugcugcaccucgucgagaucauggcgaaggccugcggcaaggagggcgcccgggcccaccugaaggugcgcacggcggcccggaagcugaucgggaaggugcgcaucaagaacguccgcuacuccgagagcuuccggaacgccuccagccaggaguaccgcgacuuccucgagcuguucuuccggauggugcgcggcucccugcccgccaccaugugccagcacauggacgccgggggcgugcggauggaggucgugagcgugaccaacggguccaucgucguggaguuccaccuccugaucaucgcggacgucgacgugcaggaggugagcgccgccuuccugaccgccuuccagacggucccgcuccuggaggugauccgcggcgacaccuucauccaggacuacgacgagugcgagcggaaggaggacgacugcgugcccggcaccagcugccgcaacacccugggguccuucacgugcagcugcgagggcggggcccccgacuucccggucgaguacuccgagcggcccugcgagggcgacagccccgggaacgagaccugggcgaccucccccgagcgcccgcucaccacggccggcaccaaggccgccuucgugcagggcaccagccccacgccccaggggcugccccagcggcugaaccucaccggcgccgugcgcguccugugcgagaucgagaaggugguggucgcgauccagaagcgguuccugcagcaggaguccaucccggagagcucccucuaccugagccaccccuccugcaacgugagccacuccaacgggacccacgugcugcucgaggccggcuggagcgagugcggcacccugaugcaguccaacaugaccaacaccgucgugcgcacgacccugcggaacgaccucagccaggaggggaucauccaccaccugaagauccugucccccaucuacugcgccuuccagaacgaccuccugaccagcuccggcuucacccuggaguggggcguguacacgaucaucgaggaccuccacggggccgggaacuucgucaccgagaugcagcuguucaucggcgacagccccaucccgcagaacuacagcguguccgcgagcgacgacgugcgcaucgaggucggccuguaccggcagaaguccaaccucaagguggugcugaccgagugcugggccacccccagcuccaacgcccgcgaccccaucacguucagcuucaucaacaacuccugccccgucccgaacaccuacaccaacgugaucgagaacgggaacagcaacaaggcccaguucaagcugcggaucuucuccuucaucaacgacagcaucguguaccuccacugcaagcugcgcgucugcauggagucccccggcgcgaccugcaagaucaacugcaacaacuuccggcugcuccagaacagcgagacguccgccacccaccagaugagcugggggccccugauccgcuccgagggcgagcccccgcacgccgaggccgggcugggcgccggcuacguggugcucaucgucguggccaucuucgugcuggucgcggggaccgccacccugcucaucgugcgcuaccagcggaugaacggccgcuacaacuucaagauccagagcaacaacuucuccuaccagguguucuacgaguga

SEQ ID NO: 38447 - RNA, 1443 nt, Artificial Sequence
  derived and/or modified sequence opt1 from UMPS__Homo_sapiens__NP_000364
auggccguggcccgcgcggcccugggcccccucgucaccgggcuguacgacgugcaggccuucaaguucggcgacuucgugcugaaguccgggcucuccagcccgaucuacaucgaccugcggggcaucgucucccgcccccggcugcucagccagguggccgacauccuguuccagaccgcccagaacgcggggaucuccuucgacacggugugcggcguccccuacaccgcccugccccucgccaccgugaucugcagcaccaaccagaucccgaugcugauccgccggaaggagacgaaggacuacggcaccaagcgccugguggaggggaccaucaaccccggcgagaccugccucaucaucgaggacgucgugacguccgggagcuccgugcuggagaccgucgaggugcugcagaaggagggccucaaggugaccgacgccaucguccugcuggaccgggagcagggcgggaaggacaagcuccaggcgcacggcauccgccugcacagcgugugcacccuguccaagaugcucgagauccuggagcagcagaagaagguggacgccgagacggucgggcgggugaagcgcuucauccaggagaacguguucgucgccgccaaccacaacggcagcccccuguccaucaaggaggcccccaaggagcucagcuucggggcgcgggccgagcugccgcgcauccaccccguggccuccaagcugcuccggcugaugcagaagaaggagaccaaccugugccucagcgccgacgugucccuggcccgcgagcugcuccagcuggcggacgcccugggccccagcaucugcaugcucaagacccacgucgacauccugaacgacuucacccuggacgugaugaaggagcucaucacgcuggccaagugccacgaguuccugaucuucgaggaccggaaguucgccgacaucggcaacaccgucaagaagcaguacgagggcgggaucuucaagaucgccuccugggcggaccucgugaacgcccacgugguccccgggagcggcguggugaaggggcugcaggaggucggccugccgcuccaccgcggcugccugcugaucgccgagaugagcuccaccgggagccucgccaccggcgacuacacgcgggccgcggugcgcauggccgaggagcacuccgaguucguggucggguucaucagcggcucccgggugagcaugaagcccgaguuccugcaccugacccccggggugcagcuggaggccggcggcgacaaccucgggcagcaguacaacagcccccaggaggucaucggcaagcgcgggagcgacaucaucaucgugggccgggggaucaucuccgccgcggaccgccuggaggccgccgagauguaccgcaaggccgccugggaggcguaccugagccggcucggcguguga

SEQ ID NO: 38448 - RNA, 723 nt, Artificial Sequence
  derived and/or modified sequence opt1 from UNC119__Homo_sapiens__NP_005139
augaaggugaagaagggcgggggcggggccggcaccgccaccgagagcgcgcccgggccguccggccagagcgucgcccccaucccccagcccccggccgaguccgagagcggcuccgagagcgagcccgacgccgggcccggcccccgcccggggccccugcagcggaagcagcccaucggccccgaggacgugcucgggcugcagcgcaucaccggcgacuaccugugcuccccggaggagaacaucuacaagaucgacuucgugcgguucaagauccgcgacauggacagcggcaccguccucuucgagaucaagaagccgcccguguccgagcggcugcccaucaaccgccgggaccuggaccccaacgccgggcgcuucgugcgguaccaguucacccccgcguuccuccgccugcggcaggucggcgccaccguggaguucacggugggggacaagcccgucaacaacuuccgcaugaucgagcggcacuacuuccgcaaccagcugcucaagagcuucgacuuccacuucggcuucugcauccccuccagcaagaacacgugcgagcacaucuacgacuucccgccccuguccgaggagcugaucagcgagaugauccggcaccccuacgagacccaguccgacagcuucuacuucguggacgaccgccucgugaugcacaacaaggccgacuacuccuacagcggcacccccuga

SEQ ID NO: 38449 - RNA, 5112 nt, Artificial Sequence
  derived and/or modified sequence opt1 from UNC13A__Homo_sapiens__NP_001073890
augucccugcucugcgugggcgucaagaaggccaaguucgacggggcccaggagaaguucaacaccuacgugacccugaaggugcagaacgucaaguccaccaccaucgcggugcgcggcagccagcccuccugggagcaggacuucauguucgagaucaaccgccuggaccucgggcugaccguggaggucuggaacaagggccugaucugggacaccaugguggggacgguguggaucccccuccgcaccauccggcagagcaacgaggagggccccggcgaguggcugacccuggacucccaggucaucauggccgacagcgagaucugcgggaccaaggaccccacguuccaccgcauccuccuggacacccgguucgagcugccccucgacauccccgaggaggaggcccgcuacugggccaagaagcuggagcagcugaacgccaugcgggaccaggacgaguacuccuuccaggacgagcaggacaagccccuccccgugcccagcaaccagugcugcaacuggaacuacuucggcuggggcgagcagcacaacgacgacccggacuccgcgguggacgaccgcgacagcgacuaccgguccgagaccagcaacuccaucccgccgcccuacuacaccacgagccagcccaacgccuccguccaccaguacagcgugcggccgccgccccucggcucccgggagagcuacuccgacagcaugcacagcuacgaggaguucuccgagccccaggcccugagccccaccggguccagccgcuacgccuccagcggcgagcucucccagggcagcucccagcugagcgaggacuucgaccccgacgagcacucccugcaggggagcgacauggaggacgagcgggaccgcgacuccuaccacagcugccacuccagcguguccuaccacaaggacagcccccggugggaccaggacgaggaggagcucgaggaggaccuggaggacuuccuggaggaggaggagcucccggaggacgaggaggagcuggaggaggaggaggaggagguccccgacgaccugggcuccuacgcgcagcgcgaggacguggccguggccgagcccaaggacuucaagcggaucagccugccgcccgccgcccccgggaaggaggacaaggcgcccgucgcccccaccgaggcccccgacauggccaagguggcccccaagcccgcgaccccggacaaggugcccgccgccgagcagauccccgaggccgagcccccgaaggacgaggagagcuuccgcccccgggaggacgaggagggccaggagggccaggacuccaugagccgcgccaaggcgaacuggcugcgggccuucaacaagguccgcaugcagcugcaggaggcccgcggggagggcgagauguccaagagccucugguucaagggcgggcccgggggcgggcugaucaucaucgacuccaugcccgacauccggaagcgcaagccgaucccccuggugagcgaccucgccaugucccuggugcagagccggaaggccgggaucacguccgcgcuggccagcuccacccucaacaacgaggagcugaagaaccacgucuacaagaagacccugcaggcccucaucuaccccaucagcugcaccacgccccacaacuucgagguguggaccgccaccaccccgacguacugcuacgagugcgagggccugcugugggggaucgcgcgccagggcaugcggugcaccgagugcggggucaagugccacgagaagugccaggaccuccugaacgccgacugccugcagcgcgccgccgagaaguccagcaagcacggcgccgaggaccggacccagaacaucaucauggugcucaaggaccgcaugaagauccgggagcgcaacaagcccgagaucuucgagcugauccaggagaucuucgcggugaccaagacggcccacacccagcagaugaaggccgucaagcaguccgugcuggacggcaccagcaagugguccgccaagaucagcaucaccguggucugcgcccaggggcuccaggcgaaggacaagacgggcagcuccgaccccuacgugaccgugcaggucgggaagaccaagaagcggaccaagacgaucuacggcaaccugaaccccgugugggaggagaacuuccacuucgagugccacaacagcuccgaccgcaucaaggugcgggucugggacgaggacgacgacaucaagagccgcgugaagcagcgguucaagcgcgaguccgacgacuuccuggggcagaccaucaucgaggugcggacccugagcggcgagauggacgucugguacaaccucgacaagcgcaccgacaaguccgccgugagcggcgccauccggcugcacaucuccguggagaucaagggggaggagaaggucgccccguaccacgugcaguacacgugccugcacgagaaccucuuccacuucgugacggacguccagaacaacggcguggugaagauccccgacgccaagggggacgacgcguggaaggucuacuacgacgagaccgcccaggagaucguggacgaguucgccaugcgcuacggcguggagagcaucuaccaggccaugacccacuucgcgugccuguccagcaaguacaugugccccggcguccccgccgugauguccacccugcucgccaacaucaacgccuacuacgcccacacgaccgcgagcaccaacguguccgccagcgaccgcuucgccgccuccaacuucgggaaggagcgguucgucaagcugcuggaccagcuccacaacagccugcgcaucgaccuguccauguaccggaacaacuucccggccagcagccccgagcgccuccaggaccugaaguccaccguggaccugcucacgagcaucaccuucuuccggaugaaggugcaggagcugcagagcccgccccgcgcgagccaggucgugaaggacugcgugaaggccugccugaacuccaccuacgaguacaucuucaacaacugccacgagcucuacagccgggaguaccagaccgacccggccaagaagggcgagguccugcccgaggagcaggggcccuccaucaagaaccuggacuucuggagcaagcucaucacgcugaucguguccaucaucgaggaggacaagaacagcuacaccccgugccugaaccaguucccccaggagcucaacgugggcaagaucuccgccgaggucauguggaaccuguucgcccaggacaugaaguacgcgauggaggagcacgacaagcaccgccugugcaagagcgccgacuacaugaaccuccacuucaaggugaaguggcuguacaacgaguacgugaccgagcugcccgccuucaaggaccggguccccgaguacccggccugguucgagcccuucgugauccaguggcucgacgagaacgaggaggugucccgcgacuuccugcacggggcgcuggagcgggacaagaaggacggcuuccagcagaccagcgagcacgcccucuucuccugcagcgucguggacguguucucccagcugaaccagagcuucgagaucaucaagaagcuggagugccccgacccccagaucgucggccacuacaugcgccgguucgccaagacgaucuccaacgugcuccugcaguacgccgacaucaucagcaaggacuucgccagcuacugcuccaaggagaaggagaaggugccgugcauccugaugaacaacacccagcagcuccgcguccagcuggagaagauguucgaggcgaugggcgggaaggagcuggacgccgaggccagcgacauccucaaggagcuccaggugaagcugaacaacguccucgacgagcugucccggguguucgccaccagcuuccagccccacaucgaggagugcgugaagcagaugggggacauccugucccaggucaagggcaccgggaacgugcccgccagcgcgugcuccagcguggcccaggacgccgacaacguccuccagcccaucauggaccugcuggacuccaaccucacgcuguucgccaagaucugcgagaagaccgugcugaagcgcgugcucaaggagcuguggaagcuggucaugaacaccauggagaagaccaucgugcucccgccccugacggaccagaccaugaucggcaaccugcuccggaagcacggcaaggggcuggagaagggccgcgugaagcugcccagccacuccgacgggacccagaugaucuucaacgccgcgaaggagcucggccagcugagcaagcugaaggaccacaugguccgggaggaggccaagucccucacccccaagcagugcgccgugguggagcuggcccuggacacgaucaagcaguacuuccacgccgggggcgucggccucaagaagaccuuccuggagaaguccccggaccugcagagccuccgcuacgcgcugagccuguacacccaggccaccgaccuccugaucaagacguucgugcagacccaguccgcccaggggcugggcguggaggaccccgucggggaggugagcgugcacgucgagcuguucacccaccccggcaccggggagcacaaggugacggugaaggucguggccgcgaacgaccugaaguggcagaccuccggcaucuuccggcccuucaucgaggugaacaucaucggcccgcagcugagcgacaagaagcgcaaguucgccaccaagagcaagaacaacuccugggcccccaaguacaacgagagcuuccaguucacccucuccgccgacgccgggcccgagugcuacgagcugcaggucugcgugaaggacuacugcuucgcgcgcgaggaccggaccgugggccuggccguccuccagcugcgcgagcuggcccagcgggggagcgccgccugcuggcucccccugggccgccggauccacauggacgacacgggccugaccgugcuccgcauccugucccagcggagcaacgacgagguggcgaaggaguucgucaagcugaaguccgacacccgcagcgccgaggagggcggggccgccccggcccccuga

SEQ ID NO: 38450 - RNA, 4776 nt, Artificial Sequence
  derived and/or modified sequence opt1 from UNC13B__Homo_sapiens__NP_006368
augagccugcucugcgugcgcgucaagcgggccaaguuccagggcucccccgacaaguucaacaccuacgugacccugaaggugcagaacgucaagagcacgaccguggccgugcgcggggaccagccguccugggagcaggacuucauguucgagaucagccggcuggaccucggccuguccgucgagguguggaacaaggggcugaucugggacaccauggugggcaccgucuggaucgcgcucaagacgauccgccagagcgacgaggaggggcccggcgagugguccacccuggaggccgagacccugaugaaggacgacgagaucugcggcacccggaaccccacgccccacaagauccuccuggacacccgcuucgagcugccguucgacauccccgaggaggaggcccgguacuggaccuacaagugggagcagaucaacgcccucggggccgacaacgaguacagcucccaggaggagagccagcgcaagccccugcccaccgcggccgcccagugcuccuucgaggacccggacagcgccguggacgaccgggacuccgacuaccgcagcgagacguccaacagcuucccgccgcccuaccacaccgcgucccagcccaacgccagcgugcaccaguuccccguccccgugcggagcccccagcagcugcuccugcagggcuccagccgcgacuccugcaacgacagcaugcaguccuacgaccuggacuaccccgagcggcgcgccaucagccccaccuccagcucccgguacgggagcuccugcaacgugagccagggcuccagccagcucuccgagcuggaccaguaccacgagcaggacgacgaccaccgcgagaccgacagcauccacuccugccacagcucccacagccugucccgggacgggcaggccggcuucggcgagcaggagaagccccucgaggucacggggcaggccgagaaggaggcggccugcgagcccaaggagaugaaggaggacgccaccacccacccgccgcccgaccuggugcugcagaaggaccacuuccucggcccccaggagagcuuccccgaggagaacgccagcucccccuucacccaggcccgcgcgcacuggauccgggccgugacgaagguccgccugcagcugcaggagauccccgacgacggggaccccagccucccgcaguggcugcccgagggccccgccggcgggcuguacggcaucgacuccaugccggaccuccggcgcaagaagccccugccccuggugagcgaccucucccuggugcagagccgcaaggccgggaucaccuccgccauggcgacccggaccagccugaaggacgaggagcucaagucccacgucuacaagaagacgcugcaggcccugaucuaccccaucagcugcaccaccccgcacaacuucgagguguggaccgccacgacccccaccuacugcuacgagugcgagggccuccugugggggaucgcccgccagggcaugcggugcuccgagugcggcgugaagugccacgagaagugccaggaccugcucaacgccgacugccugcagcgcgcggccgagaaguccugcaagcacggggccgaggaccggacccagaacaucaucauggccaugaaggaccgcaugaagauccgggagcgcaacaagcccgagaucuucgaggucauccgggacguguucacggucaacaaggcggcccacgugcagcagaugaagaccgugaagcagagcguccuggacggcaccagcaagugguccgccaagaucaccaucacgguggugugcgcccaggggcuccaggccaaggacaagaccggcagcuccgaccccuacgucaccguccaggugagcaagaccaagaagcgcaccaagacgaucuucgggaaccugaacccggugugggaggagaaguuccacuucgagugccacaacagcuccgaccggaucaaggugcgcgugugggacgaggacgacgacaucaagagccgggucaagcagcgccugaagcgggaguccgacgacuuccucggccagaccaucaucgaggugcgcacccugagcggcgagauggacgugugguacaaccuggagaagcggaccgacaaguccgcggucagcggggccauccgccugcagaucuccguggagaucaagggcgaggagaagguggcccccuaccacguccaguacacgugccuccacgagaaccuguuccacuaccugaccgacauccaggggagcggcggggugcggauccccgaggcccgcggcgacgacgccuggaagguguacuucgacgagaccgcgcaggagaucgucgacgaguucgccaugcgcuacggcaucgaguccaucuaccaggccaugacccacuucgccugccucagcuccaaguacaugugccccggggugccggccgugaugagcacgcugcuggcgaacaucaacgccuacuacgcccacaccaccgccuccaccaacgucagcgcguccgaccgguucgccgccagcaacuucggcaaggagcgcuucgugaagcuccuggaccagcugcacaacucccuccggaucgaccugagcacguaccgcaacaacuuccccgccgggucccccgagcggcugcaggaccucaagagcaccguggaccugcugaccagcaucaccuucuuccgcaugaagguccaggagcuccaguccccgccccgggccagccagguggugaaggacugcgucaaggcgugccugaacuccacguacgaguacaucuucaacaacugccacgaccuguacagccgccaguaccagcucaagcaggagcugccgcccgaggagcagggccccuccauccggaaccuggacuucuggcccaagcucaucacccugaucgugagcaucaucgaggaggacaagaacuccuacacccccgugcugaaccaguucccccaggagcucaacgucggcaaggugagcgccgaggugauguggcaccuguucgcccaggacaugaaguacgcccuggaggagcacgagaaggaccaccucugcaaguccgccgacuacaugaaccugcacuucaaggucaaguggcugcacaacgaguacgugcgcgaccuccccgugcugcaggggcaggucccggaguaccccgcgugguucgagcaguucgugcugcaguggcucgacgagaacgaggacgugagccuggaguuccugcggggcgcccucgagcgcgacaagaaggacggguuccagcagaccuccgagcacgcccuguucagcugcuccgucguggacguguucacgcagcugaaccagagcuucgagaucauccggaagcucgagugccccgacccguccauccuggcccacuacaugcgccgguucgccaagaccaucggcaagguccugaugcaguacgcggacauccucagcaaggacuuccccgccuacugcaccaaggagaagcugcccugcauccugaugaacaacgugcagcagcuccgcgugcagcuggagaagauguucgaggccaugggcgggaaggagcuggaccucgaggccgcggacucccugaaggagcugcaggucaagcucaacaccgugcuggacgagcugagcaugguguucggcaacuccuuccagguccggaucgacgagugcgugcgccagauggccgacauccucgggcagguccggggcacggggaacgccagccccgacgcccgcgccagcgcggcccaggacgccgacuccgugcugcggccgcugauggacuuccucgacggcaaccugacccuguucgccaccgugugcgagaagaccguccucaagcgcgugcugaaggagcuguggcgcguggucaugaacacgauggagcggaugaucgugcucccgccccugaccgaccagaccgggacccagcugaucuucacggccgcgaaggagcucagccaccuguccaagcugaaggaccacauggugcgcgaggagacccggaaccucacccccaagcagugcgccguccuggaccuggcccucgacaccaucaagcaguacuuccacgccggcggcaacgggcugaagaagacguuccuggagaagucccccgaccuccagagccugcgcuacgcccugagccucuacacccagaccaccgacacccugaucaagacguucgugcggucccagaccacccagggcagcgggguggacgaccccgucggcgagguguccauccagguggaccuguucacccaccccgggacgggcgagcacaaggucaccgugaagguggucgcggccaacgaccucaaguggcagaccgccggcauguuccgccccuucguggaggugaccauggucgggccgcaccagagcgacaagaagcggaaguucacgaccaaguccaagagcaacaacugggcccccaaguacaacgagaccuuccacuuccugcugggcaacgaggaggggcccgaguccuacgagcuccagaucugcgugaaggacuacugcuucgcccgcgaggaccgggugcugggccuggcggucaugccccuccgcgacgugaccgccaaggggagcugcgccugcuggugcccgcugggccggaagauccacauggacgagacgggccugaccauccuccgcauccugucccagcggagcaacgacgagguggcccgcgaguucgucaagcugaaguccgagagccgguccaccgaggaggggagcuga

SEQ ID NO: 38451 - RNA, 6645 nt, Artificial Sequence
  derived and/or modified sequence opt1 from UNC13C__Homo_sapiens__NP_001074003
augguggccaacuucuucaagagccugauccuccccuacauccacaagcugugcaagggcauguucaccaagaagcuggggaacaccaacaagaacaaggaguaccggcagcagaagaaggaccaggacuuccccacggccggccagaccaagagccccaaguucagcuacaccuucaagagcaccgugaagaagaucgcgaagugcagcuccacgcacaaccucagcaccgaggaggacgaggccuccaaggaguucagccugucccccaccuucagcuaccggguggccaucgccaacgggcugcagaagaacgccaaggugaccaacuccgacaacgaggaccuccugcaggagcugagcuccaucgagagcuccuacagcgagucccucaacgagcugcggagcuccacggagaaccaggcgcagagcacccacaccaugcccguccggcgcaaccgcaagagcuccagcucccuggccccgagcgagggcuccagcgacggggagcgcacccuccacggccugaagcugggcgcccuccggaagcugcgcaaguggaagaagucccaggagugcgugagcuccgacagcgagcuguccacgaugaagaaguccugggggauccgguccaagagccucgaccgcaccgugcggaaccccaagaccaacgcccuggagcccggcuucuccagcuccgggugcaucagccagacccacgacgucauggagaugaucuucaaggagcugcagggcaucucccagaucgagacggagcucagcgagcugcgcgggcacgugaacgcgcugaagcacagcaucgacgagaucuccagcuccguggaggucgugcagagcgagaucgagcagcuccggaccggcuucgugcagucccgccgggagacccgcgacauccacgacuacaucaagcaccugggccacauggggagcaaggccucccugcgguuccucaacgucaccgaggagcgcuucgaguacguggagagcguggucuaccagauccugaucgacaagaugggcuucuccgacgcccccaacgccaucaagaucgaguucgcccagcggaucgggcaccagcgcgacugcccgaacgcgaagccccggcccauccugguguacuucgagacgccccagcagcgcgacagcgugcucaagaaguccuacaagcugaagggcaccggcaucgggaucagcaccgacauccugacccacgacauccgcgagcggaaggagaagggcaucccguccagccagacguacgaguccauggccaucaagcucagcacccccgagcccaagaucaagaagaacaacuggcagucccccgacgacagcgacgaggaccuggagagcgaccugaaccgcaacuccuacgccguccucagcaaguccgagcugcugaccaaggggagcaccuccaagccgagcuccaagagccacuccgcccggagcaagaacaagacggccaacuccagccgcaucuccaacaagagcgacuacgacaagaucuccagccagcuccccgaguccgacauccuggagaagcagaccaccacccacuacgcggacgccacgccccuguggcacagccaguccgacuucuucaccgccaagcucagccggagcgaguccgacuucagcaagcugugccaguccuacagcgaggacuucuccgagaaccaguucuucacccgcaccaacggcagcucccugcucagcuccagcgaccgggagcuguggcagcgcaagcaggaggggacggccacccuguacgacucccccaaggaccagcaccucaacggcggcgugcaggggauccagggccagaccgagaccgagaacaccgagacgguggacagcgggauguccaacggcauggucugcgccagcggggaccggucccacuacagcgacucccagcugagccugcacgaggaccuguccccguggaaggaguggaaccagggcgcggaccucggccuggacagcagcacccaggagggguucgacuacgagaccaacucccuguucgaccagcagcucgacguguacaacaaggaccuggaguaccugggcaagugccacagcgaccuccaggacgacuccgagagcuacgaccugacccaggacgacaacuccagccccugccccgggcuggacaacgagccccagggccaguggguggggcaguacgacuccuaccagggcgccaacagcaacgagcucuaccagaaccagaaccagcuguccaugauguaccgcagccaguccgagcugcagagcgacgacuccgaggacgccccgcccaagagcuggcacucccggcucagcaucgaccuguccgacaagacguucagcuuccccaaguucggcuccacccugcagcgcgccaagagcgcccucgaggucguguggaacaagagcacccagucccugagcggguacgaggacuccggcagcucccugauggggcgguuccgcacccucagccaguccacggcgaacgagagcuccaccacccuggacagcgacgucuacaccgagcccuacuacuacaaggccgaggacgaggaggacuacacggagccgguggccgacaacgagaccgacuacguggaggucauggagcagguccuggccaagcucgagaaccggaccuccaucaccgagacggacgagcagaugcaggcguacgaccaccugagcuacgagacccccuacgagacgccccaggacgagggcuacgacggcccggccgacgacaugguguccgaggaggggcuggagccccucaacgagaccagcgccgagauggagauccgcgaggacgagaaccagaacauccccgagcagcccgucgagaucacgaagccgaagcggauccgccccuccuucaaggaggccgcccugcgggcguacaagaagcagauggccgagcuggaggagaagauccucgccggcgacagcuccagcguggacgagaaggcccgcaucguguccgggaacgaccuggacgccagcaaguucagcgcgcugcaggucugcggcggggccggcggcgggcucuacggcaucgacuccaugcccgaccugcgccggaagaagacccugcccaucgugcgcgacguggccaugacccucgccgcccgcaagagcgggcugucccuggcgauggucauccgcaccagccucaacaacgaggagcugaagaugcacguguucaagaagacgcugcaggcccucaucuacccgauguccagcaccaucccccacaacuucgagguguggaccgccaccacgcccaccuacugcuacgagugcgagggccugcugugggggaucgcccggcagggcaugaagugccucgagugcggcgucaagugccacgagaagugccaggaccugcugaacgcggacugccuccagcgcgccgccgagaaguccagcaagcacggggccgaggacaagacccagaccaucaucacggccaugaaggagcggaugaagauccgcgagaagaaccggcccgagguguucgaggugauccaggagauguuccagaucuccaaggaggacuucguccaguucaccaaggcggccaagcagagcgugcuggacggcaccuccaaguggagcgccaagaucaccaucacgguggucuccgcccaggggcugcaggccaaggacaagaccggcagcuccgacccguacgugaccgugcaggucgggaagaacaagcgccggaccaagaccaucuucggcaaccucaaccccgugugggacgagaaguucuacuucgagugccacaacagcacggaccgcaucaaggugcgggucugggacgaggacgacgacaucaagucccgcgugaagcagcacuucaagaaggagagcgacgacuuccugggccagaccaucguggagguccggacccuguccggggagauggacgugugguacaaccucgagaagcgcaccgacaagagcgcggugagcggcgccauccggcugaagaucaacgucgagaucaagggggaggagaagguggcccccuaccacauccaguacacgugccugcacgagaaccucuuccacuaccugaccgaggugaaguccaacggcggggucaagauccccgaggugaagggcgacgaggccuggaagguguucuucgacgacgccagccaggagaucgucgacgaguucgcgaugcgcuacggcaucgaguccaucuaccaggccaugacccacuucagcugccuguccagcaaguacaugugcccgggggugcccgccgugauguccacccuccuggccaacaucaacgcguucuacgcccacacgaccgucagcaccaacauccagguguccgccagcgaccgguucgccgccaccaacuucggccgcgagaaguucaucaagcugcucgaccagcugcacaacucccugcggaucgaccucagcaaguaccgcgagaacuuccccgcguccaacacggagcgccugcaggaccucaagagcaccguggaccuccugaccuccaucaccuucuuccggaugaagguccuggagcuccaguccccgcccaaggccuccaugguggugaaggacugcguccgcgccugccuggacagcacguacaaguacaucuucgacaacugccacgagcuguacagccagcucaccgaccccuccaagaagcaggacaucccccgggaggaccaggggcccaccaccaagaaccuggacuucuggccgcagcugaucacgcucauggugaccaucaucgacgaggacaagaccgccuacacccccgugcugaaccaguucccccaggagcugaacaugggcaagaucagcgccgagaucauguggacccucuucgcgcuggacaugaaguacgcccuggaggagcacgagaaccagcgccucugcaaguccaccgacuacaugaaccugcacuucaaggucaagugguucuacaacgaguacgugcgggagcugccggccuucaaggacgccguccccgaguacagccucugguucgagcccuucgugaugcaguggcuggacgagaacgaggacguguccauggaguuccugcacggcgcccucgggcgcgacaagaaggacggcuuccagcagaccagcgagcacgcgcuguucuccugcagcgucguggacguguucgcccagcugaaccaguccuucgagaucaucaagaagcucgagugccccaacccggaggcccugagccaccugaugcggcgcuucgccaagaccaucaacaagguccuccugcaguacgccgcgaucguguccagcgacuucuccagccacugcgacaaggagaacgugcccugcauccugaugaacaacauccagcagcugcggguccagcucgagaagauguucgaguccaugggcgggaaggagcuggacagcgaggccuccacgauccugaaggagcuccaggugaagcugagcggggugcuggacgagcucuccgucaccuacggcgagagcuuccaggugaucaucgaggagugcaucaagcagaugagcuucgagcugaaccagaugcgcgccaacggcaacaccaccuccaacaagaacagcgccgcgauggacgccgagaucgugcugcggucccucauggacuuccuggacaagacgcugagccucuccgccaagaucugcgagaagaccguccugaagcgcgugcugaaggagcucuggaagcuggugcugaacaagaucgagaagcagaucguccugccgccccugaccgaccagaccgggccgcagaugaucuucaucgccgccaaggaccugggccagcucagcaagcugaaggagcacaugauccgggaggacgcgcgcgggcugacgccccggcagugcgccaucauggagguggugcucgccaccaucaagcaguacuuccacgccggcgggaacggccugaagaagaacuuccuggagaagucccccgaccuccagagccugcgcuacgcccugucccucuacacccagaccaccgacgcgcugaucaagaaguucaucgacacgcagaccagccagucccggagcuccaaggacgccgucggccagaucagcgugcacguggacaucaccgccacccccgggacgggcgaccacaaggucaccgugaaggugaucgccaucaacgaccugaacuggcagaccaccgccauguuccgcccguucgucgaggugugcauccucgggcccaaccugggcgacaagaagcggaagcaggggacgaagaccaaguccaacaccuggagccccaaguacaacgagaccuuccaguucauccugggcaaggagaaccgccccggcgcguacgagcuccaccuguccgugaaggacuacugcuucgcccgcgaggaccggaucaucgggaugacggucauccagcugcagaacaucgccgagaagggcagcuacggggccugguacccgcuccugaagaacaucuccauggacgagaccggccugaccauccuccgcauccugagccagcggaccagcgacgacguggcgaaggaguucgugcgccugaaguccgagacgcggagcaccgaggaguccgccuga

SEQ ID NO: 38452 - RNA, 3273 nt, Artificial Sequence
  derived and/or modified sequence opt1 from UNC13D__Homo_sapiens__NP_954712
auggccacccugcucagccacccccagcagcgcccgcccuuccugcggcaggccaucaagauccgccggcgccgggugcgcgaccugcaggacccgccgccccagauggcgcccgagauccagccgcccucccaccacuucagccccgagcagcgggcccuccuguacgaggacgcccuguacaccguccuccaccgccugggccaccccgagcccaaccacgugacggaggccuccgagcugcuccgguaccugcaggaggccuuccacguggagcccgaggagcaccagcagacccugcagcgcguccgggagcucgagaagcccaucuucugccugaaggcgaccgugaagcaggccaaggggauccugggcaaggacgugagcggguucuccgaccccuacugccuccugggcaucgagcagggggucggcgugcccggcgggagccccggcucccgccaccggcagaaggccgugguccgccacaccaucccggaggaggagacgcaccggacccaggugaucacccagacccugaaccccgugugggacgagacguucauccucgaguucgaggacaucaccaacgccagcuuccaccuggacaugugggaccuggacaccgucgaguccgugcgccagaagcucggggagcugaccgaccugcacggccuccggcgcaucuucaaggaggcgcggaaggacaaggggcaggacgacuuccugggcaacgugguccugcgccuccaggaccugcggugccgcgaggaccagugguacccccuggagccccgcacggagaccuacccggaccggggccagugccaccuccaguuccagcugauccacaagcgccgggccaccagcgccucccgcagccagcccuccuacaccgugcaccuccaccuccugcagcagcuggugagccacgaggucacgcagcacgaggccggguccaccagcugggacggcucccucagcccccaggccgcgaccgugcuguuccugcacgccacccagaaggaccucuccgacuuccaccagagcauggcccaguggcuggccuacagccggcuguaccagucccucgaguuccccagcuccugccugcugcacccgaucacgagcaucgaguaccaguggauccaggggcgccucaaggccgagcagcaggaggagcuggcggccuccuucagcucccugcucaccuacggccugagccugauccggcgcuuccgguccguguucccccugagcgucuccgacagccccgcccgccuccagucccugcugcgggugcucgugcagaugugcaagaugaaggccuucggcgagcugugccccaacaccgccccgcugccccagcucgucaccgaggcgcugcagacggggaccaccgagugguuccaccugaagcagcagcaccaccagcccauggugcagggcaucccggaggccgggaaggcccuccugggccugguccaggacgugaucggggaccuccaccagugccagcgcaccugggacaagaucuuccacaacacgcugaagauccaccuguucagcauggccuuccgggagcuccaguggcugguggccaagcgcguccaggaccacaccaccguggugggcgacgucgugucccccgagaugggcgagagccuguuccagcucuacaucucccugaaggagcugugccagcuccggaugagcuccagcgagcgcgacggggugcuggcgcuggacaacuuccaccggugguuccagcccgccauccccagcuggcuccagaagaccuacaacgaggcccuggcccgcguccagcgggcggugcagauggacgagcuggugccgcucggcgagcugacgaagcacuccaccagcgccgucgaccuguccacgugcuucgcccagaucagccacaccgcccgccagcucgacuggcccgaccccgaggaggccuucaugaucaccgugaaguucguggaggacacgugccgccuggcgcuggucuacugcucccucaucaaggcccgggcccgcgagcugagcuccgggcagaaggaccagggccaggccgccaacaugcugugcgugguggucaacgacauggagcagcuccggcuggugaucgggaagcugcccgcgcagcucgccugggaggcccuggagcagcgcgugggcgccguccuggagcagggccagcuccagaacacccugcacgcccagcugcagagcgcgcucgccgggcugggccacgagauccggaccggggugcgcacccuggccgagcagcucgaggugggcaucgccaagcacauccagaagcuggucggggugcgggaguccgugcugccggaggacgcgauccucccccugaugaaguuccuggaggucgagcucugcuacaugaacaccaaccuggugcaggagaacuucagcucccugcucacccugcuguggacccacacccucacggugcuggucgaggccgccgccagccagcgcuccagcucccuggccagcaaccggcucaagaucgcgcugcagaaccuggagaucugcuuccacgccgagggcugcggccugccgcccaaggcccugcacaccgccaccuuccaggcccugcagcgcgaccucgagcugcaggcggccuccagccgggagcugauccgcaaguacuucugcagccggauccagcagcaggccgagaccacguccgaggagcucggggccgugaccgugaaggccagcuaccgcgcguccgagcagaagcugcgggucgagcugcucagcgccuccagccugcugccccucgacuccaacggcagcuccgaccccuucgugcagcugacccuggagccccgccacgaguuccccgagcucgccgcccgggagacccagaagcacaagaaggaccugcacccgcuguucgacgagacguucgaguuccucgugcccgcggagcccugccgcaaggccggggccugccugcugcucaccguccuggacuacgacacccugggcgccgacgaccucgagggcgaggccuuccugccccugcgggaggugccggggcucagcggcuccgaggagcccggggaggugccccagacccgccugccccugacguacccggcgcccaacggcgaccccauccugcagcuccuggaggggcggaagggcgaccgcgaggcccaggucuucgugcgccugcggcgccaccgggccaagcaggccagccagcacgcccuccgcccggcgcccuga

SEQ ID NO: 38453 - RNA, 2790 nt, Artificial Sequence
  derived and/or modified sequence opt1 from UNC45A__Homo_sapiens__NP_001034764
augaccgccagcuccguggagcagcugcgcaaggagggcaacgagcuguucaagugcggggacuacggcggggcccuggcggccuacacccaggcccugggccucgacgccacgccccaggaccaggccguccugcaccggaaccgcgcggccugccaccugaagcucgaggacuacgacaaggccgagaccgaggccagcaaggcgaucgagaaggacgggggcgacgugaaggcccuguaccggcgcucccaggcccuggagaagcucggccggcuggaccaggccgugcuggaccuccagcgcugcgucagccuggagccgaagaacaagguguuccaggaggcccugcggaacaucgggggccagauccaggagaaggugcgcuacauguccagcaccgacgcgaaggucgagcagauguuccagauccuccuggaccccgaggagaaggggaccgagaagaagcagaaggccucccagaaccugguggugcucgcccgggaggacgccggcgccgagaagaucuuccgcagcaacgggguccagcugcugcagcggcuccuggacaugggcgagacggaccugaugcucgcggcccugcgcacccuggugggcaucugcuccgagcaccagagccggaccguggccacccucuccauccuggggacgcgccgggucgugagcauccugggcguggagucccaggccgucagccucgccgcgugccaccuccuccaggugauguucgacgcccucaaggagggggugaagaagggcuuccgcggcaaggagggggccaucaucgucgaccccgcccgggagcugaaggugcugaucuccaaccuccuggaccugcucaccgaggugggcgucagcgggcagggccgcgacaacgcccugacccugcucaucaaggcggugccccggaagucccugaaggacccgaacaacagccugacccucugggugaucgaccaggggcugaagaagauccuggaggucggcggcucccuccaggacccgcccggggagcuggccgugacggccaacagccgcaugagcgccuccauccugcugagcaagcuguucgacgaccugaagugcgacgcggagcgggagaacuuccaccgccugugcgagaacuacaucaaguccugguucgagggccaggggcucgccggcaagcugcgcgccauccagaccgucagcugccugcuccaggggcccugcgacgccggcaaccgggcccuggagcuguccggcgugauggagagcgugaucgcgcucugcgccuccgagcaggaggaggagcagcuggucgccguggaggcccugauccacgccgcggggaaggccaagcgcgccagcuucaucaccgccaacggcgugucccuccugaaggaccuguacaagugcagcgagaaggacuccauccggauccgcgcccucgucgggcugugcaagcugggcagcgccgggggcaccgacuucuccaugaagcaguucgcggagggcagcacgcucaagcuggccaagcagugccggaaguggcugugcaacgaccagaucgacgccgggacccgccggugggcgguggagggccucgccuaccugaccuucgacgccgacgugaaggaggaguucgucgaggacgccgccgcgcugaaggcccucuuccagcugucccgccuggaggagcggagcguccucuucgccguggccuccgcccuggugaacugcaccaacagcuacgacuacgaggagccggaccccaagaugguggagcuggcgaaguacgccaagcagcacgugcccgagcagcaccccaaggacaagccguccuucguccgcgcccgggugaagaagcuccuggccgccgggguggucagcgcgauggugugcauggugaagacggagagccccguccugaccuccagcugccgcgagcuccugucccggguguuccuggcccucguggaggaggucgaggaccgcggcaccgugguggcccagggcgggggccgggcccugaucccccuggcgcucgaggggaccgacgucggccagacgaaggccgcccaggcccuggccaagcugaccaucaccagcaaccccgagaugaccuucccgggggagcgcaucuacgagguggugcggccccucgucucccugcugcaccucaacugcagcggccugcagaacuucgaggcgcugauggcccucacgaaccuggccggcaucuccgagcgccugcggcagaagauccucaaggagaaggccgugcccaugaucgagggguacauguucgaggagcacgagaugauccgccgcgccgcgaccgagugcaugugcaaccuggccaugagcaaggaggugcaggaccuguucgaggcccagggcaacgaccggcucaagcugcugguccucuacuccggggaggacgacgagcugcugcagcgcgccgccgcgggcgggcucgccaugcugaccagcaugcggcccacccugugcucccgcaucccccaggugacgacccacuggcucgagauccugcaggcccugcuccugagcuccaaccaggagcugcagcaccggggcgccguggucgugcucaacaugguggaggccagccgcgagaucgcguccacccugauggagagcgagaugauggagauccuguccguccucgccaagggcgaccacagccccgugacccgggccgccgcggccugccuggacaaggccguggaguacgggcugauccagcccaaccaggacggcgaguga

SEQ ID NO: 38454 - RNA, 2790 nt, Artificial Sequence
  derived and/or modified sequence opt1 from UNC45B__Homo_sapiens__NP_001253981
auggccgagguggaggccguccagcugaaggaggagggcaaccgccacuuccagcuccaggacuacaaggcggccaccaacagcuacucccaggcccugaagcugaccaaggacaaggcccuccuggccacgcuguaccggaaccgcgcggccugcgggcucaagaccgagagcuacgugcaggccgccuccgacgcgagccgggccaucgacaucaacuccagcgacaucaaggcccuguaccgccggugccaggcccuggagcaccucggcaagcuggaccaggccuucaaggacgugcagcgcugcgcgacccuggagccccggaaccagaacuuccaggagaugcuccgccggcugaacaccuccauccaggagaagcugcgcguccaguucagcacggacucccgggugcagaagauguucgagauccuccuggacgagaacagcgaggccgacaagcgcgagaaggccgccaacaaccugaucgugcucgggcgggaggaggccggcgcggagaagaucuuccagaacaacggggucgcccugcugcuccagcugcuggacaccaagaagccggagcucgugcuggccgccgugcgcacccuguccggcaugugcagcggccaccaggcccgggcgaccgucauccuccacgccgugcgcaucgaccggaucugcucccugauggccguggagaacgaggagaugagccuggccgucugcaaccuccugcaggccaucaucgacucccugagcggggaggacaagcgcgagcaccggggcaaggaggaggcgcucgugcuggacacgaagaaggaccugaagcagaucaccucccaccuccuggacaugcuggugagcaagaaggucuccgggcagggccgcgaccaggcccucaaccugcugaacaagaacgugccccggaaggaccucgccauccacgacaacagccgcaccaucuacguggucgacaacgggcugcgcaagauccugaagguggugggccagguccccgaccuccccagcugccugccgcugaccgacaacacgcggaugcucgccuccauccugaucaacaagcuguacgacgaccugcgcugcgaccccgagcgggaccacuuccgcaagaucugcgaggaguacaucaccggcaaguucgacccccaggacauggacaagaaccucaacgcgauccagaccgugagcgggauccugcagggccccuucgaccuggggaaccagcuccugggccugaagggcgugauggagaugauggucgcccucugcggguccgagcgggagaccgaccagcugguggccgucgaggcccugauccacgccagcacgaagcucucccgcgcgaccuucaucaucaccaacggcgugagccugcugaagcagaucuacaagaccacgaagaacgagaagaucaagauccggacccucguggggcugugcaagcugggcuccgccgggggcaccgacuacggccuccgccaguucgccgaggggagcaccgagaagcuggccaagcagugccggaaguggcugugcaacauguccaucgacacgcgcacccggcgcugggccgucgagggccucgcguaccugacccuggacgccgacgugaaggacgacuucgugcaggacgucccggcccuccaggccauguucgagcuggccaagaccagcgacaagacgauccuguacuccguggcgaccacccucgugaacugcaccaacagcuacgacgucaaggaggugauccccgagcuggugcagcuggccaaguucuccaagcagcacguccccgaggagcaccccaaggacaagaaggacuucaucgacaugcgggugaagcgccuccugaaggccggggugaucagcgcccuggcgugcauggucaaggccgacuccgccauccucacggaccagaccaaggagcugcuggcccggguguuccucgcccugugcgacaacccgaaggaccgcggcaccaucguggcgcagggcgggggcaaggcccugaucccccucgcccuggaggggaccgacgucggcaaggugaaggccgcccacgcgcuggccaagaucgccgccgugagcaaccccgacaucgccuuccccggggagcgggucuacgagguggugcgcccgcucguccggcugcuggacacgcagcgcgacggccuccagaacuacgaggcgcugcuggggcucaccaaccuguccggccgcagcgacaagcugcggcagaagaucuucaaggagcgcgcccuccccgacaucgagaacuacauguucgagaaccacgaccagcugcggcaggccgccaccgagugcaugugcaacauggugcugcacaaggaggugcaggagcgcuuccucgcggacggcaacgaccggcugaagcuggucgugcuccugugcggggaggacgacgacaaggugcagaacgccgccgccggcgcccuggcgaugcucaccgccgcccacaagaagcugugccugaagaugacccaggucacgacccaguggcucgagauccugcagcgccugugccuccacgaccagcuguccgugcagcaccgggggcuggugaucgccuacaaccuccuggccgcggacgccgagcuggccaagaagcucgucgagagcgagcugcuggagauccucaccguggugggcaagcaggagcccgacgagaagaaggccgaggucgugcagaccgcccgcgagugccugaucaagugcauggacuacggcuucaucaagcccgugagcuga

SEQ ID NO: 38455 - RNA, 2529 nt, Artificial Sequence
  derived and/or modified sequence opt1 from UNC5A__Homo_sapiens__NP_588610
auggccgugcgccccggccuguggccggcccuccuggggaucguccuggcggccuggcuccggggcagcggggcccagcaguccgccaccguggccaaccccgugcccggcgcgaaccccgaccugcugccgcacuuccucgucgagcccgaggacguguacaucgugaagaacaagcccguccugcuggugugcaaggccgugcccgccacccagaucuucuucaagugcaacggggaguggguccgccagguggaccacgugaucgagcggagcacggacggcuccagcggccucccgaccauggagguccgcaucaacgugucccggcagcaggucgagaaggucuucgggcuggaggaguacuggugccagugcguggccuggagcuccagcggcaccaccaagucccagaaggcguacauccgcaucgccuaccugcggaagaacuucgagcaggagccccucgccaaggaggugagccuggagcaggggaucguccugcccugccggcccccggagggcaucccgcccgccgagguggaguggcuccgcaacgaggaccugguggaccccucccuggaccccaacgucuacaucacgcgcgagcacagccucguggugcggcaggcccgccuggcggacaccgccaacuacacgugcgucgccaagaacaucguggcccggcgccgguccgccagcgcggccgucaucguguacguggacggguccuggagccccugguccaaguggagcgccugcggccuggacugcacccacuggcgcucccgggagugcagcgaccccgcgccccgcaacggcggggaggagugccagggcacggaccucgacacccggaacugcaccagcgaccugugcgugcacaccgccuccgggccggaggacguggcccuguacgugggccucaucgccgucgccgugugccuggugcugcuccugcugguccucauccugguguacugccgcaagaaggagggccuggacagcgacguggccgacuccagcauccucaccuccggguuccagcccgucagcaucaagcccuccaaggccgacaacccccaccuccugaccauccagccggaccugagcaccaccacgaccaccuaccagggcucccugugcccccggcaggacgggcccagccccaaguuccagcugaccaacggccaccuccuguccccgcucgggggcggccgccacacgcugcaccacagcucccccaccagcgaggcggaggaguucgugucccgccugagcacccagaacuacuuccggucccugccccgcgggaccagcaacaugacguacggcaccuucaacuuccucgggggccggcugaugaucccgaacaccgggaucucccugcucaucccgcccgacgccaucccccgcggcaagaucuacgagaucuaccugacccugcacaagcccgaggacgugcggcugccccucgccggcugccagacgcugcugagccccaucgucagcugcgggcccccgggcgugcuccugacccgccccgugauccuggccauggaccacugcggggagcccucccccgacagcuggucccuccggcugaagaagcagagcugcgagggcuccugggaggacguccugcaccucggggaggaggcgccgagccaccuguacuacugccagcuggaggccuccgccugcuacguguucaccgagcagcucggccgcuucgcccuggugggcgaggcccugagcgucgcggccgccaagcggcucaagcugcuccuguucgcccccguggccugcaccucccuggaguacaacauccgcguguacugccugcacgacacgcacgacgcgcucaaggaggucgugcagcuggagaagcagcucgggggccagcugauccaggagccccgggugcugcacuucaaggacagcuaccacaaccugcgccucuccauccacgacguccccagcucccuguggaaguccaagcugcucgugagcuaccaggagaucccguucuaccacaucuggaacgggacccagcgguaccugcacugcaccuucacccuggagcgcgugagccccuccacgagcgaccucgccugcaagcugugggucuggcaggucgagggcgacggccagagcuucuccaucaacuucaacaucaccaaggacacccgguucgccgagcugcucgcccuggagagcgaggccggggugcccgcgcuggugggccccuccgccuucaagaucccguuccucauccgccagaagaucaucagcucccuggacccgcccugccggcgcggggccgacuggcggacccuggcccagaagcuccaccuggacagccaccuguccuucuucgcgagcaagcccucccccaccgccaugauccucaaccugugggaggcccgccacuuccccaacggcaaccugagccagcucgccgccgcgguggccgggcugggccagcccgacgccggccuguucacgguguccgaggccgagugcuga

SEQ ID NO: 38456 - RNA, 2805 nt, Artificial Sequence
  derived and/or modified sequence opt1 from UNC5B__Homo_sapiens__NP_001231818
augggcgcccgcagcggggcccggggcgcgcugcuccuggcccugcuccugugcugggacccccgccugucccaggccgggaccgacagcggcuccgaggugcucccggacagcuuccccuccgcccccgccgagccccugccguacuuccugcaggagccccaggacgcguacaucgucaagaacaagcccguggagcuccggugccgcgccuuccccgccacccagaucuacuucaagugcaacggggagugggugagccagaacgaccacgucacgcaggagggccuggacgaggccaccggccugcgggugcgcgaggugcagaucgaggucucccggcagcaggucgaggagcuguucgggcuggaggacuacuggugccagugcguggcguggagcuccgccggcaccaccaagagccgccgggccuacguccgcaucgccuaccugcggaagaacuucgaccaggagccgcucgggaaggaggugccccuggaccacgaggugcugcuccagugccgcccgcccgagggcguccccguggccgagguggaguggcugaagaacgaggacgucaucgaccccacgcaggacaccaacuuccugcucaccaucgaccacaaccugaucauccggcaggcgcgccuguccgacaccgccaacuacacgugcguggccaagaacaucguggccaagcggcgcagcaccaccgccaccgucaucguguacgugaacgggggcugguccagcugggcggaguggucccccugcagcaaccggugcggccgcggguggcagaagcggacgcgcacgugcaccaaccccgccccgcucaacggcggggccuucugcgagggccaggccuuccagaagaccgccugcacgaccaucugccccgucgacggcgcguggaccgagugguccaaguggagcgccugcuccaccgagugcgcccacuggcggagccgcgagugcauggccccgccgccccagaacgggggccgcgacugcagcgggacccuccuggacuccaagaacugcaccgacggccucugcaugcagaugcuggaggccagcggggacgcggcccuguacgccggccucgugguggccaucuucgugguggucgcgauccugauggccgugggcguggucguguaccggcgcaacugccgggacuucgacaccgacaucaccgacuccagcgccgcccugaccgggggcuuccaccccgugaacuucaagacggcccgccccuccaacccccagcuccugcaccccagcgucccgcccgaccugaccgcguccgccgggaucuaccggggccccguguacgcccuccaggacagcaccgacaagauccccaugacgaacagcccccugcuggacccccucccgucccugaaggugaaggucuacuccagcuccaccaccgggagcggccccggccuggccgacggggccgaccuccugggcgugcugccgcccgggaccuaccccuccgacuucgcgcgcgacacgcacuuccuccaccuccgcagcgccucccugggcagccagcagcugcuggggcugccccgggaccccggcuccagcgugagcggcaccuucgggugccugggcgggcggcucuccauccccggcaccggcgucagccugcuggugccgaacggggccaucccccagggcaaguucuacgagauguaccuccugaucaacaaggccgaguccacccugccccucagcgaggggacgcagaccgugcugucccccagcgucacgugcggcccgaccgggcugcuccugugccgccccgugauccugaccaugccccacugcgccgagguguccgcgcgggacuggaucuuccagcucaagacccaggcccaccagggccacugggaggaggucgugacccuggacgaggagacccugaacacccccugcuacugccagcucgagccgcgcgccugccacauccugcuggaccagcucggcacguacguguucaccggggagagcuacucccggagcgccgucaagcgccugcagcuggcgguguucgcccccgcccucugcaccucccuggaguacagccugcggguguacugccucgaggacacccccgucgcccugaaggaggugcuggagcucgagcgcacgcugggcggguaccugguggaggagcccaagccgcucauguucaaggacuccuaccacaaccugcggcugagccuccacgaccugccccacgcccacuggcgcuccaagcugcucgcgaaguaccaggagauccccuucuaccacaucuggagcggcucccagaaggcccugcacugcaccuucacccuggagcggcacagccucgccagcaccgagcugacgugcaagaucugcguccgccagguggagggggagggccagaucuuccagcugcacaccacccucgccgagacccccgccggcucccuggacacgcugugcagcgcgccgggguccaccgugaccacccagcucggccccuacgccuucaagaucccccugagcauccgccagaagaucugcaacucccuggacgccccgaacagccgggggaacgacuggcgcaugcucgcccagaagcuguccauggaccgguaccugaacuacuucgccacgaaggcgagccccaccggcgucauccucgaccugugggaggcccugcagcaggacgacggggaccucaacucccuggccagcgcccuggaggagaugggcaaguccgagaugcucguggcgguggccaccgacggcgacugcuga

SEQ ID NO: 38457 - RNA, 2796 nt, Artificial Sequence
  derived and/or modified sequence opt1 from UNC5C__Homo_sapiens__NP_003719
augcgcaagggccugcgggccaccgccgcgcgcugcgggcucggccugggguaccugcuccagaugcuggugcugcccgcccucgcccugcugagcgccuccggcaccgggagcgccgcgcaggacgacgacuucuuccacgagcucccggagacguuccccuccgacccgcccgagccccugccccacuuccugaucgagcccgaggaggccuacaucgucaagaacaagcccgugaaccucuacugcaaggccagcccggccacccagaucuacuucaagugcaacuccgagugggugcaccagaaggaccacaucgucgacgagcggguggacgagaccagcggccugaucgugcgcgaggucuccaucgagaucagccggcagcaggucgaggagcuguucggccccgaggacuacuggugccagugcguggcgugguccagcgccgggaccacgaagucccgcaaggccuacgugcggaucgccuaccuccgcaagaccuucgagcaggagccccugggcaaggaggugagccuggagcaggaggugcuccugcagugccggcccccggaggggauccccgucgccgagguggaguggcugaagaacgaggacaucaucgaccccguggaggaccgcaacuucuacaucaccaucgaccacaaccucaucaucaagcaggcgcggcuguccgacaccgccaacuacacgugcgucgccaagaacaucguggccaagcgcaagagcaccaccgccaccgugaucgucuacgugaacggcgggugguccacguggaccgaguggagcgugugcaacucccggugcggccgcggcuaccagaagcggacccggaccugcacgaaccccgcgccgcugaacgggggcgccuucugcgaggggcagagcguccagaagaucgccugcaccacccucugccccguggacggccgguggacccccugguccaaguggagcacgugcggcaccgagugcacccacuggcgccggcgcgagugcaccgcccccgccccgaagaacgggggcaaggacugcgacgggcuggugcugcagagcaagaacugcacggacggccucugcaugcagaccgcgcccgacuccgacgacgucgcccuguacguggggaucgucaucgccgugaucgugugccuggccaucagcgucgugguggcccucuucgucuaccggaagaaccaccgcgacuucgaguccgacaucaucgacagcuccgcgcugaacggcggcuuccagcccgugaacaucaaggccgcccgccaggaccugcucgccgugcccccggaccugaccagcgcggccgccauguaccgggggcccgucuacgcccugcacgacguguccgacaagauccccaugaccaacagccccauccucgacccgcugcccaaccugaagaucaagguguacaacacguccggcgccgucacgccccaggacgaccucagcgaguucaccuccaagcugagcccgcagaugacccagucccugcucgagaacgaggcgcugagccugaagaaccagucccucgcccgccagaccgaccccagcugcaccgccuucggguccuucaacagccugggcgggcaccugaucgugcccaacuccggcgugagccuccugauccccgccggcgccaucccgcaggggcgggucuacgagauguacgugaccgugcaccgcaaggagaccaugcggccgcccauggacgacagccagacgcugcugacccccgucguguccugcggcccgcccggggcgcuccugacccgccccgugguccugaccaugcaccacugcgccgaccccaacaccgaggacuggaagauccuccugaagaaccaggccgcccagggccagugggaggacgugguggucgugggggaggagaacuucacgacccccugcuacauccagcuggacgccgaggcgugccacauccucaccgagaaccugagcaccuacgcccuggugggccacuccacgaccaaggccgccgcgaagcggcucaagcuggccaucuucggcccccugugcugcagcucccucgaguacagcauccgcgucuacugccuggacgacacccaggacgcccugaaggagauccuccaccuggagcggcagaugggcgggcagcugcucgaggagcccaaggcccugcacuucaagggguccacccacaaccugcgccucagcauccacgacaucgcccacucccuguggaaguccaagcugcucgcgaaguaccaggagauccccuucuaccacguguggagcggcagccagcggaaccugcacugcacguucacccuggagcgcuucucccucaacaccguggagcuggucugcaagcugugcgugcgccagguggagggcgaggggcagaucuuccagcucaacugcaccgucagcgaggagccgacgggcaucgaccugccccugcucgaccccgccaacaccaucaccaccgugacggggcccuccgccuucagcaucccgcugcccauccgccagaagcugugcuccagccucgacgcgccccagacccggggccacgacuggcgcaugcuggcccacaagcugaaccucgaccgguaccugaacuacuucgccaccaagagcucccccaccggggugauccuggaccucugggaggcccagaacuucccggacggcaaccugagcaugcuggccgccguccucgaggagaugggccgccacgagacgguggugucccuggccgcggaggggcaguacuga

SEQ ID NO: 38458 - RNA, 2862 nt, Artificial Sequence
  derived and/or modified sequence opt1 from UNC5D__Homo_sapiens__NP_543148
augggccgcgccgccgcgaccgccgggggcgggggcggggcccggcgcuggcugcccuggcucggccugugcuucugggccgccggcaccgcggccgcccgggggacggacaacggcgaggcccugccggagagcauccccuccgcgcccgggacccucccccacuucaucgaggagccggacgacgccuacaucaucaagagcaaccccaucgcccugcgcugcaaggcccggcccgccaugcagaucuucuucaagugcaacggcgagugggugcaccagaacgagcacgucuccgaggagacccuggacgagagcuccgggcucaaggugcgcgagguguucaucaacgucacccggcagcagguggaggacuuccacggccccgaggacuacuggugccagugcguggcguggagccaccugggcacguccaagagccgcaaggccuccguccggaucgccuaccugcgcaagaacuucgagcaggacccgcaggggcgggaggugcccaucgagggcaugaucgugcuccacugccgcccccccgagggggucccggccgccgagguggaguggcugaagaacgaggagcccaucgacagcgagcaggacgagaacaucgacacccgggcggaccacaaccugaucauccgccaggcccggcucuccgacagcggcaacuacaccugcauggccgccaacaucguggccaagcgccggucccugagcgcgaccgucgugguguacgucaacggcgggugguccagcuggacggagugguccgccugcaacgugcgcugcggccggggguggcagaagcgcagccggaccugcaccaaccccgccccccugaacggcggggccuucugcgagggcauguccgugcagaagaucaccugcacgagccucugcccggucgacggcagcugggaggugugguccgaguggagcgugugcucccccgagugcgagcaccugcgcauccgcgagugcaccgccccccccccgcggaacgggggcaaguucugcgaggggcugagccaggaguccgagaacugcaccgacggccucugcauccuggacaagaagccccugcacgagaucaagccccagagcaucgagaacgcguccgacaucgcccucuacagcgggcugggcgccgccgucguggcgguggccguccuggugaucggcgucacccucuaccgccggucccagagcgacuacgggguggacgugaucgacuccagcgcccugacgggcggguuccagaccuucaacuucaagaccguccgccagggcaacucccugcuccugaacagcgccaugcagcccgaccugaccgugucccggacguacagcgggccgaucugccuccaggacccccuggacaaggagcugaugaccgaguccagccucuucaacccccuguccgacaucaaggugaagguccagagcagcuucauggugucccugggcgugagcgagcgcgccgaguaccacggcaagaaccacucccggaccuucccccacgggaacaaccacagcuucuccaccaugcacccgcgcaacaagaugcccuacauccagaaccucagcucccugcccacgcggaccgagcugcgcaccaccggcgucuucgggcaccucggcggccggcuggugaugccgaacacgggggugagccugcucaucccccacggcgcgauccccgaggagaacuccugggagaucuacaugagcaucaaccagggggagcccucccugcagagcgacggcuccgagguccugcucagcccggaggugaccugcgggccccccgacaugaucgugaccacccccuucgcccugacgaucccgcacugcgccgacgucuccagcgagcacuggaacauccaccugaagaagcgcacccagcagggcaagugggaggaggugauguccguggaggacgagagcaccagcugcuacugccuccuggaccccuucgccugccacguccugcuggacuccuucggcaccuacgcccucacgggggagcccaucaccgacugcgcggugaagcagcugaagguggccgucuucggcugcaugagcugcaacucccuggacuacaaccuccggguguacugcguggacaacacccccugcgccuuccaggaggucgugagcgacgagcgccaccaggggggccagcugcuggaggagccgaagcuccugcacuucaaggggaacaccuucucccugcagaucagcgugcucgacaucccccccuuccuguggcggaucaagcccuucaccgccugccaggaggucccguucucccgcguguggugcagcaaccggcagccccugcacugcgccuucucccucgagcgcuacacgcccaccaccacccagcugagcugcaagaucugcauccggcagcugaagggccacgagcagauccuccaggugcagacguccauccuggagagcgagcgcgagaccaucaccuucuucgcgcaggaggacuccaccuuccccgcccagacgggcccgaaggccuucaagauccccuacagcauccgccagcggaucugcgccaccuucgacacccccaacgcgaaggggaaggacuggcagaugcuggcccagaagaacuccaucaaccgcaaccucagcuacuucgccacccaguccagccccuccgccgucauccugaaccugugggaggcccggcaccagcacgacggcgaccucgacagccuggcgugcgcccuggaggagaucgggcgcacgcacaccaagcucagcaacaucuccgagagccagcuggacgaggccgacuucaacuacucccggcagaacggccuguga

SEQ ID NO: 38459 - RNA, 7377 nt, Artificial Sequence
  derived and/or modified sequence opt1 from UNC79__Homo_sapiens__NP_065869
augaucagcacccuggccaccuucccgcccuuccuccacaaggacaucaucgaguaccuguccacgagcuuccugcccauggccauccucggcagcagccgccgggagggggugcccgcccacgugaaccuguccgccagcuccaugcugaugaucgccaugcaguacaccagcaaccccguguaccacugccagcuccuggagugccugaugaaguacaagcaggagguguggaaggaccuccuguacgucaucgccuacggccccucccaggugaagccgcccgccgugcagaugcuguuccacuacuggcccaaccucaagccgcccggggcgaucagcgaguaccgcggccugcaguacaccgccuggaaccccauccacugccagcacaucgagugccacaacgccaucaacaagcccgccgucaagaugugcaucgaccccucccugagcguggcgcucggggacaagccgccgccccucuaccugugcgaggagugcuccgagcggaucgccggcgaccacagcgaguggcucaucgacgugcugcugccccaggccgagaucuccgccaucugccagaagaagaacugcagcucccacguccgccgggccguggugaccugcuucagcgcgggcugcugcgggcgccacggcaaccggcccguccgcuacugcaagcggugccacuccaaccaccacagcaacgaggugggggccgccgccgagacccaccucuaccagaccuccccgccgcccaucaacacccgcgagugcggcgccgaggagcuggugugcgcggucgaggccgugaucucccugcucaaggaggccgaguuccacgccgagcagcgggagcacgagcugaaccgccggcgccagcuggggcucagcuccagccaccacucccuggacaacgccgacuucgacaacaaggacgacgacaagcacgaccagcggcugcucagccaguucggcaucugguuccuggugucccugugcacccccagcgagaacacgcccaccgagucccucgcgcgccuggucgccaugguguuccagugguuccacagcaccgccuacaugauggacgacgaggugggcucccuggucgagaagcucaagccccaguucgugaccaaguggcugaagacggugugcgacguccgguucgacgugauggucaugugccugcuccccaagcccauggaguucgcccgcgucgggggcuacugggacaagagcugcuccaccgugacccagcugaaggaggggcugaaccggauccucugccugauccccuacaacgucaucaaccagagcgugugggagugcaucaugcccgaguggcuggaggccauccgcaccgaggugcccgacaaccagcucaaggaguuccgggagguccuguccaagauguucgacaucgagcugugcccccuccccuucagcauggaggagauguucggcuucaucuccugccgcuucacgggcuaccccagcuccgugcaggagcaggcgcugcuguggcugcacgugcucagcgagcuggacaucauggucccccugcagcuccugaucagcauguucuccgacggggugaacagcgugaaggagcuggccaaccagcgcaagucccgggucagcgagcucgccggcaaccuggccucccgccgggugagcguggcguccgaccccgggcgccggguccagcacaacaugcugagccccuuccacuccccguuccagagccccuuccgcagcccccugcggagccccuuccgcuccccguucaagaacuucggccaccccgggggccggaccaucgacuucgacugcgaggacgacgagaugaaccugaacugcuucauccugauguucgaccuccugcugaagcagauggagcuccaggacgacggcaucaccauggggcuggagcacagccuguccaaggacaucaucagcaucaucaacaacguguuccaggcccccuggggcgggucccacacgugccagaaggacgagaaggccaucgagugcaaccucugccagagcagcauccugugcuaccagcuggccugcgagcuccuggagcgccuggcccccaaggaggagucccggcucguggagccgacggacagccuggaggacucccugcucagcucccgccccgaguucaucaucggccccgagggggaggaggaggagaaccccgcgagcaagcacggcgagaacccgggcaacugcaccgagcccgucgagcacgccgccgugaagaacgacaccgagcggaaguucugcuaccagcagcugcccgugacccugcgccucaucuacacgaucuuccaggagauggccaaguucgaggagcccgacauccuguucaacaugcugaacugccucaagauccugugccugcacggggagugccucuacaucgcccggaaggaccacccgcaguuccuggcguacauccaggaccacaugcugaucgccucccucuggcgcgucgugaaguccgaguucucccagcugagcucccuggccgugccccuccugcugcacgcccucagccugccccacggcgccgacaucuucuggaccaucaucaacgggaacuucaacuccaaggacuggaagaugcgguucgaggcggucgagaagguggccgugaucugccgcuuccuggacauccacagcgucaccaagaaccaccuccugaaguacucccuggcccacgccuucugcugcuuccucaccgcgguggaggacgugaaccccgccgucgccacgcgggccggccugcugcucgacaccaucaagcgcccggcccugcaggggcugugccucugccuggacuuccaguucgacaccguggugaaggaccgccccaccauccugagcaagcuccugcugcuccacuuccugaagcaggacauccccgcgcuguccugggaguucuucgucaaccgguucgagacgcucagccuggaggcccagcugcaccucgacugcaacaaggaguucccguuccccaccaccaucaccgccgugcgcacgaacguggccaaccuguccgacgccgcgcuguggaagaucaagcgggcccgcuucgcccggaaccgccagaaguccguccggagccuccgcgacuccgugaagggccccguggagagcaagcgggcccugucccugcccgagacccucaccagcaagauccgccagcaguccccggagaacgacaacaccaucaaggaccugcugcccgaggacgccggcaucgaccaccagaccguccaccagcucaucacggugcugaugaaguucauggcgaaggacgagagcuccgccgagagcgacaucuccagcgccaaggccuucaacaccgugaagcggcaccuguacguccuccugggguacgaccagcaggagggcugcuucaugaucgcgccccagaagaugcgccugagcacgugcuucaacgccuucaucgccgggaucgcccaggugauggacuacaacaucaaccucggcaagcaccuccugccccucgugguccaggugcugaaguacugcagcugcccgcagcugcggcacuacuuccagcagccgccccgcugcucccucuggagccugaagccccacauccggcagauguggcugaaggcccuccuggugauccuguacaaguacccguaccgcgacugcgacaucuccaagauccugcuccaccugauccacaucaccgucaacacccugaacgcgcaguaccacagcugcaagccccacgccaccgccggcccccucuacuccgacaacagcaacaucucccgguacagcgagaaggagaagggggagaucgagcuggccgaguaccgcgagaccggcgcccugcaggacagccuccugcacugcgugcgggaggaguccauccccaagaagaagcugcgcagcuucaagcagaagucccucgacaucgggaacgcggacagccugcuguucacccucgacgagcaccggcgcaaguccugcaucgaccgcugcgacaucgagaagccgcccacgcaggccgccuacaucgcccagcggcccaacgaccccggccgcagccggcagaacuccgccacccgcccggacaacagcgagauccccgagaaccccgcgauggagggguuccccgacgcccggcgcccggugauccccgagguccggcugaacugcauggagaccuucgaggugaaggucgacucccccgugaagcccgccccgaaggaggaccuggaccucaucgaccugagcuccgacagcaccuccggccccgagaagcacagcauccuguccacgagcgacuccgacagccucguguucgagccccugccgccccugcgcaucgucgaguccgacgaggaggaggagaccaugaaccagggcgacgacgggcccagcggcaagaacgccgccagcucccccagcgugccgucccaccccagcgugcucucccugagcaccgcgccccugguccagguguccguggaggacugcagcaaggacuucuccagcaaggacuccgggaacaaccagagcgccggcaacaccgacuccgcccucaucacgcuggaggaccccauggacgccgaggggagcuccaagccggaggagcugcccgaguucagcugcggcagcccccucacccugaagcagaagcgggaccugcuccagaaguccuucgcgcugcccgagaugucccuggacgaccacccggaccccggcaccgagggggagaagcccggcgagcucaugcccagcagcggggccaagaccguccugcugaaggugccggaggacgccgagaaccccacggaguccgagaagcccgacaccagcgccgaguccgacaccgagcagaaccccgagcgcaagguggaggaggacggcgccgaggagagcgaguucaagauccagaucgucccgcggcagcgcaagcagcggaagaucgcgguguccgccauccagcgcgaguaccucgacaucagcuucaacauccuggacaagcugggggagcagaaggaccccgaccccuccaccaagggccucagcacgcuggagaugccccgggaguccagcuccgccccgacccuggacgccggcgugcccgagaccagcucccacagcuccaucagcacccaguaccgccagaugaagcgggggucccucggcguccugacgaugagccagcugaugaagcgccagcucgagcaccaguccagcgcgccccacaacaucagcaacugggacaccgagcagauccagcccgggaagcggcagugcaacgugccgaccugccugaaccccgaccuggagggccagccccuccgcaugcgcggggccaccaaguccagccugcuguccgccccgagcaucguguccauguucguccccgcccccgaggaguucacggacgagcagcccaccgugaugaccgacaagugccacgacugcggcgccauccucgaggaguacgacgaggagacccugggccuggccaucgugguccucagcacguucauccaccuguccccggaccuggcggcgccccuccugcuggacaucaugcagagcguggggcggcucgccuccagcaccaccuucuccaaccaggccgagagcaugauggugcccggcaacgcggccggggucgccaagcaguuccugcgcugcaucuuccaccagcuggcccccaacggcaucuucccgcagcuguuccaguccaccaucaaggacggcaccuuccugcggacgcuggccagcucccucauggacuucaacgagcugagcuccaucgcggcccugagccagcuccuggaggggcugaacaacaagaagaaccuccccgccggcggggccaugauccgcugccuggagaacaucgccaccuucauggaggcgcugcccauggacagccccuccagccucuggaccaccaucuccaaccaguuccagacguucuucgccaagcugccgugcgugcugccccucaagugcagccuggacuccagccugcggaucaugaucugccuccugaagauccccuccaccaacgccacccgcagccugcucgagcccuucuccaagcugcugagcuucgugauccagaacgccgucuucacccucgccuaccugguggagcugugcggccucugcuaccgggcguucacgaaggagcgcgacaaguucuaccugucccggagcgugguccuggagcuccugcaggcccugaagcucaaguccccgcugcccgacaccaaccugcuccugcuggugcaguucaucugcgccgacgccgggaccaagcuggcggagagcaccauccucuccaagcagaugaucgccagcgugcccggcugcggcacggccgccauggagugcguccgccaguacaucaacgaggugcuggacuucauggccgacaugcacacccugaccaagcucaagucccacaugaagaccugcagccagccccugcacgaggacacguucgggggccaccugaagguggggcucgcgcagaucgccgccauggacaucucccggggcaaccaccgcgacaacaaggccgucauccgguaccugccguggcuguaccacccgcccagcgccaugcagcaggggcccaaggaguucaucgagugcgugagccacauccgccuccuguccuggcugcuccugggcagccugacccacaacgcggugugcccgaacgccuccagccccugccuccccaucccgcuggacgccggcucccacgucgccgaccaccugaucgugauccucaucggguuccccgagcagagcaagaccuccgugcugcacaugugcagccuguuccacgccuucaucuucgcgcagcucuggaccgucuacugcgagcaguccgccguggccacgaaccugcagaaccagaacgaguucagcuucaccgccauccugaccgcccucgaguucuggucccgggugacccccagcauccugcagcugauggcgcacaacaaggucaugguggagauggugugccuccacgucaucucccugauggaggcccugcaggagugcaacagcacgaucuucgugaagcucauccccauguggcugccgaugauccaguccaacaucaagcaccugagcgccggccuccagcugcgccugcaggccauccagaaccacgugaaccaccacucccuccggacccugcccgggagcggccaguccagcgcggggcuggccgcccuccgcaaguggcugcagugcacccaguucaagauggcccaggucgagauccagagcuccgaggccgcgagccaguucuacccccuguga

SEQ ID NO: 38460 - RNA, 1248 nt, Artificial Sequence
  derived and/or modified sequence opt1 from UNC93A__Homo_sapiens__NP_001137419
auggaccgcagccugcggaacgugcucgucguguccuucggcuuccugcuccucuucaccgccuacgggggccugcagagccugcaguccagccucuacuccgaggaggggcugggcgugaccgcccugagcacgcucuacgggggcaugcugcuguccagcauguuccugcccccgcugcugaucgagcgccucggcugcaaggggaccaucauccuguccaugugcggcuacgucgcguucagcguggggaacuucuucgccuccugguacacccugauccccaccagcauccuccugggccugggggccgcgccccucugguccgcccagugcacguaccugaccaucaccggcaacacccacgccgagaaggccggcaagcgggggaaggacauggugaaccaguacuucggcaucuucuuccugaucuuccagagcuccggggucuggggcaaccucaucagcucccugguguucggccagacgcccagccagggguccggcgugcuggccguccucaugaucgccgcguuccugcagccgauccgcgacgugcagcgggagagcgagggggagaagaaguccgugcccuucuggagcacccugcucagcaccuucaagcuguaccgcgacaagcggcugugccuccugauccugcucccccuguacuccggccugcagcagggguuccucagcuccgaguacacccgcagcuacgucacgugcacccugggcauccaguucgugggcuacgugaugaucugcuucuccgccaccgacgcccugugcagcguccucuacgggaaggugucccaguacaccggccgggccgugcuguacguccugggggccgugacgcacgugagcugcaugaucgcgcuccugcuguggcgcccccgggccgaccaccucgccgucuucuucguguucuccggccuguggggcguggccgacgccgucuggcagacccagaacaacgcgcuguacggggugcuguucgagaaguccaaggaggccgccuucgccaacuaccgccucugggaggcccugggcuucgucaucgcguucggguacagcauguuccugugcgugcacgugaagcucuacauccugcugggcguccucagccugaccaugguggccuacgggcugguggagugcgucgaguccaagaacccgauccggccccacgcccccggccaggugaaccaggccgaggacgaggagauccagaccaagauguga

SEQ ID NO: 38461 - RNA, 1794 nt, Artificial Sequence
  derived and/or modified sequence opt1 from UNC93B1__Homo_sapiens__NP_112192
auggaggccgagcccccgcuguaccccauggccggcgcggccgggccccagggcgacgaggaccuccugggggugcccgacggcccggaggcgccccuggacgagcucgucggggccuaccccaacuacaacgaggaggaggaggagcgccgguacuaccgccggaagcgccugggcgugcugaagaacgugcucgccgccagcgccggcgggaugcugaccuacggcgucuaccuggggcuccugcagaugcagcugauccuccacuacgacgagaccuaccgggaggugaaguacggcaacauggggcugcccgacaucgacuccaagaugcugaugggcaucaacgugacgccgaucgccgcccuccuguacacccccguccugauccgcuucuucggcaccaaguggaugauguuccucgcgguggggaucuacgcccuguucgugagcaccaacuacugggagcgguacuacacgcugguccccuccgccguggcccucggcauggccaucgugccccugugggcgagcauggggaacuacaucacccgcauggcccagaaguaccacgaguacucccacuacaaggagcaggacggccagggcaugaagcagcggccgccccgcgggagccacgcccccuaccugcucgucuuccaggccaucuucuacuccuucuuccaccugagcuucgccugcgcgcagcugcccaugaucuacuuccucaaccacuaccuguacgaccugaaccacacccucuacaacgugcaguccugcggcaccaacagccacgggauccuguccggcuucaacaagacggugcugcggacccucccgcgcagcgggaaccugaucgucguggaguccgugcugauggccgucgccuuccucgccaugcugcuggugcucggccugugcggcgccgcguaccggcccaccgaggagaucgaccugcgcagcgugggguggggcaacaucuuccagcuccccuucaagcacguccgggacuaccgccugcggcaccuggugcccuucuucaucuacuccggguucgaggugcuguucgccugcaccggcaucgcccugggguacggcgucugcagcgugggccuggagcgccucgccuaccugcuggucgccuacucccugggggcgagcgccgccucccuccugggccugcucgggcuguggcugccgcggcccgugccccucguggccggcgcggggguccaccuccugcucacguucauccuguucuucugggcccccgugccgcgcgugcugcagcacagcuggauccucuacgucgccgccgcccuguggggcgugggcagcgcgcugaacaagaccgggcucuccacccugcugggcauccucuacgaggacaaggagcggcaggacuucaucuucaccaucuaccacugguggcaggccguggccaucuucacggucuaccuggggagcucccugcacaugaaggccaagcucgccgugcugcuggugacccucgucgcggccgccgugagcuaccugcgcauggagcagaagcugcgccggggcguggcgccccgccagccccggaucccccgcccgcagcacaagguccggggcuaccgcuaccucgaggaggacaacuccgacgagagcgacgccgagggggagcacggcgacggggccgaggaggaggccccgcccgccggcccccggcccgggcccgagcccgccggccugggccgccggccgugccccuacgagcaggcgcagggcggggacgggcccgaggagcaguga

SEQ ID NO: 38462 - RNA, 915 nt, Artificial Sequence
  derived and/or modified sequence opt1 from UNG__Homo_sapiens__NP_003353
augggcguguucugccuggggcccuggggccucgggcgcaagcugcggacccccggcaaggggccccugcagcuccugagccgccugugcggcgaccaccuccaggccauccccgccaagaaggcgcccgccggccaggaggagcccgggaccccgcccuccagcccccuguccgccgagcagcuggaccggauccagcgcaacaaggccgccgcgcuccugcggcuggccgcccgcaacguccccgugggcuucggggagagcuggaagaagcaccucuccggcgaguucgggaagcccuacuucaucaagcugaugggcuucguggccgaggagcggaagcacuacacggucuacccgccgccccaccagguguucaccuggacccagaugugcgacaucaaggacgugaaggucgugauccugggccaggaccccuaccacgggcccaaccaggcgcacggccucugcuucagcgugcagcgccccgucccgccgccgcccucccuggagaacaucuacaaggagcugagcaccgacaucgaggacuucgugcaccccgggcacggcgaccucuccggcugggccaagcagggggugcugcugcucaacgccguccugacggugcgggcccaccaggccaacagccacaaggagcgcggcugggagcaguucaccgacgcgguggucuccuggcugaaccagaacagcaacgggcucguguuccugcuguggggcuccuacgcccagaagaaggggagcgccaucgaccggaagcgccaccacgugcuccagaccgcccaccccagcccccugagcgucuaccggggcuucuucggcugccgccacuucuccaagaccaacgagcugcuccagaaguccgggaagaagcccaucgacuggaaggagcuguga

SEQ ID NO: 38463 - RNA, 1155 nt, Artificial Sequence
  derived and/or modified sequence opt1 from UPB1__Homo_sapiens__NP_057411
auggccggcgccgaguggaagucccuggaggagugccucgagaagcaccucccccugccggaccugcaggaggugaagcgcgugcuguacgggaaggagcugcggaagcucgaccugccccgcgaggcguucgaggccgccagccgggaggacuucgagcugcagggcuacgccuucgaggccgcggaggagcagcuccgccggccccgcaucgugcacguggggcugguccagaaccggaucccccugccggccaacgcccccguggccgagcaggucagcgcgcuccaccgccggaucaaggccaucguggagguggccgccaugugcggcgugaacaucaucugcuuccaggaggccuggaccaugcccuucgcguucugcacccgcgagaagcugcccuggacggaguucgccgaguccgccgaggacgggccgaccacccgguucugccagaagcuggccaagaaccacgacauggucguggugagccccauccucgagcgcgacuccgagcacggcgacguccuguggaacaccgccguggugaucagcaacuccggcgcgguccuggggaagacgcggaagaaccacaucccccgcgugggcgacuucaacgagagcaccuacuacauggaggggaaccucggccaccccguguuccagacccaguucgggcggaucgccgucaacaucugcuacggccgccaccacccgcugaacuggcugauguacuccaucaacggcgccgagaucaucuucaaccccagcgccaccaucggggcccucuccgagagccuguggcccaucgaggcgcggaacgccgccaucgccaaccacugcuucacgugcgccaucaaccgcgugggcaccgagcacuuccccaacgaguucaccuccggggacggcaagaaggcgcaccaggacuucggcuacuucuacgggagcuccuacguggccgccccggacagcucccggacccccggccugagccgcucccgggacgggcuccuggucgccaagcuggaccucaaccugugccagcaggucaacgacguguggaacuucaagaugacgggccgcuacgagauguacgcgcgcgagcuggccgaggccgucaagagcaacuacagccccaccaucgugaaggaguga

SEQ ID NO: 38464 - RNA, 3357 nt, Artificial Sequence
  derived and/or modified sequence opt1 from UPF1__Homo_sapiens__NP_002902
augagcguggaggccuacggccccuccagccagacccugaccuuccucgacacggaggaggccgagcugcugggggcggacacccagggcuccgaguucgaguucaccgacuucacccucccgagccagacgcagaccccgcccgggggccccgggggccccggcgggggcggggccggcgggcccggcggcgccggggccggcgccgcggccgggcagcuggacgcccaggucggccccgagggcauccugcagaacggggccguggacgacuccguggcgaagaccagccagcuccuggccgagcugaacuucgaggaggacgaggaggacaccuacuacacgaaggaccuccccauccacgccugcuccuacugcggcauccacgacccggccugcgucguguacugcaacaccagcaagaagugguucugcaacgggcgcggcaacaccuccgggagccacaucgugaaccaccugguccgggccaagugcaaggaggugacccugcacaaggacggcccccucggcgagacggugcuggagugcuacaacugcgggugccgcaacgucuuccugcucggcuucauccccgcgaaggccgacuccguggugguccugcugugccggcagcccugcgccagccaguccagccucaaggacaucaacugggacuccagccaguggcagccgcugauccaggaccgcugcuuccuguccuggcucgugaagauccccagcgagcaggagcagcugcgggcccgccagaucaccgcccagcagaucaacaagcuggaggagcucuggaaggagaaccccuccgcgacccuggaggaccuggagaagcccgggguggacgaggagccgcagcacguccuccugcgguacgaggacgccuaccaguaccagaacaucuucggcccccuggugaagcucgaggccgacuacgacaagaagcugaaggagagccagacccaggacaacaucacggugcgcugggaccuggggcucaacaagaagcggaucgccuacuucacccugcccaagaccgacagcgacaugcgccugaugcagggcgacgagaucugccuccgguacaagggcgaccuggcgccccuguggaaggggaucggccacgucaucaaggugccggacaacuacggggacgagaucgccaucgagcuccgcuccagcgugggcgcccccgucgaggugacccacaacuuccagguggacuucgucuggaaguccacgagcuucgaccggaugcaguccgcccugaagaccuucgccguggacgagaccagcgucuccggguacaucuaccacaagcugcucggccacgagguggaggacgugaucaucaagugccagcugcccaagcgcuucaccgcccagggccugcccgaccucaaccacagccaggucuacgcggugaagacggugcugcagcggccgcugucccucauccaggggccgcccggcaccgggaagaccgucaccagcgccacgaucguguaccaccuggcccgccagggcaacggccccgugcuggucugcgcccccuccaacaucgcgguggaccagcugaccgagaagauccaccagaccgggcucaaggugguccggcugugcgccaagagccgcgaggccaucgacucccccgugagcuuccuggcccuccacaaccagauccggaacauggacuccaugcccgagcugcagaagcugcagcagcucaaggacgagaccggcgagcugagcuccgccgacgagaagcgcuaccgggcgcugaagcgcacggccgagcgcgagcuccugaugaacgccgacgugaucugcugcacgugcgucggggccggcgacccgcggcuggccaagaugcaguuccgcagcauccucaucgacgaguccacccaggcgaccgagcccgagugcauggugcccgugguccugggggccaagcagcugauccucgugggcgaccacugccagcugggccccguggucaugugcaagaaggccgccaaggccgggcugagccagagccucuucgagcggcugguggugcugggcauccgcccgauccggcuccagguccaguaccgcaugcaccccgcgcuguccgccuuccccagcaacaucuucuacgaggggucccugcagaacggcgugaccgccgccgaccgggugaagaagggguucgacuuccaguggccccagccggacaagcccauguucuucuacgucacccagggccaggaggagaucgcgagcuccggcaccagcuaccucaaccgcaccgaggccgccaacguggagaagaucaccacgaagcugcugaaggccggggccaagcccgaccagaucggcaucaucacccccuacgaggggcagcgguccuaccucgugcaguacaugcaguucagcggcucccugcacaccaagcuguaccaggaggucgagaucgcgagcguggacgccuuccaggggcgcgagaaggacuucaucauccucuccugcgugcgggccaacgagcaccagggcaucggcuuccugaacgacccgcgccggcugaacgucgcccucacccgcgcccgguacggggugaucaucgugggcaaccccaaggcgcugagcaagcagccccuguggaaccaccuccugaacuacuacaaggagcagaagguccugguggaggggccccucaacaaccugcgcgagucccugaugcaguucagcaagccgcggaagcucgugaacacgaucaaccccggcgcccgcuucaugaccaccgccauguacgacgcccgggaggccaucauccccggguccgucuacgaccgcagcucccagggccgccccagcagcauguacuuccagacccacgaccagaucggcaugaucuccgcggggccgagccacguggccgccaugaacauccccauccccuucaaccuggugaugcccccgaugcccccgcccggcuacuucgggcaggccaacggccccgcggccggccgggggacgcccaagggcaagaccgggcgcggcgggcggcagaagaaccgcuucggccugcccggcccgucccagaccaaccuccccaacagccaggccucccaggacgucgccagccagcccuucucccagggggcccugacccagggcuacaucagcaugucccagcccagccagaugucccagccggggcugagccagcccgagcucucccaggacagcuaccugggcgacgaguucaagucccagaucgacguggcgcugagccaggacuccacguaccagggggagcgggccuaccagcacggcggcgugaccgggcucagccaguacuga

SEQ ID NO: 38465 - RNA, 3819 nt, Artificial Sequence
  derived and/or modified sequence opt1 from UPF2__Homo_sapiens__NP_542166
augcccgccgagcgcaagaagccggccagcauggaggagaaggacucccugcccaacaacaaggagaaggacugcagcgagcggcgcaccguguccagcaaggagcggcccaaggacgacaucaagcucaccgcgaagaaggaggucuccaaggcccccgaggacaagaagaagcgccuggaggacgacaagcggaagaaggaggacaaggagcgcaagaagaaggacgaggagaaggugaaggccgaggaggagagcaagaagaaggaggaggaggagaagaagaagcaccaggaggaggagcggaagaagcaggaggagcaggccaagcgccagcaggaggaggaggccgcggcccagaugaaggagaaggaggaguccauccagcugcaccaggaggccugggagcggcaccaccuccgcaaggagcugcggagcaagaaccagaacgccccggacucccgccccgaggagaacuucuucagccggcuggacuccagccucaagaagaacacggcguucgugaagaagcugaagaccaucaccgagcagcagcgcgacucccugagccacgacuucaacggccucaaccuguccaaguacaucgccgaggccgucgccagcaucguggaggccaagcugaagaucuccgacgugaacugcgcgguccaccucugcagccuguuccaccagcgguacgccgacuucgcccccucccugcuccagguguggaagaagcacuucgaggcccgcaaggaggagaagacccccaacaucacgaagcugcggaccgaccugcgcuucaucgccgagcucaccaucguggggaucuucaccgacaaggagggccugagccugaucuacgagcagcucaagaacaucaucaacgcggaccgggagagccacacgcacgucuccguggugaucagcuucugccgccacugcggggacgacaucgccggccuggucccgcggaaggugaaguccgccgccgagaaguucaaccugagcuucccgcccuccgagaucaucagccccgagaagcagcagcccuuccagaaccuccugaaggaguacuucaccucccugaccaagcaccucaagcgcgaccaccgcgagcugcagaacaccgagcggcagaaccgccggauccugcacagcaagggggagcucuccgaggaccgccacaagcaguacgaggaguucgccaugagcuaccagaagcugcuggcgaacucccagagccucgccgaccugcuggacgagaacaugcccgaccucccccaggacaagcccacgccggaggagcacggccccggcaucgacaucuucacccccgggaagcccggcgaguacgaccuggagggcgggaucugggaggacgaggacgcccggaacuucuacgagaaccugaucgaccucaaggccuucgugccggccauccuguucaaggacaacgagaaguccugccagaacaaggagagcaacaaggacgacaccaaggaggcgaaggaguccaaggagaacaaggaggucagcucccccgacgaccuggagcucgagcuggagaaccuggagaucaacgacgacacccucgagcuggagggcggggacgaggccgaggaccugacgaagaagcuccuggacgagcaggagcaggaggacgaggaggccagcaccggcucccaccugaagcugaucguggacgccuuccuccagcagcugcccaacugcgugaaccgcgaccugaucgacaaggcggccauggacuucugcaugaacaugaacaccaaggccaaccggaagaagcucguccgcgcccuguucaucgugccccggcagcgccuggaccuccugccguucuacgcccggcugguggcgacccuccaccccugcaugagcgacgucgccgaggaccugugcagcaugcugcgcggggacuuccgguuccacgugcgcaagaaggaccagaucaacaucgagacgaagaacaagaccgugcgguucaucggcgagcucaccaaguucaagauguucaccaagaacgacacgcugcacugccugaagaugcuccuguccgacuucagccaccaccacaucgagauggccugcacccugcucgagaccugcgggcgcuuccuguuccggucccccgagagccaccuccgcaccuccguccugcuggagcagaugaugcggaagaagcaggccaugcaccuggacgcccgcuacgugacgauggucgagaacgcguacuacuacugcaacccgccgcccgccgagaagaccgugaagaagaagcggccgccccuccaggaguacgugcgcaagcugcuguacaaggaccucagcaaggucaccaccgagaaggugcugcgccagaugcggaagcugcccuggcaggaccaggaggugaaggacuacgucaucugcugcaugaucaacaucuggaacgugaaguacaacuccauccacugcguggccaaccuccuggccggccugguccucuaccaggaggacgugggcauccacguggucgacggggugcuggaggacauccgccugggcauggaggugaaccagcccaaguucaaccagcggcgcaucagcuccgccaaguuccucggggagcuguacaacuaccggauggucgagagcgcggugaucuuccgcacgcuguacuccuucaccagcuucggcgugaaccccgacgggucccccagcucccucgacccgcccgagcaccuguuccggauccgccuggucugcaccauccucgacacgugcggccaguacuucgaccggggcagcuccaagcgcaagcuggacugcuuccugguguacuuccagcgguacgugugguggaagaagucccucgaggucuggaccaaggaccaccccuuccccaucgacaucgacuacaugaucagcgacacccuggagcugcuccgccccaagaucaagcugugcaacagccuggaggagagcauccgccaggugcaggaccucgagcgggaguuccugaucaagcuggggcucgugaacgacaaggacuccaaggacagcaugaccgagggcgagaaccuggaggaggacgaggaggaggaggagggcggggccgagaccgaggagcaguccgggaacgagagcgaggucaacgagcccgaggaggaggagggcuccgacaacgacgacgacgagggcgaggaggaggaggaggagaacaccgacuaccugacggacagcaacaaggagaacgagaccgacgaggagaacaccgaggugaugaucaagggcggcgggcucaagcacgugcccugcgucgaggacgaggacuucauccaggcccuggacaagaugaugcuggagaaccuccagcagcgguccggggagagcgugaaggugcaccagcuggacgucgccaucccgcugcaccucaagucccagcugcgcaaggggccgccccugggcggcggggagggcgaggcggagagcgccgacaccaugcccuucgugaugcucacgcggaaggggaacaagcagcaguucaagauccugaacgugcccauguccagccagcuggccgccaaccacuggaaccagcagcaggccgagcaggaggagcgcaugcggaugaagaagcucacccuggacaucaacgagcgccaggagcaggaggacuaccaggagaugcugcagucccucgcgcagcgccccgcccccgccaacaccaaccgggagcgccggccccgcuaccagcacccgaagggcgcccccaacgccgaccugaucuucaagaccggcgggcggcgccgguga

SEQ ID NO: 38466 - RNA, 1431 nt, Artificial Sequence
  derived and/or modified sequence opt1 from UPF3A__Homo_sapiens__NP_075387
augcgcagcgagaaggagggcgccgggggccugcgggccgcgguggccgcccgcgggcccuccggccgggagaagcucagcgcccuggagguccaguuccaccgcgacucccagcagcaggaggccgagaccccgcccaccagcuccagcgggugcggcggcggggcgggcaagccccgggaggagaagcgcacggcccuguccaagguggugauccggcgccugcccccggggcugaccaaggagcagcuggaggagcagcuccggccccugcccgcccacgacuacuucgaguucuucgccgcggaccugagccucuacccccaccuguacucccgcgccuacaucaacuuccggaacccggacgacauccuccucuuccgcgaccgguucgacggcuacaucuuccuggacagcaaggggcuggaguaccccgccgucguggaguucgcccccuuccagaagaucgccaagaagaagcuccgcaagaaggacgcgaagaccggcuccaucgaggacgaccccgaguacaagaaguuccuggagaccuacugcguggaggaggagaagacgagcgccaacccggagacccugcucggcgagauggaggccaagacccgggagcugaucgcccgccggaccacgccccugcucgaguacaucaagaaccgcaagcuggagaagcagcggauccgcgaggagaagcgggaggagcgccgccggcgcgagcuggagaagaagcggcuccgcgaggaggagaagcggcgccggcgcgaggaggagcggugcaagaagaaggagaccgacaagcagaagaagaucgccgagaaggagguccgcaucaagcugcugaagaagcccgagaagggggaggagcccaccaccgagaagccgaaggagcggggcgaggagaucgacaccgggggcggcaagcaggaguccugcgcgcccggggccguggugaaggcccgccccauggagggcagccucgaggagccccaggagacgucccacagcggguccgacaaggagcaccgggacgucgagcgcagccaggagcaggaguccgaggcccagcgguaccacguggacgacggccgccggcaccgcgcccaccacgagccggagcggcugagccgccgcagcgaggacgagcagcggugggggaagggccccggccaggaccgcgggaagaagggcucccaggacagcggggcgcccggcgaggccauggagcggcuggggcgcgcccagcggugcgacgacucccccgccccgcgcaaggagcggcucgccaacaaggaccgccccgcgcugcagcuguacgaccccggcgcccgguuccgcgcccgggagugcggcgggaaccgccggaucugcaaggccgagggcagcgggaccggccccgagaagcgcgaggaggcggaguga

SEQ ID NO: 38467 - RNA, 1413 nt, Artificial Sequence
  derived and/or modified sequence opt1 from UPF3B__Homo_sapiens__NP_075386
augaaggaggagaaggagcaccgccccaaggagaagcgggugacccugcucaccccggccggcgccacggggagcggcgggggcaccuccggggacagcuccaagggcgaggacaagcaggaccgcaacaaggagaagaaggaggcgcugagcaaggucgugauccggcgccugccgcccacccucaccaaggagcagcugcaggagcaccuccagcccaugcccgagcacgacuacuucgaguucuucuccaacgacacgagccuguacccccacauguacgcccgggccuacaucaacuucaagaaccaggaggacaucauccuguuccgcgaccgguucgacggcuacguguuccuggacaacaaggggcaggaguaccccgccaucgucgaguucgcccccuuccagaaggcggccaagaagaagaccaagaagcgcgacaccaaggugggcaccaucgacgacgacccggaguaccggaaguuccucgaguccuacgccacggacaacgagaagaugaccagcacccccgagacccugcuggaggagaucgaggccaagaaccgcgagcucaucgcgaagaagacgacgccccugcuguccuuccucaagaacaagcagcggaugcgcgaggagaagcgggaggagcgccggcgccgggagaucgagcgcaagcggcagcgcgaggaggagcggcgcaaguggaaggaggaggagaagcgcaagcggaaggacaucgagaagcugaagaagaucgaccgcauccccgagcgggacaagcugaaggacgagccgaagaucaagcuccugaagaagcccgagaagggggacgagaaggagcuggacaagcgcgagaaggccaagaagcucgacaaggagaaccugagcgacgagcgggccuccggccagagcugcacccugcccaagcgcuccgacagcgagcucaaggacgagaagcccaagcggccggaggacgaguccgggcgcgacuaccgggagcgcgagcgggaguacgagcgcgaccaggagcggauccugcgcgagcgggagcgccugaagcggcaggaggaggagcgccggcgccagaaggagcgcuacgagaaggagaagaccuucaagcggaaggaggaggagaugaagaaggagaaggacacccuccgcgacaagggcaagaaggccgagagcaccgaguccaucggcagcuccgagaagaccgagaagaaggaggagguggucaagcgggaccgcauccggaacaaggaccgccccgccaugcagcuguaccagcccggggcgcggagccgcaaccggcugugcccgcccgacgacagcaccaaguccggcgacagcgccgccgagcgcaagcaggaguccgggaucagccaccggaaggagggcggcgaggaguga

SEQ ID NO: 38468 - RNA, 822 nt, Artificial Sequence
  derived and/or modified sequence opt1 from UPK1A__Homo_sapiens__NP_001268372
auggccagcgccgcggccgccgaggccgagaagggcucccccguggucguggggcugcucguggucggcaacaucaucauccugcugagcgggcucucccuguucgccgagaccaucugggugaccgcggaccaguaccgcguguacccccugaugggcgucagcgggaaggacgacguguucgccggcgccuggaucgccaucuucugcggcuucuccuucuucaugguggcgagcuucggggucggcgccgcccucugccggcgccgguccauggugcugacguaccuggugcucaugcugaucgucuacaucuucgagugcgccagcugcaucaccuccuacacccaccgcgacuacauggugagcaaccccucccugaucaccaagcagaugcucacguucuacagcgccgacaccgaccaggggcaggagcugacccggcugugggaccgcgugaugaucgagcaggagugcugcggcaccuccgggcccauggacugggucaacuucacgagcgcguuccgggccgccacccccgaggugguguucccguggccgccccucugcugccgccggaccggcaacuucaucccccugaacgaggagggcugccgccuggggcacauggacuaccucuucaccaaggccggcguccaguggcacaaccuguccagccugcagcggcucccgcccggguucaagggcuucucccaccugagcuuccaguccagcugggacuaccgcgccgcgagcaacacguccgccacccccagcaccgccacccggggcgugucccgcgggcugggccuccccagcuga

SEQ ID NO: 38469 - RNA, 783 nt, Artificial Sequence
  derived and/or modified sequence opt1 from UPK1B__Homo_sapiens__NP_008883
auggccaaggacaacagcaccgugcgcugcuuccagggccugcucaucuucgggaacgucaucaucggcugcugcgggaucgcccugaccgcggagugcaucuucuucguguccgaccagcacagccuguacccccuccuggaggccacggacaacgacgacaucuacggcgccgccuggaucgggaucuucgugggcaucugccuguucugccucuccguccugggcaucguggggaucaugaaguccagccggaagauccugcucgccuacuucauccugauguucaucguguacgcguucgaggucgccagcugcaucaccgccgccacccagcaggacuucuucaccccgaaccuguuccucaagcagaugcuggagcgcuaccagaacaacuccccgcccaacaacgacgaccaguggaagaacaacggcgugacgaagaccugggaccggcugaugcuccaggacaacugcugcggggugaacggccccagcgacuggcagaaguacaccuccgcguuccgcaccgagaacaacgacgccgacuaccccuggccccggcagugcugcgucaugaacaaccugaaggagccccugaaccucgaggccugcaagcugggggugcccggcuucuaccacaaccagggcugcuacgagcugaucagcgggccgaugaaccgccacgccuggggcguggccugguucggguucgcgauccucugcuggacguucuggguccugcugggcaccauguucuacuggucccggaucgaguacuga

SEQ ID NO: 38470 - RNA, 555 nt, Artificial Sequence
  derived and/or modified sequence opt1 from UPK2__Homo_sapiens__NP_006751
auggcgccccugcucccgauccgcacccugccccugauccucauccugcuggcccuccugagccccggcgccgccgacuucaacaucuccagccuguccgggcuccugagccccgcccugaccgagucccuccugguggcccugccgcccugccaccucacgggcgggaacgccacccugaugguccggcgcgcgaacgacagcaagguggugaccuccagcuucgucgugccgcccugccggggccgccgggagcugguguccgucguggacagcggggccggcuucaccgugacgcgccucuccgccuaccaggucaccaaccuggugcccggcaccaaguucuacaucagcuaccuggugaagaaggggaccgccacggaguccagccgggagauccccauguccacccucccccgccggaacauggagagcaucggccuggggauggcgcgcaccggcgggauggucgugaucaccgugcugcucuccgucgccauguuccugcuggugcucggcuucaucaucgcccuggcccugggcagccggaaguga

SEQ ID NO: 38471 - RNA, 501 nt, Artificial Sequence
  derived and/or modified sequence opt1 from UPK3A__Homo_sapiens__NP_001161046
augcccccgcugugggcccuccuggcccugggcugccuccgcuucgggagcgcggugaaccugcagccccagcuggccuccgucaccuucgccaccaacaaccccacgcucaccaccguggcccuggagaagccccugugcauguucgacagcaaggaggcccucaccggcacgcacgagguguaccuguacguccugguggacuccgugaccccguacagcaccaucgacaccuggcccgggcggcgcuccggcgggaugaucgucaucacgagcauccucggcucccugcccuucuuccugcucgugggcuucgcgggggccaucgcccugagccugguggacaugggcuccagcgacggggagaccacccacgacucccagaucacccaggaggccguccccaagagccucggcgcguccgagagcuccuacacgagcgugaaccgggggccgccccuggaccgcgccgagguguacuccagcaagcugcaggacuga

SEQ ID NO: 38472 - RNA, 933 nt, Artificial Sequence
  derived and/or modified sequence opt1 from UPP1__Homo_sapiens__NP_001274355
auggccgccaccggcgcgaacgccgagaaggccgagagccacaacgacugccccgugcgccugcucaacccgaacaucgccaagaugaaggaggacauccuguaccacuucaaccugaccacgucccggcacaacuuccccgcccucuucggggacgucaaguucgugugcgugggcgggagccccucccgcaugaaggcguucauccggugcgucggcgccgagcuggggcuggacugccccggccgcgacuacccgaacaucugcgccggcaccgaccgguacgccauguacaagguggggcccgugcucagcgucucccacggcauggggauccccagcaucuccaucaugcugcacgagcugaucaagcuccuguacuacgcgcgcugcagcaacgugaccaucauccggaucggcaccuccgggggcaucggccuggagcccgggacgguggucaucaccgagcaggccguggacacgugcuucaaggccgaguucgagcagaucgugcucggcaagcgcgucauccggaagaccgaccugaacaagaagcuggugcaggagcuccugcugugcagcgccgagcucuccgaguucaccaccguggucgggaacaccaugugcacccuggacuucuacgagggccagggccgccuggacggggcccucugcagcuacacggagaaggacaagcaggcguaccuggaggccgccuacgccgccggcgugcggaacaucgagauggaguccagcguguucgcggccaugugcuccgccugcgggcugcaggccgccgucgugugcgugacccuccugaaccgccuggagggcgaccagaucagcuccccgcggaacguccucagcgaguaccagcagcgcccccagcggcugguguccuacuucaucaagaagaagcugagcaaggcguga

SEQ ID NO: 38473 - RNA, 1125 nt, Artificial Sequence
  derived and/or modified sequence opt1 from UPP2__Homo_sapiens__NP_001128570
augcuggcccccggcugcgagcucgacccggaccaggaggugguccgcacccggcccgaggacgugcccgccagccccuccaccagcacgaugaucguguccguccugcgcccgcccagccacgcguccugcaccgccugcgggaccgugaccuuccacaucguggagcggauggccagcgucauccccgccuccaaccgcagcaugcgguccgaccgcaacacguacgugggcaagcgguucgugcacgucaagaaccccuaccuggaccucauggacgaggacauccuguaccaccuggaccucgggaccaagacccacaaccugccggccauguucggcgacgugaaguucgugugcgucgggggcagccccaaccgcaugaaggcguucgcccuguucaugcacaaggagcucggcuucgaggaggccgaggaggacaucaaggacaucugcgccgggaccgaccgguacugcauguacaagacgggccccgugcuggcgaucucccacgggaugggcauccccagcaucuccaucaugcugcacgagcucaucaagcugcugcaccacgcccgcugcugcgacgugaccaucauccggaucgggaccagcggcggcaucgggaucgccccgggcaccgucgugaucacggacaucgccguggacuccuucuucaagccccgcuucgagcaggucauccucgacaacaucgugacccggagcaccgagcuggacaaggagcuguccgaggagcuguucaacugcagcaaggagauccccaacuuccccacccucguggggcacacgaugugcaccuacgacuucuacgagggccagggccgccuggacggggcccucugcuccuucagccgggagaagaagcuggacuaccugaagcgcgcguucaaggccggcguccggaacaucgagauggagagcaccguguucgccgccaugugcgggcucugcggccugaaggccgcgguggucugcgugacccugcucgaccgccuggacugcgaccagaucaaccugccgcacgacguccucguggaguaccagcagcggccccagcugcugaucuccaacuucauccgccggcgccucgggcugugcgacuga

SEQ ID NO: 38474 - RNA, 930 nt, Artificial Sequence
  derived and/or modified sequence opt1 from UPRT__Homo_sapiens__NP_659489
auggccaccgagcugcagugccccgacagcaugccgugccacaaccagcaggucaacuccgccagcacccccucccccgagcagcuccgccccggcgaccugauccuggaccacgccgggggcaaccgggcgagccgcgccaaggugauccuccugacgggguacgcccacuccagccugccggccgagcucgacuccggcgcgugcgggggcagcucccugaacagcgagggcaacuccgggagcggcgacuccagcuccuacgacgcccccgccgggaacagcuuccuggaggacugcgagcucucccggcagaucggcgcccagcugaagcugcuccccaugaacgaccagauccgcgagcugcagaccaucauccgggacaagaccgcgagccgcggggacuucauguucuccgccgaccggcugauccgccucgugguggaggagggccugaaccagcugcccuacaaggagugcauggucaccacgccgaccggcuacaaguacgagggggugaaguucgagaagggcaacugcggggugagcaucaugcggagcggcgaggccauggagcagggccuccgcgacugcugccgguccauccgcaucgggaagauccugauccagagcgacgaggagacccagcgggccaaggucuacuacgccaaguucccgcccgacaucuaccgccggaaggugcugcucauguaccccauccuguccaccggcaacacggugaucgaggcggucaaggugcugaucgagcacggggugcagcccagcgucaucauccuccugucccuguucagcacgccccacggcgccaaguccaucauccaggaguuccccgagaucaccauccucaccaccgaggugcaccccguggccccgacccacuucgggcagaaguacuucggcaccgacuga

SEQ ID NO: 38475 - RNA, 696 nt, Artificial Sequence
  derived and/or modified sequence opt1 from UQCC1__Homo_sapiens__NP_001171906
auggcccugcucgugcgcguccugcggaaccagaccagcaucucccagugggugcccgugugcagccgccugaucccggucucccccacccagggccagggggaccgggcccucagccgcacgucccagaagaucaagaucgcggcccugcggauguacaccagcugcguggagaagaccgacuucgaggaguucuuccugcgcugccagaugcccgacaccuucaacuccugguuccucaucacgcugcugcacguguggaugugccucguccggaugaagcaggagggccgcagcgggaaguacaugugccggaucaucgugcacuucaugugggaggacgugcagcagcgcggccgggucaugggggugaaccccuacauccugaagaagaacaugauccugaugaccaaccacuucuacgccgccauccucggcuacgacgagggcauccuguccgacgaccacgggcuggccgcggcccucuggcgcaccuucuucaaccggaagugcgaggacccgcgccaccuggagcugcucguggaguacguccggaagcagauccaguaccuggacagcaugaacggcgaggaccugcuccugaccggggagguguccuggcgcccccugguggagaagaacccccagagcauccucaagccccacuccccgacguacaacgacgagggccuguga

SEQ ID NO: 38476 - RNA, 381 nt, Artificial Sequence
  derived and/or modified sequence opt1 from UQCC2__Homo_sapiens__NP_115716
auggccgccagccgcuaccggcgcuuccugaagcucugcgaggaguggcccguggacgagaccaagcggggccgcgaccugggggcguaccugcggcagcgcgucgcccaggccuuccgggagggcgagaacacccagguggccgagccggaggccugcgaccagauguacgagucccucgcgcgccugcacagcaacuacuacaagcacaaguacccccggccccgcgacacguccuucagcgggcugucccucgaggaguacaagcugauccugagcaccgacacccucgaggagcugaaggagaucgacaagggcauguggaagaagcugcaggagaaguucgcccccaaggggccggaggaggaccacaaggccuga

SEQ ID NO: 38477 - RNA, 336 nt, Artificial Sequence
  derived and/or modified sequence opt1 from UQCRB__Homo_sapiens__NP_006285
auggccggcaagcaggccgugagcgcguccgggaaguggcuggacggcauccgcaagugguacuacaacgccgccggguucaacaagcucggccugaugcgggacgacaccaucuacgaggacgaggacgucaaggaggccauccgccggcugcccgagaaccucuacaacgaccgcauguuccggaucaagcgcgcccuggaccugaaccucaagcaccagauccugccgaaggagcaguggaccaaguacgaggaggagaacuucuaccuggagcccuaccucaaggaggugauccgggagcgcaaggagcgggaggagugggcgaagaaguga

SEQ ID NO: 38478 - RNA, 1443 nt, Artificial Sequence
  derived and/or modified sequence opt1 from UQCRC1__Homo_sapiens__NP_003356
auggccgccagcguggucugccgcgcggccaccgccggcgcccaggugcugcuccgggcccgccggucccccgcgcugcugcgcaccccggcccuccggagcacggccaccuucgcccaggcgcugcaguucgugcccgagacccaggucucccugcucgacaacgggcugcgcguggccagcgagcaguccagccagccgaccugcacggugggcgucuggaucgacguggggucccgguucgagaccgagaagaacaacggcgccggguacuuccuggagcaccucgccuucaagggcaccaagaaccgccccggcagcgcccuggagaaggagguggaguccaugggggcgcaccugaacgccuacagcacccgggagcacacggccuacuacaucaaggcccucuccaaggaccugcccaaggccgucgagcugcucggcgacaucgugcagaacugcagccuggaggacucccagaucgagaaggagcgcgacgugauccugcgggagaugcaggagaacgacgcgagcaugcgcgacgucguguucaacuaccuccacgccaccgccuuccaggggacgccccuggcccaggccguggagggccccuccgagaacguccggaagcugagccgcgcggaccucaccgaguaccuguccacccacuacaaggcgccccggauggugcuggccgccgccgggggcguggagcaccagcagcuccuggaccuggcccagaagcaccucggcgggaucccguggaccuacgccgaggacgccguccccacccugacccccugccgcuucacgggcagcgagauccggcaccgcgacgacgcccugcccuucgcgcacguggccaucgccguggaggggccgggcugggccucccccgacaacgucgcccuccagguggcgaacgccaucaucggccacuacgacugcaccuacgggggcggggugcaccugagcagcccccuggccuccggcgccgucgccaacaagcucugccagagcuuccagaccuucuccaucugcuacgcggagaccgggcugcugggcgcccacuucgugugcgaccggaugaagaucgacgacaugauguucguccuccagggccaguggaugcgccugugcacgagcgccaccgaguccgagguggcccgggggaagaacauccugcgcaacgcccucgugagccaccuggacggcaccacccccgucugcgaggacaucgggcgcucccugcucacguacggccggcgcaucccgcuggcggagugggagagccggaucgccgagguggacgccuccgugguccgcgagaucugcagcaaguacaucuacgaccagugccccgccguggcgggguacggccccaucgagcagcugcccgacuacaaccggauccgcuccggcauguucuggcuccgguucuga

SEQ ID NO: 38479 - RNA, 1362 nt, Artificial Sequence
  derived and/or modified sequence opt1 from UQCRC2__Homo_sapiens__NP_003357
augaagcugcucacccgcgccggcagcuucucccgguucuacagccugaagguggcccccaaggucaaggcgaccgccgccccggccggggccccgccccagccccaggaccuggaguucacgaagcuccccaacggccuggugaucgcgucccuggagaacuacagccccgugucccgcaucgggcuguucaucaaggccggcagccgguacgaggacuucuccaaccuggggaccacccaccuccuccgccugaccagcucccugacgaccaagggcgccagcuccuucaagaucacccggggcaucgaggccgucgggggcaagcucagcgugaccgcgacgcgcgagaacauggccuacaccguggagugccugcgcggggacgucgacauccugauggaguuccuccugaacgugaccaccgcccccgaguuccggcggugggagguggccgaccugcagccccagcucaagaucgacaaggccgucgcguuccagaacccgcagacgcacgugaucgagaaccugcacgccgccgccuaccgcaacgcccuggcgaacccccucuacugccccgacuaccggaucggcaaggugaccuccgaggagcugcacuacuucguccagaaccacuucaccagcgcccgcauggcccugaucgggcucggcgugucccaccccgugcugaagcaggucgccgagcaguuccugaacaugcggggcgggcucggccugagcggggccaaggcgaacuaccgcggcggcgagauccgggagcagaacggggacucccuggugcacgccgccuucguggccgagagcgccgucgcgggcuccgccgaggccaacgccuucagcgugcuccagcacgugcugggggcgggcccgcacgucaagcgcgggagcaacaccacgucccaccuccaccaggccguggccaaggccacccagcagcccuucgacgugagcgccuucaacgcguccuacagcgacuccggccuguucggcaucuacaccaucagccaggccaccgccgccggggacgucaucaaggccgcguacaaccaggugaagacgaucgcccagggcaaccuguccaacaccgacguccaggccgccaagaacaagcugaaggccggguaccucaugagcguggaguccagcgagugcuuccuggaggaggugggcucccaggcgcuggucgccgggagcuacaugccgcccuccaccgugcuccagcagaucgacagcguggccaacgccgacaucaucaacgcggccaagaaguucgucuccggccagaaguccauggccgccagcggcaaccuggggcacacccccuucguggacgagcuguga

SEQ ID NO: 38480 - RNA, 825 nt, Artificial Sequence
  derived and/or modified sequence opt1 from UQCRFS1__Homo_sapiens__NP_005994
augcugagcguggccucccgcagcggccccuucgccccgguccucuccgcgaccagccgcgggguggccggcgcccugcggccccuggugcaggccaccguccccgccacgcccgagcagccggugcucgaccugaagcggcccuuccugucccgcgagagccucuccgggcaggcggugcggcgcccccuggucgccagcgugggccugaacgugcccgccuccgucugcuacagccacaccgacaucaaggugccggacuucuccgaguaccggcgccucgaggugcuggacagcaccaaguccagccgggaguccagcgaggcccgcaagggguucuccuaccuggucaccggcgugacgaccgugggcgucgcguacgccgccaagaacgccgugacccaguucgugagcuccaugagcgccagcgcggacguccucgcccuggccaagaucgagaucaagcuguccgacauccccgaggggaagaacauggccuucaaguggcggggcaagccccucuucgugcgccaccggacccagaaggagaucgagcaggaggccgcgguggagcugagccagcugcgcgacccccagcacgaccucgaccgggucaagaagccggagugggugauccugaucggggugugcacgcaccugggcugcguccccaucgccaacgccggggacuucggcggcuacuacugccccugccacgggucccacuacgacgccagcggccgcauccggcucgggcccgccccgcugaaccuggaggugcccaccuacgaguucaccuccgacgacauggucaucgugggcuga

SEQ ID NO: 38481 - RNA, 249 nt, Artificial Sequence
  derived and/or modified sequence opt1 from UQCRQ__Homo_sapiens__NP_055217
augggccgcgaguucgggaaccugacccggaugcgccacgugaucagcuacucccucagccccuucgagcagcgggccuacccgcacgucuucaccaagggcauccccaacgugcugcgccggauccgcgaguccuucuuccggguggucccccaguucgugguguucuaccugaucuacacgugggggaccgaggaguucgagcgcagcaagcggaagaaccccgccgcguacgagaacgacaaguga

SEQ ID NO: 38482 - RNA, 4464 nt, Artificial Sequence
  derived and/or modified sequence opt1 from URB2__Homo_sapiens__XP_005273417
auggccgccguguacagcggcaucucccugaagcucaagagcaagaccaccuccugggaggacaagcugaagcuggcgcacuucgccuggaucagccaccagugcuuccuccccaacaaggagcagguccugcuggacugggcccgccagucccucguggccuucuacaagaagaagcuggagcugaaggaggacaucguggagcggcucuggaucuacaucgacaacauccugcacagccgcaagcugcagaaccuccugaagaacgggaagacgaucaaccugcagaucucccucgucaagaucaucaacgagcggguggccgaguucagccuguccggcagccagcgcaacaucugcgcggugcugcggugcugccaggggauccucuccaccccggcccuggccgucaucuacaccgccaagcaggagcugaugguggcgcuccugagccagcugugcugguccgccugccgccagcccgagggcgccguggucgcccagcuguucgaggugauccaccuggcccuggggcacuaccuccugauccugcagcagcaggucaacccccggcgcgcguucggcgacgugaccgcccaccuccugcagcccugccuggugcuccggcaccuccugagcggcgggacguggacccaggccggccaggggcagcuccgccaggugcugucccgggacauccgcagccagaucgaggccauguuccggggcgggaucuuccagccggagcugcucuccagcuacaaggagggccugcuggaccagcagcagggcgacgucaagaccggggccaugaagaaccuccuggcgcccauggacaccgugcugaaccgccucguggacgccggcuacugcgccgccucccugcacacgagcgucguggccaacagcguggcgcugcucuacaagcuguuccuggacuccuacuucaaggaggggaaccagcugcucugcuuccagguccugccccggcuguucggcugccucaagaucagccaccuccaggaggagcaguccaaggcccugagcaccuccgacuggaccaccgagcuccuggugguggagcagcugcucaacagcgucgccaacaacaacaucuacaacaucgccgccgaccgcauccggcacgaggaggcgcaguuccgcuucuaccggcacguggccgagcugcugaucaaccacgcccaggcccccaucccggcgugguuccgcugccucaagacgcugaucucccugaaccaccucauccuggagcccgaccuggacgaccuccuggccagcgccuggaucgacgccgaggucaccgaguuccggaccaagaaggcccaggaggcgcugauccgcaccguguuccagacguacgccaagcuccgccaggugccccggcuguucgaggagguccugggcgugaucugccgccccgccgccgaggcccuccggcagccggugcuggcguccgggcccagcaccguccuguccgccugccuccuggagcugccgcccagccagauccucgacaccuggucccuggugcuggagaaguuccagagccucgugcugcccuaccugcaguccgacgccgacauggcccucaagagccugucccugagccuccugcugcacugcaucauguucaacaugcgcucccucgacagcagcacgccccugcccaucguccggcgcacccagugcaugauggagcggaugaugcgcgagcuggugcagccccuccuggcccugcucccggacacccccggccccgagcccgagcuguggcugcagaagguguccgacagcguccuccugcuguccuacaccugggcccagguggacgcgauguucagccucaacugcucccaguaccacagcauguccgggccgcugaucggcguggcccuggagaucagcaaccuccccucccugcugcccggggucaagacccagcacuggaagaagaucgagaaguucacggcccaguucagcucccucggcaccuacugccuggagcagcuguaccuccagaagaugaagcggacccugaugcagaccagcuuccgcuccgagggcgcgauccagagccugcggugcgacgccgccuucaucaucggguccggccgcaagagccucaaccagcggacgaccgccuccugggacggccagguggggauggugagcgggcugaccuaccccgucgcccacuggcaccugaucgugagcaaccucaccauccugaucuccuaccugugcccggacgacgugggcuaccucgcgagcguccugcugcgcacgcuccccaugggcaaggcccaggagguguccaucgacgaggaggccuacaucacccuggagaagaucagcaaggccuuccugcacagcccccucuucccggagaugcagucccugcacuccgccuuccugaccugcgugaccacgagcugcuccagcauccucugcuccggggcgcagcgggacagcggccuggucucccagcagcugcccuggcuguucgagaaggaccacauggugguggggcacugggagaaccgcuucgccaaggccggccccgaggggaucgagccccggggcgagaucgcccagaaccugcugagccucgucaaguccgacuucccgauccagcuggagggcgagcagcuggagagcauccucgggcugcuggaggugaucuccgcccuccagcuggacagccugcugccgcccuaccacgugcacuacuuccucguccugcuguccauggcggugaccaagcucggcugcagcugcagcuccagccuggcccugaaguuccucacgaccugcuaccagcugcugggguaccuccagaagggcaaguccgcccgcagcguguucaagaucauguacggcuccgacaucuucgaggucgugcugaccagccuguuccgggccuccagccgcuuccucaucgagauggacgaccccgcguggcuggaguuccuccaggugaucgggaccuuccuggaggagcugaugcagaugcugauccagaugaagcucucccugguccugaacuuccgcaagaucaccgccuuccucagcuccagcaagcccuacaccgaggccgccuccagcaagcagcuggagaaccagaacccccagggccggcagcugcuccuggugucccugacccgccucugccacgugcuggggcccuuccugaaggagcagaagcucggccaggaggcccccgcggcccugagcgagcugcuccagcaggucgugcugcagacgggggccgugcugcagcucugcuccgucccgggcgcccggggcuggcgccugcccagcgugcugaucuccagcgugagcacccuccuggaggccgaccuggggcagcacugccgggacggcggggcggacaucucccagggcagcgaccgcacccuccugucccacgucgcccuguaccaggggguguacagccagauccuccuggagcugcccgcccucgccggccacgaccaguccuuccaggccgcgcugcaguuccugacccucuucuuccuggcccccgagcugcacccgaagaaggacagcguguucacguccauguuccacagcguccggcgcgugcucgccgaccccgagauccccgugcaggucacccaggacaucgagccccaccugggcgcccuguucacccagaugcucgagguggggaccacggaggaccugcggcuggucaugcagugcauccuccagggccuggacguguccaacauguggaaggccgacgugcagcugcucaaccgcgaggcgagccaggagcagccggucucccugaccgugguggggcccguccuggacgugcucgccgcccugcugcggcagggcgaggaggccaucgggaacccccaccacgugagccucgcguucuccauccugcugaccgucccccucgaccaccugaagccgcuggaguacggcagcguguucccccgccuccacaacgugcuguucuccauccugcagugccaccccaaggucaugcucaaggccaucccgagcuuccugaacuccuucaaccggcugguguucagcgugaugcgcgagggccggcagaaggacaagggguccaucgacgaccuccccaccguccugaagugcgcccgccugguggagcggauguacagccacaucgccgcccgcgcggaggaguucgccguguucagccccuucauggucgcccaguacgugcucgaggugcagaaggucacgcuguaccccgccgugaagucccugcuccaggagggcaucuaccugauccuggaccucugcaucgagccggacgugcaguuccugcgggccagccugcagcccgggaugcgcgacaucuucaaggagcucuacaacgacuaccugaaguaccacaaggcgaagcacgagggcgagaagcgguacaccgccuga

SEQ ID NO: 38483 - RNA, 2796 nt, Artificial Sequence
  derived and/or modified sequence opt1 from URGCP__Homo_sapiens__NP_001071131
auggccagccccggcaucgagguggagcugcucgggaagggccacuccgaccugggggaggucgccccggagaucaaggcgagcgagcgccggaccgccguggccaucgccgaccuggaguggcgcgagauggagggcgacgacugcgaguuccgguacggggacggcaccaacgaggcccaggacaacgacuuccccacgguggagcgcucccggcuccaggagaugcugagccugcucggccuggagaccuaccagguccagaagcugucccuccaggacagccugcagaucuccuucgacagcaugaagaacugggcgccccaggugcccaaggaccugccguggaacuuccuccgcaagcugcaggcccugaacgccgacgcccggaacaccaccauggugcucgacguccugcccgacgcgcgccccguggagaaggagucccagauggaggaggagaucaucuacugggaccccgccgacgaccuggccgccgacaucuacagcuucuccgagcucccgacgcccgacacccccgugaacccccuggaccugcucugcgcccugcugcucagcuccgacagcuuccugcagcaggagaucgcgcugaagauggcccucugccaguucgcccugccgcugguccuccccgacuccgagaaccacuaccacaccuuccugcugugggccaugcgggggaucgugcgcaccugguggagccagccgccccggggcaugggguccuuccgcgaggacagcgugguccucucccgggcccccgcguucgccuucgugcgcauggacgugagcagcaacuccaagagccagcugcugaacgccguccucucccccggccaccggcagugggacugcuucuggcaccgcgaccugaaccuggggacgaacgcccgggagaucagcgacggccucguggagaucuccugguucuuccccagcggccgcgaggaccuggacaucuuccccgagccgguggccuuccugaaccuccgcggggacaucggcucccacuggcugcaguucaagcugcucaccgagaucagcuccgcggucuucauccugaccgacaacaucagcaagaaggaguacaagcugcucuacuccaugaaggagagcaccacgaaguacuacuucauccugucccccuaccgggggaagcggaacaccaaccugcgcuuccugaacaagcucauccccgugcugaagaucgaccacagccacgugcuggucaagguguccagcaccgacuccgacagcuucgugaagcgcauccgggccaucgucggcaacgugcuccgcgcccccugccggcgcgucuccguggaggacauggcccacgccgcgcggaagcugggccugaagguggacgaggacugcgaggagugccagaaggccaaggaccgcauggagcggaucacccgcaagaucaaggacagcgacgccuaccggcgcgacgagcuccggcugcagggggacccguggcgcaaggccgcgcaggucgagaaggaguucugccagcugcagugggccguggacccgcccgagaagcaccgggccgagcuccgccggcgccugcuggagcuccggaugcagcagaacggccacgaccccagcuccggggugcaggaguucaucagcggcaucuccagccccucccugagcgagaagcaguacuuccugcgcuggauggagugggggcucgcccgggucgcccagccccgccugcgccagcccccggagacgcugcucacccugcggcccaagcacggcggcaccaccgacgugggggagccccuguggcccgagccgcucggcguggagcacuuccugcgcgagauggggcaguucuacgaggcggaguccugccuggucgaggccggccggcuccccgccgggcagcgccgguucgcccacuuccccggccuggccagcgagcugcuccugacgggccugccccucgagcugaucgacggguccacccugagcaugccggugcgcugggugaccggccuccugaaggagcugcacguccggcucgagcgccggucccgccugguggugcugagcaccgucggggugcccggcacggggaaguccacccuccugaacaccauguucggccugcgguucgcgaccggcaagagcugcgggccccgcggcgccuucaugcagcucaucacgguggccgagggguucucccaggaccugggcugcgaccacauccuggucaucgacagcggcgggcucaucggcggggcccugaccuccgccggcgaccgguucgagcuggaggcgagccucgccacccugcugauggggcucagcaacgugaccgugaucucccuggccgagacgaaggacauccccgccgcgauccugcacgccuuccuccgccuggagaagaccggccacaugccgaacuaccaguucgucuaccagaaccugcacgacgugagcgugcccggcccccggccccgcgacaagcggcagcuccuggacccgcccggggaccugucccgcgccgccgcccagauggagaagcagggcgacggguuccgggcgcucgccggccuggccuucugcgaccccgagaagcagcacaucuggcacauccccgggcuguggcacggcgccccgcccauggccgcggucagccucgccuacuccgaggccaucuucgagcugaagcgcugccugcucgagaacauccggaacggccugagcaaccagaacaagaacauccagcagcugaucgagcucgugcgccgccuguga

SEQ ID NO: 38484 - RNA, 1428 nt, Artificial Sequence
  derived and/or modified sequence opt1 from URI1__Homo_sapiens__NP_001239570
augaccaccuggagcucccugcagggcagccacguguccaagcgcgcccucgccuacgcgcuggucgugacgaacugccaggagcggauccagcacuggaagaagguggacaacgacuacaacgcccugcgcgagcggcucagcacccugcccgacaagcuguccuacaacaucauggucccguucgggcccuucgccuucaugcccggcaagcucgugcacaccaacgaggugaccguccugcugggggacaacugguucgccaagugcagcgccaagcaggcggugggccucguggagcaccgcaaggagcacguccggaagacgaucgacgaccugaagaaggugaugaagaacuucgagucccgcguggaguucaccgaggaccugcagaagaugagcgacgccgccggggacaucgucgacauccgggaggagaucaagugcgacuucgaguucaaggccaagcaccgcaucgcgcacaagccccacuccaagccgaagaccagcgacaucuucgaggccgacaucgccaacgacgugaaguccaaggaccuccuggccgacaaggagcugugggcccggcucgaggagcuggagcgccaggaggagcugcucggcgagcuggacagcaagcccgacaccgugaucgcgaacggcgaggacacgaccuccagcgaggaggagaaggaggaccggaacaccaacgucaacgccaugcaccaggugaccgacucccacacgcccugccacaaggacguggccagcuccgagcccuucagcgggcaggucaacucccagcugaacugcagcgugaacggcagcuccagcuaccacuccgacgacgacgacgacgacgacgacgacgacgacgacgacaacaucgacgacgacgacggggacaacgaccacgaggcccucggcgugggggacaacagcaucccgaccaucuacuucucccacaccgucgagcccaagcgcgugcggaucaacaccggcaagaacacgacccugaaguucagcgagaagaaggaggaggccaagcgcaagcggaagaacuccaccggcagcgggcacuccgcgcaggagcugcccaccauccgcacgcccgccgacaucuaccgggccuucguggacgucgugaacggcgaguacgucccgcgcaagagcauccucaagucccggagccgcgagaacuccgugugcagcgacaccuccgagagcuccgccgccgaguucgacgaccggcgcggggugcugcgcagcaucuccugcgaggaggcgaccugcagcgacaccagcgaguccauccuggaggaggagccccaggagaaccagaagaagcuccugccccugagcgucacgcccgaggugcuccggcuggugggcuacucccgcaaccuggccccgcucaacgucauccuguga

SEQ ID NO: 38485 - RNA, 441 nt, Artificial Sequence
  derived and/or modified sequence opt1 from URM1__Homo_sapiens__NP_001129419
auggccgcgccccugagcguggaggucgaguucggcgggggcgccgagcuccuguucgacgggaucaagaagcaccgcgugacccugcccggccaggaggagcccugggacauccggaaccuccugaucuggaucaagaagaaccugcucaaggagcgccccgagcuguucauccagggggacuccgugcggcccggcauccugguccucaucaacgacgccgacugggagcugcuggugagcacccucggcgacaucccgccgcccgcccccgcccuggccgcguccguggggaagcgcugggccagcccccaggcccacaucgaguggcugggcaacccgccgccccacuccagccccacgcuccggcugcuggagucccccacccccggggaggagggcauggggagcuggggccacggcuccaccccgcccagcuga

SEQ ID NO: 38486 - RNA, 2211 nt, Artificial Sequence
  derived and/or modified sequence opt1 from UROC1__Homo_sapiens__NP_001159446
augagcucccugcaggcccucugcagcggccugccccugcgcccgcuccccgagaaccgggggcgccaggccggcgugccccacgcgcccguccggaccccgucccugagccccguggagaagcagcuggcccuccgcaacgcccugcgguacuucccgcccgacgugcaggagcugcucgcccccgaguucgcccaggagcugcagcuguacgggcacaucuacauguaccgcuucugccccgacaucgagaugcgggcguaccccaucgagcaguaccccugccagaccaaggucgccgccgccaucaugcacaugaucaugaacaaccucgacccggcgguggcccaguucccccaggagcuggugacguacggcgggaacggccaggucuucuccaacugggcccaguucuggcugaccauguucuaccucagcaagaugaccgaggagcagacccuggugauguacuccggccacccccugggccucuuccccagcucccgcagcgccccgcggcuggugaucacgaacgggauggucauccccaacuacuccagccgcaccgaguacgagaagcuguucgcccucggggugaccauguacggccagaugaccgcgggguccuacugcuacaucggcccccagggcaucgugcacgggacgguccugaccgugcugaacgccgcccggcgcuaccucggcaucgaggaccuggccgggaagguguucgucaccagcggccugggcgggauguccggcgcccaggcgaaggccgccgugaucguggggugcaucggcgucaucgccgagguggacaaggccgcgcucgagaagcggcaccgccagggguggcugauggaggugaccgacagccuggaccggugcauccagcgccuccggguccugcagcugggccuccagcaggcccugggcugggccgggcugcccgccgcccucggccugugcgugcuguccugcuucgugaaccucgcgccgcugggggagggccgcugccuggcccccagcggguucucccggccccuccugggcgcccccguccugcuccugugcccgagccgcgaggcccggaagaagaaggaggugcugagccucggcuaccacgggaacgucguggcgcugugggagcgccuggugcacgagcuggacacgaccggcgagugccucgucgaccugggguccgaccagaccagcugccacaaccccuucaacggcggguacuaccccgugcagcuguccuucaccgaggcccagagccucauggccuccaaccccgccguguucaaggaccugguccaggagagccugcgccgccagguguccgccaucaaccggcucgcggaggagaaguucuucuucugggacuacggcaacgccuuccugcuggaggcccagcgggccggcgccgacguggagaagaagggggcgggccgcacggaguuccgguacccgagcuacguccagcacaucaugggggacaucuucucccagggcuucggccccuuccgcugggugugcaccagcggggacccccaggaccucgccgugaccgacgagcuggccaccuccguccuggaggaggccaucgccgacggcgugaaggugagcgucaagcuccaguacauggacaacauccgguggauccgcgaggcggcccggcaccgccuggugguggggucccaggcccggauccuguacagcgaccagaagggccgcgucgccaucgcgguggccaucaaccaggccaucgccugccggcgcaucaaggccccggugguccucucccgggaccaccacgacgugagcgggacggacucccccuuccgcgagaccagcaacaucuacgacggcuccgcguucugcgccgacauggccgugcagaacuucgucggcgacgccugccgcggggccaccuggguggcgcugcacaacggcgggggcgugggguggggcgaggucaucaacggcggguucggccuggugcucgacgggacccccgaggccgagggccgggcccggcugaugcugagcugggacgugagcaacggggucgcccgccgcugcugguccggcaaccagaaggccuacgagaucaucugccagacgaugcaggagaacagcacccucguggugacccugccccacaaggucgaggacgagcgggugcugcagcaggcgcuccagcuguga

SEQ ID NO: 38487 - RNA, 1041 nt, Artificial Sequence
  derived and/or modified sequence opt1 from UROD__Homo_sapiens__XP_011540382
auggaggccaacggccuggggccccagggcuucccggagcucaagaacgacaccuuccugcgcgccgcguggggcgaggagaccgacuacacgcccguguggugcaugcggcaggccgggcgcuaccugcccgaguuccgggagacccgcgccgcccaggacuucuucagcacgugccggucccccgaggccugcugcgagcucacccugcaggcgcuggggauggaggucaccauggugccgggcaagggccccagcuuccccgagccccuccgcgaggagcaggaccuggagcggcugcgcgacccggagguggucgccuccgagcucggguacguguuccaggccaucacccugacccggcagcgccuggccggccgggugccccucaucggguucgcgggcgcccccuggacccugaugacguacauggucgagggcgggggcagcuccaccauggcccaggccaagcgcuggcuguaccagcggccccaggccagccaccagcuccugcgcauccugaccgacgcgcucgugccguaccugguggggcaggucguggccggcgcccaggcccugcagcuguucgagucccacgccgggcaccucggcccccagcuguucaacaaguucgcgcuccccuacauccgggacguggccaagcaggucaaggcccgccugcgggaggccggccuggcccccgugccgaugaucaucuucgcgaaggacgggcacuucgcccucgaggagcuggcccaggccggcuacgagguggucgggcuggacuggaccguggcccccaagaaggcgcgcgagugcgugggcaagacggucacccuccaggggaaccuggaccccugcgcccuguacgccagcgaggaggagaucggccagcucgugaagcagaugcuggacgacuucggcccccaccgguacaucgccaaccuggggcacggccucuacccggacauggaccccgagcacgugggggcguucgucgacgccgugcacaagcacucccgccugcugcggcagaacuga

SEQ ID NO: 38488 - RNA, 798 nt, Artificial Sequence
  derived and/or modified sequence opt1 from UROS__Homo_sapiens__NP_000366
augaaggugcugcuccugaaggacgccaaggaggacgacugcggccaggaccccuacauccgcgagcuggggcucuacggccuggaggccacccugaucccgguccucagcuucgaguuccugucccugcccagcuucuccgagaagcucagccaccccgaggacuacgggggccugaucuucaccagcccccgggcgguggaggccgccgagcugugccucgagcagaacaacaagacggaggugugggagcgcucccugaaggagaaguggaacgccaaguccgucuacgugguggggaacgccaccgcgagccuggucuccaagaucggccucgacaccgagggcgagaccugcgggaacgccgagaagcuggccgaguacaucugcagccgggaguccagcgcccugccgcuccuguuccccugcggcaaccugaagcgcgagauccuccccaaggcgcugaaggacaaggggaucgccauggaguccaucacgguguaccagaccguggcccaccccggcauccaggggaaccugaacagcuacuacucccagcagggcgucccggccagcaucaccuucuucucccccagcggccucaccuacucccugaagcacauccaggagcugagcggggacaacaucgaccagaucaaguucgccgcgaucggccccacgaccgcccgggcccucgccgcccaggggcugcccgugagcugcaccgcggaguccccgacgccccaggcccuggccaccggcauccgcaaggcccuccagccccacggcugcugcuga

SEQ ID NO: 38489 - RNA, 744 nt, Artificial Sequence
  derived and/or modified sequence opt1 from USB1__Homo_sapiens__NP_001182231
augagcgccgcgccccuggugggcuacuccagcuccgggagcgaggacgaguccgaggacggcaugcgcacccggccgggggacggcagccaccgccgggggcagagcccccucccccgccagcgguuccccgugccggacuccgugcugaacauguuccccggcaccgaggagggccccgaggacgacuccacgaagcacgggggccgcgugcggaccuucccccacgagcgcgggaacugggccacccacgucuacgugccguacgaggccaaggaggaguuccuggaccuccuggacgugcugcucccccacgcccagaccuacgucccccggcuggugcgcaugaagguguuccaccugagccucucccagagcgucgugcugcggcaccacuggauccugcccuucgugcaggcccucaaggcccgcaugacguccuuccaccggaccuucaucggccuggaggucaccagcgggcacgcgcaguuccuggaccucguguccgagguggaccgcgucauggaggaguucaaccugaccacguucuaccaggacccgagcuuccaccugucccucgccuggugcgugggcgacgcccggcugcagcuggagggccagugccuccaggagcugcaggccaucguggacggguucgaggacgcggagguccugcuccgcgugcacaccgagcagguccggugcaagagcggcaacaaguucuucuccaugccccugaaguga

SEQ ID NO: 38490 - RNA, 780 nt, Artificial Sequence
  derived and/or modified sequence opt1 from USE1__Homo_sapiens__NP_060937
auggccgccagccgccuggagcucaaccuggugcggcugcucagccgcugcgaggcgauggccgccgagaagcgggaccccgacgaguggcgccuggagaaguacgucggcgcccuggaggacaugcuccaggcccugaaggugcacgcgagcaagccggccuccgaggugaucaacgaguacagcuggaaggucgacuuccugaaggggaugcuccaggccgagaagcugaccuccagcuccgagaaggcccuggcgaaccaguuccucgcccccggccgggugcccaccacggcccgcgagcgggugcccgccaccaagaccguccaccuccagagccgcgcccgguacaccuccgagaugcgcagcgagcugcuggggacggacuccgcggagccggagauggacgugcggaagcgcaccggcguggccgggagccagcccgucuccgagaagcagagcgccgccgagcuggaccuggugcuccagcggcaccagaaccugcaggagaagcuggccgaggagaugcucggccuggcgcgcucccugaagaccaacacccucgccgcccagagcgugaucaagaaggacaaccagacgcugucccacagccugaagauggccgaccagaaccucgagaagcugaagaccgaguccgagcggcuggagcagcacacccagaaguccgucaacuggcuccugugggccaugcugaucaucgugugcuucaucuucaucagcaugauccucuucauccgcaucaugcccaagcugaaguga

SEQ ID NO: 38491 - RNA, 933 nt, Artificial Sequence
  derived and/or modified sequence opt1 from USF1__Homo_sapiens__NP_001263302
augaagggccagcagaagaccgccgagaccgaggaggggacggugcagauccaggagggcgccgucgcgaccggggaggaccccaccagcguggccaucgccuccauccagagcgccgccaccuucccggaccccaacgugaaguacgucuuccgcacggagaacggcggccaggugauguaccgggugauccaggucuccgaggggcagcuggacggccagaccgaggggaccggcgcgaucagcggguaccccgccacccaguccaugacgcaggccgugauccagggcgccuucaccagcgacgacgcgguggacaccgaggggaccgccgccgagacgcacuacaccuacuuccccuccaccgccgucggcgacggcgccgggggcaccacgagcggguccaccgcggccguggugaccacccagggcagcgaggcccuccugggccaggccacgccgcccgggaccggccaguucuucgucaugaugagcccccaggaggugcugcagggcgggucccagcgcuccaucgccccgcggacccaccccuacagccccaaguccgaggcgccccgcaccacgcgggacgagaagcgccgggcccagcacaacgagguggagcgccggcgccgggacaagaucaacaacuggaucguccagcucagcaagaucauccccgacugcuccauggagagcaccaaguccgggcagagcaagggcggcauccugagcaaggccugcgacuacauccaggagcugcgccaguccaaccaccggcucagcgaggagcugcaggggcuggaccagcuccagcuggacaacgacgugcugcgccagcaggucgaggaccucaagaacaagaaccugcugcuccgggcccagcugcgccaccacggccuggagguggugaucaagaacgacuccaacuga

SEQ ID NO: 38492 - RNA, 1041 nt, Artificial Sequence
  derived and/or modified sequence opt1 from USF2__Homo_sapiens__NP_003358
auggacaugcuggaccccggccucgacccggccgccagcgcgaccgccgccgccgccgcgucccacgacaaggggcccgaggccgaggagggcguggagcugcaggagggcggggacgggcccggcgccgaggagcagaccgccgucgcgaucacgagcgugcagcaggccgccuucggcgaccacaacauccaguaccaguuccgcaccgagaccaacgggggccaggugaccuaccgggucguccaggugacggacgggcagcuggacggccagggggacaccgccggcgccguguccguggugagcaccgcggccuucgccggcgggcagcaggccgucacccaggugggcguggacggggccgcgcagcgccccggcccggccgccgccuccgucccgcccggccccgccgcgcccuucccccucgccgugauccagaaccccuucagcaacgggggcucccccgccgccgaggccgugagcggggaggcgcgguucgccuacuucccggccuccagcgucggcgacacgaccgccguguccgugcagaccaccgaccagagccugcaggccgggggccaguucuacgucaugaugacgccccaggacgugcugcagaccggcacccagcgcaccaucgcgccccggacgcaccccuacuccccgaagaucgacgggacccgcacgccccgggacgagcgccggcgcgcccagcacaacgagguggagcggcgccggcgcgacaagaucaacaacuggaucguccagcucagcaagaucauccccgacugcaacgccgacaacuccaagaccggcgccagcaagggcgggauccuguccaaggcgugcgacuacauccgggagcugcgccagaccaaccagcggaugcaggagaccuucaaggaggccgagcgccuccagauggacaacgagcugcugcggcagcagaucgaggagcucaagaacgagaacgcccugcugcgcgcccagcuccagcagcacaaccuggagauggugggggagggcacccggcaguga

SEQ ID NO: 38493 - RNA, 1602 nt, Artificial Sequence
  derived and/or modified sequence opt1 from USH1C__Homo_sapiens__NP_001284693
auggaccgcaagguggcccgggaguuccgccacaaggucgacuuccugaucgagaacgacgccgagaaggacuaccucuacgacgugcugcggauguaccaccagaccauggacguggcgguccuggugggcgaccucaagcuggugaucaacgagcccagccgccugccccucuucgacgccauccggccccugaucccccugaagcaccaggucgaguacgaccagcucacgccccgccggucccgcaagcugaaggaggugcggcuggaccgccuccacccggaggggcugggccugagcgugcgcgggggccucgaguucgggugcggccuguucaucucccaccugaucaagggcgggcaggccgacagcgucggccuccaggugggggacgagaucgugcggaucaacggcuacuccaucagcuccugcacccacgaggaggucaucaaccugauccggaccaagaagaccgugagcaucaaggugcgccacaucgggcugauccccgucaaguccagccccgacgagccccucaccuggcaguacguggaccaguucguguccgagagcggcggcguccgggggucccugggcagcccggggaaccgcgagaacaaggagaagaagguguucaucucccuggugggcagccggggccucgggugcuccaucagcuccggccccauccagaagcccgggaucuucaucagccacgucaagcccggcagccuguccgccgagguggggcuggagaucggcgaccagaucguggaggucaacggcguggacuucagcaaccucgaccacaaggaggggcgcgagcuguucaugacggaccgggagcgccuggccgaggcgcggcagcgcgagcuccagcgccaggagcugcugaugcagaagcggcucgccauggaguccaacaagauccugcaggagcagcaggagauggagcgccagcggcgcaaggagaucgcccagaaggccgcggaggagaacgagcgguaccgcaaggagauggagcagaucgucgaggaggaggagaaguucaagaagcagugggaggaggacuggggcagcaaggagcagcugcuccugccgaagaccaucaccgccgaggugcaccccgugccccugcggaagcccaaguacgaccagggggucgagccggagcucgagcccgccgacgaccuggacggcgggaccgaggagcagggcgagcaggacuuccgcaaguacgaggagggcuucgaccccuacuccauguucacgcccgagcagaucauggggaaggacgugcggcugcuccgcaucaagaaggagggcagccuggaccuggcccucgagggcgggguggacuccccgaucgggaaggucguggugagcgccgucuacgagcggggcgcggccgagcgccacggcgggaucgugaagggcgacgagaucauggccaucaacgggaagaucgugaccgacuacacccuggccgaggccgaggcggcccugcagaaggccuggaaccagggcggcgacuggaucgaccucgucguggccgugugcccgcccaaggaguacgacgacgagcugaccuucuucuga

SEQ ID NO: 38494 - RNA, 1386 nt, Artificial Sequence
  derived and/or modified sequence opt1 from USH1G__Homo_sapiens__NP_775748
augaacgaccaguaccaccgcgccgcccgggacggcuaccuggagcuccugaaggaggcgacccgcaaggagcugaacgcccccgacgaggacgggaugacccccacgcucugggccgccuaccacggcaaccuggagagccugcggcucaucgugucccgcgggggcgaccccgacaagugcgacaucugggggaacacgccccugcaccuggccgcgagcaacggccaccuccacugccuguccuuccuggucagcuucggcgccaacaucuggugccucgacaacgacuaccacacgccccuggacauggccgccaugaaggggcacauggagugcgugcgguaccuggacuccaucgcggccaagcagagcucccucaacccgaagcuggugggcaagcugaaggacaaggccuuccgcgaggccgagcggcgcauccgggagugcgccaagcuccagcgccggcaccacgagcgcauggagcggcgcuaccggcgcgagcuggcggagcggagcgacacccuguccuucagcucccucaccagcuccacccugagccgccggcugcagcaccucgcccuggggucccaccuccccuacagccaggccacccugcacggcaccgcccgcgggaagaccaagaugcagaagaagcuggagcggcgcaagcagggcggcgaggggaccuucaaggucuccgaggacggccgcaagagcgcccggucccugagcgggcuccagcugggcagcgacgugauguucgugcgccagggcaccuacgcgaaccccaaggagugggggcgggcgccccugcgcgacauguuccucuccgacgaggacagcgucucccgggccacccuggccgccgagccggcccacagcgagguguccacggacagcggccacgacucccuguucacccgccccgggcucggcaccaugguguuccggcgcaacuaccugagcuccgggcugcacggccucggccgggaggacgggggccuggacggggucggcgcgccccgcgggcggcugcagagcucccccagccucgacgacgacucccugggcagcgccaacucccugcaggaccgcagcugcggcgaggagcucccgugggacgagcuggaccuggggcucgacgaggaccuggagcccgagaccagcccccuggagacguuccuggccucccuccacauggaggacuucgccgcccugcugcggcaggagaagaucgaccucgaggcccugaugcugugcuccgaccucgaccugcgcagcaucagcgugccccugggcccgcggaagaagauccucggggccgugcgccggcgccggcaggccauggagcgcccgcccgcgcuggaggacaccgagcuguga

SEQ ID NO: 38495 - RNA, 4641 nt, Artificial Sequence
  derived and/or modified sequence opt1 from USH2A__Homo_sapiens__NP_009054
augaacugccccgugcugagccucggcuccggguuccuguuccaggucaucgagaugcugaucuucgccuacuucgccagcaucucccucaccgagagccgcggccuguucccgcggcuggagaacgugggggcguucaagaagguguccaucguccccacccaggccgugugcggccuccccgaccgcagcacguucugccacuccagcgccgccgccgaguccauccaguucugcacccagcgguucugcauccaggacugccccuaccgcagcucccacccgaccuacaccgcgcuguucagcgccgggcuguccagcugcaucacgcccgacaagaacgaccuccaccccaacgcccacuccaacagcgccuccuucaucuucggcaaccacaagagcugcuucuccagccccccgagccccaagcugauggcguccuucacccuggccguguggcucaagcccgagcagcagggcgucaugugcgugaucgagaagaccguggacgggcagaucgucuucaagcugaccaucagcgagaaggagacgauguucuacuaccggaccgugaacggccugcagcccccgaucaaggugaugacccucgggcgcauccuggucaagaaguggauccaccuguccgugcaggugcaccagaccaagaucagcuucuucaucaacggcgucgagaaggaccacacgcccuucaacgcccggacccucuccgggagcaucaccgacuucgccuccggcaccgugcagaucggccagagccugaacgggcuggagcaguucgugggccgcaugcaggacuuccggcucuaccaggucgcccugacgaaccgcgagauccuggagguguucuccggggaccuccugcggcugcacgcgcagagccacugccgcugccccggcucccacccccgggugcacccgcucgcccagcgcuacugcauccccaacgacgccggcgacaccgccgacaaccgggucagccgccugaaccccgaggcccacccccuguccuucgugaacgacaacgacguggggaccagcugggucuccaacguguucaccaacaucacgcagcucaaccagggcgucaccaucagcguggaccuggagaacgggcaguaccagguguucuacaucaucauccaguucuucuccccgcagcccaccgagauccggauccagcgcaagaaggagaacagccuggacugggaggacuggcaguacuucgcgcggaacugcggcgccuucgggaugaagaacaacggcgaccucgagaagcccgacuccgucaacugccugcagcugagcaacuucacccccuacagccgcggcaacgugacguucuccauccucaccccggggcccaacuaccggcccggcuacaacaacuucuacaacacccccagccugcaggaguucgugaaggccacccagauccgcuuccacuuccacgggcaguacuacacgaccgagaccgccgucaaccugcgccaccgguacuacgccguggacgagaucaccaucuccggccgcugccagugccacgggcacgcggacaacugcgacacgaccagccagccguaccggugccucugcucccaggagagcuucaccgagggccugcacugcgaccgcugccugccccucuacaacgacaagcccuuccggcagggcgaccagguguacgccuucaacugcaagccgugccagugcaacucccacagcaaguccugccacuacaacaucagcgucgaccccuuccccuucgagcacuuccgcgggggcgggggcgugugcgacgacugcgagcacaacaccacggggcggaacugcgagcugugcaaggacuacuucuuccgccaggugggcgccgaccccuccgccaucgacgucugcaagccgugcgacugcgacaccgugggcacccggaacgggagcauccugugcgaccagaucggcgggcagugcaacugcaagcgccacguguccggccggcagugcaaccagugccagaacggcuucuacaaccuccaggagcuggaccccgacgggugcagccccugcaacugcaacaccuccggcaccgucgacggggacaucacgugccaccagaacagcggccagugcaagugcaaggccaacgugaucgggcugcgcugcgaccacugcaacuucggcuucaaguuccuccgguccuucaacgacgugggcugcgagcccugccagugcaaccugcacgggagcgucaacaaguucugcaacccgcacagcggccagugcgagugcaagaaggaggcgaaggggcugcagugcgacaccugccgcgagaacuucuacggccuggacgugaccaacugcaaggccugcgacugcgacaccgccgggucccuccccggcacggugugcaacgccaagaccggccagugcaucugcaagcccaacgucgaggggcggcagugcaacaagugccuggagggcaacuucuaccugcgccagaacaacagcuuccucugccugcccugcaacugcgacaagaccgggaccaucaacggcucccugcucugcaacaagagcacggggcagugcccgugcaagcugggcgugaccggccugcggugcaaccagugcgagccccaccgcuacaaccucaccaucgacaacuuccagcacugccagaugugcgagugcgacucccuggggacccugcccggcacgaucugcgaccccaucagcgggcagugccucugcgugccgaaccggcagggccgccgcugcaaccagugccagcccggguucuacaucucccccggcaacgcgaccggcugccugcccugcagcugccacaccaccggggccgucaaccacaucugcaacucccugacgggccagugcgugugccaggacgccagcaucgccgggcagcggugcgaccagugcaaggaccacuacuucggcuucgacccgcagaccggccgcugccagcccugcaacugccaccucuccggggcccugaacgagaccugccaccuggugaccggccagugcuucugcaagcaguucgucacggggagcaagugcgacgcgugcgugcccuccgccagccaccucgacgugaacaaccugcugggcugcuccaagacccccuuccagcagccgcccccccgggggcagguccagagcuccagcgccaucaaccucuccuggagcccgcccgacagccccaacgcccacuggcugaccuacucccugcuccgcgacggcuucgagaucuacaccacggaggaccaguaccccuacagcauccaguacuuccuggacaccgaccugcucccguacaccaaguacuccuacuacaucgagaccacgaacgugcacggcagcacccgguccguggccgucaccuacaagaccaagcccggggugcccgagggcaaccugacgcugagcuacaucauccccaucggguccgacagcgugacccucaccuggaccacgcuguccaaccagagcggcccgaucgagaaguacauccuguccugcgcgccccucgccgggggccagcccugcgucagcuacgagggccacgagaccuccgccaccaucuggaaccuggugcccuucgccaaguacgacuucagcgugcaggccugcaccuccgggggcugccugcacagccucccgaucaccgucacgaccgcgcaggcccccccccagcgccugucccccccgaagaugcagaagaucagcuccaccgagcugcacguggaguggagcccccccgccgagcucaacgggaucaucauccgguacgagcuguacaugcgccggcugcgcagcaccaaggagacgaccuccgaggagagccggguguuccaguccagcggcuggcucuccccccacagcuucgucgaguccgccaacgagaacgcgcugaagccgccccagaccaugaccacgaucaccgggcuggagcccuacaccaaguacgaguuccgcgugcucgccgugaacauggccggcagcgucuccagcgccuggguguccgagcggaccggcgagagcgcccccguguucaugaucccgcccuccgucuucccccugagcuccuacagccugaacaucuccugggagaagcccgcggacaacgugacgcgcgggaagguggucggcuacgacaucaacaugcucagcgagcaguccccgcagcagagcauccccauggccuucagccagcugcugcacaccgccaagucccaggagcucagcuacaccguggaggggcugaagcccuaccggaucuacgaguucaccaucacgcugugcaacuccgucggcugcgugaccagcgccuccggcgccgggcagacccucgcggccgccccggcccagcugcgccccccccuggugaagggcaucaacagcaccacgauccaccucaagugguuccccccggaggagcugaacgggcccucccccaucuaccagcuggagcggcgcgagagcucccuccccgcccugaugaccaccaugaugaagggcauccgguucaucgggaacggcuacugcaaguucccgagcuccacccaccccgucaacacggacuucaccggcaagugcguguga

SEQ ID NO: 38496 - RNA, 2922 nt, Artificial Sequence
  derived and/or modified sequence opt1 from USO1__Homo_sapiens__NP_001276978
augaacuuccugcgcggcgugaugggcgggcagagcgccgggccccagcacaccgaggccgagaccauccagaagcucugcgaccgggucgcguccagcacgcugcuggacgaccgccggaacgccgugcgcgcccucaagucccugagcaagaaguaccggcuggaggugggcauccaggccauggagcaccucauccacguccugcagaccgaccgcuccgacagcgagaucaucggguacgcccuggacacccucuacaacaucaucuccaacgaggaggaggaggagguggacgacguggaggaggagaacagcacccggcaguccgaggaccugggcagccaguucacggagaucuucaucaagcagcaggagaacgucacccugcuccugucccugcucgaggaguucgacuuccacgugcgcuggccgggcgugaagcugcugaccagccuccugaagcagcuggggccccagguccagcagaucauccucgugucccccaugggcgugagccggcugauggaccugcucgcggacucccgcgaggucauccggaacgacggggugcugcugcuccaggcccugacccgcagcaacggcgccauccagaagaucguggccuucgagaacgcguucgagcggcugcucgacaucaucuccgaggaggggaacagcgacggcggcaucgucguggaggacugccugauccugcuccagaaccugcugaagaacaacaacuccaaccagaacuucuucaaggaggggagcuacauccagcgcaugaagcccugguucgaggugggcgacgagaacagcgggugguccgcccagaaggucacgaaccuccaccugaugcugcagcucgugcgggugcuggucagcccgaccaacccgcccggcgccaccuccagcugccagaaggccauguuccagugcggccugcuccagcagcugugcaccauccugauggccacgggggugcccgcggacauccucaccgagaccaucaacaccguguccgaggucauccgcggcugccaggugaaccaggacuacuucgccagcgucaacgcccccuccaacccgccccggcccgccaucguggugcugcugaugagcauggucaacgagcgccagcccuucgugcuccggugcgccgugcuguacugcuuccagugcuuccuguacaagaaccagaaggggcagggcgagaucgucuccacgcugcuccccagcaccaucgacgcgaccgggaacuccgugagcgccggccagcugcugugcggcggccucuucuccaccgacagccuguccaacuggugcgccgccguggcccuggcgcacgcccuccaggagaacgccacgcagaaggagcagcugcugcgcguccagcucgccaccagcaucgggaacccgcccgugucccugcugcagcagugcaccaacauccucagccagggggacaagaucgaccggcgcggcuccaagauccagacccgcguggggcugcugaugcuccugugcacguggcugagcaacugccccaucgccgucacccacuuccuccacaacagcgcgaacgugcccuuccugaccggccagaucgccgagaaccugggcgaggaggagcagcucgugcaggggcugugcgcccugcuccugggcaucuccaucuacuucaacgacaacagccuggaguccuacaugaaggagaagcucaagcagcugaucgagaagcggaucgggaaggagaacuucaucgagaagcugggcuucaucagcaagcacgagcucuacucccgcgccagccagaagccccagcccaacuucccgucccccgaguacaugaucuucgaccacgaguucaccaagcuggucaaggagcuggagggggugaucacgaaggcgaucuacaagagcuccgaggaggacaagaaggaggaggaggugaagaagacccucgagcagcacgacaacaucgucacccacuacaagaacaugauccgggagcaggaccugcagcuggaggagcuccgccagcaggucagcacccugaagugccagaacgagcagcugcagacggccgugacccagcaggucucccagauccagcagcacaaggaccaguacaaccuccugaagauccagcugggcaaggacaaccagcaccagggcagcuacuccgagggggcccagaugaacggcauccagcccgaggagaucgggcggcuccgcgaggagaucgaggagcugaagcggaaccaggagcugcuccagagccagcugaccgagaaggacuccaugaucgagaacaugaaguccagccagaccagcggcacgaacgagcagagcuccgccaucgugagcgcccgcgacuccgagcaggucgcggagcugaagcaggagcucgccacccucaagagccagcugaacucccagagcguggagaucaccaagcugcagaccgagaagcaggagcugcugcagaagaccgaggccuucgccaaguccguggaggugcagggcgagacggagaccaucaucgccaccaagaccacggacguggaggggcggcucagcgcgcugcugcaggagaccaaggagcucaagaacgagaucaaggcccuguccgaggagcgcaccgccaucaaggagcagcuggacagcuccaacagcaccaucgccauccuccagacggagaaggacaagcuggagcuggagaucaccgacuccaagaaggagcaggacgaccuccuggugcugcucgccgaccaggaccagaagauccugagccugaagaacaagcucaaggaccugggccaccccguggaggaggaggacgagcuggaguccggggaccaggaggacgaggacgacgagagcgaggacccgggcaaggaccucgaccacaucuga

SEQ ID NO: 38497 - RNA, 2397 nt, Artificial Sequence
  derived and/or modified sequence opt1 from USP10__Homo_sapiens__NP_005144
auggcccugcacagcccccaguacaucuucggcgacuucuccccggacgaguucaaccaguucuucgugacgccccgcagcuccgucgagcucccgcccuacagcgggaccgugcugugcggcacgcaggccguggacaagcugcccgacgggcaggaguaccagcggaucgaguucggcgucgacgaggugaucgagcccuccgacacccucccccgcacccccagcuacuccaucagcuccacccugaacccgcaggcgcccgaguucauccuggggugcacggccagcaagaucacccccgacggcaucaccaaggaggccuccuacggcagcaucgacugccaguaccccggguccgcccucgcccuggacggcagcuccaacguggaggcggagguccuggagaacgacggggugagcggcgggcucggccagcgggagcgcaagaagaagaagaagcggccgcccggcuacuacuccuaccugaaggacgggggcgacgacagcaucuccaccgaggcccuggugaacgggcacgccaacagcgccguccccaacagcguguccgcggaggacgccgaguucaugggcgacaugcccccgagcgugacgccccggaccugcaacagcccccagaacuccaccgacuccgucagcgacaucgugcccgacuccccguuccccggcgcccucgggagcgacacccgcacggccggccagcccgagggcgggcccggggccgacuucggccaguccugcuucccggcggaggccggccgcgacacccugagccggaccgccggggcccagcccugcgugggcaccgacacgaccgagaaccugggggucgccaacggccagauccucgaguccagcggggagggcaccgcgaccaacggcguggagcugcacacgaccgaguccaucgaccuggaccccaccaagcccgagagcgccuccccgcccgccgacgggaccggcagcgccuccgggacgcuccccgugagccagccgaaguccugggccagccuguuccacgacagcaagcccuccagcuccagccccgucgcguacguggagaccaaguacuccccgcccgccaucagcccccugguguccgagaagcaggucgaggugaaggagggccucgugcccgucagcgaggaccccguggccaucaagaucgccgagcugcuggagaacgucacccucauccacaagccggugucccugcagccccgcgggcugaucaacaagggcaacuggugcuacaucaacgccacccuccaggcgcugguggccugcccgcccauguaccaccugaugaaguucaucccccucuacagcaagguccagcggcccugcacguccacccccaugaucgacagcuucgugcgccugaugaacgaguucaccaacaugcccgugccgcccaagccccggcaggcccugggcgacaagaucguccgcgacauccggcccggggccgcguucgagccgaccuacaucuaccgccuccugacggugaacaaguccagccuguccgagaagggccggcaggaggacgccgaggaguaccucggguucauccugaacggccugcacgaggagaugcucaaccugaagaagcugcucagccccuccaacgagaagcugaccaucagcaacggccccaagaaccacagcgugaacgaggaggagcaggaggagcagggggagggcuccgaggacgagugggagcaggucgggccccgcaacaagaccagcgugacccggcaggccgacuucgugcagacgccgaucaccggcaucuucgggggccacauccgcuccgucguguaccagcagagcuccaaggagagcgccacccugcagcccuucuucacccuccagcuggacauccaguccgacaagauccggaccgugcaggacgcccuggagagccucgucgcgcgcgaguccgugcagggcuacacgaccaagaccaagcaggagguggagaucagccgccgggucacccuggagaagcugcccccggugcuggugcuccaccugaagcgcuucgucuacgagaagaccgggggcugccagaagcugaucaagaacaucgaguaccccguggaccucgagaucuccaaggagcugcugagccccggggugaagaacaagaacuucaagugccaccggaccuaccgccucuucgccgucguguaccaccacggcaacuccgccaccgggggccacuacaccacggacguguuccagaucggccugaacggguggcugcggaucgacgaccagaccgucaaggugaucaaccaguaccagguggucaagcccaccgccgagcgcaccgccuaccuccuguacuaccggcgcguggaccugcucuga

SEQ ID NO: 38498 - RNA, 2892 nt, Artificial Sequence
  derived and/or modified sequence opt1 from USP11__Homo_sapiens__NP_004642
auggccguggcgccccgccuguucggcgggcucugcuuccgguuccgcgaccagaaccccgaggucgccguggagggccggcugcccaucagccacuccugcguggggugccgccgggagcgcaccgccauggccaccgucgccgccaaccccgcggccgccgccgcggccguggccgccgccgcggccgugacggaggaccgggagccccagcacgaggagcugccgggccucgacagccaguggcgccagaucgagaacggggaguccggccgggagcgcccccugcgggccggcgagagcugguuccuggucgagaagcacugguacaagcagugggaggccuacgugcagggcggggaccaggacuccagcaccuuccccgggugcaucaacaacgccacccucuuccaggacgagaucaacuggcgccugaaggagggccugguggagggggaggacuacguccuccugcccgcggccgccuggcacuaccugguguccugguacggccucgagcacggccagccgcccaucgagcggaaggugaucgagcugcccaacauccagaaggucgagguguaccccguggagcugcuccugguccgccacaacgaccugggcaagagccacaccgugcaguucucccacacggacagcaucgggcucgugcugcggaccgcccgcgagcgguuccuggucgagccgcaggaggacacccgccucugggccaagaacuccgaggggagccuggaccggcuguacgacacccacaucacggugcucgacgcggcccuggagaccggccagcugaucaucauggagacccgcaagaaggacggcaccuggcccuccgcccagcuccacgugaugaacaacaacaugagcgaggaggacgaggacuucaaggggcagcccggcaucugcgggcugacgaaccugggcaacacgugcuucaugaacuccgcccuccagugccugagcaacgucccccagcugaccgaguacuuccucaacaacugcuaccuggaggagcugaacuuccggaacccgcucgggaugaagggcgagaucgccgaggcguacgccgaccuggugaagcaggccugguccggccaccaccgcagcaucgugccccacgucuucaagaacaagguggggcacuucgccucccaguuccugggcuaccagcagcacgacagccaggagcuccugagcuuccugcucgacgggcugcacgaggaccugaaccgcgucaagaagaaggaguacguggagcucugcgacgcggccggccggcccgaccaggagguggcccaggaggccuggcagaaccacaagcgccggaacgacuccgucaucguggacaccuuccacgggcuguucaagagcacccuggugugccccgacugcggcaacgucuccgugaccuucgacccguucugcuaccucagcgugccccugcccaucucccacaagcgcguccuggagguguucuucauccccauggacccgcggcgcaagcccgagcagcaccggcuggugguccccaagaagggcaagaucagcgaccucugcguggcccuguccaagcacaccgggaucagccccgagcgcaugaugguggcggacgucuucucccaccgguucuacaagcuguaccagcucgaggagccgcugagcuccauccuggaccgcgacgacaucuucguguacgaggugagcggccggaucgaggccaucgaggggucccgcgaggacaucgucgugcccguguaccuccgggagcgcacccccgcccgggacuacaacaacagcuacuacggccugaugcuguucgggcacccgcuccuggucuccgugccccgcgaccgguucacgugggagggccuguacaacgugcucauguaccgccugagccgguacgucaccaagcccaacuccgacgacgaggacgacggcgacgagaaggaggacgacgaggaggacaaggacgacgugcccgggccgagcaccggcgggucccugcgcgaccccgagcccgagcaggccggccccagcagcggcgugaccaaccgcugcccguuccuccuggacaacugccuggggacgucccaguggccgccccggcgccggcgcaagcagcuguucacccuccagaccgucaacagcaacggcaccuccgaccggacgaccagccccgaggaggugcacgcccagcccuacaucgcgaucgacugggagcccgagaugaagaagcgcuacuacgacgagguggaggccgagggguacgucaagcacgacugcgugggcuacgugaugaagaaggcccccguccggcugcaggagugcaucgagcuguucaccaccguggagacgcucgagaaggagaaccccugguacugcccguccugcaagcagcaccagcuggccaccaagaagcucgaccuguggaugcugcccgagauccucaucauccaccugaagcgcuucagcuacaccaaguucucccgggagaagcuggacacccucguggaguuccccauccgcgaccuggacuucagcgaguucgucauccagccccagaacgaguccaacccggagcuguacaaguacgaccucaucgccgugagcaaccacuacgggggcaugcgggacggccacuacacgaccuucgcgugcaacaaggacuccgggcaguggcacuacuucgacgacaacagcgugucccccgucaacgagaaccagaucgagagcaaggccgccuacgugcuguucuaccagcgccaggacguggcccggcgccugcucucccccgcgggcagcuccggggcccccgccagcccggccugcagcuccccgcccagcuccgaguucauggacgucaacuga

SEQ ID NO: 38499 - RNA, 1113 nt, Artificial Sequence
  derived and/or modified sequence opt1 from USP12__Homo_sapiens__NP_872294
auggagauccugaugaccgugagcaaguucgccuccaucugcaccaugggcgccaacgcgagcgcccucgagaaggagaucgggcccgagcaguucccggugaacgagcacuacuucggccuggugaacuucgggaacacgugcuacugcaacuccgugcugcaggcccucuacuucugccgccccuuccgggagaagguccuggccuacaagagccagccccgcaagaaggagucccugcugaccugccuggccgaccuguuccacagcaucgcgacccagaagaagaaggugggcgugaucccgcccaagaaguucaucacccggcuccgcaaggagaacgagcuguucgacaacuacaugcagcaggacgcccacgaguuccugaacuaccuccugaacacgaucgccgacauccugcaggaggagcggaagcaggagaagcagaacgggcgccuccccaacggcaacaucgacaacgagaacaacaacuccacccccgaccccaccuggguccacgagaucuuccagggcacccugacgaacgagacccggugccugaccugcgagaccaucagcuccaaggacgaggacuuccucgaccugagcguggacguggagcagaacacguccaucacccacugccugcgcggguucagcaacaccgagacccucugcuccgaguacaaguacuacugcgaggagugccggagcaagcaggaggcccacaagcgcaugaaggucaagaagcugccgaugauccuggcgcuccaccugaagcgguucaaguacauggaccagcugcaccgcuacacgaagcucuccuaccgggugguguucccccuggagcugcgccucuucaacaccagcggcgacgccaccaaccccgaccggauguacgaccuggucgccguggugguccacugcggguccggccccaaccgcgggcacuacaucgccaucgucaagagccacgacuucuggcuccucuucgacgacgacaucguggagaagaucgacgcccaggcgaucgaggaguucuacggccugaccuccgacaucagcaagaacagcgaguccggcuacauccuguucuaccagagccgggacuga

SEQ ID NO: 38500 - RNA, 2592 nt, Artificial Sequence
  derived and/or modified sequence opt1 from USP13__Homo_sapiens__NP_003931
augcagcgccggggcgcccuguucgggaugcccggcgggagcggcgggcgcaagauggccgcgggcgacaucggcgagcuccuggugccccacaugcccaccauccgggucccccgcuccggggaccggguguacaagaacgagugcgccuucagcuacgacucccccaacagcgagggcgggcuguacgugugcaugaacaccuuccucgccuucggccgcgagcacgucgagcggcacuuccgcaagacggggcaguccguguacaugcaccugaagcggcacgugcgcgagaagguccggggcgccagcggcggggcccugccgaagcgccggaacuccaagaucuuccucgaccuggacaccgacgacgaccugaacagcgacgacuacgaguacgaggacgaggcgaagcucgugaucuuccccgaccacuacgagaucgcccugcccaacaucgaggagcugcccgcccucgugaccaucgccugcgacgcgguccuguccagcaaguccccguaccgcaagcaggaccccgacaccugggagaacgagcugcccgugagcaaguacgccaacaaccucacgcagcuggacaacggcgugcggaucccgcccuccggguggaagugcgcccgcugcgaccugcgggagaaccucuggcugaaccugaccgacggcagcguccucugcggcaagugguucuucgacuccagcgggggcaacgggcacgcccuggagcacuaccgcgacaugggcuacccccuggccgugaagcucgggaccaucacccccgacggcgcggacguguacuccuuccaggaggaggagcccguccuggacccgcaccuggccaagcaccucgcccacuucggcaucgacaugcugcacaugcacgggacggagaacggccugcaggacaacgacaucaagcuccgggugagcgagugggaggugauccaggaguccgggaccaagcugaagcccauguacggccccggguacaccggccugaagaaccucggcaacagcugcuaccugagcuccgucaugcaggccaucuucagcauccccgaguuccagcgcgccuacguggggaaccugccgcggaucuucgacuacagcccccucgaccccacccaggacuucaacacgcagaugaccaagcugggccacgggcugcucagcggccaguacuccaagcccccggugaaguccgagcugaucgagcaggucaugaaggaggagcacaagccccagcagaacgggaucagcccccgcauguucaaggcguucguguccaagucccaccccgaguucagcuccaaccgccagcaggacgcccaggaguucuuccugcaccucgugaaccuggucgagcggaaccgcaucggcagcgagaacccguccgacguguuccgguuccuggucgaggagcgcauccagugcugccagacccggaaggugcgcuacaccgagcggguggacuaccucaugcagcugcccgucgccauggaggccgccacgaacaaggacgagcugaucgcguacgagcucacccgccgggaggccgaggccaaccgccggccccugccggagcuggugcgcgccaagauccccuucagcgccugccugcaggcguucuccgagcccgagaacguggacgacuucuggagcuccgcccuccaggccaagagcgccggcgucaagaccucccgguucgcgagcuuccccgaguaccugguggugcagaucaagaaguucaccuucgggcuggacugggucccgaagaaguucgacgugagcaucgacaugcccgaccuccuggacaucaaccaccuccgcgcccggggccugcagcccggggaggaggagcugcccgacaucuccccgcccaucgugauccccgacgacagcaaggaccgccugaugaaccagcucaucgaccccuccgacaucgacgagagcuccgucaugcagcuggccgagaugggcuucccgcuggaggccugccggaaggccguguacuucacgggcaacaugggggcggagguggccuucaacuggaucaucguccacauggaggagcccgacuucgccgagccccucaccaugcccggcuacgggggcgccgccagcgcgggggccuccguguucggcgccagcggccuggacaaccagccgcccgaggagaucguggccaucaucaccuccaugggguuccagcgcaaccaggccauccaggcgcugcgggccaccaacaacaaccucgagcgcgcccuggacuggaucuucagccaccccgaguucgaggaggacuccgacuucgucaucgagauggagaacaacgccaacgcgaacaucaucagcgaggccaagcccgagggcccgcgcgugaaggacggguccggcacguacgagcuguucgccuucaucagccacauggggaccuccaccaugagcggccacuacaucugccacaucaagaaggagggccggugggugaucuacaacgaccacaaggucugcgccuccgagcgcccgcccaaggaccucggguacauguacuucuaccggcgcauccccagcuga

SEQ ID NO: 38501 - RNA, 1380 nt, Artificial Sequence
  derived and/or modified sequence opt1 from USP14__Homo_sapiens__NP_001032411
augccccuguacagcgugaccgucaaguggggcaaggagaaguucgaggggguggagcucaacaccgacgagccgcccaugguguucaaggcccagcuguucgcccugacgggcguccagcccgcgcgccagaaggugauggugaagggcgggacccucaaggacgacgacugggggaacaucaagaucaagaacauggagcugcccugcggccugaccaaccucggcaacacgugcuacaugaacgccaccguccagugcauccgguccgugccggagcugaaggacgcccugaagcgcuacgccggggcccuccgggcgagcggcgagauggccuccgcccaguacaucaccgccgcgcugcgcgaccuguucgacagcauggacaagaccuccagcuccaucccgcccaucauccuccugcaguuccugcacauggccuucccccaguucgccgagaagggggagcagggccaguaccuccagcaggacgccaacgagugcuggauccagaugaugcgggugcugcagcagaagcuggaggccaucgaggacgacagcgucaaggagaccgacuccagcuccgcgagcgccgccacgcccuccaagaagaagucccucaucgaccaguucuucgggguggaguucgagaccaccaugaagugcaccgaguccgaggaggaggaggugacgaagggcaaggagaaccagcugcagcugagcugcuucaucaaccaggaggucaaguaccucuucaccggccugaagcugcgccuccaggaggagaucaccaagcagucccccacccugcagcggaacgcccuguacaucaagagcuccaagaucagccgccuccccgccuaccugacgauccagauggugcgguucuucuacaaggagaaggagagcgugaacgcgaagguccugaaggacgugaaguucccccucaugcuggacauguacgagcugugcaccccggagcuccaggagaagaugguguccuuccgcagcaaguucaaggaccuggaggacaagaaggucaaccagcagcccaacaccuccgacaagaaguccagcccccagaaggaggugaaguacgagcccuucagcuucgccgacgacaucgggagcaacaacugcggcuacuacgaccugcaggccgugcucacccaccaggggcggagcuccagcuccggccacuacgucagcugggugaagcgcaagcaggacgaguggaucaaguucgacgacgacaagguguccaucgucacgccggaggacauccugcggcugagcggcgggggcgacuggcacaucgccuacgugcuccuguacgggccccgccgggucgagaucauggaggaggaguccgagcaguga

SEQ ID NO: 38502 - RNA, 2946 nt, Artificial Sequence
  derived and/or modified sequence opt1 from USP15__Homo_sapiens__NP_001239007
auggccgagggcggggccgcggaccuggacacccagcgcagcgacaucgccacccuccugaagacgucccugcggaagggcgacaccugguaccucguggacagccgcugguucaagcaguggaagaaguacgucggguucgacuccugggacaaguaccagaugggcgaccagaacguguaccccgggccgaucgacaacagcggccugcugaaggacggcgacgcccagucccucaaggagcaccugaucgacgagcuggacuacauccuccugcccaccgagggguggaacaagcuggugagcugguacacccucauggagggccaggagcccaucgcccggaaggucguggagcaggggauguucgugaagcacugcaaggucgagguguaccugacggagcugaagcucugcgagaacggcaacaugaacaacguggucacccgccgguucuccaaggccgacaccaucgacaccaucgagaaggagauccgcaagaucuucagcauccccgacgagaaggagacgcggcuguggaacaaguacauguccaacaccuucgagccgcugaacaagcccgacagcaccauccaggacgcggggcucuaccagggccaggugcuggugaucgagcagaagaacgaggacggcaccuggccccgcgggcccuccacgcccaagagcccgggcgccuccaacuucagcacccugcccaagaucucccccagcucccucagcaacaacuacaacaacaugaacaaccggaacgucaagaacuccaacuacugccugccgagcuacaccgccuacaagaacuacgacuacagcgagcccgggcgcaacaacgagcagcccggccugugcggccucuccaaccuggggaacacgugcuucaugaacagcgccauccagugccuguccaacaccccgccccucaccgaguacuuccugaacgacaaguaccaggaggagcugaacuucgacaacccccucggcaugcgcggggagaucgccaagagcuacgccgagcugaucaagcagaugugguccggcaaguucagcuacgugacgccccgggccuucaagacccagguggggcgguucgcgccccaguucuccggcuaccagcagcaggacugccaggagcugcucgccuuccugcuggacggccuccacgaggaccugaaccgcauccggaagaagccguacauccagcugaaggacgcggacgggcgccccgacaaggucguggccgaggaggccugggagaaccaccucaagcggaacgacagcaucaucguggacaucuuccacggccuguucaaguccacccuggucugccccgagugcgccaagaucagcgugaccuucgaccccuucugcuaccucacccugccgcugcccaugaagaaggagcgcacccucgagguguaccugguccggauggacccccugacgaagcccaugcaguacaaggugguggucccgaagaucgggaacauccucgaccugugcaccgcccuguccgcgcugagcggcauccccgccgacaagaugaucgugaccgacaucuacaaccaccgcuuccaccggaucuucgccauggacgagaaccucuccagcaucauggagcgcgacgacaucuacgucuucgagaucaacaucaaccgcaccgaggacacggagcacgugaucauccccgugugccugcgggagaaguuccgccacuccagcuacacccaccacaccggguccagccuguucggccagccguuccucauggccgucccccggaacaacaccgaggacaagcuguacaaccugcuccugcugcgcaugugccgguacgugaagaucuccacggagaccgaggagaccgagggcagccuccacugcugcaaggaccagaacaucaacgggaacggccccaacgggauccacgaggagggcagccccuccgagauggagaccgacgagccggacgacgagagcucccaggaccaggagcugcccagcgagaacgagaacucccagagcgaggacuccgucgggggcgacaacgacagcgagaacggccugugcacggaggacacgugcaaggggcagcucaccggccacaagaagcgccuguucaccuuccaguucaacaaccuggggaacaccgacaucaacuacaucaaggacgacacccggcacauccgcuucgacgaccggcagcuccgccuggacgagcgguccuuccuggcccucgacugggaccccgaccugaagaagcgcuacuucgacgagaacgcggccgaggacuucgagaagcacgagagcguggaguacaagcccccgaagaagcccuucgugaagcugaaggacugcaucgagcuguucaccaccaaggagaagcucggcgccgaggaccccugguacugccccaacugcaaggagcaccagcaggccaccaagaagcuggaccucuggucccugccgcccgugcuggucgugcaccucaagcgguucagcuacucccgcuacaugcgggacaagcuggacacgcugguggacuuccccaucaacgaccucgacaugagcgaguuccugaucaaccccaacgccggcccgugccgcuacaaccugaucgcggucuccaaccacuacgggggcaugggcggcgggcacuacaccgccuucgccaagaacaaggacgacgggaagugguacuacuucgacgacagcuccgugagcaccgccagcgaggaccagaucguguccaaggcggccuacguccucuucuaccagcggcaggacaccuucagcggcacgggguucuucccccuggaccgcgagaccaagggcgccuccgccgccaccgggaucccccuggagagcgacgaggacuccaacgacaacgacaacgacaucgagaacgagaacugcaugcacaccaacuga

SEQ ID NO: 38503 - RNA, 1593 nt, Artificial Sequence
  derived and/or modified sequence opt1 from USP17L2__Homo_sapiens__NP_958804
auggaggacgacagccuguaccucggcggggaguggcaguucaaccacuucuccaagcugaccagcucccgccccgacgccgccuucgcggagauccagcggaccagccugccggagaaguccccgcucagcuccgaggcccgcguggaccugugcgacgaccuggcccccgucgcccggcagcucgcgccccgcaagaagcugccccugagcucccggcgccccgccgccgugggcgccgggcuccagaacaugggcaacacgugcuacgagaacgccagccugcagugccugaccuacaccccgccccucgcgaacuacaugcugucccgggagcacagccagaccugccagcgccccaagugcugcaugcugugcacgaugcaggcccacaucaccugggcccuccacucccccgggcacgugauccagcccagccaggcccuggccgcgggcuuccaccggggcaagcaggaggacgcccacgaguuccugauguucaccgucgacgccaugaagaaggccugccuccccgggcacaagcaggucgaccaccacuccaaggacaccacgcugauccaccagaucuucggcgggugcuggcgcagccagaucaagugccugcacugccacggcaucuccgacaccuucgacccguaccucgacaucgcccuggacauccaggcggcccagagcgugaagcaggcccuggagcagcucgugaagcccgaggagcugaacggggagaacgccuaccacugcggccugugccuccagcgggcccccgcguccaagacccugacccugcacacgagcgccaaggugcucauccuggugcugaagcgcuucagcgacgucaccggcaacaagcucgccaagaacgugcaguaccccgagugccuggacaugcagccguacaugucccagcagaacaccgggccccugguguacguccucuacgccgugcuggugcacgccggcuggagcugccacgacgggcacuacuucuccuacgucaaggcgcaggagggccagugguacaagauggacgacgccaaggugaccgccugcagcaucacguccgugcugagccagcaggccuacguccucuucuacauccagaaguccgagugggagcggcacagcgaguccgugagccgcggccgggagccccgcgcgcugggggccgaggacaccgaccggcgcgccacccagggcgagcugaagcgggaccaccccugccuccaggccccggagcuggacgagcgccugguggagcgggccacccaggaguccacgcucgaccacuggaaguucccccaggagcagaacaagaccaagcccgaguucaacguccgcaagguggaggggacccugcccccgaacgugcuggucauccaccagagcaaguacaagugcggcaugaagaaccaccaccccgagcagcaguccagccuccugaaccuguccagcaccacgcgcaccgaccaggaguccgugaacaccgggacccuggcgagccuccagggccggacgcgccgguccaagggcaagaacaagcacagcaagcgcgcccugcuggucugccaguga

SEQ ID NO: 38504 - RNA, 1593 nt, Artificial Sequence
  derived and/or modified sequence opt1 from USP17L30__Homo_sapiens__NP_001243796
auggaggacgacagccuguaccuccgcggcgaguggcaguucaaccacuucuccaagcugaccagcucccggcccgacgccgccuucgcggagauccagcgcaccagccugccggagaaguccccgcucagcugcgagacgcggguggaccugugcgacgaccuggcccccgucgcccgccagcucgcgccccgggagaagcugccccuguccagccgccggcccgccgccgugggggccggccuccagaacauggggaacacgugcuacgugaacgccucccugcagugccugaccuacaccccgccccucgccaacuacaugcugagccgcgagcacucccagaccugccaccggcacaagggcugcaugcugugcaccaugcaggcgcacaucacccgcgcccuccacaaccccgggcacgucauccagcccagccaggcccuggccgccggcuuccaccggggcaagcaggaggacgcgcacgaguuccugauguucaccguggacgccaugaagaaggccugccuccccgggcacaagcaggucgaccaccacuccaaggacacgacccugauccaccagaucuucggcggguacuggcgcagccagaucaagugccugcacugccacggcaucuccgacaccuucgaccccuaccucgacaucgcccuggacauccaggccgcgcagagcgugcagcaggcccuggagcagcucgugaagccggaggagcugaacggggagaacgccuaccacugcggcgugugccugcagcgggcccccgccuccaagacccucacgcugcacaccagcgcgaagguccugauccucgugcugaagcgcuucuccgacgugaccggcaacaagaucgccaagaacguccaguaccccgagugccuggacaugcagcccuacaugagccagccgaacaccgggccccucguguacgugcuguacgccguccuggugcacgccggcuggagcugccacaacgggcacuacuucuccuacgugaaggcccaggagggccagugguacaagauggacgacgcggaggucacggccagcuccaucaccagcgugcucucccagcaggccuacgugcuguucuacauccagaaguccgagugggagcggcacagcgagagcgucucccgcggccgggagccccgcgcccugggggcggaggacaccgaccggcgcgccacccagggcgagcucaagcgggaccaccccugccugcaggccccggagcuggacgagcaccucguggagcgcgccacgcaggagagcacccuggaccacuggaaguuccugcaggagcagaacaagaccaagcccgaguucaacgugcgcaaggucgaggggacccucccgcccgacgugcuggucauccaccaguccaaguacaagugcggcaugaagaaccaccaccccgagcagcagagcucccugcucaaccugagcuccagcacgcccacccaccaggaguccaugaacaccgggacccuggccagccugcggggccgcgcgcggcgcuccaagggcaagaacaagcacagcaagcgggcccuccuggugugccaguga

SEQ ID NO: 38505 - RNA, 1119 nt, Artificial Sequence
  derived and/or modified sequence opt1 from USP18__Homo_sapiens__NP_059110
augagcaaggccuucggccugcuccgccagaucugccaguccauccuggccgagagcucccagagccccgcggaccuggaggagaagaaggaggaggacuccaacaugaagcgggagcagccgcgcgagcggccccgcgccugggacuacccccacgggcucgugggccugcacaacaucgggcagaccugcugccugaacagccucauccaggucuucgugaugaacguggacuucacccggauccugaagcgcaucacggucccccggggcgccgacgagcagcgccgguccgugccguuccagaugcugcuccugcuggagaagaugcaggacagccgccagaaggccgugcggccccucgagcuggccuacugccugcagaagugcaacgucccccucuucgugcagcacgacgcggcccagcuguaccugaagcucuggaaccugaucaaggaccagaucaccgacgugcaccuggucgagcgccuccaggcccuguacaccauccgggugaaggacucccugaucugcguggacugcgccauggagagcucccgcaacagcuccaugcucacccugccccugagccucuucgacgucgacuccaagccgcugaagacgcuggaggacgcgcuccacugcuucuuccagccccgggagcugagcuccaagagcaagugcuucugcgagaacugcgggaagaagacccgcggcaagcagguccugaagcucacccaccucccccagacccugacgauccaccugaugcgguucuccauccgcaacagccagacccggaagaucugccacagccuguacuucccccagucccuggacuucagccagauccucccgaugaagcgcgaguccugcgacgccgaggagcagagcggcgggcaguacgagcuguucgccgugaucgcccacgugggcauggccgacuccgggcacuacugcguguacauccggaacgcgguggacggcaagugguucugcuucaacgacagcaacaucugccuggucuccugggaggacauccagugcaccuacgggaaccccaacuaccacuggcaggagaccgccuaccuccugguguacaugaagauggagugcuga

SEQ ID NO: 38506 - RNA, 2745 nt, Artificial Sequence
  derived and/or modified sequence opt1 from USP20__Homo_sapiens__XP_005251722
augggcgacagccgcgaccugugcccccaccucgacuccaucggggaggugaccaaggaggaccugcugcucaagagcaaggggaccugccaguccugcggggucacgggcccgaaccugugggccugccuccagguggccugccccuacguggggugcggcgagagcuucgcggaccacuccaccauccacgcccaggccaagaagcacaaccucaccgucaaccugaccacguuccggcuguggugcuacgccugcgagaaggagguguuccucgagcagcgccuggccgcgccccugcucggcagcuccagcaaguucuccgagcaggacagcccgccgcccucccacccccugaaggccgugcccaucgccgucgccgacgagggggagagcgaguccgaggacgacgaccugaagccgcggggccucaccgggaugaagaaccugggcaacagcugcuacaugaacgcggcccugcaggcccucuccaacugcccgccccugacccaguucuuccuggagugcgggggccucgugcgcaccgacaagaagcccgcccugugcaagagcuaccagaagcugguguccgaggucuggcacaagaagcggcccagcuacguggugcccacgucccucagccacggcaucaagcuggucaaccccauguuccgcggguacgcccagcaggacacccaggaguuccugcggugccucauggaccagcugcacgaggagcugaaggagcccgugguggcgaccgucgcccucaccgaggcccgcgacagcgacuccagcgacacggacgagaagcgggagggcgaccgcuccccgagcgaggacgaguuccuguccugcgacagcuccagcgaccggggcgagggcgacggccaggggcgcggcgggggcuccagccaggccgagaccgagcugcucauccccgacgaggccgggcgggcgaucuccgagaaggagcgcaugaaggaccggaaguucagcuggggccagcagcgcaccaacuccgagcaggucgacgaggacgccgacguggacaccgccauggccgcccuggacgaccagcccgcggaggcccagcccccgagcccccgguccagcucccccugccgcacgcccgagccggacaacgacgcccaccuccggagcuccagccgccccugcagccccgugcaccaccacgagggccacgccaagcuguccagcuccccgccccgggccagccccgugcgcauggcgcccuccuacgugcugaagaaggcccagguccugagcgccgggucccgccggcgcaaggagcagcgguaccgcagcgugaucuccgacaucuucgacggcagcauccucucccuggugcagugccugaccugcgaccgggucagcaccaccguggagacguuccaggaccucucccugcccauccccgggaaggaggaccuggccaagcuccacagcgcgaucuaccagaacguccccgccaagcccggcgccugcggggacuccuacgccgcccagggcuggcuggcguucaucguggaguacauccgccgguucguggucagcugcaccccguccugguucuggggccccguggugacccuggaggacugccucgccgccuucuucgccgccgacgagcugaagggggacaacauguacagcugcgagcgcugcaagaagcugcggaacggcgucaaguacugcaaggugcugcgccuccccgagauccugugcauccaccugaagcgguuccgccacgaggugauguacagcuucaagaucaacucccacgucagcuucccccucgaggggcuggaccugcggccguuccucgcgaaggagugcaccucccagaucacgaccuacgaccugcugagcgugaucugccaccacggcaccgccggguccggccacuacaucgccuacugccagaacgugaucaacggccagugguacgaguucgacgaccaguacgucaccgaggugcacgagacggugguccagaacgccgagggguacgugcuguucuaccgcaagagcuccgaggaggccaugcgggagcgccagcaggucgugagccuggcggccaugcgggagcccucccugcuccgcuucuacgugagccgggaguggcugaacaaguucaacaccuucgccgagcccggccccaucaccaaccagaccuuccugugcucccacgggggcaucccgccccacaaguaccacuacaucgacgaccucguggucauccugccccagaacgugugggagcaccuguacaaccgcuucggcgggggccccgccgugaaccaccucuacgucugcagcaucugccagguggagaucgaggcgcuggccaagcgccggcgcaucgagaucgacacguucaucaagcugaacaaggccuuccaggccgaggaguccccgggggugaucuacugcaucagcaugcagugguuccgggagugggaggccuucgucaagggcaaggacaacgagccgcccgggcccaucgacaacucccgcaucgcccaggugaagggcagcggccacgugcagcucaagcagggggcggacuacggccagaucuccgaggagaccuggaccuaccugaacagccuguacgggggcgggcccgagaucgccauccggcaguccgucgcccagccccucggccccgagaaccugcacggcgagcagaagaucgaggccgagacccgcgcgguguga

SEQ ID NO: 38507 - RNA, 1578 nt, Artificial Sequence
  derived and/or modified sequence opt1 from USP22__Homo_sapiens__NP_056091
auggugagccgccccgagccggagggcgaggccauggacgccgagcuggcggucgccccgcccgggugcucccaccucggcagcuucaagguggacaacuggaagcagaaccugcgggccaucuaccagugcuucgugugguccgggaccgccgaggcccgcaagcggaaggcgaaguccugcaucugccacgucugcggcgugcaccugaaccgccuccacuccugccuguacugcguguucuucgggugcuucaccaagaagcacauccacgagcacgccaaggccaagcggcacaaccuggccaucgaccucauguacggcggcaucuacugcuuccugugccaggacuacaucuacgacaaggacauggagaucaucgcgaaggaggagcagcgcaaggccuggaagaugcagggggucggcgagaaguucagcacgugggagcccaccaagcgggagcuggagcuccugaagcacaaccccaagcgccggaagaucaccuccaacugcaccaucgggcugcgcggccucaucaaccuggggaacacgugcuucaugaacugcaucgugcaggcccugacccacacgccccuccugcgggacuucuuccugagcgaccgccaccggugcgagaugcagucccccagcuccugccucgugugcgagaugagcucccuguuccaggaguucuacagcggccaccgcagcccccacaucccguacaagcugcuccaccuggucuggacccacgcccggcaccuggccggcuacgagcagcaggacgcgcacgaguuccucaucgccgcccuggacgugcugcaccgccacugcaagggggacgacaacggcaagaaggccaacaaccccaaccacugcaacugcaucaucgaccagaucuucaccgggggccuccagagcgacgugaccugccaggucugccacggcguguccaccaccaucgaccccuucugggacaucagccuggaccugcccggguccagcacgccguucuggccccucagccccggcuccgaggggaacguggucaacggcgagagccacguguccgggaccaccacccugacggacugccugcggcgcuucacccggcccgagcaccucggcagcuccgccaagaucaagugcagcggcugccacuccuaccaggagagcaccaagcagcugaccaugaagaagcugccgaucguggcgugcuuccaccucaagcgcuucgagcacuccgccaagcugcggcgcaagaucacgaccuacgucagcuucccccuggagcucgacaugacccccuucauggccuccagcaaggagucccgcaugaacgggcaguaccagcagcccaccgacagccugaacaacgacaacaaguacucccuguucgccguggugaaccaccagggcacgcucgagagcgggcacuacaccuccuucauccggcagcacaaggaccagugguucaagugcgacgacgccaucaucaccaaggcgagcaucaaggacguccuggacuccgagggcuaccuccuguucuaccacaagcaguuccuggaguacgaguga

SEQ ID NO: 38508 - RNA, 3378 nt, Artificial Sequence
  derived and/or modified sequence opt1 from USP25__Homo_sapiens__NP_001269970
augaccguggagcagaacguccugcagcagagcgccgcccagaagcaccagcagaccuuccucaaccagcugcgcgagaucacgggcaucaacgacacccagauccugcagcaggcgcucaaggacuccaacgggaaccuggagcuggccguggccuuccucaccgccaagaacgccaagacgccccagcaggaggagaccaccuacuaccagaccgcgcugccgggcaacgaccgguacaucagcguggggucccaggccgacaccaacgucaucgaccugacgggcgacgacaaggacgaccuccagcgcgccaucgcccugagccuggcggaguccaaccgggccuuccgcgagaccgggaucaccgacgaggagcaggccaucagccgggugcucgaggccuccaucgccgagaacaaggcgugccugaagcgcacccccacggagguguggcgggacagccgcaaccccuacgaccggaagcgccaggacaaggcccccgucggccugaagaacgugggcaacacgugcugguucuccgccgugauccagagccucuucaaccugcuggaguuccggcgccucguccugaacuacaagccgcccuccaacgcccaggaccugccccggaaccagaaggagcaccgcaaccuccccuucaugcgggagcugcgcuaccuguucgcccuccugguggggaccaagcggaaguacguggacccgagccgcgcggucgagauccugaaggacgccuucaaguccaacgacagccagcagcaggacguguccgaguucacccacaagcuccuggacuggcuggaggacgccuuccagaugaaggccgaggaggagaccgacgaggagaagcccaagaaccccaugguggagcuguucuacggccgguuccuggccgucggggugcuggagggcaagaaguucgagaacaccgagauguucgggcaguacccccuccaggugaacggcuucaaggaccugcacgagugccuggaggcggccaugaucgagggcgagaucgagagccuccacuccgagaacagcgggaaguccggccaggagcacugguucaccgagcugccgcccguccugaccuucgagcucagccgcuucgaguucaaccaggcccuggggcggcccgagaagauccacaacaagcuggaguucccccaggugcucuaccuggaccgcuacaugcaccgcaaccgggagaucacgcgcaucaagcgggaggagaucaagcgccugaaggacuaccucaccgugcugcagcagcggcuggagcgcuaccucagcuacggcuccggcccgaagcgguucccccuggucgacgugcugcaguacgcccuggaguucgccagcuccaagcccgugugcaccagccccgucgacgacaucgacgcguccagcccgcccuccgggagcauccccucccagacccuccccagcacgaccgagcagcagggcgcccuguccagcgagcugccguccaccagccccuccagcguggccgccaucuccagccgcuccgucauccacaagcccuucacccagagccggaucccgcccgaccuccccaugcaccccgcgccgcgccacaucacggaggaggagcugagcgugcuggaguccugccuccaccgguggcgcaccgagaucgagaacgacacccgggaccugcaggagagcaucucccgcauccaccggaccaucgagcugauguacagcgacaaguccaugauccaggugcccuaccgccuccacgccguccuggugcacgaggggcaggccaacgccggccacuacugggccuacaucuucgaccaccgggagagccgcuggaugaaguacaacgacaucgcggugacgaaguccagcugggaggagcugguccgggacuccuucgggggcuaccgcaacgccagcgccuacugccucauguacaucaacgacaaggcccaguuccugauccaggaggaguucaacaaggagaccggccagccccugguggggaucgagacccugcccccggaccugcgcgacuucguggaggaggacaaccagcgguucgagaaggagcuggaggagugggacgcccagcucgcgcagaaggcccugcaggagaagcugcucgccucccagaagcugcgcgagagcgagaccuccgucacgaccgcccaggccgcgggcgaccccgaguaccuggagcagcccagccgguccgacuucagcaagcaccucaaggaggagaccauccagaucaucaccaaggccucccacgagcacgaggacaagagccccgagaccgugcugcagagcaagccggagaacacgaccucccagccccugagcaaccagcgcguggucgagguggccaucccccacguggggaaguucaugaucgaguccaaggagggcggguacgacgacgagaucaugaugacccccaacaugcagggcaucaucauggccaucggcaagagccgguccgucuacgaccgcugcgggccggaggcgggcuucuucaaggccaucaagcucgaguacgcccggcuggugaagcuggcccaggaggacaccccgcccgagacggacuaccgccuccaccacguggucguguacuucauccagaaccaggcccccaagaagaucaucgagaagacccugcuggagcaguucggggaccggaaccucagcuucgacgagcgcugccacaacaucaugaagguggcgcaggccaagcuggagaugaucaagcccgaggaggucaaccuggaggaguacgaggaguggcaccaggacuaccggaaguuccgcgagaccaccauguaccucaucaucggccuggagaacuuccagcgggaguccuacaucgacagccuccucuuccugaucugcgccuaccagaacaacaaggagcugcucuccaaggggcuguaccgcggccacgacgaggagcugaucagccacuaccggcgcgagugccuccugaagcugaacgagcaggccgccgagcuguucgaguccggcgaggaccgggaggugaacaacgggcucaucaucaugaacgaguucaucgugcccuuccugccccuccugcuggucgacgagauggaggagaaggacauccucgcgguggaggacaugcgcaaccgguggugcagcuaccugggccaggagauggagccccaccuccaggagaagcucacggacuuccugccgaagcugcucgacugcuccauggagaucaagagcuuccacgagccgcccaagcugcccuccuacagcacccacgagcugugcgagcgcuucgcccggaucaugcucucccugagccgcacccccgccgacgggcgcuga

SEQ ID NO: 38509 - RNA, 2742 nt, Artificial Sequence
  derived and/or modified sequence opt1 from USP26__Homo_sapiens__NP_114113
auggccgcccuguuccuccgcggcuucgugcagaucgggaacugcaagaccggcaucagcaaguccaaggaggcguucaucgaggccgucgagcggaagaagaaggaccgccuggugcuguacuucaagagcgggaaguacuccaccuuccggcucagcgacaacauccagaacgugguccugaaguccuaccgcggcaaccagaaccaccuccaccucacgcugcagaacaacaacgggcuguucaucgagggccucagcuccaccgacgccgagcagcugaagaucuuccuggaccgggugcaccagaacgaggugcagcccccgguccgccccggcaagggcgggagcguguucuccagcaccacccagaaggagaucaacaagacguccuuccacaagguggacgagaaguccagcagcaaguccuucgagaucgccaaggggagcggcaccgggguccuccagcggaugccccugcugaccuccaagcucacccugacgugcggcgagcugagcgagaaccagcacaagaagcgcaagcggaugcucuccagcagcuccgagaugaacgaggaguuccugaaggagaacaacagcguggaguacaagaaguccaaggccgacugcagccgcugcguguccuacaaccgggagaagcagcugaagcucaaggagcuggaggagaacaagaagcuggagugcgagagcuccugcaucaugaacgcgaccggcaaccccuaccucgacgacaucgggcugcugcaggcccucaccgagaagaugguccugguguuccugcuccagcagggcuacagcgacggguacaccaagugggacaagcugaagcuguucuucgagcuguucccggagaagaucugccacggccugcccaaccugggcaacacgugcuacaugaacgccgugcuccagucccugcugagcauccccuccuucgccgacgaccuccugaaccagagcuuccccugggggaagaucccgcugaacgcgcucaccaugugccuggcccgccuccuguucuucaaggacaccuacaacaucgagaucaaggagaugcugcugcucaaccugaagaaggccaucuccgccgccgcggagaucuuccacggcaacgcccagaacgacgcccacgaguuccuggcccacugccuggaccagcucaaggacaacauggagaagcugaacaccaucuggaagcccaagagcgaguucggggaggacaacuuccccaagcaggucuucgccgacgaccccgacacguccggcuucagcugcccggugaucaccaacuucgagcuggagcuccugcacuccaucgcgugcaaggccugcggccaggugauccugaagaccgagcucaacaacuaccugagcaucaaccugccccagcggaucaaggcccaccccuccagcauccagagcaccuucgaccucuucuucggggccgaggagcuggaguacaagugcgccaagugcgagcacaagacguccgucggcgugcacagcuucucccgccugccccggauccucaucgugcaccugaagcgcuacagccugaacgaguucugcgcgcucaagaagaacgaccaggaggucaucaucuccaaguaccugaaggugagcucccacugcaacgaggggacccggccgccccugccccucagcgaggacggcgagaucaccgacuuccagcugcugaaggugauccgcaagaugaccuccgggaacaucagcgucuccuggcccgccacgaaggagagcaaggacauccucgccccgcacaucggcuccgacaaggagagcgagcagaagaaggggcagaccguguucaagggcgccucccggcgccagcagcagaaguaccugggcaagaacagcaagcccaacgagcuggaguccgucuacagcggggaccgggccuucaucgagaaggagccccucgcgcaccugaugaccuaccuggaggacaccagccucugccaguuccacaaggccggcgggaagcccgccuccagcccgggcacgccccuguccaagguggacuuccagaccgugcccgagaaccccaagcgcaagaaguacgucaagaccagcaaguucguggccuucgaccgcaucaucaacccgaccaaggaccuguacgaggacaagaacauccggauccccgagcgcuuccagaagguguccgagcagacgcagcagugcgacgggaugcggaucugcgagcaggcgccccagcaggcccucccgcagagcuuccccaagcccggcacccagggccacaccaagaaccugcugcgccccaccaagcucaaccugcagaaguccaaccggaacagccugcucgcccugggguccaacaagaacccgcgcaacaaggacauccuggacaagaucaagagcaaggccaaggagacgaagcggaacgacgacaagggcgaccacaccuaccgccucaucuccgucgugagccaccuggggaagacccugaaguccggccacuacaucugcgacgccuacgacuucgagaagcagaucugguucaccuacgacgacaugcgggugcucggcauccaggaggcgcagaugcaggaggaccgccggugcaccggguacaucuucuucuacaugcacaacgagaucuucgaggagaugcugaagcgcgaggagaacgcccagcugaacagcaaggaggucgaggagacgcuccagaaggaguga

SEQ ID NO: 38510 - RNA, 3234 nt, Artificial Sequence
  derived and/or modified sequence opt1 from USP28__Homo_sapiens__NP_065937
augaccgccgagcugcagcaggacgacgccgcgggcgccgccgacgggcacggcagcuccugccagaugcuccugaaccagcugcgcgagaucaccgggauccaggaccccagcuuccuccacgaggcccugaaggccuccaacggcgacaucacgcaggcggugagccugcucaccgacgagcgggucaaggagccgucccaggacaccguggccaccgagcccagcgagguggagggguccgccgccaacaaggagguccuggcgaaggugaucgaccugacgcacgacaacaaggacgaccuccaggccgccaucgcccugagccugcucgagucccccaagauccaggccgacggccgcgaccugaaccggaugcacgaggcgaccagcgccgagaccaagcgcuccaagcggaagcgcugcgagguguggggcgagaaccccaacccgaacgacuggcggcgcgucgacggguggcccgugggccugaagaacguggggaacacgugcugguucagcgccgucauccagucccucuuccagcugcccgaguuccggcgccuggugcucagcuacucccugccccagaacgugcuggagaacugccggagccacaccgagaagcgcaacaucauguucaugcaggagcuccaguaccuguucgcccugaugaugggcuccaaccggaaguucgucgacccgagcgccgcgcucgaccugcugaagggggccuuccgcuccagcgaggagcagcagcaggacgugagcgaguucacccacaagcuccuggacuggcuggaggacgccuuccagcucgccgugaacgucaacagcccccggaacaaguccgagaaccccauggugcagcuguucuacggcaccuuccugaccgagggcgugcgcgaggggaagcccuucugcaacaacgagacguucggccaguacccgcuccaggucaacggguaccggaaccuggacgagugccuggagggcgccaugguggagggcgacguggagcuccugcccuccgaccacagcgucaaguacgggcaggagcgcugguucaccaagcugccgcccgugcucaccuucgagcugucccgguucgaguucaaccagagccugggccagcccgagaagauccacaacaagcucgaguucccccagaucaucuacauggaccgcuacauguaccgguccaaggagcugauccgcaacaagcgcgagugcauccggaagcugaaggaggagaucaagauccuccagcagaagcuggagcgcuacgugaaguacgggagcggccccgcgcgguucccccugccggacaugcucaaguacgucaucgaguucgccuccaccaagcccgccagcgaguccugcccgcccgagagcgacacgcacaugacccugccccuguccagcgugcacugcuccgucagcgaccagaccuccaaggagagcaccuccacggagagcagcucccaggacguggagagcaccuucuccagccccgaggacucccugcccaagagcaagccccucaccuccagccgcuccagcauggagaugccgucccagcccgcgccccggaccgugacggacgaggagaucaacuucgucaagaccugccugcagcgcuggcggagcgagaucgagcaggacauccaggaccugaagaccugcaucgccuccaccacgcagaccaucgagcagauguacugcgacccgcuccugcgccaggugcccuaccggcugcacgccgugcucguccacgaggggcaggccaacgccggccacuacugggccuacaucuacaaccagccccgccagagcuggcugaaguacaacgacaucuccgugaccgagagcuccugggaggagguggagcgggacagcuacggcgggcugcgcaacgucagcgcguacugccucauguacaucaacgacaagcugcccuacuucaacgccgaggccgccccgaccgaguccgaccagaugagcgagguggaggcccuguccguggagcucaagcacuacauccaggaggacaacuggcgguucgagcaggaggucgaggagugggaggaggagcagagcugcaagaucccccagauggaguccagcacgaacuccagcucccaggacuacagcaccucccaggagcccagcguggcguccagccacggcgugcgcugccuguccagcgagcacgccgucaucgugaaggagcagaccgcccaggccaucgccaacaccgcgcgggccuacgagaaguccgggguggaggccgcccugagcgaggucaugcucucccccgccaugcagggcgugauccuggcgaucgccaaggcccgccagacguucgaccgggacgggagcgaggccggccugaucaaggcguuccacgaggaguacagccgccucuaccagcuggccaaggagaccccgaccucccacagcgacccccggcugcagcacgugcucgucuacuucuuccagaacgaggcccccaagcgcgugguggagcgcacccugcuggagcaguucgccgacaagaaccucuccuacgacgagcggagcaucuccaucaugaaggucgcccaggcgaagcugaaggagaucggccccgacgacaugaacauggaggaguacaagaaguggcacgaggacuacagccuguuccgcaagguguccguguaccuccugaccgggcuggagcucuaccagaagggcaaguaccaggaggcccugagcuaccuggucuacgccuaccaguccaacgccgcccuccugaugaaggggccgcggcgcggcgugaaggagagcgugaucgcgcuguaccggcgcaagugccuccuggagcugaacgccaaggccgccucccucuucgagacgaacgacgaccacagcgucaccgaggggaucaacgugaugaacgagcugaucauccccugcauccaccugaucaucaacaacgacaucuccaaggacgaccucgacgccaucgaggugaugcggaaccacuggugcagcuaccugggccaggacaucgcggagaaccugcagcucugccugggcgaguuccugccccgccuccuggaccccuccgccgagaucaucguccugaaggagccgcccaccauccggcccaacagccccuacgaccucugcucccgcuucgccgccgugauggagagcauccaggggguguccaccgucacggugaaguga

SEQ ID NO: 38511 - RNA, 1089 nt, Artificial Sequence
  derived and/or modified sequence opt1 from USP2__Homo_sapiens__NP_001230688
augcuggugcccggcagcacccgcccguacuccaagaagcggcagaacagcaaguccgcccaggggcucgccggccugcgcaaccuggggaacacgugcuucaugaacagcauccuccagugccuguccaacacccgggagcugcgcgacuacugccuccagcggcuguacaugcgcgaccugcaccacggcagcaacgcgcacaccgcccucgucgaggaguucgccaagcugauccagaccaucuggaccuccagccccaacgacguggugucccccagcgaguucaagacgcagauccagcgguacgcgccccgcuucgucggguacaaccagcaggacgcccaggaguuccugcgguuccuccuggacggccugcacaacgaggugaaccgcgugacccuccggccgaaguccaaccccgagaaccuggaccaccuccccgacgacgagaagggccgccagauguggcggaaguaccucgagcgcgaggacagccggaucggggaccuguucgucggccagcugaaguccagccugaccugcaccgacugcggguacugcuccacgguguucgaccccuucugggaccugagccugccgaucgccaagcgcggcuaccccgaggugacccucauggacugcaugcggcuguucaccaaggaggacguccuggacggggacgagaagccgaccugcugccgcugccggggccgcaagcggugcaucaagaaguucuccauccagcgcuuccccaagauccucgugcugcaccugaagcgcuucagcgagucccggauccgcacgagcaagcucaccaccuucgugaacuucccccugcgggaccuggaccuccgcgaguucgccagcgagaacaccaaccacgccgucuacaaccuguacgccguguccaaccacagcggcacgaccaugggcgggcacuacaccgcguacugccggucccccgggaccggcgaguggcacacguucaacgacagcuccgugacccccaugagcuccagccagguccgcaccuccgacgccuaccuccuguucuacgagcuggccagcccgcccucccggauguga

SEQ ID NO: 38512 - RNA, 4815 nt, Artificial Sequence
  derived and/or modified sequence opt1 from USP32__Homo_sapiens__NP_115971
augggcgccaaggagagccgcaucggguuccuguccuacgaggaggcccuccggcgcgugaccgacgucgagcugaagcggcugaaggacgcguucaagcggaccugcggccucagcuacuacauggggcagcacugcuucauccgcgaggugcugggcgacggggugcccccgaaggucgccgaggugaucuacugcuccuucggcggcacgagcaaggggcugcacuucaacaaccucaucgugggccugguccugcucacccgcgggaaggacgaggagaaggccaaguacaucuucucccuguucagcuccgagagcggcaacuacgugauccgggaggagauggagcgcaugcugcacguggucgacgggaaggugcccgacacccuccggaagugcuucuccgagggcgagaaggugaacuacgagaaguuccgcaacuggcuguuccugaacaaggacgccuucaccuucagccgguggcuccuguccggcggggucuacgugacgcugaccgacgacagcgacacccccaccuucuaccagacgcucgccggcgugacccaccuggaggaguccgacaucaucgaccuggagaagcgcuacuggcuccugaaggcgcagagccggaccgggcgcuucgaccuggagaccuucggcccccucgucuccccgcccauccggcccagccuguccgagggccuguucaacgccuucgacgagaaccgcgacaaccacaucgacuucaaggagaucagcugcgggcucuccgccugcugccggggcccccuggccgagcgccagaaguucugcuucaagguguucgacguggaccgggacgggguccugagccgcguggagcuccgggacaugguggucgcgcugcuggagguguggaaggacaaccgcacggacgacaucccggagcuccacauggaccugagcgacaucguggagggcauccugaacgcccacgacaccaccaagauggggcaccucacccuggaggacuaccagaucugguccgucaagaacgugcuggccaacgaguuccucaaccugcuguuccaggucugccacaucgugcucggccugcgccccgccacgcccgaggaggagggccagaucauccggggguggcuggagcgcgagagccgguacggccuccaggccgggcacaacugguucaucaucuccaugcagugguggcagcaguggaaggaguacgugaaguacgacgcgaaccccgucgugaucgagccgagcuccgugcugaacggcgggaaguacagcuucggcaccgccgcccaccccauggagcaggucgaggaccgcaucggcuccagccuguccuacgugaacaccaccgaggagaaguucagcgacaacaucuccacggccagcgaggccuccgagaccgcggggagcggcuuccucuacuccgccacccccggggccgacgugugcuucgcccggcagcacaacaccagcgacaacaacaaccagugccugcugggcgccaacgggaacauccugcuccaccugaacccccagaagccgggcgcgaucgacaaccagccccuggucacgcaggagcccgugaaggccaccucccucacccuggagggcgggcgccugaagcggacgccccagcucauccacggccgcgacuacgagauggugccggagcccgucuggcgggcccuguaccacugguacggggccaaccuggcccucccccgccccgugaucaagaacagcaagaccgacaucccggagcuggagcuguucccccgguaccuccuguuccugcgccagcagcccgcgacccggacccagcaguccaacaucugggugaacaugggcaacguccccagcccgaacgcgccccucaagcgcgugcuggccuacaccggcugcuucagccggaugcagacgaucaaggagauccacgaguaccugucccagcgccuccggaucaaggaggaggacaugcgccuguggcuguacaacagcgagaacuaccucacccugcuggacgacgaggaccacaagcucgaguaccugaagauccaggacgagcagcaccuggugaucgagguccggaacaaggacauguccuggcccgaggagaugagcuucaucgccaacuccagcaagaucgaccgccacaaggugccgaccgagaagggggccaccggccucuccaaccuggggaacacgugcuucaugaacagcuccauccagugcgugagcaacacccagccccugacccaguacuucaucuccggccgccaccucuacgagcugaaccggaccaaccccaucgggaugaagggccacauggccaagugcuacggcgaccugguccaggagcucuggagcgggacccagaagaacguggcgccccugaagcugcgcuggacgaucgccaaguacgccccgcgguucaacggcuuccagcagcaggacucccaggagcuccuggccuuccugcucgacgggcugcacgaggaccugaaccgcgugcacgagaagcccuacgucgagcucaaggacagcgacggccggcccgacugggagguggccgccgaggccugggacaaccaccuccgccggaaccgcuccaucguggucgaccuguuccacgggcagcugcggagccaggugaagugcaagaccugcggccacaucuccgugcgcuucgaccccuucaacuuccugagccugccgcuccccauggacagcuacaugcaccuggagaucaccgucaucaagcuggacggcaccacgcccgugcgguacgggcuccgccugaacauggacgagaaguacaccggccugaagaagcagcucuccgaccugugcgggcugaacagcgagcagauccuccuggccgaggugcacggcuccaacaucaagaacuucccccaggacaaccagaagguccggcugagcguguccggguuccucugcgcguucgagaucccggugcccgucagccccaucuccgccagcucccccacccagaccgacuucagcuccagcccguccacgaacgagauguucacccugaccaccaacggcgaccugccccgccccaucuucauccccaacggcaugccgaacacgguggugcccugcgggaccgagaagaacuucaccaacggcauggucaacgggcacaugcccagccuccccgacuccccguucaccggcuacaucaucgccgugcaccggaagaugaugcgcacggagcuguacuuccugagcucccagaagaaccggcccagccucuucgggaugccccugaucgugccgugcaccguccacacccgcaagaaggaccuguacgacgccguguggauccaggugucccggcucgccagcccccugccgccccaggaggcgagcaaccacgcccaggacugcgacgacuccaugggcuaccaguaccccuucacccugcgcgucgugcagaaggacggcaacagcugcgccuggugccccugguaccgguucugccgcgggugcaagaucgacugcggcgaggaccgcgccuucaucgggaacgcguacaucgccguggacugggaccccacggcccuccaccuccgguaccagaccucccaggagcgcgucguggacgagcacgagagcguggagcagucccggcgcgcccaggccgagcccaucaaccuggacagcugccugcgggcguucaccuccgaggaggagcugggcgagaacgagauguacuacugcagcaagugcaagacccacugccuggccacgaagaagcucgaccuguggcgccugccgcccauccucaucauccaccugaagcgguuccaguucgucaacggccgcuggaucaagucccagaagaucgugaaguucccccgggagagcuucgaccccuccgccuuccuggucccgcgcgaccccgcccucugccagcacaagccccugaccccgcagggggacgagcugagcgagccccggauccucgcccgcgaggugaagaagguggacgcgcaguccagcgccggcgaggaggacguccugcuguccaagagccccuccagccucuccgccaacaucaucagcagccccaaggggucccccagcuccagccggaaguccggcaccagcugcccguccagcaagaacuccagccccaacuccagcccccgcacccuggggcgguccaagggccgccugcggcucccccagaucggcagcaagaacaagcuguccagcuccaaggagaaccuggacgccagcaaggagaacggggccggccagaucugcgagcuggcggacgcccucucccgcgggcacgugcugggcgggagccagccggagcuggugacgccccaggaccacgaggucgcccucgccaacggcuuccuguacgagcacgaggcgugcggcaacggguacagcaacggccagcuggggaaccacuccgaggaggacagcaccgacgaccagcgggaggacacccgcaucaagcccaucuacaaccucuacgccaucuccugccacagcggcauccucgggggcggccacuacgugaccuacgccaagaaccccaacugcaagugguacugcuacaacgacuccagcugcaaggagcugcacccggacgagaucgacacggacuccgccuacauccuguucuacgagcagcaggggaucgacuacgcccaguuccugcccaagaccgacggcaagaagauggcggacaccagcuccauggacgaggacuucgagagcgacuacaagaaguacugcgugcugcaguga

SEQ ID NO: 38513 - RNA, 1803 nt, Artificial Sequence
  derived and/or modified sequence opt1 from USP33__Homo_sapiens__XP_011539358
augaccggcagcaacucccacaucaccauccugacgcucaaggugcugccccacuucgagagccuggggaagcaggagaagaucccgaacaagauguccgccuuccgcaaccacugcccccaccucgacagcgucggcgagaucaccaaggaggaccugauccagaagucccuggggaccugccaggacugcaaggugcagggccccaaccucugggccugccuggagaaccggugcagcuacguggggugcggcgagucccaggucgaccacagcaccauccacucccaggagacgaagcacuaccugaccgugaaccucaccacccugcgcguguggugcuacgcgugcagcaaggaggucuuccuggaccggaagcucggcacgcagcccucccugccgcacgugcgccagccccaccagauccaggagaacagcgugcaggacuucaagauccccuccaacaccacccugaagacgccccucgucgccguguucgacgaccuggacaucgaggccgacgaggaggacgagcugcgggcccgcgggcucaccggccugaagaacaucgggaacacgugcuacaugaacgccgcgcugcaggcccucagcaacugcccgccccugacccaguucuuccuggacugcggcgggcucgcccggaccgacaagaagcccgccaucugcaaguccuaccugaagcugaugaccgagcucuggcacaagagccgccccggcuccguggucccgaccacccuguuccagggcaucaagaccgugaaccccacguuccggggguacagccagcaggacgcgcaggaguuccugcgcugccucauggaccugcugcacgaggagcucaaggagcaggucauggagguggaggaggacccccagaccaucaccaccgaggagacgauggaggaggacaagucccagagcgacguggacuuccagagcugcgaguccugcagcaacuccgaccgggccgagaacgagaacggcagccgcugcuucuccgaggacaacaacgagaccaccaugcugauccaggacgacgagaacaacagcgagauguccaaggacuggcagaaggagaagaugugcaacaagaucaacaaggugaacagcgagggggaguucgacaaggaccgggacuccaucagcgagaccgucgaccugaacaaccaggagacggugaaggugcagauccacucccgcgccagcgaguacaucaccgacguccacuccaacgaccucagcacgccccagauccugccguccaacgagggcgugaacccccggcugagcgccuccccgcccaagagcggcaaccucuggcccgggcuggccccgccccacaagaaggcgcaguccgccagccccaagcgcaagaagcagcacaagaaguaccggagcgugaucuccgacaucuucgacggcaccaucaucagcuccguccagugccugaccugcgaccgcgugagcgucacccucgagaccuuccaggaccugucccugcccauccccgggaaggaggaccucgccaagcugcacagcuccagccaccccaccuccaucgugaaggccggcagcugcggggaggccuacgcgccccagggcuggaucgccuucuucauggaguacgugaagcgguucgucguguccugcgugccgagcugguucuggggccccgucgugacgcugcaggacugccucgccgccuucuucgcccgcgacgagcugaagggggacaacauguacuccugcgagaagugcaagaagaacgcgaccgccugcuga

SEQ ID NO: 38514 - RNA, 3372 nt, Artificial Sequence
  derived and/or modified sequence opt1 from USP36__Homo_sapiens__XP_005257599
augcccaucguggacaagcugaaggaggcccucaagccgggccgcaaggacagcgccgacgacggggagcugggcaagcugcucgcguccagcgccaagaagguccugcugcagaagaucgaguucgagcccgccuccaagagcuucuccuaccagcucgaggcccugaagagcaaguacgugcugcucaaccccaagaccgagggggccucccggcacaagagcggcgacgaccccccggcgcgccggcagggguccgagcacaccuacgagagcugcggcgacggcgugcccgccccccagaagguccuguuccccacggagcgccugucccuccggugggagcgcguguuccgggugggggccggccugcacaaccuggggaacaccugcuuccucaacgccaccauccagugccugaccuacacgccgccccuggcgaacuaccuccugagcaaggagcacgcccgcuccugccaccagggcagcuucugcaugcugugcgucaugcagaaccacaucgugcaggccuucgccaacuccgggaacgccaucaagcccgugagcuucauccgggaccucaagaagaucgcgcgccacuuccgguucggcaaccaggaggacgcccacgaguuccugcgcuacaccaucgacgccaugcagaaggccugccugaacggcugcgccaagcucgaccggcagacccaggcgaccacgcugguccaccagaucuucgggggcuaccugcgcucccgggugaagugcagcgugugcaaguccgucagcgacaccuacgaccccuaccucgacguggcccuggagauccgccaggccgccaacaucgugcgggcccuggagcucuucgucaaggcggacgugcugagcggggagaacgccuacaugugcgccaagugcaagaagaaggugccggccuccaagcgcuucaccauccaccggaccagcaacguccugacgcucucccugaagcgcuucgccaacuucagcggcggcaagaucaccaaggacgugggguaccccgaguuccugaacauccggcccuacaugucccagaacaacggcgaccccgugauguacgggcucuacgcgguccuggugcacagcggcuacuccugccacgccgggcacuacuacugcuacgugaaggccagcaacggccagugguaccagaugaacgacucccugguccacagcuccaacgugaaggucgugcucaaccagcaggccuacgugcuguucuaccugcgcaucccgggcagcaagaagucccccgaggggcucaucagccgcaccggcuccagcucccugcccgggcggcccagcgucaucccggaccacuccaagaagaacaucggcaacgggaucaucagcagcccccugaccggcaagcgccaggacuccggcacgaugaagaagccccacaccaccgaggagaucggggugcccaucagccggaacggcuccacccucgggcugaagagccagaacggcugcaucccgcccaagcugcccuccgggagccccuccccgaagcucagccagacgcccacccacaugcccaccauccuggacgacccgggcaagaaggugaagaagcccgcgcccccccagcacuucuccccgcgcaccgcccagggccugcccgggacgagcaacuccaacagcucccggagcggcucccagcgccaggggagcugggacucccgggacgucgugcugagcaccagccccaagcuccuggccaccgccaccgccaacggccacggccugaaggggaacgacgaguccgcgggccucgaccgccgggggagcuccagcuccagccccgagcacuccgccagcuccgacagcacgaaggccccgcagaccccccgcuccggcgccgcccaccugugcgacagccaggagaccaacugcuccaccgcggggcacagcaagacgccccccuccggcgccgacagcaagaccgugaagcugaaguccccgguccucagcaacaccaccacggagcccgccuccaccaugagcccccccccggccaagaagcuggcccugagcgcgaagaaggccuccacccucuggcgggccaccggcaacgaccugcgccccccccccccgagccccuccagcgaccugacccaccccaugaagacgucccaccccgugguggccagcaccuggccgguccaccgggcgcgcgccgugucccccgccccccagagcuccagccggcuccagccgcccuucuccccccaccccacccugcugagcuccaccccgaagccccccgggacgagcgagccccgcuccugcagcuccaucagcaccgcccucccgcaggugaacgaggaccuggucucccugccccaccagcuccccgaggccagcgagcccccgcagagccccuccgagaagcggaagaagaccuucgugggcgagccccagcgccuggggagcgagacccggcugccccagcacauccgcgaggcgacggccgccccgcacggcaagcgcaagcggaagaagaagaagcgccccgaggacaccgccgccuccgcgcuccaggaggggcagacccagcggcagcccggcagccccauguaccgccgggagggccaggcccagcugccggccgugcgccggcaggaggacgggacccagccccaggucaacggccagcagguggggugcgugacggacggccaccacgccuccagccgcaagcggcgccggaagggggccgagggccugggcgaggaggggggccuccaccaggacccccugcgccacuccugcagccccaugggggacggcgacccggaggcgauggaggaguccccccggaagaagaagaagaagaagcgcaagcaggagacccagcgggccgucgaggaggacgggcaccugaagugcccccgcagcgccaagccccaggacgccguggugccggaguccagcuccugcgcgcccagcgccaacggcuggugccccggcgaccggauggggcucucccaggccccgcccgucagcuggaacggcgagcgcgaguccgacguggugcaggagcugcugaaguacagcuccgacaaggccuacgggcggaagguccucaccugggacggcaagaugagcgccgugagccaggacgcgaucgaggacucccgccaggcccggaccgagacgguggucgacgacugggacgaggaguucgaccgcggcaaggagaagaagaucaagaaguucaagcgcgagaagcggcgcaacuucaacgccuuccagaagcugcagacccggcgcaacuucuggagcgugacccaccccgccaaggccgcgucccugagcuaccggcgcuga

SEQ ID NO: 38515 - RNA, 2940 nt, Artificial Sequence
  derived and/or modified sequence opt1 from USP37__Homo_sapiens__XP_005246779
augagcccccugaagauccacggcccgauccgcauccgguccaugcagaccgggaucaccaaguggaaggagggcagcuucgagaucguggagaaggagaacaaggucucccucguggugcacuacaacaccgggggcaucccccgcaucuuccagcugagccacaacaucaagaacgucgugcugcggcccuccggggccaagcagagccgccucaugcugacccugcaggacaacuccuuccucagcaucgacaaggugcccuccaaggacgccgaggagaugcggcuguuccuggacgcgguccaccagaaccgccucccggccgccaugaagcccagccagggcuccggcagcuucggggccauccugggcucccggaccagccagaaggagaccucccgccagcugagcuacuccgacaaccaggccagcgcgaagcgggggucccucgagacgaaggacgacauccccuuccgcaaggugcugggcaaccccgggcggggcagcaucaagaccguggccggcagcgggaucgcccgcaccaucccgucccugaccagcacguccacgccccuccggagcggccugcuggagaaccgcaccgagaagcggaagcgcaugaucuccaccgggagcgagcucaacgaggacuaccccaaggagaacgacuccagcuccaacaacaaggccaugacggaccccagccggaaguaccugaccuccagccgcgagaagcagcugucccucaagcagagcgaggagaaccggaccuccggccugcugccgcuccagagcuccagcuucuacggcucccgcgcggggagcaaggagcacagcuccggcgggaccaaccuggaccggacgaacgucagcucccagacccccagcgccaagcgcucccugggcuuccucccccagcccgugccgcugagcgugaagaagcugcgcugcaaccaggacuacaccggguggaacaagccccgggucccccucuccagccaccagcagcagcagcugcagggcuucuccaaccugggcaacacgugcuacaugaacgccauccuccagagccuguucucccugcagagcuucgccaacgaccuccugaagcaggggauccccuggaagaagaucccgcugaacgcccucauccgccgguucgcgcaccuccuggugaagaaggacaucugcaacuccgagaccaagaaggaccugcugaagaaggugaagaacgccaucagcgccaccgccgagcgcuucuccggcuacaugcagaacgacgcccacgaguuccugagccagugccucgaccagcugaaggaggacauggagaagcugaacaagaccuggaagaccgagcccgucuccggggaggagaacagccccgacaucagcgcgacgcgggccuacacgugccccgugaucaccaaccucgaguucgaggugcagcacuccaucaucugcaaggccugcggcgagaucaucccgaagcgcgagcaguucaacgaccugagcaucgaccugccccggcgcaagaagccccugcccccgcgguccauccaggacagccucgaccuguucuuccgcgccgaggagcuggaguacuccugcgagaagugcgggggcaagugcgcccucguccggcacaaguucaaccgccugccccgggugcugauccuccaccugaagcgcuacagcuucaacguggcgcugucccucaacaacaagaucggccagcaggucaucaucccccgguaccugacccugagcucccacugcaccgagaacaccaagccgcccuucacccucggguggagcgcccacauggccaucucccgcccccugaaggccagccagauggugaacuccugcaucaccagccccuccacgccgagcaagaaguucaccuucaaguccaagagcucccuggcccucugccuggacagcgacagcgaggacgagcugaagcgguccguggcgcucagccagcgccugugcgagaugcugggcaacgagcagcagcaggaggaccucgagaaggacuccaagcugugccccaucgagcccgacaagagcgagcuggagaacuccggguucgaccggaugagcgaggaggagcuccuggccgccguccuggagaucuccaagcgcgacgccagccccucccucagccacgaggacgacgacaagccgaccuccagccccgacaccggcuucgcggaggacgacauccaggagaugcccgagaaccccgacacgauggagaccgagaagccgaagaccaucaccgagcuggaccccgccuccuucaccgagaucacgaaggacugcgacgagaacaaggagaacaagacccccgaggggagccagggcgagguggacuggcugcagcaguacgacauggagcgcgagcgggaggagcaggagcuccagcaggcccuggcccagucccugcaggagcaggaggccugggagcagaaggaggacgacgaccucaagcgcgcgaccgagcugagccugcaggaguucaacaacuccuucgucgacgcccucggcagcgacgaggacuccgggaacgaggacguguucgacauggaguacaccgaggccgaggccgaggagcugaagcggaacgccgagacgggcaaccugccccacagcuaccgccucaucagcguggucucccacaucgggagcaccuccagcuccggccacuacaucagcgacguguacgacaucaagaagcaggcgugguucaccuacaacgaccuggagguguccaagauccaggaggccgccguccagagcgaccgggaccgcuccggcuacaucuucuucuacaugcacaaggagaucuucgacgagcugcucgagaccgagaagaacagccagucccugagcacggagguggggaagaccacccggcaggcccuguga

SEQ ID NO: 38516 - RNA, 1431 nt, Artificial Sequence
  derived and/or modified sequence opt1 from USP3__Homo_sapiens__NP_001243631
auggagugcccccaccugagcuccagcgugugcaucgccccggacuccgccaaguuccccaacggcagccccuccagcuggugcugcuccgucugccgcagcaacaagucccccugggugugccugaccugcagcuccgugcacugcgggagcuaccggugcgacgacuucgucgugaacgacaccaagcugggccuggugcagaagguccgcgagcaccuccagaaccuggagaacuccgcguucacggccgaccggcacaagaagcgcaagcugcucgagaacagcacccugaacuccaagcugcucaaggugaacgggagcaccaccgccaucugcgccacgggccugcggaaccuggggaacacgugcuucaugaacgccauccuccagucccugagcaacaucgagcaguucugcugcuacuucaaggagcugccggcgguggagcuccgcaacggcaagaccgccggccggcgcaccuaccacacccggucccagggggacaacaacgucagccugguggaggaguuccgcaagacccugugcgcccucuggcagggcagccagaccgccuucucccccgagagccuguucuacguggucuggaagaucaugcccaacuuccggggguaccagcagcaggacgcgcacgaguucaugcgcuaccugcucgaccaccuccaccuggagcuccagggcggguucaacggcgugucccggagcgccauccugcaggagaacuccacccugagcgccuccaacaagugcugcaucaacggcgccagcacgguggucaccgccaucuucgggggcauccuccagaacgaggugaacugccugaucugcgggaccgagucccgcaaguucgaccccuuccuggaccucagccuggacaucccgucccaguuccggagcaagcgcuccaagaaccaggagaacggccccgugugcagccugcgggacugccuccgcuccuucaccgaccuggaggagcuggacgagacggagcucuacaugugccacaagugcaagaagaagcagaaguccaccaagaaguucuggauccagaagcugcccaagguccugugccuccaccugaagcgguuccacuggaccgcguaccugcgcaacaagguggacaccuacguggaguucccccuccggggccuggacaugaagugcuaccugcucgagccggagaacagcgggcccgagagcugccuguacgaccuggccgccgucguggugcaccacggcuccggggucggcagcgggcacuacacggccuacgccacccacgagggccgcugguuccacuucaacgacagcaccgugacccucacggacgaggagaccgucgugaaggcgaaggccuacauccuguucuacguggagcaccaggccaaggccggcuccgacaagcuguga

SEQ ID NO: 38517 - RNA, 3744 nt, Artificial Sequence
  derived and/or modified sequence opt1 from USP40__Homo_sapiens__NP_060688
augagccuguuccuccgcguggucuucuccuucaccauguucggcgaccuguucgaggaggaguacagcaccguguccaacaaccaguacgggaagggcaagaagcugaagacgaaggcccucgagcccccggcgccccgggaguucaccaaccugagcgggauccgcaaccagggcgggaccugcuaccugaacucccuccugcagacccugcacuucacgcccgaguuccgggaggcgcuguucagccugggccccgaggagcugggccucuucgaggacaaggacaagccggacgccaaggugcgcaucaucccccugcagcugcagcgccucuucgcccagcugcugcuccuggaccaggaggccgccuccaccgcggaccugaccgacagcuucggguggaccuccaacgaggagaugcggcagcacgacguccaggagcucaaccggauccuguucagcgcccuggagacgucccucgugggcaccagcgggcacgaccugaucuaccgccuguaccacggcaccaucgugaaccagaucgucugcaaggagugcaagaacguguccgagcggcaggaggacuuccucgaccugaccguggccgucaagaacgugagcgggcuggaggacgcccucuggaacauguacguggaggaggaggucuucgacugcgacaaccuguaccacugcggcacgugcgaccgccuggugaaggcggccaaguccgccaagcuccggaagcugccgcccuuccugaccgugagccuccugcgcuucaacuucgacuucgucaagugcgagcgguacaaggagaccuccugcuacaccuucccccugcgcaucaaccucaagcccuucugcgagcagagcgagcuggacgaccuggaguacaucuacgaccucuucuccgugaucauccacaagggcgggugcuacggcgggcacuaccacguguacaucaaggacgucgaccaccugggcaacuggcaguuccaggaggagaaguccaagcccgacgugaaccugaaggaccuccagagcgaggaggagaucgaccacccccugaugauccugaaggccauccuccuggaggagaacaaccugaucccgguggaccagcugggccagaagcuccugaagaagaucgggaucagcuggaacaagaaguaccggaagcagcacggcccccugcgcaaguuccuccagcugcacagccagaucuuccugcucuccagcgacgaguccacgguccggcugcugaagaacagcucccuccaggccgagagcgacuuccagcgcaacgaccagcagaucuucaagaugcugccgcccgagucccccgggcugaacaacagcaucuccugcccccacugguucgacaucaacgacagcaaggugcagcccauccgggagaaggacaucgagcagcaguuccagggcaaggaguccgcguacaugcuguucuaccgcaagagccagcugcagcggcccccggaggcccgcgccaacccccgcuacggggugcccugccaccuccucaacgagauggacgccgccaacaucgagcugcagaccaagcgggcggagugcgacuccgccaacaacaccuucgagcugcaccuccaccugggcccccaguaccacuucuucaacggcgcccugcacccggucgugagccagaccgaguccgucugggaccucacguucgacaagcgcaagacccugggggaccugcggcagagcaucuuccagcuccuggaguucugggagggcgacauggugcuguccguggccaagcucguccccgccgggcugcacaucuaccagagccugggcggggacgagcucacccugugcgagaccgagaucgcggacggcgaggacaucuucguguggaacggcguggaggucgggggcgugcacauccagacggggaucgacugcgagccccugcuccugaacgugcugcaccucgacaccagcuccgacggcgagaagugcugccaggucaucgagagcccccacguguucccggccaacgccgagguggggaccguccugaccgcccuggccauccccgcgggcgugaucuucaucaacuccgccggcugccccgggggcgagggguggacggccaucccgaaggaggacaugcgcaagaccuuccgggagcagggccuccgcaacggcagcuccauccugauccaggacagccacgacgacaacucccugcucaccaaggaggagaagugggugaccagcaugaacgagaucgacuggcugcacgucaagaaccugugccagcucgaguccgaggagaagcaggucaagaucagcgccacggugaacaccaugguguucgacauccggaucaaggcgaucaaggagcugaagcugaugaaggagcucgccgacaacuccugccugcgccccaucgaccggaacgggaagcugcucugccccgugcccgacagcuacacccugaaggaggccgagcugaagaugggcuccagccucgggcugugccugggcaaggccccguccagcucccagcuguuccuguucuucgccauggggagcgacgugcagcccggcaccgagauggagaucgucguggaggagacgaucagcgugcgcgacugccugaagcucaugcugaagaaguccggccugcagggggacgcguggcaccuccggaagauggacuggugcuacgaggccggcgagccccugugcgaggaggacgccacccugaaggagcuccugaucugcagcggggacacccugcuccugaucgagggccagcugcccccgcucggguuccugaagguccccaucuggugguaccagcugcagggccccuccggccacugggagagccaccaggaccagaccaacugcaccuccagcugggggcgcguguggcgggccacguccagccagggcgccuccgggaacgagcccgcccaggugagccuccuguaccugggcgacaucgagaucuccgaggacgccacccucgccgagcucaagagccaggccaugacccugccgcccuuccucgaguucgggguccccucccccgcccaccuccgcgcguggaccguggagcggaagcgcccgggccggcugcuccgcacggaccggcagccccugcgcgaguacaagcugggccgccggaucgagaucugccucgagccccugcagaagggggagaaccugggcccccaggacgugcuccugcgcacccagguccggaucccgggggagcgcaccuacgcccccgcccuggaccucguguggaacgccgcgcagggcgggaccgccggcagccugcggcagcgcguggccgacuucuaccggcugcccgucgagaagaucgagaucgccaaguacuuccccgagaaguucgaguggcugccgaucuccagcuggaaccagcagaucacgaagcgcaagaagaagaagaagcaggacuaccuccagggcgcccccuacuaccugaaggacggggacaccaucggcgugaagaaccugcucaucgacgacgacgacgacuucuccaccauccgggacgacaccgggaaggagaagcagaagcagcgcgcgcugggccggcgcaagagccaggaggcccugcacgagcaguccagcuacauccucagcuccgccgagacgcccgcccggccgcgcgcccccgagaccagccuguccauccacgugggcagcuuccgguga

SEQ ID NO: 38518 - RNA, 3951 nt, Artificial Sequence
  derived and/or modified sequence opt1 from USP42__Homo_sapiens__NP_115548
augaccaucguggacaaggccagcgaguccagcgaccccuccgccuaccagaaccagccgggcagcuccgaggcggucagccccggggacauggacgccggcuccgccagcuggggggccguguccagccugaacgacguguccaaccacacccucagccugggccccguccccggggccgugguguacuccagcuccagcgucccggacaaguccaagcccagcccccagaaggaccaggcgcugggcgacggcaucgcccccccgcagaaggugcucuuccccuccgagaagaucugccugaaguggcagcagacgcaccgcgugggggccggccugcagaaccucgggaacaccugcuucgccaacgcggcccugcagugccugaccuacacccccccccucgccaacuacaugcugagccacgagcacagcaagacgugccacgccgagggcuucugcaugaugugcaccaugcaggcccacaucacccaggcgcuguccaacccgggggacgucaucaagcccauguucgugaucaacgagaugcggcgcaucgcccggcacuuccgcuucggcaaccaggaggacgcccacgaguuccuccaguacaccguggacgccaugcagaaggccugccugaacggcagcaacaagcuggaccggcacacgcaggcgaccacccucgucugccagaucuucgggggcuaccugcgcucccgggugaagugccugaacugcaagggggugagcgacaccuucgaccccuaccucgacaucacgcuggagaucaaggccgcccaguccgucaacaaggcccuggagcaguucgugaagcccgagcagcucgacggcgagaacagcuacaagugcuccaagugcaagaagauggugccggccagcaagcgcuucaccauccaccgguccagcaacguccugacccugucccucaagcgcuucgcgaacuucaccggcgggaagaucgccaaggacgugaaguaccccgaguaccuggacauccggcccuacaugagccagcccaacggcgagccgaucguguacguccuguacgccgugcucgugcacacgggguucaacugccacgccggccacuacuucugcuacaucaaggccuccaacgggcugugguaccagaugaacgacagcaucgucuccaccagcgacauccgcuccgugcugagccagcaggcguacguccucuucuacauccggucccacgacgugaagaacggcggcgagcugacccaccccacccacagccccgggcagagcuccccccgcccggugaucagccagcgggucgugacgaacaagcaggccgcccccggcuucaucgggccccagcugcccucccacaugaucaagaacccgccccaccucaacggcaccgggccccugaaggacaccccgagcuccagcauguccagccccaacggcaacuccagcgugaaccgcgccucccccgucaacgcgagcgccuccgugcagaacuggagcgugaaccgguccagcgucauccccgagcacccgaagaagcagaagaucaccaucuccauccacaacaagcugcccgugcgccagugccagagccagcccaaccuccacagcaacucccuggagaaccccacgaagccggugcccagcuccaccaucaccaacagcgccguccaguccaccagcaacgccuccacgaugagcguguccagcaaggugaccaagcccaucccccgguccgagagcugcucccagccggucaugaacggcaagagcaagcugaacuccagcgugcucgugcccuacggggccgaguccagcgaggacuccgacgaggagagcaagggccuggggaaggagaacggcaucgggaccaucgucagcucccacagccccggccaggacgcggaggacgaggaggccaccccccacgagcugcaggagccgaugacgcucaacggcgccaacuccgccgacagcgacuccgaccccaaggagaacgggcuggcccccgacggcgcgagcugccaggggcagcccgcccugcacuccgagaacccguucgccaaggccaacggccuccccggcaagcugaugcccgccccccugcucagccugccggaggacaagauccuggagaccuuccgccuguccaacaagcucaaggggagcaccgacgagauguccgcgcccggcgccgagcgggggcccccggaggaccgcgacgccgagccccagcccggcagccccgccgcggagucccuggaggagccggacgccgccgccgggcugagcuccaccaagaaggccccccccccccgcgacccgggcacgcccgcgaccaaggagggcgccugggaggccauggccguggcccccgaggagcccccgcccagcgcgggggaggacaucgugggcgacaccgccccccccgaccucugcgacccggggucccugaccggcgacgccagcccccugucccaggacgccaaggggaugaucgccgagggcccccgggacagcgcgcucgccgaggcccccgagggccugagcccggccccccccgcgcgcuccgaggagcccugcgagcagccgcugcucguccaccccagcggggaccacgcccgggacgcccaggaccccucccagagccugggcgcccccgaggccgcggagcgcccgcccgcccccgugcuggacauggccccggccgggcaccccgagggcgacgccgagcccucccccggggagcggguggaggacgcggccgccccgaaggcccccggccccagccccgccaaggagaagaucggcucccuccgcaaggucgaccgggggcacuaccgcagccggcgcgagcgguccagcuccggcgagccggcgcgcgagagccgguccaagaccgaggggcaccgccaccggcgccggcgcacgugcccccgggagcgcgaccgccaggaccggcacgcccccgagcaccaccccggccacggggaccgccugagcccgggcgagcggcgcucccugggccggugcagccaccaccacucccgccaccggagcgggguggagcucgacugggugcgccaccacuacaccgagggcgagcggggguggggccgcgagaaguucuaccccgaccggccccgcugggaccggugccgcuacuaccacgaccgguacgcccuguacgccgcccgcgacuggaagcccuuccacggcgggcgggagcacgagcgcgcgggccugcacgagcggccgcacaaggaccacaaccgcgggcggcgcggcugcgagcccgcccgcgagcgggagcgccaccggcccuccagcccccgcgccggggccccgcacgcgcucgccccccaccccgaccgguucagccacgaccgcaccgcccuggucgccggcgacaacugcaaccuguccgaccgguuccacgagcacgagaacggcaagagccgcaagcggcgccacgacuccguggagaacagcgacucccacguggagaagaaggcccggcgcagcgagcagaaggacccccucgaggagccgaaggcgaagaagcacaagaaguccaagaagaagaagaagagcaaggacaagcaccgggaccgcgacucccggcaccagcaggacagcgaccuguccgccgccugcagcgacgccgaccugcaccgccacaagaagaagaagaagaagaagaagcggcacucccgcaagagcgaggacuucgucaaggacuccgagcuccaccugccccgggugaccagccuggagacgguggcccaguuccgccgcgcgcaggggggcuucccccucuccgggggccccccgcuggagggggucggccccuuccgggagaagaccaagcaccugcgcauggagagccgggacgaccgcugccggcucuucgaguacggccagggggacuga

SEQ ID NO: 38519 - RNA, 3357 nt, Artificial Sequence
  derived and/or modified sequence opt1 from USP43__Homo_sapiens__NP_001254505
auggaccugggccccggggacgccgccggcgggggcccgcucgcgccccgcccccggcgccggcgcagccugcggcgccuguucucccgguuccuccuggcccuggggagccgcucccggcccggcgacagcccgccccgcccccagcccggccacugcgacggggacggcgaggggggcuucgccugcgccccggggcccgugcccgccgcgcccggcuccccgggcgaggagcggccccccgggccccagccgcagcuccagcugcccgccggcgacggggcccgcccccccggcgcccagggccugaagaaccacgggaacaccugcuucaugaacgcggucgugcagugccucagcaacaccgaccugcuggccgaguuccucgcccugggccgguaccgcgccgccccggggcgggcggaggugacggagcagcuggccgcccucguccgcgcccuguggacccgggaguacaccccccagcuguccgccgaguucaagaacgcggugagcaaguacggcucccaguuccaggggaacagccagcacgacgcccucgaguuccugcuguggcuccuggaccgcgugcacgaggaccuggagggcuccagccggggccccgucuccgagaagcuccccccggaggccaccaagacgagcgagaacugccugucccccagcgcccagcugccccucgggcaguccuucgugcagagccacuuccaggcccaguaccgcuccagccugaccugcccccacugccugaagcagagcaacaccuucgacccguuccucugcgugucccugcccaucccccugcggcagacccgcuuccucagcgucacgcugguguucccguccaagagccagcgcuuccugcgggugggccucgcgguccccauccuguccaccguggccgcccugcgcaagaugguggccgaggaggggggcguccccgccgacgaggugauccucguggagcuguaccccagcggguuccagcgguccuucuucgacgaggaggaccugaacaccaucgcggagggcgacaacgucuacgccuuccaggugccgcccagccccucccagggcacccucagcgcccacccccuggggcuguccgccagcccgcgccucgcggcccgggagggccagcgcuucucccugagccugcacuccgagagcaaggugcucauccuguucugcaaccuggucggguccggccagcaggccagccgguucgggccccccuuccugauccgcgaggaccgggccguguccugggcccagcuccagcagagcauccugagcaaggugcgccaccugaugaaguccgaggcgcccguccagaaccucggcagccuguucuccauccggguggucggccugagcguggccugcuccuaccucagcccgaaggacucccgcccccugugccacugggccguggaccggguccugcaccuccgccggcccgggggccccccgcacgugaagcuggccguggagugggacagcuccgucaaggagcgccuguucgggagccuccaggaggagcgggcccaggacgcggacuccguguggcagcagcagcaggcccaccagcagcacagcugcacgcuggacgagugcuuccaguucuacaccaaggaggagcagcuggcccaggacgacgccuggaagugcccccacugccaggugcuccagcagggcauggucaagcugucccuguggacccuccccgacauccugaucauccaccugaagcgcuucugccaggugggcgagcggcgcaacaagcucagcacccuggugaaguucccccuguccgggcucaacauggccccgcacgucgcgcagcgcagcacgucccccgaggccggccuggggcccuggcccagcuggaagcagccggacugccugcccaccagcuacccccucgacuuccuguacgaccuguacgccgugugcaaccaccacggcaaccuccaggccuacugccggaacucccuggacgggcagugguacagcuacgacgacuccaccguggagccgcugcgcgaggacgaggucaacacccggggcgcguacauccucuucuaccagaagcgcaacagcaucccccccugguccgccagcuccagcaugcggggcuccacgagcuccagccuguccgaccacuggcugcuccgccuggggagccacgccggcuccacccgggggagccugcucuccuggagcuccgcccccugcccgagccugccccaggugcccgacagccccaucuucaccaacucccugugcaaccaggagaagggcgggcucgagccgcgccggcuggugcgcggcgucaagggccggagcaucuccaugaaggcccccaccacgagccgcgcgaagcaggggcccuucaagaccaugccccugcggugguccuucggcagcaaggagaagccgcccggggccuccguggagcucguggaguaccuggagagccgccggcgcccccgguccaccagccaguccaucgucagccugcucaccggcacggccggggaggacgagaaguccgccagcccccgcuccaacguggcccugccggcgaacagcgaggacggcggccgggccaucgagcgcgggcccgccggcgugcccugccccuccgcccagccgaaccacugccuggcccccgggaacagcgacggccccaacaccgcgcggaagcucaaggagaacgccgggcaggacaucaagcugccccgcaaguucgaccugccgcucaccgucaugcccuccguggagcacgagaagcccgcccgccccgagggccagaaggccaugaacuggaaggagagcuuccagaugggcagcaaguccagcccgcccucccccuacaugggguucagcggcaacuccaaggacagccggcgcgggaccuccgagcuggaccggccgcugcagggcacgcucacccugcugcgcagcguguuccggaagaaggagaaccgccggaacgagcgcgcggaggucuccccccaggugccccccgugagccucgucuccggcgggcugagcccggccauggacggccaggcccccggguccccccccgcccugcggaucccggagggccucgcccgcgggcugggcagccggcuggagcgcgacgugugguccgcgcccagcucccuccggcugccccgcaaggccagccgggccccccgcggcuccgcccuggggaugagccagcggaccgugccgggcgagcaggccagcuacgggaccuuccagcgcgucaaguaccacacgcucucccugggccggaagaagacccugcccgagagcuccuucuga

SEQ ID NO: 38520 - RNA, 2139 nt, Artificial Sequence
  derived and/or modified sequence opt1 from USP44__Homo_sapiens__NP_001265322
augcuggccauggacacgugcaagcacgugggccagcuccagcuggcccaggaccacagcucccugaacccccagaaguggcacugcgucgacugcaacaccaccgagagcaucugggcgugccucuccugcagccacguggccugcgggcgcuacaucgaggagcacgcccugaagcacuuccaggaguccagccaccccguggcccuggaggucaacgagauguacguguucugcuaccucugcgacgacuacgugcugaacgacaacaccaccggcgaccugaagcuccugcggcgcacccuguccgccaucaagagccagaacuaccacugcacgacccgguccgggcgcuuccuccggagcaugggcaccggggacgacuccuacuuccugcacgacggcgcgcagagccugcuccaguccgaggaccagcuguacaccgcccuguggcaccgccggcgcauccucaugggcaagaucuuccggacgugguucgagcagagccccaucgggcgcaagaagcaggaggagcccuuccaggagaagaucgucgugaagcgggaggugaagaagcgccggcaggagcuggaguaccaggucaaggccgagcuggaguccaugcccccgcgcaagagccuccggcugcagggccuggcccaguccaccaucaucgagaucgugagcgugcagguccccgcgcagacccccgccucccccgccaaggacaaggugcucagcaccagcgagaacgagaucucccagaaggugagcgacuccagcgucaagcgccggccgaucgugacgcccggggugaccggccugcgcaaccuggggaacacgugcuacaugaacuccguccuccaggugcugagccaccuccugaucuuccggcagugcuuccugaagcuggaccucaaccaguggcuggccaugaccgccuccgagaagacccgcagcugcaagcacccgcccgugaccgacaccgucguguaccagaugaacgagugccaggagaaggacaccggcuucgugugcucccggcagagcucccugagcuccggccucagcgggggcgcguccaaggggcgcaagauggagcugauccagcccaaggagcccacgagccaguacaucucccugugccacgagcuccacacccuguuccaggucauguggagcggcaagugggcccuggugucccccuucgccaugcuccacagcgucuggcgccugauccccgccuuccggggcuacgcccagcaggacgcgcaggaguuccugugcgagcuccuggacaagauccagcgcgagcuggagaccaccgggacgagccucccggcccugauccccaccucccagcggaagcugaucaagcagguccugaacguggugaacaacaucuuccacggccagcuccugagccaggugaccugccuggccugcgacaacaaguccaacaccaucgagcccuucugggaccucagccuggaguuccccgagcgcuaccagugcuccgggaaggacaucgccagccagccgugccuggugacggagaugcucgccaaguucaccgagaccgaggcgcuggagggcaagaucuacgucugcgaccagugcaacuccaagcggcgccgguucagcuccaagcccguggugcugaccgaggcccagaagcagcucaugaucugccaccucccccagguccugcgccugcaccugaagcgguuccgcuggagcgggcggaacaaccgcgagaagaucggcgugcacgugggcuucgaggagauccugaacauggagcccuacugcugccgggagacgcucaagucccugcgcccggagugcuucaucuacgaccugagcgccgucgugaugcaccacgggaagggcuucggguccggccacuacaccgccuacugcuacaacagcgagggcggguucugggugcacugcaacgacuccaagcucagcaugugcaccauggacgaggucugcaaggcccaggcguacauccuguucuacacccagcgggugacggagaacggccacuccaagcugcucccgcccgagcugcugcucgggagccagcaccccaacgaggacgccgacaccagcuccaacgagauccugagcuga

SEQ ID NO: 38521 - RNA, 1080 nt, Artificial Sequence
  derived and/or modified sequence opt1 from USP46__Homo_sapiens__NP_001127695
augaacugcuuccagggcaccaacgccagcgcccuggagaaggacaucgggcccgagcaguucccgaucaacgagcacuacuucggccucgugaacuucgggaacacgugcuacugcaacuccguccugcaggcgcuguacuucugccgccccuuccgggagaacgugcucgccuacaaggcccagcagaagaagaaggagaaccugcugaccugccucgccgaccuguuccacagcaucgccacccagaagaagaaggugggcgucaucccgcccaagaaguucaucucccgccugcggaaggagaacgaccucuucgacaacuacaugcagcaggacgcgcacgaguuccugaacuaccugcucaacaccaucgccgacauccugcaggaggagaagaagcaggagaagcagaacgggaagcugaagaacggcaacaugaacgagcccgccgagaacaacaagcccgagcucaccugggugcacgagaucuuccagggcacgcugaccaacgagacccgcugccugaacugcgagaccgugagcuccaaggacgaggacuuccucgaccugagcgucgacguggagcagaacacguccaucacccacugccugcgggacuucagcaacaccgagacccucugcuccgagcagaaguacuacugcgagacgugcugcagcaagcaggaggcccagaagcgcaugcgggugaagaagcugcccaugauccuggcgcuccaccugaagcgcuucaaguacauggagcagcugcaccgguacaccaagcucuccuaccgcgucguguucccccuggagcugcgccucuucaacaccagcuccgacgccgugaaccuggaccggauguacgaccuggucgccguggugguccacugcgggagcggcccgaaccgggggcacuacaucaccaucgugaagucccacggcuucuggcuccuguucgacgacgacaucguggagaagaucgacgcccaggccaucgaggaguucuacgggcugacgagcgacaucuccaagaacagcgaguccggcuacauccucuucuaccagagccgcgaguga

SEQ ID NO: 38522 - RNA, 3105 nt, Artificial Sequence
  derived and/or modified sequence opt1 from USP48__Homo_sapiens__XP_011540564
auggcgccccggcugcagcucgagaaggccgccuggcggugggccgagaccgugcgcccggaggaggugagccaggagcacaucgagaccgccuaccggaucuggcuggagcccugcauccgcggcgugugccggcgcaacugcaaggggaaccccaacugccuggugggcaucggggagcacaucuggcucggcgagaucgacgagaacuccuuccacaacaucgacgaccccaacugcgagcggcgcaagaagaacagcuucgucgggcugacgaaccugggcgcgaccugcuacgugaacaccuuccuccaggugugguuccugaaccuggagcuccggcaggcccuguaccugugcccguccacgugcagcgacuacaugcucggcgacgggauccaggaggagaaggacuacgagccccagaccaucugcgagcaccuccaguaccuguucgcccuccugcagaacuccaaccgccgguacaucgaccccagcggcuucgucaaggcccuggggcucgacaccggccagcagcaggacgcccaggaguucuccaagcuguucaugagccugcucgaggacacccuguccaagcagaagaaccccgacgugcgcaacaucgugcagcagcaguucugcggggaguacgccuacgucaccgugugcaaccagugcggccgggagagcaagcugcucuccaaguucuacgagcuggagcugaacauccagggccacaagcagcucacggacugcaucagcgaguuccugaaggaggagaagcuggagggggacaaccgcuacuucugcgagaacugccaguccaagcagaacgcgacccggaagauccgccuccugagccugccgugcacccucaaccugcagcugaugcgguucguguucgaccgccagaccggccacaagaagaagcucaacacguacaucggguucuccgagauccuggacauggagcccuacgucgagcacaagggcggcagcuacguguacgagcuguccgccgugcucauccaccgcggggucagcgccuacuccggccacuacaucgcccacgugaaggacccccagagcggggagugguacaaguucaacgacgaggacaucgagaagauggagggcaagaagcugcagcuggggaucgaggaggaccucgagcccagcaagucccagacccggaagccgaagugcggcaagggcacccacugcagccggaacgccuacaugcugguguaccgccugcagacccaggagaagcccaacacgaccguccaggugcccgcguuccuccaggagcugguggaccgcgacaacuccaaguucgaggaguggugcaucgagauggccgagaugcggaagcagagcgucgacaaggggaaggccaagcacgaggaggugaaggagcuguaccagcgccuccccgccggcgccgagccguacgaguucgugucccuggaguggcugcagaaguggcuggacgagagcacccccaccaagcccaucgacaaccacgcgugccucugcucccacgacaagcugcaccccgacaagaucagcaucaugaagcggaucuccgaguacgccgccgacaucuucuacagccgcuacgggggcgggccgcggcugacggucaaggcccucugcaaggagugcguggucgagcgcugccggauccugcgccugaagaaccagcucaacgaggacuacaagaccgugaacaaccugcugaaggccgcggugaagggcuccgacggcuucugggucggcaagagcucccuccggagcuggcgccagcuggcccuggagcagcucgacgagcaggacggggacgccgagcaguccaacgggaagaugaacggcagcacccugaacaaggacgaguccaaggaggagcggaaggaggaggaggagcugaacuucaacgaggacauccucugcccccacggggagcugugcaucagcgagaacgagcgccggcugguguccaaggaggccuggagcaagcuccagcaguacuuccccaaggcccccgaguucccgagcuacaaggagugcugcucccagugcaagauccuggagcgcgagggcgaggagaacgaggcgcugcacaagaugaucgccaacgagcagaagaccagccuccccaaccuguuccaggacaagaaccggcccugccuguccaacuggcccgaggacacggacgugcucuacaucgucagccaguucuucguggaggaguggcgcaaguucgugcggaagccgacccgcugcucccccgucagcuccgugggcaacagcgcccugcugugcccccacgggggccucauguucaccuucgccuccaugaccaaggaggacagcaagcugaucgcgcugaucuggccguccgaguggcagaugauccagaagcuguucguggucgaccacgugaucaagaucacgcggaucgaggugggggacgucaaccccagcgagacccaguacaucuccgagcccaagcugugccccgagugccgcgagggccugcucugccagcagcagcgcgaccugcgggaguacacccaggccaccaucuacgugcacaagguggucgacaacaagaaggugaugaaggacagcgccccggagcugaacguguccagcuccgagacggaggaggacaaggaggaggccaagcccgacggcgagaaggaccccgacuucaaccagagcaacgggggcaccaagcgccagaagaucagccaccagaacuacaucgccuaccagaagcaggucauccggcgcuccaugcggcaccgcaaggugcgcggggagaaggcgcuccuggugagcgccaaccagacccugaaggagcucaagauccagaucaugcacgccuucuccgucgcccccuucgaccagaaccugagcaucgacggcaagauccuguccgacgacugcgccacccucgggacgcugggcgugaucccggagagcgugauccugcucaaggcggacgagcccaucgccgacuacgccgccauggacgacgucaugcaggucugcaugcccgaggagggcuucaaggggaccggccugcuggggcacuga

SEQ ID NO: 38523 - RNA, 2067 nt, Artificial Sequence
  derived and/or modified sequence opt1 from USP49__Homo_sapiens__NP_001273483
auggaccgcugcaagcacgugggccggcugcgccuggcccaggaccacagcauccugaacccccagaaguggugcugccuggagugcgccaccaccgaguccgucugggcgugccucaagugcagccacguggccugcgggcgguacaucgaggaccacgcccugaagcacuucgaggagacgggccacccgcuggccauggaggugcgcgaccucuacgucuucugcuaccugugcaaggacuacgugcugaacgacaaccccgagggggaccucaagcugcugcgguccagccuccuggccgugcgcggccagaagcaggacacccccguccggcgcgggcggacccugcgcuccauggcgagcggcgaggacguggugcucccccagcgggccccgcagggccagccccagaugcugaccgcccugugguaccgccggcagcgccuccuggcccggacgcugcgccucugguucgagaaguccagccgggggcaggcgaagcuggagcagcgccggcaggaggaggcccuggagcgcaagaaggaggaggcccggcgccgccggcgcgaggucaagcggcgccuccuggaggagcuggccuccaccccgccccgcaagagcgcccggcuccugcugcacacgccccgggacgcgggccccgccgccucccgccccgccgcccuccccaccagccggcgcgugccggcggccacccugaagcugcggcgccagcccgccauggcccccggggugaccggccuccggaaccuggggaacacgugcuacaugaacuccauccugcagguccucagccaccuccagaaguuccgcgagugcuuccugaaccuggaccccuccaagaccgagcaccuguucccgaaggccacgaacggcaagacccagcugagcggcaagcccaccaacuccagcgcgaccgagcucucccugcggaacgaccgcgccgaggccugcgagcgggagggguucugcuggaacggccgcgccagcaucagccggucccuggagcucauccagaacaaggagcccagcuccaagcacaucagccugugccgcgagcugcacacccucuuccgcgugaugugguccgggaagugggcccuggugagccccuucgcgaugcugcacuccgucuggagccugaucccggccuuccggggcuacgaccagcaggacgcccaggaguuccucugcgagcugcugcacaaggugcagcaggagcucgaguccgagggcaccacccgccggauccugauccccuucagccagcgcaagcugaccaagcagguccucaagguggugaacacgaucuuccacgggcagcugcugucccaggugaccugcaucagcugcaacuacaaguccaacaccaucgagcccuucugggaccucagccuggaguuccccgagcgguaccacugcaucgagaagggcuucgucccgcugaaccagaccgagugccuccugacggagaugcuggccaaguucaccgagaccgaggcgcucgaggggcgcaucuacgccugcgaccagugcaacuccaagcggcgcaagagcaaccccaagccccuggugcuguccgaggcccggaagcagcucaugaucuaccgccugccccaggugcugcggcuccaccugaagcgcuuccgguggagcggccgcaaccaccgggagaagaucgggguccacguggucuucgaccaggugcugaccauggagccguacugcugccgcgacaugcucuccagccuggacaaggagacguucgccuacgaccugagcgccguggucaugcaccacggcaagggcuucggguccggccacuacaccgcguacugcuacaacaccgagggcggguucugggugcacugcaacgacagcaagcucaacgugugcuccgucgaggaggugugcaagacccaggccuacauccuguucuacacgcagcggaccgugcaggggaacgcccgcaucagcgagacccaccuccaggcccagguccaguccagcaacaacgacgagggccggccccagaccuucuccuga

SEQ ID NO: 38524 - RNA, 942 nt, Artificial Sequence
  derived and/or modified sequence opt1 from USP4__Homo_sapiens__NP_001238806
auggccgagggcgggggcugccgcgagcggcccgacgccgagacccagaaguccgagcuggggccgcucaugcgcaccacgcugcagcggggcgcgcagugguaccugaucgacagccgcugguucaagcaguggaagaaguacgugggguucgacagcugggacauguacaacgucggcgagcacaaccucuuccccggccccaucgacaacuccgggcuguucagcgaccccgagucccagacccugaaggagcaccucaucgacgagcuggacuacgugcuggugccgaccgaggccuggaacaagcuccugaacugguacggcugcgucgaggggcagcagcccaucgugcggaagguggucgagcacggccuguucgugaagcacugcaagguggaggucuaccuccuggagcugaagcucugcgagaacagcgaccccaccaacgugcuguccugccacuucagcaaggccgacacgaucgccaccaucgagaaggagaugcgcaagcuguucaacauccccgccgagcgggagacccgccucuggaacaaguacauguccaacaccuacgagcagcugagcaagcuggacaacacggugcaggacgcggggcucuaccagggccagguccuggugaucgagccgcagaacgaggacggcaccuggccccggcagacccugcaguccaaggugagcuucuuccucccccgccuggagugcaacggggccauccuggcccacugcaacuucugccuccccggcuccagcaacuccccggccagcgcgucccgggucgcccccagccaccuggccaacuucuucuucuucgagauggagucccacagcgugaccaagcuggagugcgggggcgccgugagcgccuacucccgcguccaggugaugcuccugccccagcccccggaguggcugggcuga

SEQ ID NO: 38525 - RNA, 2577 nt, Artificial Sequence
  derived and/or modified sequence opt1 from USP5__Homo_sapiens__NP_001092006
auggccgagcugagcgaggaggcccuccuguccgugcugcccaccauccgcguccccaaggcgggcgaccgggugcacaaggacgagugcgccuucagcuucgacacccccgaguccgagggcgggcucuacaucugcaugaacacguuccugggguucggcaagcaguacguggagcgccacuucaacaagaccgggcagcgggucuaccugcaccuccgccggacccgccggcccaaggaggaggaccccgccaccggcacgggcgacccgccccgcaagaagcccacccggcuggccaucgggguggagggcggguucgaccugagcgaggagaaguucgagcucgacgaggacgugaagaucgucauccugcccgacuaccuggagaucgcccgcgacggccucgggggccugccggacaucgugcgggaccgcgugaccuccgcggucgaggcccugcucagcgccgacuccgccagccggaagcaggaggugcaggcgugggacggcgaggugcgccaggucuccaagcacgccuucagccugaagcagcuggacaaccccgcccggaucccgcccugcggguggaagugcuccaagugcgacaugcgcgagaaccucuggcugaaccugaccgacggcagcauccucugcgggcggcgcuacuucgacggcuccggcgggaacaaccacgccguggagcacuaccgggagacgggcuacccccuggccgugaagcuggggaccaucacccccgacggcgcggacgucuacagcuacgacgaggacgacauggugcucgaccccucccuggccgagcaccugagccacuucgggaucgacaugcucaagaugcagaagaccgacaagacgaugaccgagcuggagaucgacaugaaccagcgcaucggcgagugggagcugauccaggaguccggcgugccccucaagccgcuguucgggcccggcuacaccgggauccggaaccugggcaacagcugcuaccucaacuccgucguccaggugcuguucagcauccccgacuuccagcgcaaguacguggacaagcuggagaagaucuuccagaacgcccccaccgacccgacgcaggacuucagcacccagguggccaagcucgggcacggccugcuguccggcgaguacagcaagcccgugcccgaguccggggacggcgagcgcguccccgagcagaaggaggugcaggacgggaucgccccgcggauguucaaggcgcucaucggcaaggggcaccccgaguucagcaccaaccgccagcaggacgcccaggaguucuuccugcaccugaucaacauggucgagcggaacugccgcuccagcgagaaccccaacgagguguuccgguuccucguggaggagaagaucaagugccuggccaccgagaaggucaaguacacgcagcgcguggacuacaucaugcagcugcccgugccgauggacgccgcccucaacaaggaggagcugcuggaguacgaggagaagaagcggcaggcggaggaggagaagauggcccuccccgagcugguccgcgcccaggugcccuucuccagcugccuggaggccuacggcgccccggagcaggucgacgacuucugguccaccgcgcugcaggccaagagcguggccgugaagaccacccgguucgccuccuuccccgacuaccucgugauccagaucaagaaguucacguucggccuggacuggguccccaagaagcuggacgugagcaucgagaugcccgaggagcucgacaucucccagcugcgcgggaccggccugcagccgggggaggaggagcuccccgacaucgcgccgccccuggugacccccgacgagcccaagggcagccugggcuucuacgggaacgaggacgaggacuccuucugcagcccccacuucuccagccccaccuccccgaugcucgacgagagcgucaucauccagcugguggagaugggcuuccccauggacgccugccggaaggccguguacuacacggggaacagcggcgccgaggccgcgaugaacugggucaugucccacauggacgaccccgacuucgccaacccccugauccucccggggagcuccggccccggcagcaccuccgccgccgccgacccgccgcccgaggacugcgugaccaccaucgugagcaugggguucucccgcgaccaggcgcugaaggcccugcgggccacgaacaacagccucgagcgcgccgucgacuggaucuucucccacaucgacgaccuggacgccgaggcggccauggacaucagcgagggccgguccgccgccgacagcaucuccgagagcgugcccguggggcccaagguccgcgacggccccgggaaguaccagcuguucgcguucaucucccacaugggcaccagcaccaugugcggccacuacgugugccacaucaagaaggaggggcggugggugaucuacaacgaccagaaggucugcgccuccgagaagccgcccaaggaccucggcuacaucuacuucuaccagcgcguggccagcuga

SEQ ID NO: 38526 - RNA, 4221 nt, Artificial Sequence
  derived and/or modified sequence opt1 from USP6__Homo_sapiens__NP_001291213
auggacaugguggagaacgccgacagccugcaggcccaggagcgcaaggacauccucaugaaguacgacaagggccaccgggcggggcugcccgaggacaagggcccggagcccgucgggaucaacuccagcaucgaccgcuucggcauccugcacgagaccgagcucccgcccgugaccgcccgggaggccaagaagauccgccgggagaugacgcgcaccuccaaguggauggagaugcugggggagugggagaccuacaagcacagcuccaagcugaucgaccggguguacaagggcaucccgaugaacauccgcggccccgucuggagcgugcuccugaacauccaggagaucaagcugaagaaccccgggcgguaccagaucaugaaggagcgcggcaagcgguccagcgagcacauccaccacaucgaccucgacgugcgcaccacgcugcggaaccacgucuucuuccgcgaccgguacggggccaagcagcgcgagcuguucuacauccuccuggccuacuccgaguacaaccccgaggugggcuacugccgggaccugagccacaucaccgcccucuuccugcuguaccucccggaggaggacgccuucugggcccuggugcagcugcucgccuccgagcgccacagccugcccggguuccacucccccaacggcggcaccguccaggggcugcaggaccagcaggagcacguggugcccaagagccagccgaagaccauguggcaccaggacaaggagggccucugcgggcagugcgcgucccugggcugccugcuccggaaccugaucgacggcaucagccuggggcucacgcugcgccugugggacgucuaccucguggagggcgagcagguccugaugcccaucaccuccaucgcccugaagguccagcagaagcggcucaugaagaccagccgcugcgggcugugggcccgccugcggaaccaguucuucgacaccugggccaugaacgacgacacggugcucaagcaccuccgcgccuccaccaagaagcugacccggaagcagggcgaccugcccccgcccgcgaagcgcgagcaggggagccucgcgccccggcccgugcccgccagccgcggcggcaagacccugugcaagggguaccggcaggccccgcccggcccgcccgcccaguuccagcgccccaucugcuccgccagcccgcccugggccucccgguucagcacgcccugccccgggggcgccguccgcgaggacaccuaccccguggggacccagggcgugcccucccucgcccuggcccagggcgggccccagggcagcuggcgguuccuggaguggaaguccaugccccgccuccccaccgaccuggacaucgggggccccugguucccgcacuacgacuucgaguggagcugcugggugcgggcgaucucccaggaggaccagcuggcgacgugcuggcaggccgagcacugcggggaggugcacaacaaggacaugagcuggcccgaggagauguccuucaccgccaacagcuccaagaucgaccgccagaaggugcccaccgagaagggcgccaccggccugagcaaccuggggaacacgugcuucaugaacuccagcauccagugcgucuccaacacccagccccugacccaguacuucaucagcggccggcaccuguacgagcucaaccgcaccaacccgaucgggaugaagggccacauggcgaagugcuacggcgaccuggugcaggagcugugguccgggacgcagaaguccgucgcgccccucaagcugcggcgcaccaucgccaaguacgcccccaaguucgacggcuuccagcagcaggacagccaggagcugcucgccuuccugcuggacgggcuccacgaggaccugaaccgggugcacgagaagcccuacguggagcugaaggacagcgacggccgcccggacugggaggucgccgccgaggccugggacaaccaccuccgccggaaccgcagcaucaucguggaccuguuccacgggcagcugcggucccaggugaagugcaagaccugcggccacaucagcguccgcuucgaccccuucaacuuccucucccugccccugcccauggacagcuacauggaccucgagaucaccgugaucaagcuggacggcacgaccccggugcgguacgggcugcgccucaacauggacgagaaguacaccggccugaagaagcagcugcgggaccucugcgggcugaacuccgagcagauccugcucgccgagguccacgacagcaacaucaagaacuucccccaggacaaccagaaggugcagcuguccgugagcggcuuccugugcgcguucgagauccccguccccuccagcccgaucuccgccagcucccccacccagaucgacuucagcuccagccccagcacgaacgggauguucacccucaccaccaacggcgaccugcccaagccgaucuucauccccaacggcaugcccaacaccguggugccgugcgggacggagaagaacuucaccaacggcauggucaacgggcacaugcccucccugcccgacagccccuucaccggcuacaucaucgccgugcaccgcaagaugaugcggaccgagcucuacuuccuguccccgcaggagaaccgccccagccuguucgggaugccccucaucgugcccugcacgguccacacccggaagaaggaccuguacgacgccguguggauccagguguccuggcuggcccgcccgcucccgccccaggaggcgagcauccacgcccaggaccgggacaacugcaugggcuaccaguaccccuucacccugcgcgucgugcagaaggacggcaacuccugcgccuggugcccccaguaccgguucugccgcgggugcaagaucgacugcggcgaggaccgggccuucaucgggaacgccuacaucgcgguggacuggcaccccaccgcccugcaccuccgcuaccagacgagccaggagcgggucguggacaagcacgaguccguggagcagagccgccgggcccaggccgagcccaucaaccuggacuccugccugcgcgcguucaccagcgaggaggagcucggcgaguccgagauguacuacugcagcaagugcaagacccacugccuggccaccaagaagcuggaccucuggcgccugcccccguuccugaucauccaccucaagcgguuccaguucgucaacgaccaguggaucaagucccagaagaucgugcgcuuccugcgggagagcuucgaccccuccgccuuccuggugccccgcgaccccgcccucugccagcacaagccgcugacgccccagggggacgagcugagcaagccccggauccucgcccgcgaggucaagaagguggacgcgcaguccagcgccggcaaggaggacaugcugcugagcaagucccccagcucccucagcgccaacaucuccagcuccccgaagggcagccccuccagcucccgcaagagcgggaccuccugccccagcuccaagaacagcucccccaacagcuccccgcggacccugggccggagcaaggggcgccugcggcucccccagaucggcagcaagaacaagcccuccagcuccaagaagaaccuggacgccagcaaggagaacggcgccgggcagaucugcgagcuggcggacgcccucucccgcggccacaugcgcgggggcagccagccggagcuggugacgccccaggaccacgaggucgcccuggccaacggguuccucuacgagcacgaggccugcggcaacggcugcggggacggcuacuccaacgggcagcugggcaaccacagcgaggaggacuccaccgacgaccagcgggaggacacccacaucaagcccaucuacaaccuguacgcgaucagcugccacuccgggauccucagcggcggccacuacaucaccuacgccaagaaccccaacugcaagugguacugcuacaacgacuccagcugcgaggagcugcacccggacgagaucgacaccgacuccgccuacauccuguucuacgagcagcaggggaucgacuacgcccaguuccuccccaagaucgacggcaagaagauggcggacacgagcuccaccgacgaggacagcgaguccgacuacgagaaguacagcaugcugcaguga

SEQ ID NO: 38527 - RNA, 2538 nt, Artificial Sequence
  derived and/or modified sequence opt1 from USP6NL__Homo_sapiens__NP_001073960
augcgcaccgaggccguggucaacagccagggccagaccgacuaccugacgaaggacuccgaccaggacguggcccucaagcuggcgcaggagcgggccgagaucguggccaaguacgaccgcgggcgggagggcgccgagaucgagcccugggaggacgccgacuaccuggucuacaaggugaccgaccgcuucggguuccuccacgaggaggagcugccggaccacaacguggcggucgagcggcagaagcaccuggagaucgagcgcaccaccaaguggcucaagaugcugaagggcugggagaaguacaagaacacggagaaguuccaccggcgcaucuacaaggggaucccccugcagcuccggggcgaggugugggcccugcugcucgagauccccaagaugaaggaggagacccgcgaccuguacagcaagcugaagcaccgggcccgcggcugcucccccgacauccggcagaucgaccucgacgugaaccgcaccuuccgggaccacaucauguuccgcgaccgguacggggucaagcagcagagccuguuccacgugcuggccgcguacuccaucuacaacaccgaggugggcuacugccaggggaugagccagaucacggcccuccugcugauguacaugaacgaggaggacgccuucugggcccucgucaagcuguucuccggcccgaagcacgccaugcacggguucuucgugcagggcuuccccaagcugcuccgcuuccaggagcaccacgagaagauccugaacaaguuccugagcaagcucaagcagcaccuggacucccaggagaucuacaccagcuucuacaccaugaagugguucuuccagugcuuccuggaccggacccccuucacgcucaaccugcgcaucugggacaucuacaucuucgagggcgagcgggugcugaccgcgauguccuacaccauccucaagcugcacaagaagcaccugaugaagcucagcauggaggagcuggucgaguucuuccaggagacccuggccaaggacuucuucuucgaggacgacuucgugaucgagcagcuccagaucuccaugacggagcugaagcgcgccaagcuggaccuccccgagccggggaaggaggacgaguaccccaagaagccccugggccagcugcccccggagcuccagagcuggggggugcaccaccuguccaacggccagcgcagcgucggccggcccuccccccuggccagcgggcgccgggaguccggcgccccccaccgccggcacgagcacagcccgcacccccagagccgcaccgggacccccgagcgggcgcagcccccgcgccggaaguccguggaggaggagagcaagaagcucaaggacgaggccgacuuccagcgcaagcugcccuccggcccccaggacagcucccggcaguacaaccacgccgccgccaaccagaacagcaacgcgaccuccaacauccgcaaggaguucgugcccaaguggaacaagccgagcgacgucuccgccacggagcggaccgccaaguacaccauggaggggaagggccgcgccgcccaccccgcgcuggccgugaccgugcccggccccgccgagguccgggugagcaacguccgcccgaagaugaaggcccuggacgcggaggacgggaagcggggcuccacggccagccaguacgacaacgugcccgggcccgagcucgacuccggcgccagcguggaggaggcccuggagcgcgccuacucccagagcccgcggcacgcgcuguacccccccuccccccgcaagcacgccgagccgagcuccagccccagcaaggucuccaacaaguucaccuucaaggugcagccccccagccacgcccgcuacccgucccagcucgacggggaggcccggggccuggcccacccccccagcuacuccaaccccccgguguaccacggcaacagccccaagcacuuccccaccgcgaacuccagcuucgccuccccccaguucagcccggggacccagcugaaccccucccgccggccccacggcagcacgcucuccgucagcgccucccccgagaagagcuacucccgcccgagcccccuggugcugcccagcucccggaucgaggugcuccccgucgacaccggggccggcggguacagcggcaacuccggcagcccgaagaacgggaagcugaucaucccccccguggacuaccugccggacaaccgcaccugguccgaggugagcuacaccuaccggcccgagacgcagggccaguccuggacccgcgacgccagccgggggaaccuccccaaguacuccgcguuccagcuggcccccuuccaggaccacggccugccggccgucagcguggacucccccgugcgcuacaaggccagccccgcggccgaggacgccucccccagcggcuacccguacuccgggcccccccccccggccuaccacuaccggaaccgcgacggccucagcauccaggaguccguccugcuguga

SEQ ID NO: 38528 - RNA, 3261 nt, Artificial Sequence
  derived and/or modified sequence opt1 from USP7__Homo_sapiens__NP_001273386
auggccggcaaccaccgccuggggcucgaggccggcgacaccgacgacccgccccggaucacccagaaccccgugaucaacgggaacgucgcgcugagcgacggccacaacacggccgaggaggacauggaggacgacaccuccuggcgcagcgaggccaccuuccaguucaccguggagcgguucucccgccugagcgaguccgugcucagcccgcccugcuucguccggaaccugcccuggaagaucauggugaugccccgcuucuaccccgaccggccccaccagaaguccgugggguucuuccugcagugcaacgccgagagcgacuccacgagcugguccugccacgcccaggcgguccucaagaucaucaacuaccgcgacgacgagaaguccuucagccggcgcaucagccaccuguucuuccacaaggagaacgacuggggcuucuccaacuucauggccuggagcgaggugaccgacccggagaagggcuucaucgacgacgacaaggugaccuucgaggucuucgugcaggccgacgcgccccacgggguggccugggacuccaagaagcacaccggcuacgucgggcugaagaaccagggcgccacgugcuacaugaacagccuccugcagacccuguucuucaccaaccagcuccggaaggccguguacaugaugcccaccgagggggacgacuccagcaagagcgugccccuggcccugcagcgcgucuucuacgagcuccagcacuccgacaagccggugggcacgaagaagcugaccaagagcuucggcugggagacccuggacuccuucaugcagcacgacgugcaggagcucugccggguccugcuggacaacguggagaacaagaugaaggggaccugcguggagggcacgauccccaagcuguuccgcgggaagauggucagcuacauccagugcaaggagguggacuaccgguccgaccgccgggaggacuacuacgacauccagcugagcaucaagggcaagaagaacaucuucgaguccuucguggacuacgucgccgugggccagcuggacggggacaacaaguacgacgcgggcgagcacgggcuccaggaggccgagaagggcgucaaguuccugacccugccgcccgugcuccaccuccagcugaugcgcuucauguacgacccccagaccgaccagaacaucaagaucaacgaccgguucgaguuccccgagcagcucccccuggacgaguuccugcagaagaccgaccccaaggacccggccaacuacauccuccacgccgugcugguccacagcggggacaaccacggcggccacuacgugguguaccugaaccccaagggggacggcaaguggugcaaguucgacgacgacgucgugucccgcugcacgaaggaggaggccaucgagcacaacuacgggggccacgacgacgaccucagcgugcggcacugcaccaacgcguacaugcuggucuacauccgcgaguccaagcugagcgaggugcuccaggccgugaccgaccacgacaucccccagcagcuggucgagcgccugcaggaggagaagcggaucgaggcccagaagcgcaaggagcggcaggaggcccaccucuacaugcagguccagaucguggccgaggaccaguucugcgggcaccagggcaacgacauguacgacgaggagaaggugaaguacaccguguucaaggugcugaagaacuccagccuggcggaguucguccagucccucagccagacgaugggcuucccccaggaccagauccgccuguggccgaugcaggcccgguccaacgggaccaagcgccccgccaugcuggacaacgaggccgacggcaacaagaccaugaucgagcucagcgacaacgagaaccccuggaccaucuuccuggagacgguggaccccgagcuggccgcguccggggccacccugccgaaguucgacaaggaccacgacgugaugcuguuccucaagauguacgaccccaagacccggagccugaacuacugcggccacaucuacacccccaucagcugcaagauccgcgaccuccugccggucaugugcgaccgggccggguucauccaggacacgucccugauccucuacgaggaggugaagcccaaccugaccgagcgcauccaggacuacgacgugagccuggacaaggcccucgacgagcugauggacggcgacaucaucgucuuccagaaggacgaccccgagaacgacaacuccgagcugcccaccgcgaaggaguacuuccgggaccucuaccaccgcguggacgugaucuucugcgacaagaccaucccgaacgaccccggcuucgucgugacgcugagcaaccggaugaacuacuuccagguggccaagaccgucgcccagcgccugaacaccgaccccaugcuccugcaguucuucaagucccagggguaccgggacggccccgggaacccgcugcgccacaacuacgagggcacccuccgggaccugcugcaguucuucaagccccgccagcccaagaagcucuacuaccagcagcugaagaugaagaucaccgacuucgagaaccggcgcagcuucaagugcaucuggcugaacucccaguuccgcgaggaggagaucacgcucuaccccgacaagcacggcugcgugcgggaccugcuggaggagugcaagaaggccguggagcucggggagaaggccagcggcaagcugcgccugcucgagaucgucuccuacaagaucaucggggugcaccaggaggacgagcugcuggagugccucagcccggcgaccucccggaccuuccgcaucgaggagaucccccuggaccagguggacaucgacaaggagaacgagaugcuggucaccguggcccacuuccacaaggagguguucggcacguucgggauccccuuccuccugcggauccaccagggcgagcacuuccgcgaggucaugaagcggauccagagccugcucgacauccaggagaaggaguucgagaaguucaaguucgccaucgugaugaugggccgccaccaguacaucaacgaggacgaguacgaggugaaccugaaggacuucgagccccagccggggaacaugucccacccccggcccuggcugggccucgaccacuucaacaaggcccccaagcgcagccgguacaccuaccuggagaaggccaucaagauccacaacuga

SEQ ID NO: 38529 - RNA, 3357 nt, Artificial Sequence
  derived and/or modified sequence opt1 from USP8__Homo_sapiens__NP_001122082
augcccgccguggccagcgucccgaaggagcuguaccucuccagcucccugaaggaccugaacaagaagaccgaggugaagcccgagaagaucagcaccaaguccuacgugcacagcgcgcucaagaucuucaagacggccgaggagugccgccuggaccgggacgaggagcgcgccuacguccuguacaugaaguacgugaccguguacaaccucaucaagaagcggcccgacuucaagcagcagcaggacuacuuccacuccauccugggccccgggaacaucaagaaggccgucgaggaggccgagcgccugagcgagucccucaagcugcgguacgaggaggcggaggugcgcaagaagcuggaggagaaggaccggcaggaggaggcccagcgccuccagcagaagcggcaggagaccggccgcgaggacgggggcacccuggccaaggggagccuggagaacgugcucgacuccaaggacaagacgcagaaguccaacggcgagaagaacgagaagugcgagaccaaggagaagggcgccaucaccgcgaaggagcuguacaccaugaugacggacaagaacaucucccugaucaucauggacgcccggcgcaugcaggacuaccaggacagcugcauccuccacucccugagcgucccggaggaggccaucucccccggggugaccgccagcuggaucgaggcccaccuccccgacgacuccaaggacaccuggaagaagcggggcaacguggaguacgucgugcuccuggacugguucagcagcgcgaaggaccugcagaucgggaccacgcuccgcucccugaaggacgcccuguucaagugggagagcaagaccgugcuccggaacgagccccugguccuggagggcggguacgagaacuggcuccugugcuacccgcaguacaccaccaacgccaaggugacgcccccgccccgccggcagaacgaggagguguccaucagccuggacuucaccuaccccucccucgaggagagcauccccuccaagcccgccgcccagacgcccccggcgagcaucgaggucgacgagaacaucgagcugaucuccggccagaacgagcgcaugggcccccugaacaucagcacccccguggagcccguggccgccagcaagagcgacgucuccccgaucauccagcccgugcccagcaucaagaacgugccccagaucgaccggaccaagaagccggccgucaagcugcccgaggagcaccgcaucaaguccgagagcaccaaccacgagcagcagagcccccaguccgggaaggugauccccgaccgguccaccaagccggucguguucagccccacccugaugcugacggacgaggagaaggcccgcauccacgcggagaccgcccuccugauggagaagaacaagcaggagaaggagcugcgcgagcggcagcaggaggagcagaaggagaagcuccgcaaggaggagcaggagcagaaggccaagaagaagcaggaggccgaggagaacgagaucaccgagaagcagcagaaggccaaggaggagauggagaagaaggagagcgagcaggcgaagaaggaggacaaggagaccuccgccaagcggggcaaggagaucacgggggugaagcgccagagcaaguccgagcacgagaccagcgacgccaagaaguccgucgaggaccggggcaagcgcugccccaccccggagauccagaagaaguccaccggcgacgugccccacacgagcgugaccggggacagcggcuccgggaagcccuucaagaucaagggccagcccgagagcgggauccugcggaccggcaccuuccgcgaggacacggacgacaccgagcggaacaaggcccagcgcgagccgcugacccgggcgcgcuccgaggagaugggccggaucguccccgggcuccccagcggcugggccaaguuccuggaccccaucaccgggaccuuccgcuacuaccacuccccgacgaacaccgugcacauguacccgcccgagauggcccccagcuccgccccgcccagcaccccgcccacccacaaggccaagccccagauccccgcggagcgggaccgcgagcccuccaagcugaagcggagcuacagcucccccgacaucacgcaggccauccaggaggaggagaagcgcaagcccaccgugacccccaccgucaaccgggagaacaagcccacgugcuaccccaaggccgagaucagccgccucuccgccagccagauccgcaaccugaacccgguguucggcggguccggccccgcccugaccggccugcggaaccucgggaacacgugcuacaugaacagcauccugcagugccugugcaacgcgccccaccucgccgacuacuucaaccgcaacugcuaccaggacgacaucaaccgguccaaccugcugggccacaagggggagguggccgaggaguucggcaucaucaugaaggcccucuggaccgggcaguaccgcuacaucagcccgaaggacuucaagaucaccaucggcaagaucaacgaccaguucgccggcuacucccagcaggacagccaggagcugcuccuguuccugauggacgggcugcacgaggaccucaacaaggcggacaaccggaagcgcuacaaggaggagaacaacgaccaccuggacgacuucaaggccgccgagcacgccuggcagaagcacaagcagcugaacgaguccaucaucgucgcccucuuccagggccaguucaagagcaccgugcagugccugaccugccacaagaagucccggaccuucgaggcguucauguaccugagccucccccuggccuccacgagcaagugcacccugcaggacugccuccgccuguucuccaaggaggagaagcugaccgacaacaaccgguucuacugcagccacugccgcgcccggcgcgacucccucaagaagaucgagaucuggaagcugccgcccgugcugcucguccaccugaagcgguucagcuacgacgggcgcuggaagcagaagcugcagaccagcguggacuucccccucgagaaccuggaccugucccaguacgugaucggccccaagaacaaccucaagaaguacaaccuguucagcgucuccaaccacuacggcgggcuggacggcgggcacuacacggccuacugcaagaacgcggcccggcagcgcugguucaaguucgacgaccacgaggugagcgacaucuccgugagcuccgucaagagcuccgccgccuacauccucuucuacaccagccugggcccccgggugaccgacguggccaccuga

SEQ ID NO: 38530 - RNA, 7713 nt, Artificial Sequence
  derived and/or modified sequence opt1 from USP9X__Homo_sapiens__NP_001034679
augaccgccaccacccgcggcagccccgucgggggcaacgacaaccaggggcaggcccccgacggccagucccagccgccccugcagcagaaccagaccagcucccccgacagcagcaacgagaacagccccgccacgccgcccgacgagcaggggcagggcgacgcgccgccccagcucgaggacgaggagcccgccuucccccacaccgaccuggccaagcuggacgacaugaucaaccggccccgcuggguggugcccgugcugcccaagggcgagcuggaggugcugcuggaggccgccaucgaccugagcaagaaggggcuggacgucaagagcgaggccugccagcgguucuuccgcgacggccucaccaucuccuucaccaagauccugaccgacgaggccgugagcggguggaaguucgagauccaccggugcaucaucaacaacacccaccgccugguggagcucugcguggccaagcugucccaggacugguucccccugcucgagcugcuggcgauggcccucaacccccacugcaaguuccacaucuacaacggcacgcggcccugcgagagcguguccagcuccgugcagcugcccgaggacgagcuguucgcccgcagccccgacccccggucccccaagggguggcucguggaccugcugaacaaguucggcacccucaacggcuuccagauccugcacgaccgcuucaucaacgggagcgcccugaacgugcagaucaucgccgcgcucaucaagcccuucggccagugcuacgaguuccugacccugcacaccgucaagaaguacuuccuccccaucaucgagauggugccccaguuccuggagaaccugacggacgaggagcucaagaaggaggccaagaacgaggccaagaacgacgcccuguccaugaucaucaagagccugaagaaccucgccagccgggugcccgggcaggaggagaccgucaagaaccuggagaucuuccgccugaagaugauccuccggcugcugcagaucuccagcuucaacggcaagaugaacgcgcucaacgaggugaacaaggugaucuccagcgucuccuacuacacccaccgccacggcaaccccgaggaggaggaguggcugaccgccgagcggauggccgaguggauccagcagaacaacauccugagcaucgugcuccgcgacucccugcaccagccccaguacguggagaagcuggagaagauccuccgguucgucaucaaggagaaggcccugacgcugcaggaccuggacaacaucugggccgcgcaggccgggaagcacgaggccaucgugaagaacgugcacgaccuccuggccaagcuggccugggacuucagccccgagcagcucgaccaccuguucgacugcuucaaggcguccuggaccaacgccagcaagaagcagcgcgagaagcugcucgagcugauccggcgccuggccgaggacgacaaggacggcgucauggcccacaaggugcucaaccugcuguggaaccucgcgcacuccgacgacguccccguggacaucauggaccuggcccugagcgcccacaucaagauccucgacuacuccugcagccaggaccgggacacccagaagauccaguggaucgaccgcuucaucgaggagcugcgcaccaacgacaagugggugauccccgcccugaagcagauccgggagaucugcucccucuucggggaggcgccccagaaccugagccagacgcagcgcagcccccacgucuucuaccggcacgaccugaucaaccagcuccagcacaaccacgcgcuggugacccugguggccgagaaccucgccaccuacauggagagcaugcgccuguacgcccgggaccacgaggacuacgacccccagaccguccgccugggcucccgguacagccacgugcaggaggugcaggagcgccucaacuuccugcgguuccugcucaaggacgggcagcuguggcugugcgcgccccaggcgaagcagaucuggaagugccucgccgagaacgccgucuaccugugcgaccgcgaggccugcuucaagugguacagcaagcugaugggcgacgagcccgaccucgaccccgacaucaacaaggacuucuucgaguccaacgugcugcagcuggaccccagccuccugacggagaacggcaugaagugcuucgagcgguucuucaaggccgugaacugccgcgaggggaagcuggucgcgaagcggcgcgccuacaugauggacgaccucgagcugaucggccuggacuaccucuggcggguggugauccaguccaacgacgacaucgccagccgcgccaucgaccugcugaaggagaucuacaccaaccucgggccccggcugcaggucaaccagguggugauccacgaggacuucauccaguccugcuucgaccgccugaaggcgagcuacgacacccucugcguccuggacggcgacaaggacuccgugaacugcgcccggcaggaggccgugcgcaugguccgcgugcugaccgugcuccgggaguacaucaacgagugcgacuccgacuaccacgaggagcgcacgauccugcccaugucccgggccuuccgcgggaagcaccugagcuucgucgugcgguuccccaaccagggccgccagguggacgaccucgaggucuggucccacaccaacgacaccaucggcagcgugcggcgcugcauccugaaccggaucaaggccaacguggcgcacaccaagaucgagcuguucgucgggggcgagcucaucgaccccgccgacgaccgcaagcugaucgggcagcugaaccucaaggacaagucccugaucacggccaagcugacccagaucagcuccaacaugcccagcucccccgacagcagcuccgacagcuccaccggcagcccggggaaccacggcaaccacuacuccgacggccccaaccccgagguggagagcugccuccccggggugaucaugucccugcacccgcgguacaucagcuuccuguggcaggucgccgaccucggcuccagccugaacaugccgccccugcgcgacggggcccgggugcucaugaagcugaugcccccggacuccaccacgaucgagaagcugcgcgcgaucugccucgaccacgccaagcugggcgagagcucccugagccccucccucgacagccuguucuucggccccuccgccagccaggugcuguaccucaccgaggucguguacgcccugcugaugcccgccggggcgccgcucgccgacgacuccagcgacuuccaguuccacuuccugaaguccggcgggcugccccucgugcuguccaugcugacccggaacaacuuccuccccaacgccgacauggagacccgccggggcgccuaccugaacgcgcugaagaucgccaagcuccugcugaccgccaucggguacggccacguccgcgccguggccgaggcgugccagccgggcguggagggggucaaccccaugacgcagaucaaccaggugacccacgaccaggccgugguccugcagagcgcccuccaguccauccccaaccccagcuccgagugcaugcugcggaacgugagcgugcgccuggcccagcagaucuccgacgaggccagccgguacaugccggacaucugcgucauccgcgcgauccagaagaucaucugggccuccggcugcgggagccuccagcugguguucucccccaacgaggagaucaccaagaucuacgagaagaccaacgccggcaacgagcccgaccuggaggacgagcaggucugcugcgaggcccucgaggucaugacgcugugcuucgcccugauccccaccgcgcucgacgcccugagcaaggagaaggccuggcagaccuucaucaucgaccugcuccugcacugccacuccaagaccgugcgccaggucgcccaggagcaguucuuccugaugugcacgcggugcugcauggggcaccgcccgcuccuguucuucaucacccugcuguucaccgugcugggcagcaccgcccgggagcgcgcgaagcacuccggcgacuacuucacgcugcuccggcaccuccugaacuacgccuacaacagcaacaucaacgugcccaacgccgagguccuccugaacaacgagaucgacuggcugaagcgcauccgggacgacgugaagcgcaccggggagaccggcaucgaggagaccauccucgaggggcaccugggcgugacgaaggagcugcucgccuuccagaccuccgagaagaaguuccacaucgggugcgagaagggcggcgcgaaccugaucaaggagcugaucgacgacuucaucuuccccgccagcaacgucuaccuccaguacaugcggaacggggagcugcccgccgagcaggccaucccggugugcggcagcccgcccaccaucaacgccggguucgagcugcucguggcgcuggccgucggcugcgugcgcaaccugaagcagaucguggacagccucaccgagauguacuacaucgggacggccaucacgaccugcgaggcccugaccgagugggaguaccugcccccggucggcccccggccgcccaagggcuucguggggcucaagaacgccggcgcgacgugcuacaugaacagcgugauccagcagcuguacaugaucccguccauccgcaacgggauccuggccaucgagggcaccggcagcgacgucgacgacgacauguccggggacgagaagcaggacaacgagagcaacguggacccccgggacgacguguucggcuacccccagcaguucgaggacaagcccgcccucuccaagaccgaggaccgcaaggaguacaacaucgggguccugcggcaccuccaggugaucuucggccaccucgccgccagccgccugcaguacuacgugccgcggggguucuggaagcaguuccgccuguggggcgagcccgucaaccuccgggagcagcacgacgcgcuggaguucuucaacucccugguggacagccucgacgaggcccugaaggcccugggccaccccgccaugcucuccaaggugcucgggggcagcuucgcggaccagaagaucugccaggggugcccccaccgcuacgagugcgaggaguccuucaccacgcugaacgucgacauccgcaaccaccagaaccuccuggacagccuggagcaguacgugaagggcgaccuccuggagggggccaacgccuaccacugcgagaagugcaacaagaagguggacaccgucaagcggcugcucaucaagaagcugccgcccgugcuggccauccagcucaagcgcuucgacuacgacugggagcgggagugcgccaucaaguucaacgacuacuucgaguucccccgcgagcuggacauggagccguacaccguggcgggcgucgccaagcuggagggcgacaacgugaaccccgagucccagcucauccagcagagcgagcaguccgagagcgagaccgccggguccacgaaguaccggcuggugggcguccuggugcacagcgggcaggccuccggcgggcacuacuacagcuacaucauccagcgcaacggcggcgacggggagcggaaccgcugguacaaguucgacgacggcgacgugaccgagugcaagauggacgacgacgaggagaugaagaaccagugcuucgggggcgaguacaugggcgaggucuucgaccacaugaugaagcggaugagcuaccgccggcagaagcgcugguggaacgccuacauccucuucuacgagcggauggacaccaucgaccaggacgacgagcugauccgcuacaucuccgagcuggcgaucaccacgcggccccaccagaucaucaugcccagcgccaucgagcgcuccgugcggaagcagaacgugcaguucaugcacaaccgcaugcaguacagcauggaguacuuccaguucaugaagaagcuccugaccugcaacggggucuaccugaacccgcccccgggccaggaccaccuccugcccgaggccgaggagaucaccaugaucuccauccagcuggccgcccgguuccucuucaccaccggguuccacacgaagaagguggugcgcggcagcgcguccgacugguacgacgcccugugcauccugcuccggcacagcaagaacguccgcuucugguucgcccacaacgugcuguucaacguguccaaccgcuucagcgaguaccugcucgagugcccguccgccgagguccgcggggccuucgccaagcugaucguguucaucgcccacuucagccugcaggacggccccugccccucccccuucgccagcccgggccccuccagccaggccuacgacaaccucucccugagcgaccaccuccugcgggcggugcugaaccugcugcggcgcgaggucuccgagcacgggcggcaccuccagcaguacuucaaccuguucgugauguacgccaaccugggcguggccgagaagacccagcuccugaagcugagcguccccgccaccuucaugcucgugagccuggacgaggggcccggcccgcccaucaaguaccaguacgccgagcuggggaagcucuacuccgucgugagccagcugauccgcugcugcaacguguccagccggaugcaguccagcaucaacggcaacccgccccugccgaaccccuucggcgaccccaaccucucccagcccaucaugccgauccagcagaacgucgcggacauccuguucgugcgcaccagcuacgugaagaagaucaucgaggacugcuccaacagcgaggagacggucaagcugcuccgguucugcugcugggagaacccccaguucuccagcaccgugcuguccgagcugcucuggcaggucgccuacagcuacaccuacgagcugcgccccuaccuggaccuccugcugcagauccuccugaucgaggacuccuggcagacccaccggauccacaacgcccugaaggggauccccgacgaccgcgacggccucuucgacacgauccagcggagcaagaaccacuaccagaagcgcgccuaccagugcaucaagugcauggucgcccuguucuccaacugcccgguggcguaccagauccugcaggggaacggcgaccucaagcggaaguggaccugggccguggaguggcugggggacgagcuggagcgccggcccuacaccggcaacccccaguacaccuacaacaacuggagcccgcccguccaguccaacgagacgagcaacggcuacuuccucgagcgcagccacuccgcccggaugacccuggccaaggccugcgagcugugccccgaggaggugaagaaggcgaccagcgugcagcagaucgagauggaggaguccaaggagcccgacgaccaggacgccccggacgagcacgaguccccgccgcccgaggacgccccgcucuacccccacucccccgggagccaguaccagcagaacaaccacguccacggccagcccuacaccgggccggccgcgcaccacaugaacaacccccagcgcacgggccagcgcgcccaggagaacuacgagggguccgaggagguguccccgccccagaccaaggaccaguga

SEQ ID NO: 38531 - RNA, 7668 nt, Artificial Sequence
  derived and/or modified sequence opt1 from USP9Y__Homo_sapiens__XP_011529771
augaccgccaucacccacggcucccccgugggcgggaacgacucccagggccaggugcuggacgggcagagccagcaccucuuccagcagaaccagacguccagcccggacuccuccaacgagaacuccguggccacgccgccgcccgaggagcaggggcagggcgacgccccgccccagcacgaggacgaggagcccgccuucccccacaccgagcuggccaaccuggacgacaugaucaaccgcccccgguggguggugcccgugcugcccaagggcgagcuggaggugcugcucgaggccgccaucgaccugagcgucaaggggcuggacgugaaguccgaggcgugccagcgcuucuuccgggacggccucaccaucagcuucacgaagauccugauggacgaggccguguccggguggaaguucgagauccaccgcugcaucaucaacaacacccaccggcuggucgagcucugcguggccaagcugagccaggacugguucccccugcucgagcugcuggccauggcgcucaacccccacugcaaguuccacaucuacaacggcacccgccccugcgagcugaucuccagcaacgcccagcugcccgaggacgagcuguucgcccgguccagcgacccccgcucccccaagggguggcugguggaccugaucaacaaguucggcacccucaacggcuuccagauccugcacgaccgguucuucaacgggagcgcccugaacauccagaucaucgccgcgcucaucaagcccuucggccagugcuacgaguuccugucccagcacacgcugaagaaguacuucauccccgucaucgagaucgugccccaccuccuggagaaccugaccgacgaggagcucaagaaggaggccaagaacgaggccaagaacgacgcccugagcaugaucaucaagagccugaagaaccucgccucccgcaucagcgggcaggacgagaccaucaagaaccuggagaucuuccggcugaagaugauccuccgccugcugcagaucuccagcuucaacggcaagaugaacgcgcucaacgagaucaacaaggugaucuccagcgucuccuacuacacccaccggcacagcaaccccgaggaggaggaguggcugaccgccgagcgcauggccgaguggauccagcagaacaacauccuguccaucgugcuccaggacagccugcaccagccccaguacguggagaagcuggagaagauccuccgguucgucaucaaggagaaggcccugacccugcaggaccuggacaacaucugggccgcgcaggccggcaagcacgaggccaucgugaagaacgugcacgaccuccuggccaagcuggccugggacuucucccccgggcagcucgaccaccuguucgacugcuucaaggcgagcuggaccaacgccuccaagaagcagcgcgagaagcugcucgagcugauccggcgccuggccgaggacgacaaggacggcgucauggcccacaaggugcucaaccugcuguggaaccucgcgcagagcgacgacgugcccgucgacaucauggaccuggcccuguccgcccacaucaagauccucgacuacagcugcucccaggaccgggacgcccagaagauccaguggaucgaccacuucaucgaggagcugcgcaccaacgacaagugggugaucccggcccugaagcagauccgggagaucugcagccucuucggggaggcgucccagaaccugagccagacgcagcgcagcccccacaucuucuaccgccacgaccugaucaaccagcuccagcagaaccacgcccuggucacccugguggccgagaaccucgccaccuacaugaacuccauccggcuguacgccggcgaccacgaggacuacgacccccagaccgugcgccuggggagccgguacucccacguccaggaggugcaggagcgccucaacuuccugcgguuccugcucaaggacggccagcuguggcugugcgcgccccaggccaagcagaucuggaagugccucgccgagaacgccguguaccugugcgaccgcgaggccugcuucaagugguacagcaagcugaugggcgacgagccggaccucgaccccgacaucaacaaggacuucuucgaguccaacguccugcagcuggaccccagccuccugacggagaacgggaugaagugcuucgagcgguucuucaaggcggugaacugccgcgagcggaagcugaucgccaagcgccgguccuacaugauggacgaccucgagcugaucggccuggacuaccucuggcgcguggucauccagagcuccgacgagaucgccaaccgggccaucgaccugcugaaggagaucuacaccaaccucgggccgcgccugaaggcgaaccagguggugauccacgaggacuucauccagagcugcuucgaccggcugaaggccuccuacgacacccucugcgucuucgacggcgacaagaacagcaucaacugcgcccgccaggaggccauccggauggugcgcgugcugaccgucaucaaggaguacaucaacgagugcgacuccgacuaccacaaggagcggaugauccugcccaugagccgcgccuuccgcgggaagcaccucucccugaucgugcgguuccccaaccagggccgccagguggacgagcuggacaucuggagccacacgaacgacaccaucggcuccguccggcgcugcaucgugaaccggaucaaggcgaacguggcccacaagaagaucgagcuguucgucgggggcgagcugaucgacagcgaggacgaccgcaagcugaucgggcagcucaaccugaaggacaagagccugaucaccgccaagcucacccagaucaacuucaacaugcccuccagcccggacuccagcuccgacagcuccacggccagccccggcaaccaccggaaccacuacaacgacgggcccaaccuggagguggaguccugccugcccggcgugaucaugagcguccacccgcgcuacaucuccuuccucuggcaggucgccgaccugggcagcaaccugaacaugccgccccuccgggacggggcgcgcgugcugaugaagcugaugcccccggaccggaccgccgucgagaagcuccgcgccgugugccuggaccacgccaagcugggcgaggggaagcucagcccgccccucgacagccuguucuucggccccuccgccagccaggugcucuaccugaccgaggucguguacgcgcugcucaugccggccggcgugccccugaccgacggguccagcgacuuccagguccacuuccugaaguccggcgggcucccccuggugcugagcaugcucauccggaacaacuuccugcccaacacggacauggagacccgccggggcgccuaccugaacgcccucaagaucgcgaagcugcugcucaccgccaucggguacggccacgugcgcgccgucgccgaggccugccagccggugguggacggcaccgaccccaucacgcagaucaaccaggucacccacgaccaggcgguggugcugcagagcgcccugcaguccauccccaaccccagcuccgagugcguccugcggaacgagagcauccuccuggcccaggagaucuccaacgaggccagccgcuacaugccggacaucugcgugauccgggccauccagaagaucaucugggcguccgccugcggggcccugggccucguguucagccccaacgaggagaucaccaagaucuaccagaugaccaccaacggguccaacaagcuggaggucgaggacgagcaggucugcugcgaggcccuggaggugaugacgcucugcuucgcccugcugcccaccgcgcucgacgcccugagcaaggagaaggccuggcagaccuucaucaucgaccugcuccugcacugcccguccaagaccguccgccagcuggcccaggagcaguucuuccucaugugcacgcggugcugcaugggccaccgcccccugcuguucuucaucacccuccuguucaccauccuggggagcaccgcccgcgagaagggcaaguacuccggcgacuacuucacgcuccugcggcaccuccugaacuacgcguacaacgggaacaucaacauccccaacgccgaggugcugcuggugagcgagaucgacuggcucaagcgcauccgggacaacgucaagaacaccggcgagaccgggguggaggagcccauccuggagggccaccugggggucaccaaggagcuccuggccuuccagacguccgagaagaaguaccacuucggcugcgagaagggcggggccaaccugaucaaggagcucaucgacgacuucaucuucccggcgagcaagguguaccugcaguaccugcgcuccggcgagcuccccgccgagcaggccauccccgugugcagcucccccgucaccaucaacgccggguucgagcugcugguggcccucgcgaucggcugcgugcggaaccugaagcagaucgucgacugccugaccgagauguacuacauggggaccgccaucacgaccugcgaggcccucaccgagugggaguaccugccgcccgugggcccccggccgcccaagggcuucguggggcugaagaacgccggcgcgaccugcuacaugaacagcgucauccagcagcucuacaugauccccagcauccggaacuccauccuggcgaucgaggggacgggcagcgaccugcacgacgacauguucggcgacgagaagcaggacuccgagagcaacguggacccccgcgacgacguguucggguacccccaccaguucgaggacaagcccgcccucuccaagaccgaggaccggaaggaguacaacaucggcguccugcgccaccuccaggugaucuucgggcaccucgccgccagccagcugcaguacuacgugccccggggcuucuggaagcaguuccgccuguggggcgagcccgucaaccuccgggagcagcacgacgcccuggaguucuucaacucccugguggacagccucgacgaggcgcugaaggcccugggccaccccgccauccucuccaaggugcugggcgggagcuucgccgaccagaagaucugccagggcugcccgcaccgcuacgagugcgaggaguccuucaccacccugaacgucgacauccggaaccaccagaaccuccuggacagccuggagcaguacaucaagggggaccuccuggagggcgcgaacgccuaccacugcgagaagugcgacaagaagguggacacggugaagcgccugcucaucaagaagcugccccggguccuggccauccagcucaagcgcuucgacuacgacugggagcgggagugcgccaucaaguucaacgacuacuucgaguucccccgcgagcuggacauggggcccuacaccguggccggcguggcgaaccuggagcgcgacaacgucaacuccgagaacgagcucaucgagcagaaggagcagagcgacaacgagaccgccggcgggaccaaguaccggcuggugggcgugcugguccacuccgggcaggccagcggcgggcacuacuacuccuacaucauccagcgcaacggcaaggacgaccagacggaccacugguacaaguucgacgacggcgacgugaccgagugcaagauggacgacgacgaggagaugaagaaccagugcuucgggggcgaguacaugggggagguguucgaccacaugaugaagcggaugagcuaccgccggcagaagcgcugguggaacgccuacauccucuucuacgagcagauggacaugaucgacgaggacgacgagaugauccgguacaucuccgagcugaccaucgcccgcccgcaccagaucaucaugagccccgcgaucgagcggagcguccgcaagcagaacgugaaguucaugcacaaccggcugcaguacucccucgaguacuuccaguucgugaagaagcugcugaccugcaacggcgucuaccucaaccccgcccccggccaggacuaccugcugccggaggccgaggagaucacgaugaucagcauccagcucgccgcccgcuuccuguucaccaccggguuccacaccaagaagaucgugcggggccccgcguccgacugguacgacgcccugugcgugcuccugcgccacagcaagaacguccgguucugguucacgcacaacgugcuguucaacguguccaaccgcuucagcgaguaccuccuggagugccccuccgccgagguccgcggggccuucgcgaagcugaucguguucaucgcccacuucagccuccaggacggcuccugcccgagccccuucgccucccccgggcccagcucccaggccugcgacaaccugagccuguccgaccaccuccugcgcgccacccugaaccugcuccggcgcgaggugagcgagcacggccaccaccuccagcaguacuucaaccuguucgucauguacgcgaaccucggcguggccgagaagacccagcugcugaagcucaacgugccggccaccuucaugcuggucucccuggacgaggggcccgggccgcccaucaaguaccaguacgccgagcucgggaagcuguacagcguggugucccagcugauccggugcugcaacgucagcagcaccaugcaguccagcaucaacggcaacccgccccuccccaaccccuucggggaccugaaccugucccagccgaucaugcccauccagcagaacgugcucgacauccuguucgugcgcacgagcuacgucaagaagaucaucgaggacugcuccaacagcgaggacaccaucaagcugcuccgcuucugcuccugggagaacccccaguucagcuccaccgugcugagcgagcugcucuggcaggucgccuacuccuacaccuacgagcugcggcccuaccuggaccuccuguuccagauccugcucaucgaggacagcuggcagacgcaccgcauccacaacgcgcugaagggcaucccggacgaccgggacggccuguucgacaccauccagcgcuccaagaaccacuaccagaagcgggccuaccagugcaucaagugcaugguggcccucuucagcuccugccccguggccuaccagauccugcaggggaacggcgaccugaagcgcaaguggaccugggccgucgaguggcucggggacgagcuggagcggcgccccuacaccggcaacccccaguacagcuacaacaacugguccccgcccgugcagagcaacgagacggcgaacggguacuuccuggagcggucccacagcgcccgcaugacccucgccaaggccugcgagcugugccccgaggaggagcccgacgaccaggacgccccggacgagcacgagcccagccccuccgaggacgcgccccuguacccgcacagccccgccucccaguaccagcagaacaaccacgugcacggccagcccuacaccggcccggccgcccaccaccucaacaacccccagaagaccgggcagcggacgcaggagaacuacgagggcaacgaggaggucagcagcccccagaugaaggaccaguga

SEQ ID NO: 38532 - RNA, 3279 nt, Artificial Sequence
  derived and/or modified sequence opt1 from USPL1__Homo_sapiens__NP_005791
augauggacagccccaagaucggcaacgggcugccggugaucggccccgggaccgacaucggcaucuccagccuccacauggucggguaccugggcaagaacuucgacuccgccaaggugcccagcgacgaguacugccccgccugccgcgagaagggcaagcugaaggcgcucaagaccuaccggaucuccuuccaggagagcaucuuccugugcgaggaccugcagugcaucuacccgcucggguccaagagccugaacaaccugaucucccccgaccucgaggagugccacacgccccacaagccccagaagcgcaagagccuggaguccagcuacaaggacucccugcuccuggccaacagcaagaagacccggaacuacaucgccaucgacggcgggaaggugcugaacuccaagcacaacggcgaggucuacgacgagaccagcuccaaccucccggacagcuccgggcagcagaaccccauccgcaccgccgacagccuggagcggaacgagauccuggaggccgacacgguggacauggcgaccaccaaggaccccgccaccguggacgucagcggcacgggccgccccuccccgcagaacgaggggugcaccagcaagcucgagaugccccuggaguccaagugcaccagcuucccccaggcccugugcgugcaguggaagaacgccuacgcgcucugcuggcuggacugcauccuguccgcccucgugcacagcgaggagcugaagaacaccgucacgggccugugcuccaaggaggagagcaucuucuggcggcuccugaccaaguacaaccaggccaacacccugcucuacaccucccagcugagcggggugaaggacggcgacugcaagaagcugacguccgagaucuucgccgagaucgagaccugccucaacgaggugcgcgacgagaucuucaucagccugcagccccagcugcggugcacccucggcgacauggaguccccggucuucgccuucccccugcugcucaagcuggagacccacaucgagaagcuguuccucuacagcuucuccugggacuucgagugcagccagugcgggcaccaguaccagaaccgccacaugaagucccuggugacguucaccaacgugauccccgaguggcacccccugaacgcggcccacuucggcccgugcaacaacugcaacagcaagucccagauccggaagaugguccucgagaaggugagccccaucuucaugcugcacuucguggaggggcugccccagaacgaccuccagcacuacgccuuccacuucgagggcugccuguaccagaucaccagcgucauccaguaccgcgccaacaaccacuucaucaccuggauccuggacgccgacggguccuggcuggagugcgacgaccucaagggccccugcagcgagcggcacaagaaguucgaggugccggcguccgagauccacaucgugaucugggagcgcaagaucagccaggucacggacaaggaggccgccugccugccccugaagaagaccaacgaccagcacgcccucuccaacgagaagcccgugagccugaccuccugcagcgugggcgacgccgcguccgccgagaccgccagcgucacgcaccccaaggacaucuccguggccccgcggacccugagccaggacaccgccgucacccacggggaccaccuccuguccggccccaaggggcugguggacaacauccucccccugacgcuggaggagaccauccagaagaccgcgagcgugucccagcucaacagcgaggccuuccugcuggagaacaagccggucgccgagaacaccggcauccucaagacgaacacccugcugucccaggagagccucauggccagcuccgugagcgcgcccugcaacgagaagcugauccaggaccaguucguggacaucuccuuccccagccaggucgugaacaccaacaugcaguccgugcagcugaacaccgaggacaccgucaacaccaagagcgugaacaacacggacgccaccgggcucauccagggcgugaaguccgucgagaucgagaaggacgcccagcugaagcaguuccugacccccaagacggagcagcucaagccggagcgcgugaccagccagguguccaaccugaagaagaaggagaccaccgccgacagccagacgaccaccuccaagagccugcagaaccagucccucaaggagaaccagaagaagcccuucgucggcagcugggugaaggggcugaucucccggggcgccagcuucaugccccugugcguguccgcgcacaaccgcaacaccaucacggaccuccagcccagcgucaagggggugaacaacuucggcggguucaagaccaagggcaucaaccagaaggccucccacgugagcaagaaggcccgcaagagcgccuccaagccgccgcccaucagcaagccgcccgccggcccgcccuccagcaacgggaccgcggcccacccccacgcccacgccgccuccgagguccuggagaaguccggcagcaccagcugcggggcgcagcugaaccacuccagcuacggcaacggcaucuccagcgccaaccacgaggaccucguggaggggcagauccacaagcugcggcugaagcuccggaagaagcugaaggccgagaagaagaagcuggccgcgcucauguccagcccccagucccgcacggugcgcagcgagaaccuggagcaggucccccaggacggcucccccaacgacugcgagagcaucgaggaccugcucaacgagcugcccuaccccaucgacaucgccuccgagagcgccugcaccaccgugcccggggugagccuguacuccagccagacccacgaggagauccucgccgagcugcugucccccacgcccgucagcaccgagcucuccgagaacggcgagggggacuuccgguaccugggcaugggcgacagccacaucccgccgcccgugcccuccgaguucaacgacgugagccagaacacccaccuccgccaggaccacaacuacugcucccccaccaagaagaaccccugcgagguccagcccgacagccugacgaacaacgccugcgugcggacccugaaccuggaguccccgaugaagaccgacaucuucgacgaguucuucagcuccagcgcgcucaacgcccuggccaacgacacccuggaccucccccacuucgacgaguaccuguucgagaacuacuga

SEQ ID NO: 38533 - RNA, 1221 nt, Artificial Sequence
  derived and/or modified sequence opt1 from UST__Homo_sapiens__NP_005706
augaagaagaagcagcagcaccccggcgggggcgccgacccguggccccacggggcccccaugggcggggcgcccccgggccugggcagcuggaagcgccgggugccccuccugcccuuccugcgcuucucccuccgggacuacggguucugcauggccacccugcuggucuucugccucggcagccugcuguaccagcucuccgggggcccgccccgcuuccugcuggaccuccggcaguaccuggggaacagcaccuaccuggacgaccacggcccgccgcccuccaaggugcuccccuuccccagccagguggucuacaaccgcgugggcaagugcgggucccggacggugguccugcugcuccgcauccugagcgagaagcacggcuucaaccuggugaccuccgacauccacaacaagacccggcucaccaagaacgagcagauggagcugaucaagaacaucagcacggccgagcagcccuaccuguucacccgccacgugcacuuccucaacuucucccgguucgggggcgaccagcccgucuacaucaacaucauccgcgaccccgugaaccgguuccugagcaacuacuucuuccgccgguucggcgacuggcgcggggagcagaaccacaugauccggacccccuccaugcgccaggaggagcgguaccuggacaucaacgagugcauccucgagaacuaccccgagugcagcaacccccgccuguucuacaucaucccguacuucugcggccagcacccccggugccgcgagcccggggagugggcccuggagcgcgccaagcucaacgugaacgagaacuuccugcuggucggcauccucgaggagcuggaggacgugcugcuccugcuggagcgguuccucccccacuacuucaagggggugcuguccaucuacaaggacccggagcaccgcaagcugggcaacaugaccgucacggugaagaagaccgugcccagccccgaggcgguccagauccucuaccagcggaugcgcuacgaguacgaguucuaccacuacgugaaggagcaguuccaccuccugaagcggaaguucggccugaagucccacgugagcaagcccccgcugcgcccccacuucuucauccccaccccgcuggagaccgaggagcccaucgacgacgaggagcaggacgacgagaaguggcucgaggacaucuacaagcgguga

SEQ ID NO: 38534 - RNA, 1026 nt, Artificial Sequence
  derived and/or modified sequence opt1 from UTF1__Homo_sapiens__NP_003568
augcugcuccgcccccggcggcccccgccccuggcgccgcccgccccgcccagccccgccucccccgaccccgagccccgcacccccggcgacgcccccgggaccccgccccgccggcccgccagccccuccgcccugggcgagcucgggcugcccgugagccccggcuccgcccagcgcacgcccuggagcgcgcgggagaccgagcugcuccuggggacccugcuccagcccgccgucuggcgcgcccugcugcucgaccggcgccaggcccugcccaccuaccggcgcguguccgcggcccuggcccagcagcagguccggcgcacgcccgcccagugccggcgccgguacaaguuccucaaggacaaguuccgcgaggcccacggccagccgcccggccccuucgacgagcagauccggaagcugauggggcugcucggcgacaacgggcgcaagcggccccgccgccggagccccggcuccgggcgcccccagcgggcgcgccggcccgugcccaacgcccacgccccggcccccagcgagcccgacgccacgccccugccgaccgcgcgcgaccgggacgccgaccccaccuggacccugcgcuucucccccagcccgcccaaguccgccgacgccagccccgcccccggcagcccgcccgcgcccgcccccaccgcccucgcgaccugcauccccgaggaccgggccccggugcgcggccccggguccccgcccccgccgcccgcccgggaggaccccgacuccccgcccggccgccccgaggacugcgccccgccgcccgccgcgccgcccagccugaacaccgcccugcuccagacgcuggggcaccugggcgacaucgccaacauccucggcccccugcgggaccagcugcucacccugaaccagcacguggagcagcugcgcggggccuucgaccagaccgucucccucgccgugggcuucauccuggggagcgccgcggccgagcggggcgugcugcgcgaccccugccaguga

SEQ ID NO: 38535 - RNA, 2160 nt, Artificial Sequence
  derived and/or modified sequence opt1 from UTP14A__Homo_sapiens__NP_001159693
augaccgccaaccgccuggccgagagccuccuggcgcugucccagcaggaggagcucgccgaccugcccaaggacuaccugcucagcgaguccgaggacgagggcgacaacgacggggagcggaagcaccagaagcugcuggaggccaucagcucccucgacggcaagaaccgccggaagcuggccgagcgcagcgaggccucccugaaggugagcgaguucaacgucuccagcgagggguccggcgagaagcucgugcuggcggaccugcucgagccggugaagaccagcuccagccuggccacggucaagaagcagcugucccgggucaagagcaagaagaccguggagcucccccugaacaaggaggagaucgagcgcgcccggacgccccuggagcaggagaucuucaaccuccugcacaagaacaagcagcccgugaccgacccgcugcucacccccguggagaaggccucccugcgcgcgaugagccuggaggaggccaagaugcggcgcgccgagcuccagcgggcccgcgcccugcaguccuacuacgaggcgaaggcccggcgcgagaagaagaucaagagcaagaaguaccacaagguggucaagaaggggaaggccaagaaggcccugaaggaguucgagcagcuccggaaggugaaccccgccgcggcccuggaggagcuggagaagaucgagaaggcccgcaugauggagcggaugagccucaagcaccagaacuccggcaagugggccaagagcaaggccaucauggcgaaguacgaccuggaggcccgccaggccaugcaggagcagcuguccaagaacaaggagcucacccagaagcuccagguggccagcgaguccgaggaggaggagggcgggaccgaggacgucgaggagcugcuggugcccgacguggucaacgaggugcagaugaacgccgacggcccgaaccccuggaugcugcggagcugcaccuccgacacgaaggaggcggccacccaggaggaccccgagcagcugcccgagcucgaggcccacggggugagcgaguccgagggcgaggagcgcccggucgccgaggaggagauccugcugcgggaguucgaggagcgccgcagccuccggaagcgcuccgagcugagccaggacgcggagcccgccgggucccaggagaccaaggacagcggcucccaggaggugcugagcgagcuccgggugcugucccagaagcugaaggagaaccaccagagccgcaagcagaaggccuccagcgagggcaccaucccccagguccagcgggaggagcccgccccggaggaggaggagccccugcuccugcagcgccccgagcgggugcagacgcuggaggagcucgaggagcuggggaaggaggagugcuuccagaacaaggagcugccccgcccggugcucgagggccagcagagcgagcggacccccaacaaccgccccgacgcccccaaggagaagaagaagaaggagcagaugaucgaccugcagaaccugcucaccacccaguccccgagcgucaagucccuggcggugcccacgaucgaggagcuggaggacgaggaggagcggaaccaccgccagaugaucaaggaggccuucgccggggacgacgucauccgggacuuccucaaggagaagcgcgaggccguggaggccagcaagcccaaggacguggaccugacccugcccggcuggggcgaguggggcggcgucgggcucaagccguccgcgaagaagcggcgccgguuccugaucaaggcccccgaggggcccccgcgcaaggacaagaaccugcccaacgugaucaucaacgagaagcggaacauccacgccgccgcccaccaggugcgcguccuccccuaccccuucacccaccacuggcaguucgagcgcaccauccagacgccgaucgggagcaccuggaacacccagcgggcguuccagaagcugaccacgcccaagguggugaccaagcccggccacaucaucaaccccaucaaggccgaggacgucggcuaccgcuccagcucccggagcgaccuguccgugauccagcgcaacccgaagcggaucaccacccgccacaagaagcagcucaagaagugcagcguggacuga

SEQ ID NO: 38536 - RNA, 2301 nt, Artificial Sequence
  derived and/or modified sequence opt1 from UTP14C__Homo_sapiens__NP_067677
augaacgugaaccaggucgccgagaaccuggcccucagccaccaggaggagcugguggaccugcccaagaacuacccgcucuccgagaacgaggacgagggcgacagcgacggggagcgcaagcaccagaagcugcuggaggcgaucaucucccucgacggcaagaaccggcgcaagcuggccgagcggagcgaggccucccugaaggugagcgaguucuccgucagcuccgaggggagcggcgagaagcucgggcuggccgaccugcucgagcccgugaagaccuccagcucccuggccaccgugaagaagcagcugaaccgcgucaagagcaagaaggugguggagcucccccugaacaaggagaagaucgagcagauccaccgggaggucgcguucuccaagacgagccaggugcuguccaagugggaccccaucauccucaagaaccagcaggccgagcagcugguguucccgcugggcaaggagcagcccgccaucgcccccaucgagcacgcgcucagcggcuggaaggcccgcacgccccuggagcaggagaucuucaaccugcuccacaagaacaagcagccggucaccgacccccugcugacccccauggagaaggccucccuccaggccaugagccuggaggaggccaagaugcaccgggcggagcugcagcgcgcccgggcccuccagagcuacuacgaggccaaggcccgcaaggagaagaagaucaaguccaagaaguaccacaagguggugaagaaggggaaggcgaagaaggcccugaaggaguucgagcagcugcagaaggucaaccccaccguggcccucgaggagauggagaagaucgagaacgcccggaugauggagcgcaugagccugaagcaccagaacuccggcaagugggccaagagcaaggcgaucauggccaaguacgaccuggaggcccggcaggccaugcaggagcagcucgccaagaacaaggagcugacccagaagcuccagguggcguccgagagcgaggaggaggagggcgggaccgaggucgaggagcugcuggugccgcacguggccaacgagguccagaugaacguggacgggcccaaccccuggauguuccgcuccugcaccagcgacacgaaggaggccgccacccaggaggaccccgagcaggucccggagcuggcggcccacgagguguccgccagcgaggccgaggagcggcccguggccgaggaggagauccuccugcgcgaguucgaggagcggcagucccugcgcaagcggagcgagcucaaccaggacgcggagcccgccuccagccaggagaccaaggacuccagcucccaggagguccugagcgagcugcgcgcccucucccagaagcugaaggagaagcaccagagccggaagcagaaggccagcuccgagggcaccgugccccaggugcagcgcgaggagccggcccccgaggaggcggagccccugcugcuccagcgcagcgagcggguccagacgcuggaggagcuggaggagcucggcaaggaggacugcuuccagaacaaggagcugccccgcccggugcuggaggggcagcaguccgagcggacccccaacaaccgccccgacgcccccaaggagaagaaggagaaggagcagcucaucaaccugcagaacuuccugaccacccagagcccguccgugcggagccucgccguccccacgaucaucgaggagcuggaggacgaggaggagcgcgaccagcggcagaugaucaaggaggccuucgccggcgacgacgugauccgcgacuuccugaaggagaagcgggaggcgguggaggccuccaagcccaaggacgucgaccucacccugccgggguggggcgaguggggcggggugggccugaagcccagcgccaagaagcgccggcaguuccucaucaaggcccccgaggggcccccgcgcaaggacaagaaccugcccaacgugaucaucuccgagaagcggaacauccacgcggccgcccaccagguccaggugcugcccuaccccuucacccaccaccgccaguucgagcggaccauccagacgccgaucggcagcaccuggaacacccagcgcgccuuccagaagcucaccacgcccaagguggucaccaagcccgggcacaucaucaagcccaucaaggccgaggacgugggcuaccaguccagcucccggagcgaccugccggugauccagcgcaaccccaagcggaucaccacccgccacaacaaggaggagaagcuguga

SEQ ID NO: 38537 - RNA, 8358 nt, Artificial Sequence
  derived and/or modified sequence opt1 from UTP20__Homo_sapiens__NP_055318
augaagaccaagcccgugagccacaagaccgagaacaccuaccgcuuccugaccuucgccgagcggcucggcaacgugaacaucgacaucauccaccgcaucgaccggaccgccagcuacgaggaggagguggagaccuacuucuucgaggggcugcugaaguggcgcgagcucaaccugacggagcacuucggcaaguucuacaaggaggugaucgacaagugccagagcuucaaccagcugguguaccaccagaacgagaucgugcagucccucaagacccaccuccaggugaagaacagcuucgccuaccagccgcugcucgaccugguggugcagcuggcccgggaccuccagauggacuucuacccccacuuccccgaguucuuccugaccaucaccuccauccuggagacgcaggacaccgagcuccuggagugggccuucaccagccuguccuaccucuacaaguaccuguggcgccugauggugaaggacaugagcuccaucuacagcauguacuccacccuccuggcccacaagaagcugcacauccggaacuucgccgcggagagcuucacguuccucaugcgcaaggucuccgacaagaacgcccuguucaaccugauguuccucgaccuggacaagcaccccgagaagguggagggggugggccagcuccuguucgagaugugcaaggggguccggaacauguuccacagcugcaccggccaggccgugaagcugauccugcgcaagcucggcccggugaccgagaccgagacgcagcugcccuggaugcugaucggggagacccucaagaacauggucaaguccaccgugagcuacaucuccaaggagcacuucggcaccuucuucgagugccugcaggagagccugcucgaccugcacacgaaggugaccaagaccaacugcugcgaguccagcgagcagaucaagcggcugcucgagaccuaccugauccuggucaagcacgggagcggcacgaagauccccacccccgccgacgugugcaaggugcucucccagacccugcaggucgcgagccuguccaccagcugcugggagacgcuccuggacgugaucuccgcccugauccugggggagaacgugagccucccggagacccugaucaaggagaccaucgagaagaucuucgagucccgcuucgagaagcggcugaucuucagcuucuccgaggucauguucgccaugaagcaguucgagcagcuguuccugcccagcuuccuguccuacaucgugaacugcuuccucaucgacgacgccgucgugaaggacgaggcccuggcgauccuggccaagcucauccugaacaaggccgcgccgcccaccgccggcagcauggcgaucgagaaguacccgcugguguucagcccccagauggucggcuucuacaucaagcagaagaagacgcgcagcaaggggcggaacgagcaguuccccgugcucgaccaccuccucuccaucaucaagcugccgcccaacaaggacaccaccuaccugagccaguccugggccgcccuggugguccucccccacauccgcccccuggagaaggagaaggugaucccccuggugaccggcuucaucgaggcccucuucaugacggucgacaaggggagcuucggcaagggcaaccuguucgugcugugccaggccgugaacacccuccugucccuggaggagagcagcgagcuccugcaccugguccccguggagcgggugaagaaccucguccugaccuucccccuggagcccuccgugcuccugcugaccgaccucuacuaccagcgccuggcgcugugcgggugcaagggcccccucagccaggaggcccugauggagcuguucccgaagcuccaggccaacaucuccaccggggugagcaagauccggcugcugacgauccgcauccucaaccacuucgacguccagcugcccgaguccauggaggacgacggccugagcgagcggcaguccguguucgccauccuccgccaggccgagcuggugcccgcgaccgucaacgacuaccgcgagaagcugcuccaccuccggaagcugcgccacgacguggugcagaccgccguccccgacgggccgcuccaggaggugccccugcgguaccugcucggcaugcuguacaucaacuucagcgcccugugggaccccgugaucgagcucaucuccagccacgcccacgagauggagaacaagcaguucuggaaggucuacuacgagcaccuggagaaggcggccacccacgccgagaaggagcugcagaacgacaugacggacgagaaguccgugggcgacgagagcugggagcagacccaggagggggacgugggcgcccucuaccacgagcagcuggcccugaagaccgacugccaggagcgccucgaccacaccaacuuccgguuccugcuguggcgcgcgcucacgaaguucccggagcgggucgagccccgcucccgggagcugagcccccuguuccuccgcuucaucaacaacgaguacuaccccgccgaccuccagguggccccgacccaggaccugcggcgcaaggggaagggcaugguggccgaggagaucgaggaggagcccgccgcgggggacgacgaggagcucgaggaggaggccgucccccaggacgaguccagccagaagaagaagacccggcgcgccgccgccaagcagcugaucgcgcaccuccagguguucuccaaguucagcaacccccgggcccucuaccuggagagcaagcuguacgagcucuaccugcagcugcuccugcaccaggaccagauggugcagaagaucacccuggacugcaucaugacguacaagcacccgcacguccuccccuaccgcgagaaccugcagcggcugcucgaggaccgcuccuucaaggaggagaucgugcacuucagcaucuccgaggacaacgccguggucaagaccgcccaccgggcggaccuguuccccauccugaugcgcauccucuacggccgcaugaagaacaagaccggcagcaagacccaggggaaguccgccagcggcacgcggauggccaucgugcugcgcuuccuggccgggacccagcccgaggagauccagaucuuccuggaccuccuguucgagccggugcggcacuucaagaacggcgagugccacuccgccgucauccaggcgguggaggaccuggaccucagcaaggugcugccccuggggcgccagcacggcauccucaacucccuggagaucguccugaagaacaucagccaccucaucuccgccuaccugcccaagauccugcagauccuccugugcaugaccgccaccgugagccacauccuggaccagcgggagaagauccagcuccgcuucaucaacccccugaagaaccugcggcgccucggcaucaagauggugacggacaucuuccuggacugggaguccuaccaguuccggaccgaggagaucgacgccgucuuccacggggccguguggccgcagaucagccgccugggcuccgagagccaguacucccccacgccccugcugaagcugaucagcaucuggucccggaacgcgcgcuacuucccccuccuggccaagcagaagccggggcaccccgagugcgacauccugaccaacguguucgccauccucagcgccaagaaccugagcgacgccacggcguccaucgucauggacaucguggacgaccugcucaaccugcccgacuucgagcccaccgagaccguccugaaccuccuggugaccggcugcguguacccgggcaucgccgagaacaucggggagagcaucacgaucggcgggcggcugauccucccccacguccccgccauccugcaguaccuguccaagaccaccaucagcgccgagaaggugaagaagaagaagaaccgcgcccagguguccaaggagcucggcauccugagcaagaucuccaaguucaugaaggacaaggagcagagcuccguccugaucacccuccugcugccguuccuccaccgggggaacaucgccgaggacacggagguggacauccuggugaccguccagaaccugcucaagcacugcguggaccccaccagcuuccugaagcccaucgccaagcuguucuccgugaucaagaacaagcucagccgcaagcugcugugcaccgucuucgagacgcucuccgacuucgagagcggccugaaguacaucaccgacguggugaagcugaacgccuucgaccagcggcaccucgacgacaucaacuucgacguccgcuucgagaccuuccagaccaucaccuccuacaucaaggagaugcagaucguggacgugaacuaccugauccccgucaugcacaacugcuucuacaaccuggagcucggcgacaugagccuguccgacaacgccagcaugugccugauguccaucaucaagaagcucgcggcccugaacgugacggagaaggacuaccgggagaucauccaccgcagccugcucgagaagcugcggaaggggcugaagucccagaccgaguccauccagcaggacuacaccaccauccucagcugccugauccagacguucccgaaccagcuggaguucaaggaccucgugcagcugacccacuaccacgaccccgagauggacuucuucgagaacaugaagcacauccagauccaccgccgcgcccgggcccugaagaagcucgccaagcagcugauggagggcaaggucgugcuguccagcaagucccuccagaacuacaucaugcccuacgcgaugacccccaucuucgacgagaagaugcugaagcacgagaacaucaccacggccgccaccgagaucaucggggccaucugcaagcaccugagcugguccgccuacauguacuaccucaagcacuucauccacgugcugcagaccggccagaucaaccagaagcugggggucagccuccuggugaucgugcuggaggcguuccacuucgaccacaagacccucgaggagcagaugggcaagaucgagaacgaggagaacgccaucgaggccaucgagcugccggagcccgaggccauggagcuggagcgcgucgacgaggaggagaaggaguacacgugcaagucccucagcgacaacggccagcccgggacccccgacccggccgacuccggcgggaccagcgcgaaggaguccgagugcaucaccaagcccgugagcuuccugccccagaacaaggaggagaucgagcggacgaucaagaacauccagggcaccaucaccggggacauccugccccgccuccacaagugccuggccuccaccacgaagcgggaggaggagcacaagcuggucaagagcaaggucgugaacgacgaggaggugguccgcgugccgcucgccuucgccauggugaagcugaugcagucccugccccaggaggucauggaggcgaaccuccccagcauccugcugaaggugugcgcccugcucaagaaccgggcccaggagauccgcgacaucgcccgguccacccuggccaagaucaucgaggaccugggcgugcacuuccuccuguacguccugaaggagcuccagaccacccuggugcgcggcuaccaggugcacguccugacguucaccgugcacaugcuccugcaggggcugaccaacaagcuccaggugggcgaccuggacagcugccuggacaucaugaucgagaucuucaaccacgagcuguucggggcggucgccgaggagaaggaggugaagcagauccugagcaaggugauggaggcccggcgcuccaagagcuacgacuccuacgagauccugggcaaguucgucgggaaggaccaggugaccaagcucauccugccccugaaggagauccuccagaacacgaccagccugaagcuggcccggaaggugcacgagacccuccgccggaucaccgucggccugaucgugaaccaggagaugacggccgaguccauccugcuccugagcuacggccugaucuccgagaaccucccgcugcugaccgagaaggagaagaaccccgucgcgcccgcccccgacccgcgccugccgccccagagcugccugcugcugcccccgacccccgugcgcgggggccagaaggccguggucucccgcaagaccaacaugcacaucuucaucgagagcgggcugcggcugcuccaccugucccugaagacgagcaagaucaaguccagcggcgagugcgugcucgagaugcuggaccccuucgugucccugcucaucgacugccugggcagcauggacgucaaggugaucaccggggcccugcagugccucaucugggugcugcgcuucccgcugcccuccaucgagaccaaggccgagcagcucaccaagcaccuguuccugcuccugaaggacuacgcgaagcugggcgccgcccgcgggcagaacuuccaccucgucgugaacugcuucaagugcgugaccauccuggucaagaaggucaagagcuaccagaucacggagaagcagcuccaggugcuccuggccuacgcggaggaggacaucuacgacaccucccggcaggccaccgccuucggccugcucaaggccauccugagccgcaagcugcucguccccgagaucgacgaggugaugcggaaggugagcaagcuggccgucuccgcgcagagcgagcccgcccgcgugcagugccgccagguguuccugaaguacauccucgacuacccgcugggggacaagcugcgccccaaccucgaguucaugcuggcccagcugaacuacgagcacgagaccggccgggaguccacgcucgagaugaucgccuaccuguucgacaccuucccccagggccugcuccacgagaacugcgggauguucuucaucccccugugccugaugaccaucaacgacgacagcgcgaccugcaagaagauggcguccaugacgaucaagagccuccugggcaagaucucccuggagaagaaggacuggcuguucgacauggucaccaccugguucggggccaagaagcgccugaaccggcagcuggccgcccucaucugcggccuguucguggagagcgaggggguggacuucgagaagcgccugggcaccguccucccggugaucgagaaggagaucgaccccgagaacuucaaggacaucauggaggagacggaggagaaggccgcggaccggcugcuguucuccuuccucacccugaucaccaagcugaucaaggagugcaacaucauccaguucaccaagcccgccgagacgcucagcaagaucuggucccacgugcacagccaccuccggcacccccacaacugggucuggcugaccgccgcccagaucuucggccugcuguucgcguccugccagccggaggagcugauccagaaguggaacaccaagaagaccaagaagcaccuccccgagcccguggccaucaaguuccucgccagcgaccuggaccagaagaugaaguccaucagccuggccuccugccaccagcuccacagcaaguuccuggaccagucccugggggagcaggucgucaagaaccuccuguucgccgcgaaggugcuguaccuccuggagcuguacugcgaggacaagcagagcaagaucaaggaggaccucgaggagcaggaggcccuggaggacggcguggccugcgccgacgagaaggccgagagcgacggggaggagaaggaggaggucaaggaggagcugggccggcccgcgacgcuccuguggcugauccagaagcucucccgcaucgccaagcuggaggccgccuacagcccgcggaacccccugaagcggaccugcaucuucaaguuccucggggccguggcgauggaccugggcaucgacaaggugaagcccuaccugcccaugaucaucgcgccccuguuccgggagcugaacuccaccuacagcgagcaggacccccugcucaagaaccugucccaggagaucaucgagcugcucaagaagcuggucggccuggagagcuucucccucgccuucgccagcgugcagaagcaggccaacgagaagcgcgcccugcggaagaagcgcaaggcccuggaguucgugaccaaccccgacaucgccgccaagaagaagaugaagaagcacaagaacaaguccgaggcgaagaagcggaagaucgaguuccuccgccccggguacaaggccaagcgccagaagucccacucccugaaggaccuggccauggucgaguga

SEQ ID NO: 38538 - RNA, 10302 nt, Artificial Sequence
  derived and/or modified sequence opt1 from UTRN__Homo_sapiens__NP_009055
auggccaaguacggcgagcacgaggccagccccgacaacgggcagaacgaguucagcgacaucaucaagagccggagcgacgagcacaacgacgugcagaagaagaccuucaccaaguggaucaacgcgcgguucagcaaguccggcaagccgcccaucaacgacauguucaccgaccugaaggacgggcgcaagcugcuggaccugcuggagggccugaccgggaccagccugcccaaggagcggggcuccacccgcgugcacgcccugaacaacgugaaccgggugcuccaggugcugcaccagaacaacguggagcuggugaacaucggcgggacggacaucguggacggcaaccacaagcugacccuggggcuccuguggagcaucauccugcacuggcaggucaaggacgugaugaaggacgugauguccgaccuccagcagaccaacagcgagaagauccugcuguccugggugcgccagaccacgcggcccuacagccaggugaacgugcucaacuucaccaccuccuggaccgacggccuggccuucaacgccgugcugcaccgccacaagcccgaccucuucagcugggacaagguggucaagaugucccccaucgagcggcuggagcacgccuucagcaaggcgcagacguaccuggggaucgagaagcuccuggaccccgaggacguggccgugcagcugcccgacaagaaguccaucaucauguaccucaccagccuguucgagguccugccccagcaggucaccaucgacgccauccgcgagguggagacccucccccggaaguacaagaaggagugcgaggaggaggccaucaacauccaguccacggcgcccgaggaggagcacgagagcccccgcgccgagacccccagcaccgucaccgagguggacauggaccuggacuccuaccagaucgcccuggaggaggugcucacguggcugcugagcgccgaggacaccuuccaggagcaggacgacaucuccgacgacgucgaggaggugaaggaccaguucgccacccacgaggcguucaugauggagcucaccgcccaccagagcuccgucggcagcgugcugcaggccggcaaccagcugaucacgcaggggacccucuccgacgaggaggaguucgagauccaggagcagaugacccugcugaacgcccggugggaggcccuccgcguggagagcauggaccggcagucccgccugcacgacguccugauggagcuccagaagaagcagcugcagcagcugagcgcguggcucacccugacggaggagcggauccagaagauggagaccugcccccuggacgacgacgugaagucccugcagaagcuccuggaggagcacaagagccugcaguccgaccucgaggccgagcaggucaaggucaacagccugacccacaugguggugaucgucgacgagaacuccggcgagagcgccaccgccauccuggaggaccagcuccagaagcugggggagcgcuggacggccgugugccgguggaccgaggagcgcuggaaccggcugcaggagaucaacauccucuggcaggagcugcuggaggagcagugccuccugaaggcguggcugaccgagaaggaggaggcccucaacaaggugcagaccuccaacuucaaggaccagaaggagcugagcgucuccgugcgccgccuggccauccucaaggaggacauggagaugaagcggcagacgcuggaccagcugagcgagaucggccaggacgugggccagcuccuggacaacagcaaggccuccaagaagaucaacagcgacuccgaggagcugacccagcgcugggacagccucguccagcggcuggaggacuccagcaaccaggugacccaggccguggcgaagcuggggaugucccagaucccccagaaggaccuccuggagaccguccgcgugcgggagcaggccaucaccaagaaguccaagcaggagcugcccccgccgccgccgcccaagaagcgccagauccacguggacaucgaggccaagaagaaguucgacgccaucuccgcggagcuccugaacuggauccugaaguggaagacggccauccagaccaccgagaucaaggaguacaugaagaugcaggacaccagcgagaugaagaagaagcucaaggcccuggagaaggagcagcgggagcgcaucccccgggccgacgagcugaaccagacgggccagauccucgucgagcagauggggaaggagggccugcccaccgaggagaucaagaacgugcuggagaagguguccagcgaguggaagaacgucucccagcaccucgaggaccuggagcgcaagauccagcugcaggaggacaucaacgccuacuucaagcagcucgacgagcuggagaaggugaucaagaccaaggaggagugggugaagcacaccagcaucuccgagagcucccggcagagccugcccagccucaaggacuccugccagcgcgagcugacgaaccugcucgggcugcaccccaagaucgagauggcgcgggccagcugcuccgcccugaugagccagcccuccgcccccgacuucguccagcgcggcuucgacagcuuccucggccgguaccaggccgugcaggaggcgguggaggaccgccagcagcaccuggagaacgagcugaaggggcagcccggccacgccuaccucgagacccugaagacccugaaggacguccucaacgacuccgagaacaaggcccaggugagccugaacgugcugaacgaccucgccaaggucgagaaggcccugcaggagaagaagacccuggacgagauccucgagaaccagaagccggcgcugcacaagcuggccgaggagacgaaggcccucgagaagaacgugcaccccgacguggagaagcuguacaagcaggaguucgacgacguccaggggaaguggaacaagcugaaggugcucguguccaaggaccugcaccuccuggaggagaucgcccugacccugcgggcguucgaggccgacagcaccgucaucgagaaguggauggacggcgugaaggacuuccucaugaagcagcaggccgcccagggggacgacgccggccugcagcgccagcuggaccagugcuccgcguucgugaacgagaucgagaccaucgagagcucccucaagaacaugaaggagaucgagacgaaccugcggagcggccccgucgccgggaucaagaccugggugcagacccgccugggcgacuaccagacccagcucgagaagcuguccaaggagaucgccacgcagaagucccgccuguccgagagccaggagaaggccgccaaccucaagaaggaccuggcggagaugcaggaguggaugacccaggccgaggaggaguaccuggagcgggacuucgaguacaaguccccggaggagcucgagagcgccguggaggagaugaagcgcgccaaggaggacguccugcagaaggaggugcgggugaagauccugaaggacaacaucaagcuccuggccgcgaagguccccagcgggggccaggagcugaccuccgagcucaacguggugcuggagaacuaccagcugcugugcaaccgcauccgggggaagugccacacccucgaggaggucuggagcugcuggaucgagcugcugcacuaccucgaccuggagacgaccuggcugaacacccucgaggagcgcaugaaguccaccgaggugcugcccgagaagacggacgccgucaacgaggcccuggagagccucgaguccgugcugcggcaccccgccgacaaccgcacccagauccgggagcugggccagacccucaucgacggcgggauccuggacgacaucaucagcgagaagcuggaggcguucaacucccgcuacgaggaccucagccaccuggccgaguccaagcagaucagccuggagaagcagcuccaggugcugcgggagaccgaccagaugcugcagguccuccaggagucccugggcgagcuggacaagcagcucacgaccuaccugaccgaccgcaucgacgccuuccaggugccgcaggaggcccagaagauccaggccgagaucagcgcgcacgagcugacccucgaggagcugcggcgcaacaugcggucccagccccugacgagccccgagucccgcaccgcccgcgggggcagccagauggacgugcuccagcggaagcugcgggaggucuccaccaaguuccagcuguuccagaagcccgccaacuucgagcagcgcaugcucgacugcaagcgggugcuggacggcgugaaggccgagcugcacguccucgacgugaaggacguggacccggacgucauccagacccaccuggacaagugcaugaagcuguacaagacccucagcgaggugaagcuggagguggagacggucaucaagaccgggcgccacaucgugcagaagcagcagaccgacaaccccaagggcauggacgagcagcugaccucccucaaggugcuguacaacgaccugggggcccaggucacggagggcaagcaggaccucgagcgcgcgagccagcuggcccggaagaugaagaaggaggccgccagccuguccgaguggcucagcgccaccgagaccgagcuggugcagaaguccaccagcgaggggcugcucggcgaccuggacacggagaucuccugggcgaagaacgugcugaaggaccucgagaagcgcaaggccgaccugaacaccaucaccgagagcuccgccgcccugcagaaccucaucgagggcagcgagcccauccuggaggagcggcugugcguccucaacgccggguggucccgcgugcggaccuggacggaggacuggugcaacacccugaugaaccaccagaaccagcuggagaucuucgacggcaacguggcgcacaucagcaccuggcucuaccaggccgaggcccugcuggacgagaucgagaagaagcccaccuccaagcaggaggagaucgucaagcgccucgugagcgagcuggacgacgccaaccuccagguggagaacguccgggaccaggcgcucauccugaugaacgcccgcggguccagcucccgggagcugguggagccgaagcucgccgagcugaaccgcaacuucgagaaggugagccagcacaucaaguccgccaagcugcucaucgcccaggagccccuguaccagugccuggucacgaccgagaccuucgagaccggcgugcccuucagcgaccucgagaagcuggagaacgacaucgagaacaugcugaaguucguggagaagcaccucgaguccagcgacgaggacgagaagauggacgaggagagcgcgcagaucgaggagguccugcagcgcggggaggagaugcugcaccagcccauggaggacaacaagaaggagaagauccgccuccagcugcugcuccugcacacgcgguacaacaagaucaaggccaucccgauccagcagcgcaagaugggccagcuggccuccggcauccggagcucccuccugcccaccgacuaccugguggagaucaacaagauccuccugugcauggacgacguggagcugagccucaacguccccgagcugaacaccgccaucuacgaggacuucuccuuccaggaggacagccugaagaacaucaaggaccagcucgacaagcugggggagcagaucgccgugauccacgagaagcagcccgacgugauccuggaggcguccggcccggaggccauccagauccgcgacacccugacgcagcucaacgccaagugggaccggaucaaccgcauguacagcgaccggaaggggugcuucgaccgcgccauggaggaguggcgccaguuccacugcgaccugaacgaccugacccaguggaucaccgaggccgaggagcuccuggucgacacgugcgcgcccggcgggucccuggaccucgagaaggcccggauccaccagcaggagcuggaggugggcaucagcucccaccagcccagcuucgccgcccugaaccgcacgggcgacgggaucgugcagaagcucucccaggcggacggcagcuuccugaaggagaagcuggccgggcucaaccagcggugggacgccaucgucgccgaggugaaggaccgccagccccggcugaagggcgaguccaagcaggucaugaaguaccgccaccagcuggacgagaucaucugcuggcucaccaaggccgagcacgcgaugcagaagcggagcaccaccgagcugggggagaaccugcaggagcuccgcgaccugacgcaggagauggagguccacgccgagaagcugaaguggcucaaccggaccgagcuggagaugcuguccgacaagagccucucccugccggagcgcgacaagaucagcgagagccugcggaccgugaacaugaccuggaacaagaucugccgcgaggugcccacgacccucaaggagugcauccaggagcccuccagcgucucccagacccggaucgccgcccacccgaacgugcagaaggugguccuggugagcuccgccagcgacauccccguccagucccaccgcaccagcgagaucuccauccccgcggaccuggacaagaccaucacggagcucgccgacuggcuggugcugaucgaccagaugcucaagagcaacaucgugaccgucggcgacguggaggagaucaacaagaccgugucccggaugaagaucaccaaggccgaccuggagcagcgccacccccagcuggacuacgucuucacgcucgcccagaaccugaagaacaaggccagcuccagcgacaugcggaccgcgaucaccgagaagcuggagcgcgugaagaaccagugggacggcacccagcacgggguggagcuccggcagcagcagcuggaggacaugaucaucgacucccugcagugggacgaccaccgcgaggagacggaggagcucaugcggaaguacgaggcccgccuguacauccugcagcaggcccgccgggacccgcucaccaagcagaucagcgacaaccagauccugcugcaggagcucggccccggggacggcaucgucauggccuucgacaacgugcugcagaagcugcucgaggaguacggcuccgacgacacccgcaacgugaaggagaccacggaguaccugaagaccagcuggaucaaccugaagcaguccaucgcggaccggcagaacgcccucgaggccgaguggcgcaccguccaggccagccggcgcgaccuggagaacuuccugaaguggauccaggaggccgagaccacggugaacgugcucgucgacgcgagccaccgggagaacgcccugcaggacuccauccuggcccgcgagcucaagcagcagaugcaggacauccaggccgagaucgacgcccacaacgacaucuucaagagcaucgacgggaaccggcagaagauggugaaggcgcugggcaacuccgaggaggccaccaugcugcagcaccgccucgacgacaugaaccagcgguggaacgaccugaaggccaagagcgccuccauccgcgcccaccuggaggcgagcgccgagaaguggaaccggcuccugaugucccuggaggagcucaucaaguggcugaacaugaaggacgaggagcugaagaagcagaugcccaucgggggcgacgugcccgcccuccagcugcaguacgaccacugcaaggcccugcgccgggagcucaaggagaaggaguacagcguccugaacgccguggaccaggcgcgcguguuccuggccgaccagccgaucgaggcccccgaggagccccggcgcaaccuccaguccaagaccgagcugacccccgaggagcgggcccagaagaucgcgaaggccaugcgcaagcagagcuccgaggucaaggagaagugggagagccugaacgccgugacguccaacuggcagaagcaggucgacaaggcccucgagaagcugcgcgaccugcagggggccauggacgaccucgacgcggacaugaaggaggccgagagcguccggaacggcuggaagccggugggcgaccugcugaucgacucccuccaggaccacaucgagaagaucauggccuuccgcgaggagaucgcccccaucaacuucaaggugaagaccgucaacgaccugagcucccagcugagcccccucgaccugcaccccagccugaagaugucccggcagcucgacgaccugaacaugcgcuggaagcugcuccaggugagcguggacgaccggcugaagcagcugcaggaggcccaccgcgacuucgggccguccagccagcacuuccuguccaccagcguccagcuccccuggcagcgguccaucagccacaacaaggugcccuacuacaucaaccaccagacccagacgaccugcugggaccaccccaagaugaccgagcuguuccagucccuggcggaccucaacaacgugcgcuucagcgccuaccggaccgccaucaagauccgccggcugcagaaggcccugugccucgaccugcuggagcucuccacgaccaacgagaucuucaagcagcacaagcugaaccagaacgaccagcugcucagcgucccggacgugaucaacugccugaccaccacguacgacggccuggagcagaugcacaaggaccucgugaacgucccccugugcguggacaugugccugaacuggcuccugaacguguacgacaccgggcgcaccggcaagauccggguccagucccugaagaucgggcucaugagccuguccaagggccugcucgaggagaaguaccgcuaccuguucaaggagguggccggccccaccgagaugugcgaccagcggcagcuggggcuccugcugcacgacgcgauccagaucccccgccagcucggcgagguggccgccuucgggggcagcaacaucgagccguccguccggagcugcuuccagcagaacaacaacaagcccgagaucuccgugaaggaguucaucgacuggaugcaccuggagccccagagcaugguguggcugcccguccuccaccgcguggccgcggccgagacggccaagcaccaggccaagugcaacaucugcaaggagugcccgaucgugggguuccgguaccgcagccugaagcacuucaacuacgacgucugccaguccugcuucuucagcggccggaccgccaagggccacaagcugcacuaccccaugguggaguacugcauccccaccaccuccggggaggacgugcgcgacuucacgaagguccucaagaacaaguuccgcagcaagaaguacuucgcgaagcacccgcggcugggcuaccugcccgugcagaccguccucgagggggacaaccuggagacccccaucacccugaucuccauguggcccgagcacuacgacccgagccagagcccccagcuguuccacgacgacacccacagccgcaucgagcaguacgccacgcggcuggcccagauggagcgcaccaacggcuccuuccugaccgacagcuccagcaccacgggcuccguggaggacgagcacgcccucauccagcaguacugccagacccucgggggcgagagccccgugucccagccccagagcccggcccagauccugaaguccgucgagcgggaggagcgcggggagcucgagcggaucaucgcggaccuggaggaggagcagcgcaaccuccagguggaguacgagcagcucaaggaccagcaccuccggcgcggccugcccgugggguccccgcccgaguccaucaucagcccgcaccacaccagcgaggacuccgagcucaucgccgaggccaagcugcugcggcagcacaagggccgccucgaggcccggaugcagauccuggaggaccacaacaagcagcuggagagccagcuccaccgccugcggcagcugcucgagcagcccgaguccgacagccgcaucaacggcgucucccccugggccagcccccagcacuccgcgcugagcuacucccuggacccggacgccagcgggccccaguuccaccaggccgccggcgaggaccuccuggcgccgccccacgacaccuccacggaccugaccgaggugauggagcagauccacagcaccuucccguccugcugccccaacgugcccagccggccccaggccauguga

SEQ ID NO: 38539 - RNA, 360 nt, Artificial Sequence
  derived and/or modified sequence opt1 from UTS2B__Homo_sapiens__NP_937795
augaacaagauccugagcuccaccgugugcuucggccuccugacccugcucagcguccuguccuuccugcagagcgugcacgggcgccccuaccucacgcagggcaacgagaucuucccggacaagaaguacaccaaccgggaggagcugcugcucgcccugcugaacaagaacuucgacuuccagcgccccuucaacaccgaccucgcccugcccaacaagcuggaggagcucaaccagcuggagaagcugaaggagcagcucguggaggagaaggacuccgagaccagcuacgcggucgacgggcuguucuccagccaccccuccaagcgggccugcuucuggaaguacugcguguga

SEQ ID NO: 38540 - RNA, 420 nt, Artificial Sequence
  derived and/or modified sequence opt1 from UTS2__Homo_sapiens__XP_011538839
auggagaccaacguguuccaccugaugcucugcgucaccagcgcccgcacgcacaaguccaccagccugugcuucggccacuucaacuccuaccccagccugccgcucauccacgaccugcugcucgagaucuccuuccagcugagcgcgccccacgaggacgcccggcugacccccgaggagcucgagcgcgccucccugcugcagauccuccccgagaugcugggggccgagcggggcgacauccugcgcaaggccgacagcuccaccaacaucuucaacccgcgggggaaccuccgcaaguuccaggacuucagcggccaggaccccaacauccugcugucccaccuccuggcccggaucuggaagcccuacaagaagcgcgagacgcccgacugcuucuggaaguacugcguguga

SEQ ID NO: 38541 - RNA, 1170 nt, Artificial Sequence
  derived and/or modified sequence opt1 from UTS2R__Homo_sapiens__NP_061822
auggcccugacccccgagagcccguccagcuuccccggccucgccgcgaccggguccagcgugcccgagcccccgggcgggcccaacgccacgcugaacuccagcugggccucccccaccgagcccagcucccuggaggaccucgucgccaccggcaccaucgggacgcugcugagcgccaugggcguggugggcgucguggggaacgcguacacccucguggugaccugccgcucccugcgggccgucgccagcauguacguguacgucgugaaccuggcccucgcggaccugcuguaccuccuguccaucccguucaucguggccaccuacgucacgaaggaguggcacuucggcgacguggggugccgcgugcuguucggccucgacuuccugaccaugcacgccagcaucuucacccugaccgucauguccagcgagcgguacgccgccgugcuccgcccccuggacacggugcagcggcccaagggguaccgcaagcugcucgcgcugggcaccuggcugcucgcccugcugcucacccugcccgucaugcuggccaugcggcucgugcgccggggcccgaagucccugugccugcccgccugggggccccgcgcccaccgggcguaccucacccugcuguucgccacgagcaucgccggccccgggcuccugaucggccugcucuacgcccgccuggcccgggcguaccgccggucccagcgcgccagcuucaagcgggcccgccggccgggcgcccgcgcccugcggcucgugcuggggaucguccugcuguucugggcgugcuuccugcccuucuggcuguggcagcuccuggcccaguaccaccaggcgccccuggcgccccgcaccgcccgcaucgugaacuaccugacgaccugccucaccuacggcaacagcugcgccaacccguuccuguacacccugcucacccggaacuaccgcgaccaccuccgggggcgcgugcggggccccggguccggcggcgggcgcggccccguccccagccugcagccgcgggcccgcuuccagcggugcuccgggcgcagccucuccagcugcagcccccagcccaccgacucccuggugcuggcccccgccgccccggcccggcccgcccccgagggcccgcgcgcccccgccuga

SEQ ID NO: 38542 - RNA, 4179 nt, Artificial Sequence
  derived and/or modified sequence opt1 from UTY__Homo_sapiens__NP_001245181
augaaguccugcgccgugagccugaccaccgccgcggucgccuucggcgacgaggccaagaagauggccgaggggaaggccagccgcgaguccgaggaggagagcgugucccucacgguggaggagcgggaggcgcugggcgggauggacagccgccuguucggcuucguccggcuccacgaggacggggcccgcaccaagacccugcugggcaaggccgugcggugcuacgagucccucauccugaaggccgagggcaagguggagagcgacuucuucugccagcuggggcacuucaaccuccugcuggaggacuacuccaaggcgcucagcgccuaccagcgcuacuacucccugcaggccgacuacuggaagaacgccgccuuccuguacggccucgggcuggucuacuucuacuacaacgcguuccacugggccaucaaggccuuccaggacgugcuguacguggaccccagcuucugccgggccaaggagauccaccuccgccugggccugauguucaaggucaacaccgacuacaaguccagccucaagcacuuccagcuggcccugaucgacugcaacccgugcacgcucuccaacgcggagauccaguuccacaucgcccaccuguacgagacccagcggaaguaccacagcgccaaggaggccuacgagcagcugcuccagaccgagaaccugcccgcccaggugaaggcgaccgugcugcagcagcucggguggaugcaccacaacauggaccuggucggcgacaaggccacgaaggaguccuacgccauccaguaccugcagaagucccucgaggccgaccccaacagcggccagagcugguacuuccuggggcgcugcuacagcuccaucggcaaggugcaggacgccuucaucagcuaccggcaguccaucgacaagagcgaggcguccgccgacaccuggugcagcaucggggugcuguaccagcagcagaaccagcccauggacgcccuccaggccuacaucugcgcgguccagcuggaccacggccacgccgccgccuggauggaccugggcacccucuacgaguccugcaaccagccgcaggacgccaucaagugcuaccugaacgcggcccgcagcaagcggugcuccaacaccagcacgcuggccgcccgcaucaaguuccuccaggcccagcugugcaaccugccccaguccagccuccagaacaagaccaagcugcugcccuccaucgaggaggcguggagccuccccaucccggccgagcugaccucccggcagggggccaugaacaccgcccagcagaacggcagcgacaacuggaacgggggccagucccugagccaccaccccgugcagcaggucuacucccugugccucacgccccagaagcugcagcaccuggagcagcuccgcgccaaccgggacaaccugaaccccgcgcagaagcaccagcuggagcagcucgagagccaguucgugcugaugcagcagaugcgccacaaggagguggcccaggugcggaccaccgggauccacaacggcgccaucaccgacagcucccugccgacgaacagcgucuccaaccgccagccccacggcgcccucacccgggugagcuccgugagccagcccgggguccgccccgcgugcguggagaagcugcuguccagcggcgccuucuccgccgggugcaucccgugcggcaccagcaagauccucggguccaccgacacgauccugcugggcagcaacugcaucgccggcuccgagagcaacgggaacguccccuaccuccagcagaacacccacacccugccccacaaccacaccgaccugaacuccagcacggaggagcccuggcgcaagcagcucuccaacagcgcccagggccugcacaagagccaguccagcugccuguccgggccgaacgaggagcagccccucuucagcaccggcuccgcgcaguaccaccaggccaccagcaccgggaucaagaaggccaacgagcaccugacgcugcccuccaacagcgugccccagggcgacgccgacucccaccucagcugccacaccgccaccuccggcgggcagcagggcaucauguucaccaaggagagcaagccguccaagaaccggagccuggugcccgagacgucccgccacaccggggacaccagcaacggcugcgcggacgucaagggccuguccaaccacgugcaccagcucaucgccgacgccgugagcucccccaaccacggggacagccccaaccugcugaucgccgacaacccgcagcucagcgcccugcugaucggcaaggcgaacgggaacgucggcaccgggaccugcgacaaggugaacaacauccaccccgccgugcacacgaagaccgaccacuccgucgccagcucccccagcuccgccaucagcaccgcgaccccgucccccaagagcacggagcagcgguccaucaacagcgugaccucccucaacagcccccacuccggccugcacaccgugaacggcgaggggcugggcaagagccaguccagcaccaaggucgaccucccccuggccucccaccgcagcacgucccagauccugccgagcaugagcguguccaucugccccagcuccaccgaggugcucaaggccugccggaaccccgggaagaacggccugagcaacuccugcauccugcucgacaagugcccgccgccccggccgcccaccagccccuacccgccccugcccaaggacaagcugaacccgcccacccccuccaucuaccucgagaacaagcgcgacgccuucuucccgccccugcaccaguucugcacgaaccccaagaaccccgucaccgugauccgcgggcuggccggcgcgcucaagcuggaccugggccucuucagcaccaagacccugguggaggccaacaacgagcacauggucgaggugcggacgcagcugcuccagcccgccgacgagaacugggaccccaccgggaccaagaagaucuggcgcugcgaguccaaccggagccacaccacgaucgccaaguacgcccaguaccaggcguccagcuuccaggagucccugcgcgaggagaacgagaagcggacccagcacaaggaccacagcgacaacgaguccaccagcuccgagaacagcggccgccggcgcaaggggcccuucaagaccaucaaguucggcacgaacaucgaccuguccgacaacaagaaguggaagcuccagcugcacgagcugaccaagcuccccgccuucgcccggguggucagcgccgggaaccugcugacccacgugggccacaccauccucggcaugaacacggugcagcuguacaugaagguccccgggagccgcacccccggccaccaggagaacaacaacuucugcuccgugaacaucaacaucgggcccggcgacugcgagugguucgugguccccgaggacuacuggggcgugcugaacgacuucugcgagaagaacaaccucaacuuccugaugagcuccugguggccgaaccuggaggaccucuacgaggccaacgugcccgucuaccgguucauccagcgccccggggaccugguguggaucaacgcgggcaccgugcacuggguccaggccgugggguggugcaacaacaucgccuggaacgugggcccccugaccgccugccaguacaagcucgccgucgagcgcuacgaguggaacaagcucaagagcgugaaguccccggugcccaugguccaccugagcuggaacauggcgcggaacaucaagguguccgaccccaagcuguucgagaugaucaaguacugccugcugaagauccucaagcaguaccagacgcugcgcgaggcccugguggccgccgggaaggaggucaucuggcacggccggaccaacgacgagcccgcgcacuacugcagcaucugcgagguggagguguucaaccuccuguucgucaccaacgaguccaacacccagaagacguacaucgugcacugccacgacugcgcccgcaagaccagcaagucccuggagaacuucgugguccucgagcaguacaagauggaggaccugauccagguguacgaccaguucacccuggcccucagccuguccagcuccagcuga

SEQ ID NO: 38543 - RNA, 2100 nt, Artificial Sequence
  derived and/or modified sequence opt1 from UVRAG__Homo_sapiens__NP_003360
augagcgccuccgccagcgugggcgggcccgucccgcagcccccgcccggccccgcggccgcccugccgcccggguccgccgcccgcgcgcuccacguggagcugcccagccagcagcggcgccugcggcaccuccgcaacaucgccgcccggaacaucgugaaccgcaacggccaccagcugcuggacaccuacuucacccuccaccugugcuccacggagaagaucuacaaggaguucuaccggagcgaggucaucaagaacucccugaaccccaccuggcgcagccucgacuucgggaucaugcccgaccggcuggacaccuccgugagcugcuucguggucaagaucuggggcggcaaggagaacaucuaccagcugcucaucgaguggaaggugugccuggacgggcugaaguaccucggccagcagauccacgcccgcaaccagaacgagaucaucuucgggcugaacgacggcuacuacggggcgcccuucgagcacaagggcuacuccaacgcccagaagaccauccugcuccagguggaccagaacugcguccggaacagcuacgacguguucucccugcugcgccuccaccgggcccagugcgccaucaagcagacccaggugaccguccagaagaucggcaaggagaucgaggagaagcugcgccugaccagcaccuccaacgagcucaagaagaaguccgagugccugcagcugaagauccucgugcugcagaacgagcuggagcggcagaagaaggcccucgggcgcgagguggcgcugcugcacaagcagcagaucgcccuccaggacaagggcagcgccuucagcgccgagcaccugaagcugcagcuccagaaggagucccugaacgagcugcggaaggagugcacggccaagcgcgagcuguuccugaagaccaacgcgcagcugaccauccggugccgccagcuccugagcgagcugagcuacaucuaccccaucgaccucaacgagcacaaggacuacuucgucugcggggugaagcugccgaacuccgaggacuuccaggccaaggacgacggcagcaucgccguggcccugggcuacaccgcccaccucgucuccaugaucagcuucuuccuccaggugccccugcgguaccccaucauccacaaggggucccgcagcacgaucaaggacaacaucaacgacaagcugaccgagaaggagcgcgaguucccccucuacccgaagggcggggagaagcugcaguucgacuacggcguguaccugcucaacaagaacaucgcgcagcugcgguaccagcacgggcugggcacccccgaccuccgccagacccugcccaaccugaagaacuucauggagcacggccucaugguccggugcgaccgccaccacacguccagcgccauccccgugccgaagcggcaguccagcaucuucgggggcgccgacgugggguucuccggcgggauccccagccccgacaagggccaccgcaagcgggccuccagcgagaacgagcgccugcaguacaagacgcccccgcccuccuacaacagcgcccuggcgcagcccgucaccaccgugcccuccaugggcgagacggagcggaagaucaccagccucuccagcagccuggacaccucccuggacuucagcaaggagaacaagaagaagggggaggaccucgucggcucccugaacgggggccacgccaacgugcacccgagccaggagcagggggaggcccuguccggccaccgcgccaccgugaacggcacgcuccugcccagcgagcaggcgggguccgccagcguccagcugcccggcgaguuccacccgguguccgaggccgagcucugcugcaccguggagcaggccgaggagaucaucgggcuggaggccaccggcuucgcgagcggcgaccagcuggaggccuucaacugcauccccgucgacuccgccguggccguggagugcgacgagcagguccucggggaguucgaggaguucagccggcgcaucuacgcccugaacgagaacguguccagcuuccggcgcccccggcgcuccagcgacaaguga

SEQ ID NO: 38544 - RNA, 2457 nt, Artificial Sequence
  derived and/or modified sequence opt1 from UVSSA__Homo_sapiens__XP_011511824
augcagggccacgcccacccgcccgagaaggagacccccgcccgccggcgccggcccccgcccugcacccagccccgcgagcccagccgggcguccgcccugcgcgggcucugccgggcgccccgcgaguggggcccgcaccacgccccgcccaagccccgguuccccaagcgcgggcuccaggugcggcccagcgccgcggaccuggcccuccccugcguccgcggcugcgggcugcggcgccaggacggccggcgccugugcuucuccuuccggcccggcccggcccgcgcccagggguaccuccugugcguguggcggcgcgacauggaccagaagcugagcaagcucguggaggagcugacgaccuccggcgagccccggcugaaccccgagaagaugaaggagcucaagaagaucugcaagagcuccgaggagcagcugagccgcgcguaccgccugcucaucgcccagcugacccaggagcacgccgagauccggcuguccgccuuccagaucgucgaggagcuguucgugcgcagccaccaguuccggaugcugguggucuccaacuuccaggaguuccuggagcucacccuggggacggaccccgcccagccgcugcccccgccccgcgaggcggcccagcggcuccgccaggccaccacccgggccguggagggcuggaacgagaaguucggggaggccuacaagaagcuggcgcugggcuaccacuuccuccgccacaacaagaagguggacuuccaggacaccaacgcccggagccuggccgagcgcaagcgggaggaggagaagcagaagcaccucgacaagaucuaccaggagcgcgccucccaggccgagcgggagaugcaggagaugagcggcgagaucgaguccugccugacggaggucgagagcugcuuccgccugcuggugcccuucgacuucgaccccaaccccgagaccgagucccucgggauggcgagcggcauguccgacgcccugcggagcagcugcgccggccagguggggcccugccgcuccggcaccccggacccccgggacggggagcagcccugcugcagccgcgaccugccggccuccgccggccacccccgggccgggggcggggcccagcccagccagaccgccacgggcgaccccuccgacgaggacgaggacagcgaccucgaggaguucguccgcucccacggccuggggagccacaaguacacccuggacguggagcucugcuccgagggccugaaggugcaggagaacgaggacaaccuggcccucauccacgcggcccgcgacacccugaagcugauccggaacaaguuccucccggccgucugcagcuggauccagcgcuucacccggguggggacgcacggcgggugccugaagcgcgccaucgaccugaaggccgagcucgagcuggugcugcggaaguacaaggagcuggacaucgagcccgagggcggcgagcgccggcgcaccgaggcgcucggggacgccgaggaggacgaggacgacgaggacuucgucgaggugcccgagaaggagggcuacgagccccacaucccggaccaccuccgccccgaguacgggcuggaggccgcccccgagaaggacaccgugguccggugccugcggacccgcacgcggauggacgaggagguguccgaccccaccagcgccgcggcccagcugcgccagcugcgggaccaccucccgccgcccuccagcgccucccccagccgcgcccugcccgagccccaggaggcccagaagcuggcggccgagcgggcccgcgcccccgugguccccuacggcguggaccuccacuacugggggcaggagcugccgaccgcgggcaagaucgucaaguccgacagccagcaccgguucuggaagcccuccgagguggaggaggagguggucaacgccgacaucagcgagaugcugcgcagccggcacaucaccuucgccggcaaguucgagcccgugcagcacuggugccgcgcgccccgcccggacgggcggcucugcgagcgccaggaccggcugaagugccccuuccacggcaagaucgugccccgcgacgacgaggggcggccgcuggaccccgaggaccgcgcccgggagcagcgccggcagcuccagaagcaggagcgccccgaguggcaggaccccgagcugaugcgggacgucgaggccgccacgggccaggaccugggcuccagccgcuacuccgggaagggccgggggaagaagcgccgguacccgagccucaccaaccugaaggcccaggccgacaccgcccgcgcgcggaucggccgcaagguguucgccaaggccgccgugcggcgcgucguggccgcgaugaaccgcauggaccagaagaagcacgagaaguucuccaaccaguucaacuacgcccugaacuga

SEQ ID NO: 38545 - RNA, 1278 nt, Artificial Sequence
  derived and/or modified sequence opt1 from UXS1__Homo_sapiens__NP_001240804
auggugagcaaggcccugcuccgccuggucuccgccgugaaccggcgccggaugaagcugcuccugggcaucgcgcugcucgccuacguggccagcgucugggggaacuucgugaacauguccuuccugcugaaccgcagcauccaggagaacggcgagcucaagaucgaguccaagaucgaggagaugguggagccccugcgggagaagauccgcgaccuggagaaguccuucacccagaaguacccgcccgucaaguuccucagcgagaaggaccggaagcgcauccugaucaccgggggcgccggguucgugggcagccaccugacggacaagcucaugauggacggccacgaggugaccgucguggacaacuucuucaccgggcggaagcgcaacguggagcacuggaucggccacgagaacuucgagcugaucaaccacgacgucguggagccccuguacaucgagguggaccagaucuaccaccucgccucccccgcgagcccgcccaacuacauguacaaccccaucaagacccugaagacgaacaccaucgggacccugaacaugcucggccuggccaagcgggucggggcccgccugcuccuggccuccaccagcgagguguacggcgaccccgaggugcacccgcaguccgaggacuacuggggccacgucaaccccaucgggccccgggcgugcuacgacgagggcaagcgcguggccgagacgaugugcuacgccuacaugaagcaggaggggguggagguccggguggcccgcaucuucaacaccuucggcccccggaugcacaugaacgacggccgcguggucagcaacuucauccugcaggcccuccagggggagccgcugaccguguacggcuccgggagccagacccgggcguuccaguacgucuccgaccuggugaacggccucguggcccugaugaacagcaacgucuccagccccgugaaccuggggaaccccgaggagcacacgauccucgaguucgcccagcugaucaagaaccuggugggcagcggcuccgagauccaguuccucagcgaggcccaggacgacccccagaagcgcaagccggacaucaagaaggccaagcugaugcuggggugggagcccgucgugccccucgaggagggccugaacaaggcgauccacuacuuccggaaggagcuggaguaccaggccaacaaccaguacauccccaagccgaagcccgcccgcaucaagaaggggcgcacccggcacuccuga

SEQ ID NO: 38546 - RNA, 474 nt, Artificial Sequence
  derived and/or modified sequence opt1 from UXT__Homo_sapiens__NP_004173
auggccacgcccccgaagcgccgggccguggaggcgaccggcgagaagguccugcgcuacgagaccuucaucagcgacgugcuccagcgggaccugcgcaaggugcuggaccaccgggacaaggucuacgagcagcucgccaaguaccugcagcugcgcaacgugaucgagcggcuccaggaggccaagcacuccgagcuguacaugcaggucgaccuggggugcaacuucuucguggacaccguggugcccgacaccagccgcaucuacgucgcccucggcuacggguucuuccuggagcugacccucgccgaggcgcugaaguucaucgaccggaaguccagccugcucacggagcuguccaacagccugaccaaggacuccaugaacaucaaggcccacauccacaugcuccuggagggccugcgcgagcuccaggggcugcagaacuuccccgagaagccccaccacuga

SEQ ID NO: 38547 - RNA, 2349 nt, Artificial Sequence
  derived and/or modified sequence opt1 from VAC14__Homo_sapiens__NP_060522
augaaccccgagaaggacuucgccccgcugacccccaacaucgugcgcgcccucaacgacaagcuguacgagaagcggaaggucgcggcccuggagaucgagaagcucgugcgcgaguucguggcccagaacaacaccguccagaucaagcacgugauccagacgcugagccaggaguucgcccugucccagcacccccacagccggaagggcgggcucaucggccuggccgcgugcuccaucgcccuggggaaggacagcggccucuaccugaaggagcugaucgagcccgugcugaccugcuucaacgacgccgacucccgccugcgguacuacgccugcgaggcgcuguacaacaucgucaagguggcccgcggggccgugcucccgcacuucaacguccuguucgacggccugagcaagcucgccgccgaccccgaccccaacgugaaguccggcagcgagcugcuggaccggcuccugaaggacaucgugaccgaguccaacaaguucgaccuggucagcuucaucccccuccugcgcgagcggaucuacuccaacaaccaguacgcgcgccaguucaucaucagcuggauccuggugcucgaguccgugccggacaucaaccugcuggacuaccuccccgagauccuggacgggcuguuccagauccucggcgacaacgggaaggagauccggaagaugugcgaggucgugcugggcgaguuccugaaggagaucaagaagaaccccagcuccgugaaguucgccgagauggccaacauccucgucauccacugccagaccacggacgaccugauccagcugaccgccaugugcuggaugcgcgaguucauccagcucgccgggcgggugaugcugcccuacagcuccggcauccugaccgcggugcucccgugccuggccuacgacgaccgcaagaaguccaucaaggaggucgccaacgugugcaaccagagccugaugaagcucgugacccccgaggacgacgagcuggacgagcugcggcccggccagcgccaggccgagcccacgccggacgacgcccuccccaagcaggaggggaccgcgagcggcgggcccgacggcagcugcgacuccagcuucuccagcggcaucuccgucuucaccgccgccagcaccgagcgggcccccgugacgcugcaccuggacgggaucguccaggugcugaacugccaccucuccgacaccgccaucggcaugaugacccgcaucgcggugcugaaguggcuguaccaccucuacaucaagaccccgcggaagauguuccgccacacggacagccuguuccccauccugcuccagacccuguccgacgagagcgacgaggucauccugaaggaccucgaggugcuggccgagaucgccuccagccccgccgggcagaccgacgaccccggcccgcuggacgggcccgaccuccaggcgucccacagcgagcuccaggugcccacccccggccgggccggccugcucaacacguccgggaccaagggccuggagugcagcccguccacccccaccaugaacagcuacuucuacaaguucaugaucaaccugcucaagcgcuucuccagcgagcgcaagcugcuggagguccgggggcccuucaucauccgccagcucugccugcugcucaacgccgagaacaucuuccacagcauggccgacauccugcugcgggaggaggaccucaaguucgccuccacgauggugcacgcgcugaacaccauccugcucaccagcaccgagcuguuccagcugcgcaaccagcucaaggaccugaagacgcuggagucccagaaccucuucugcugccuguaccggagcuggugccacaacccggugaccaccgucucccugugcuuccucacccagaacuaccgccacgccuacgaccugauccagaaguucggcgaccuggaggugacgguggacuuccucgccgaggucgacaagcuggugcagcugaucgagugccccaucuucaccuaccuccggcugcagcugcucgacgugaagaacaaccccuaccugaucaaggcccuguacgggcuccugaugcugcucccccagagcuccgccuuccagcugcugagccaccgccuccagugcgucccgaaccccgagcugcugcagaccgaggacucccucaaggcggcccccaagagccagaaggccgacucccccagcaucgacuacgccgagcugcugcagcacuucgagaaggugcagaacaagcaccucgaggugcggcaccagcgcuccggccggggcgaccaccuggaccgccgggucgugcuguga

SEQ ID NO: 38548 - RNA, 351 nt, Artificial Sequence
  derived and/or modified sequence opt1 from VAMP1__Homo_sapiens__NP_001284367
augagcgcccccgcccagccgcccgcggagggcaccgaggggaccgcccccggcgggggccccccggggcccccccccaacaugacguccaaccgccggcugcagcagacccaggcccagguggaggaggucguggacaucauccgcgugaacgucgacaaggugcucgagcgggaccagaagcugagcgagcuggacgaccgcgccgacgcccuccaggcgggcgccucccaguucgagagcuccgccgccaagcugaagcggaaguacugguggaagaacugcaagaugaugaucaugcugggcgcgaucugcgccaucaucguggucgugaucgugcgccggggguga

SEQ ID NO: 38549 - RNA, 351 nt, Artificial Sequence
  derived and/or modified sequence opt1 from VAMP2__Homo_sapiens__NP_055047
augagcgccaccgccgcgaccgcccccccggccgcccccgccggcgaggggggcccccccgcgccgccccccaaccugacguccaaccgccggcuccagcagacccaggcccagguggacgaggucguggacaucaugcgcgugaacgucgacaaggugcuggagcgggaccagaagcugagcgagcucgacgaccgcgccgacgcccugcaggcgggggccucccaguucgagaccagcgccgccaagcugaagcggaaguacugguggaagaaccucaagaugaugaucauccugggcgugaucugcgccaucauccugaucaucaucaucgucuacuucuccaccuga

SEQ ID NO: 38550 - RNA, 423 nt, Artificial Sequence
  derived and/or modified sequence opt1 from VAMP4__Homo_sapiens__NP_001172056
augcccccgaaguucaagcgccaccugaacgacgacgacgugaccggcagcgucaaguccgagcggcgcaaccuccuggaggacgacagcgacgaggaggaggacuucuuccuggggcccuccggcccccgguucgggccccgcaacgacaagaucaagcacgugcagaaccagguggacgaggucaucgacgugaugcaggagaacaucaccaaggugaucgagcggggcgagcgccucgacgagcugcaggacaagagcgagucccugagcgacaacgccacggccuucuccaaccggagcaagcagcuccgccggcagaugugguggcgcgggugcaagaucaaggcgaucauggcccuggucgccgccauccugcuccuggugaucaucauccugaucgugaugaaguaccggaccuga

SEQ ID NO: 38551 - RNA, 540 nt, Artificial Sequence
  derived and/or modified sequence opt1 from VAMP7__Homo_sapiens__NP_001138621
auggccauccuguucgccguggucgcgcgcggcaccaccauccucgccaagcacgccuggugcgggggcaacuuccuggaggacuucgagcggagccgcgccuucaacuuccugaacgagaucaagaagcgguuccagacgaccuacgggucccgcgcccagaccgcgcuccccuacgccaugaacagcgaguucuccagcgugcuggccgcccagcugaagcaccacuccgagaacaagggccucgacaaggugauggagacccaggcgcaggucgacgagcugaaggggaucauggugcggaacaucgaccugguggcccagcgcggcgagcggcucgagcugcugaucgacaagacggagaaccucgucgacagcuccgugaccuucaagaccaccagccgcaaccuggcccgggccaugugcaugaagaaccugaagcucacgaucaucaucaucaucguguccaucgucuucaucuacaucaucgugagcccgcugugcggcggguucaccuggcccuccugcgugaagaaguga

SEQ ID NO: 38552 - RNA, 303 nt, Artificial Sequence
  derived and/or modified sequence opt1 from VAMP8__Homo_sapiens__NP_003752
auggaggaggccagcgagggcgggggcaacgaccgcgugcggaaccugcaguccgaggucgagggggugaagaacaucaugacccagaacguggagcgcauccucgcccggggcgagaaccuggagcaccuccgcaacaagaccgaggaccucgaggcgacgagcgagcacuucaagaccaccucccagaaggucgcccggaaguucugguggaagaacgugaagaugaucgugcugaucugcgucaucguguucaucaucauccuguucaucgugcuguucgccaccggggccuucagcuga

SEQ ID NO: 38553 - RNA, 1566 nt, Artificial Sequence
  derived and/or modified sequence opt1 from VANGL2__Homo_sapiens__NP_065068
auggacaccgagagccaguacuccggcuacagcuacaaguccgggcacagccgcuccagccggaagcaccgcgaccggcgcgaccggcaccgcuccaagagccgggacggcgggcgcggcgacaaguccgugaccauccaggcccccggggagccgcugcucgacaacgagagcacgcggggcgacgagcgcgacgacaacuggggcgagaccaccaccgucgugacggggaccuccgagcacagcaucucccacgacgaccugacccggaucgccaaggacauggaggacagcgugccccuggacugcucccgccaccucggcgucgcggccggggccacccuggcccugcucagcuuccugacgccccuggccuuccuccugcugcccccgcuccuguggcgggaggagcuggagcccugcggcaccgcgugcgaggggcuguucaucuccguggccuucaagcugcugauccuccugcugggcagcugggcccucuucuuccgccggcccaaggccucccugccccgcguguucguccugcgggcgcuccugauggugcugguguuccuccuggucgugagcuacuggcuguucuacggcgugcgcauccucgacgcccgggagcgcagcuaccagggggucgugcaguucgccgugucccuggucgacgcccuccucuucgugcacuaccuggccgugguccugcucgagcugcggcagcugcagccgcaguucacccucaagguggugcgcagcaccgacggcgcgucccgcuucuacaacgucgggcaccugagcauccagcggguggccguguggauccuggagaaguacuaccacgacuuccccgucuacaaccccgcccuccugaaccugcccaaguccgugcucgccaagaaggucagcggcuucaagguguacucccugggcgaggagaacagcacgaacaacuccaccgggcagagccgcgccgugaucgcggccgccgcccggcgccgggacaacucccacaacgaguacuacuacgaggaggccgagcacgagcgccggguccgcaagcggcgcgcgcggcuggugguggccgucgaggaggccuucacccacaucaagcgccuccaggaggaggagcagaagaacccgcgggaggugauggacccccgcgaggccgcccaggcgaucuucgccagcauggcccgggccaugcagaaguaccugcgcaccacgaagcagcagcccuaccacaccauggaguccauccugcagcaccuggaguucugcaucacccacgacaugacccccaaggcguuccucgagcgguaccuggccgccggcccgacgauccaguaccacaaggagcgcuggcuggccaagcaguggacccucgugagcgaggagcccgucaccaacgggcugaaggacggcaucguguuccugcucaagcggcaggacuucucccugguggucagcaccaagaaggugcccuucuucaagcuguccgaggaguucguggaccccaagagccacaaguucgucaugcgccuccaguccgagacgagcguguga

SEQ ID NO: 38554 - RNA, 885 nt, Artificial Sequence
  derived and/or modified sequence opt1 from VAPA__Homo_sapiens__NP_003565
auggccagcgccuccggcgcgauggccaagcacgagcagauccuggugcucgacccgcccaccgaccugaaguucaaggggcccuucaccgacgucgugacgaccaaccugaagcuccgcaaccccagcgaccggaaggugugcuucaaggucaagaccaccgcgccccgccgguacugcgugcgcccgaacuccggcaucaucgaccccgggagcacggugaccgucuccgugaugcugcagcccuucgacuacgaccccaacgagaaguccaagcacaaguucauggugcagaccaucuucgccccgcccaacaccagcgacauggaggccgucuggaaggaggccaagcccgacgagcugauggacagcaagcuccggugcguguucgagaugcccaacgagaacgacaagcugggcaucacgccgcccgggaacgcccccaccgugaccuccaugagcuccaucaacaacaccgucgccacgcccgccagcuaccacaccaaggacgacccgcgcggccuguccgugcucaagcaggagaagcagaagaacgacauggagcccagcaaggcggugccccugaacgccuccaagcaggacggccccaugccgaagccccacagcgucucccugaacgacaccgagacccggaagcucauggaggagugcaagcgccugcagggggagaugaugaagcugagcgaggagaaccggcaccuccgcgacgagggccugcggcugcgcaagguggcccacuccgacaagcccgggagcacgagcaccgccuccuuccgggacaacgugaccagcccccucccgucccugcuggucgugaucgccgcgaucuucaucggcuucuuccucgggaaguucauccuguga

SEQ ID NO: 38555 - RNA, 300 nt, Artificial Sequence
  derived and/or modified sequence opt1 from VAPB__Homo_sapiens__NP_001182606
auggccaagguggagcagguccugagccucgagccccagcacgagcugaaguuccgcggcccguucaccgacguggugaccacgaaccugaagcucgggaaccccaccgaccggaacgucugcuucaaggugaagaccaccgcgccccgccgguacugcgugcgccccaacuccggcaucaucgacgccggggccagcaucaacgucuccggccggcgcuggacggccgacgaggaggacagcgccgagcagcagccgcacuucuccaucagccccaacugggaggggcggcgccccuga

SEQ ID NO: 38556 - RNA, 2772 nt, Artificial Sequence
  derived and/or modified sequence opt1 from VARS2__Homo_sapiens__NP_001161205
augugcaucccgccgcccaacgugaccggcagccugcacaucgggcacgcccucaccgucgccauccaggacgcgcuggugcgcuggcaccggaugcgcggcgaccaggugcuguggguccccggguccgaccacgccggcaucgccacgcaggccgugguggagaagcagcucuggaaggagcgcgggguccggcggcacgagcugagccgcgaggccuuccugcgggagguguggcaguggaaggaggcgaagggcggcgagaucugcgagcagcuccgcgcccugggggccucccuggacugggaccgggagugcuucaccauggacgugggcagcuccgucgccgugaccgaggcguucgugcgccucuacaaggccgggcugcuguaccggaaccaccagcucgucaacuggagcugcgcccugcgcuccgccaucagcgacaucgagguggagaaccggccccugcccggccacacccagcuccgccugcccgggugccccacgcccguguccuucggccuccuguucagcgucgccuucccgguggacggcgagcccgacgcggagguggucguggggaccacccggcccgagacccugcccggcgacguggccgucgccgugcacccggacgacucccgcuacacgcaccuccacgggcggcagcugcgccacccccugaugggccagccccugccccucaucaccgacuacgccgugcagccgcacgucggcaccggggccgugaaggucacccccgcgcacagccccgccgacgccgagaugggcgcccggcacgggcugagcccccugaacgugaucgccgaggacggcacgaugaccucccucugcggggacuggcugcagggccugcaccgcuucguggcgcgggagaagaucauguccguccucagcgaguggggccuguuccgcgggcugcagaaccacccgauggugcuccccaucugcucccgcagcggcgacgugaucgaguaccugcugaagaaccagugguucguccggugccaggagaugggggcccgcgccgccaaggccguggaguccggcgcgcucgagcugagccccagcuuccaccagaagaacuggcagcacugguucucccacaucggggacuggugcgugagccggcagcugugguggggccaccagauccccgccuaccucgucguggaggaccacgcccagggcgaggaggacugcuggguggucgggcgcuccgaggccgaggcgcgggagguggccgccgagcugaccggccgcccgggggccgagcugacccucgagcgggaccccgacgugcuggacacgugguucagcuccgcccuguuccccuucagcgcgcucggcuggccccaggagaccccggaccuggcccgcuucuacccccugucccuccuggagaccgggagcgaccugcuccuguucugggucggccggauggugaugcugggcacccagcugacggggcagcuccccuucuccaaggugcugcugcacccgaugguccgcgaccggcagggccgcaagaugagcaagucccucgggaacgugcuggacccccgggacaucaucagcggcguggagaugcagguccugcaggagaagcuccgcuccggcaaccuggaccccgccgagcuggccaucguggccgcggcccagaagaaggacuucccccacgggaucccggagugcggcaccgacgcccuccgguucacccugugcagccacggggugcaggccggcgaccugcaccucuccgucagcgaggugcaguccugccgccacuucugcaacaagaucuggaacgcccugcgguucauccugaacgcgcucggggagaaguucgugccccagcccgccgaggagcugagccccuccagcccgauggacgccuggauccugagccgccucgcccuggcggcccaggagugcgagcggggcuuccugacccgcgagcucucccuggucacgcacgcccugcaccacuucuggcuccacaaccugugcgacguguaccuggaggccgugaagcccguccucuggcacagcccccgcccccugggcccgccccaggugcuguucuccugcgccgaccucgggcugcggcugcucgcgccccugaugcccuuccuggccgaggagcucuggcagcgccugccgccccggcccggcugcccgcccgcccccagcaucuccguggcccccuaccccagcgccugcucccuggagcacuggcgccagccggagcucgagcggcgcuucagccggguccaggagguggugcagguccugcgcgcgcugcgggccaccuaccagcucaccaaggcccgcccccgggugcugcugcaguccagcgagcccggggaccagggccucuucgaggccuuccuggagccgcuggggacccucggcuacugcggcgccguggggcugcugccgcccggcgcggccgcccccuccgggugggcccaggcgccccucagcgacacggcccaggucuacauggagcugcagggccugguggacccccagauccagcucccccugcuggccgcccgccgguacaagcuccagaagcagcuggacucccugaccgcccgcacccccagcgagggggaggcgggcacccagcggcagcagaagcucuccagccugcagcuggagcucuccaagcuggacaaggccgccagccaccuccgccagcugauggacgagccgcccgcccccggcagccccgagcuguga

SEQ ID NO: 38557 - RNA, 3795 nt, Artificial Sequence
  derived and/or modified sequence opt1 from VARS__Homo_sapiens__NP_006286
augagcacccuguacgugagcccccacccggacgccuuccccucccuccgcgcccugaucgcggcccgguacggcgaggccggggagggccccggguggggcggggcccacccccgcaucugccugcagccgccgcccaccucccggacgcccuucccgccgccccgccuccccgcccuggagcagggccccggcgggcugugggucuggggcgcgaccgccguggcccagcuccuguggcccgccgggcugggcgggcccggcggcagccgggcggccgugcucguccagcaguggguguccuacgccgacaccgagcugauccccgccgccugcggggcgacccugccggcccucggccugcgcagcuccgcccaggacccccaggccgugcugggggcccucggccgggcgcugagcccccuggaggaguggcuccgccugcacacguaccuggccggcgaggcccccacccucgccgaccuggccgcggucaccgcccugcuccugccguuccgguacgugcuggacccgcccgcccgccggaucuggaacaacgugacccgcugguucgucacgugcgugcggcagcccgaguuccgcgccgugcucggggaggucgugcuguacuccggcgcccggccccugagccaccagcccgggcccgaggcgcccgcccucccgaagaccgccgcccagcugaagaaggaggcgaagaagcgcgagaagcuggagaaguuccagcagaagcagaagauccagcagcagcagcccccgcccggcgagaagaagcccaagcccgagaagcgggagaagcgcgaccccggggugaucaccuacgaccuccccaccccgcccggcgagaagaaggacgucuccggccccaugcccgacagcuacagcccccgguacguggaggccgccugguaccccuggugggagcagcagggguucuucaagcccgaguacggccgcccgaacguguccgccgccaacccccgcggggucuucaugaugugcaucccgccgcccaacgugacgggcucccugcaccuggggcacgcgcucaccaacgccauccaggacagccugacccgguggcaccgcaugcggggcgagaccacgcuguggaaccccggcugcgaccacgccgggaucgccacccagguggucguggagaagaagcucuggcgcgagcagggccugucccggcaccagcuggggcgcgaggccuuccuccaggagguguggaaguggaaggaggagaagggcgaccggaucuaccaccagcugaagaagcuggggagcucccucgacugggaccgcgcgugcuucaccauggaccccaagcugagcgccgccgucaccgaggccuucgugcggcugcacgaggagggcaucaucuaccgcagcacgcggcucgucaacugguccugcacccugaacagcgccaucuccgacaucgagguggacaagaaggagcugaccggccgcacccugcucagcgugcccggguacaaggagaaggucgaguucggcgugcugguguccuucgcguacaagguccaggggagcgacuccgacgaggaggugguggucgccacgacccggaucgagaccaugcugggcgacguggccguggccguccaccccaaggacacccgcuaccagcaccucaagggcaagaacgugauccaccccuuccugagccggucccugcccaucguguucgacgaguucgucgacauggacuucgggacgggcgcggugaagaucacccccgcccacgaccagaacgacuacgagguggggcagcgccacggccucgaggccaucagcaucauggacucccgcggggcccugaucaacgucccgccgcccuuccugggccucccccgguucgaggcccggaaggcggugcugguggcccugaaggagcgcggccucuuccgggggaucgaggacaaccccauggucgugccccugugcaaccgcagcaaggacguggucgagccccugcuccgcccgcagugguacgugcggugcggcgagauggcccaggccgccuccgcggccgugacccgcggggaccugcggauccugcccgaggcccaccagcgcaccuggcacgccuggauggacaacauccgggaguggugcaucagccgccagcucugguggggccaccggauccccgccuacuucgucacgguguccgaccccgcggugccgcccggggaggaccccgacggccgcuacugggucagcggccggaacgaggccgaggcccgcgagaaggccgcgaaggaguucggggugucccccgacaagaucagccugcagcaggacgaggacgugcuggacaccugguucuccagcggccucuucccgcugagcauccugggguggcccaaccaguccgaggaccucagcgucuucuaccccggcacccugcuggagaccgggcacgacauccucuucuucuggguggcccggauggugaugcugggccugaagcucacgggccgccugcccuuccgggaggucuaccugcacgccaucgugcgcgacgcccacgggcggaagauguccaagagccucggcaacgugaucgacccgcuggacgucaucuacgggaucucccugcagggccuccacaaccagcugcugaacagcaaccucgaccccuccgagguggagaaggccaaggaggggcagaaggcggacuuccccgccggcauccccgagugcggcaccgacgcccugcgcuucgggcugugcgccuacaugagccagggccgggacaucaaccucgacgugaaccgcauccugggguaccggcacuucugcaacaagcuguggaacgccaccaaguucgcgcuccgcggccugggcaagggguucgucccgucccccaccagccagcccggcgggcacgagucccugguggaccgguggauccgcagccgccucaccgaggccgugcggcuguccaaccagggcuuccaggccuacgacuuccccgccgucacgaccgcccaguacagcuucuggcuguacgagcucugcgacguguaccuggagugccugaagccggugcucaacggggucgaccagguggcggccgagugcgcccgccagacccuguacacgugccuggacgugggccuccggcugcugucccccuucaugcccuucgucaccgaggagcuguuccagcgccugccccggcgcaugccgcaggccccgcccagccugugcgugacccccuaccccgagcccuccgagugcagcuggaaggaccccgaggccgaggcggcccucgagcuggcccugagcaucacccgggccguccgcucccuccgggcggacuacaaccugacccgcauccggccggacugcuuccuggagguggccgacgaggccacgggcgcccucgccagcgcgguguccggguacguccaggcccuggccagcgccggcgugguggccguccuggcgcucggggcccccgcgccccagggcugcgccguggcccuggccuccgaccgcugcagcauccaccuccagcuccaggggcugguggaccccgcccgggagcugggcaagcuccaggccaagcgcgucgaggcccagcggcaggcgcagcgccugcgggagcgccgggccgccuccggcuacccggugaaggugccccuggagguccaggaggccgacgaggccaagcuccagcagaccgaggcggagcugcgcaagguggacgaggccaucgcccuguuccagaagaugcucuga

SEQ ID NO: 38558 - RNA, 1098 nt, Artificial Sequence
  derived and/or modified sequence opt1 from VASH1__Homo_sapiens__NP_055724
augcccggcgggaagaagguggccggcgggggcagcuccggggccaccccgaccagcgcggccgccacggcccccuccggcguccgccggcuggagaccagcgagggcaccuccgcccagcgcgacgaggagcccgaggaggagggggaggaggaccuccgggacggcggggugcccuucuucgugaaccgcggcgggcugccggucgacgaggcgaccugggagcggauguggaagcacguggccaagauccaccccgacggcgagaagguggcccagcgcauccggggcgccacggaccugcccaagauccccaucccgagcguccccaccuuccagcccuccacccccgugccggagcgccucgaggcggugcagcgguacauccgcgagcugcaguacaaccacaccgggacgcaguucuucgagaucaagaagucccggccccugaccggccucauggaccuggccaaggagaugaccaaggaggcccugcccaucaagugccucgaggccgucauccuggggaucuaccugaccaacagcaugcccacgcucgagcgcuucccgaucagcuucaagaccuacuucuccggcaacuacuuccggcacaucgugcugggcgugaacuucgccgggcgcuacggcgcgcuggggaugagccggcgcgaggaccucauguacaagccgcccgccuuccggacccuguccgagcugguccucgacuucgaggccgccuacggccgcugcuggcacgugcugaagaaggugaagcuggggcagagcgucucccacgacccccacagcguggagcagaucgaguggaagcacuccgugcucgacgucgagcggcugggccgcgacgacuuccggaaggagcuggagcgccacgcccgcgacaugcggcucaagaucggcaaggggaccggcccgcccagccccacgaaggaccgcaagaaggacguguccagcccccagcgggcgcagagcagcccccaccgccggaacucccgcuccgagcggcgccccagcggggacaagaagaccuccgagcccaaggccaugcccgaccugaacggcuaccagauccggguguga

SEQ ID NO: 38559 - RNA, 873 nt, Artificial Sequence
  derived and/or modified sequence opt1 from VASH2__Homo_sapiens__NP_001129946
auguggaugcacguggccaagguccaccccaagggcggggagauggugggcgccauccgcaacgcggccuuccuggccaagccgagcaucccccaggugcccaacuaccggcucuccaugaccauccccgacuggcugcaggccauccagaacuacaugaagacccugcaguacaaccacacggggacccaguucuucgagauccgcaagaugcggccgcucagcggccugauggagaccgccaaggagaugacccgcgagucccugcccaucaagugccucgaggcggucauccuggggaucuaccugacgaacggccagcccagcaucgagcgguuccccaucuccuucaagaccuacuucagcggcaacuacuuccaccacguggugcucgggaucuacugcaacggccgcuacgggucccugggcaugagccggcgcgccgagcugauggacaagccgcucaccuuccggacccuguccgaccugaucuucgacuucgaggacagcuacaagaaguaccuccacacggucaagaaggugaagaucgggcuguacgugccccacgagccccacuccuuccagcccaucgaguggaagcagcugguccucaacgugagcaagaugcugcgcgccgacauccggaaggagcuggagaaguacgcccgcgacaugcggaugaagauccucaagccggcguccgcccacagccccacccaggugcgcucccggggcaagagccugagcccccgccggcgccaggccuccccgccccggcgccugggccggcgcgagaagucccccgcccuccccgagaagaaggucgccgaccugagcacccugaacgaggugggguaccagauccgcaucuga

SEQ ID NO: 38560 - RNA, 1143 nt, Artificial Sequence
  derived and/or modified sequence opt1 from VASP__Homo_sapiens__NP_003361
augagcgagaccgugaucugcuccagccgcgccaccgucaugcuguacgacgacggcaacaagcgguggcuccccgccgggacgggcccgcaggcguucucccgcgugcagaucuaccacaaccccaccgccaacagcuuccggguggucgggcgcaagaugcagcccgaccagcagguggugaucaacugcgccaucguccggggcgugaaguacaaccaggccacccccaacuuccaccaguggcgcgacgcccggcaggugugggggcugaacuucggcuccaaggaggacgcggcccaguucgccgccggcauggcgagcgcccuggaggcccucgaggggggcgggccgcccccccccccggcccugcccaccugguccguccccaacggccccagcccggaggagguggagcagcagaagcgccagcagcccgggcccuccgagcacaucgagcggcgcgugagcaacgccggcggccccccggcgccccccgccgggggccccccgcccccccccgggccgcccccccccccgggcccccccccgccccccggccugcccccguccgggguccccgccgccgcccacggcgcggggggcgggccccccccggcccccccccuccccgccgcccagggcccgggcgggggcggggccggcgcgcccgggcuggccgccgccaucgccggcgcgaagcugcggaaggugagcaagcaggaggaggccuccggcgggcccacggcccccaaggccgagagcggccgcuccgggggcgggggccucauggaggagaugaacgcgaugcuggcccggcgccggaaggccacccaggugggcgagaagaccccgaaggacgagagcgccaaccaggaggagcccgaggcccgcguccccgcgcaguccgagagcgugcggcgccccugggagaagaacuccaccacgcugccgcggaugaagagcagcuccagcgugaccaccuccgagacccagcccugcacgcccagcuccagcgacuacuccgaccuccagcgcgucaagcaggagcugcuggaggaggugaagaaggagcuccagaaggugaaggaggagaucaucgaggccuucguccaggagcugcggaagcgcgggagccccuga

SEQ ID NO: 38561 - RNA, 1182 nt, Artificial Sequence
  derived and/or modified sequence opt1 from VAT1__Homo_sapiens__NP_006364
augagcgacgagcgcgagguggccgaggccgcgaccggcgaggacgccuccagcccgccgcccaagaccgaggccgccuccgacccccagcaccccgccgcgagcgagggggccgccgccgcggccgccuccccgccccugcuccggugccugguccugacgggcuucgggggcuacgacaaggugaagcuccagagccgccccgccgcgcccccggcccccgggcccggccagcugacccugcggcuccgcgccugcggccugaacuucgccgaccugauggcccggcaggggcucuacgaccgccugcccccgcugcccgugacccccggcauggagggggccggcgucgugaucgcggugggggagggcgucuccgaccggaaggccggcgaccgcgugauggugcucaaccggagcgggauguggcaggaggaggucaccgugcccuccgugcagacguuccugauccccgaggccaugaccuucgaggaggccgccgcgcugcucgucaacuacaucaccgccuacauggugcuguucgacuucggcaaccugcagcccgggcacagcgugcucguccacauggccgccggcggcguggggauggccgcggugcagcugugccgcaccgucgagaacgugacgguguucggcaccgccuccgccagcaagcacgaggcccugaaggagaacggggucacccaccccaucgacuaccacaccacggacuacguggacgagaucaagaagaucucccccaagggcguggacaucgucauggacccgcucgggggcagcgacaccgcgaagggcuacaaccugcugaagcccauggggaagguggucaccuacggcauggccaaccuccugaccgggcccaagcggaaccugauggcccucgcccgcacgugguggaaccaguucuccgugaccgcccugcagcugcuccaggcgaaccgggccgugugcggcuuccaccugggguaccuggacggcgaggucgagcucgugagcggcguggucgcccgccugcuggcccucuacaaccaggggcacaucaagccccacaucgacuccguguggccguucgagaagguggccgacgcgaugaagcagaugcaggagaagaagaacgucggcaaggugcugcuggugcccgggcccgagaaggagaacuga

SEQ ID NO: 38562 - RNA, 1260 nt, Artificial Sequence
  derived and/or modified sequence opt1 from VAT1L__Homo_sapiens__NP_065978
auggccaaggagggcguggagaaggccgaggagaccgagcagaugaucgagaaggaggcggggaaggagcccgccgagggcgggggcggggacggcagccaccgccugggcgacgcccaggagaugcgggccgucgugcucgccggguucggcgggcugaacaagcugcgccucuuccggaaggcgaugccggagccccaggacggcgagcugaagauccgcgugaaggccugcgggcugaacuucaucgaccucaugguccggcagggcaacaucgacaacccgcccaagacgccccuggugcccggcuucgagugcuccgggaucguggaggcccugggcgacagcgucaagggguacgagaucggcgaccgcgugauggccuucgugaacuacaacgcgugggccgaggucgugugcacccccguggaguucgucuacaagauccccgacgacauguccuucagcgaggccgccgccuucccgaugaacuucgugaccgcguacgugaugcuguucgaggucgccaaccuccgggagggcauguccgugcuggugcacagcgccgggggcggggucggccaggccguggcccagcucugcuccaccgugcccaacgucaccguguucgggacggcgagcaccuucaagcacgaggccaucaaggacuccgugacccaccuguucgaccgcaacgccgacuacguccaggaggugaagcggaucagcgccgagggcgucgacaucgugcuggacugccucugcggcgacaacaccgggaagggccugucccugcucaagccccuggggacguacauccuguacggcagcuccaacauggugaccggggagaccaagagcuucuucuccuucgccaagagcugguggcaggucgagaaggugaaccccaucaagcucuacgaggagaacaaggugaucgcgggcuucucccugcugaaccuccuguucaagcagggccgcgccgggcugauccggggcgucguggagaagcucaucgggcuguacaaccagaagaagaucaagccgguggucgacagccugugggcccucgaggaggugaaggaggccaugcagcgcauccacgaccggggcaacaucgggaagcugauccuggacguggagaagacccccacgccccucauggccaacgacuccaccgagaccagcgaggcgggcgaggaggaggaggaccacgagggcgacagcgagaacaaggagcgcaugcccuucauccaguga

SEQ ID NO: 38563 - RNA, 2442 nt, Artificial Sequence
  derived and/or modified sequence opt1 from VAV1__Homo_sapiens__NP_001245136
auggagcuguggcgccagugcacccacuggcucauccagugccgggugcugcccccgagccaccgcgucaccugggacggcgcccaggugugcgagcuggcccaggcgcuccgggacggggugcugcugugccagcuccugaacaaccugcucccccacgccaucaaccugcgcgaggucaaccugcggccccagaugucccaguuccucugccugaagaacauccgcacguuccugagcacgugcugcgagaaguucggccucaagcgguccgagcuguucgaggccuucgaccuguucgacgugcaggacuucgggaaggugaucuacacccucagcgcccuguccuggacccccaucgcccagaaccgcggcaucaugccguuccccaccgaggaggagagcgucggggacgaggacaucuacuccggccugagcgaccagaucgacgacaccguggaggaggacgaggaccucuacgacugcguggagaacgaggaggcggagggcgacgagaucuacgaggaccugaugcgguccgagcccgucagcaugccccacuuccugaagccgcuccagcgcuuccugaagccccaggacaucgagaucaucuucaucaacaucgaggaccugcuccgggugcacacccacuuccugaaggagaugaaggaggcccuggggacccccggcgccgccaaccucuaccagguguucaucaaguacaaggagcgcuuccuggucuacgggcgguacugcucccagguggagagcgcguccaagcaccuggaccgcguggccgccgcccgggaggacguccagaugaagcucgaggagugcagccagcgcgccaacaacggccgguucacgcugcgcgaccugcucauggugcccaugcagcgggugcugaaguaccaccuccugcugcaggagcuggucaagcacacccaggaggcgauggagaaggagaaccuccgccuggcccuggacgccaugcgggaccucgcccagugcgugaacgaggugaagcgcgacaacgagacccugcgccagaucaccaacuuccagcuguccaucgagaaccucgaccagagccuggcccacuacgggcggccgaagaucgacggcgagcugaagaucacguccgucgagcgccggagcaagauggaccgcuacgcguuccugcucgacaaggcccugcugaucugcaagcggcgcggcgacuccuacgaccucaaggacuucgugaaccugcacagcuuccaggugcgggacgacagcuccggggaccgcgacaacaagaaguggagccacauguuccugcucaucgaggaccagggcgcccagggguacgagcuguucuucaagacccgggagcugaagaagaaguggauggagcaguucgagauggccaucuccaacaucuaccccgagaacgccaccgcgaacggccacgacuuccagauguucagcuucgaggagaccacguccugcaaggccugccagaugcuccugcgcggcaccuucuaccagggguaccggugccaccgcugccgggccagcgcccacaaggagugccugggccgcgucccgcccugcgggcggcacggccaggacuuccccgggaccaugaagaaggacaagcuccaccgccgggcccaggacaagaagcgcaacgagcugggccugcccaagauggagguguuccaggaguacuacggccucccgccgccgcccggggcgaucggccccuuccugcggcugaaccccggggacaucgucgagcucaccaaggccgaggccgagcagaacuggugggagggccgcaacacguccaccaacgagaucgggugguuccccugcaaccgcgugaagcccuacgugcacggcccgccccaggaccugagcguccaccugugguacgccggccccauggagcgggcgggggccgaguccauccucgccaaccgcagcgacggcaccuuccuggugcggcagcgcgugaaggacgccgccgaguucgcgaucuccaucaaguacaacgucgaggugaagcacaucaagaucaugaccgccgaggggcuguaccggaucacggagaagaaggccuuccgcggccucaccgagcugguggaguucuaccagcagaacagccugaaggacugcuucaagucccucgacaccacccugcaguuccccuucaaggagcccgagaagcggacgaucagccgccccgccgucggguccaccaaguacuucggcaccgccaaggcgcgguacgacuucugcgcccgcgaccggagcgagcugucccucaaggagggcgacaucaucaagauccugaacaagaaggggcagcagggcugguggcgcggggagaucuacggccgggugggcugguuccccgccaacuacguggaggaggacuacagcgaguacugcuga

SEQ ID NO: 38564 - RNA, 2637 nt, Artificial Sequence
  derived and/or modified sequence opt1 from VAV2__Homo_sapiens__NP_001127870
auggagcaguggcgccagugcggccgguggcugaucgacugcaaggugcugcccccgaaccaccgcgucguguggcccagcgccguggucuucgaccuggcccaggcgcugcgggacggggugcuccugugccagcugcuccacaaccugucccccggcagcaucgaccugaaggacaucaacuuccgcccccagaugucccaguuccucugccugaagaacauccggaccuuccugaaggugugccacgacaaguucgggcuccgcaacagcgagcuguucgacccguucgaccuguucgacguccgggacuucggcaaggugaucuccgccgugagccgccucucccugcacagcaucgcccagaacaaggggauccggcccuuccccuccgaggagaccacggagaacgacgacgacgucuaccgcagccuggaggagcucgccgacgagcacgaccugggcgaggacaucuacgacugcgugcccugcgaggacggcggggacgacaucuacgaggacaucaucaagguggagguccagcagccgaugauccgguacaugcagaagaugggcaugaccgaggacgacaagcgcaacugcugccugcucgagauccaggagaccgaggccaaguacuaccggacccuggaggacaucgagaagaacuacaugagcccccugcgccucgugcugagccccgcggacauggccgccguguucaucaaccuggaggaccucaucaagguccaccacuccuuccugcgggccaucgacgugagcgugauggucgggggcuccacgcuggcgaagguguuccucgacuucaaggagcgccugcugaucuacggggaguacugcagccacauggagcacgcccagaacacccucaaccagcugcuggccucccgggaggacuuccgccagaagguggaggagugcacccucaagguccaggacggcaaguucaagcugcaggaccugcucguggugcccaugcagcggguccugaaguaccaccuccuccugaaggagcugcucagccacuccgccgagcgcccggagcggcagcagcugaaggaggcccuggaggcgaugcaggaccucgccauguacaucaacgaggugaagcgcgacaaggagacccugcgcaagaucagcgaguuccagagcuccaucgagaaccugcaggucaagcuggaggaguucggccggcccaagaucgacggggagcucaaggugcgcagcaucgugaaccacacgaagcaggaccgguaccuguuccuguucgacaaggucgugaucgugugcaagcgcaagggcuacuccuacgagcucaaggagaucaucgagcugcuguuccacaagaugaccgacgaccccaugaacaacaaggacgucaagaagucccacgggaagaugugguccuacggcuucuaccucauccaccuccagggcaagcagggguuccaguucuucugcaagaccgaggacaugaagcggaaguggauggagcaguucgagauggccaugagcaacaucaagcccgacaaggccaacgccaaccaccacuccuuccagauguacaccuucgacaagacgaccaacugcaaggcgugcaagauguuccugcgcggcaccuucuaccagggguacaugugcaccaagugcggcgugggggcccacaaggagugccuggaggugaucccgcccugcaaguucacgagccccgccgaccuggacgccuccggcgccggccccgggccgaagauggucgcgaugcagaacuaccacggcaaccccgccccgcccgggaagcccgugcugaccuuccagaccggcgacgugcucgagcugcugcgcggggaccccgagagccccuggugggagggccgccucguccagacccggaaguccggcuacuuccccagcuccagcgugaagccgugccccguggacgggcggcccccgaucucccggccgcccagccgcgagaucgacuacacggccuaccccugguucgccggcaacauggagcggcagcagaccgacaaccugcugaagucccacgccagcgggaccuaccucauccgcgagcggcccgcggaggccgagcgcuucgccaucuccaucaaguucaacgacgaggucaagcacaucaaggugguggagaaggacaacuggauccacaucaccgaggccaagaaguucgacagccugcuggagcucgucgaguacuaccagugccacagccugaaggaguccuucaagcagcuggacacgacccucaaguaccccuacaagagccgggagcgcuccgcgagccgggccuccagccgcucccccgccagcugcgccuccuacaacuucagcuuccugagcccccagggccuguccuucgccucccaggggccgagcgcgcccuucugguccguguucacgccccgcgugaucggcaccgccgucgcccgguacaacuucgccgcccgcgacaugcgggagcucagccugcgcgagggcgacguggugcggaucuacucccgcaucgggggcgaccaggggugguggaagggcgagaccaacggccggaucgggugguuccccagcaccuacgucgaggaggagggcauccaguga

SEQ ID NO: 38565 - RNA, 2520 nt, Artificial Sequence
  derived and/or modified sequence opt1 from VAV3__Homo_sapiens__XP_011538805
augacccagagccuguccuaccucgccacccgcgccgcgcccuucaagaaggagcggacgcuguacgaccugaucagcauguaccucaagcuggagcacacccaguccagcgugauccugggcgucuccgugagcuccgggagcccggcccuccagauccugcacucccugcccgugugccuccagcccgccggcgggcagagccugcgcaagaaccggcacggcuccggggagagccacaccuaccugaaguuccucugccugaagaacauccgcaccuuccugacggccugcugcgagaccuucggcaugcggaaguccgagcuguucgaggccuucgaccuguucgacguccgcgacuucggcaaggugaucgagacccugagccggcucucccgcacccccaucgcgcuggccacggggauccggccguuccccaccgaggagagcaucaacgacgaggacaucuacaagggccugcccgaccucaucgacgagacccugguggaggacgaggaggaccuguacgacugcgucuacggggaggacgagggcggggagguguacgaggaccucaugaaggccgaggaggcccaccagcccaagugcccggagaacgacauccgcuccugcugccuggcggagaucaagcagaccgaggagaaguacacggagacccuggagagcaucgagaaguacuucauggcgccccucaagcgguuccugaccgccgccgaguucgacuccguguucaucaacauccccgagcuggucaagcuccaccgcaaccugaugcaggagauccacgacagcaucgugaacaagaacgaccagaaccuguaccagguguucaucaacuacaaggagcggcucgucaucuacggccaguacugcagcggcguggaguccgccaucagcucccuggacuacaucagcaagaccaaggaggacgugaagcugaagcucgaggagugcuccaagcgcgccaacaacgggaaguucacgcugcgggaccugcucgucgugcccaugcagcgcgugcugaaguaccaccuccuccugcaggagcuggucaagcacaccaccgacccgaccgagaaggccaaccucaagcuggcccuggacgccaugaaggaccucgcccaguacgugaacgaggugaagcgggacaacgagacgcugcgcgagaucaagcaguuccagcugagcaucgagaaccugaaccagcccguccuccuguucggccggccccagggggacggcgagauccgcaucaccacccuggacaagcacaccaagcaggagcggcacaucuuccucuucgaccuggcggugaucgugugcaagcgcaagggcgacaacuacgagaugaaggagaucaucgaccugcagcaguacaagaucgccaacaaccccacgaccgacaaggagaacaagaagugguccuacggguucuaccucauccacacccagggccagaacgggcuggaguucuacugcaagaccaaggaccugaagaagaaguggcucgagcaguucgagauggcccugagcaacauccgcccggacuacgccgacuccaacuuccacgacuucaagaugcacacguucacccgggucaccagcugcaaggugugccagaugcugcuccgcggcaccuucuaccagggguaccugugcuucaagugcggcgcccgggcgcacaaggagugccugggccgcgucgacaacugcgggcgggugaacuccggcgggcuccccaagaugcaggucauccgcaacuacagcggcacgcccccgcccgcccugcacgaggggccgccccugcagcuccaggccggcgacaccguggagcugcugaagggcgacgcccacucccucuucuggcaggggcggaaccuggccagcggcgaggugggguucuuccccuccgacgcggugaagcccugccccugcguccccaagcccguggacuacagcugccagccgugguacgccggcgccauggagcgccugcaggccgagaccgagcucaucaaccgggugaacuccaccuaccugguccgccaccggacgaaggagagcggggaguacgcgaucuccaucaaguacaacaacgaggccaagcacaucaagauccugacccgcgacggcuucuuccacaucgccgagaaccggaaguucaagagccucauggagcugguggaguacuacaagcaccacagccugaaggagggcuuccgcacccucgacaccacccugcaguuccccuacaaggagcccgagcacuccgccgggcagcggggcaaccgcgccgggaacagccugcucuccccgaaggugcugggcaucgcgaucgcccgguacgacuucugcgcccgcgacaugcgggagcugagccuccugaagggcgacgucgugaagaucuacacgaagauguccgccaacgggugguggcgcggcgaggugaacgggcgcgucggcugguuccccagcaccuacguggaggaggacgaguga

SEQ ID NO: 38566 - RNA, 1005 nt, Artificial Sequence
  derived and/or modified sequence opt1 from VAX1__Homo_sapiens__NP_001106175
auguucggcaagcccgacaagauggacgugcgcugccacagcgacgccgaggccgcgcgggucuccaagaacgcccacaaggagagccgcgaguccaagggggccgagggcaaccugccggccgccuuccucaaggagccccagggggcguucagcgccuccggcgccgccgaggacugcaacaagagcaaguccaacagcgcggccgaccccgacuacugccggcgcauccuggugcgggacgccaagggguccauccgcgagaucauccugcccaagggccucgaccuggaccggccgaagcgcacccggaccagcuucacggccgagcagcuguaccgccucgagauggaguuccagcggugccaguacguggucggccgcgagcggaccgagcuggcccgccagcugaaccucuccgagacccaggugaaggugugguuccagaaccggcgcaccaagcagaagaaggaccaggggaaggacagcgagcugcgguccgucgugagcgagacggcggcgaccugcuccgugcugcgccuccuggagcagggccggcugcucagcccgcccgggcugcccgcccugcucccgcccugcgccaccggcgcccugggguccgcccugcgcggccccagccuccccgcccugggcgccggggccgccgcgggcuccgccgccgccgccgcggccgccgccccggggcccgcgggcgccgccagcccccacccgcccgccgucggcggggcccccggccccgggcccgcgggccccgggggccugcacgccggcgcccccgccgccgggcacagccucuucucccugcccgugcccagccugcucggcuccguggcgagccggcuguccagcgccccgcugaccauggccgggucccucgccggcaaccugcaggagcugagcgcccgcuaccucuccagcuccgcguucgagcccuacagccgcacgaacaacaaggagggggccgagaagaaggcccuggacuga

SEQ ID NO: 38567 - RNA, 873 nt, Artificial Sequence
  derived and/or modified sequence opt1 from VAX2__Homo_sapiens__NP_036608
augggcgacgggggcgccgagcgcgaccgggggcccgcccgccgggcggagagcggcgggggcggcgggcgcugcggcgaccgguccggggccggcgaccugcgcgccgacgggggcggccacagcccgaccgagguggccgggaccuccgccagcucccccgcgggcagccgggaguccggggccgacagcgacggccagcccggccccggggaggccgaccacugccgccggauccucguccgcgacgccaagggcacgauccgggagaucgugcugccgaaggggcuggaccucgaccgccccaagcggacccgcaccuccuucaccgcggagcagcuguaccggcuggagauggaguuccagcgcugccaguacguggucggccgggagcgcacggagcucgcccggcagcugaaccugagcgagacccaggugaaggugugguuccagaaccgccggaccaagcagaagaaggaccagucccgcgaccucgagaagcgcgccagcuccagcgccuccgaggccuucgcgaccagcaacauccugcggcugcucgagcaggggcgccugcuguccgucccccgggcccccagccuccuggcccugacgccgucccuccccggccugcccgccagccaccgcggcaccagccugggggacccccggaacuccagcccgcgccucaacccccuguccagcgccuccgcgagcccgccccugcccccgccccuccccgccgugugcuucuccagcgcgccccugcuggaccuccccgccggcuacgagcugggguccagcgccuucgagcccuacuccuggcuggagcggaaggugggcagcgccuccagcugcaagaaggccaacaccuga

SEQ ID NO: 38568 - RNA, 702 nt, Artificial Sequence
  derived and/or modified sequence opt1 from VBP1__Homo_sapiens__NP_001290472
augaacgugcacggcgacggggaggccggccugcagguccgcaccagccagucccggaaccccgggggccgccggcccgggcgccagagccgggcccgcauccccaagauggcggccgugaaggacuccugcggcaagggcgagauggccaccgggaacggccggcgccuccaccuggggauccccgaggccguguucgucgaggacguggacagcuucaugaagcagcccggcaacgagacggccgacaccgugcugaagaagcucgacgagcaguaccagaaguacaaguucauggagcugaaccuggcgcagaagaagcggcgccucaaggggcagaucccggagaucaagcagacccuggagauccugaaguacaugcagaagaagaaggaguccaccaacagcauggagacgcgguuccuccuggccgacaaccuguacugcaaggccuccgucccgcccaccgacaaggugugccucuggcugggcgccaacgugaugcuggaguacgacaucgacgaggcgcaggcccuccuggagaagaaccugagcaccgccaccaagaaccucgacucccuggaggaggaccuggacuuccuccgcgaccaguucacgaccaccgaggucaacauggcccggguguacaacugggacgugaagcgccggaacaaggacgacagcaccaagaacaaggccuga

SEQ ID NO: 38569 - RNA, 1968 nt, Artificial Sequence
  derived and/or modified sequence opt1 from VCAN__Homo_sapiens__NP_001119808
auguucaucaacaucaagagcauccuguggaugugcuccacccugaucgugacccacgcccugcacaaggucaaggugggcaagagcccgcccgugcgcgggucccugagcggcaaggucucccuccccugccacuucagcacgaugcccacccugcccccguccuacaacaccagcgaguuccugcggaucaagugguccaagaucgagguggacaagaacgggaaggaccucaaggagaccacggugcuggucgcccagaacggcaacaucaagaucgggcaggacuacaagggccgcgugagcgugcccacccaccccgaggcggucggcgacgccucccugaccguggugaagcuccuggccagcgacgccgggcuguaccggugcgacgucauguacggcaucgaggacacccaggacacggugucccucaccguggacggggucguguuccacuaccgcgccgcgaccagccgguacacccugaacuucgaggccgcccagaaggccugccuggacgugggcgcggucaucgccacgcccgagcagcuguucgccgccuacgaggacggguucgagcagugcgacgccggcuggcuggcggaccagaccgugcgcuacccgauccgggcgccccgcgugggcugcuacggggacaagaugggcaaggccgggguccggaccuacggcuuccgcagcccccaggagaccuacgacguguacugcuacguggaccaccucgacggcgacgucuuccaccucacggugcccuccaaguucaccuucgaggaggccgccaaggagugcgagaaccaggacgcccggcuggccaccgucggggagcugcaggccgccuggcgcaacggcuucgaccagugcgacuacggguggcucuccgacgccagcgugcggcacccggugaccgucgcgcgcgcccagugcggcgggggccugcugggcgugcggacgcucuaccgcuucgagaaccagaccggguucccgccgcccgacucccgguucgacgccuacugcuucaagcgccccgaccggugcaagaugaaccccugccugaacggcgggaccugcuaccccaccgagacgagcuacgugugcacgugcguccccggcuacagcggggaccagugcgagcuggacuucgacgagugccacuccaaccccugccgcaacggcgcgaccugcguggacggcuucaacaccuuccggugccucugccugcccagcuacgugggggcccugugcgagcaggacaccgagaccugcgacuacggcuggcacaaguuccaggggcagugcuacaaguacuucgcccaccgccgcaccugggacgccgccgagcgggagugccgccuccagggcgcccaccugaccuccauccugagccacgaggagcagauguucgucaaccggguggggcacgacuaccaguggaucggccucaacgacaagauguucgagcacgacuuccgcuggacggacggcuccacccugcaguacgagaacuggcggcccaaccagcccgacagcuucuucuccgcgggggaggacugcguggucaucaucuggcacgagaacggccaguggaacgacgugccgugcaacuaccaccugaccuacacgugcaagaaggggaccguggccugcggccagccgcccgucguggagaacgccaagaccuucggcaagaugaagccccgcuacgagaucaacagccucauccgguaccacugcaaggacggguucauccagcgccaccuccccaccauccggugccugggcaacgggcgcugggccauccccaagaucacgugcaugaaccccuccgccuaccagcggaccuacagcaugaaguacuucaagaacuccagcuccgcgaaggacaacagcaucaacaccuccaagcacgaccaccgcuggagccggcgcuggcaggagucccggcgcuga

SEQ ID NO: 38570 - RNA, 3201 nt, Artificial Sequence
  derived and/or modified sequence opt1 from VCL__Homo_sapiens__NP_003364
augcccguguuccacacccgcaccaucgagagcauccuggagcccgucgcccagcagaucucccaccucgugaucaugcacgaggagggcgagguggacgggaaggccauccccgaccugacggcgcccgucgccgccgugcaggccgccgugagcaaccugguccgggugggcaaggagaccgugcagaccaccgaggaccagauccucaagcgcgacaugccgcccgcguucaucaaggucgagaacgccugcacgaagcuggugcaggccgcccagaugcugcaguccgaccccuacagcgugcccgcgcgggacuaccucaucgacgggucccgcggcauccugagcgggaccuccgaccugcuccugaccuucgacgaggccgagguccggaagaucauccgcgugugcaagggcauccuggaguaccucaccguggccgaggucguggagacgauggaggaccuggugaccuacaccaagaaccugggccccgggaugaccaagauggccaagaugaucgacgagcggcagcaggagcucacgcaccaggagcaccgcgucaugcuggugaacagcaugaacaccgugaaggagcugcuccccguccugaucuccgccaugaagaucuucgugaccaccaagaacagcaagaaccagggcaucgaggaggcgcugaagaaccggaacuucacgguggagaagauguccgccgagaucaacgagaucauccgcguccuccagcugaccagcugggacgaggacgccugggccuccaaggacaccgaggccaugaagcgggcgcuggccagcaucgacuccaagcucaaccaggccaagggguggcugcgcgaccccagcgccucccccggcgacgccggggagcaggcgauccggcagauccuggacgaggccggcaaggugggcgagcucugcgccgggaaggagcgccgggagauccuggggaccugcaagaugcuggggcagaugacggaccaggucgccgaccuccgcgcccggggccagggcagcucccccguggcgaugcagaaggcccagcaggucagccagggccuggacgugcugaccgccaagguggagaacgccgcgcgcaagcucgaggccaugaccaacagcaagcaguccaucgccaagaagaucgacgccgcccagaacuggcuggcggaccccaacggcgggcccgagggcgaggagcagauccgcggggcccuggccgaggcccggaagaucgccgagcucugcgacgaccccaaggagcgggacgacauccugcgcagccugggcgagaucuccgcgcucaccagcaagcuggccgaccugcgccggcagggcaagggggacucccccgaggcccgcgcccucgccaagcaggucgcgacggcccugcagaaccugcagaccaagaccaaccgggccguggccaacagccgccccgcgaaggccgccgugcaccucgagggcaagaucgagcaggcccagcgguggaucgacaaccccaccguggacgaccgcggggucggccaggccgcgauccgggggcugguggccgagggccaccgccuggccaacgugaugaugggccccuaccggcaggaccuccuggccaagugcgaccgcgucgaccagcugacggcccagcuggcggaccucgccgcccgcggggagggcgagagcccccaggcccgggcccuggcgucccagcugcaggacucccucaaggaccugaaggcccggaugcaggaggccaugacccaggaggugagcgacguguucuccgacaccaccacgccgaucaagcugcucgccgucgcggccaccgccccgcccgacgcccccaaccgcgaggagguguucgacgagcgggccgcgaacuucgagaaccacagcgggaagcugggcgccaccgccgagaaggccgccgcgguggggaccgccaacaaguccacggucgagggcauccaggccagcgugaagaccgcccgcgagcugacgccccagguggucuccgccgcgcggauccuccugcgcaaccccggcaaccaggccgccuacgagcacuucgagaccaugaagaaccaguggaucgacaacguggagaagaugaccgggcugguggacgaggccaucgacaccaagagccuccuggacgccuccgaggaggcgaucaagaaggaccuggacaagugcaaggucgccauggccaacauccagccccagaugcucguggccggcgcgaccagcaucgcccggcgcgccaaccgcauccugcugguggccaagcgggaggucgagaacuccgaggaccccaaguuccgcgaggccgugaaggcggccagcgacgagcucagcaagaccaucuccccgauggugauggacgccaaggccgucgccgggaacaucagcgaccccggccugcagaaguccuuccuggacagcggcuaccggauccucggggcgguggccaaggugcgcgaggccuuccagccccaggagccggacuucccgcccccgccgcccgaccuggagcagcugcggcucaccgacgagcuggccccgcccaagccgccccugcccgagggcgaggugcccccgccccggccgccgccgcccgaggagaaggacgaggaguuccccgagcagaaggccggggaggucaucaaccagcccaugaugauggcggcccgccagcuccacgacgaggcccgcaagugguccagcaagggcaacgacaucaucgccgcggccaagcggauggcccugcugauggccgagaugucccgccucgugcgcgggggcagcggcacgaagcgggcccugauccagugcgcgaaggacaucgccaaggccuccgacgaggucacccggcuggccaaggagguggccaagcagugcaccgacaagcgcauccggaccaaccuccuccaggugugcgagcgcauccccacgaucagcacccagcugaagauccuguccaccgucaaggcgaccaugcuggggcggacgaacaucagcgacgaggaguccgagcaggccaccgagaugcuggugcacaacgcccagaaccucaugcagagcgugaaggagaccguccgcgaggccgaggccgcguccaucaagauccggaccgacgccggcuucacgcugcgcugggugcggaagacccccugguaccaguga

SEQ ID NO: 38571 - RNA, 2421 nt, Artificial Sequence
  derived and/or modified sequence opt1 from VCP__Homo_sapiens__NP_009057
auggccagcggcgccgacuccaagggggacgaccugagcaccgcgauccucaagcagaagaaccgccccaaccggcugaucguggacgaggccaucaacgaggacaacuccgucgugagccugucccagccgaagauggacgagcuccagcuguuccgcggcgacaccgugcugcucaaggggaagaagcggcgcgaggccgucugcaucgugcugagcgacgacacgugcuccgacgagaagauccggaugaaccgcgugguccggaacaaccugcgcgugcggcucggcgacgugaucagcauccagcccugccccgacgucaaguacgggaagcgcauccacgugcugcccaucgacgacaccguggagggcaucaccggcaaccuguucgaggucuaccucaagccguacuuccuggaggccuaccggcccauccgcaagggggacaucuuccuggugcggggcgggaugcgcgccguggaguucaaggucguggagaccgaccccucccccuacugcaucguggcgccggacacggucauccacugcgagggcgagcccaucaagcgggaggacgaggaggagagccucaacgaggugggguacgacgacaucggcggcugccgcaagcagcuggcccagaucaaggagaugguggagcugccccuccggcaccccgcccuguucaaggccaucggggucaagccgccccgcggcauccugcucuacgggccgcccggcaccggcaagacccugaucgcgcgggccguggccaacgagaccggggccuucuucuuccugaucaacggccccgagaucauguccaagcucgccggggagagcgaguccaaccugcgcaaggcguucgaggaggccgagaagaacgcccccgccaucaucuucaucgacgagcuggacgccaucgcgcccaagcgggagaagacgcacggcgagguggagcgccgcaucgucagccagcuccugacccugauggacgggcucaagcagcgggcccacgugaucgucauggccgccaccaaccgccccaacuccaucgacccggcccugcggcgcuucggccgguucgaccgcgagguggacaucggcauccccgacgcgaccgggcggcuggagauccuccagauccacacgaagaacaugaagcuggccgacgacguggaccuggagcaggucgccaacgagacccacggccacgugggggccgaccucgccgcgcugugcagcgaggccgcccugcaggccauccgcaagaagauggaccucaucgaccuggaggacgagaccaucgacgcggaggugaugaacucccuggccgucaccauggacgacuuccggugggcccucagccaguccaaccccagcgcccugcgcgagacggugguggaggucccccaggugaccugggaggacaucggcgggcuggaggacgugaagcgggagcuccaggagcugguccaguacccgguggagcaccccgacaaguuccugaaguucggcaugacccccagcaagggcguccucuucuacgggcccccgggcugcgggaagacccugcuggccaaggcgaucgccaacgagugccaggccaacuucaucuccaucaagggccccgagcugcucacgaugugguucggggagagcgaggccaacgugcgcgagaucuucgacaaggcccggcaggcggcccccugcgugcuguucuucgacgagcuggacuccaucgccaaggcccgcggcggcaacaucggggacggcgggggcgccgcggaccgggugaucaaccagauccucaccgagauggacggcaugagcaccaagaagaacgucuucaucaucggggccaccaaccgcccggacaucaucgaccccgccauccugcggcccggccgccuggaccagcucaucuacaucccccugccggacgagaagucccggguggccauccugaaggcgaaccuccgcaagagccccguggccaaggacgucgaccuggaguuccuggccaagaugacgaacggguucuccggcgccgaccucaccgagaucugccagcgcgccugcaagcuggcgauccgggagagcaucgaguccgagauccgccgggagcgcgagcggcagaccaaccccagcgccauggagguggaggaggacgaccccgugccggagauccgccgggaccacuucgaggaggccaugcgcuucgcccggcgcuccgucagcgacaacgacauccggaaguacgagauguucgcccagacccugcagcagucccgcggguucggcagcuuccgguuccccuccggcaaccagggcggggcggggcccagccagggcuccgggggcggcaccgggggcagcguguacacggaggacaacgacgacgaccucuacggguga

SEQ ID NO: 38572 - RNA, 420 nt, Artificial Sequence
  derived and/or modified sequence opt1 from VCX2__Homo_sapiens__NP_057462
augagccccaagccgcgcgccuccggcccgcccgccaaggcgaccgaggccgggaagcgcaagagcuccagccagcccucccccagcgaccccaagaagaagaccacgaagguggccaagaagggcaaggccguccggcgggggcgccggggcaagaagggggccgcgaccaagauggccgccgugaccgcccccgaggcggaguccgcccccgccgccccgggccccagcgaccagcccucccaggagcugccccagcacgagcucccgcccgaggagcccgugagcgagggcacccagcacgacccccugucccaggagagcgaggucgaggagccgcugucccaggagagcgagguggaggagccccucacgguguggauggccuccuucagccccgucuccgagagcaccgacuga

SEQ ID NO: 38573 - RNA, 561 nt, Artificial Sequence
  derived and/or modified sequence opt1 from VCX3A__Homo_sapiens__NP_057463
augagccccaagccgcgcgccuccggcccgcccgccaaggcgaccgaggccgggaagcgcaagagcuccagccagcccucccccagcgaccccaagaagaagaccacgaagguggccaagaagggcaaggccguccggcgggggcgccggggcaagaagggggccgcgaccaagauggccgccgugaccgcccccgaggcggaguccggccccgccgccccgggccccagcgaccagcccucccaggagcugccccagcacgagcucccgcccgaggagcccgugagcgaggggacccagcacgacccccugucccaggagagcgagcuggaggagccgcucucccaggagagcgaggucgaggagccccugucccaggagagccagguggaggagccccugucccaggagagcgagguggaggagccccucucccaggagagccaggucgaggagccgcugagccaggaguccgagguggaggagccccugagccaggagucccagguggaggagccccucagccaggaguccgagauggaggagcugcccagcgucuga

SEQ ID NO: 38574 - RNA, 741 nt, Artificial Sequence
  derived and/or modified sequence opt1 from VCX3B__Homo_sapiens__NP_001001888
augagccccaagccgcgcgccuccggcccgcccgccaaggcgaaggaggccgggaagcgcaagagcuccagccagcccucccccagcgaccccaagaagaagaccaccaagguggccaagaagggcaaggccguccggcgggggcgccggggcaagaagggggccgcgacgaagauggccgccgugaccgcccccgaggcggaguccggccccgccgccccgggccccagcgaccagcccucccaggagcugccccagcacgagcucccgcccgaggagcccgugagcgaggggacccagcacgacccccugucccaggagagcgagcuggaggagccgcucucccaggagagcgaggucgaggagccccugucccaggagagccagguggaggagccccugucccaggagagcgagguggaggagccccucucccaggagagccaggucgaggagccgcugagccaggaguccgagguggaggagccccugagccaggaguccgagguggaggagccccucagccaggagucccaggucgaggagccccugagccaggaguccgagguggaggagccgcugagccaggagucccagguggaggagccccucagccaggaguccgagauggaggagccccugagccaggagucccaggucgaggagccccugagccaggaguccgagauggaggagccgcucagccaggaguccgagauggaggagcugcccagcguguga

SEQ ID NO: 38575 - RNA, 621 nt, Artificial Sequence
  derived and/or modified sequence opt1 from VCX__Homo_sapiens__NP_038480
augagccccaagccgcgcgccuccggcccgcccgccaaggcgaccgaggccgggaagcgcaagagcuccagccagcccucccccagcgaccccaagaagaagaccacgaagguggccaagaagggcaaggccguccggcgggggcgccggggcaagaagggggccgcgaccaagauggccgccgugaccgcccccgaggcggaguccgcccccgccgccccgggccccagcgaccagcccucccaggagcugccccagcacgagcucccgcccgaggagcccgugagcgagggcacccagcacgacccccugucccaggaggccgagcuggaggagccgcucagccaggaguccgaggucgaggagccccugagccaggagucccagguggaggagccccugagccaggaguccgagguggaggagccccucagccaggagucccaggucgaggagccgcugagccaggagagcgagguggaggagccccugucccaggagagccagguggaggagccccucucccaggagagcgagauggaggagccccugucccaggagagccaggucgaggagccgcccucccaggagagcgagauggaggagcugcccuccguguga

SEQ ID NO: 38576 - RNA, 378 nt, Artificial Sequence
  derived and/or modified sequence opt1 from VCY__Homo_sapiens__NP_004670
augagccccaagccgcgcgccuccggcccgcccgccaaggcgaaggagaccgggaagcgcaagagcuccagccagcccucccccagcggccccaagaagaagaccacgaagguggccgagaagggggaggccguccggggcgggcggcgcggcaagaagggcgccgccaccaagauggcggccgugaccgcccccgaggccgaguccgggcccgcggccccgggccccagcgaccagcccucccaggagcugccccagcacgagcucccgcccgaggagcccgugagcgaggggacccagcacgacccccugucccaggagagcgagcuggaggagccgcucuccaagggccggcccagcacgccccugucccccuga

SEQ ID NO: 38577 - RNA, 852 nt, Artificial Sequence
  derived and/or modified sequence opt1 from VDAC1__Homo_sapiens__XP_005272132
auggccgugcccccgaccuacgccgaccugggcaagagcgcgcgcgacgucuucaccaagggguacggcuucgggcucaucaagcuggaccugaagacgaaguccgagaacggccucgaguucaccagcuccgggagcgccaacaccgagaccacgaaggugaccggcucccuggagaccaaguaccgguggaccgaguacggccugacguucaccgagaaguggaacaccgacaacacccucgggacggagaucaccguggaggaccagcuggcccgcggccugaagcucaccuucgacagcuccuucagccccaacaccgggaagaagaacgccaagaucaagacgggcuacaagcgggagcacaucaaccuggggugcgacauggacuucgacaucgccggccccuccauccgcggcgcgcugguccucggguacgagggcuggcuggccggguaccagaugaacuucgagaccgccaagagccgggugacccaguccaacuucgccgugggcuacaagaccgacgaguuccagcugcacacgaacgucaacgacggcaccgaguucgggggcagcaucuaccagaaggugaacaagaagcucgagaccgcggugaaccuggccuggaccgccgggaacuccaacacgcgcuucggcaucgccgccaaguaccagaucgaccccgacgcgugcuucagcgccaaggucaacaacuccagccugaucgggcucggcuacacccagacccugaagccgggcaucaagcugacccucuccgcccugcuggacgggaagaacgugaacgccggcgggcacaagcucggccuggggcuggaguuccaggccuga

SEQ ID NO: 38578 - RNA, 930 nt, Artificial Sequence
  derived and/or modified sequence opt1 from VDAC2__Homo_sapiens__NP_001171712
augagcuggugcaacgagcugcgccuccccgcccugaagcagcacuccaucggccgggggcuggagagccacaucaccaugugcaucccgcccuccuacgccgaccucggcaaggcggcccgcgacaucuucaacaagggguucggcuucgggcuggugaagcuggacgucaagaccaagagcugcuccggcguggaguucagcacguccggcagcuccaacaccgacaccgggaaggugaccggcacgcucgagaccaaguacaaguggugcgaguacgggcugaccuucaccgagaaguggaacacggacaacacccugggcaccgagaucgccaucgaggaccagaucugccaggggcucaagcugaccuucgacacgaccuucagccccaacaccggcaagaaguccggcaagaucaagagcuccuacaagcgggagugcaucaaccuggggugcgacgucgacuucgacuucgccggccccgccauccacgggagcgcgguguucggcuacgagggcuggcucgccggguaccagaugaccuucgacuccgccaagagcaagcugacgcgcaacaacuucgccgugggcuaccggaccggggacuuccagcugcacaccaacgucaacgacggcaccgaguucgggggcuccaucuaccagaaggugugcgaggaccucgacacgagcgugaaccuggcguggaccuccggcaccaacugcacccgcuucgggaucgccgccaaguaccagcuggacccgacggccagcaucagcgccaaggucaacaacuccagccucaucggcgugggguacacccagacccugcggcccggcgugaagcugacccucuccgcgcuggucgacggcaagagcaucaacgccgggggccacaagguggggcuggcccucgagcuggaggccuga

SEQ ID NO: 38579 - RNA, 1284 nt, Artificial Sequence
  derived and/or modified sequence opt1 from VDR__Homo_sapiens__NP_000367
auggaggccauggccgcgagcaccucccugcccgacccgggcgacuucgaccgcaacgugccccggaucugcggggucugcggcgaccgcgccaccggguuccacuucaacgccaugaccugcgagggcugcaagggguucuuccggcgcagcaugaagcggaaggcccucuucacgugccccuucaacggcgacugccgcaucaccaaggacaaccggcgccacugccaggccugccggcugaagcgcugcguggacaucggcaugaugaaggaguucauccugaccgacgaggaggugcagcggaagcgcgagaugauccucaagcggaaggaggaggaggcgcugaaggacucccugcgccccaagcucagcgaggagcagcagcggaucaucgccauccugcuggacgcccaccacaagaccuacgacccgaccuacuccgacuucugccaguuccgcccgcccguccgggugaacgacgggggcgggagccaccccucccgccccaacagccggcacacccccuccuucagcggcgacuccagcuccagcugcuccgaccacugcaucaccagcuccgacaugauggacagcuccagcuucagcaaccucgaccuguccgaggaggacagcgacgaccccuccgugacgcuggagcucagccagcuguccaugcugccccaccucgccgaccuggucagcuacuccauccagaaggugaucggguucgcgaagaugaucccgggcuuccgcgaccugaccagcgaggaccagaucgugcuccugaaguccagcgccaucgaggucaucaugcugcgguccaacgagagcuucaccauggacgacauguccuggaccugcggcaaccaggacuacaaguaccgcgugagcgacgugacgaaggccgggcacucccucgagcugaucgagccccugaucaaguuccaggucggccucaagaagcugaaccugcacgaggaggagcacgugcuccugauggccaucugcaucgugagccccgaccgccccgggguccaggacgccgcgcugaucgaggccauccaggaccggcucuccaacacccugcagaccuacauccgcugccggcacccgccgcccggcagccaccuccuguacgccaagaugauccagaagcuggccgaccugcgcucccucaacgaggagcacagcaagcaguaccggugccugagcuuccagcccgagugcuccaugaagcugacgccccucgugcuggagguguucggcaacgagaucagcuga

SEQ ID NO: 38580 - RNA, 1239 nt, Artificial Sequence
  derived and/or modified sequence opt1 from VEGFA__Homo_sapiens__NP_001020537
augaccgaccgccagaccgacacggcccccagcccguccuaccaccuccugcccggccggcgccggaccguggacgccgcggccagccgcgggcagggccccgagcccgcccccgggggcggggucgagggcgugggcgcccgcgggguggcccugaagcuguucguccagcuccugggcugcucccgguucgggggcgcgguggugcgggccggggaggccgagcccagcggcgccgcgcgcuccgccagcuccggccgggaggagccccagcccgaggagggggaggaggaggaggagaaggaggaggagcgcggcccgcaguggcggcugggggcccgcaagcccggcagcuggaccggcgaggccgccgucugcgcggacuccgcccccgccgcccgggccccgcaggcgcucgcccgcgccagcgggcggggcgggcgcguggcccggcgcggcgccgaggaguccgggccgccccacagccccucccggcgcggcagcgcgucccgggccggccccgggcgcgccagcgagaccaugaacuuccugcuguccugggugcacuggagccucgcccugcugcucuaccugcaccacgccaaguggucccaggcggccccgauggccgagggcgggggccagaaccaccacgaggucgugaaguucauggacguguaccagcgcagcuacugccaccccaucgagacgcuggucgacaucuuccaggaguaccccgacgagaucgaguacaucuucaagcccagcugcgugccgcucaugcggugcgggggcugcugcaacgacgagggccuggagugcgugcccaccgaggaguccaacaucaccaugcagaucaugcgcaucaagccccaccaggggcagcacaucggcgagaugagcuuccugcagcacaacaagugcgagugccggcccaagaaggaccgcgcccggcaggagaagaaguccguccgcgggaagggcaaggggcagaagcggaagcgcaagaagucccgguacaagagcuggagcguguacgugggcgcgcgcugcugccucaugccguggucccugcccggcccccaccccugcgggccgugcagcgagcggcgcaagcaccuguucguccaggacccccagaccugcaagugcuccugcaagaacacggacagccggugcaaggcccgccagcucgagcugaacgagcggaccugccgcugcgacaagccccggcgcuga

SEQ ID NO: 38581 - RNA, 567 nt, Artificial Sequence
  derived and/or modified sequence opt1 from VEGFB__Homo_sapiens__NP_001230662
augagcccccugcuccgccggcugcugcucgccgcccugcugcagcucgcgccggcccaggcccccgugucccagcccgacgcccccggccaccagcgcaaggucgugagcuggaucgacguguacacccgggcgaccugccagccgcgcgaggucguggugccccugaccgucgagcugauggggaccguggccaagcagcucgugcccuccugcgucaccgugcagcggugcggcgggugcugccccgacgacggccuggagugcgugccgaccgggcagcaccagguccgcaugcagauccugaugauccgguaccccagcucccagcucggcgagaugagccuggaggagcacucccagugcgagugccgccccaagaagaaggacagcgccgugaagcccgacuccccgcggccccugugcccccgcugcacgcagcaccaccagcggcccgacccgcggaccugccgcugccgcugccggcgccggagcuuccuccgcugccagggccgggggcuggagcugaaccccgacacgugccgcugccggaagcuccgccgcuga

SEQ ID NO: 38582 - RNA, 1260 nt, Artificial Sequence
  derived and/or modified sequence opt1 from VEGFC__Homo_sapiens__NP_005420
augcaccuccugggcuucuucagcguggccugcucccugcuggccgcggcccuccugcccgggccgcgcgaggcccccgccgccgcggccgccuucgagagcggccuggaccucuccgacgccgagcccgacgcgggggaggccaccgccuacgccagcaaggaccuggaggagcagcugcgguccgucagcuccguggacgagcucaugaccgugcuguaccccgaguacuggaagauguacaagugccagcugcgcaagggcggguggcagcacaaccgggagcaggccaaccucaacagccgcacggaggagaccaucaaguucgcggccgcccacuacaacaccgagauccugaaguccaucgacaacgaguggcggaagacccagugcaugccgcgcgaggucugcaucgacgugggcaaggaguucggcguggccacgaacaccuucuucaagccgcccugcgucagcguguaccggugcgggggcugcugcaacuccgaggggcugcagugcaugaacaccagcaccuccuaccucagcaagacgcuguucgagaucaccgugccccugucccagggccccaagcccgucaccaucagcuucgccaaccacaccuccugccgcugcaugagcaagcucgacguguaccgccaggugcacuccaucauccggcggagccugcccgcgacgcugccccagugccaggccgccaacaagaccugcccgaccaacuacauguggaacaaccacaucugccgcugccucgcccaggaggacuucauguucagcuccgacgccggggacgacagcaccgacggcuuccacgacaucugcggccccaacaaggagcuggacgaggagacgugccagugcgucugccgggcggggcugcgccccgccuccugcggcccccacaaggagcucgaccggaacagcugccagugcgugugcaagaacaagcuguucccgucccagugcggggccaaccgcgaguucgacgagaacacgugccagugcgugugcaagcggaccugcccccgcaaccagccccugaaccccggcaagugcgccugcgagugcaccgagagcccgcagaagugccuccugaagggcaagaaguuccaccaccagaccugcuccugcuaccggcgccccugcaccaaccggcagaaggccugcgagcccggguucagcuacuccgaggaggucugccgcugcgugcccagcuacuggaagcgcccgcagauguccuga

SEQ ID NO: 38583 - RNA, 777 nt, Artificial Sequence
  derived and/or modified sequence opt1 from VENTX__Homo_sapiens__NP_055283
augcgccugagcuccagcccgccccggggcccccagcagcucuccagcuucggguccguggacuggcugagccaguccagcugcuccggccccacccacacgccccgcccggccgacuucagccuggggucccuccccggccccgggcagaccagcggcgcccgggagcccccgcaggcggucuccaucaaggaggccgccggcagcuccaaccugcccgcccccgagcgcaccauggccgggcugagcaaggagcccaacacccuccgggcgccgcgcgugcggaccgccuucacgauggagcagguccgcacccuggagggcguguuccagcaccaccaguaccugagcccccucgagcggaagcgccuggcccgggagaugcagcuguccgaggugcagaucaagaccugguuccagaaccgccggaugaagcacaagcgccagaugcaggacccccagcuccacucccccuucagcgggagccugcacgccccgcccgcguucuacuccaccagcuccggccuggccaacgggcuccagcugcugugccccugggcgccccucagcggcccgcaggcccugaugcugccgcccggcuccuucugggggcucugccagguggcccaggaggcccuggccagcgccggcgccuccugcugcgggcagccccuggccagccacccgcccacgcccggccggcccucccucggccccgcgcugagcaccgggccccgcggccugugcgccaugccccagaccggggacgccuucuga

SEQ ID NO: 38584 - RNA, 2367 nt, Artificial Sequence
  derived and/or modified sequence opt1 from VEPH1__Homo_sapiens__NP_001161383
augcaccagcuguuccgccucgugcugggccagaaggaccugagccgggccggggaccucuucucccuggacgacagcgagaucgaggacucccugaccgaggcccucgagcagaucaagaucaucagcuccagcuccgacuaccagaccaacaacaacgaccaggcggucguggagaucugcaucacgcgcaucaccaccgccauccgggagaccgagagcaucgagaagcacgccaaggcccuggugggccugugggacuccugccucgagcacaaccugcgccccuucgggaaggacgaggacacgccgcacgccaagaucgcgagcgacaucauguccugcauccugcagaacuacaaccggccgcccgucauggcccucgccauccccaucgccgugaaguuccugcaccgcggcaacaaggagcugugccggaacaugagcaacuaccucucccuggcggccaucaccaaggccgaccugcucgccgaccacaccgaggugaucgucaagagcauccugcaggggaacaccaugcugcuccgcgugcugcccgccguguacgagaagcagccccagcccaucaaccggcaccugacggagcuccuggcgcugaugucccagcucgagcagcccgagcaguaccaccuccugcgccugcugcacgucgccgccaagaagaagcagcuggagguggugcagaagugcaucccguuccucaucggccaccugaaggacagcacccacaacgacaucauccugaacauccucaucgagaucgccgucuacgagcccguggcccugaacuccuuccugcccaugcucaaggagaucggcgagcgguuccccuaccugaccgggcagauggcgcgcaucuacggcgccguggggcacgucgacgaggagcgggcccgcagcugccugaccuaccucgugucccagcuggccaacauggagcacagcuuccaccacauccugcuccuggagaucaagagcaucacggacaccuucuccagcauccugggcccgcagucccgggacaucuuccgcaugagcaacuccuucaccgccaucgcgaagcuccugacccggcagcuggagaacacgaaggccgggagcggccgccggaagaucuccaccgagaucgaguuccccgagaagcuggaggagaccaagcucaucgugaccgagaacgaggaccacgagaagcugcaggucaagauccaggccuucgaggacaagaucaacgccggcagcaacacgcccggguccauccgccgguacagccugggccagguguccaaggaggagcgcaagaacauccgcuucaaccggagcaagucccucgccuuccacaccaugcugaccaagggggugggcagcgacgacggcgaggacgagaaccgcggggacauccccgcguccaucagccuguccgagaucgacccgcucggccaggggaacgacaagcugcccuucaagaccgacacggagcggagccagcugggcgaguccagcgucagcuaccccaacaucauccacaucgacuccgagaaccucagcgagaccgugaaggagaacucccaggaggagacccccgagaccacggccagcccgaucgaguaccaggacaagcuguaccugcaccucaagaagaaccuguccaaggugaaggccuacgccauggagaucgggaagaagauccccguccccgaccagugcaccaucgaggacaccgugcgcagcugcgucgcgaagcuguucuucacgugcucccucaagggccacuacugccuguacagcaaguccagcuucauccugaucucccaggagccccagccguggauccagaucauguuccucuuccagcaggaccuggaccaggugcagcugcaccucgaggaggugcgguucuucgacgucuucggcuucagcgagaccgccggggccuggcagugcuucaugugcaacaaccccgagaaggccaccguggugaaccaggacggccagccccugaucgaggggaagcugaaggagaagcagguccgcuggaaguucaucaagcgguggaagacccgcuacuucacccucgccggcaaccagcugcuguuccagaaggggaaguccaaggacgaccccgacgacugcccgaucgagcucagcaaggugcaguccgugaaggcggucgccaagaagcggcgcgaccggagccugccccgcgccuucgagaucuucacggacaacaagaccuacguguucaaggccaaggacgagaagaacgccgaggaguggcugcagugcaucaacguggcggucgcccaggccaaggagcgggagucccgcgaggugaccaccuaccucuga

SEQ ID NO: 38585 - RNA, 2340 nt, Artificial Sequence
  derived and/or modified sequence opt1 from VEZT__Homo_sapiens__NP_060069
augacccccgaguucgacgaggagguggucuucgagaacagcccgcuguaccaguaccuccaggaccugggccacaccgacuucgagaucugcuccagccugucccccaagacggagaagugcaccaccgaggggcagcagaagccgcccacccgcgugcuccccaagcagggcauccugcugaagguggccgagacgaucaagagcuggaucuucuucucccagugcaacaagaaggacgaccuccugcacaagcuggacaucggguuccggcucgacagccugcacaccauccugcagcaggagguccuccugcaggaggacguggagcugaucgagcuccuggaccccuccauccugagcgccggccagucccagcagcaggagaacgggcaccuccccacccugugcagccuggcgacccccaacaucugggaccucuccaugcuguucgccuucaucagccugcucgugaugcugccgacgugguggaucgucuccagcuggcugguguggggcgugauccucuucgucuaccuggugauccgcgcccugcggcucuggcgcaccgccaagcuccaggugacccugaagaaguacuccguccaccucgaggacauggccaccaacagccgggcguucacgaaccuggugcgcaaggcccugcggcucauccaggagaccgaggugaucucccgcggcuucacccuggucagcgccgccugccccuucaacaaggcggggcagcaccccucccagcaccugaucggccuccggaaggccguguaccgcacccugcgggccaacuuccaggccgcccgccuggcgacgcucuacaugcugaagaacuacccccugaacagcgagagcgacaacgugaccaacuacaucugcgucgugccguucaaggagcucgggcugggccuguccgaggagcagaucagcgaggaggaggcccacaacuucaccgacggguucucccuccccgcccugaaggugcuguuccagcugugggucgcccagagcuccgaguucuuccggcgccucgcccugcugcucagcaccgcgaacuccccgcccggcccccugcugacgcccgcccuccugccccaccggauccugagcgacgugacccagggccucccccacgcccacuccgccugccuggaggagcugaagcgcagcuacgaguucuaccgguacuucgagacccagcaccaguccgugccgcagugccucagcaagacccagcagaagucccgcgagcugaacaacguccacacggccgugcggagccugcagcuccaccugaaggcgcugcucaacgaggucaucauccuggaggacgagcuggagaagcucgugugcaccaaggagacccaggagcugguguccgaggccuaccccauccuggagcagaagcucaagcugauccagccccacguccaggccagcaacaacugcugggaggaggccaucucccagguggacaagcugcuccgccggaacaccgacaagaaggggaagcccgagaucgccugcgagaacccgcacugcacgguggucccccugaagcagcccacccugcacaucgcggacaaggaccccaucccggaggagcaggagcucgaggccuacguggacgacaucgacaucgacagcgacuuccgcaaggacgacuucuacuaccugucccaggaggacaaggagcgccagaagcgggagcacgaggagagcaagcgcgugcugcaggagcucaagagcguccugggcuucaaggccuccgaggccgagcggcagaaguggaagcagcugcuguucagcgaccacgcggugcugaagucccugagccccguggaccccgucgagccgaucuccaacagcgagcccuccaugaacagcgacauggggaagguguccaagaacgacaccgaggaggagagcaacaaguccgccaccacggacaacgagaucagccgcaccgaguaccucugcgagaacucccuggagggcaagaacaaggacaacagcuccaacgagguguucccccagggcgccgaggagcggaugugcuaccagugcgagagcgaggacgagccccaggccgacggguccggccugaccaccgccccgcccacgccccgcgacagccuccagcccagcaucaagcagcggcuggcgcgccugcagcucuccccggacuucaccuucaccgccgggcuggccgccgaggucgccgcgcggagccuguccuucaccaccaugcaggagcagacguucggcggggaggaggaggagcagaucaucgaggagaacaagaacgagaucgaggagaaguga

SEQ ID NO: 38586 - RNA, 1848 nt, Artificial Sequence
  derived and/or modified sequence opt1 from VGF__Homo_sapiens__XP_011514851
augaaggcccugcgccucagcgccuccgcgcuguucugccugcuccugaucaacggccugggggccgcccccccgggccggcccgaggcccagccccccccgcucagcuccgagcacaaggagcccguggccggggacgcgguccccggccccaaggacgggagcgccccggaggugcgcggcgcccggaacuccgagccccaggacgagggcgagcuguuccaggggguggacccccgcgcccuggcggccguccuccugcaggcccuggaccggcccgccagcccgcccgcccccuccggcagccagcaggggcccgaggaggaggcggccgaggcccuccugaccgagaccgugcgcucccagacgcacagccugccggcccccgagucccccgagcccgccgcgccgccccggccccagacccccgagaacggcccggaggccagcgaccccuccgaggagcucgaggcccuggccagccugcuccaggagcugcgcgacuucucccccagcuccgccaagcggcagcaggagaccgcggccgccgagaccgagacgcgcacccacacccugacccgggugaaccucgagagccccgggccggagcgcgucuggcgggccuccuggggcgaguuccaggcccgcgugcccgagcgggcgccccugccgccccccgcccccagccaguuccaggcccgcaugccggacagcggcccccugcccgagacgcacaaguucggggagggcguguccagccccaagacccaccucggggaggcccuggcgccgcuguccaaggccuaccagggcgucgccgcccccuuccccaaggcccggcgccccgagagcgcgcuccugggcggguccgaggccggcgagcggcugcuccagcaggggcuggcccagguggaggccggccgccggcaggccgaggcgacccgccaggccgccgcccaggaggagcgccuggccgaccucgcgagcgaccugcugcuccaguaccugcugcaggggggcgcccggcagcgcggccucgggggccgggggcugcaggaggccgccgaggagcgcgaguccgcgcgggaggaggaggaggccgagcaggagcgccggggcggggaggagcgcgugggcgaggaggacgaggaggccgccgaggccgaggcggaggccgaggaggccgagcgggcccgccagaacgcccugcucuucgcggaggaggaggacggcgaggccggggccgaggacaagcggagccaggaggagaccccgggccaccgccggaaggaggccgaggggacggaggagggcggggaggaggaggacgacgaggagauggacccccagaccaucgacucccugaucgagcugagcaccaagcuccaccugcccgccgacgacgucguguccaucaucgaggagguggaggagaagcgcaagcggaagaagaacgcgcccccggagcccgucccccccccgcgcgccgcccccgcccccacccacgugcggagcccccagccgccccccccggcgcccgcccccgcccgcgacgagcugcccgacuggaacgaggugcucccgcccugggaccgggaggaggacgaggucuacccccccggcccguaccaccccuuccccaacuacauccgcccccgcacgcugcagccgcccuccgcccugcggcgccggcacuaccaccacgcccugccccccagccgccacuacccgggccgggaggcgcaggcccgccgggcccaggaggaggccgaggccgaggagcgccggcuccaggagcaggaggagcuggagaacuacaucgagcacgugcugcuccgccggcccuga

SEQ ID NO: 38587 - RNA, 777 nt, Artificial Sequence
  derived and/or modified sequence opt1 from VGLL1__Homo_sapiens__NP_057351
auggaggagaugaagaagaccgccauccgccugcccaagggcaagcagaagcccaucaagaccgaguggaacagccggugcguccucuucacguacuuccagggggacaucuccagcgugguggacgagcacuucucccgcgcccugagcaacaucaagagcccccaggagcugacccccuccucccagagcgagggcgugaugcucaagaacgacgacuccaugagccccaaccaguggcgguacuccagcccguggaccaagccccagcccgagguccccgugaccaaccgcgcggccaacugcaaccugcacgugccggggcccauggccgucaaccaguucucccccagccuggcccggcgcgccuccgugcggcccggcgagcucuggcacuucagcucccuggcggggacgagcucccuggagccgggcuacagccaccccuuccccgcccgccaccucgugcccgagccgcagcccgacggcaagcgggagccccugcugagccuccugcagcaggaccgcugccuggcccggccccaggaguccgccgcgcgcgagaacgggaacccgggccagaucgccgggagcaccggccuccuguucaaccugccgcccggguccguccacuacaagaagcucuacgugagccggggcuccgccagcaccucccugcccaacgagacccugagcgagcucgagacgcccggcaaguacucccugaccccgcccaaccacugggggcacccccaccgcuaccugcagcaccucuga

SEQ ID NO: 38588 - RNA, 432 nt, Artificial Sequence
  derived and/or modified sequence opt1 from VGLL2__Homo_sapiens__NP_703154
augagcugccuggacgugauguaccaggucuacgggcccccgcagcccuacuucgccgccgcguacacccccuaccaccagaagcucgccuacuacuccaagaugcaggaggcccaggagugcaacgccagccccuccagcuccggcagcggcuccagcuccuucagcucccagaccccggccagcaucaaggaggaggaggggucccccgagaaggagcgcccgcccgaggcggaguacaucaacagccggugcgugcuguucacguacuuccagggcgacaucuccagcguggucgacgagcacuucucccgcgcccugagccagcccuccagcuacagccccuccugcaccagcuccaaggcgccccggagcuccgggcccuggcgcgcccggcgcuacagccucugcggcgccucccugcugagcuga

SEQ ID NO: 38589 - RNA, 981 nt, Artificial Sequence
  derived and/or modified sequence opt1 from VGLL3__Homo_sapiens__NP_057290
augagcugcgccgaggugauguaccacccccagccguacggcgccucccaguaccugcccaaccccauggcggccacgaccugccccaccgccuacuaccagccggcgccccagcccgggcagcagaagaagcucgccgucuucagcaagaugcaggacucccuggaggugacccugcccagcaagcaggaggaggaggacgaggaggaggaggaggaggagaaggaccagccggccgagauggaguaccucaacucccgcugcgugcuguucaccuacuuccagggcgacaucgggagcgucguggacgagcacuucucccgggcccugggccaggccaucacccuccaccccgagagcgccaucuccaagagcaagauggggcugacgccccuguggcgcgacuccagcgcgcucuccagccagcggaacuccuuccccaccagcuucuggaccuccagcuaccagccgccgcccgcccccugccugggcggcgugcaccccgacuuccaggucaccgggccgcccggcacguucuccgccgccgaccccagccccuggcccgggcacaaccugcaccagaccggccccgcgcccccgcccgccgugagcgaguccuggcccuacccccucaccagccagguguccccgagcuacucccacaugcacgacgucuacaugcgccaccaccacccccacgcccacaugcaccaccggcaccgccaccaccaccaccaccaccacccgcccgccgggagcgcccuggaccccuccuacggcccccugcucaugcccagcgugcacgccgcgcggaucccggcgccccagugcgacaucaccaagacggagcccaccaccgugaccuccgccacgagcgccugggccggcgccuuccacgggaccgucgacaucgugcccuccgugggcuucgacaccgggcugcagcaccaggacaagagcaaggaguccccgugguacuga

SEQ ID NO: 38590 - RNA, 891 nt, Artificial Sequence
  derived and/or modified sequence opt1 from VGLL4__Homo_sapiens__NP_001121691
augcuguucaugaagauggaccuccugaacuaccaguaccuggacaagaugaacaacaacaucggcauccucugcuacgagggggaggccgcccugcgcggcgagccccggauccagacccugccgguggcgagcgcccucuccagccaccgcaccgggcccccgcccaucucccccagcaagcggaaguucuccauggagcccggcgacgaggaccuggacugcgacaacgaccacgucagcaagaugucccgcaucuucaacccccaccugaacaagaccgccaacggggacugccggcgcgacccccgggagcgcagccgguccccgaucgagcgcgccguggcccccaccaugagccuccacggcucccaccuguacaccagccugcccucccucggccuggagcagccccuggcgcucaccaagaacagccuggacgccucccggccggccgggcugagccccacgcucacccccggcgagcgccagcagaaccggcccuccgugaucacgugcgccagcgcgggggcccgcaacugcaaccugucccacugcccgaucgcccacagcggcugcgccgcccccgggcccgcgagcuaccggcggcccccguccgccgccacgaccugcgaccccgucguggaggagcacuuccgccgcagccugggcaagaacuacaaggagcccgagcccgccccgaacuccgugagcaucaccggcuccgucgacgaccacuucgccaaggcgcucggggacaccuggcugcagaucaaggccgccaaggacggcgccagcuccagccccgaguccgccagccggcgcgggcagcccgcgucccccagcgcccacauggugucccacagccacuccccgagcguggucuccuga

SEQ ID NO: 38591 - RNA, 642 nt, Artificial Sequence
  derived and/or modified sequence opt1 from VHL__Homo_sapiens__NP_000542
augccccgccgggccgagaacugggacgaggccgaggugggcgcggaggaggccggggucgaggaguacggcccggaggaggacgggggcgaggagagcggggccgaggaguccggccccgaggagagcggccccgaggagcugggggccgaggaggagauggaggccggccgcccccggccggugcuccgcuccgugaacagccgggagcccucccaggucaucuucugcaaccgcagcccccggguggugcugcccgucuggcugaacuucgacggggagccgcagcccuaccccacccugcccccgggcaccgggcgccggauccacuccuaccgcggccaccucuggcuguuccgggacgcgggcacgcacgacgggcuccuggugaaccagaccgagcuguucgugcccagccucaacgucgacggccagcccaucuucgccaacaucacccugcccguguacacccugaaggagcgcugccuccaggugguccggucccuggugaagccggagaacuaccgccggcuggacaucgugcgcagccucuacgaggaccuggaggaccaccccaacguccagaaggaccuggagcggcucacgcaggagcgcaucgcccaccagcggaugggggacuga

SEQ ID NO: 38592 - RNA, 420 nt, Artificial Sequence
  derived and/or modified sequence opt1 from VHLL__Homo_sapiens__NP_001004319
augcccuggcgcgccggcaacggggugggccuggaggcccaggcggggacccaggaggccggcccggaggaguacugccaggaggagcucggggccgaggaggagauggccgcccgggcggccuggcccguccugcgcagcgugaacucccgggagcugagccgcaucaucaucugcaaccacagcccccggaucgugcuccccgucuggcugaacuacuacggcaagcugcucccguaccugacccugcuccccggccgcgacuuccggauccacaacuuccgcucccaccccuggcuguuccgggacgcccgcacgcacgacaagcugcucgugaaccagaccgagcuguucgugcccuccagcaacgucaacgggcagccgguguucgccaacaucacccugcagugcauccccuga

SEQ ID NO: 38593 - RNA, 2484 nt, Artificial Sequence
  derived and/or modified sequence opt1 from VIL1__Homo_sapiens__NP_009058
augaccaagcugagcgcccaggugaagggcucccucaacaucaccacgcccgggcugcagaucuggcgcaucgaggccaugcagauggucccggugcccagcuccaccuucggcagcuucuucgacggggacugcuacaucauccuggcgauccacaagaccgccuccagccucuccuacgacauccacuacuggaucggccaggacagcucccuggacgagcagggggccgccgccaucuacaccacgcagauggacgacuuccugaagggccgggcggugcagcaccgcgagguccagggcaacgagagcgaggccuuccggggguacuucaagcagggccucgugauccgcaagggcgggguggccuccgggaugaagcacgucgagaccaacagcuacgacgugcagcggcugcugcacgugaagggcaagcgcaacgucguggccggcgagguggagauguccuggaaguccuucaaccgcggggacgucuuccuccuggaccugggcaagcucaucauccaguggaacgggcccgagagcacccggauggagcggcugcgcggcaugacccuggcgaaggagauccgggaccaggagcgcggcgggcggacguacgugggcguggucgacggggagaacgagcucgccagccccaagcugauggaggugaugaaccacgugcugggcaagcgccgggagcucaaggccgccgucccggacaccgugguggagcccgcccugaaggcggcccugaagcucuaccacgucuccgacagcgaggggaaccugguggugcgcgaggucgccacccggccccugacccaggaccuccugucccacgaggacugcuacauccuggaccagggcggccucaagaucuacguguggaaggggaagaaggccaacgagcaggagaagaagggcgccaugagccacgcgcugaacuucaucaaggccaagcaguacccgcccagcacgcaggucgaggugcagaacgacggggccgaguccgccguguuccagcagcuguuccagaaguggaccgccagcaaccgcaccuccggccucgggaagacccacacggucggcagcguggcgaagguggagcaggucaaguucgacgccaccuccaugcacgugaagccccagguggccgcccagcagaagauggucgacgacggcagcggggagguccagguguggcggaucgagaaccuggagcuggugcccguggacuccaaguggcucggccacuucuacgggggcgacugcuaccugcugcucuacaccuaccugaucggggagaagcagcacuaccugcucuacguguggcagggcagccaggccucccaggacgagaucaccgcgagcgccuaccaggccgucauccuggaccagaaguacaacggcgagcccgugcagauccgcgugccgauggggaaggagccgccccaccugauguccaucuucaagggccggauggucguguaccagggcgggacgagccgcaccaacaaccucgagaccggccccuccacccgccuguuccaggugcaggggacgggcgccaacaacaccaaggcguucgagguccccgcccgggccaacuuccugaacagcaacgacguguucgugcucaagacccaguccugcugcuaccuguggugcgggaagggcugcagcggggacgagcgcgagauggccaagauggucgccgacaccaucucccggacggagaagcaggucgugguggagggccaggagcccgcgaacuucuggauggcccugggcgggaaggcccccuacgccaacaccaagcgccuccaggaggagaaccuggugaucacgccccggcuguucgagugcagcaacaagaccggccgcuuccuggccaccgagaucccggacuucaaccaggacgaccucgaggaggacgacguguuccugcuggacgucugggaccagguguucuucuggaucgggaagcacgcgaacgaggaggagaagaaggccgccgccaccaccgcccaggaguaccucaagacccaccccuccggccgggaccccgagacgcccaucaucguggucaagcaggggcacgagccgcccaccuucaccggcugguuccuggcgugggaccccuucaaguggagcaacaccaagagcuacgaggaccugaaggccgagcucggcaacucccgcgacuggagccagaucaccgccgaggugacgucccccaagguggacgucuucaacgccaacagcaaccuguccagcgggccgcugcccaucuucccccucgagcagcuggugaacaagccgguggaggagcugcccgagggcgucgaccccucccggaaggaggagcaccucagcaucgaggacuucacccaggcguucgggaugacccccgccgccuucuccgcccugccgcgcuggaagcagcagaaccugaagaaggagaagggccucuucuga

SEQ ID NO: 38594 - RNA, 1401 nt, Artificial Sequence
  derived and/or modified sequence opt1 from VIM__Homo_sapiens__XP_011517951
augagcacccgcuccgugagcuccagcuccuaccggcgcauguucggcgggcccggcaccgccagccggccguccagcucccgcagcuacgucacgaccuccacccggaccuacagccugggguccgcccuccgccccagcacgucccggagccuguacgcguccagccccggcgggguguacgccacccgcuccagcgccgugcggcugcgcagcuccguccccggcgugcggcuccugcaggacagcguggacuucucccuggccgacgccaucaacaccgaguucaagaacacccgcacgaacgagaaggucgagcuccaggagcugaacgaccgguucgcgaacuacaucgacaaggugcgcuuccuggagcagcagaacaagauccuccuggccgagcuggagcagcucaagggccagggcaagagccggcugggggaccuguacgaggaggagaugcgcgagcuccggcgccagguggaccagcugaccaacgacaaggcccgggucgagguggagcgcgacaaccuggccgaggacaucaugcggcuccgcgagaagcugcaggaggagaugcugcagcgcgaggaggcggagaacacccuccaguccuuccggcaggacguggacaacgccagccuggcccgccuggaccucgagcggaaggucgagucccugcaggaggagaucgccuuccugaagaagcuccacgaggaggagauccaggagcugcaggcccagauccaggagcagcacgugcagaucgacguggacgucagcaagccggaccugaccgcggcccuccgcgacgugcggcagcaguacgaguccguggccgccaagaaccugcaggaggccgaggagugguacaagagcaaguucgcggaccuguccgaggccgccaaccgcaacaacgacgcccuccggcaggccaagcaggagagcacggaguaccgccggcagguccagucccugaccugcgagguggacgcgcugaaggggaccaacgagagccucgagcgccagaugcgggagauggaggagaacuucgccguggaggccgccaacuaccaggacaccaucggccgccugcaggacgagauccagaacaugaaggaggagauggcccggcaccuccgcgaguaccaggaccugcugaacgucaagauggcgcuggacaucgagaucgccacguaccggaagcuccuggagggggaggagucccgcaucagccugccccuccccaacuucuccagccugaaccugcgggagaccaaccucgacucccugccccugguggacacccacagcaagcgcacccugcucaucaagacgguggagacccgggacggccaggucaucaacgagaccagccagcaccacgacgaccuggaguga

SEQ ID NO: 38595 - RNA, 1482 nt, Artificial Sequence
  derived and/or modified sequence opt1 from VIPAS39__Homo_sapiens__NP_001180244
augaaccgcaccaagggcgacgaggaggaguacuggaacagcuccaaguucaaggccuucaccuucgacgacgaggacgacgagcugagccagcucaaggaguccaagcgggccgugaacagccugcgcgacuucgucgacgacgacgacgacgacgaccuggagcggguguccuggagcggggagcccgugggcuccaucagcugguccauccgcgagacggcggggaacagcggcuccacccacgaggggcgggagcagcucaagagccgcaacuccuucagcuccuacgcccagcugccgaagcccaccagcaccuacucccugagcuccuucuuccggggccgcacgcggcccggcagcuuccagagccucuccgacgcccugagcgacacccccgccaaguccuacgccccggagcuggggcgccccaagggcgaguaccgggacuacagcaacgacuggucccccagcgacaccguccgccggcuccgcaaggggaaggugugcucccuggagcgguuccgcagccugcaggacaagcuccagcugcuggaggaggcgguguccaugcacgacggcaacgucaucaccgccgugcucaucuuccugaagcggacgcugagcaaggagauccucuuccgcgagcuggaggugcggcaggucgcccugcgccaccucauccacuuccugaaggagaucggggaccagaagcugcuccuggaccuguuccgguuccucgaccgcaccgaggagcuggcccugucccacuaccgcgagcaccucaacauccaggaccccgacaagcggaaggaguuccugaagaccugcgugggccugccguucagcgcggaggacuccgcccacauccaggaccacuacacccuccuggagcgccagaucaucaucgaggccaacgaccggcaccuggagagcgccggccagacggagaucuuccgcaagcacccccggaaggccuccauccucaacaugccccuggugaccacccuguucuacagcugcuucuaccacuacaccgaggcggaggggacguucuccagccccgucaaccucaagaagaccuucaagaucccggacaagcaguacgugcugaccgcccuggccgcccgcgccaagcuccgggcguggaacgacguggacgcccuguucaccacgaagaacuggcugggcuacaccaagaagcgcgcccccaucggguuccaccgggucguggagauccuccacaagaacaacgcccccgugcagauccugcaggaguacgucaaccugguggaggacguggacaccaagcucaaccuggccaccaaguucaagugccacgacgucgugaucgacacguaccgcgaccugaaggaccggcagcagcugcucgcguaccgcuccaagguggacaagggcagcgccgaggaggagaagaucgacgcccugcugagcuccagccagauccgguggaagaacuga

SEQ ID NO: 38596 - RNA, 513 nt, Artificial Sequence
  derived and/or modified sequence opt1 from VIP__Homo_sapiens__NP_003372
auggacacccgcaacaaggcccagcugcucgugcugcugacccuccugagcguccuguucucccagacgagcgccuggccccucuaccgggcgccguccgcccugcgccugggcgaccggauccccuucgagggggccaacgagcccgaccaggugagccucaaggaggacaucgacaugcugcagaacgcccuggccgagaacgacacccccuacuacgacgugucccgcaacgcgcggcacgccgacggcgucuucaccagcgacuucuccaagcuccuggggcagcugagcgccaagaaguaccucgagucccugaugggcaagcgcgugagcuccaacaucagcgaggacccggugcccgucaagcggcacuccgacgccguguucaccgacaacuacacgcgccugcggaagcagauggcggugaagaaguaccucaacagcauccugaacgggaagcgcuccagcgagggcgagucccccgacuuccccgaggagcuggagaaguga

SEQ ID NO: 38597 - RNA, 1251 nt, Artificial Sequence
  derived and/or modified sequence opt1 from VIPR1__Homo_sapiens__NP_001238811
augaucgaggugcagcacaagcagugccuggaggaggcccagcucgagaacgagaccaucggcugcagcaagaugugggacaaccugaccugcuggcccgccacgccgcgcgggcaggucguggugcuggcgugcccccucaucuucaagcuguucuccagcauccagggccggaacgucucccgcagcugcaccgacgagggguggacccaccuggagcccggccccuacccgaucgccugcgggcucgacgacaaggccgccucccuggacgagcagcagaccauguucuacggcagcgugaagacgggcuacaccaucggguacggccugucccucgccacccugcugguggcgaccgccauccucagccuguuccggaagcugcacugcacgcgcaacuacauccacaugcaccucuucaucuccuucauccugcgggccgccgcggucuucaucaaggaccuggcccucuucgacagcggggaguccgaccagugcagcgagggcuccguggggugcaaggccgccaugguguucuuccaguacugcgucauggccaacuucuucuggcugcugguggagggccucuaccuguacacccugcucgcggugagcuucuucuccgagcgcaaguacuucuggggcuacauccugaucggguggggcguccccagcaccuucaccaugguguggacgaucgcccggauccacuucgaggacuacgggugcugggacaccaucaacuccagccugugguggaucaucaagggccccauccucaccuccauccuggugaacuucauccuguucaucugcaucauccgcauccuccugcagaagcugcggcccccggacauccgcaagagcgacagcucccccuacagccggcucgcccgcuccacccugcugcucaucccccuguucggcguccacuacaucauguucgccuucuuccccgacaacuucaagccggaggugaagaugguguucgagcuggucguggggagcuuccagggcuucguggucgccauccucuacugcuuccugaacggggaggugcaggcggagcugcggcgcaaguggcggcgcuggcaccuccagggcgugcugggguggaaccccaaguaccggcaccccuccggcggcagcaacggggccacgugcuccacccaggucagcaugcugacccgcgugucccccggcgcccggcgcagcuccagcuuccaggccgaggucucccucguguga

SEQ ID NO: 38598 - RNA, 1077 nt, Artificial Sequence
  derived and/or modified sequence opt1 from VIPR2__Homo_sapiens__NP_001291451
augcgcacccugcugcccccggcccuccugaccugcuggcuccuggcccccgugaacagcauccaccccgagugccgguuccaccuggagauccaggaggaggagacgaagugcgcggagcuccugcgcucccagaccgagaagcacaaggccugcagcggcgucugggacaacaucacgugcuggcggcccgccaacgugggggagaccgugaccgucccgugccccaagguguucuccaacuucuacagcaaggccggcaacaucuccaagaacugcaccagcgacgggugguccgagaccuuccccgacuucguggacgccugcggcuacagcgaccccgaggacgaguccaaggucgggugcaagcugagccucguguuccugcaguacugcaucauggcgaacuucuucuggcugcucguggagggccuguaccugcacacccuccuggucgccaugcugccgccccgccggugcuuccucgccuaccugcugaucggcugggggcuccccacggugugcaucggcgccuggaccgcggcccgccuguaccuggaggacaccgggugcugggacaccaacgaccacuccgugcccuggugggucauccggaucccgauccucaucagcaucaucgugaacuucgugcuguucaucuccaucauccgcauccugcuccagaagcugacgagccccgacgucggcgggaacgaccagucccaguacaagcggcuggccaagagcacccuccugcugaucccccucuucggcgugcacuacaugguguucgccgucuuccccaucuccaucagcuccaaguaccagauccuguucgagcugugccucggcagcuuccaggggcuggugguggccguccuguacugcuuccucaacagcgaggugcagugcgagcugaagcgcaaguggcggucccgcugcccgacccccagcgcgucccgggacuaccgcgugugcggcagcuccuucagccggaacggguccgagggcgcccugcaguuccaccgcggcagccgggcccaguccuuccuccagaccgagacgagcgucaucuga

SEQ ID NO: 38599 - RNA, 2037 nt, Artificial Sequence
  derived and/or modified sequence opt1 from VIT__Homo_sapiens__NP_001171440
augcgcaccgugguccugaccaugaaggccagcgugaucgagauguuccucgugcugcuggucacgggcgugcacuccaacaaggagaccgccaagaagaucaagcggcccaaguucaccgugccgcagaucaacugcgacgucaaggcggggaagaucaucgaccccgaguucaucgugaagugccccgccggcugccaggaccccaaguaccacguguacgggaccgacgucuacgccagcuacuccagcgugugcggcgccgccgugcacuccgggguccucgacaacagcggcggcaagauccuggugcgcaagguggcggggcaguccggcuacaaggggagcuacuccaacggcguccagagccugucccucccgcgguggcgcgagagcuucaucgugcuggaguccaagcccaagaagggggugacguaccccagcgcccugaccuacuccagcuccaagagccccgccgcccaggcgggcgagaccaccaaggccuaccagcggccgcccauccccggcacgaccgcccagcccgucacccucaugcagcugcuggccgugaccguggccgucgcgacgccgaccacccucccccgccccucccccagcgccgccagcaccacguccaucccgcggccccagagcguggggcaccgcucccaggagauggaccuguggagcaccgccaccuacaccuccagccagaaccggccccgcgccgaccccggcauccagcggcaggacccguccggggcggccuuccagaagcccgugggcgccgacgucagccugggccucgugcccaaggaggagcuguccacgcagagccuggagcccgucucccucggggacccgaacugcaagaucgaccugagcuuccugaucgacggcuccaccagcaucgggaagcgccgguuccgcauccagaagcagcuccuggccgacguggcccaggcgcuggacaucggccccgccgggccccucaugggcgugguccaguacggcgacaaccccgccacccacuucaaccugaagacccacacgaacucccgggaccugaagaccgccaucgagaagaucacccagcgcgggggccucagcaacguggggcgggccaucuccuucgugaccaagaacuucuucagcaaggcgaacggcaaccgcuccggggccccgaacgucgugguggucaugguggacggcuggcccacggacaagguggaggaggccagccggcuggcccgcgagagcggcaucaacaucuucuucaucaccaucgagggggcggccgagaacgagaagcaguacgucguggagcccaacuucgccaacaaggccgugugccggaccaacggcuucuacucccugcacguccagagcugguucgggcuccacaagacccugcagccgcuggugaagcgcgugugcgacacggaccgccucgccugcuccaagaccugccugaacagcgcggacaucggcuucgucaucgacggguccagcuccgugggcaccggcaacuuccggaccgugcugcaguucgucacgaaccucaccaaggaguucgagaucagcgacaccgacacccgcaucggggccgugcaguacaccuacgagcagcggcuggaguucggcuucgacaaguacuccagcaagcccgacauccugaacgccaucaagcgcgugggguacugguccggcggcacgagcaccggggccgccaucaacuucgcgcucgagcagcuguucaagaaguccaagcccaacaagcggaagcugaugauccucaucaccgacggccgcagcuacgacgacguccggauccccgccauggccgcccaccugaagggggugaucaccuacgccaucggcguggcgugggccgcccaggaggagcuggaggucaucgccacgcacccggcgcgcgaccacuccuucuucguggacgaguucgacaaccuccaccaguacgugccccggaucauccagaacaucugcaccgaguucaacagccagccccgcaacuga

SEQ ID NO: 38600 - RNA, 492 nt, Artificial Sequence
  derived and/or modified sequence opt1 from VKORC1__Homo_sapiens__NP_076869
augggcagcaccugggggucccccggcugggugcgccuggcccucugccugaccgggcugguccucagccuguacgcccugcacgugaaggcggcccgggcccgcgaccgggacuaccgcgcccucugcgacgugggcacggccaucuccugcagccgggucuucuccagccgcugggggcggggcuucggccugguggagcacgugcuggggcaggacuccauccucaaccagagcaacuccaucuucggcugcaucuucuacacccugcagcugcuccuggggugccugcgcacccggugggcgagcguccucaugcugcuguccagccucgugucccuggccggcagcguguaccuggccuggauccucuucuucguccuguacgacuucugcaucgugugcaucaccacguacgccaucaacgugucccugauguggcucagcuuccgcaagguccaggagccgcaggggaaggcgaagcggcacuga

SEQ ID NO: 38601 - RNA, 2538 nt, Artificial Sequence
  derived and/or modified sequence opt1 from VLDLR__Homo_sapiens__NP_001018066
augggcaccagcgcccugugggcccucuggcugcugcucgcgcugugcugggcgccccgcgaguccggggccaccggcacggggcggaaggccaagugcgagccgagccaguuccagugcaccaacggccgcugcaucacccugcucuggaagugcgacggggacgaggacugcguggacggcuccgacgagaagaacugcgucaagaagaccugcgccgagagcgacuucgugugcaacaacggccagugcgugcccucccgguggaagugcgacggggaccccgacugcgaggacggcagcgacgagucccccgagcagugccacaugcgcacgugccggauccacgagaucagcugcggggcccacuccacccagugcaucccggucagcuggcgcugcgacggcgagaacgacugcgacuccggggaggacgaggagaacugcggcaacaucacgugcagccccgacgaguucacgugcuccagcggccggugcaucucccgcaacuucgugugcaacgggcaggacgacugcagcgacggcuccgacgagcuggacugcgccccgccgaccugcggggcccacgaguuccagugcagcaccuccagcugcauccccaucagcugggugugcgacgacgacgccgacugcuccgaccagagcgacgagucccuggagcagugcggccggcagcccgucauccacaccaagugccccgcgagcgagauccagugcggcuccggggagugcauccacaagaaguggcgcugcgacggcgaccccgacugcaaggacgggagcgacgaggugaacugccccucccggaccugccgccccgaccaguucgagugcgaggacggcagcugcauccacgggucccggcagugcaacggcauccgcgacugcguggacggcagcgacgaggucaacugcaagaacgugaaccagugccucgggcccggcaaguucaagugccgguccggggagugcaucgacaucagcaaggugugcaaccaggagcaggacugccgcgacugguccgacgagccccugaaggagugccacaucaacgagugccuggucaacaacggcgggugcagccacaucugcaaggaccucgugaucggcuacgagugcgacugcgccgccggcuucgagcugaucgaccggaagaccugcggggacaucgacgagugccagaacccgggcaucugcucccagaucugcaucaaccugaagggcggguacaagugcgagugcagccgcggguaccagauggaccucgccaccggcgugugcaaggccgucggcaaggagcccucccugaucuucaccaaccggcgcgacauccggaagaucgggcuggagcgcaaggaguacauccagcucguggagcagcugcgcaacaccguggcgcuggacgccgacaucgccgcccagaagcuguucugggccgaccugagccagaaggcgaucuucuccgccagcaucgacgacaaggucggccggcacgugaagaugaucgacaacguguacaaccccgccgccaucgccgucgacuggguguacaagacgaucuacuggaccgacgcggccagcaagaccaucuccguggccacccuggacgggacgaagcgcaaguuccucuucaacagcgaccugcgggagcccgccuccaucgccgucgacccgcugagcggcuucguguacugguccgacuggggcgagcccgcgaagaucgagaaggccgggaugaacggcuucgaccgccggccccucgucaccgccgacauccaguggcccaacgggaucacccuggaccugaucaagagccgccucuacuggcuggacuccaagcugcacaugcucagcuccguggaccugaacggccaggaccggcgcaucgugcucaagagccucgaguuccuggcccacccgcuggcgcucaccaucuucgaggaccgggucuacuggaucgacggggagaacgaggccguguacggcgccaacaaguucacgggcuccgagcuggccacccuggugaacaaccucaacgacgcccaggacaucaucgucuaccacgagcuggugcagcccagcgggaagaacuggugcgaggaggacauggagaacggcgggugcgaguaccugugccuccccgcgccccagaucaacgaccacuccccgaaguacacgugcagcugccccuccggcuacaacguggaggagaacgggcgcgacugccagcggaucaacgucaccaccgccgugagcgagguguccgugcccccgaagggcaccagcgccgccugggccauccugccccugcuccugcuggucauggcggccgugggcggguaccugauguggcgcaacuggcagcacaagaacaugaaguccaugaacuucgacaaccccgucuaccucaagaccaccgaggaggaccugagcaucgacaucggccggcacagcgccuccguggggcacacguaccccgccaucagcguggucuccaccgacgacgaccuggccuga

SEQ ID NO: 38602 - RNA, 306 nt, Artificial Sequence
  derived and/or modified sequence opt1 from VMA21__Homo_sapiens__NP_001017980
auggagcgccccgacaaggccgcccugaacgcgcuccagccgcccgaguuccggaacgagagcucccuggccagcacccugaagacccuccuguucuucacggcccugaugaucaccgugcccaucggccucuacuucaccaccaaguccuacaucuucgagggggcccugggcaugagcaaccgcgacuccuacuucuacgccgcgaucgucgccgugguggccguccacguggugcuggcccucuucgucuacguggcguggaacgaggggagccggcaguggcgcgagggcaagcaggacuga

SEQ ID NO: 38603 - RNA, 345 nt, Artificial Sequence
  derived and/or modified sequence opt1 from VMO1__Homo_sapiens__NP_001138411
auggagcgcggcgccggggccaagcugcucccccugcugcuccugcugcgggcgaccggcuucacgugcgcccagaccgacgggcgcaacggcuacaccgccgugaucgaggucaccagcgggggcccguggggcgacugggccuggcccgagaugugccccgacggguucuucgccuccggcuucagccucaagguggagcccccgcaggggauccccggcgacgacaccgcgcugaacgggauccggcugcacugcgcccgcggcaacgugcucggcaacacgcacgucguggagucccagagcgggcgguggggcgccgggguggaggacccccugggcuga

SEQ ID NO: 38604 - RNA, 1221 nt, Artificial Sequence
  derived and/or modified sequence opt1 from VMP1__Homo_sapiens__NP_112200
auggccgagaacggcaagaacugcgaccagcgccggguggccaugaacaaggagcaccacaacgggaacuucaccgaccccagcuccgucaacgagaagaagcgccgggagcgcgaggagcggcagaacaucgugcuguggcgccagccgcucaucacccugcaguacuucagccuggagauccucgugauccugaaggaguggacguccaagcuguggcaccggcagagcaucgucguguccuuccuccugcugcucgcggugcugaucgccaccuacuacgucgagggcgugcaccagcaguacgugcagcgcaucgagaagcaguuccugcucuacgccuacuggaucgggcugggcauccugagcuccgucgggcucggcaccggccugcacaccuuccugcucuaccuggggccccacaucgccagcgugacgcuggccgcguacgagugcaacuccgugaacuuccccgagcccccguaccccgaccagaucaucugccccgacgaggagggcaccgaggggaccaucagccucugguccaucaucagcaagguccggaucgaggccugcauguggggcaucgggaccgccaucggcgagcugcccccguacuucauggcccgcgcggcccggcuguccggcgccgagcccgacgacgaggaguaccaggaguucgaggagaugcucgagcacgccgagagcgcccaggacuucgcgucccgcgccaagcuggccgugcagaagcuggugcagaaggucggguucuucggcauccucgccugcgccagcauccccaacccccuguucgaccuggcggggaucacgugcggccacuuccucgugccguucuggaccuucuucggcgccacccugaucgggaaggccaucaucaagaugcacauccagaagaucuucgugaucaucaccuucuccaagcacaucgucgagcagaugguggccuucaucggcgccgugcccgggaucggccccagccugcagaagcccuuccaggaguaccucgaggcgcagcggcagaagcugcaccacaaguccgagauggggacgccgcagggcgagaacuggcugagcuggauguucgagaagcucgucguggugauggucugcuacuucauccugagcaucaucaacuccauggcccagagcuacgccaagcgcauccagcagcggcugaacuccgaggagaagaccaaguga

SEQ ID NO: 38605 - RNA, 1188 nt, Artificial Sequence
  derived and/or modified sequence opt1 from VN1R2__Homo_sapiens__NP_776255
augacccacacccuguaccccacgccguucgcccucuaccccaucaacaucagcgccgcguggcaccugggcccccugcccguguccugcuucgucagcaacaaguaccagugcucccucgccuucggggccaccaccggccugcgcgugcugguggucguggugccgcagacccagcucagcuuccuguccagccugugccucgucucccuguuccugcacagccucguguccgcccacggggagaagcccacgaagcccgugggccuggaccccacccuguuccaggucgugguggggauccucggcaacuucagccugcuguacuacuacauguuccucuacuuccggggcuacaagccgcgcuccaccgaccugauccugcggcaccucaccgucgccgacagccuggugauccuguccaagcgcauccccgagacgauggcgaccuucgggcucaagcacuucgacaacuacuucggcugcaaguuccugcuguacgcccaccggguggggcgcggcgucagcaucggguccacgugccuccugagcguguuccaggugaucaccaucaacccccggaacucccgcugggccgagaugaaggucaaggcccccaccuacaucggccugagcaacauccucugcugggcguuccacaugcuggugaacgccaucuucccgaucuacaccaccggcaagugguccaacaacaacaucaccaagaagggggaccugggcuacugcagcgcgccccucagcgacgaggugacgaaguccgucuacgccgcccugaccagcuuccacgacgugcugugccucgggcugaugcugugggccuccagcuccaucgugcucguccuguaccggcacaagcagcagguccagcacaucugccgcaacaaccuguaccccaacagcucccccggcaaccgggccauccagagcauccucgcccugguguccaccuucgcccugugcuacgcccucagcuucaucaccuacguguaccuggcgcuguucgacaacuccagcugguggcucgugaacacggccgcccugaucaucgccugcuucccgaccaucucccccuucguccugaugugccgcgaccccagccggucccgccugugcagcaucugcugccggcgcaaccggcgcuucuuccacgacuuccggaagauguga

SEQ ID NO: 38606 - RNA, 906 nt, Artificial Sequence
  derived and/or modified sequence opt1 from VN1R4__Homo_sapiens__NP_776256
auggccagccgcuacguggccgucggcaugauccugucccagaccgugguggggguccucggcagcuucuccgugcugcugcacuaccucagcuucuacugcaccgggugccggcugcgcuccacggaccugaucgugaagcaccucaucgucgcgaacuuccuggcccugcggugcaagggcgugccccagaccauggccgccuucggggugcgcuacuuccucaacgcccugggcugcaagcuggucuucuaccuccaccgggugggccgcggggugagcaucggcacgaccugccugcuguccgucuuccaggugaucaccgugagcucccgcaagagccggugggcgaagcucaaggagaaggccccgaagcacgucggguucuccgugcugcugugcuggaucgugugcaugcucgucaacaucaucuuccccauguacgugaccggcaaguggaacuacaccaacaucaccgugaacgaggaccugggguacugcagcggcggcgggaacaacaagaucgcccagacgcugcgggccaugcuccuguccuuccccgacguccugugccucggccugaugcugugggugagcuccagcauggugugcauccuccaccgccacaagcagcggguccagcacaucgaccgcuccaaccugagcccccgggcguccccggagaaccgcgccacccagagcauccugauccucgugagcaccuucgucuccagcuacacccuguccugccuguuccaggugugcauggcccuccuggacaaccccaacagccugcucgugaacacguccgcccugaugagcgucugcuuccccacccugucccccuucgugcucaugagcugcgacccguccguguaccgguucugcuucgccuggaagcgcuga

SEQ ID NO: 38607 - RNA, 1542 nt, Artificial Sequence
  derived and/or modified sequence opt1 from VNN1__Homo_sapiens__NP_004657
augaccacccagcugcccgccuacguggccauccuccuguucuacgucagccgcgcguccugccaggacacguucaccgccgccguguacgagcacgccgccauccugccgaacgcgacccucacccccgugagccgggaggaggcccuggcccugaugaaccgcaaccucgacauccuggagggcgccaucacguccgcggccgaccagggggcccacaucaucgucacccccgaggacgccaucuacggcuggaacuucaaccgggacagccuguaccccuaccucgaggacaucccggaccccgaggugaacuggauccccugcaacaaccgcaaccgguucgggcagacccccgugcaggagcgccuguccugccuggccaagaacaacagcaucuacgucguggcgaacaucggcgacaagaagccgugcgacaccuccgacccccagugcccgcccgacgggcgguaccaguacaacacggacguggucuucgacagccagggcaagcucguggcccgcuaccacaagcagaaccuguucaugggcgagaaccaguucaacgugcccaaggagcccgagaucgucaccuucaacaccaccuucggguccuucggcaucuucacgugcuucgacauccuguuccacgaccccgccgugacccucgugaaggacuuccacgucgacaccaucguguuccccaccgccuggaugaacgugcugccgcaccugagcgccgucgaguuccacuccgcgugggccauggggaugcgggugaacuuccucgccagcaacauccacuaccccuccaagaagaugacgggcagcgggaucuacgcccccaacuccagccgcgccuuccacuacgacaugaagaccgaggagggcaagcugcugcucucccagcuggacagccaccccucccacagcgcgguggucaacuggaccagcuacgccuccagcaucgaggcccuguccagcggcaacaaggaguucaaggggaccguguucuucgacgaguucacguucgugaagcucaccggcgucgccgggaacuacaccgugugccagaaggaccugugcugccaccuguccuacaagaugagcgagaacaucccgaacgaggucuacgcccucggcgcguucgacggccugcacaccguggaggggcgguacuaccugcagaucugcacgcuccugaagugcaagaccaccaaccugaacacgugcggcgacuccgccgagaccgccagcacccgcuucgagauguucucccucagcgggaccuucggcacccaguacguguuccccgagguccugcuguccgagaaccagcucgcccccggggaguuccaggugagcacggacggccggcuguucucccugaagcccaccagcggcccggugcucaccgucacccuguucgggcgccuguacgagaaggacugggcguccaacgccagcuccggccucacggcccaggcccggaucaucaugcugaucgugaucgcccccaucgugugcagccuguccugguga

SEQ ID NO: 38608 - RNA, 900 nt, Artificial Sequence
  derived and/or modified sequence opt1 from VNN2__Homo_sapiens__NP_001229279
auggugaccagcuccuuccccaucagcgucgccguguucgcccugaucacccuccaggugggcacgcaggacuccuucaucgcggccgucuacgagcacgccgugauccugccgaacaagaccgagacccccgugagccaggaggacgcccugaaccucaugaacgagaacaucgacauccuggagaccgccaucaagcaggcggccgagcagggggcccgcaucaucgucacgcccgaggacgcccuguacggcuggaaguucacccgggagaccguguuccccuaccucgaggacaucccggacccccaggugaacuggauccccugccaggacccccaccgcuucgggcacaccccgguccaggcgcggcuguccugccuggccaaggacaacagcaucuacgugcucgccaaccugggcgacaagaagcccugcaacucccgcgacagcacgugcccgcccaacggguacuuccaguacaacaccaacguggucuacaacaccgagggcaagcugguggcccgguaccacaaggugugcaccaugcucaagugcaagacgaccaaccugacgaccugcggccgccccgucgagaccgccuccacccgguucgagauguucagccuguccgggaccuucggcaccgaguacguguuccccgaggugcuccugacggagauccaccugagccccgggaaguucgagguccucaaggacggccgccuggugaacaagaacggguccagcggccccauccugaccgugucccucuucggccggugguacaccaaggacagccuguacuccagcugcgggaccuccaacagcgcgaucacguaccugcucaucuucauccugcugaugaucaucgcccuccagaacaucgucaugcuguga

SEQ ID NO: 38609 - RNA, 732 nt, Artificial Sequence
  derived and/or modified sequence opt1 from VNN3__Homo_sapiens__NP_001278632
augggcgugaaccugcucgccgccaacacccacaacaccagcaugcacaugacgggguccggcaucuacgcccccgaggccgucaagguguaccacuacgacauggagaccgagagcgggcagcugcugcucuccgagcucaagagccgcccccggcgcgagcccaccuaccccgccgccguggacuggcacgccuacgcguccagcgucaagcccuucuccagcgagcaguccgacuuccugggcaugaucuacuucgacgaguucaccuucacgaagcugaagcggaacaccgggaacuacaccgccugccagaaggaccugugcugccaccugaccuacaagaugagcgagaagcgcacggacgagaucuacgcccucggcgccuucgacggccugcacaccguggaggggcaguacuaccugcagaucugcgcgcuccugaagugccagaccaccgaccuggagacgugcggcgagccggugggguccgccuucaccaaguucgaggacuucagccucuccggcaccuucgggacccgguacgucuucccccagaucauccugagcggcucccagcuggcccccgagcgccacuacgagaucagccgggacggccgccuccggucccgcagcggggcgccccugccggugcuggugauggcccucuacggccgggucuucgagaaggacccgccccgccuggggcagggcuccggcaaguuccaguga

SEQ ID NO: 38610 - RNA, 510 nt, Artificial Sequence
  derived and/or modified sequence opt1 from VOPP1__Homo_sapiens__NP_001271212
augcugagcgagacccucggcuaccuguccagcgugcugcuccagugcaccgaggccaagaagcacugcugguacuucgaggggcuguaccccacguacuacaucugccgcuccuacgaggacugcugcggcagccggugcugcguccgcgcccuguccauccagcggcucugguacuucugguuccugcugaugaugggggugcucuucugcugcggcgcgggguucuucauccgccggcgcauguacccgcccccccugaucgaggagcccgccuucaacgugagcuacacccggcagccgcccaaccccggccccggcgcccagcagccggggccccccuacuacaccgaccccggcgggccgggcaugaaccccgucgggaacuccauggccauggccuuccaggugccccccaacagcccgcagggcuccguggcgugccccccccccccggccuacugcaacacccccccccccccguacgagcaggucgugaaggccaaguga

SEQ ID NO: 38611 - RNA, 4524 nt, Artificial Sequence
  derived and/or modified sequence opt1 from VPRBP__Homo_sapiens__NP_055518
augaccaccguggucgugcacguggacagcaaggccgagcugacgacccuccuggagcagugggagaaggagcacggcuccgggcaggacaugguccccauccugacccgcaugagccagcucaucgagaaggagaccgaggaguaccggaagggcgacccggaccccuucgacgaccgccaccccgggcgggccgaccccgagugcaugcugggccaccuccugcgcauccuguucaagaacgacgacuucaugaacgcgcuggugaacgccuacgugaugacgucccgggagccgccccucaacaccgccgccugccgccugcugcucgacaucaugcccgggcuggagaccgccgucguguuccaggagaaggagggcaucguggagaaccuguucaagugggcgcgggaggccgaccagccccuccgcaccuacagcacgggccugcugggcggcgccauggagaaccaggacaucgccgcgaacuaccgggacgagaacucccagcucgucgccaucgugcugcgccggcugcgcgagcuccagcugcaggagguggcccugcggcaggagaacaagcgcccgagcccccggaagcucuccagcgagccccugcugccccucgacgaggaggccgucgacauggacuacggggacauggccguggacguggucgacggcgaccaggaggaggcguccggggacauggagaucagcuuccaccuggacuccggccacaagaccagcucccgcgugaacagcaccaccaagccggaggacggcgggcugaagaagaacaaguccgccaagcagggcgaccgggagaacuuccgcaaggccaagcagaagcucggguucagcuccagcgaccccgaccggauguucguggagcuguccaacagcagcugguccgagaugagccccugggucaucggcacgaacuacacccuguaccccaugaccccggccaucgagcagcgccucauccugcaguaccugacgccccucggcgaguaccaggagcugcugcccaucuucaugcagcucgggucccgggagcugaugauguucuacaucgaccugaagcagaccaacgacgugcuccugaccuucgaggcccugaagcaccucgcgagccugcugcuccacaacaaguucgccaccgaguucguggcccacggcgggguccagaagcugcuggagaucccccgcccguccauggccgccaccggcgugagcaugugccuguacuaccucuccuacaaccaggacgcgauggagcgcgugugcaugcacccccacaacguccugagcgacguggucaacuacacgcuguggcucauggagugcucccacgccagcgggugcugccacgccaccauguucuucuccaucugcuucagcuuccgggccgugcuggagcuguucgaccgcuacgacggccuccggcgccuggugaaccugaucuccacccucgagauccugaaccuggaggaccagggcgcccuccugagcgacgacgagaucuucgcgucccggcagaccgggaagcacacgugcauggcccugcgcaaguacuucgaggcccaccucgccaucaagcuggagcaggucaagcagagccugcagcggaccgagggcgggauccucgugcacccccagcccccguacaaggcgugcuccuacacccacgagcagaucguggagaugauggaguuccugaucgaguacggccccgcccagcuguacugggagcccgccgaggucuuccucaagcugagcugcgugcagcugcuccugcagcugaucuccaucgccugcaacuggaagaccuacuacgcccgcaacgacacggugcgguucgcgcucgacguccuggccauccugaccguggugcccaagauccagcuccagcuggccgagagcgucgacgugcuggacgaggccgggagcaccguguccaccgucggcaucagcaucauccucggcguggccgagggggaguucuucauccacgacgcggagauccagaaguccgcccugcagaucaucaucaacugcgugugcggcccggacaaccgcaucagcuccaucgggaaguucaucagcggcacgccccggcgcaagcugccccagaacccgaaguccagcgagcacacccucgccaagauguggaacgucgugcaguccaacaacgggaucaaggugcugcugagccuccuguccaucaagaugcccaucaccgacgccgaccagauccgggcccuggcgugcaaggcccucgucggccugagccgcuccagcaccgugcggcagaucaucuccaagcugccccucuucagcuccugccagauccagcagcugaugaaggagcccgugcugcaggacaagcgcagcgaccacgucaaguucugcaaguacgccgccgagcucaucgagcgggugagcggcaagccgcugcugaucgggacggacgugucccucgcgcgccugcagaaggccgacgucguggcccagagccggaucuccuuccccgagaaggagcugcuccugcugauccgcaaccaccucaucagcaagggccugggggagaccgccaccgugcugaccaaggaggccgaccuccccaugaccgcggccucccacagcuccgccuucacgcccgucaccgccgccgcgagcccggugucccugccccgcacgccccggaucgccaacggcaucgccacccgccugggcagccacgccgccgugggggcguccgcccccagcgccccgaccgcccacccccagccccggcccccgcagggcccccucgcgcugcccgggcccuccuacgccggcaacagcccgcugaucgggcgcaucuccuucauccgggagcgccccagccccugcaacggccggaagauccgcguccuccggcagaaguccgaccacggcgccuacagccagucccccgccaucaagaagcagcuggaccgccaccucccgagcccgcccacccuggacagcaucaucaccgaguaccugcgggagcagcacgcccgcugcaagaaccccguggcgaccugcccgcccuucucccuguucacgccccaccagugccccgagcccaagcagcggcgccaggcccccaucaacuucaccagccggcucaaccgccgggccuccuuccccaaguacgggggcguggacgggggcugcuucgaccgccaccugaucuucagccgguuccgcccgaucuccgucuuccgggaggccaacgaggacgagagcggguucacgugcugcgccuucuccgcgcgcgagcgcuuccugaugcucgggaccugcaccggccagcugaagcuguacaacguguucagcgggcaggaggaggccuccuacaacugccacaacagcgccaucacccaccucgagcccucccgggacggcagccugcugcucaccuccgccaccuggagccagccccuguccgcccugugggggaugaaguccguguucgacaugaagcacagcuucacggaggaccacuacgucgaguucagcaagcacucccaggaccgcgugaucggcaccaagggggacaucgcgcacaucuacgacauccagaccggcaacaagcuccugacccuguucaaccccgaccucgccaacaacuacaagcggaacugcgccacguucaacccgaccgacgaccuggugcugaacgacggcguccucugggacgugcgcagcgcccaggccauccacaaguucgacaaguucaacaugaacaucagcgggguguuccaccccaacggccuggaggucaucaucaacaccgagaucugggaccugcggaccuuccaccuccugcacacggugcccgcgcuggaccagugccgcguggucuucaaccacaccgggaccgugauguacggcgccaugcugcaggccgacgacgaggacgaccucauggaggagcggaugaagucccccuucgggagcuccuuccgcaccuucaacgccacggacuacaagccgaucgcgaccaucgacgugaagcggaacaucuucgaccugugcaccgacaccaaggacugcuaccuggccgucaucgagaaccagggcagcauggacgcccucaacauggacacggugugccgccuguacgaggucggccggcagcgccuggccgaggacgaggacgaggaggaggaccaggaggaggaggagcaggaggaggaggacgacgacgaggacgacgacgacaccgacgaccucgacgagcuggacaccgaccagcugcucgaggccgagcuggaggaggacgacaacaacgagaacgcgggggaggacggcgacaacgacuucucccccagcgacgaggagcuggccaaccuccuggaggagggggaggacggcgaggacgaggacuccgacgccgacgaggagguggagcugauccucggcgacaccgacagcuccgacaacagcgaccuggaggacgacaucauccugucccucaacgaguga

SEQ ID NO: 38612 - RNA, 438 nt, Artificial Sequence
  derived and/or modified sequence opt1 from VPREB1__Homo_sapiens__NP_009059
augagcugggcccccgugcugcucaugcuguucgucuacugcaccggcugcgggccgcagcccgugcugcaccagccgcccgccauguccagcgcgcucggcaccacgauccgccugaccugcacccugcggaacgaccacgacaucgggguguacuccgucuacugguaccagcagcgccccggccacccgccccgguuccuccugcgcuacuucagccaguccgacaagagccaggggccccaggugccgccccgguucuccggcagcaaggacguggcccgcaaccggggcuaccuguccaucagcgagcuccagcccgaggacgaggccauguacuacugcgccaugggggcccgcuccagcgagaaggaggagcgggagcgcgagugggaggaggagauggagcccaccgcggcccggacgcgcguccccuga

SEQ ID NO: 38613 - RNA, 372 nt, Artificial Sequence
  derived and/or modified sequence opt1 from VPREB3__Homo_sapiens__NP_037510
auggccugccgcugccugagcuuccuccugaugggcaccuuccuguccgugagccagaccguccucgcccagcuggacgcgcugcucguguuccccggccagguggcccagcuguccugcacgcugagcccgcagcacgucaccauccgggacuacgggguguccugguaccagcagcgcgccgggagcgcgccccgguaccuccuguacuaccgcuccgaggaggaccaccaccggcccgccgacauccccgaccgcuucagcgccgccaaggacgaggcccacaacgccugcgugcugaccaucuccccgguccagcccgaggacgacgcggacuacuacugcagcgugggcuacggguucucccccuga

SEQ ID NO: 38614 - RNA, 1740 nt, Artificial Sequence
  derived and/or modified sequence opt1 from VPS11__Homo_sapiens__XP_011541201
augcuguucaagaagaaccucuucgagauggccaucaaccuggccaagagccagcaccuggacuccgacggccucgcgcagaucuucaugcaguacggggaccaccuguacagcaagggcaaccacgacggggccgugcagcaguacauccgcaccaucggcaagcuggagcccuccuacgucauccggaaguuccucgacgcccagcgcauccacaaccugaccgccuaccugcagacgcuccaccggcagagccuggccaacgcggaccacaccacccugcuccugaacugcuacaccaagcugaaggacuccagcaagcucgaggaguucaucaagaagaaguccgagagcgaggugcacuucgacguggagacggccaucaagguccugcgccaggccggguacuacucccacgcccuguaccucgcggagaaccacgcccaccacgagugguaccugaagauccagcuggaggacaucaagaacuaccaggaggcccuccgguacaucggcaagcugccguucgagcaggccgagagcaacaugaagcgcuacggcaagauccugaugcaccacauccccgagcagaccacccagcuccugaaggggcugugcaccgacuaccggcccucccucgagggccgcagcgaccgggaggcccccgggugccgcgcgaacuccgaggaguucaucccgaucuucgccaacaacccccgggagcugaaggccuuccuggagcacaugagcgaggugcagcccgacagcccccagggcaucuacgacacgcuccuggagcugcgccuccagaacugggcccacgagaaggacccccaggugaaggagaagcugcacgccgaggcgaucucccugcucaaguccgggcgguucugcgacgucuucgacaaggcccuggugcugugccagaugcacgacuuccaggacggcgugcucuaccuguacgagcagggcaagcuguuccagcagaucaugcacuaccacaugcagcacgagcaguaccgccaggucaucagcgugugcgagcggcacggggagcaggaccccucccucugggagcaggcccugagcuacuucgcccgcaaggaggaggacugcaaggaguacguggccgcgguccugaagcacaucgagaacaagaaccucaugccgccccugcugguggugcagacccucgcccacaacagcaccgccacccuguccgucauccgggacuaccuggugcagaagcugcagaagcagagccagcagaucgcccaggacgagcuccgcgugcggcgcuaccgggaggagacgacccgcauccgccaggagauccaggagcugaaggccuccccgaagaucuuccagaagaccaagugcagcaucugcaacuccgcgcuggagcuccccagcguccacuuccugugcggccacuccuuccaccagcacugcuucgagagcuacuccgagagcgacgccgacugccccacgugccugcccgagaaccggaaggugauggacaugauccgcgcccaggagcagaagcgggaccuccacgaccaguuccagcaccagcugaagugcuccaacgacagcuucuccgugaucgccgacuacuucgggcgcggcgucuucaacaagcugacccuccugaccgacccgcccaccgcgcggcugaccagcucccucgaggccggccugcagcgcgaccugcucaugcacagccggcgcgggacguga

SEQ ID NO: 38615 - RNA, 9408 nt, Artificial Sequence
  derived and/or modified sequence opt1 from VPS13A__Homo_sapiens__NP_001018047
augguguucgagagcguggugguggacguccugaaccgguuccugggcgacuacgugguggaccuggacaccagccagcugagccuggggaucuggaagggcgccgucgcccugaagaaccugcagaucaaggagaacgcgcugagccagcuggacgugcccuucaaggugaaggucgggcacaucggcaaccugaagcugaucauccccuggaagaaccuguacacccagcccguggaggccgugcuggaggagaucuaccuccugaucguccccagcagccggaucaaguacgacccccugaaggaggagaagcagcucauggaggccaagcagcaggagcugaagcgcaucgaggaggccaagcagaaggugguggaccaggagcagcaccuccccgagaagcaggacaccuucgccgagaagcuggucacccagaucaucaagaaccuccaggugaagaucagcuccauccacauccgguacgaggacgacaucaccaaccgcgacaagccccugagcuucgggaucucccuccagaaccugagcaugcagaccaccgaccaguacugggugcccugccugcacgacgagaccgagaagcucguccggaagcugauccgccuggacaaccucuucgcguacuggaacgugaagucccagauguucuaccugagcgacuacgacaacucccuggacgaccucaagaacggcaucgugaacgagaacaucguccccgagggcuacgacuucguguuccggcccaucagcgccaacgccaagcuggugaugaaccgccgguccgacuucgacuucagcgcccccaagaucaaccuggagaucgagcuccacaacaucgcgaucgaguucaacaagccccaguacuucuccaucauggagcugcuggagagcgucgacaugauggcccagaaccuccccuaccgcaaguucaagccggacgugccccugcaccaccacgcccgggaguggugggccuacgccauccacgggguccuggaggugaacgugugcccccgccucuggaugugguccuggaagcacauccggaagcaccgccagaaggucaagcaguacaaggagcuguacaagaagaagcugaccagcaagaagccgcccggcgagcuccuggugagccuggaggagcucgagaagacccuggacguguucaacaucacgaucgcgcggcagaccgccgaggucgaggugaagaaggccggguacaagaucuacaaggagggcgugaaggaccccgaggacaacaaggggugguucuccuggcuguggagcugguccgagcagaacaccaacgagcagcagcccgacguccagcccgagacccucgaggagaugcugacgcccgaggagaaggcccugcuguacgaggccaucggcuacagcgagaccgcgguggaccccacccuccugaagaccuucgaggcccugaaguucuucgugcaccucaaguccaugagcaucguccugcgcgagaaccaccagaagcccgagcugguggacaucgugaucgaggaguucuccacgcucaucguccagcggcccggcgcccaggccaucaaguucgagaccaagaucgacagcuuccacaucaccgggcugccggacaacuccgagaagccccgccugcucagcucccuggacgacgccaugagccuguuccagaucaccuucgagaucaacccccucgacgagacggugucccagcggugcaucaucgaggcggagccccuggagaucaucuacgacgcccgcaccgugaacagcaucgucgaguucuuccggccgcccaaggaggugcaccuggcccagcucaccgccgccacccugacgaagcuggaggaguuccgcuccaagaccgcgaccggccuccuguacaucaucgagacccagaaggugcuggaccucaagaucaaccugaaggccagcuacaucaucgucccccaggacgggaucuucuccccgacgagcaaccugcuccugcuggaccucggccaccugaaggugaccuccaagagccgcagcgagcugcccgacgugaagcagggcgaggccaaccucaaggagaucauggaccgggccuacgacuccuucgacauccagcugaccagcguccagcugcucuacucccgcgugggggacaacuggcgggaggcgcgcaagcugagcguguccacccagcacauccugguccccaugcacuucaaccucgagcugagcaaggccaugguguucauggacgugcggaugcccaaguucaagaucuacggcaagcugccgcucaucucccugcgcaucagcgacaagaagcugcaggggaucauggagcucaucgaguccauccccaagcccgagcccgucacggaggugagcgccccggugaaguccuuccagauccagaccagcaccucccugggcaccagccagaucucccagaagaucaucccccugcucgagcugcccagcgucuccgaggacgacagcgaggaggaguucuucgacgcccccugcagcccgcuggaggagccccuccaguuccccacgggggugaaguccauccggacccgcaagcugcagaagcaggacugcagcgugaacaugaccaccuucaagauccgguucgagguccccaaggugcugaucgaguucuaccaccucgugggcgacugcgagcuguccgucguggagauccuggugcucggccugggggccgagaucgagauccgcaccuacgaccugaaggcgaacgccuuccucaaggaguucugccugaagugcccggaguaccuggacgagaacaagaagcccgucuaccucgugacgacccuggacaacaccauggaggaccugcucacccuggaguacgugaaggccgagaagaacguccccgaccucaagagcacguacaacaacgugcuccagcugaucaaggugaacuucuccagccuggacauccaccuccacaccgaggcccugcugaacaccaucaacuaccuccacaacauccugccccaguccgaggagaaguccgccccggucuccaccacggagaccgaggacaagggcgacgugaucaagaagcuggggcucgacagcgagaugaucaugcggcccuccgagaccgagaucaacgcgaagcugcgcaacaucaucgugcuggacagcgacaucaccgccaucuacaagaaggccgucuacaucacgggcaaggagguguucuccuucaagauggucagcuacauggacgccaccgccggguccgcguacaccgacaugaacgugguggacauccaggucaaccucaucgugggcugcaucgagguggucuucgugaccaaguuccuguacagcauccuggccuucaucgacaacuuccaggccgccaagcaggcgcucgccgaggccacggugcaggccgccggcauggcggccaccggggucaaggagcuggcccagcgguccagccgcauggcccuggacaucaacaucaaggcccccgugguggucaucccccaguccccggugagcgagaacguguucgucgcggacuucggccucaucaccaugaccaacacguuccacaugaucaccgagagccaguccuccccgccgcccgugaucgaccugaucaccaucaagcuguccgagaugcggcucuaccgcagccgguucaucaacgacgccuaccaggaggugcuggaccugcuccugccccugaaccucgaggucgugguggagcgcaaccugugcugggagugguaccaggagguccccugcuucaacgugaacgcccagcugaagcccauggaguucauccugucccaggaggacaucaccacgaucuucaagacccuccacgggaacaucugguacgagaaggacggcagcgccucccccgccgugaccaaggaccaguacagcgcgaccuccggggucacgaccaacgccagccaccacuccggcggcgccaccguggugaccgccgcggucguggaggugcacagccgggcccugcuggucaagacgacccucaacaucuccuucaagaccgacgaccugaccauggugcuguacagccccgggcccaagcaggccuccuucacggacgugcgcgaccccagccucaagcuggccgaguucaagcuggagaacaucaucuccacccucaagauguacaccgacggcagcaccuucuccagcuucagccugaagaacugcauccuggacgacaagcgcccgcacgucaagaaggccacgccccgcaugaucgggcucacggugggcuucgacaagaaggacaugauggacaucaaguaccgcaaggugcgggacggcugcgucaccgacgcgguguuccaggagauguacaucugcgccuccguggaguuccugcagaccgucgccaacguguuccuggaggccuacaccacggggaccgccguggagaccagcguccagaccuggacggcgaaggaggaggugcccacccaggaguccgugaagugggagaucaacgucaucaucaagaaccccgagaucguguucguggccgacaugaccaagaacgacgccccggcccucgucaucaccacgcagugcgagaucugcuacaagggcaaccuggagaacagcaccaugaccgccgcgaucaaggaccuccaggugcgcgccugccccuuccuccccgugaagcggaaggggaagaucaccacgguccugcagcccugcgaccuguucuaccagaccacccagaagggcaccgacccccaggugaucgacauguccgucaagagccucacgcugaaggugucccccgugaucaucaacaccaugaucaccaucaccagcgcccuguacacgaccaaggagaccauccccgaggagaccgccuccagcacggcccaccucugggagaagaaggacaccaagacccugaagaugugguuccuggaggaguccaacgagaccgagaagaucgcgcccacgaccgagcucgucccgaagggggagaugaucaagaugaacaucgacagcaucuucaucgugcuggaggccggcaucggccaccgcaccgugcccaugcugcucgccaagucccgguucagcggggagggcaagaacugguccagccugaucaaccugcacugccagcucgagcuggagguccacuacuacaacgagauguucggggugugggagccccugcucgagccccuggagaucgaccagaccgaggacuuccgcccguggaaccugggcaucaagaugaagaagaaggccaagauggcgaucguggaguccgaccccgaggaggagaacuacaagguccccgaguacaagacggugaucagcuuccacuccaaggaccagcucaacaucacccugagcaagugcgggcuggugaugcucaacaaccuggucaaggccuucaccgaggccgccaccggcagcuccgccgacuucgugaaggaccuggcgcccuucaugauccucaacagccugggccugaccaucuccgugagcccguccgacagcuucuccguccucaacauccccauggccaagagcuacgugcugaagaacggggagucccugagcauggacuacauccggacgaaggacaacgaccacuucaacgccaugaccucccucagcuccaagcuguucuucauccugcucacccccgugaaccacagcaccgccgacaagaucccgcugacgaaggucggccgccggcuguacaccgugcgccaccgggaguccgggguggagcgcagcaucgucugccagaucgacaccguggagggcuccaagaaggugaccauccggagccccguccagauccgcaaccacuucuccgugccccucagcguguacgagggggacacgcugcugggcaccgccagccccgagaacgaguucaacaucccgcucggcuccuaccggagcuucaucuuccugaagcccgaggacgagaacuaccagaugugcgaggggaucgacuucgaggagaucaucaagaacgacggcgcgcugcucaagaagaagugccgcuccaagaaccccagcaaggaguccuuccugaucaacaucguccccgagaaggacaaccugaccagccucuccguguacagcgaggacgggugggaccugccguacaucaugcaccuguggccgcccauccuccugcggaaccugcuccccuacaagaucgccuacuacaucgagggcaucgagaacuccguguucacccugagcgaggggcacuccgcccagaucugcacggcccagcugggcaaggcccgccuccaccugaagcugcucgacuaccugaaccacgacuggaaguccgaguaccacaucaagccgaaccagcaggacaucuccuucgucagcuucacgugcgugaccgagauggagaagaccgaccuggacaucgcggugcacaugacguacaacaccggccagaccgucguggccuuccacucccccuacuggauggugaacaagaccgggcggaugcuccaguacaaggccgacggcauccaccgcaagcacccgcccaacuacaagaagccgguccuguucagcuuccagcccaaccacuucuucaacaacaacaaggugcagcugauggugacggacuccgagcucagcaaccaguucuccaucgacaccgucgggagccacggcgccgugaagugcaagggccugaagauggacuaccaggugggggucaccaucgaccugagcuccuucaacaucacccgcaucgugacguucacccccuucuacaugaucaagaacaagagcaaguaccacaucuccguggcggaggagggcaacgacaaguggcucagccuggaccuggagcagugcauccccuucuggccggaguacgccuccagcaagcuccugauccaggucgagcgguccgaggacccgcccaagcgcaucuacuucaacaagcaggagaacugcauccugcuccggcuggacaacgagcucggcgggaucaucgccgaggugaaccucgccgagcacagcaccgugaucaccuuccuggacuaccacgacggggccgcgacguuccugcucaucaaccacaccaagaacgagcugguccaguacaaccaguccagccuguccgagaucgaggacagccugcccccggggaaggccguguucuacaccugggccgaccccgugggcucccgccggcucaaguggcgcugccgcaagagccacggggaggucacccagaaggacgacaugaugaugcccaucgaccugggcgagaagacgaucuaccugguguccuucuucgaggggcuccagcgcaucauccuguucaccgaggacccccgggucuucaaggugaccuacgagagcgagaaggccgagcuggccgagcaggagaucgcgguggcccuccaggacgucggcaucucccuggugaacaacuacaccaagcaggagguggccuacaucgggaucacgagcagcgacgucgugugggagaccaagccgaagaagaaggcccgcuggaagcccauguccgugaagcacaccgagaagcuggagcgggaguucaaggaguacaccgagagcucccccagcgaggacaaggucauccagcucgacacgaacgugccggugcgccugacccccaccggccacaacaugaagauccugcagccccacgucaucgcccuccggcgcaacuaccugcccgcgcugaagguggaguacaacaccuccgcccaccagagcuccuuccggauccagaucuaccgcauccagauccagaaccagauccacggcgccguguucccguucgucuucuaccccgugaagccgcccaagagcgugaccauggacuccgccccgaagcccuucacggacgucagcaucgugaugcgguccgcggggcacagccagaucucccgcaucaaguacuucaaggugcucauccaggagauggaccugcggcuggaccucggcuucaucuacgcccugaccgaccugaugaccgaggccgaggucaccgagaacacggagguggagcuguuccacaaggacaucgaggccuucaaggaggaguacaagaccgccagccugguggaccagucccaggucagccuguacgaguacuuccacaucucccccaucaagcuccaccugagcgugucccugagcagcgggcgcgaggaggcgaaggacuccaagcagaacggcgggcucauccccgugcacagccugaaccugcuccugaaguccaucggcgccacccugaccgacguccaggacgugguguucaagcucgccuucuucgagcugaacuaccaguuccacacgaccagcgaccugcaguccgaggucauccgccacuacagcaagcaggccaucaagcagauguacgugcucauccugggccuggacgugcucgggaacccguucggccugauccgggaguucuccgagggggucgaggccuucuucuacgagcccuaccagggcgcgauccagggccccgaggaguucguggaggggauggcccugggccucaaggcccuggucgggggcgccgucgggggccuggccggcgcggccagcaagaucaccggggccauggccaagggcguggccgcgaugaccauggacgaggacuaccagcagaagcgccgggaggccaugaacaagcagcccgccggguuccgcgagggcaucacgcgcgggggcaagggccucguguccggguucgucagcggcaucaccgggaucgugaccaagccgaucaagggcgcccagaagggcggcgcggccggcuucuucaagggggugggcaaggggcuggucggcgccguggcccggcccaccgggggcaucaucgacauggccuccagcacguuccagggcaucaagcgggcgaccgagaccuccgagguggagagccugcggccgccccgguucuucaacgaggacggggucauccgcccguaccggcuccgcgacggcaccgggaaccagaugcuccaggugauggagaacggccgguucgccaaguacaaguacuucacgcacgugaugaucaacaagaccgacaugcugaugaucacccgccggggcguccucuucgugaccaaggggacguucggccagcugaccugcgaguggcaguacuccuucgacgaguucaccaaggagcccuucaucgugcacgggcgccggcugcgcaucgaggccaaggagcgggucaagagcguguuccacgcccgcgaguucggcaagaucaucaacuucaagacccccgaggacgcccgguggauccucacgaagcugcaggaggcgcgcgagcccuccccgagccuguga

SEQ ID NO: 38616 - RNA, 2592 nt, Artificial Sequence
  derived and/or modified sequence opt1 from VPS13B__Homo_sapiens__NP_056058
augcuggagagcuacgugacccccauccucauguccuacgucaaccgcuacaucaagaaccugaagcccagcgaccugcagcucucccuguggggcggggacguggugcugagcaagcucgagcugaagcuggacguccucgagcaggagcugaagcugcccuucaccuuccucuccggccacauccacgagcugcggauccacgugcccuggacgaagcuggggagcgagcccguggucaucaccaucaacaccauggagugcauccucaagcugaaggacggcauccaggacgaccacgaguccugcgggagcaacuccaccaaccgcagcacggccgaguccaccaagagcuccaucaagccgcggcgcaugcagcaggccgcgcccaccgaccccgaccugcccccgggcuacgugcagagccucauccggcgcguggucaacaacgugaacaucgugaucaacaaccugauccugaaguacgucgaggacgacaucgugcucuccgugaacaucaccagcgccgagugcuacacggucggcgagcugugggaccgggccuucauggacaucuccgccaccgaccuggugcuccgcaaggugaucaacuucagcgacugcaccgucugccuggacaagcggaacgccuccgggaagaucgaguucuaccaggacccccugcucuacaagugcagcuuccgcacccggcugcacuucacguacgagaaccugaacagcaagaugcccuccgugaucaagauccacacccucguggagagccugaagcuguccaucaccgaccagcagcuccccauguucauccgcaucaugcagcugggcaucgcgcuguacuacggggagaucggcaacuucaaggagggggagaucgaggaccugaccugccacaacaaggacaugcugggcaacaucacgggcagcgaggacgagacccggaucgacaugcaguacccggcccagcacaaggggcaggagcuguacucccagcaggacgaggagcagccccagggcugggucagcugggccugguccuucgugcccgccaucgugagcuacgacgacggggaggaggacuucgucggcaacgaccccgcguccaccaugcaccagcagaaggcccagacccucaaggacccgaucgugagcaucggcuucuacugcacgaaggccaccgucaccuucaagcugaccgagaugcaggucgaguccagcuacuacagcccccagaaggucaagagcaaggaggugcugugcugggagcaggaggggacgaccguggaggcccucaugaugggcgagcccuucuucgacugccagaucggguucgugggcugccgcgccaugugccugaaggggaucaugggcgugaaggacuucgaggagaacaugaaccgguccgagaccgaggcgugcuucuucaucugcggcgacaaccugagcaccaagggguucacguaccucaccaacucccuguucgacuaccgcagccccgagaacaacggcacccgggccgaguucauccuggacuccacccaccacaaggagacguacaccgagaucgccgggaugcagcgcuucggcgccuucuacauggacuaccucuacaccauggagaacaccagcgggaagggcagcacgaaccagcaggacuucuccagcggcaaguccgaggaccuggggaccgugcaggagaaguccaccaagucccuggugaucggcccgcuggacuuccggcucgacagcuccgccguccaccgcauccugaagaugaucgugugcgcgcuggagcacgaguacgagcccuacagccggcucaaguccgacaucaaggacgagaacgagaccauccugaaccccgaggagguggcccugcucgaggaguacauccccacccgccacacgagcgucacccugcugaagugcacgugcaccaucuccauggccgaguucaaccuccuggaccaccuccucccggugaucaugggggagaagaacagcuccaacuucaugaacaccaccaacuuccagagccugcgcccccugcccuccauccggauccucguggacaagaucaaccuggagcacagcguccccauguacgccgagcagcuggugcacguggucuccagccucacccagccgagcgacaaccugcugcacuacugcuacgugcacugcuaccucaagaucuucggcuuccaggccgggcugaccucccuggacugcagcggcuccuacugccuccccgugcccgucaucccgagcuucuccacggcgcuguacggcaagcugcucaagcugccgaccugcuggaccaagcgcagccagaucgccaucaccgaggggaucuucgagcugcccaaccucacgauccaggccacccgggcccagacccugcugcuccaggccaucuaccaguccuggagccaccugggcaacguguccagcuccgcggugaucgaggcccugaucaacgagaucuuccucagcaucgagaucggguccugcuacgucgcccagguggaccuggagcugcucgccagcaacgacccgcccaccuccacgagcuga

SEQ ID NO: 38617 - RNA, 10887 nt, Artificial Sequence
  derived and/or modified sequence opt1 from VPS13C__Homo_sapiens__NP_001018098
auggugcuggagagcgucguggccgaccuccugaaccgcuuccugggcgacuacguggagaaccucaacaagucccagcugaagcuggggaucuggggcgggaacgucgcccucgacaaccugcagaucaaggagaacgcgcugagcgagcucgacgugcccuucaaggugaaggccggccagaucgacaagcugacccugaagaucccguggaagaaccucuacggggaggccgucguggccacccuggagggccuguaccuccuggugguccccggcgccuccaucaaguacgacgcggugaaggaggagaagagccugcaggacgugaagcagaaggagcucucccggaucgaggaggcccugcagaaggccgccgagaaggggacgcacagcggcgaguucaucuacgggcuggagaacuucgucuacaaggacaucaagcccggccgcaagcggaagaagcacaagaagcacuucaagaagcccuucaaggggcucgaccgcuccaaggacaagccgaaggaggcgaagaaggacaccuucguggagaagcuggccacccaggugaucaagaacguccaggugaagaucaccgacauccacaucaaguacgaggacgacgugacggaccccaagcggccccugagcuucggcgucacccucggcgagcugucccugcucaccgccaacgagcacuggacccccugcauccugaacgaggccgacaagaucaucuacaagcugauccgccucgacagccuguccgccuacuggaacgugaacugcagcauguccuaccagcggagccgcgagcagauccuggaccagcucaagaacgagauccugacguccgggaacaucccgcccaacuaccaguacaucuuccagcccaucagcgcguccgccaagcuguacaugaaccccuacgccgagagcgagcucaagaccccgaagcuggacugcaacaucgagauccagaacaucgccaucgagcugaccaagccccaguaccucuccaugaucgaccugcuggagagcguggacuacaugguccggaacgcccccuaccgcaaguacaagcccuaccucccgcugcacaccaacggccggcgcugguggaaguacgcgaucgacagcgugcuggaggugcacauccggcgcuacacgcagaugugguccuggagcaacaucaagaagcaccggcagcuccugaaguccuacaagaucgccuacaagaacaagcugacccagagcaaggucuccgaggagauccagaaggagauccaggaccucgagaagacccuggacguguucaacaucauccuggcccgccagcaggcccaggucgaggugauccggagcgggcagaagcugcgcaagaaguccgccgacaccggcgagaagcggggcgggugguucagcggccucugggggaagaaggaguccaagaagaaggacgaggagagccugauccccgagacgaucgacgaccugaugacccccgaggagaaggacaagcucuucaccgcgaucggcuacuccgagagcacccacaaccugacgcugcccaagcaguacguggcccacaucaugacccucaagcuggucuccaccagcgugaccauccgcgagaacaagaacaucccggagauccugaagauccagaucaucgggcucggcacgcaggugucccagcggcccggcgcccaggcccugaaggucgaggccaagcuggagcacugguacaucaccgggcuccgccagcaggacaucgugcccagccugguggcguccaucggcgacaccaccagcucccugcucaagaucaaguucgagacgaaccccgaggacagcccggccgaccagacccugaucguccagagccagcccguggaggugaucuacgacgccaagaccgucaacgccgugguggaguucuuccaguccaacaaggggcuggaccucgagcagaucaccagcgcgacgcugaugaagcuggaggagaucaaggagcgcaccgccaccggccucacccacaucaucgagacgcggaagguccuggaccugcgcaucaaccucaagcccuccuaccugguggugccccagaccggguuccaccacgagaagagcgaccugcucauccuggacuucggcaccuuccagcugaacuccaaggaccagggccuccagaagaccaccaacagcucccuggaggagaucauggacaaggccuacgacaaguucgacgucgagaucaagaacgugcagcugcucuucgcccgggccgaggagacguggaagaagugccgcuuccagcacccgagcaccaugcacauccugcagcccauggacauccacguggagcuggcgaaggccauggucgagaaggacauccggauggcccgcuucaagguguccgggggccucccccugaugcacgugcggaucagcgaccagaagaugaaggacguccuguaccucaugaacuccaucccgcugccccagaagagcuccgcccagagccccgagcgccagguguccagcauccccaucaucuccgggggcaccaaggggcugcucggcaccagccugcugcucgacacgguggagagcgaguccgacgacgaguacuucgacgccgaggacggcgagccgcagaccugcaagagcaugaagggguccgagcugaagaaggcggccgagguccccaacgaggagcugaucaaccuccugcugaaguucgagaucaaggaggugauccucgaguucaccaagcagcagaaggaggaggacaccauccugguguucaacgucacgcagcugggcaccgaggccaccaugcggaccuucgaccucacgguggugagcuaccugaagaagaucucccuggacuaccacgagaucgaggggagcaagcgcaagccccuccaccugaucuccagcuccgacaagcccggccuggaccuccugaaggucgaguacaucaaggccgacaagaacggcccgagcuuccagaccgccuucgggaagaccgagcagaccgugaagguggcguucuccagccugaaccuccugcugcagacgcaggcccucgucgccuccaucaacuaccugaccaccaucauccccagcgacgaccaguccaucagcguggccaaggaggugcagaucuccaccgagaagcagcagaagaacagcacgcugcccaaggcgaucgucuccagccgggacagcgacaucaucgacuuccgccucuucgccaagcugaacgccuucugcgugaucgugugcaacgagaagaacaacaucgccgagaucaagauccagggccuggacuccagccucucccugcagagccggaagcagucccuguucgcccgccucgagaacaucaucgucaccgacguggaccccaagaccgugcacaagaaggcggucagcaucauggggaacgagguguuccgguucaaccuggaccuguacccggacgccaccgagggcgaccucuacacggacauguccaagguggacgggguccugagccugaacgugggcugcauccagaucguguaccuccacaaguuccugaugucccugcucaacuuccugaacaacuuccagaccgccaaggagagccuguccgccgccaccgcgcaggccgccgagcgcgccgccaccagcgucaaggaccucgcgcagcgguccuuccgcgugagcaucaacaucgaccugaaggcccccgucaucgugaucccccaguccagcaucuccacgaacgccguggucguggaccugggccucauccgggugcacaaccaguucagccuggucuccgacgaggacuaccugaaccccccggugaucgaccgcauggacgugcagcucaccaagcugacccuguaccgcaccgucauccagcccgggaucuaccaccccgacauccagcugcuccaccccaucaaccuggaguuccuggugaaccggaaccucgccgcgagcugguaccacaaggugccggucguggagaucaagggccaccuggacagcaugaacgugucccugaaccaggaggaccucaaccugcuguuccgcauccucacggagaaccugugcgaggggaccgaggaccuggacaaggucaagccccgggugcaggagaccggcgagaucaaggagccccucgagaucagcaucucccaggacgugcacgacagcaagaacacccugacgaccggggucgaggagauccgcuccguggacaucaucaacaugcugcucaacuucgagaucaaggagguggucgugacccugaugaagaagagcgagaagaagggccggccccugcacgagcucaacgugcugcagcugggcauggaggccaaggucaagaccuacgacaugaccgccaaggccuaccucaagaagaucuccaugcagugcuucgacuucacggacagcaagggggagccgcugcacaucaucaacuccagcaacgugaccgacgagccccugcucaagaugcugcugaccaaggccgacuccgacggccccgaguucaagaccauccacgacagcacgaagcagcgccucaagguguccuucgcgagccuggaccugguccuccaccuggaggcccugcucuccuucauggacuuccugagcuccgccgccccguucagcgagcccuccagcagcgagaaggaguccgagcugaagccccucgugggggagagccgguccaucgccgugaaggcggucagcuccaacaucagccagaaggacguguucgaccugaagaucaccgccgagcugaacgccuucaacguguucgucugcgaccagaagugcaacaucgccgacaucaagauccacggcauggacgccuccaucagcgugaagcccaagcagaccgacguguucgcgcgccucaaggacaucaucgucaugaacguggaccugcaguccauccacaagaaggccgugagcauccugggggacgaggucuuccgguuccagcucacccuguacccggacgccacggagggcgaggccuacgccgacauguccaagguggacggcaagcugagcuucaagguggggugcauccagaucgucuacgugcacaaguucuucaugucccuccugaacuuccugaacaacuuccagaccgcgaaggaggcccucagcaccgccaccgugcaggccgcggagcgcgccgccuccagcaugaaggaccuggcccagaaguccuuccggcugcucauggacaucaaccugaaggcccccgucaucaucaucccccagagcuccgugagccccaacgcggugaucgccgaccugggccucauccgcgucgagaacaaguucagccuggugccgauggagcacuacucccugccccccgugaucgacaagaugaacaucgagcucacgcagcugaagcugagccggaccauccuccaggccucccugccccagaacgacaucgagauccugaagccggucaacaugcuccugagcauccagcgcaaccuggccgccgcgugguacgugcagauccccgggauggagaucaagggcaagcucaagcccaugcaggucgcccuguccgaggacgaccugaccgugcucaugaagauccugcuggagaaccucggggaggccagcucccagcccagcccgacccaguccgugcaggagacgguccgggugcgcaagguggacgucagcuccgugcccgaccaccugaaggagcaggaggacuggaccgacagcaagcuguccaugaaccagaucgugagccuccaguucgacuuccacuucgagucccugagcaucauccuguacaacaacgacaucaaccaggaguccggcgucgccuuccacaacgacagcuuccagcucggcgagcugcggcugcaccucauggccuccagcgggaagauguucaaggacggcagcaugaacguguccgugaagcugaagaccugcacccuggacgaccuccgcgaggggaucgagcgggcgacgagccgcaugaucgaccggaagaacgaccaggacaacaacuccagcaugaucgacaucuccuacaagcaggacaagaacggcagccagaucgacgccguccuggacaagcuguacgugugcgccuccguggaguuccucaugaccgucgccgacuucuucaucaaggcggugccccagagccccgagaacguggccaaggagacccagauccugccgcgccagaccgccacgggcaaggucaagaucgagaaggacgacuccgugcgccccaacaugacccugaaggccaugaucaccgaccccgagguggucuucguggccagccucaccaaggcggacgcccccgcccugacggccuccuuccagugcaaccugagccucuccaccagcaagcuggagcagaugauggaggccuccgugcgggaccugaagguccucgcgugcccguuccugcgcgagaagcgggggaagaacaucaccaccgugcugcagcccugcagccucuucauggagaagugcacgugggccuccggcaagcagaacaucaacaucauggugaaggaguucaucaucaagaucagccccaucauccugaacaccguccugaccaucauggccgcccugagccccaagaccaaggaggacggguccaaggacacgagcaaggagauggagaaccucuggggcaucaaguccaucaacgacuacaacaccugguuccuggggguggacaccgccaccgagaucaccgagagcuucaagggcaucgagcacucccugaucgaggagaacugcggcguggucguggagagcauccaggugacgcucgagugcgggcugggccaccgcaccgucccgcugcuccuggcggaguccaaguucagcgggaacaucaagaacuggaccucccugauggccgccguggccgacgugacccuccagguccacuacuacaacgagauccacgcggugugggagccccugaucgagcggguggagggcaagcgccaguggaaccugcggcucgacgucaagaagaaccccgugcaggacaagagccugcugccgggggacgacuucauccccgagccccagauggccauccacaucuccagcggcaacacgaugaacaucaccaucuccaagagcugccucaacguguucaacaaccuggccaagggcuucuccgaggggaccgccagcaccuucgacuacucccugaaggaccgcgcccccuucacggucaagaacgcggugggcgugccgaucaaggucaagcccaacugcaaccuccgggugaugggguuccccgagaagagcgacaucuucgacguggacgccggccagaaccuggagcuggaguacgccuccaugguccccagcagccaggggaaccucuccauccugagccgccaggaguccagcuucuucacccugaccaucgugccgcacggcuacaccgagguggccaacauccccgucgcccggcccggccgccggcucuacaacgugcgcaaccccaacgcgucccacagcgacuccguccuggugcagaucgacgccacggaggggaacaaggugaucacccugcggagcccgcuccagaucaagaaccacuucuccaucgccuucaucaucuacaaguucgucaagaacgugaagcugcuggagcgcaucggcaucgcccggcccgaggaggaguuccacgugccccucgacagcuaccgcugccagcuguucauccagcccgccgggauccuggagcaccaguacaaggaguccaccaccuacaucagcuggaaggaggagcuccaccggucccgcgagguccgcugcaugcugcagugcccgagcguggagguguccuuccugccccucaucgucaacacgguggcgcugcccgacgagcugagcuacaucugcacccacggcgaggacugggacguggccuacaucauccaccucuaccccucccugacccugcggaaccuccugccguacagccugcgcuaccuccuggagggcaccgccgagacgcacgagcuggccgagggguccaccgccgacguccuccacagccggaucagcggcgagaucauggagcuggugcuggugaaguaccaggggaagaacuggaacggccacuuccgcauccgggacacccuccccgaguucuuccccgucugcuucuccagcgacuccaccgaggugacgaccguggaccugagcguccacgugcgccggaucgggucccgcauggugcugagcgucuucucccccuacuggcucaucaacaagaccacccgggugcugcaguaccgcagcgaggacauccacgugaagcacccggcggacuuccgggacaucauccuguucuccuucaagaagaagaacaucuucacgaagaacaagguccagcucaagaucagcaccuccgccuggagcuccagcuucucccuggacaccgugggcagcuacggcugcgugaagugccccgccaacaacauggaguaccuggucgggguguccaucaagaugagcuccuucaaccucagccgcaucgugacccugacgcccuucugcaccaucgccaacaagagcucccuggagcucgaggucggcgagaucgcgagcgacggguccaugcccaccaacaaguggaacuacaucgccagcuccgagugccugccguucuggcccgagagccuguccggcaagcucugcgugcggguggucgggugcgagggcagcuccaagcccuucuucuacaaccgccaggacaacggcacccugcugagccucgaggaccugaacgggggcauccugguggacgugaacacggccgagcacuccaccgucaucaccuucagcgacuaccacgagggguccgccccggcccucaucaugaaccacacccccugggacauccugacguacaagcagagcggcucccccgaggagauggugcugcucccccggcaggcgcgccuguucgccugggccgacccgaccgggacccggaagcugaccuggaccuacgccgccaacgugggcgagcacgaccuccugaaggacggcugcgggcaguuccccuacgacgcgaacauccagauccacugggucagcuuccuggacggccgccagcgggugcuccuguucacggacgacguggcccuggucuccaaggcccuccaggccgaggagauggagcaggccgacuacgagaucacccugagccugcacucccucgggcugagccuggugaacaacgagagcaagcaggagguguccuacaucggcaucaccagcuccggggucgugugggaggugaagcccaagcagaaguggaagcccuucagccagaagcagaucauccuccuggagcaguccuaccagaagcaccagaucagccgcgaccacggcuggaucaagcuggacaacaacuucgaggucaacuucgacaaggacccgauggagaugcggcuccccauccgcucccccaucaagcgcgacuuccugagcggcauccagaucgaguucaagcaguccagccaccagcggucccugcgcgcgcggcucuacuggcugcagguggacaaccagcugcccggggccauguucccgguggucuuccaccccguggccccccccaagagcaucgcccuggacuccgagccgaagcccuucaucgacgucagcgugaucacccgcuucaacgaguacuccaaggugcuccaguucaaguacuucaugguccugauccaggagauggcgcugaagaucgaccagggcuuccucggggccaucaucgcccuguucacgcccaccaccgaccccgaggccgagcggcgccggaccaagcugauccagcaggacaucgacgcccucaacgcggagcugauggagacgagcaugaccgacauguccauccugagcuucuucgagcacuuccacaucuccccggugaagcuccaccugagccugagccucggcuccggcggggaggagagcgacaaggagaagcaggagauguucgccgugcacuccgucaaccugcugcucaagagcaucggcgccacccugaccgacguggacgaccugaucuucaagcucgccuacuacgagauccgcuaccaguucuacaagcgggaccagcugaucugguccgugguccgccacuacagcgagcaguuccugaagcagauguacgugcucgugcuggggcuggacguccucggcaaccccuucgggcugauccggggccuguccgagggcguggaggcccucuucuacgagcccuuccagggggcggugcagggccccgaggaguucgccgaggggcuggucaucggcgugcgcagccuguucgggcacacggugggcggcgccgccggggucgugucccggaucaccggcagcguggggaagggccucgccgcgaucaccauggacaaggaguaccagcagaagcgccgggaggagcugucccgccagccgcgggacuucggggacagccuggcccgcggcggcaagggguuccuccggggcgucguggggggcgugaccgggaucaucacgaagcccgucgagggcgccaagaaggagggcgccgcgggguucuucaagggcaucgggaagggccuggugggcgccguggcccgccccaccgggggcaucgucgacauggccuccagcaccuuccaggggauccagcgcgccgcggaguccaccgaggaggugagcucccugcggccgccccgccucauccacgaggacggcaucauccggcccuacgaccgccaggagagcgaggggagcgaccugcuggagcaggagcucgagauccaggaguga

SEQ ID NO: 38618 - RNA, 756 nt, Artificial Sequence
  derived and/or modified sequence opt1 from VPS26A__Homo_sapiens__NP_001030337
augagcuuccugggcggguucuucggccccaucugcgagaucgacaucgugcucaacgacggggagacccgcaagauggccgagaugaagaccgaggacggcaaggucgagaagcacuaccuguucuacgacggggaguccgugagcggcaaggugaaccuggccuucaagcagccgggcaagcggcucgagcaccaggggauccgcaucgaguucgucggccagaucgagcuguucaacgacaaguccaacacgcacgaguucgugaaccuggugaaggagcucgcgcugcccggggagcugacccagagccgguccuacgacuucgaguucaugcaggucgagaagcccuacgagagcuacaucggcgccaacgugcgccuccgguacuuccugaaggugaccaucguccgccggcugaccgaccucgugaaggaguacgaccugaucgugcaccagcuggccacguaccccgacgucaacaacuccaucaagauggagguggggaucgaggacugccuccacaucgaguucgaguacaacaagagcaaguaccaccugaaggacgugaucgucggcaagaucuacuuccugcucgugcgcaucaagauccagcacauggagcugcagcugaucaagaaggagaucaccggcaucgggccguccaccaccacggagaccgagaccaucgccaaguacgagaucauggacggcgcccccgugaagggggacaacuucauggagaaguccagcuga

SEQ ID NO: 38619 - RNA, 666 nt, Artificial Sequence
  derived and/or modified sequence opt1 from VPS28__Homo_sapiens__NP_057292
auguuccacggcauccccgccaccccggggaucggcgcccccgggaacaagcccgagcuguacgaggaggugaagcucuacaagaacgcgcgcgagcgggagaaguacgacaacauggccgagcuguucgccgucgugaagaccaugcaggcccuggagaaggccuacaucaaggacugcgugagccccuccgaguacacggcggccugcagccgccuccugguccaguacaaggccgccuuccgccaggugcagggcuccgagaucagcuccaucgacgaguucugccggaaguuccggcuggacugcccgcucgcgauggagcgcaucaaggaggaccggcccaucaccaucaaggacgacaaggggaaccugaaccgcugcaucgccgacguggucagccuguucaucaccgugauggacaagcuccggcuggagauccgcgccauggacgagauccagcccgaccugcgggagcucauggagaccaugcaccgcaugucccaccucccgcccgacuucgagggccggcagacggugagccaguggcugcagacccuguccggcaugagcgccuccgacgagcuggacgacagccagguccgccagaugcuguucgaccucgaguccgccuacaacgcguucaaccgguuccugcacgccuga

SEQ ID NO: 38620 - RNA, 1791 nt, Artificial Sequence
  derived and/or modified sequence opt1 from VPS33A__Homo_sapiens__NP_075067
auggccgcccaccugagcuacggccgcgugaaccucaacguccugcgggaggcggugcgccgggagcugcgcgaguuccucgacaagugcgccggguccaaggccaucgugugggacgaguaccugaccggccccuucgggcugaucgcccaguacagccuccugaaggagcacgaggucgagaagauguucacccugaagggcaaccggcucccggccgcggacgugaagaacaucaucuucuucgugcgcccccggcuggagcugauggacaucaucgccgagaacguccucuccgaggaccgccgggggcccacgcgcgacuuccacauccuguucgugccccggcgcagccugcucugcgagcagcggcugaaggaccugggcgugcucggcuccuucauccaccgcgaggaguacagccuggaccugaucccguucgacggggaccuccuguccauggagagcgagggcgccuucaaggagugcuaccuggagggggaccagaccucccucuaccacgccgcgaagggccugaugacccugcaggcccucuacgggaccaucccccagaucuucggcaagggcgagugcgcccggcaggucgccaacaugaugauccgcaugaagcgggaguucacggggagccagaacuccaucuuccccguguucgacaaccugcugcuccuggaccgcaacguggaccugcucacgccccuggccacccagcugaccuacgagggccucaucgacgagaucuacgggauccagaacagcuacgucaagcugccgcccgagaaguucgcgcccaagaagcagggcgacggcgggaaggaccugcccaccgaggccaagaagcuccagcugaacuccgccgaggagcuguacgccgagauccgggacaagaacuucaacgccgugggcagcgugcucuccaagaaggcgaagaucaucagcgccgccuucgaggagcgccacaacgccaagaccgucggggagaucaagcaguucgugucccagcugccgcacaugcaggccgcgcggggcagccuggccaaccacaccuccaucgccgagcucaucaaggacgugaccacgagcgaggacuucuucgacaagcugaccgucgagcaggaguucaugagcgggaucgacaccgacaaggugaacaacuacaucgaggacugcaucgcccagaagcacucccugaucaaggugcuccgccuggucugccugcagagcgugugcaacuccggccugaagcagaaggugcucgacuacuacaagcgcgagauccugcagaccuacggcuacgagcacauccugacgcuccacaaccuggagaaggccgggcugcucaagccccagaccggcgggcggaacaacuaccccaccauccgcaagacccugcggcuguggauggacgacgucaacgagcagaaccccacggacaucagcuacguguacuccggcuacgcgccgcucagcguccgccuggcccagcugcucucccggcccggguggcgcagcaucgaggaggugcugcggauccugcccggcccccacuucgaggagcgccagccgcuccccaccggccugcagaagaagcggcagcccggggagaaccgcgugacccugaucuucuuccucggcggggucaccuucgccgagaucgccgcgcugcgguuccugucccagcucgaggacggcgggacggaguacgugaucgccaccaccaagcugaugaacggcaccagcuggaucgaggcccugauggagaagcccuucuga

SEQ ID NO: 38621 - RNA, 1854 nt, Artificial Sequence
  derived and/or modified sequence opt1 from VPS33B__Homo_sapiens__NP_061138
auggccuucccccaccgcccggacgcccccgagcugcccgacuucagcaugcucaagcggcuggcgcgcgaccagcugaucuaccuccuggagcagcugcccggcaagaaggaccucuucaucgaggccgaccugauguccccgcuggaccggaucgccaacgugagcauccucaagcagcacgaggucgacaagcuguacaagguggagaacaagcccgcccuguccagcaacgagcagcucugcuuccuggugcgcccccggaucaagaacaugcgcuacaucgccucccuggucaacgcggacaagcucgccgggcggacccgcaaguacaaggugaucuucagcccccagaaguucuacgccugcgagauggugcuggaggaggagggcaucuacggggacgucuccugcgacgagugggccuucagccugcucccgcuggacguggaccugcucuccauggagcugcccgaguucuuccgggacuacuuccuggagggcgaccagcgcuggaucaacaccguggcgcaggcccuccaccuccugagcacgcuguacgggcccuuccccaacugcuacggcaucggccggugcgccaagauggccuacgagcuguggcgcaaccuggaggaggaggaggacggggagaccaagggccggcgcccggagaucgggcacaucuuccuccuggaccgggacgucgacuucgugaccgcccugugcucccagguggucuacgagggccucguggacgacaccuuccgcaucaagugcgggagcguggacuucggccccgaggucacguccagcgacaagucccugaaggugcugcucaacgcggaggacaagguguucaacgagauccggaacgagcacuucagcaacgucuucggcuuccugucccagaaggcccgcaaccugcaggcccaguacgaccggcgccgggggauggacaucaagcagaugaagaacuucgugagccaggagcucaagggccugaagcaggagcaccgccugcucucccugcacaucggggccugcgagagcaucaugaagaagaagaccaagcaggacuuccaggagcugaucaagaccgagcacgcccuccuggagggcuucaacauccgcgagagcaccuccuacaucgaggagcacaucgaccgccaggugagccccaucgagucccugcggcucaugugccugcugagcaucacggagaacggccugauccccaaggacuaccggucccucaagacccaguaccugcagagcuacgggccggagcaccuccugaccuucuccaaccugcgccgggcgggccugcucaccgagcaggcccccggggacacgcugaccgccgucgagagcaagguguccaagcuggugaccgacaaggccgccggcaagaucaccgacgcguucagcucccucgccaagcgcagcaacuuccgggccaucuccaagaagcugaaccugaucccccgcgucgacggggaguacgaccucaaggugccccgggacauggccuacgucuucggcggcgccuacgugccgcugagcugccgcaucaucgagcagguccuggagcggcgcuccuggcaggggcucgacgagguggugcggcugcugaacugcagcgacuucgcguucacggacaugaccaaggaggacaaggccuccagcgagucccuccgccugauccugguggucuuccucggcgggugcaccuucagcgagaucagcgcccugcgguuccugggccgcgagaagggguaccgguucaucuuccucaccacggccgugaccaacuccgcgcgccugauggaggccaugagcgaggugaaggccuga

SEQ ID NO: 38622 - RNA, 2391 nt, Artificial Sequence
  derived and/or modified sequence opt1 from VPS35__Homo_sapiens__NP_060676
augcccaccacccagcagagcccgcaggacgagcaggagaagcugcucgacgaggccauccaggccgugaagguccaguccuuccagaugaagcgcugccuggacaagaacaagcugauggacgcgcucaagcacgccagcaacaugcugggcgagcugcggacguccaugcucagccccaaguccuacuacgagcuguacauggccaucagcgacgagcugcacuaccucgagguguaccugaccgacgaguucgccaaggggcgcaagguggccgaccuguacgagcucguccaguacgcgggcaacaucaucccccggcuguaccugcucaucaccguggggguggucuacgugaaguccuucccccagagccgcaaggacauccugaaggaccugguggagaugugccggggcguccagcacccgcuccgcgggcuguuccugcggaacuaccuccugcagugcacccgcaacauccugcccgacgagggcgagcccacggacgaggagaccaccggcgacaucuccgacagcauggacuucgugcuccugaacuucgccgagaugaacaagcugugggugcggaugcagcaccaggggcacucccgcgaccgggagaagcgcgagcgggagcgccaggagcuccggauccuggucggcaccaaccuggugcgccucagccagcuggagggggugaacgucgagcgguacaagcagaucgugcugacgggcauccucgagcaggucgugaacugccgcgacgcccuggcccaggaguaccugauggagugcaucauccagguguuccccgacgaguuccaccuccagacccugaacccguuccugcgggcgugcgccgagcuccaccagaacgugaacgucaagaacaucaucaucgcccugaucgaccgccuggcccucuucgcccaccgggaggacgggcccggcauccccgcggacaucaagcuguucgacaucuucucccagcaggucgccaccgugauccagagccgccaggacaugcccuccgaggacguggugagccugcaggucucccucaucaaccuggccaugaagugcuacccggaccgcguggacuacguggacaagguccuggagaccacgguggagaucuucaacaagcucaaccuggagcacaucgccaccagcuccgccgugagcaaggagcugacccggcugcucaagauccccgucgacaccuacaacaacauccugacggugcugaagcucaagcacuuccacccccuguucgaguacuucgacuacgagagccgcaaguccaugagcugcuacgugcuguccaacguccucgacuacaacaccgagaucgugagccaggaccagguggacuccaucaugaaccuggucagcacccugauccaggaccagcccgaccagccgguggaggaccccgaccccgaggacuucgcggacgagcagucccucgugggccgguucauccaccuccugcgcagcgaggaccccgaccagcaguaccucauccugaacaccgcccggaagcacuucggggccggcgggaaccagcgcauccgguucacgcugccgccccucgucuucgccgccuaccagcuggcguuccgcuacaaggagaacuccaagguggacgacaagugggagaagaagugccagaagaucuucagcuucgcccaccagaccaucuccgcccugaucaaggccgagcucgccgagcugccccugcggcuguuccugcagggcgcgcuggccgccggcgagaucggguucgagaaccacgagaccguggccuacgaguucaugagccaggcguucucccucuacgaggacgagaucagcgacuccaaggcccagcuggccgccaucacccugaucaucggcacguucgagcgcaugaagugcuucagcgaggagaaccacgagccccuccggacccagugcgcccuggcggccuccaagcugcucaagaagccggaccaggggcgcgccgucagcacgugcgcccaccuguucugguccggccggaacaccgacaagaacggggaggagcugcacggcggcaagcgcgugauggagugccucaagaaggcccugaagaucgcgaaccagugcauggaccccagccuccaggugcagcuguucaucgagauccugaaccgguacaucuacuucuacgagaaggagaacgacgccgucaccauccaggugcugaaccagcucauccagaagauccgcgaggaccugcccaaccuggagagcuccgaggagaccgagcagaucaacaagcacuuccacaacacccucgagcaccuccggcugcgccgggagagccccgaguccgaggggccgaucuacgagggccugauccuguga

SEQ ID NO: 38623 - RNA, 1161 nt, Artificial Sequence
  derived and/or modified sequence opt1 from VPS36__Homo_sapiens__NP_057159
auggaccgcuucguguggaccagcggccugcucgagaucaacgagacccuggucauccagcagcgcggggugcggaucuacgacggcgaggagaagaucaaguucgacgccgggacgcugcuccuguccacccaccggcugaucuggcgcgaccagaagaaccacgagugcugcauggccauccuccugagccagaucguguucaucgaggagcaggcggccggcaucgggaaguccgccaagaucgucgugcaccuccaccccgccccgcccaacaaggagcccggccccuuccagagcuccaagaacagcuacaucaagcuguccuucaaggagcacggccagaucgaguucuaccggcgccugagcgaggagaugacccagcggcgcugggagaacaugccggugucccagagccugcagaccaaccgggggccccagcccggccgcauccgggccgucgggaucgugggcaucgagcgcaagcucgaggagaagcggaaggagacggacaagaacaucuccgaggcguucgaggaccugagcaagcugaugaucaaggccaaggagaugguggagcucuccaagagcaucgccaacaagaucaaggacaagcagggggacaucaccgaggacgagaccauccgcuucaaguccuaccugcugagcaugggcaucgccaaccccgucacccgggagacguacggcuccgggacccaguaccacaugcagcucgcgaagcagcuggccggcauccuccaggugccgcuggaggagcgcgggggcaucaugagccugaccgagguguacugccuggucaaccgggcccgcggcauggagcuccugucccccgaggaccuggugaacgccugcaagaugcucgaggcccugaagcugccccuccggcugcgcguguucgacagcggggucauggugaucgagcugcagagccacaaggaggaggagaugguggcguccgcccucgagaccgucagcgagaagggcucccugacgagcgaggaguucgccaagcugguggggauguccgugcuccuggccaaggagcggcugcuccuggccgagaagaugggccaccugugccgcgacgacagcgucgaggggcuccgcuucuaccccaaccuguucaugacccaguccuga

SEQ ID NO: 38624 - RNA, 1119 nt, Artificial Sequence
  derived and/or modified sequence opt1 from VPS37A__Homo_sapiens__NP_001138624
augagcuggcuguucccccucaccaaguccgccagcuccagcgccgccggcucccccgggggccugaccagccugcagcagcagaagcagcgccucaucgagucccugcggaacagccacucccgccugcucccgccccaguucccccaggagaagccggugaucagcgucuacccgcccauccggcaccaccugauggacaagcaggggguguacgugacgagcccccuggucaacaacuucaccaugcacagcgaccucggcaagaucauccagucccugcuggacgaguucuggaagaacccgcccgugcucgcccccaccagcaccgccuuccccuaccuguacuccaaccccagcgggaugucccccuacgccagccagggcuuccccuuccugcccccguacccgccccaggaggccaaccgcuccaucacgagccucagcguggcggacaccgucuccagcuccaccaccagccacacgaccgccaagcccgccgcccccuccuucggcgugcugagcaaccugccccuccccauccccaccguggacgcguccaucccgaccagccagaacggguucggcuacaagaugcccgacguccccgacgccuuccccgagcuguccgagcugagcgugucccagcucacggacaugaacgagcaggaggaggugcugcuggagcaguuccucacccugccgcagcugaagcagaucaucaccgacaaggacgaccucgucaagagcaucgaggagcuggcccggaagaaccugcuccuggagcccucccuggaggccaagcgccagaccgugcucgacaaguacgagcugcugacgcagaugaaguccaccuucgagaagaagaugcagcggcagcacgagcucuccgagagcugcuccgccagcgcgcugcaggcccgccugaagguggccgcccacgaggccgaggaggaguccgacaacaucgcggaggacuuccucgaggggaagauggagaucgacgacuuccugagcagcuucauggagaagcggaccaucugccacugccgccgggccaaggaggagaagcugcagcaggccaucgccaugcacucccaguuccacgcgccccucuga

SEQ ID NO: 38625 - RNA, 858 nt, Artificial Sequence
  derived and/or modified sequence opt1 from VPS37B__Homo_sapiens__NP_078943
auggccggcgccgggagcgaggcgcgcuucgccggccugucccucgugcagcugaacgagcugcucgaggacgaggggcagcugaccgagaugguccagaagauggaggagacccagaacgugcagcugaacaaggagaugacgcucgccagcaaccggucccuggccgagggcaaccugcucuaccagccccagcuggacacccugaaggcccgccucacccagaaguaccaggagcuccaggugcuguucgaggcguaccagaucaagaagaccaagcuggaccggcagagcuccagcgccucccuggagacgcugcucgcccugcugcaggccgagggggcgaagaucgaggaggacaccgagaacauggccgagaaguuccucgacggcgagcugccccuggacagcuucaucgacgucuaccaguccaagcgcaagcucgcccacaugcggcgcgugaagaucgagaagcugcaggagauggugcugaagggccagcggcucccccaggcccuggcgccccugccgccccgccuccccgagcuggcccccaccgcgccccugcccuaccccgcccccgaggccagcgggccgcccgccgucgcgccccggcgcaucccgcccccgcccccgcccgugcccgccggccggcucgccacccccuucacggccgccauguccagcgggcaggccgugcccuaccccggccugcagugcccgccccugccgccccgcgucgggcuccccacccagcagggcuucuccagccaguucgugucccccuacccgccgccccugccccagcggcccccgccccgccugccgccccaccagcccggcuucauccuccaguga

SEQ ID NO: 38626 - RNA, 1068 nt, Artificial Sequence
  derived and/or modified sequence opt1 from VPS37C__Homo_sapiens__NP_060436
auggagacccugaaggacaagacccuccaggagcuggaggagcugcagaacgacagcgaggccaucgaccagcucgcccuggagucccccgaggugcaggaccugcagcucgagcgcgagauggcgcuggccacgaaccggagccuggccgagcgcaaccucgaguuccagggcccccuggagaucucccggagcaaccuguccgaccgcuaccaggagcuccggaagcuggucgagcgcugccaggagcagaaggccaagcuggagaaguucagcuccgcccuccagcccgggacccugcuggaccuccuccagguggagggcaugaagaucgaggaggagagcgaggcgauggccgagaaguuccuggagggggaggugccccuggagaccuuccuggagaacuucuccagcaugcggaugcugucccaccuccgccggguccgcguggagaagcugcaggaggugguccggaagccccgcgccagccaggagcuggccggcgacgcgcccccgccccggcccccgccgcccgugcgccccgugccccaggggaccccgcccgucguggaggagcagccccagccgccccucgccaugccgcccuacccccugcccuacucccccagccccucccugcccgugggccccacggcccacggcgcccucccgcccgcccccuuccccgucgugagccagcccuccuucuacagcgggccccugggccccaccuaccccgcggcccagcuggggccccggggcgccgccggguacuccuggagcccgcagcgcagcaugccgccccggcccggcuaccccggcacccccaugggggccuccggccccggguacccccuccgcggcggccgggcgccgagccccggguacccccagcagucccccuacccggccaccggcgggaagccgcccuaccccauccagccccagcugcccagcuuccccggccagccccagccguccgugccccugcagcccccguacccgcccgggcccgccccgcccuacggcuucccgcccccgcccggccccgccuggcccggguacuga

SEQ ID NO: 38627 - RNA, 2661 nt, Artificial Sequence
  derived and/or modified sequence opt1 from VPS39__Homo_sapiens__NP_001288067
augcacgacgccuucgagcccgugccgauccuggagaagcucccccugcagaucgacugccuggccgcgugggaggaguggcuccuggucggcaccaagcaggggcaccuccuccuguaccgcauccggaaggacguggugcccgccgacgucgccagccccgaguccggcagcugcaaccgcuucgaggugacccuggagaaguccaacaagaacuucagcaagaagauccagcagauccacguggucucccaguucaagauccucgugagccugcuggagaacaacaucuacgugcacgaccuccugacguuccagcagaucaccaccgucuccaaggccaagggggccagccuguucacgugcgaccuccagcacaccgagaccggcgaggaggugcugcggaugugcguggcggucaagaagaagcugcagcucuacuucuggaaggaccgcgaguuccacgagcugcagggggacuucuccgugccggacgugcccaagagcauggccuggugcgagaacuccaucugcgucggcuucaagcgggacuacuaccugauccgcguggacggcaaggggagcaucaaggagcuguuccccaccggcaagcagcuggagccccugguggccccgcucgccgacgggaaggucgcggugggccaggacgaccugaccgugguccugaacgaggaggggaucugcacgcagaagugcgcccucaacuggaccgacauccccguggccauggagcaccagccgcccuacaucaucgccgugcugccccgguacgucgagauccgcaccuucgagccccggcugcucgugcaguccaucgagcugcagcgcccccgguucaucaccagcggcggcuccaacaucaucuacgucgccagcaaccacuucguguggcgccugauccccgugccgauggcgacgcagauccagcagcuccugcaggacaagcaguucgagcuggcccuccagcuggccgagaugaaggacgacuccgacagcgagaagcagcagcagauccaccacaucaagaaccuguacgccuucaaccucuucugccagaagcgguucgacgaguccaugcaggucuucgccaagcuggggaccgaccccacccacgugaugggccuguaccccgaccuccugcccaccgacuaccgcaagcagcugcaguacccgaacccccuccccgugcugagcggggcggagcuggagaaggcccaccucgcccugaucgacuaccugacgcagaagcggagccagcuggucaagaagcucaacgacuccgaccaccagagcuccaccagcccccugauggagggcaccccgaccaucaaguccaagaagaagcugcuccagaucaucgacacgacccugcugaagugcuaccuccacaccaacguggcccugguggcgccccugcuccgccuggagaacaaccacugccacaucgaggagagcgagcacguccugaagaaggcccacaaguacuccgagcucaucauccuguacgagaagaagggccugcacgagaaggcccuccaggugcugguggaccagagcaagaaggccaacagcccccugaaggggcacgagcggaccguccaguaccuccagcaccugggcacggagaaccugcaccucaucuucuccuacuccgugugggugcugcgcgacuuccccgaggacgggcugaagaucuucaccgaggaccucccggaggucgagagccugccccgggaccgcgugcugggcuuccucaucgagaacuucaaggggcuggccauccccuaccuggagcacaucauccacgugugggaggagaccggcucccgguuccacaacugccucauccagcuguacugcgagaagguccagggccugaugaaggaguaccuccugagcuucccggccgggaagacccccgugcccgcgggcgaggaggagggggagcugggcgaguaccgccagaagcuccugauguuccuggagaucuccagcuacuacgaccccgggcgccucaucugcgacuucccguucgacggccugcuggaggagcgggcccuccugcugggccgcauggggaagcacgagcaggcccucuucaucuacgugcacauccugaaggacacgcggauggccgaggaguacugccacaagcacuacgaccgcaacaaggacggcaacaaggacgucuaccugucccuccugcggauguaccugagcccgcccuccauccacugccucgggcccaucaagcuggagcugcucgagcccaaggcgaaccugcaggccgcccuccaggugcuggagcugcaccacagcaagcuggacaccaccaaggcccucaaccugcugcccgccaacacccagaucaacgacauccgcaucuuccucgagaaggugcuggaggagaacgcgcagaagaagcgguucaaccagguccugaagaaccuccugcacgccgaguuccugcgcgugcaggaggagcggauccuccaccagcaggucaagugcaucaucacggaggagaaggugugcauggugugcaagaagaagaucggcaacagcgccuucgcccgcuaccccaacgggguggucgugcacuacuucugcuccaaggaggugaaccccgccgacaccuga

SEQ ID NO: 38628 - RNA, 2565 nt, Artificial Sequence
  derived and/or modified sequence opt1 from VPS41__Homo_sapiens__NP_055211
auggccgaggccgaggagcaggagaccggcagccuggaggaguccaccgacgagagcgaggaggaggaguccgaggaggagcccaagcucaaguacgagcgccugagcaacggggugacggagauccugcagaaggacgcggccuccugcaugaccguccacgacaaguuccucgcccugggcacccacuacgggaagguguaccugcucgacgugcagggcaacaucacccagaaguucgacgucagcccggugaagaucaaccagaucucccuggacgagagcggggagcacaugggcgugugcuccgaggacggcaagguccagguguucgggcuguacagcggcgaggaguuccacgagacguucgacugccccaucaagaucaucgccgugcacccccacuucguccgguccagcugcaagcaguucgugaccgggggcaagaagcuccugcuguucgagcgcuccuggaugaaccgguggaaguccgccgugcuccacgagggggagggcaacauccgcuccgucaaguggcggggccaccugaucgcgugggccaacaacaugggggugaagaucuucgacaucaucagcaagcagcgcaucaccaacgugccccgggacgacaucucccugcgcccggacauguaccccugcagccucugcuggaaggacaacgucacccugaucaucggcugggggacguccgugaaggugugcagcgucaaggagcggcacgccagcgagaugcgcgaccugcccucccgguacguggagaucgugagccaguucgagaccgaguucuacaucuccggccucgcgccccugugcgaccagcuggucgugcucagcuacgugaaggagaucuccgagaagaccgagcgcgaguacugcgcccggccgcgccuggacaucauccagccccugagcgagaccugcgaggagaucuccagcgacgcccucacgguccggggcuuccaggagaacgagugccgcgacuaccaccuggaguacuccgagggggagagccuguucuacaucgugagcccccgggacgucgugguggccaaggagcgcgaccaggacgaccacaucgacuggcuccuggagaagaagaaguacgaggaggcccugauggccgcggagaucagccagaagaacaucaagcggcacaagauccucgacaucggccuggccuacaucaaccaccuggucgagcgcggggacuacgacaucgccgcccggaagugccagaagauccucggcaagaacgccgcgcugugggaguacgagguguacaaguucaaggagaucgggcagcugaaggccaucucccccuaccucccgcgcggcgaccccgugcugaagccccugaucuacgagaugauccuccacgaguuccuggagagcgacuacgagggcuucgccacccugauccgcgaguggcccggggaccucuacaacaacuccgucaucgugcaggccgugcgggaccaccugaagaaggacagccagaacaagacccugcucaagacccuggccgagcuguacacguacgacaagaacuacggcaacgcgcucgagaucuaccugacccugcgccacaaggacgucuuccagcugauccacaagcacaaccucuucuccagcaucaaggacaagaucgugcugcugauggacuucgacuccgagaaggccguggacaugcuccuggacaacgaggacaagaucagcaucaagaaggucguggaggagcuggaggaccggccggagcuccagcacguguaccugcacaagcuguucaagcgcgaccaccacaaggggcagcgguaccacgagaagcagaucagccucuacgccgaguacgaccgccccaaccugcugcccuuccuccgggacuccacccacugcccccuggagaaggcccuggagaucugccagcagcgcaacuucgucgaggagaccguguaccuccugagccggaugggcaacucccgcagcgcccugaagaugaucauggaggagcuccacgacguggacaaggcgaucgaguucgccaaggagcaggacgacggggagcugugggaggaccugauccucuacuccaucgacaagccgcccuucaucacgggccugcugaacaacaucggcacccacgucgaccccauccuccugauccaccggaucaaggaggggauggagauccccaaccugcgcgacagccucgugaagauccugcaggacuacaaccugcagauccuccugcgggagggcugcaagaagauccugguggccgacucccucagccugcugaagaagaugcaccgcacccagaugaaggggguccucguggacgaggagaacaucugcgaguccugccugagcccgauccugcccuccgacgccgcgaagcccuucagcguggucguguuccacugccggcacauguuccacaaggagugccuccccaugccguccaugaacagcgccgcccaguucugcaacaucugcuccgccaagaaccgcggccccgggagcgccauccuggagaugaagaaguga

SEQ ID NO: 38629 - RNA, 1314 nt, Artificial Sequence
  derived and/or modified sequence opt1 from VPS4A__Homo_sapiens__NP_037377
augaccaccagcacgcugcagaaggccaucgaccucgugaccaaggccaccgaggaggacaaggcgaagaacuacgaggaggcccugcgccuguaccagcacgccgucgaguacuuccuccacgccaucaaguacgaggcccacuccgacaaggcgaaggagagcauccgggccaagugcgugcaguaccuggaccgcgccgagaagcugaaggacuaccuccgguccaaggagaagcacggcaagaagcccgugaaggagaaccagagcgaggggaagggcuccgacagcgacuccgagggggacaacccggagaagaagaagcugcaggagcagcugaugggcgccgucgugauggagaagcccaacauccgcuggaacgacguggcggggcucgagggcgccaaggaggcccugaaggaggccgucauccugcccaucaaguucccccaccucuucaccggcaagcggacgccguggcgcgggauccugcuguucggcccgcccgggaccggcaagagcuaccucgccaaggcgguggccaccgaggccaacaacuccaccuucuucagcguguccagcuccgaccugaugagcaaguggcugggggaguccgagaagcucgucaagaaccuguucgagcuggcccggcagcacaagcccagcaucaucuucaucgacgagguggacucccucugcggcagccgcaacgagaacgaguccgaggccgcgcggcgcaucaagacggaguuccuggugcagaugcagggcgucgggaacaacaacgacggcacccuggugcucggggccaccaacauccccugggugcuggacagcgccauccggcgccgguucgagaagcgcaucuacaucccccugcccgaggaggccgcccgggcgcagauguuccgccuccaccugggcagcacgccccacaaccugaccgacgccaacauccacgagcucgcccggaagaccgagggcuacuccggggccgacaucagcaucaucguccgcgacucccugaugcagccggugcggaaggugcagagcgccacccacuucaagaaggucugcggccccucccgcaccaaccccagcaugaugaucgacgaccugcucacgcccugcuccccgggggaccccggcgcgauggagaugaccuggauggacgugcccggggacaagcugcuggagcccguggucugcaugagcgacaugcuccggucccuggccaccacccgcccgacggugaacgccgacgaccugcucaaggugaagaaguucagcgaggacuucggccaggaguccuga

SEQ ID NO: 38630 - RNA, 1335 nt, Artificial Sequence
  derived and/or modified sequence opt1 from VPS4B__Homo_sapiens__NP_004860
augagcuccaccagccccaaccugcagaaggccaucgaccucgccuccaaggcggcccaggaggacaaggccggcaacuacgaggaggcccugcagcuguaccagcacgccgugcaguacuuccuccacgucgugaaguacgaggcgcagggggacaaggccaagcagagcauccgcgccaagugcaccgaguaccuggaccgggccgagaagcugaaggaguaccucaagaacaaggagaagaaggcgcagaagccggugaaggagggccagcccucccccgccgacgagaaggggaacgacagcgacggcgagggggaguccgacgaccccgagaagaagaagcugcagaaccagcugcagggcgccaucgucaucgagcgcccgaacgugaaguggagcgacguggccggccucgagggggccaaggaggcgcugaaggaggccgucauccugcccaucaaguucccccaccucuucacgggcaagcggacccccuggcgcgggauccugcuguucggcccgcccgggaccggcaaguccuaccucgccaaggccguggccaccgaggcgaacaacagcacguucuucuccaucagcuccagcgaccugguguccaaguggcugggcgagagcgagaagcucgucaagaaccuguuccagcuggcccgggagaacaagcccuccaucaucuucaucgacgagaucgacagccucugcgggucccgcagcgagaacgagagcgaggccgcccggcgcaucaagaccgaguuccuggugcagaugcagggcgugggggucgacaacgacggcauccuggugcucggcgccaccaacauccccugggugcuggacuccgcgauccggcgccgguucgagaagcgcaucuacaucccgcugcccgagccccacgcccgggccgccauguucaagcuccaccuggggaccacgcagaacagccugaccgaggccgacuuccgcgagcucggccggaagaccgacggguacuccggcgcggacaucagcaucaucguccgcgacgcccugaugcagcccgugcggaaggugcaguccgccacccacuucaagaagguccgcgggccgagccgggccgaccccaaccaccugguggacgaccuccugacgcccugcucccccggcgacccgggcgcgaucgagaugaccuggauggacgugcccggggacaagcugcucgagcccgucgugagcauguccgacaugcugcgcagccuguccaacaccaagcccaccgugaacgagcacgaccuccugaagcugaagaaguucacggaggacuucggccaggagggguga

SEQ ID NO: 38631 - RNA, 2349 nt, Artificial Sequence
  derived and/or modified sequence opt1 from VPS51__Homo_sapiens__NP_037397
auggccgccgcggccgccgccggccccagcccgggguccggccccggggacagccccgagggccccgagggggaggccccggagcgccggcgcaaggcgcacggcaugcugaagcucuacuacggccuguccgagggggaggccgccggccggcccgccgggcccgacccccuggacccgaccgaccucaacggcgcgcacuucgaccccgagguguaccuggacaagcugcgccgggagugcccccucgcccagcugauggacagcgagaccgacaugguccgccagauccgggcccuggacuccgacaugcagacgcucguguacgagaacuacaacaaguucaucagcgccaccgacaccauccgcaagaugaagaacgacuuccggaagauggaggacgagauggaccgccuggccaccaacauggcggugaucacggacuucuccgcccggaucagcgccacccugcaggaccgccacgagcggaucaccaagcucgccgggguccacgcccugcugcgcaagcuccaguuccuguucgagcugcccucccggcucaccaagugcguggagcugggcgcguacggccaggccgugcgcuaccaggggcgggcccaggccguccugcagcaguaccagcaccucccgagcuuccgcgccauccaggacgacugccaggugaucacggcgcggcuggcccagcagcugcgccagcgguuccgcgagggcggguccggcgcccccgagcaggccgagugcguggagcuccugcuggcccucggcgagcccgcggaggagcugugcgaggaguuccuggcccacgcccgcgggcggcucgagaaggagcugcgcaaccuggaggccgagcucggccccagcccgcccgcgcccgacguccuggaguucaccgaccacgggggcuccggguucgugggcggccugugccagguggccgccgccuaccaggagcuguucgccgcgcaggggcccgccggcgccgagaagcuggccgccuucgcgcggcagcuggggagccgcuacuucgcccucgucgagcggcgccuggcccaggagcagggcgggggcgacaacucccugcucgugcgggcccuggaccgcuuccaccggcgccugcgggccccgggcgcgcuccuggccgccgccgggcuggcggacgccgccaccgagaucguggagcgcgucgcccgggagcgccucggccaccaccuccaggggcugcgggccgcguuccugggcugccucaccgacgugcgccaggcccuggccgcgccccggguggccgggaaggagggccccggccuggccgagcuccuggccaacgucgccagcuccauccugagccacaucaaggccucccucgccgcggugcaccuguucacggccaaggaggugagcuucagcaacaagcccuacuuccgcggggaguucugcucccagggcguccgggaggggcugaucgugggcuucgugcacagcaugugccagaccgcccaguccuucugcgacagcccgggcgagaagggcggggccaccccgcccgcgcuccugcugcuccugucccgccugugccucgacuacgagaccgccacgaucagcuacauccugacccugaccgacgagcaguuccucguccaggaccaguuccccgugacccccgucuccacgcugugcgccgaggcccgcgagaccgcccggcgccugcucacccacuacgugaaggugcaggggcuggucaucagccagaugcugcggaaguccguggagacccgcgacuggcucagcacgcuggagccccggaacgugcgcgcggucaugaagcgggugguggaggacaccaccgccaucgacguccaggugggccugcucuacgaggagggggugcgcaaggcccaguccagcgacuccagcaagcggaccuucuccgucuacagcuccagccgccagcagggccgguacgcccccuccuacacgccgagcgcccccauggacaccaaccugcugagcaacauccagaagcuguucuccgagcgcaucgacguguucagccccguggaguucaacaaggucuccgugcugaccggcaucaucaagaucagccugaagacccuccuggagugcgugcggcugcgcacguucgggcgguucggccuccagcagguccagguggacugccacuuccugcagcuguaccucuggcgcuucguggcggacgaggagcugguccaccuccuccuggacgaggugguggccuccgccgcccugcggugccccgacccgguccccauggagcccagcgugguggaggucaucugcgagcgcggguga

SEQ ID NO: 38632 - RNA, 1605 nt, Artificial Sequence
  derived and/or modified sequence opt1 from VPS52__Homo_sapiens__NP_001276105
auggagcagaugcugggcgccuuccagagcgaccucuccagcaucuccagcgagauccgcacccugcaggagcaguccggggccaugaacauccggcugcgcaaccggcaggcggugcgcggcaagcucggggagcuggucgacggccugguggugcccagcgcccucgucaccgccauccuggaggccccggugacggagccccgguuccuggagcagcuccaggagcuggacgccaaggcggccgccgugcgcgagcaggaggcccgggggaccgcggccugcgccgacguccgcggcgugcuggaccggcuccgcgugaaggccgucaccaagauccgggaguucauccugcagaagaucuacuccuuccgcaagcccaugaccaacuaccagaucccccagacggcccugcucaaguaccgguucuucuaccaguuccugcugggcaacgagcgcgcgaccgccaaggagauccgggacgaguacguggagacccucagcaagaucuaccuguccuacuaccgcagcuaccuggggcggcucaugaaggugcaguacccguucgaggcccuguuccgcucccagcacuacgcccugcucgacaacagcugccgggaguaccuguucaucugcgaguucuucgucguguccggccccgccgcgcacgaccuguuccacgccgugauggggcgcacccucagcaugacgcugaagcaccuggacuccuaccucgccgacugcuacgacgccaucgccgucuuccugugcauccacaucgugcugcgguuccgcaacaucgcggccaagcgcgacgugcccgcccucgaccgguacugggagcagguccuggcccugcucuggccccgcuucgagcugauccuggagaugaacgugcagagcgugcgguccaccgacccgcagcgccucggcgggcuggacacccggccccacuacaucacccgccgguacgccgaguucagcuccgcgcuggucagcaucaaccagacgauccccaacgagcgcaccaugcagcuccugggccagcuccagguggagguggagaacuucguccugcggguggccgccgaguucagcucccgcaaggagcagcuggucuuccugaucaacaacuacgacaugaugcucggcgugcugauggagcgggccgcggacgacagcaaggagguggaguccuuccagcagcugcugaacgcccgcacccaggaguucaucgaggagcuccugagcccgcccuucgggggccuggucgccuucgugaaggaggccgaggcccucaucgagcgggggcaggcggagcgccugcggggcgaggaggcccgcgugacccagcugauccggggcuucggguccagcuggaaguccagcgucgagucccucagccaggacgugaugcgcuccuucacgaacuuccggaacggcaccagcaucauccagggggcccugacccagcugauccagcucuaccaccgcuuccaccgcgugcugucccagccccagcugcgggcccuccccgcccgcgcggagcugaucaacauccaccaccugauggucgagcucaagaagcacaagcccaacuucuga

SEQ ID NO: 38633 - RNA, 2499 nt, Artificial Sequence
  derived and/or modified sequence opt1 from VPS53__Homo_sapiens__NP_001121631
augauggaggaggaggagcuggaguucguggaggagcucgaggccguccugcagcugacccccgaggugcagcucgccaucgagcaggucuucccgagccaggacccccuggaccgcgcggacuucaacgccguggaguacaucaacacccuguuccccacggagcagucccucgccaacaucgacgagguggugaacaagauccggcugaagauccgccggcuggacgacaacauccgcaccgucgugcggggccagaccaacguggggcaggacggccgccaggcccucgaggaggcccagaaggcgauccagcagcuguucgggaagaucaaggacaucaaggacaaggccgagaaguccgagcagauggucaaggagaucacccgggacaucaagcagcuggaccacgccaagcgccaccucacgaccagcaucaccacccugaaccaccuccacaugcuggccggcgggguggacagccuggaggcgaugacgcggcgccggcaguacggcgagguggccaaccugcuccagggcgucaugaacgugcuggagcacuuccacaaguacauggggaucccccagauccgccagcuguccgagcgggugaaggccgcccagaccgagcucggccagcagauccuggccgacuucgaggaggcguucccgagccaggggaccaagcgccccggcgggcccuccaacguccugcgggacgccugccucguggccaacauccuggacccccgcaucaagcaggagaucaucaagaaguucaucaagcagcaccugagcgaguaccucgugcuguuccaggagaaccaggacgucgccuggcuggacaagaucgaccggcgcuacgccuggaucaagcggcagcucguggacuacgaggagaaguacggccgcauguucccgcgggaguggugcauggcggagcgcaucgccguggaguucugccacgucacccgcgccgagcuggccaagaucaugcggacgcgcgccaaggagaucgaggugaagcugcuccuguucgcgauccagcggaccaccaacuucgagggcuuccuggccaagcgcuucuccgggugcacccucacggacggcacccugaagaagcuggagagcccgccgcccuccaccaaccccuuccucgaggacgagcccacccccgagauggaggagcuggccacggagaagggggaccuggaccagcccaagaagcccaaggcccccgacaaccccuuccacggcaucgugagcaagugcuucgagccccaccucuacgucuacaucgagucccaggacaagaaccugggcgagcugaucgaccgguucguggccgacuucaaggcgcaggggccgcccaagcccaacaccgacgagggcggggccguccuccccagcugcgccgaccuguucguguacuacaagaagugcauggugcagugcucccagcugagcaccggcgagccgaugaucgcccucaccacgaucuuccagaaguaccugcgcgaguacgcguggaagauccuguccgggaaccugcccaagaccaccaccagcuccggcggccucacgaucagcagccugcugaaggagaaggagggguccgaggucgccaaguucacccucgaggagcugugccugaucugcaacauccucagcaccgccgaguacugccuggccaccacgcagcagcuggaggagaagcucaaggagaagguggacgugucccugaucgagcggaucaaccugaccggcgagauggacaccuucagcaccgucaucuccagcuccauccagcuccuggugcaggaccuggacgccgcgugcgaccccgcccucacggccaugagcaagaugcaguggcagaacguggagcacgucggggaccagucccccuacgugaccagcgugauccugcacaucaagcagaacgucccgaucauccgcgacaaccuggccuccacccggaaguacuucacccaguucugcgugaaguucgccaacagcuucauccccaaguucaucacccaccucuucaagugcaagcccaucuccauggugggcgcggagcagcugcugcucgacacgcacagccugaagaugguccugcucgaccugccguccaucagcucccagguggugcgcaaggcccccgccagcuacaccaagaucgucgugaaggggaugacccgggccgagaugauccugaagguggucauggcgccccacgagccccucgugguguucgucgacaacuacaucaagcugcugaccgacugcaacacggagaccuuccagaagauccucgacaugaagggccugaagcgcuccgagcagagcagcaugcuggagcuccugcggcagcgccugccggccccgcccuccggcgccgagagcuccgggagccucucccugaccgcccccacccccgagcaggagagcucccggauccgcaagcuggagaagcucaucaagaagcggcuguga

SEQ ID NO: 38634 - RNA, 2898 nt, Artificial Sequence
  derived and/or modified sequence opt1 from VPS54__Homo_sapiens__NP_001005739
auggccagcucccacagcuccagccccgugccgcagggcuccagcuccgacgucuucuucaagaucgagguggaccccagcaagcacauccgccccgugcccucccugccggacgucugccccaaggagcccaccgugaccgaccagcaccgguggacgguguaccacagcaaggucaaccuccccgccgcgcugaacgacccgcgccuggccaagcgggaguccgacuucuucaccaagaccugggggcucgacuucguggacaccgaggugauccccagcuucuaccugccccagaucuccaaggagcacuucacggucuaccagcaggagaucagccagcgcgagaagauccacgagcggugcaagaacaucugcccgcccaaggacaccuucgagcgcacccugcuccacacccacgacaagucccggacggaccuggagcagguccccaagaucuucaugaagcccgacuucgcccuggacgacagccucaccuucaacuccgugcugcccuggagccacuucaacaccgccggcgggaagggcaaccgcgacgccgcguccagcaagcugcuccaggagaagcugagccacuaccuggacaucguggaggugaacaucgcccaccagaucucccuccggagcgaggccuucuuccacgccaugaccucccagcacgagcugcaggacuaccugcgcaagacgagccaggcggugaagaugcuccgggacaagaucgcccagaucgacaaggucaugugcgaggggucccugcacauccugcgccucgcccugacccggaacaacugcgugaagguguacaacaagcugaagcucauggccaccguccaccagacccagccgacgguccaggugcugcugagcaccuccgaguucgugggcgcccucgaccugaucgcgaccacccaggaggugcugcagcaggagcuccagggcauccacagcuuccgccaccuggggucccagcugugcgagcucgagaagcugaucgacaagaugaugaucgccgaguucagcacguacucccacagcgaccugaaccggccccucgaggacgacugccaggugcuggaggaggagcgccugaucucccucgucuucggccugcugaagcagcggaagcucaacuuccuggagaucuacggggagaagauggugaucaccgccaagaacaucaucaagcagugcgucaucaacaaggugagccagaccgaggagaucgacaccgacguggucgugaagcuggccgaccagaugcgcaugcucaacuucccccagugguucgaccugcugaaggacaucuucuccaaguucacgaucuuccuccagcgggugaaggccacccugaacaucauccacagcgucgugcuguccgugcuggacaagaaccagcgcacccgggagcucgaggagaucagccagcagaagaacgcggccaaggacaacucccuggacaccgaggucgccuaccugauccacgagggcauguucaucagcgacgccuucggggagggcgagcucacgcccaucgccguggacaccaccagccagcgcaacgcguccccgaacagcgagcccugcuccagcgacuccgugagcgagcccgagugcaccacggacuccagcuccagcaaggagcacaccuccagcuccgccauccccggcggggucgacaucauggugagcgaggacaugaagcugaccgacuccgagcugggcaagcucgccaacaacauccaggagcugcuguacagcgccuccgacaucugccacgaccgcgccgugaaguuccucaugagccgggcgaaggacggguuccuggagaagcugaacagcauggaguucaucacccucucccgccugauggagacguucauccuggacaccgagcagaucugcggccgcaagagcaccucccuccugggcgcccugcagagccaggccaucaaguucgucaaccgguuccacgaggagcggaagaccaagcucucccugcugcucgacaacgagcgcuggaagcaggccgacgugccggcggaguuccaggaccugguggacagccuguccgacgggaagaucgcccuccccgagaagaaguccggcgccaccgaggagcggaagcccgccgagguccugaucguggaggggcagcaguacgccguggucggcacggugcugcuccugauccgcaucauccuggaguacugccagugcguggacaacauccccagcgucaccaccgacaugcucacccggcugagcgaccugcucaaguacuucaacucccgcagcugccagcuggugcugggggcgggcgcccuccagguggucggccugaagacgaucaccaccaagaaccuggcccucuccagccggugccugcagcugaucgugcacuacaucccggugauccgcgcccacuucgaggcccggcucccgcccaagcaguacuccaugcugcgccacuucgaccacaucaccaaggacuaccacgaccacaucgcggagaucagcgccaagcuggucgccaucauggacucccucuucgacaagcugcugagcaaguacgaggugaaggcccccgugcccuccgccugcuuccggaacaucugcaagcagaugacgaagaugcacgaggcgaucuucgaccuccugcccgaggagcagacccagaugcuguuccuccgcaucaacgccagcuacaagcugcaccugaagaagcagcucagccaccugaacgucaucaacgacgggggcccccagaacgggcuggugaccgccgacguggccuucuacaccggcaaccuccaggcgcugaaggggcugaaggaccucgaccugaacauggccgagaucugggagcagaagcgguga

SEQ ID NO: 38635 - RNA, 1128 nt, Artificial Sequence
  derived and/or modified sequence opt1 from VPS72__Homo_sapiens__NP_001258016
augagccuggccggcgggcgcgcgccccggaagaccgccggcaaccgccucuccgggcugcuggaggccgaggaggaggacgaguucuaccagaccacguacggcggguucaccgaggagagcggcgacgacgaguaccagggcgaccaguccgacaccgaggacgagguggacagcgacuucgacaucgacgagggggacgagccguccagcgacggcgaggccgaggagccccggcgcaagcggcgcgucgugaccaaggccuacaaggagccccucaagucccugcggccccgcaaggugaacacgccggccgggagcucccagaaggcgcgggaggagaaggcccugcucccccuggagcugcaggacgacggcagcgacucccgcaagagcaugcggcaguccaccgccgagcacacccgccagaccuuccuccggguccaggagcgccaggggcagagccggcgccggaagggcccccacugcgagcgcccccugacgcaggaggagcugcuccgggaggccaagaucaccgaggagcugaaccugcgcucccucgagaccuacgagcggcuggaggcggacaagaagaagcagguccacaagaagcgcaagugcccgggccccaucaucaccuaccacagcgugacggugccccuggugggggagcccggcccgaaggaggagaacguggacaucgaggggucccucugcuucagccuguccuucguccugcgccucgaccccgcccccagcgugagcgcccugacgccccacgccggcaccggcccggugaacccgcccgcccggugcucccgcaccuucaucaccuucagcgacgacgcgaccuucgaggagugguucccccaggggcggccgcccaagguccccgugcgcgaggugugccccgucacccaccggcccgcccuguaccgcgaccccgugaccgacauccccuacgccacggcccgggccuucaagaucauccgcgaggcguacaagaaguacaucaccgcccacggccugcccccgaccgccuccgcccucgggcccgggcccccgccgcccgagccccugcccggcagcggcccccgggcccuccgccagaagaucgugaucaaguga

SEQ ID NO: 38636 - RNA, 4287 nt, Artificial Sequence
  derived and/or modified sequence opt1 from VPS8__Homo_sapiens__NP_001009921
auggagaacgagcccgaccacgagaacguggagcagagccugugcgccaagaccuccgaggaggagcucaacaagagcuucaaccuggaggccucccugagcaaguucuccuacaucgacauggacaaggagcucgaguucaagaacgaccugaucgacgacaaggaguucgacaucccccaggucgacaccccgcccacgcuggagagcauccucaacgagaccgacgacgaggacgaguccuucauccuggaggaccccacccugcucaacaucgacaccaucgacagccacuccuacgacacgagcuccguggcgagcuccgacagcggcgaccgcaccaaccugaagcggaagaagaagcugcccgacuccuucagccuccacggguccgugaugcgccacagccugcugaagggcaucuccgcccagaucgucagcgccgccgacaagguggacgccgggcuccccaccgcgaucgccgugagcucccugaucgccgucggcaccagccacgggcuggcccucaucuucggcaaggaccagaaccaggcgcugcggcugugccucggcuccacgagcgucgggggccaguacggggccaucuccgcccugagcaucaacaacgacugcucccgccugcucugcggcuucgccaaggggcagaucaccaugugggaccuggccagcggcaagcugcuccgguccaucaccgacgcgcacccgcccggcaccgccauccugcacaucaaguucacggacgaccccacccuggccaucugcaacgacagcgggggcuccguguucgagcucaccuucaagcgcgugaugggggugcggaccugcgagagccgcugccuguucuccggcagcaagggcgaggugugcugcaucgagccccugcacuccaagcccgagcucaaggaccaccccaucacgcaguucagccugcuggccauggccucccucaccaagauccuggucaucgggcugaagcccagccucaagguguggaugaccuuccccuacggccggauggaccccuccagcgugccccugcuggcguggcacuucgucgccgugcagaacuacgugaacccgaugcucgccuucugccgcggggacgucgugcacuuccugcuggugaagcgggacgagagcggcgccauccacgucaccaagcagaagcaccuccaccuguacuacgaccugaucaacuucacguggaucaacucccgcaccguggugcuccuggacagcgucgagaagcugcacgugaucgaccggcagacccaggaggagcuggagaccgucgagaucuccgaggugcagcucguguacaacagcucccacuucaagagccuggccaccgggggcaacgucucccaggcgcuggcccucgugggcgagaaggccugcuaccagagcaucuccagcuacgggggccagaucuucuaccuggggaccaaguccguguacgucaugaugcugcgcagcuggcgggagcgcguggaccaccuccugaagcaggacugccugaccgaggcccucgcccuggcgugguccuuccacgagggcaaggccaaggccguggucgggcugagcggcgacgccuccaagcggaaggcgaucguggccgaccgcaugguggagauccucuuccacuacgccgaccgggcccugaagaagugccccgaccagggcaagauccaggucauggagcagcacuuccaggacauggugcccgugaucgucgacuacugccugcuccugcagcgcaaggaccuccucuucagccagauguacgacaagcuguccgagaacagcguggccaaggggguguuccuggagugccucgagcccuacauccugagcgacaagcuggucggcaucacgccccaggugaugaaggaccucaucgugcacuuccaggacaagaagcugauggagaacgucgaggcgcugaucgugcacauggacaucacgucccucgacauccagcaggucgugcugaugugcugggagaaccggcuguacgacgccaugaucuacguguacaaccgcgggaugaacgaguucaucagcccgauggagaagcuguuccgcgugaucgccccgccccugaacgccggcaagacccugaccgacgagcaggucgugauggggaacaagcuccugguguacaucuccugcugccuggccggccgggcguacccccucggcgacauccccgaggaccuggucccccuggugaagaaccagguguucgaguuccucauccgccugcacagcgccgaggccucccccgaggaggagaucuacccguacauccggacccugcuccacuucgacacgcgcgaguuccugaacguccuggcccucaccuucgaggacuucaagaacgacaagcaggccguggaguaccagcagcggaucguggacauccugcugaaggucaugguggagaacagcgacuucacccccucccagguggggugccucuucaccuuccuggcgcgccagcuggccaagcccgacaacacccucuucgucaaccggacgcuguucgaccaggugcuggaguuccucugcagcccggacgacgacucccgccacagcgagcggcagcagguccugcuggagcuccugcaggccggcgggaucgugcaguucgaggagucccgccugauccggauggccgagaaggcggaguucuaccagaucugcgaguucauguacgagcgcgagcaccaguacgacaagaucaucgacugcuaccuccgggacccccugcgcgaggaggagguguucaacuacauccacaacauccugagcauccccggccacuccgccgaggagaagcagagcguguggcagaaggccauggaccacaucgaggagcucgucucccugaagcccugcaaggccgccgagcugguggcgacccacuucagcggccacaucgagaccgugaucaagaagcuccagaaccagguccugcuguucaaguuccuccggucccugcuggacccgcgcgaggggauccacgugaaccaggagcuccugcagaucagccccugcaucaccgagcaguucaucgagcugcucugccaguucaaccccacccaggugaucgagacgcugcagguccuggagugcuaccggcucgaggagaccauccagaucacccagaaguaccagcugcacgaggugacggccuaccugcucgagaagaagggcgacauccacggggccuuccugaucaugcuggagcgccuccaguccaagcugcaggaggucacccaccagggcgagaacaccaaggaggaccccagccugaaggacguggaggacaccaugguggagacgaucgcccucugccagcggaacagccacaaccugaaccagcagcagcgcgaggcccugugguucccgcuccuggaggcgaugauggcgccccagaagcuguccagcuccgccaucccccaccuccacagcgaggcccugaagucccugaccaugcagguccugaacagcauggccgccuucaucgcccuccccuccauccugcagcgcauccugcaggacccgguguacgggaagggcaagcucggcgagauccaggggcugauccugggcaugcucgacaccuucaacuacgagcagacccugcuggagacgaccaccagccuccugaaccaggaccugcacuggucccucugcaaccugcgggccagcgugacccgcgggcugaaccccaagcaggacuacugcuccaucugccuccagcaguacaagcggcgccaggagauggccgacgagaucaucgucuucagcugcggccaccuguaccacuccuucugccugcagaacaaggagugcacgguggaguucgaggggcagacccgguggaccugcuacaagugcagcuccagcaacaaggugggcaagcucuccgagaacagcuccgagaucaagaagggccgcaucacccccagccaggucaagaugagccccuccuaccaccagagcaagggggacccgacggcgaagaagggcaccuccgagcccgugcuggacccccagcagauccaggccuucgaccagcugugccggcucuaccgcgggagcucccggcuggcccugcucaccgagcugagccagaaccgcuccagcgaguccuaccggcccuucagcggcucccagagcgccccggccuucaacuccaucuuccagaacgagaacuuccagcugcagcucaucccgccgcccgugaccgaggacuga

SEQ ID NO: 38637 - RNA, 1191 nt, Artificial Sequence
  derived and/or modified sequence opt1 from VRK1__Homo_sapiens__NP_003375
augccccgcgugaaggccgcccaggcgggccggcagagcuccgccaagcgccaccuggccgagcaguucgccgucggggagaucaucaccgacauggccaagaaggaguggaaggugggccucccgaucgggcagggcggguucggcugcaucuaccuggcggacaugaacagcuccgagagcgugggcuccgacgcccccugcgucgugaagguggagcccagcgacaacgggccccuguucaccgagcucaaguucuaccagcgggccgccaagccggagcagauccagaaguggauccgcacgcggaagcugaaguaccugggcguccccaaguacuggggguccggccuccacgacaagaacggcaagagcuaccgcuucaugaucauggaccgguucggguccgaccugcagaagaucuacgaggcgaacgccaagcgcuucagccggaagaccgugcugcagcucucccugcgcauccuggacauccucgaguacauccacgagcacgaguacgugcacggcgacaucaaggccagcaaccugcugcucaacuacaagaaccccgaccaggucuaccugguggacuacgggcuggccuaccgguacugccccgagggcgugcacaaggaguacaaggaggacccgaagcgcugccacgacgggaccaucgaguucaccuccaucgacgcccacaacggcgucgcgcccagccggcgcggcgaccucgagauccugggguacugcaugauccaguggcugacgggccaccuccccugggaggacaaccugaaggaccccaaguacgugcgggacuccaagauccgcuaccgggagaacaucgccagccugauggacaagugcuucccggagaagaacaagcccggggagaucgccaaguacauggagaccgugaagcuccuggacuacaccgagaagccccuguacgagaaccuccgcgacauccugcugcagggccucaaggccaucggguccaaggacgacggcaagcuggaccugagcgucguggagaacggcgggcucaaggccaagaccaucacgaagaagcggaagaaggagaucgaggaguccaaggagcccggcguggaggacaccgaguggagcaacacccagaccgaggaggcgauccagacgcgcagccggacccgcaagcgcguccagaaguga

SEQ ID NO: 38638 - RNA, 1527 nt, Artificial Sequence
  derived and/or modified sequence opt1 from VRK2__Homo_sapiens__NP_001123953
augcccccgaagcgcaacgagaaguacaagcugcccauccccuuccccgagggcaaggugcucgacgacauggaggggaaccaguggguccugggcaagaagaucgggagcggcggguucggccugaucuaccucgccuucccgaccaacaagcccgagaaggacgcccggcacguggugaaggucgaguaccaggagaacggcccccuguucuccgagcugaaguucuaccagcgcguggcgaagaaggacugcaucaagaaguggaucgagcggaagcagcucgacuaccuggggaucccccuguucuacggcagcgggcucaccgaguucaagggccgcuccuaccgguucauggugauggagcgccuggggaucgaccugcagaagaucagcggccagaacggcacguucaagaaguccaccguccuccagcuggggauccggaugcuggacgugcucgaguacauccacgagaacgaguacgugcacggcgacaucaaggccgccaaccugcugcucggguacaagaacccggaccaggucuaccuggccgacuacggccugagcuaccgcuacugccccaacggcaaccacaagcaguaccaggagaacccccggaaggggcacaacggcaccaucgaguucaccucccucgacgcccacaaggggguggcgcugagccgccgguccgacguggagauccugggcuacugcaugcuccgcuggcugugcgggaagcugcccugggagcagaaccucaaggacccggucgccgugcagacggccaagaccaaccugcuggacgagcucccccagagcgugcugaagugggcccccuccggcagcuccugcugcgagaucgcgcaguuccuggucugcgcccacagccucgccuacgacgagaagcccaacuaccaggcccugaagaagauccugaacccgcacggcaucccccucgggccccuggacuucuccaccaagggccagagcaucaacgugcacacccccaacucccagaagguggacagccagaaggccgcgacgaagcaggucaacaaggcccacaaccggcugaucgagaagaaggugcacuccgagcgcagcgccgagagcugcgccaccuggaaggugcagaaggaggagaagcucaucgggcugaugaacaacgaggccgcgcaggaguccacccggcgccggcagaaguaccaggagagccaggagccgcugaacgaggucaacuccuucccccagaagaucagcuacacccaguuccccaacuccuucuacgagccccaccaggacuucacgagcccggacaucuucaagaagucccgcagccccuccugguacaaguacaccagcaccguguccaccggcaucacggaccucgagagcuccaccgggcuguggcccaccaucagccaguucacccuguccgaggagacgaacgccgacguguacuacuaccggaucaucauccccguccuccugaugcugguguuccucgcccuguucuuccuguga

SEQ ID NO: 38639 - RNA, 1623 nt, Artificial Sequence
  derived and/or modified sequence opt1 from VSIG10__Homo_sapiens__NP_061959
auggccgccggcgggagcgcgcccgagccgcgcgugcuggucugccucggcgcccugcuggccggguggguggccgugggccucgaggccgucgugaucggggaggugcacgagaacgucacccugcacugcggcaacaucuccggccugcggggccaggugaccugguaccgcaacaacagcgagcccguguuccuccuguccagcaacuccagccugcggcccgcggagccccgcuucucccucgucgacgccacgagccugcacaucgagucccugagccucggggacgaggggaucuacacgugccaggagauccugaacgugacccagugguuccagguguggcugcaggucgccuccggcccguaccagaucgaggugcacaucguggccaccgggacccuccccaacggcacccuguacgcggcccggggcagccaggucgacuucuccugcaacagcuccagccggcccccgcccgugguggaguggugguuccaggcccugaacuccagcuccgagagcuucgggcacaaccucaccgucaacuucuucagccugcugcucaucucccccaaccugcagggcaacuacacgugccuggcccucaaccagcugagcaagcgccaccgcaaggugaccaccgagcugcucguguacuacccgcccccguccgcgccccagugcugggcccagauggccagcggguccuucaugcugcagcugaccugccggugggacggcggcuaccccgaccccgacuuccucuggaucgaggagcccgggggcgucaucgugggcaagagcaagcuggggguggagaugcuguccgagagccagcucuccgacgggaagaaguucaagugcgucaccagccacaucgugggccccgaguccggcgccagcugcaugguccagauccgcgggcccucccugcugagcgagcccaugaagacgugcuucaccggcgggaacgugacccugaccugccagguguccggcgccuacccgcccgccaagauccucuggcugcggaaccucacgcagcccgaggucaucauccagcccagcucccgccaccugaucacccaggacgggcagaacagcacccugaccauccacaacugcucccaggaccucgacgagggcuacuacaucugccgggcggacagcccggugggcgugcgcgagauggagaucuggcugagcgucaaggagccccugaacaucgggggcaucguggggacgaucgugucccuccugcugcucggccuggccaucaucagcgggcugcugcuccacuacucccccgucuucugcuggaaggugggcaacaccagccggggccagaacauggacgacgugaugguccugguggacuccgaggaggaggaggaggaggaggaggaggaggaggaggacgccgccgugggggagcaggagggcgcccgcgagcgggaggagcugcccaaggagaucccgaagcaggaccacauccaccgcgucaccgcgcucgugaacgggaacaucgagcagaugggcaacggcuuccaggaccugcaggacgacagcuccgaggagcagagcgacaucgugcaggaggaggaccggcccgucuga

SEQ ID NO: 38640 - RNA, 1272 nt, Artificial Sequence
  derived and/or modified sequence opt1 from VSIG1__Homo_sapiens__NP_001164024
augguguucgccuucuggaaggucuuccugauccucagcugccuggccggccagguguccgugguccaggugaccauccccgacggguucgugaacgucaccgugggcagcaacgugacgcugaucugcaucuacaccaccaccgucgcgucccgcgagcagcucagcauccagugguccuucuuccacaagaaggagauggagccgaucagccacuccagcugccuguccacggaggggauggaggagaaggccgugagccagugccugaagaugacccacgcccgggacgcccgcggccggugcuccuggaccagcgagaucuacuucucccagggcgggcaggccguggcgaucggccaguucaaggaccgcaucaccgggagcaacgaccccggcaacgccuccaucacgaucagccacaugcagcccgccgacuccgggaucuacaucugcgacgucaacaacccgcccgacuuccucggccagaaccaggggauccugaacgugagcgugcuggucaagcccuccaagccccucugcagcgugcagggccggcccgagaccggccacaccaucagccuguccugccugagcgcccucgggaccccgucccccguguacuacuggcacaagcuggagggccgcgacaucguccccgugaaggagaacuucaaccccacgaccgggauccuggugaucggcaaccucaccaacuucgagcagggcuacuaccagugcaccgcgaucaaccggcuggggaacagcuccugcgagaucgaccugacgagcucccacccggaggucggcaucaucgugggggcccucaucggcagccuggugggggccgccaucaucaucuccgucgugugcuucgcccgcaacaaggcgaaggccaaggccaaggagcggaacagcaagaccaucgccgagcuggagcccaugaccaagaucaacccccgcggcgaguccgaggccaugccccgggaggacgcgacccagcucgaggucacgcugccgagcuccauccacgagaccggccccgacaccauccaggagcccgacuacgagcccaagccgacccaggagcccgcccccgagcccgccccggggagcgagcccauggccgugcccgaccuggacaucgagcucgagcuggagcccgagacgcaguccgagcuggagccggagcccgagcccgagccggagagcgagcccggcguggucguggagccccucuccgaggacgagaaggggguggucaaggccuga

SEQ ID NO: 38641 - RNA, 984 nt, Artificial Sequence
  derived and/or modified sequence opt1 from VSIG2__Homo_sapiens__NP_055127
auggccgagcugcccggcccguuccucugcggggcccugcugggcuuccucugccugagcgggcuggcgguggaggucaaggugcccaccgagccccucuccacgccccugggcaagaccgccgagcugaccugcaccuacagcaccuccgugggggacagcuucgcccucgagugguccuucguccagccgggcaagcccaucagcgagucccaccccauccuguacuucacgaacggccaccuguaccccaccgggagcaaguccaagcgcgugagccuccugcagaacccgcccaccgugggcgucgccacccugaagcucacggacgugcaccccuccgacaccgggaccuaccugugccaggugaacaacccgcccgacuucuacaccaacggccuggggcucaucaaccugacgguccuggugccgcccagcaacccccucugcucccagagcggccagaccuccgugggcgggagcaccgcccugcggugcuccagcuccgagggcgcgcccaagcccgucuacaacugggugcgccuggggaccuuccccacgcccagcccgggcagcauggugcaggacgaggucuccggccagcucauccugaccaaccugagccucaccuccagcgggaccuaccggugcguggccacgaaccagaugggcuccgccagcugcgagcugacccuguccgugaccgagcccagccaggggcgcgucgccggcgcgcucaucggggugcugcugggcgugcuccugcuguccgucgccgccuucugccucgugcgguuccagaaggagcgcggcaagaagcccaaggagaccuacgggggcagcgaccugcgggaggacgccaucgcccccgggaucuccgagcacacgugcaugcgcgcggacagcuccaagggcuuccuggagcggccgagcuccgccagcaccgugaccaccacgaaguccaagcuccccauggucguguga

SEQ ID NO: 38642 - RNA, 918 nt, Artificial Sequence
  derived and/or modified sequence opt1 from VSIG4__Homo_sapiens__NP_001093901
augggcauccugcucgggcugcugcuccugggccaccugaccguggacaccuacgggcgccccauccucgaggucccggagagcgugacgggccccuggaagggggacgugaaccugcccugcaccuacgacccccugcagggcuacacccagguccucgugaaguggcuggugcagcggggcuccgacccggucaccaucuuccugcgcgacagcuccggggaccacauccagcaggccaaguaccagggccggcuccacgugagccacaaggugcccggggacgucucccugcagcugagcacgcucgagauggacgaccgcucccacuacacgugcgaggugaccuggcagacccccgacggcaaccaggugguccgggacaagaucaccgagcugcgcgugcagaagcacagcuccaagcugcucaagaccaagaccgaggcccccaccacgaugaccuacccgcugaaggcgaccagcaccgugaagcaguccugggacuggacgaccgacauggacggguaccugggcgagaccagcgccggccccgggaagucccuccccgucuucgccaucauccugaucaucagccugugcugcauggugguguucaccauggccuacaucaugcucugccggaagacgucccagcaggagcacgucuacgaggccgcgcgcgcccacgcccgggaggccaacgacagcggcgagaccaugcgcguggcgaucuucgccuccgggugcagcuccgacgagcccaccagccagaaccugggcaacaacuacagcgacgagccgugcaucggccaggaguaccagaucaucgcccagaucaacgggaacuacgcccggcugcucgacaccgugccccuggacuacgaguuccuggccacggagggcaaguccgucugcuga

SEQ ID NO: 38643 - RNA, 576 nt, Artificial Sequence
  derived and/or modified sequence opt1 from VSNL1__Homo_sapiens__NP_003376
augggcaagcagaacagcaagcuggcccccgaggugauggaggaccucgucaaguccaccgaguucaacgagcacgagcugaagcagugguacaagggguuccugaaggacugcccgagcggccgccucaaccuggaggaguuccagcagcuguacgugaaguucuuccccuacggggacgccuccaaguucgcgcagcacgccuuccggaccuucgacaagaacggcgacgggacgaucgacuuccgcgaguucaucugcgcccucagcaucaccucccggggcagcuucgagcagaagcugaacugggccuucaacauguacgaccuggacggcgacgggaagaucacccgcguggagaugcucgagaucaucgaggccaucuacaagauggucggcaccgugaucaugaugaagaugaacgaggacgggcugacgcccgagcagcggguggacaagaucuucuccaagauggacaagaacaaggacgaccagaucacccuggacgaguucaaggaggcggccaagagcgaccccuccaucguccuccugcugcagugcgacauccagaaguga

SEQ ID NO: 38644 - RNA, 447 nt, Artificial Sequence
  derived and/or modified sequence opt1 from VSTM1__Homo_sapiens__NP_001275720
augcgcaagcggaugggccccacccgccugccccggcucgagugcagcggggccaucaccgcccacugcucccuggaccugcccggccccgacaagcacgacgagcucgaggcgcccagcaugaagacggacacccgcaccaucuucguggccaucuucuccugcaucagcauccugcuccuguuccuguccgucuucaucaucuaccggugcagccagcacuccagcuccagcgaggaguccaccaagcgcacgagccacuccaagcugccggagcaggaggccgccgaggccgaccucagcaacauggagcgggugucccugagcaccgcggacccccagggggugaccuacgccgagcuguccaccagcgcccucuccgaggccgcgagcgacacgacccaggagccgcccggcagccacgaguacgccgcccugaaggucuga

SEQ ID NO: 38645 - RNA, 711 nt, Artificial Sequence
  derived and/or modified sequence opt1 from VSX1__Homo_sapiens__NP_001243200
augaccggccgcgacagccuguccgacgggcggaccagcucccgcgcccucgugcccggcgggagcccgcggggcucccgcccccggggguucgccaucacggaccugcugggccucgaggcggagcugcccgcccccgccggcccggggcagggcagcgggugcgagggccccgccgucgcccccugccccgggccgggccuggacggcuccagccucgcgcgcggggcccugccccugggccucgggcugcugugcggcuucggcacccagccgcccgccgccgcgcgggcccccugccuccugcuggccgacgugcccuuccucccgccccgcgggcccgagcccgccgcgccccuggcccccucccggccgccgcccgcccugggccgccagaagcggagcgacuccgugagcaccuccgacgaggacagccaguccgaggaccgcaacgaccucaaggccagccccacccuggggaagcggaagaagcgccggcaccgcacggucuucaccgcccaccagcuggaggagcucgagaaggccuucuccgaggcgcacuaccccgacguguacgcccgggagaugcuggccgugaagaccgagcugcccgaggaccgcauccagugcaagcuccugcugcucgaggcccccguccacuggacccugcaggagacgcaccggcugccccgcccgcggggcggggccuga

SEQ ID NO: 38646 - RNA, 1086 nt, Artificial Sequence
  derived and/or modified sequence opt1 from VSX2__Homo_sapiens__NP_878314
augaccggcaaggccggggaggcccugagcaagcccaaguccgagaccguggccaagagcacguccggcggggcgccggcccgcugcaccggcuucgggauccaggagauccucggccugaacaaggagccgcccagcucccacccccgggccgcccuggacggccucgcgcccgggcaccuccuggccgcccgcagcguccugucccccgccggcgucgggggcauggggcugcugggccccggcgggcuccccggcuucuacacccagccgaccuuccuggaggugcugagcgacccccaguccgugcaccuccagccccuggggcgggcgagcggcccccuggacacgucccagaccgccagcuccgacagcgaggacguguccagcuccgaccgcaagaugagcaaguccgcccucaaccagaccaagaagcggaagaagcgccggcaccgcaccaucuucacgagcuaccagcuggaggagcuggagaaggccuucaacgaggcccacuacccggacguguacgcgcgggagaugcucgccaugaagaccgagcugcccgaggaccgcauccaggucugguuccagaaccggcgcgccaaguggcggaagcgcgagaagugcuggggccggagcuccgugauggccgaguacgggcuguacggcgccauggugcgccacagcaucccccuccccgaguccauccucaagagcgcgaaggacgggaucauggacuccugcgccccguggcugcugggcaugcacaagaagucccuggaggccgccgccgagagcgggcggaagcccgagggcgagcgccaggcgcugcccaagcucgacaagauggagcaggacgagcggggccccgacgcccaggccgccaucagccaggaggagcugcgcgagaacuccaucgccguccugcgggcgaaggcccaggagcacagcaccaaggugcucgggaccguguccggcccggacagccuggcccgcuccacggagaagcccgaggaggaggaggccauggacgaggaccgccccgcggagcggcugagcccgccccagcucgaggacauggccuga

SEQ ID NO: 38647 - RNA, 843 nt, Artificial Sequence
  derived and/or modified sequence opt1 from VTA1__Homo_sapiens__NP_001273300
auggccgcccuggcgccccucccgccccugcccgcccaguucaagagcauccagcaccaccuccgcaccgcccaggagcacgacaagcgggaccccguggucgccuacuacugccgccuguacgccaugcagaccggcaugaagaucgacuccaagacgccggagugccggaaguuccugagcaagcugauggaccagcucgaggcgcugaagaagcagcugggggacaacgaggccaucacccaggagaucgugggcugcgcccaccucgagaacuacgcccugaagauguuccuguacgcggacaacgaggaccgcgccgggcgguuccacaagaacaugaucaaguccuucuacaccgccagccuccugaucgacgugaucaccgucuucggcgagcugacggacgagaacgugaagcaccgcaaguacgcccgguggaaggccaccuacauccacaacugccucaagaacggggagacgccccaggcgggccccgugggcaucgaggaggacaacgacaucgaggagaacgaggacgccggggccgccucccugcccacccagccgacccagcccagcuccagcuccaccuacgaccccagcaacaugcccuccggcaacuacaccgggauccagaucccgcccggcgcccacgcgcccgccaacacccccgccgaggucccgcacagcacgggggacgugcgccugacccccgaggacuucgcccgggcccagaaguacugcaaguacgcgggcuccgcccuccaguacgaggacgugagcaccgccguccagaaccugcagaaggcccugaagcuccugaccacgggccgcgaguga

SEQ ID NO: 38648 - RNA, 900 nt, Artificial Sequence
  derived and/or modified sequence opt1 from VTCN1__Homo_sapiens__XP_011540445
augggcagcgugaugcugcucaaggaguccugcgggaacgucuucuucagcgccgugcgcauccggcgcucccggaagcacagcaucaucuccaucaucaucauccuggccggcgcgaucgcccugaucaucggguucggcaucagcgggcgccacuccaucaccgugaccacggucgccagcgccggcaacaucggcgaggacgggauccucuccugcaccuucgagcccgacaucaagcugagcgacaucgugauccaguggcugaaggagggcgugcucgggcugguccacgaguucaaggagggcaaggacgagcuguccgagcaggacgagauguuccgggggcgcaccgccguguucgcggaccaggugaucgucggcaacgccagccuccggcugaagaacgugcagcugaccgacgccggcacguacaagugcuacaucaucaccuccaaggggaagggcaacgccaaccucgaguacaagaccggggcguucagcaugccggaggugaacgucgacuacaacgccuccagcgagacccugcgcugcgaggcgccccggugguucccccagcccacgguggugugggccucccaggucgaccagggcgccaacuucagcgagguguccaacaccagcuucgagcugaacagcgagaacgugaccaugaaggucguguccgugcucuacaacgucaccaucaacaacacguacagcugcaugaucgagaacgacaucgccaaggccaccggcgacaucaaggugaccgaguccgagaucaagcgccggagccaccuccagcugcugaacuccaaggccagccugugcguguccagcuucuucgccaucuccugggcccugcucccgcugagccccuaccugaugcucaaguga

SEQ ID NO: 38649 - RNA, 654 nt, Artificial Sequence
  derived and/or modified sequence opt1 from VTI1A__Homo_sapiens__NP_660207
augagcuccgacuucgagggcuacgagcaggacuucgccgugcugaccgccgagaucaccagcaagaucgcgcgcgucccccggcucccgcccgacgagaagaagcagaugguggccaacguggagaagcagcuggaggaggccaaggagcugcucgagcagauggaccuggagguccgcgagauccccccccagucccgggggauguacagcaaccgcaugcgguccuacaagcaggagaugggcaagcuggagacggacuucaagcgcagccggaucgccuacuccgacgaggugcgcaacgagcuccugggggacgacggcaacagcuccgagaaccagcgggcccaccugcucgacaacaccgagcgccuggagcggagcucccgccggcuggaggcgggguaccagaucgccguggagaccgagcagaucggccaggagaugcucgagaaccugagccacgaccgcgagaagauccagcgggcccgcgagcggcugcgcgagaccgacgccaaccucggcaaguccagccggauccugacggggaugcugcgccggaucauccagaaccgcauccuccuggucauccugggcaucaucguggugaucaccauccucauggcgaucaccuucuccguccgccggcacuga

SEQ ID NO: 38650 - RNA, 699 nt, Artificial Sequence
  derived and/or modified sequence opt1 from VTI1B__Homo_sapiens__NP_006361
auggccagcuccgccgcgagcuccgagcacuucgagaagcugcacgagaucuuccgcggccuccacgaggaccugcagggggugcccgagcggcugcucggcaccgccgggaccgaggagaagaagaagcugauccgcgacuucgacgagaagcagcaggaggccaacgagacgcuggccgagauggaggaggagcuccgguacgccccgcugagcuuccgcaaccccaugauguccaagcugcggaacuaccgcaaggaccucgcgaagcugcaccgggagguccgcagcacgccccugaccgccacccccggcgggcggggcgacaugaaguacggcaucuacgccguggagaacgagcacaugaaccgccuccagucccagcgggccaugcugcugcaggggacggagagccucaaccgcgcgacccaguccaucgagcggagccaccgcaucgccaccgagaccgaccagaucggcuccgagaucaucgaggagcugggggagcagcgggaccagcuggagcgcaccaagagccggcucgugaacaccuccgagaaccugagcaagucccgcaagauccugcggagcaugucccgcaaggucaccaccaacaagcuccugcugagcaucaucauccuccuggagcuggccauccucggcgggcugguguacuacaaguucuuccggucccacuga

SEQ ID NO: 38651 - RNA, 1437 nt, Artificial Sequence
  derived and/or modified sequence opt1 from VTN__Homo_sapiens__NP_000629
auggcgccccugcgcccgcuccugauccuggcccuccuggccuggguggcccuggccgaccaggagagcugcaagggccggugcaccgagggguucaacgucgacaagaagugccagugcgacgagcucugcuccuacuaccagagcugcugcaccgacuacacggccgagugcaagccccaggugacccgcggcgacguguucaccaugcccgaggacgaguacaccgucuacgacgacggggaggagaagaacaacgccacggugcacgagcaggucggcgggcccucccugaccagcgaccugcaggcgcaguccaagggcaacccggagcagacccccgugcucaagcccgaggaggaggcccccgccccggaggugggcgccagcaagcccgaggggaucgacucccggcccgagacccugcaccccggccgcccgcagccgcccgcggaggaggagcugugcagcgggaagcccuucgacgccuucacggaccucaagaacggcucccuguucgccuuccgggggcaguacugcuacgagcuggacgagaaggccgugcgccccggcuaccccaagcucauccgggacgucuggggcaucgaggggcccaucgacgccgcguucacccgcaucaacugccagggcaagaccuaccuguucaaggggagccaguacuggcgguucgaggacggcgugcuggaccccgacuacccgcgcaacaucuccgacggcuucgacgggauccccgacaacguggacgccgcccucgcccugcccgcccacagcuacuccggccgggagcgcgucuacuucuucaaggggaagcaguacugggaguaccaguuccagcaccagcccagccaggaggagugcgagggcuccagccuguccgcgguguucgagcacuucgccaugaugcagcgggacagcugggaggacaucuucgagcuccuguucugggggcgcaccuccgccggcacgcggcagccgcaguucaucagccgcgacuggcacggcgugcccgggcaggucgacgccgccauggcgggccggaucuacaucagcgggauggccccgcgccccucccuggccaagaagcagcgguuccgccaccggaaccgcaagggcuaccgcagccagcgggggcacucccgcggccggaaccagaacagccgccggcccucccgcgccaccuggcucagccuguucuccagcgaggaguccaaccugggcgccaacaacuacgacgacuaccggauggacuggcucgugcccgcgaccugcgagcccauccagagcguguucuucuucuccggggacaaguacuaccgcgucaaccugcggacccgccggguggacacgguggacccgcccuacccccgcagcaucgcccaguacuggcugggcugccccgccccggggcaccucuga

SEQ ID NO: 38652 - RNA, 2268 nt, Artificial Sequence
  derived and/or modified sequence opt1 from VWA2__Homo_sapiens__NP_001258975
augcccccguuccugcuccuggaggccgugugcgucuuccuguucagccgcgugccgcccucccucccccugcaggaggugcacgucagcaaggagaccaucggcaagaucuccgccgcgagcaagaugauguggugcuccgccgccguggacaucauguuccugcucgacgggagcaacuccgugggcaaggggagcuucgagcgguccaagcacuucgccaucaccgucugcgacggccuggacaucagccccgagcgcgugcgggugggggccuuccaguucuccagcacgccccaccuggaguucccccucgacuccuucagcacccagcaggaggucaaggcgcgcaucaagcggaugguguucaagggcggccgcaccgagaccgagcuggcccugaaguaccuccugcaccgggggcugcccggcgggcgcaacgccuccgugccgcagauccucaucaucgucacggacggcaagagccagggggacguggcccugcccuccaagcagcugaaggagcggggcgugaccgucuucgcggugggcgugcgcuucccccggugggaggagcuccacgcccuggccagcgagccccgcgggcagcacguccugcucgccgagcaggucgaggacgccaccaacggccuguucuccacccugagcagcuccgcgaucugcagcuccgccacgccggacugccggguggaggcccaccccugcgagcaccgcacccucgagauggugcgggaguucgccgggaacgcccccugcuggcgcggcagccggcgcacccuggcggugcuggccgcccacugccccuucuacuccuggaagcggguguuccucacccacccggccacgugcuaccgcacgaccugccccggccccugcgacagccagcccugccagaacgggggcacgugcgucccggaggggcuggacggcuaccagugccugugcccccucgccuucgggggcgaggcgaacugcgcccugaagcugucccucgagugccggguggaccugcuguuccuccuggacagcuccgccggcaccacccuggacggguuccuccgcgccaaggucuucgugaagcgcuucgugcgggccguccugagcgaggacucccgcgcgcgggugggcguggccaccuacagccgcgagcugcucgucgccgugcccgugggggaguaccaggacguccccgaccugguguggucccuggacggcaucccguuccgcgggggccccacccucaccggcagcgcccugcggcaggcggccgagcggggguucggcuccgccacccgcaccgggcaggaccggccccgccggguggucgugcugcucaccgagagccacuccgaggacgagguggccggccccgcccgccacgcgcgggcccgcgagcugcugcugcucggggucggcagcgaggccgugcgggccgagcuggaggagaucacgggcuccccgaagcacgugauggucuacagcgacccccaggaccuguucaaccagauccccgagcuccaggggaagcugugcagccgccagcggccgggcugccgcacccaggcccuggaccucguguucaugcuggacaccuccgcgagcguggggcccgagaacuucgcccagaugcaguccuucguccggagcugcgcccugcaguucgaggugaaccccgacgugacccaggucggccucgugguguacggcucccagguccagacggccuucgggcuggacaccaagcccacccgcgccgcgaugcugcgcgccaucagccaggccccguaccucggcggggugggcuccgccgggaccgcgcugcugcacaucuacgacaaggugaugacgguccagcggggcgcccgccccggcgugcccaaggccguggucgugcucaccgggggccgcggggccgaggacgccgcggugcccgcccagaagcugcggaacaacggcaucagcguccugguggugggggucggcccggugcucuccgagggccugcggcgccuggccgggccccgggacagccucauccacguggccgccuacgcggaccugcgcuaccaccaggacguccugaucgaguggcucugcggcgaggccaagcagcccgugaaccugugcaagcccuccccgugcaugaacgaggggagcugcgugcugcagaacggcuccuaccggugcaagugccgcgacgggugggagggcccccacugcgagaaccgguuccuccgccggcccuga

SEQ ID NO: 38653 - RNA, 3555 nt, Artificial Sequence
  derived and/or modified sequence opt1 from VWA3A__Homo_sapiens__NP_775886
augaagaaguaccgcaagaucagcaucggcugcuucgccauggccacccagaccucccacguguuccacgggcaggagaacauguuccuggagaaccacugcauccggcgcaacacgggccgggacagcaagaagccccucaagcagaagaacaugaacgggcugggccagaacuccgacaacgggcugcucgucacccacgugaaccagacccaggaccugcugcgccuccagggcagcgagacccaguccagcgacugggaggacuccgaggacuggcugagcgcgcacucccugaagugccagaagcucacgcuggccgaccugaucagccagggcaccgaggugcucgaggaggggaccaacgucgugcagaagaucugcuucuccacccagaucauccggcacuucgagagcaagcuguccgacacgaucgagguguaccaggagcgcauccaguggcugaccgagaacagcaagaaggccuucggccucaucaagggggcccgggucuccauccugaucgacgugagcgccaucuccagcggcccgcagaaggaggaguuccagaaggaccugaugucccucaucgacgagcagcugagccacaaggagaagcuguucgugcucagcuucgggaccaacgcgggcucccuguggcccgaccccauggaggucagcgccuccacccugcaggagcucaagcugugggugaagacgcugcagcccgacggcgggagcaaccuccugcaggcccugaagaagaucuucacccucaagggccuggacucccugguggccaucaugcgcagcugcccggaccagcccuccgagauccucagcgacuacauccagcaguccaccauggggcgggaccugaucauccacuucaucaccuaccgcugcgacgaccagaugccgcccgcgguccugaagaaccucgccgaggccgugcggggcuacuaccacugcuacagccccaagauggagcacuacacgucccgcgacauggacgagcugcuggccgagauccagaaggcccagagccuccugucccacgugcaggcgcugcagcacagcucccccugcgaggcccugaccugcaccauggaggagaucagcaccgagaucacgaacggcccccugaucucccugcuccccaagccgcccaagcacgacgcgccccugaccaucgaguuccccaaccuggacaagaccagcgccgaguggcucaaggucaacgggcugaaggccaagaagcugucccuguaccaggugcucgccccgaacgccuucagccccguggaggaguucguccccauccugcagaagaccgugagcuccacgauccacgagaaggccaugauccaguucgaguggcacgacggcaccgugaagaacauccacgucgacccgcccuuccuguacaaguaccagcagcagcucagccgggccaugcgcauguacgagcggcgcaucgaguggcugucccuggccagccggcgcaucugggggaccgugugcgagaagcggguggucgugcuccuggacaucuccgcgaccaacagcauguacaucauccacauccagcacucccugcgccuccugcuggaggagcagcucagcaacaaggacugcuucaaccugaucgccuucggcuccacgaucgagagcuggcggcccgagaugguccccgugucccacaacaaccugcagagcgccuggcgcugggcccucaaccugcgcugccgggggucccgcaacgugcugagcgcccuccggaaggcggucgagguggacuucaaggacaaggacaagcaccagucccagggcaucuaccuguucaccggcgggauccccgaccaggacaugccgacccugagcgccuacauggccgaggccugcggcgggugcgaccuccagcugaacgugugccuguucuacgucggcgagcccaagauggacaccacgccgcccgcgcgcuacgccucccacaccgacaccgccgccgccuacaaggaggugacccgggcggccgggggccgcuuccacugguucggcgacacggggaucuacgagagcgacgacaucaacagcaucauguccgagauggagaaggcccucaacuacagccagaagugcgccuuccugauggccucccugaagaaccacagcggcaaggugcucggguccagcgcgcugcccaaggagaagcccaagacccugcagcuccggucccagcccaagaagcugugcccgccccgccccaccgucccccugggcgcccggaugagcaucaaggacgacccggaccgcgagaaguccccgccccucaagagccugaaguggcggccccuguccagccgcguggggaucucccccgccgccgcccagcccaccaaggagggcaugauggagcuccggcgcaagaccaagagccgggaggcggagacgucccugcuccucuucuacaccgagaagggcaacgacguggggagcgucuacaagaaguacccccagggccgcgggcugcggcgcaccuccagcuccaucgaccugccccggaaggacaccgugugcagcagccaggaguggguggccaaguacggccucaagaagcugaagcuggagaucucccgcugcaugggcccgaacugcacgcaccagaaguccgggcagcgcagcgccagcgccaagcacugcuccaucuuccccagcgucgagauccacggcguggugcggcacauccaguggacgccccgcgagauggaggucuacauccggcaccucgagaaggugcugcgccgguacgugcagcgccugcaguggcuccuguccgggagccggcgccuguucggcaccguccucgaguccaaggugugcauccugcuggacaccagcggguccaugggccccuaccuccagcaggucaagaccgagcuggugcugcucaucugggagcagcugcggaagugcugcgacagcuucaaccugcucuccuucgcggagagcuuccaguccuggcaggacacccugguggagaccaccgacgccgccugccacgaggccaugcagugggugacgcaccuccaggcccagggcagcaccuccauccugcaggcgcugcugaaggccuucagcuuccacgaccucgaggggcuguaccugcucaccgacggcaagccggacaccuccugcagccugguccugaacgaggugcagaagcuccgcgagaagcgggacgugaagguccacacgaucagccugaacugcuccgaccgcgccgccguggaguuccugcggaagcucgccagcuucaccgggggccgcuaccacugccccgugggggaggacacccuguccaagauccacagccugcucaccaagggcuucaucaacgagaaggaccccacgcugcccccguucgagggcgacgaccugcggauccucgcgcaggagaucaccaaggcccgcuccuuccuguggcaggcccagagcuuccggucccagcugcagaagaagaacgacgccgagcccaaggucacccucagcuga

SEQ ID NO: 38654 - RNA, 3885 nt, Artificial Sequence
  derived and/or modified sequence opt1 from VWA3B__Homo_sapiens__NP_659429
auggagaaguccggccccagcagcaccaucuccgagcagcagcugcagcgccaggagggguggaucaacaccaagacggaccucgccgagcagagccugaucuccagcgagaaguggcugcagcuccacggccugaaguccaacaagcugacccucaagcagauccugagccagaucggguucccgcacugcgaggacuacguggccucccugggccggcccgucgcgagccgcuacgccgacggccucuucccccagcuguaccgggccgaggacgggcgcguguacaaccugaccgccaaguccgagcucaucuaccaguucguggagcaccugacccaggccgucgagagcuacaagcagcggauggacuggcugacguccaagagccgccagaucuucggcgugauccucgagcagugcgugaccaucguccuggacuucgggggcauccuggagggggagcucgaccugugccgggaggcgcugaccauggugcuccaggagcaggucgcccacaucaccgaguucaacaucauccgcgugucccaggagcccgugaaguggcaggagaacgccacgccggugaccgagcagagcaucgccaccgcgaucuccugggucgagaagcugaccguggagcugacggugagcgaggccggccggcucgacgcccugcuggaggccgggcgcgacaagaccaucgaguccaucuacuacuucgucgugggcgacgugcccgaggagagcaaggagcuccugcugcagcgggcccucgagauccccugccccgucuacaccgugagcuucaacgcgcgcggcgaggggaccaucgccuuccugaaggaccuguccgccaagacgcacagccgguuccacgccuucgccgagcgcaccgagugcguggaguucccggcguucuccaccaaggacggcgacaacgucaugaccuggaacagccggaagcucaaggggaagcugccgcccggcgccggcgugcgcgaggacguguuccuggucuggcaggagauggaggaggccugcuccacgcucgcccagauccagcggcugguggccgagccgcccaagcccgacgucgcgaccguggacugcgagagcgagaccaccuccguggagaucgccagcaaccccgaggacacgugggacuccaagaccuggcugcagaaguacgggcucaaggcccagaagcugagccuguacgacguccucgccgacugcuccuuccgccacgccgacggcgugguggacaucaaggcgaagcccgagaacgagagcguccagaccuccgccgagaccaacaagaagacggugcacgccaaguacugcagccgguucgugcacgcccccuggaaggacgggucccugguccacgugaacaucaccaaggagaagugcaagugguacagcgagcgcauccacaccgcgcuggcccggauccgccgccggaucaaguggcuccaggacggcucccagagccuguucgggcgccugcacaacgacugcaucuacauccucaucgacaccucccacagcaugaaguccaagcuggaccuggugaaggacaagaucauccaguucauccaggagcagcugaaguacaagagcaaguucaacuucgucaaguucgacggccaggccguggccuggcgggagcagcucgccgaggugaacgaggacaaccuggagcaggcgcagagcuggauccgcgacaucaagaucggcuccagcacgaacacccuguccgcccucaagaccgccuucgccgacaaggagacccaggccaucuaccugcugacggacgggcggcccgaccagccgcccgagaccgucaucgaccaggugaagcgcuuccaggagauccccaucuacaccaucagcuucaacuacaacgacgagaucgcgaaccgguuccucaaggagguggccgcccugaccggcggggaguuccacuucuacaacuucggcugcaaggaccccaccccgcccgaggccguccagaacgaggaccugacgcuccuggugaaggagauggagcaggggcacuccgaccuggagaagaugcaggaccucuacagcgagucccugaucauggacuggugguacaacgccgagaaggacggcgacagcaagcaccagaaggagaucugcuccaugaucagcacccccgagaagugcgcgaagccccaguccgacguggacagcacccagaccuccagccugaacaugcucaagggccccugggggcuguccgaccagaagguccagaagaagaaggugcugcacgccgagagcacgaagaccagccuccugcgcucccagaugagcucccugcggagcuccgccugcagcgagcgcaaggacggccucuccaacgccagcucccggcgcaccgcgcugagcgacaaggagauguccauccugcucgccgaggaguggcuggacgacaagagcuccgagaaggugacccgggaggggagccaggucuacgaccacgacuccagcgacguguccagcgagaacuggcugaagacguacggccucguggccaagaagcugacccugauggacgcccucuccgucgccgcggugccccacagcagcaccuacgugccgguccuggacaagcacgugguguccaaggucuucgacgagguguucccccuggcccacgugugcaacgacaccaacaagaugacgcucaucaacccccagggggccaagcugaacaucuacaagcgcaaggucgagcaggccauccagagcuacgagaagcggcugaacaagaucguguggcgcgcccucucccaggaggagaaggagaagcuggacgcgaacaagccgauccaguaccuggagaacaagaccgugcucaaccaggcccuggagcggcugaacuggcccaucagccucaaggagcuguccaugcuggagagcgagauccucgccggcaagauguacauccagcaggccauggagcugcaggaggccgcgaagaagaacuacgccaacaaggcccccggcgagcagcagaagcugcaggggaaccccaccaagaagaccaaguccaagcgcccggacccccucaagggccagaaggucaucgcccggugcgacgagaacggguucuacuuccccggcguggugaagaagugcgucagccgcacgcaggcgcuggugggcuucuccuacggggacaccaagguggucagcaccuccuucaucacccccgugggcggggccaugccgugcccccugcuccaggugggcgacuacgucuucgccaagaucgugauccccaagggguucgacuucuacgugcccgccaucgucaucgcccugccgaacaagcacguggcgacggagaaguucuacaccguccugaagugcaacaaccgccgggaguucugcccccgcagcgcccucaucaagaucucccagaacaaguacgcccugagcugcucccacaucaagagcccgcccauccccgaggaccccgagguggaggacguggaggcccggaacuccgccuuccuguucuggccccucaaggaggcggacacccaggacagccgcgagccccggcgcgagaagccgcggcgcaagaagcggcccgccaagcagccccugcagcaggccgcccccuccgacagcgacggcagcucccacggcaucagcucccacgggagcugccagggcacccacccggagccccgcacggcccaccuccacuuccccgcggccgggcggcugggccuguccagccacgccaucaucgccaccccgccgccccgcgccgcgcugcccugcacccuccaggccacccacuccagcaaggggcugcgguccguccccgagacgcuguga

SEQ ID NO: 38655 - RNA, 2361 nt, Artificial Sequence
  derived and/or modified sequence opt1 from VWA5A__Homo_sapiens__NP_055437
auggugcacuucugcggccugcucacccugcaccgcgagcccgucccgcucaagagcaucuccgugagcgugaacaucuacgaguucgucgccgggguguccgccacccucaacuacgagaacgaggagaaggugccccuggaggcguucuucgucuuccccauggacgaggacagcgccguguacuccuucgaggcccugguggacggcaagaagaucgucgccgagcuccaggacaagaugaaggcccggacgaacuacgagaaggcgaucagccaggggcaccaggccuuccugcuggagggcgacuccagcucccgcgacguguucagcugcaacguggggaaccuccagcccggcuccaaggccgccgucacccugaaguacgugcaggagcugccgcucgaggcggacggcgcccugcgguucgugcugcccgccguccucaacccccgcuaccaguucagcggguccagcaaggacuccugccugaacgugaagacccccaucgugccggucgaggaccugcccuacacccucagcaugguggccacgaucgacucccagcacggcaucgagaaggugcagagcaacugcccccugucccccaccgaguaccugggggaggacaagaccagcgcccaggucagccucgcggccggccacaaguucgaccgggacguggagcugcugaucuacuacaacgaggugcacaccccguccgucgugcucgagauggggaugcccaacaugaagcccggccaccugaugggcgaccccagcgccauggucuccuucuacccgaacauccccgaggaccagcccagcaacacgugcggggaguucaucuuccugauggaccgcuccggcagcaugcagucccccaugagcucccaggacaccagccagcuccggauccaggccgccaaggagacccugauccugcuccugaagucccugccgaucgggugcuacuucaacaucuacggcuucggcagcuccuacgaggcgugcuuccccgagagcgugaaguacacccagcagacgauggaggaggcccucgggcgcgugaagcugaugcaggccgaccugggcgggaccgagauccucgcgccccugcagaacaucuaccggggccccuccaucccggggcacccccugcagcuguucgucuucaccgacggcgaggugaccgacacguucagcgugaucaaggagguccgcaucaaccggcagaagcaccgcugcuucuccuucggcaucggggagggcaccagcaccucccugaucaaggggaucgcccgggccagcggcgggaccagcgaguucaucacgggcaaggaccgcaugcaguccaaggcccugcggacccucaagcgcagccugcagcccgugguggaggacgucucccugagcuggcaccucccgcccggccuguccgccaagaugcugagccccgagcagaccgugaucuuccgggggcagcgccucaucuccuacgcccagcugaccggccggaugcccgccgcggagacgaccggggaggugugccugaaguacacccugcagggcaagaccuucgaggacaaggucacguucccgcuccagcccaagcccgacgugaaccugaccauccaccgccuggccgccaagagccuccugcagaccaaggacauggggcugcgggagacccccgccuccgacaagaaggacgcgcucaaccugagccuggaguccggcgugaucagcuccuucacggccuucaucgccaucaacaaggagcucaacaagccgguccagggcccccuggcccaccgcgacgugccccgccccauccugcucggggccagcgcgccgcugaagaucaagugccaguccggcuuccggaaggcccugcacagcgaccgcccgcccuccgccagccagccccgcggggagcucaugugcuacaaggccaagaccuuccagauggacgacuacagccugugcggccugaucucccacaaggaccagcacagccccggcuucggggagaaccaccucgugcagcugaucuaccaccagaacgccaacggcuccugggaccugaacgaggaccucgcgaagauccuggggaugagccuggaggagaucauggccgcccagcccgccgagcucgucgacuccagcggcugggccaccauccuggcggugaucuggcugcacuccaacgggaaggaccucaagugcgagugggagcugcuggagcggaaggccguggccuggaugcgggcccacgcgggcagcaccaugcccuccgucgugaaggccgccaucacguuccucaagagcuccguggaccccgccaucuucgccuucuga

SEQ ID NO: 38656 - RNA, 3648 nt, Artificial Sequence
  derived and/or modified sequence opt1 from VWA5B1__Homo_sapiens__XP_011538989
augcccggccugcucaacuggaucaccggggccgcccugccgcugaccgcgagcgacgugacguccugcgucagcggcuacgcccucgggcugaccgccucccugaccuacggcaaccucgaggcccagcccuuccaggggcuguucguguacccccuggacgagugcaccacggugaucggcuucgaggccgucaucgcggaccgcguggugaccguccagaucaaggacaaggccaagcucgagagcggccacuucgacgccucccacgugcggagccccaccgugaccgggaacauccugcaggacggcgucuccaucgccccgcacagcugcacgcccgggaaggugacccuggacgaggaccucgagcgcauccuguucguggcgaaccugggcaccaucgcccccauggagaacgucaccaucuucaucuccacgagcuccgagcuccccacccugccgagcggggccgugcgggugcugcuccccgccgucugcgcccccaccgugccccaguucugcaccaaguccacgggcaccagcaaccagcaggcgcagggcaaggaccgccacugcuucggggccugggccccgggcuccuggaacaagcugugccuggccacccuccugaacaccgaggugagcaaccccauggaguacgaguucaacuuccagcuggagauccgggggcccugccuccuggccggcgucgagucccccacgcacgagauccgcgcggacgccgccccgagcgcccgguccgccaagagcaucaucaucacccuggcgaacaagcacaccuucgaccgccccguggagauccucauccaccccagcgagccccacaugccgcacgugcugaucgagaagggcgacaugacccugggggaguucgaccagcaccucaagggccggacggacuucaucaaggggaugaagaagaagucccgcgccgagcggaagaccgagaucauccgcaagcggcugcacaaggacaucccccaccacagcgucaucaugcugaacuucugccccgaccuccaguccgugcagcccugccugcgcaaggcccacggcgaguucaucuuccugaucgaccggagcuccagcauguccgggaucagcaugcaccgcgugaaggacgccaugcucgucgcccugaagucccugaugccggcgugccucuucaacaucaucggcuucggcagcaccuucaagucccuguuccccagcucccagaccuacagcgaggacucccuggccauggccugcgacgacauccagcggaugaaggccgacaugggcgggacgaacauccucagcccccugaagugggugauccgccagcccguccaccgggggcacccgcgccuccucuucgugaucaccgacggcgcggugaacaacaccgggaagguccuggagcuggugcggaaccacgccuucuccacccgcugcuacagcuucggcaucggccccaacgugugccaccgccucgucaaggggcuggccuccgugagcgagggcagcgccgagcugcugauggagggggagcggcuccagcccaagauggugaagucccugaagaaggccauggcgccgguccugagcgacgugacgguggaguggaucuuccccgagaccaccgagguccucgugucccccgugagcgccuccagccuguuccccggcgagcgccuggucggguacggcaucgugugcgacgccucccuccacaucagcaacccgcgguccgacaagcgccggcgcuacagcaugcugcacucccaggagagcggcuccagcguguucuaccacucccaggacgacgggcccggccuggagggcggggacugcgccaagaacagcggcgcccccuucauccucgggcaggcgaagaacgcccggcuggccuccggcgacagcaccacgaagcacgaccugaaccucagccagcgccggcgcgccuacuccaccaaccagaucaccaaccacaagccccugccgcgggccaccauggcgagcgaccccaugcccgccgccaagcgcuacccccugcggaaggcccgccuccaggaccugaccaaccagacgucccuggacguccagcgguggcagaucgaccuccagccgcugcugaacagcgggcaggaccucaaccagggccccaagcugcgcgggcccggcgcgcggcgccccucccugcucccgcagggcugccagcccuuccugcccugggggcaggagacccaggccuggagccccgugcgggagcgcaccuccgacagccgcuccccgggcgaccuggagcccagccaccaccccuccgccuucgagaccgagacgagcuccgacugggacccgcccgccgagagccaggagcgggccucccccagccgccccgcgaccccggcccccgugcucgggaaggcccuggucaagggccugcacgacucccagcggcuccagugggaggugagcuucgagcuggggacccccggccccgagcgcggcggggcccaggacgccgaccugugguccgagaccuuccaccaccucgcggcccgggccaucauccgcgacuucgagcagcuggccgagcgggagggcgagaucgagcaggggagcaaccgccgguaccaggugagcgcccugcacacguccaaggcgugcaacaucaucagcaaguacaccgccuucgucccgguggacguguccaagagccgcuaccuccccaccgucguggaguaccccaacuccggcgccgcccugcggaugcuggggagccgcgcgcucgcccagcaguggcggggcaccuccagcggcuucgggcgcccccagacgaugcugggcgaggacuccgccccggggaacgacauggaggccagccccaccgcccuguucuccgaggcgcggagccccggccgcgagaagcacggggccuccgagggcccccagcggagccucgccaccaacacccuguccagcaugaaggccuccgagaaccuguucggcagcuggcucaaccugaacaagucccgccugcucacgcgggccgcgaagggguuccugagcaagccgcugaucaaggccguggagagcaccuccggcaaccagagcuucgacuacaucccccucgucucccugcagcuggccagcggggccuuccuccugaacgaggccuucugcgaggcgacccacauccccauggagaagcugaaguggaccucccccuucacgugccaccgcgugagccucaccacccggccguccgagagcaagacccccagcccccagcugugcacguccuccccgccccgccaccccagcugcgacuccuucagccuggagccccucgccaagggcaagcugggccuggagccccgcgccguggucgagcacaccgggaagcucugggccaccguggugggccuggccuggcuggagcacuccagcgcguccuacuucaccgagugggagcucgucgccgccaaggccaacagcuggcuggagcagcaggaggugccggaggggcggacgcagggcacccugaaggcggccgcccgccagcuguucgugcugcugcggcacugggacgagaaccucgaguucaacaugcugugcuacaaccccaacuacgucuga

SEQ ID NO: 38657 - RNA, 2676 nt, Artificial Sequence
  derived and/or modified sequence opt1 from VWA7__Homo_sapiens__NP_079534
augcugcccaccgaggugccgcagagccaccccggccccuccgcccuccugcugcuccagcugcugcuccccccgaccagcgccuucuuccccaacaucuggucccugcuggcggcccccgggagcaucacgcaccaggaccucaccgaggaggccgcccugaacgucacccugcagcucuuccuggagcagcccccgcccggccgccccccccugcggcucgaggacuuccuggggcgcacccugcucgccgacgaccuguucgcggccuacuucggcccgggguccagccggcgcuuccgggccgcccugggcgaggugucccgcgcgaacgccgcccaggacuuccuccccacgagccggaacgaccccgaccugcacuucgacgccgagcgccugggccaggggcgggcccgccucgugggcgcgcugcgggagaccgucguggccgcccgcgcccuggaccacacccucgcccggcagcgccugggggcggcccugcacgcccuccaggacuucuacucccacagcaacuggguggagcugggcgagcagcagccccacccgcaccugcucuggccccggcaggagcugcagaaccuggcccaggucgccgaccccaccugcuccgacugcgaggagcucagcugcccccgcaacuggcugggguucacgcugcucaccuccggcuacuucggcacccacccgcccaagccccccgggaagugcagccacggcgggcacuucgaccgguccagcucccagccgccccgcggcggcaucaacaaggacagcaccucccccggguucagcccccaccacaugcugcaccugcaggcggccaagcucgcccugcuggccagcauccaggccuucucccuccugcggagccgccugggcgaccgggacuucucccgccuccuggacaucacgccggcgagcucccugagcuucgugcuggacaccaccggguccaugggcgaggagaucaacgccgccaagauccaggcccgccaccucguggagcagcggcgcgggagccccauggagcccguccacuacgugcuggugccguuccacgaccccggcuucggccccgucuucaccacguccgaccccgacagcuucuggcagcagcugaacgagauccacgcgcucgggggcggggacgagccggagaugugccuguccgcccugcagcucgcccugcugcacacccccccccucagcgacaucuucguguucaccgacgccucccccaaggacgccuuccugaccaaccagguggagagccugacgcaggagcggcgcugccgggucaccuuccucgugaccgaggacaccucccgcgugcagggccgggcgcgccgggagauccugagcccgcugcgcuucgagcccuacaaggccgucgcccucgccuccgggggcgaggugaucuucacgaaggaccagcacauccgggacguggccgcgaucgucggcgagagcauggccgcccuggugacccugccccucgaccccccgguggucgugcccgggcagccccuggucuucuccguggacggccugcuccagaagaucaccgugcgcauccacggggacaucagcagcuucuggaucaagaaccccgccggcgucucccaggggcaggaggagggcggcgggccgcugggccacacccggcgcuucgggcaguucuggauggugacgauggacgaccccccccagaccggcaccugggagauccaggugaccgccgaggacacgcccggcguccgggugcaggcgcagaccagccuggacuuccucuuccacuucgggaucccgauggaggacggcccccaccccgggcuguacccccugacccagccgguggccggccuccagacccagcugcuggucgaggugacggggcucggcucccgcgccaaccccggcgacccccagccgcacuucagccacgugauccugcgggggguccccgagggcgccgagcuggggcaggugccccucgagcccgugggcccgcccgagcgcgggcugcuggcggccucccucagccccacccugcuguccaccccccggccguucagccucgagcugaucggccaggacgccgccggccgccgccugcaccgggccgcgccccagcccuccaccgucgugcccgugcuccuggagcugagcgggccguccggcuuccucgcccccgggagcaaggucccccugucccugcgcaucgccagcuucuccggcccccaggaccucgaccugcggaccuucgugaacccgagcuucucccugacgagcaaccucagccgcgcccaccuggagcugaacgaguccgccugggggcggcucuggcuggaggugcccgacagcgcggcccccgacuccgucgugauggugaccgucaccgccggcggccgcgaggccaaccccgugccgcccacccacgccuuccugcggcuccuggugagcgcgcccgccccccaggaccgccacacgaccccgaccggguccagcgaccccauccugaccacggccacccccgccuucucccccuucacccucgucacccagggccgggcgggggccggccuggccgccgggagcccgugguggggcacggugggcggggugcugcuccugcugggccucgccuccugguga

SEQ ID NO: 38658 - RNA, 3120 nt, Artificial Sequence
  derived and/or modified sequence opt1 from VWA8__Homo_sapiens__NP_001009814
augcagagccgccugcuccugcugggcgcccccgggggccacgggggcccggccucccggcgcaugcggcuccugcugcgccaggugguccagcggcgccccgggggcgaccggcagcgccccgaggugcggcuccugcacgcgggcagcggggccgacaccggcgacaccgugaacaucggggacgucuccuacaagcugaagauccccaagaacccggagcucgugccccagaacuacaucagcgacucccuggcccagagcgugguccagcaccuccgcuggaucaugcagaaggaccuccugggccaggacguguuccugaucgggccgcccggcccccuccggcgcuccaucgccaugcaguaccuggagcugacgaagcgggagguggaguacaucgcccucagccgcgacaccaccgagaccgaccugaagcagcggcgcgagauccgggcgggcacggccuucuacaucgaccagugcgccguccgcgccgcgaccgaggggcggacccugauccucgagggccuggagaaggccgagcgcaacgugcugcccgugcucaacaaccugcuggagaaccgggagaugcagcucgaggacgggcgcuuccugauguccgccgagcgcuacgacaagcugcuccgggaccacaccaagaaggagcuggacagcuggaagaucguccgcguguccgagaacuuccgggugaucgcccugggccuccccgucccccgcuacagcggcaacccgcuggacccgccccugcggucccgcuuccaggcccgggacaucuacuaccuccccuucaaggaccagcugaagcugcucuacagcaucggggcgaacguguccgccgagaaggugagccagcugcuguccuucgccacgacccucugcagccaggaguccagcacccugggccugcccgacuucccccucgacagccuggccgccgcgguccagauccuggacuccuuccccaugaugcccaucaagcacgccauccaguggcucuacccguacagcauccugcuggggcacgagggcaagauggccguggagggggugcugaagcgcuucgagcuccaggacuccggcagcucccugcugcccaaggagaucgucaagguggagaagaugauggagaaccacgugagccaggccuccgucaccauccggaucgccgacaaggaggugacgaucaagguccccgcgggcacccgccuccugagccagcccugcgccuccgaccgguucauccagacccugagccacaagcagcuccaggccgagaugaugcagucccacauggugaaggacaucugccugaucgggggcaaggggugcggcaagaccgugaucgccaagaacuucgccgacacgcugggguacaacaucgagccgaucaugcucuaccaggacaugaccgcgcgcgaccugcugcagcagcgguacacccuccccaacggcgacaccgccuggcgcagcagcccccuggucaacgccgcccuggagggcaagcucgugcugcuggacgggauccaccgggugaacgcgggcacgcucgccguccugcagcgccugauccacgaccgggagcucagccuguacgacgggucccgccugcuccgggaggaccgcuacaugcgccugaaggaggagcugcagcucagcgacgagcagcugcagaagcgguccaucuuccccauccacccgagcuuccgcaucaucgcccuggccgagccgcccgugaucggcuccaccgcccaccaguggcucgggcccgaguuccugaccauguucuucuuccacuacaugaagccccuggugaaguccgaggagauccaggucaucaaggagaaggugcccaacgugccccaggaggcgcucgacaagcugcugagcuucacccacaagcuccgggagacgcaggacccgaccgcccagucccuggccgccagccuguccacccgccagcuccugcggaucagccgccggcugucccaguaccccaacgagaaccuccacagcgccgucaccaaggcgugccugucccgcuuccugcccagccucgcccgguccgcccuggagaagaaccuggccgacgccacgaucgagaucaacaccgacgacaaccucgagcccgagcugaaggacuacaagugcgaggugaccagcggcacccugcgcaucggcgcgguguccgccccgaucuacaacgcccacgagaagaugaagguccccgacgugcuguucuacgacaacauccagcacgugaucgucauggaggacaugcugaaggacuuccugcucggggagcaccuccugcuggugggcaaccagggggugggcaagaacaagaucgucgaccgguuccugcaccuccugaaccgcccccgggaguacauccagcugcaccgcgacacgaccgugcagacccugacccuccagcccagcgugaaggacggccugaucgucuacgaggacuccccgcuggugaaggccgugaagcucgggcacauccuggucguggacgaggcggacaaggcccccacgaacgugaccugcauccugaagacccucgucgagaacggcgagaugauccuggccgacgggcggcgcaucguggccaacagcgccaacgugaacggccgggagaacgucguggugauccaccccgacuuccgcaugaucguccuggcgaaccggcccggguucccguuccucggcaacgacuucuucggcacccugggggacaucuucuccugccacgccguggacaaccccaagccccacagcgagcuggagaugcuccgccaguacggccccaacgugccggagcccauccugcagaagcuggucgccgccuucggggagcuccggucccuggccgaccagggcaucaucaacuaccccuacagcacccgcgagguggugaacaucgucaagcaccuccagaaguuccccacggaggggcugagcuccguggugcgcaacgucuucgacuucgacagcuacaacaacgacaugcgggagauccugaucaacacccugcacaaguacggcaucccgaucggcgcgaagcccaccuccgugcagcucgccaaggaguga

SEQ ID NO: 38659 - RNA, 2868 nt, Artificial Sequence
  derived and/or modified sequence opt1 from VWCE__Homo_sapiens__NP_689931
augugggccggccugcuccugcgcgccgcgugcguggcccugcuccugcccggggccccggcccggggcuacaccgggcgcaagccccccggccacuucgccgcggagcggcgccggcuggggccccacgucugccucagcggcuucggcuccgggugcugcccgggcugggcccccagcauggggggcgggcacugcacccugccccugugcuccuucggcugcggcagcgggaucugcaucgcccccaacgugugcuccugccaggacggcgagcagggggccacgugcccggagacccacggccccugcggcgaguacgggugcgaccucaccugcaaccacggcgggugccaggagguggcgcgcgucugccccgugggcuucagcaugaccgagacggccguggggauccggugcaccgacaucgacgagugcgucaccuccagcugcgagggccacugcgugaacaccgagggcggguucgugugcgagugcggccccgggaugcagcuguccgccgaccgccacagcugccaggacacggacgagugccugggcaccccgugccagcagcggugcaagaacuccaucgggagcuacaagugcuccugccgcaccggcuuccaccuccacggcaaccggcacagcugcgucgacgugaacgagugccgccggccccuggagcgccgggugugccaccacuccugccacaacaccgucgggagcuuccugugcacgugccgccccggcuuccggcuccgcgccgaccggguguccugcgaggccuuccccaaggcggugcuggccccgagcgccauccugcagccccgccagcaccccuccaagaugcuccugcugcuccccgaggccgggcggccggcccugagccccggccacagcccccccuccggggcgccgggcccccccgccggcguccgcaccacccgccugcccagcccgaccccccggcuccccacguccagcccguccgcccccguguggcugcugagcacccuccuggccacccccgugcccaccgccucccugcucgggaaccugcgcccgcccagccugcuccagggcgaggucauggggacgcccuccagcccccggggcccggaguccccccgccuggcggccggccccagccccugcuggcaccugggggccaugcacgagucccggagccgcuggaccgagccgggcugcucccagugcuggugcgaggacgggaaggugaccugcgagaaggugcggugcgaggccgccugcagccaccccauccccucccgcgacggcgggugcugccccagcugcaccggcugcuuccacuccggcgucgugcgggcggagggggacguguucagcccgcccaacgagaacugcacggucugcgugugccucgccggcaacgucagcugcaucucccccgagugccccagcgggccgugccagacccccccccagaccgacugcugcaccugcgugcccgugcgcugcuacuuccacggccggugguacgccgacggggccgucuucuccggcggcggggacgagugcacgaccugcgugugccagaacggcgagguggagugcagcuucaugccgugccccgagcuggcgugcccccgcgaggaguggcggcuggggccgggccagugcugcuucaccugccaggagcccacccccuccacggggugcagccucgacgacaacggcgucgaguuccccaucggccagaucugguccccgggggaccccugcgagcugugcaucugccaggccgacggcagcguguccugcaagcgcaccgacugcguggacagcugcccccaccccauccggaucccggggcagugcugccccgacugcuccgccggcugcaccuacaccgggcgcaucuucuacaacaacgagacguuccccagcguccuggaccccugccucuccugcaucugccugcugggcagcguggccugcuccccgguggacugccccaucaccugcaccuaccccuuccaccccgacggcgagugcugcccggucugccgggacugcaacuacgaggggcgcaagguggccaacggccagguguucacccucgacgacgagcccugcacccggugcacgugccagcugggggaggucagcugcgagaaggugcccugccagcgcgcgugcgccgaccccgcccugcucccgggcgacugcugcuccagcugccccgacagccuguccccccuggaggagaagcagggccugagcccccacgggaacguggccuucuccaaggccggccgcagccuccacggggacaccgaggcgccggucaacugcuccagcugccccggcccccccaccgccuccccgagccggcccgugcugcaccugcuccagcugcugcuccgcaccaaccugaugaagacgcagacccugcccaccuccccggccggggcccacggcccccacagccucgcccugggccugaccgcgacguuccccggggagcccggcgccuccccgcggcucagccccgggcccuccacccccccgggcgcccccacccugccccuggccagccccggggcgccgcagcccccccccgugaccccggagcgcuccuucagcgccuccggcgcccagaucgucagccgguggcccccccuccccggcacgcugcugaccgaggccuccgcccucagcaugauggacccgagccccuccaagacccccaucacccugcuggggccccgcgugcucagcccgacgaccucccggcugagcaccgcgcuggccgccaccacgcaccccggcccccagcagcccccggugggggccucccgcggcgaggagagcaccauguga

SEQ ID NO: 38660 - RNA, 4773 nt, Artificial Sequence
  derived and/or modified sequence opt1 from VWDE__Homo_sapiens__NP_001129396
augcccggcggggccugcgugcuggucaucgcccucauguuccuggcguggggcgaggcccaggagugcagccccgggggccaccaguuccugcgcucccccuaccggagcgugcgcuucgacuccuggcaccuccagcagagcgccgugcaggaccugaucugcgaccacucccugagccccgggugguaccgguuccucauccuggaccgccccgccgagaugccgaccaagugcgucgagaugaaccacugcggcacccaggcccccaucuggcugucccuccgggacagcgagacccugcccucccccggcgagaucaagcagcugaccgcgugcgccaccuggcaguuccucuucagcaccacgaaggacugcugccuguuccagaucccgguguccgugcgcaacugcgggaacuucagcgucuaccugcuccagcccacccagggcugcaugggguacugcgccgaggccaucuccgacgcgcggcugcaccccugcggcagcgacgagaccgagaccgggggcgacugcgugcgccagcuggccgccucccugcccccgccgcccgccggccggcccgaggugcucgucgagcugaucgagagccgccucuucugccggugcuccuucgacgugccggccacgaagaacagcgugggguuccacaucgcguggucccgccugagcagccaggaggucaaggaggagcugacccaggagaccaccgugcaggccuucucccuccuggagcuggacggcaucaaccuccggcugggggaccgcaucuucugcagcgccuccguguucuuccuggagaacccccacguccagagcguggccaucgagucccaggaguucuucgccggcuucaagcuccagcccgagcugagcacgaucuccgaggacggcaaggaguacuaccugcggaucgagagcaccgugcccaucaucugcuccgaguucagcgagcucgaccaggagugcaagaucucccugaagcugaagaccaucgggcagggccgcgagcaccucgggcugaaccuggcgcucagcuccugccacgucgaccugcugcagaccagcuccugcgccaacggcacgugcagccacaccuucguguacuacaccgccgugaccgacuucucccgggacggggaccgcgucagcaacaucguggugcagccgaucgucaacgaggacuuccucuggaacaacuacauccccgacuccauccagaucaaggugaaggacguccccacggccuacugcuacaccuucaccgacccccacaucaucaccuucgacggccggguguacgacaacuucaagacgggcaccuucgugcuguacaagagcaugagccgcgacuucgagguccacgugcggcagugggacugccgcucccugcacuacccggugagcugcaacugcggguucgucgcccaggagggcggggacaucgugaccuucgacaugugcaacggccagcuccgcgagucccagcccuaccuguucaucaagagccaggacgugacccggaacaucaagaucuccgagagcuaccuggggcgcaaggucacgaucugguucuccagcggcgcguucauccgggccgaccucggcgagugggggaugucccugaccauccgcgcccccagcguggacuaccggaacacccugggccugugcgggaccuucgacgagaaccccgagaacgacuuccacgacaagaacggcaugcagaucgaccagaacuucaacaacuacguggccuucaucaacgaguggcgcauccucccggggaaguccaugagcgacacgcugcccgucuccaugaccagccccggcaagccguccuacugcagcugcucccuggacaccgccgcguaccccagcagcgaggaccucgacuccgugagccgguccgagaucgcccugggcugcaaggaccugaaccacgugagccucuccagccugauccccgagcuggacgucaccuccgaguacaucaacagcgacacgcucgugcgcgagaucaacaagcacaccucccccgaggaguacaaccugaaccuguuccuccaggagaagaagcacaucaaccugaccaagcuggggcucaacgugcagaagcacccgggcaacgagaaggaggacagccugcaguaccuggccaacaagaaguacacccaggggcggggcucccacagccaggagaugcgcuacaaccggcagaaccgcuggaagcggcagaacuuccacgaguucccgccccucuucgccuuccccucccugagccagaccgaccuggaggagcucacguacuucuuccccgaggaccacgcggaggacguccagcaggaguucuuccccuccuggcccacccccagcggccugaccgaguacuccacccugacgcucugccaggagacccuggccaacagcuccaucgggcgccugugccucgccuuccugggcaagcggcuggacagcgugaucgagaugugcgugaaggacguccuccugaaggacgaccugagcugggccgaggccgggguggcgcuccuggagaacgagugcgagaagcgcaucguggaggagggcaaguacaacaccgaggaguacgggaccuccaucgaggacauccugagcguccucaagugcccgaaccugugcuccggcaacggccagugcauggagugggggugcgccugcagccccuccuucagcuccuacgacugcagcgacuccuacgacaaggcccccgagaucacggagcugggcaacgccggguucugcgacgugcagaaguacaacugcaugauggugcgggucuucggcaagggguucaaggagcuccccagcaucaagugcgaggugaccaagcugcaguacaacuccagcgaguggaugccgggcgagcccaucuacacccagaccguguuccacaacucccgcgccgucgacugccagcugcccacggacgugcagcaguucgacaccauggaccucgugggcgggaagcccaccggcaaguggcagcugaaggucagcaacgacggguacaaguucuccaacccgaagaucaccgugaucuacgacggcgcgugccaggugugcgggcuguacaagaacgacagcugcacgaucaaggagaacgucugcaucaucgacggccucugcuacguggagggcgacaagaaccccaccucccccugccugaucugccggcccaagaucagccgcuucaccugguccuuccuggagaacaaccagccgcccgugauccaggcccuccaggacaagcugcagaccuucuacggggagaacuucgaguaccaguucgucgccuucgaccccgagggcagcgacauccacuucacgcuggacagcgggccggagggcgccuccgugagcuccgccggccucuucauguggaagaccgaccugcugaccacccagcagaucacggugcgccucaacgacgacugcgacgcggagacccgggucaccaucgaggugaccgucaagagcugcgacugccugaacggcggcuccugcgugagcgaccgcaacuucucccccgggagcggcguguaccugugcgugugccuccccggguuccacggcucccugugcgaggucgacaucagcggcugccaguccaaccccugcgggcugggcagcuacaucuccggguuccacagcuacuccugcgacugcccgcccgagcucaagguggagacgcaguucgugaaccaguucaccacccagaccgucgugcugacgcggagcgacaaguccgucaacaaggaggaggacgacaagaacgcccagggccgcaagcggcacgugaagcccaccagcgggaacgccuucaccaucugcaaguaccccugcggcaagucccgcgagugcguggccccgaacaucugcaagugcaagcccggcuacaucgggagcaacugccagaccgcgcugugcgaccccgacugcaagaaccacggcaagugcaucaagcccaacaucugccagugccucccggggcacggcggggccacgugcgacgaggagcacugcaacccgcccugccagcacggcgggaccugccuggccgggaaccugugcacgugccccuacggcuucgucgggccccggugcgagaccauggugugcaaccgccacugcgagaacggcgggcagugccucacccccgacaucugccagugcaagcccggcugguacggcccgaccugcagcaccgcccugugcgaccccgugugccugaacgggggcuccugcaacaagcccaacacgugccucugccccaacggguucuucggcgagcacugccagaacgccuucugccacccgcccugcaagaacggcgggcacugcaugcggaacaacgucugcgugugccgcgagggcuacaccgggcggcgcuuccagaaguccaucugcgacccgaccugcaugaacggcgggaagugcgugggccccagcacgugcagcugccccuccggcuggagcgggaagcggugcaacacccccaucugccugcagaagugcaagaacggcggggagugcaucgcgcccuccaucugccacugccccagcuccugggagggcguccgcugccagaucccgaucugcaaccccaagugccuguacgggggccggugcaucuuccccaacgugugcagcugccgcaccgaguacuccggcgugaagugcgagaagaagauccagauccggcgccacuga

SEQ ID NO: 38661 - RNA, 8442 nt, Artificial Sequence
  derived and/or modified sequence opt1 from VWF__Homo_sapiens__NP_000543
augauccccgcccgcuucgccggcgugcugcucgcccuggcccugauccuccccgggacccugugcgccgagggcacccgggggcgcagcagcaccgcccggugcagccuguucggcuccgacuucgugaacaccuucgacgggagcauguacuccuucgccggcuacugcagcuaccuccuggccggcgggugccagaagcgcuccuucagcaucaucggcgacuuccagaacgggaagcgggugucccugagcguguaccucggcgaguucuucgacauccaccuguucgugaacgggaccgugacccagggcgaccagcgcguguccaugcccuacgccagcaagggccuguaccucgagaccgaggccggguacuacaagcuguccggcgaggccuacggguucguggcgcggaucgacggcagcggcaacuuccaggugcugcucuccgaccgcuacuucaacaagaccugcgggcugugcggcaacuucaacaucuucgccgaggacgacuucaugacccaggaggggacccugaccagcgaccccuacgacuucgccaacuccugggcccucagcuccggcgagcaguggugcgagcgggccuccccgcccagcuccagcugcaacaucuccagcggggagaugcagaagggccugugggagcagugccagcugcucaaguccaccagcguguucgcgcgcugccacccccuggucgaccccgagcccuucguggcccugugcgagaagacccucugcgagugcgccggcgggcuggagugcgccugccccgcccugcucgaguacgcgcggaccugcgcccaggagggcauggugcuguacggguggaccgaccacuccgccugcagccccgucugccccgccggcauggaguaccgccagugcgugucccccugcgcccggaccugccagagccugcacaucaacgagaugugccaggagcgcugcguggacgggugcuccugccccgagggccagcuccuggacgagggccugugcgucgagagcaccgagugccccugcgugcacuccgggaagcgguacccgcccggcaccagccucucccgcgacugcaacacgugcaucugccggaacagccaguggaucugcuccaacgaggagugccccggggagugccuggugaccggccagagccacuucaaguccuucgacaaccgcuacuucaccuucagcgggaucugccaguaccugcucgcgcgggacugccaggaccacagcuucuccaucgucaucgagaccgugcagugcgccgacgaccgcgacgccgugugcacccggagcgucaccgugcgccugcccggccugcacaacucccucgugaagcugaagcacggcgccggggucgccauggacggccaggacgugcagcugccccuccugaagggggaccugcgcauccagcacaccgucaccgcgagcgugcggcucuccuacggcgaggaccugcagauggacugggacggccgcgggcggcugcucgugaagcugagccccgucuacgccggcaagaccugcgggcugugcggcaacuacaacgggaaccagggcgacgacuuccugacccccuccggccucgccgagccccgcguggaggacuucgggaacgccuggaagcugcacggcgacugccaggaccugcagaagcagcacagcgaccccugcgcgcucaacccccggaugacccgcuucuccgaggaggccugcgccgugcugaccagccccaccuucgaggccugccaccgggccgucagcccccugcccuaccuccgcaacugccgguacgacgugugcagcugcuccgacgggcgcgagugccugugcggcgcgcuggccagcuacgccgccgccugcgcggggcggggcgugcgcgucgccuggcgggagcccggccgcugcgagcucaacugcccgaagggccagguguaccugcagugcggcacccccugcaaccugaccugccggucccucagcuaccccgacgaggagugcaacgaggccugccuggaggggugcuucugcccgcccggccuguacauggacgagcgcggggacugcgugcccaaggcccagugccccugcuacuacgacggcgagaucuuccagccggaggacaucuucuccgaccaccacaccaugugcuacugcgaggacggcuucaugcacugcacgaugagcgggguccccggcagccuccugcccgacgccgugcuguccagcccccucucccaccggagcaagcgcucccugagcugccggccgcccauggugaagcuggucugccccgcggacaaccuccgcgccgaggggcuggagugcaccaagaccugccagaacuacgaccuggagugcauguccaugggcugcgugagcgggugccucugcccgcccggcauggugcgccacgagaaccggugcgucgcccuggagcgcugccccugcuuccaccagggcaaggaguacgcccccggggagaccgugaagaucggcugcaacacgugcgugugccgggaccgcaaguggaacugcaccgaccacgucugcgacgcgaccugcuccaccaucgggauggcccacuaccugaccuucgacggccucaaguaccuguuccccggcgagugccaguacgugcuggugcaggacuacugcgggagcaaccccggcacguuccggauccucgucgggaacaagggcugcucccaccccagcgugaagugcaagaagcgcgugaccauccuggucgagggcggggagaucgagcuguucgacggcgaggugaacgugaagcggcccaugaaggacgagacccacuucgaggucguggaguccgggcgcuacaucauccuccugcugggcaaggcccucagcguggucugggaccggcaccuguccaucagcguggugcugaagcagaccuaccaggagaaggucugcgggcucugcggcaacuucgacgggauccagaacaacgaccugacguccagcaaccuccagguggaggaggaccccguggacuucggcaacuccuggaaggucagcagccagugcgccgacacccgcaaggugccgcucgacuccagccccgcgaccugccacaacaacaucaugaagcagaccaugguggacuccagcugccggauccugacguccgacgucuuccaggacugcaacaagcugguggaccccgagcccuaccucgacgugugcaucuacgacacgugcagcugcgaguccaucggcgacugcgcgugcuucugcgacaccaucgccgccuacgcccacgucugcgcccagcacgggaagguggugaccuggcgcacggcgacccugugcccgcagagcugcgaggagcggaaccugcgcgagaacggcuacgagugcgaguggcgguacaacuccugcgcccccgccugccaggugaccugccagcaccccgagccgcucgccugccccgugcagugcguggaggggugccacgcccacugcccgcccggcaagauccuggacgagcugcuccagaccugcgucgacccggaggacugccccgugugcgaggucgcggggcgccgguucgccagcggcaagaaggugacgcugaaccccuccgaccccgagcacugccagaucugccacugcgacguggucaaccugaccugcgaggccugccaggagccgggcgggcucguggugccgcccaccgacgcccccgucagcccgaccacgcuguacguggaggacaucuccgagccgccccugcacgacuucuacugcagccgccuccuggaccugguguuccuccuggacggcuccagccggcuguccgaggcggaguucgagguccucaaggccuucgugguggacaugauggagcgccugcggaucagccagaaguggguccgcguggccguggucgaguaccacgacgggucccacgccuacaucggccugaaggaccgcaagcggcccagcgagcuccgccggaucgccagccaggugaaguacgcgggcucccagguggccagcaccuccgagguccugaaguacacccuguuccagaucuucagcaagaucgaccgcccggaggccucccggaucacccuccugcugauggccagccaggagccccagcgcaugucccggaacuucgugcgcuacgugcaggggcucaagaagaagaaggucaucgugauccccgugggcaucgggccccacgccaaccugaagcagauccggcugaucgagaagcaggcgccggagaacaaggccuucguccucagcuccguggacgagcuggagcagcagcgcgacgagaucgugagcuaccugugcgaccucgcccccgaggcgccgccgcccacgcugccgcccgacauggcccaggucaccgugggccccgggcugcucggcguguccacccugggccccaagcggaacagcaugguccuggacguggcguucgugcucgagggguccgacaagaucggcgaggccgacuucaaccgcagcaaggaguucauggaggaggucauccagcggauggacguggggcaggacuccauccacgugaccguccugcaguacagcuacauggugacgguggaguaccccuucuccgaggcccagagcaagggcgacauccugcagcgcguccgggagauccgcuaccagggcgggaaccggaccaacaccggccucgcccugcgcuaccuguccgaccacagcuuccucgugagccagggggaccgggagcaggcccccaaccugguguacauggucaccggcaacccggcguccgacgagaucaagcgccugcccggggacauccagguggugcccaucggcgucgggcccaacgccaacgugcaggagcucgagcgcaucggcuggccgaacgcccccauccugauccaggacuucgagacgcugccccgggaggcccccgaccuggugcuccagcgcugcugcagcggcgaggggcugcagaucccgacccugucccccgcgcccgacugcagccagccccucgacgucauccugcugcucgacggcuccagcuccuucccggccagcuacuucgacgagaugaaguccuucgccaaggccuucaucagcaaggccaacaucgggccccggcugacccagguguccgugcugcaguacggcagcaucaccacgaucgacguccccuggaacgugguccccgagaaggcgcaccuccugucccugguggacgugaugcagcgcgagggcgggccgagccagaucggcgacgcccucggguucgccguccgguaccugaccuccgagaugcacggcgcccgccccggggccagcaaggcgguggugauccuggucaccgacguguccguggacagcgucgacgccgccgccgacgccgcgcgguccaaccgcgugaccguguuccccaucggcaucggcgaccgguacgacgccgcccagcuccgcauccuggccgggcccgcgggcgacagcaacgucgugaagcugcagcggaucgaggaccucccgaccauggugacgcuggggaacagcuuccugcacaagcucugcuccggcuucguccgcaucugcauggacgaggacgggaacgagaagcggcccggcgacguguggacccugcccgaccagugccacaccgugaccugccagcccgacggccagacgcugcucaagagccaccgcgucaacugcgaccgggggcugcgcccguccugccccaacagccagucccccgugaagguggaggagaccugcggcugccgguggaccugccccugcgucugcaccgggagcuccacgcgccacaucgugaccuucgacggccagaacuucaagcugaccgggagcugcuccuacguccuguuccagaacaaggagcaggaccuggaggucauccugcacaacggcgccugcagcccgggcgcccggcaggggugcaugaaguccaucgaggugaagcacagcgcccucuccguggagcugcacagcgacauggaggucaccgugaacggccgccugguguccguccccuacgucgggggcaacauggaggugaacgucuacggggccaucaugcacgaggugcgguucaaccaccucggccacaucuucacguucacgccccagaacaacgaguuccagcugcagcugagcccgaagaccuucgcguccaagaccuacggccucugcgggaucugcgacgagaacggcgccaacgacuucaugcugcgcgacgggacggugaccaccgacuggaagacccugguccaggaguggacggugcagcgccccggccagaccugccagcccauccucgaggagcagugccuggugcccgacagcucccacugccagguccugcuccugccgcuguucgccgagugccacaaggugcucgcccccgccaccuucuacgcgaucugccagcaggacagcugccaccaggagcaggucugcgaggucaucgccagcuacgcccaccugugccggaccaacggggugugcguggacuggcgcacgcccgacuucugcgccauguccugcccgcccagccuggucuacaaccacugcgagcacggcugcccccggcacugcgacggcaacguguccagcugcggggaccaccccuccgagggcugcuucugcccgcccgacaaggugaugcucgaggggagcugcguccccgaggaggccugcacccagugcaucggcgaggacggcgugcagcaccaguuccuggaggcgugggugcccgaccaccagcccugccagaucugcacgugccuguccgggcgcaaggucaacugcaccacgcagcccugccccaccgccaaggccccgaccugcggccucugcgagguggcccggcugcgccagaacgcggaccagugcugccccgaguacgagugcgucugcgaccccgugagcugcgaccugccgcccgugccccacugcgagcgggggcuccagccgacccugacgaaccccggcgagugccgccccaacuucacgugcgccugccggaaggaggagugcaagcgcgucuccccgcccagcugcccgccccaccggcugccgacccuccgcaagacccagugcugcgacgaguacgagugcgccugcaacugcgugaacuccacggugagcugcccccugggguaccuggccuccaccgccaccaacgacugcggcugcaccaccacgaccugccuccccgacaaggucugcgugcaccggagcaccaucuaccccgugggccaguucugggaggaggggugcgacgucugcacgugcacggacauggaggacgcggugaugggccugcgcguggcccagugcucccagaagccgugcgaggacagcugccgguccggguucaccuacguccugcacgagggcgagugcugcgggcgcugccuccccagcgccugcgagguggugaccggcagcccccggggcgacucccagagcuccuggaaguccgucgggucccagugggccagccccgagaacccgugccugaucaacgagugcgugcgcgugaaggaggaggucuucauccagcagcggaacguguccugcccccagcuggaggugcccgucugccccagcggcuuccagcucuccugcaagaccagcgccugcugcccguccugccgcugcgagcgcauggaggcgugcaugcugaacgggacggugaucggccccgggaagaccgugaugaucgacgucugcacgaccugccggugcaugguccaggugggcgucaucagcggcuucaagcuggagugccgcaagacgaccugcaaccccugcccccucggguacaaggaggagaacaacaccggcgagugcugcgggcggugccugccgaccgccugcacgauccagcugcgcggcggccagaucaugacccucaagcgggacgagacccugcaggacgggugcgacacccacuucugcaaggugaacgagcgcggcgaguacuucugggagaagcgggugacggggugcccgcccuucgacgagcacaagugccuggccgagggcgggaagaucaugaagauccccgggaccugcugcgacacgugcgaggagccggagugcaacgacaucaccgcccgccuccaguacgucaaggugggcuccugcaagagcgagguggaggucgacauccacuacugccaggggaagugcgccuccaaggcgauguacagcaucgacaucaacgacgugcaggaccagugcuccugcugcagccccacgcggaccgagcccaugcaggucgcccugcacugcaccaacggcuccgugguguaccacgaggugcugaacgccauggagugcaagugcagcccccgcaagugcagcaaguga

SEQ ID NO: 38662 - RNA, 3573 nt, Artificial Sequence
  derived and/or modified sequence opt1 from WAPAL__Homo_sapiens__NP_055860
augaccagccgcuucggcaagaccuacucccggaagggcggcaacgggagcuccaaguucgacgagguguucagcaacaagcgcacgacccuguccaccaaguggggcgagaccacguucauggccaagcucgggcagaagcggcccaacuucaagccggacauccaggagauccccaagaagcccaaggucgaggaggagagcaccggcgaccccuucggcuucgacuccgacgacgagagccugccgguguccagcaagaaccuggcccaggugaagugcuccagcuacuccgagagcuccgaggcggcccagcucgaggaggucaccagcgugcuggaggccaacuccaagaucagccacguggucguggaggacaccguggucuccgacaagugcuucccccuggaggacacgcuccuggggaaggagaaguccaccaaccgcaucguggaggacgacgccagcaucagcagcugcaacaagcugaucaccuccgacaagguggagaacuuccacgaggagcacgagaagaacagccaccacauccacaagaacgccgacgacuccaccaagaagcccaacgcggagacgaccgucgccagcgagaucaaggagaccaacgacaccuggaacucccaguucggcaagcggcccgagagcccguccgagaucagccccaucaagggguccgugcgcacgggccucuucgagugggacaacgacuucgaggacauccggagcgaggacugcauccugucccuggacagcgacccccuccuggagaugaaggacgacgacuucaagaaccgccuggagaaccucaacgaggccaucgaggaggacaucgugcaguccguccugcggcccaccaacugccgcaccuacugccgggccaacaagaccaagagcucccagggggcgagcaacuucgacaagcugauggacggcacgucccaggcccucgccaaggccaacagcgagagcuccaaggacggccugaaccaggccaagaagggcggggugagcugcgggaccuccuuccgcggcaccgugggccggacccgcgacuacacgguccugcacccgagcugccucuccgugugcaacgugaccauccaggacaccauggagcggagcauggacgaguucaccgcguccacgcccgccgaccugggggaggccggccgccugcggaagaaggccgacaucgccaccagcaagaccaccacgcgcuuccggcccuccaacaccaagagcaagaaggacgucaagcucgaguucuucggguucgaggaccacgagaccggcggggacgagggcggcuccgggagcuccaacuacaagaucaaguacuucggcuucgacgaccugagcgaguccgaggacgacgaggacgacgacugccagguggagcgcaagaccagcaagaagcggacgaagaccgcgcccuccccgagccugcagcccccgcccgagagcaacgacaacucccaggacagccaguccgggaccaacaacgccgagaaccucgacuucaccgaggaccugcccggcgugcccgagagcgucaagaagcccaucaacaagcagggggacaaguccaaggagaacacccgcaagaucuucagcggccccaagcgcuccccgacgaaggccguguacaacgcccggcacuggaaccaccccgacagcgaggagcugcccgggcccccggucgugaagccccaguccgugaccguccgccucagcuccaaggagcccaaccagaaggacgacgggguguucaaggccccggcgccgcccagcaaggugaucaagaccgucaccauccccacgcagcccuaccaggacaucgugaccgcccugaagugccggcgcgaggacaaggagcuguacaccgugguccagcacgugaagcacuucaacgacguggucgaguucggcgagaaccaggaguucaccgacgacaucgaguaccuccuguccgggcucaagagcacgcagccccucaacacccggugccuguccgugaucagccuggccaccaagugcgccaugcccuccuuccgcaugcaccuccgggcccacggcaugguggcgauggucuucaagacccuggacgacagccagcaccaccagaaccugucccucugcacggccgcccugauguacauccugagccgcgaccggcucaacauggaccuggaccgcgccagccuggaccucaugauccggcugcuggagcuggagcaggacgcguccagcgccaagcuccugaacgagaaggacaugaacaagaucaaggagaagauccgccggcugugcgagaccgugcacaacaagcaccucgaccuggagaacaucaccaccgggcaccuggccauggagacgcuccugucccugaccagcaagcgcgccggcgacugguucaaggaggagcuccggcugcugggcgggcucgaccacaucguggacaaggucaaggagugcguggaccaccugucccgcgacgaggacgaggagaagcugguggccagccucuggggcgcggagcggugccugcgcguccuggaguccgugaccgugcacaaccccgagaaccagagcuaccucaucgccuacaaggacucccagcugaucgucagcuccgccaaggcccugcagcacugcgaggagcucauccagcaguacaaccgggccgaggacagcaucugccuggcggacuccaagccgcugccccaccagaacgugaccaaccacguggggaaggccgucgaggacugcaugcgcgccaucaucggcgugcuccugaaccugacgaacgacaacgaguggggcagcaccaagaccggggagcaggacggccucaucgggaccgcccugaacugcgugcugcagguccccaaguaccucccccaggagcagcgcuucgacauccgggugcugggccuggggcuccugaucaaccugguggaguacuccgcccgcaaccggcacugccucgucaacauggagacgagcugcuccuucgacagcuccaucugcagcggcgagggcgacgacagccugcgcaucgggggccaggugcacgcggugcaggcccugguccagcuguuccuggagcgggagcgcgccgcccagcuggcggaguccaagaccgacgagcucaucaaggacgccccgaccacccagcacgacaagagcggggaguggcaggagacguccggcgagauccagugggugagcaccgagaagaccgacgggaccgaggagaagcacaagaaggaggaggaggacgaggagcuggaccugaacaaggcccuccagcacgccggcaagcacauggaggacugcaucguggccuccuacacggcgcugcugcucggcugccugugccaggagagccccaucaacgucaccaccgugcgggaguaccugcccgagggggacuucuccaucaugaccgagaugcucaagaaguuccugagcuucaugaaccugacgugcgccgugggcaccaccgggcagaaguccaucagccgcgucaucgaguaccucgagcacugcuga

SEQ ID NO: 38663 - RNA, 1014 nt, Artificial Sequence
  derived and/or modified sequence opt1 from WARS2__Homo_sapiens__XP_011538796
augaugguggccuggaccaccaaggacagcaagaagcgcgucuucuccggcauccagcccacggggauccugcaccucggcaacuaccugggggccaucgagagcugggugcggcugcaggacgaguacgacuccgugcucuacagcaucgucgaccugcacuccaucaccgugccgcaggaccccgcggugcugcgccagagcauccucgacaugaccgccguccugcuggccugcggcaucaaccccgagaaguccauccucuuccagcagagccagguguccgagcacacccagcugagcuggauccuguccugcauggugcggcucccccgccugcagcaccuccaccaguggaaggccaagacgaccaagcagaagcacgacgggaccgucggccugcugaccuacccggugcugcaggccgcggacauccuccuguacaagagcacgcacgugcccgucggcgaggaccaggugcagcacauggagcuggugcaggaccucgcccagggguucaacaagaaguacggcgaguucuuccccguccccgaguccauccugaccagcaugaagaaggugaagucccugcgggacccgagcgccaagauguccaagagcgaccccgacaagcucgccaccgugcgcaucaccgacucccccgaggagaucguccagaaguuccggaaggcggugacggacuucaccagcgaggugaccuacgaccccgccgggcgcgccggcgucagcaacaucguggccgugcacgccgcggucaccgggcuguccguggaggaggucgugcggcgcagcgccggcaugaacacggcccgguacaagcuggccguggccgacgcggucaucgagaaguucgccccgaucaagcgcgagaucgagaagcucaagcuggacaaggaccaccuggagaaggugcuccagaucggcuccgccaaggccaaggagcuggccuacaccgugugccaggaggucaagaagcuggugggguuccucuga

SEQ ID NO: 38664 - RNA, 1416 nt, Artificial Sequence
  derived and/or modified sequence opt1 from WARS__Homo_sapiens__XP_006720312
augcccaacagcgagccggccucccugcucgagcuguucaacagcaucgccacccagggcgagcuggugcgcucccucaaggcggggaacgccagcaaggacgagaucgacuccgccgucaagaugcuggugagccugaagauguccuacaaggccgccgcgggcgaggacuacaaggccgacugcccgcccgggaaccccgcccccaccagcaaccacggccccgacgccaccgaggcggaggaggacuucguggaccccuggaccguccagaccuccagcgccaaggggaucgacuacgacaagcucaucgugcgguucggcuccagcaagaucgacaaggagcugaucaaccgcaucgagcgggccaccggccagcgcccccaccacuuccugcggcgcgggaucuucuucucccaccgggacaugaaccaggugcucgacgccuacgagaacaagaagccguucuaccuguacacgggccgcgggcccagcuccgaggccaugcacgucggccaccugauccccuucaucuucaccaaguggcuccaggacguguucaacgugccccuggucauccagaugaccgacgacgagaaguaccuguggaaggaccucacccuggaccaggcguacagcuacgccguggagaacgccaaggacaucaucgccugcggguucgacaucaacaagacguucaucuucuccgaccuggacuacaugggcaugagcuccggcuucuacaagaacguggucaagauccagaagcacgugaccuucaaccaggugaaggggaucuucggcuucaccgacagcgacugcaucgggaagaucagcuucccggccauccaggcggcccccuccuucagcaacuccuucccccagaucuuccgggaccgcaccgacauccagugccucauccccugcgccaucgaccaggacccguacuuccggaugacgcgcgacgucgcgccccggaucggcuaccccaagcccgcccugcugcacagcaccuucuucccggcccuccagggcgcccagaccaagauguccgccagcgaccccaacuccagcaucuuccugaccgacacggccaagcagaucaagaccaaggugaacaagcacgccuucuccgggggccgcgacaccaucgaggagcaccggcaguucgggggcaacugcgacguggacgucagcuucauguaccugaccuucuuccucgaggacgacgacaagcuggagcagauccgcaaggacuacacguccggggcgaugcugaccggcgagcucaagaaggcccugaucgaggugcugcagccccucaucgccgagcaccaggcccggcgcaaggaggugaccgacgagaucgucaaggaguucaugacgccccggaagcugagcuucgacuuccaguga

SEQ ID NO: 38665 - RNA, 1680 nt, Artificial Sequence
  derived and/or modified sequence opt1 from WASF1__Homo_sapiens__NP_001020106
augccccuggugaagcgcaacaucgacccgcggcaccucugccacaccgcccugccccgcggcaucaagaacgagcuggagugcgucaccaacaucagccucgccaacaucauccggcagcuguccagccuguccaaguacgcggaggacaucuucggggagcucuucaacgaggcccacagcuucuccuuccgcgugaacagccugcaggagcggguggaccgccuguccgucagcgugacgcagcucgaccccaaggaggaggagcugucccugcaggacaucaccaugcggaaggccuuccgcagcuccaccauccaggaccagcagcucuucgaccggaagacccugcccaucccgcugcaggagacguacgacgugugcgagcagccccccccccucaacauccugaccccguaccgcgacgacggcaaggaggggcugaaguucuacaccaaccccagcuacuucuucgaccucuggaaggagaagaugcugcaggacaccgaggacaagcggaaggagaagcgcaagcagaagcagaagaaccuggaccggccccacgagcccgagaaggucccgcgcgccccccacgaccggcgccgggaguggcagaagcucgcccagggccccgagcuggcggaggacgacgccaaccugcuccacaagcacaucgagguggccaacgggcccgccucccacuucgagacgcgcccgcagaccuacguggaccacauggacggcagcuacucccugagcgcgcugcccuucucccagaugagcgagcuccugacccgggccgaggagcgcguccuggugcggccccacgagcccccgcccccccccccgaugcacggcgccggggacgccaagcccauccccaccugcaucuccagcgccacgggccucaucgagaaccgcccccagagcccggcgaccgggcgcacccccguguucgucucccccaccccgcccccccccccgcccccccugcccagcgcccuguccacgagcucccuccgggccagcaugaccuccaccccgcccccccccgugccgcccccccccccgccccccgccaccgcccugcaggcgcccgccgugccgcccccccccgccccgcugcagaucgcccccggcguccuccaccccgccccgccccccaucgcgcccccgcuggugcagcccagcccccccguggcccgcgccgccccggucugcgagacggugcccgugcacccccugccccagggggagguccagggccucccgcccccccccccgccccccccccugccgccccccggcauccggcccuccagcccggugaccgugaccgcccuggcgcacccccccuccgggcuccaccccaccccgagcacggcccccggcccccacgucccgcugaugccccccucccccccgagccaggugauccccgccuccgagcccaagcgccaccccagcacccugccggucaucuccgacgcccggagcgugcuccuggaggcgauccgcaaggggauccagcugcggaagguggaggagcagcgcgagcaggaggccaagcacgagcggaucgagaacgacgucgccaccauccucucccgccggaucgccguggaguacagcgacagcgaggacgacuccgaguucgacgagguggacuggcuggaguga

SEQ ID NO: 38666 - RNA, 1500 nt, Artificial Sequence
  derived and/or modified sequence opt1 from WASF3__Homo_sapiens__NP_001278894
augccccuggugaagcgcaacaucgagccgcggcaccucugccgcggcgcccugcccgaggggaucaccagcgagcuggagugcgucaccaacuccacgcucgccgcgaucauccggcagcugagcucccugagcaagcacgccgaggacaucuucggcgagcucuucaacgaggccaacaacuucuacauccgcgccaacucccugcaggaccggaucgaccgccuggccgugaaggugacccagcucgacagcaccgucgaggaggugucccugcaggacaucaacaugaagaaggcguucaagagcuccaccgugcaggaccagcaggucgugagcaagaacuccauccccaaccccguggccgacaucuacaaccagagcgacaagccgcccccccugaacauccucacgcccuaccgggacgacaagaaggacgggcugaaguucuacaccgacccguccuacuucuucgaccuguggaaggagaagaugcuccaggacaccgaggacaagcgcaaggagaagcggcgccagaagcgggagaagcacaagcugaaccccaaccgcaaccagcaggucaacgugcggaaggugcgcacccggaaggaggagugggagcgccggaagaugggcaucgaguucaugagcgacgccaagaagcuggagcaggccggguccgcgaaggaggaccgcguccccagcggcucccacgccagcgacgugacggacuacuccuaccccgccaccccgaaccacagccuccacccccagcccgugacccccagcuacgccgccggcgacgucccgccccacgggcccgcgucccaggccgccgagcacgaguaccggcccccgagcgccuccgcccgccacauggcgcugaaccggccccagcagccccccccgcccccccccccgcaggcccccgagggcagccaggccuccgcccccauggccccggcggacuacgggaugcugcccgcccagaucaucgaguacuacaaccccagcggccccccgcccccccccccgccccccgugauccccuccgcccagaccgccuucgugagcccgcuccagaugcccaugcagccccccuucccggccuccgcgagcuccacgcacgccgcccccccccaccccccgagcaccgggcugcuggucaccgcccccccccccccgggcccccccccgcccccccccggcccgcccgggcccggcuccagccucuccagcucccccaugcacgggccgcccguggcggaggccaagcgccaggagcccgcccagcccccgaucagcgacgcccgcuccgaccugcuggccgcgauccggaugggcauccagcucaagaaggugcaggagcagcgcgagcaggaggccaagcgggagcccgucggcaacgacguggccaccauccugagccgccggaucgccguggaguacagcgacuccgacgacgacagcgaguucgacgagaacgacugguccgacuga

SEQ ID NO: 38667 - RNA, 1440 nt, Artificial Sequence
  derived and/or modified sequence opt1 from WASH1__Homo_sapiens__XP_011515960
augggcgccgugugcaccagcggggcccgcuccgagcggaccaugacgcccguccgcaugcagcacagccuggcgggccagaccuacgccgugccguucauccagcccgaccuccggcgcgaggaggccgugcagcagauggccgacgcccugcaguaccugcagaaggucuccggggacaucuucagccggaucucccagcagguggagcagagccgcucccaggugcaggcgaucggcgagaaggucagccucgcccaggccaagaucgagaagaucaagggguccaagaaggccaucaagguguucagcuccgcgaaguaccccgcccccggccggcugcaggaguacggcagcaucuucaccggggcccaggacccgggccugcagcgccggccccgccaccggauccaguccaagcaccgcccccucgacgagcgggcccugcaggagaagcugaaggacuuccccgugugcgucagcaccaagccggagcccgaggacgacgccgaggaggggcucggcgggcugcccuccaacaucagcuccgugagcucccugcuccuguucaacacgaccgagaaccuguacaagaaguacguguuccucgacccccuggcgggcgccgucaccaagacccacgugaugcugggcgccgagacggaggagaagcucuucgacgccccgcugagcaucagcaagcgcgagcagcuggagcagcaggugcccgagaacuacuucuacguccccgaccucgggcaggugcccgagauccacgugccguccuaccugcccgaccugcccggcaucgccaacgaccucauguacagcgcggaccuggggcccggcaucgccccguccgcccccggcaccauccccgagcugcccaccuuccacaccgaggucgccgagccgcucaagguggaccugcaggacggggugcugacgcccccccccccgccccccccgcccccccccgccccggagguccucgcgagcgcccccccccugcccccguccaccgccgcccccgugggccagggggcccggcaggacgacagcuccagcuccgcgagccccuccgugcagggcgccccccgcgaggucguggacccgagcgggggcugggccacccugcucgaguccauccggcaggccggcgggaucggcaaggcgaagcugcgcagcaugaaggagcggaagcuggagaagcagcagcagaaggagcaggagcagguccgcgccaccucccaggggggccaccucaugagcgaccuguucaacaagcuggugaugcggcgcaaggggaucuccggcaagggccccggggccggcgaggggcccggcggggccuucgugcgcgucagcgacuccauccccccgcucccccccccccagcagccgcaggccgaggaggacgaggacgacugggagagcuga

SEQ ID NO: 38668 - RNA, 1509 nt, Artificial Sequence
  derived and/or modified sequence opt1 from WAS__Homo_sapiens__NP_000368
augagcggcgggcccaugggcgggcgcccgggcgggcggggcgcccccgccgugcagcagaacauccccuccacccugcuccaggaccacgagaaccagcgccuguucgagaugcugggccggaagugccucacccuggcgacggccgucgugcagcuguaccucgcccugcccccgggggccgagcacuggaccaaggagcacugcggcgccgugugcuucgucaaggacaacccccagaagagcuacuucauccgccuguacgggcuccaggcgggccggcugcugugggagcaggagcucuacucccagcugguguacagcacccccacccccuucuuccacacguucgccggggacgacugccaggccggccugaacuucgccgacgaggacgaggcgcaggccuuccgcgcccucgugcaggagaagauccagaagcggaaccagcgccaguccggcgaccggcgccagcugccgcccccccccaccccggccaacgaggagcggcgcgggggccugcccccccucccccugcacccggggggcgaccagggcgggccccccgucggcccccugagccucgggcuggccaccguggacauccagaacccggacaucaccuccagccgguaccgcggccugcccgcgcccgggcccuccccggccgacaagaagcggagcggcaagaagaagaucuccaaggccgacaucggcgcccccagcggguucaagcacgugucccacgucggcugggacccccagaacggguucgacgugaacaaccucgaccccgaccugcgcagccuguucucccgggccggcaucagcgaggcgcagcucacggacgccgagaccuccaagcugaucuacgacuucaucgaggaccaggggggccuggaggccgugcgccaggagaugcggcgccaggagccgcucccccccccgcccccccccagccggggcgggaaccagcugccgcgcccccccaucgucggcgggaacaagggccgcuccgggccccugccgcccgugccccucggcaucgcccccccgccccccaccccccggggcccgcccccccccgggcgcggcgggccgcccccccccccgccccccgccaccggccggagcggcccgcugcccccccccccgcccggggcgggcgggccccccaugccgcccccccccccgcccccccccccgccccccagcuccggcaacgggcccgccccgcccccccugcccccggcccucgugcccgccggcggccuggcccccgggggcgggcgcggcgcgcugcucgaccagauccggcaggggauccagcugaacaagacgcccggcgccccggagagcuccgcccugcagccccccccgcagagcuccgagggccucgucggggcccugaugcacgugaugcagaagcgcagccgggcgauccacuccagcgacgagggcgaggaccaggccggggacgaggacgaggacgacgagugggacgacuga

SEQ ID NO: 38669 - RNA, 1518 nt, Artificial Sequence
  derived and/or modified sequence opt1 from WASL__Homo_sapiens__NP_003932
augagcuccgugcagcagcagcccccgcccccccgccgggucaccaacgugggcagccugcuccugaccccccaggagaacgagucccuguucacguuccucgggaagaagugcgugaccaugagcuccgccgucgugcagcuguacgccgcggaccgcaacugcauguggagcaagaagugcuccggcguggccugccuggucaaggacaacccgcagcggagcuacuuccuccgcaucuucgacaucaaggacgggaagcugcugugggagcaggagcucuacaacaacuucguguacaacuccccccggggcuacuuccacaccuucgccggggacaccugccagguggcccugaacuucgccaacgaggaggaggcgaagaaguuccgcaaggccgucacggaccugcucggccggcgccagcggaagagcgagaagcgccgggacccccccaacggcccgaaccugcccauggccaccguggacaucaagaaccccgagaucaccaccaaccgcuucuacgggccccaggugaacaacaucucccacacgaaggagaagaagaagggcaaggccaagaagaagcggcugaccaaggcggacaucgggaccccgagcaacuuccagcacaucggccacgucgggugggaccccaacaccggcuucgaccucaacaaccuggaccccgagcugaagaaccucuucgacaugugcggcaucuccgaggcccagcugaaggaccgcgagacgagcaaggugaucuacgacuucaucgagaagaccgggggcguggaggccgucaagaacgagcugcggcgccaggcccccccgcccccccccccgucccgggggggccccccccccccgcccccccccccgcacaacagcggcccccccccgccccccgcccgcgggcggggcgcgcccccgcccccccccucccgcgccccgaccgccgcccccccccccccgccccccagccggcccuccguggccgugccgcccccccccccgaaccgcauguaccccccccccccgcccgcgcuccccagcagcgccccguccgggcccccccccccgccccccagcguccugggcguggggcccguggccccgcccccccccccgcccccccccccgccccccggccccccgcccccccccggccugccguccgacggggaccaccagguccccaccacggccggcaacaaggccgcgcuccuggaccagauccgcgagggggcccagcugaagaagguggagcagaacagccggcccguguccugcagcggccgcgacgcccuccuggaccagauccggcaggggauccagcugaaguccgucgccgacggccaggagagcacccccccgacccccgcccccaccuccggcaucgugggggcgcucauggaggucaugcagaagcgcagcaaggccauccacuccagcgacgaggacgaggacgaggacgacgaggaggacuucgaggacgacgacgagugggaggacuga

SEQ ID NO: 38670 - RNA, 1092 nt, Artificial Sequence
  derived and/or modified sequence opt1 from WBP1L__Homo_sapiens__NP_001077382
auggagcgccggcgccugcucggcgggauggcccugcugcuccugcaggcccugcccagcccccucuccgcgcgggccgagccgccccaggacaaggaggccugcgugggcaccaacaaccagagcuacaucugcgacaccgggcacugcugcggccagucccagugcugcaacuacuacuacgagcuguggugguucuggcuggucuggacgaucaucaucauccucagcugcugcugcgugugccaccaccgccgggccaagcaccgccugcaggcccagcagcggcagcacgagaucaaccugaucgcguaccgcgaggcccacaacuacuccgcccuccccuucuacuuccgguuccugcccaacuaccugcucccgcccuacgaggagguggucaaccgcccgcccaccccgccgccgcccuacagcgccuuccagcugcagcagcagcagcugcucccgccccagugcgggcccgcgggcggcuccccgcccgggaucgaccccacccggggcagccagggggcccaguccagcccccuguccgagcccagccgcuccagcacccggccgcccuccaucgccgaccccgaccccagcgaccugcccguggaccgcgccgccacgaaggcgcccggcauggagcccuccgggagcguggccggccucggcgagcuggaccccggggccuuccuggacaaggacgccgagugccgggaggagcuccugaaggacgacuccagcgagcacggcgcccccgacagcaaggagaagacccccgggcgccaccggcgcuucaccggcgacuccggcaucgaggucugcgugugcaaccgggggcaccacgacgacgaccugaaggaguucaacacccucaucgacgacgcgcuggacggcccccuggacuucugcgacagcugccacgugcgcccgcccggggacgaggaggagggccucugccaguccagcgaggagcaggcccgggagcccgggcacccccaccucccccgcccgcccgccugccugcugcugaacacgaucaacgagcaggacucccccaacagccaguccagcuccagccccuccuga

SEQ ID NO: 38671 - RNA, 786 nt, Artificial Sequence
  derived and/or modified sequence opt1 from WBP2__Homo_sapiens__NP_036610
auggcccugaacaagaaccacagcgagggcgggggcgugaucgucaacaacaccgaguccauccucaugagcuacgaccacguggagcugaccuucaacgacaugaagaacgugcccgaggccuucaaggggacgaagaagggcaccgucuaccugaccccguaccgcgugaucuuccucuccaaggggaaggacgcgaugcagagcuucaugaugcccuucuaccugaugaaggacugcgagaucaagcagcccguguucggcgccaacuacaucaagggcaccgucaaggccgaggccgggggcgggugggagggcuccgccagcuacaagcugacguucaccgcggggggcgccaucgaguucggccagcggaugcuccagguggccucccaggccagccgcggggaggugcccuccggcgcguacggguacagcuacaugccguccggcgccuacgucuaccccccccccguggccaacggcauguacccgugcccccccggguaccccuacccgcccccccccccggaguucuaccccggcccccccaugauggacggggccaugggcuacgugcagccgcccccccccccguaccccgggcccauggagcccccggucagcggccccgacgugcccuccaccccggccgcggaggccaaggccgccgaggccgcggccagcgccuacuacaaccccggcaacccccacaacguguacaugcccaccucccagccgcccccccccccguacuacccccccgaggacaagaagacgcaguga

SEQ ID NO: 38672 - RNA, 1797 nt, Artificial Sequence
  derived and/or modified sequence opt1 from WBSCR17__Homo_sapiens__NP_071924
auggccagccugcgccgggugaagguccuccuggugcugaaccucaucgccguggcgggcuucguccuguuccuggccaagugccgccccaucgccgugcgguccggggacgccuuccacgagauccgcccgcgggccgagguggcgaaccucagcgcccacuccgccagccccauccaggacgccguccugaagcgccugucccuccuggaggacaucguguaccggcagcugaacggccucagcaagucccuggggcugaucgagggcuacgggggccgcggcaagggcgggcuccccgcgacccugagccccgccgaggaggagaaggccaaggggccgcacgagaaguacggcuacaacuccuaccugagcgagaagaucucccucgaccggagcauccccgacuaccgccccaccaagugcaaggagcugaaguacuccaaggaccugccccagaucagcaucaucuucaucuucgugaacgaggcccucuccgucauccugcggagcgugcacuccgccgugaaccacacgccgacccaccuccugaaggagaucauccuggucgacgacaacagcgacgaggaggagcugaaggugccccucgaggaguacgugcacaagcgcuaccccgggcuggucaagguggugcggaaccagaagcgcgagggccugauccgggcgcgcaucgagggcuggaaggucgccaccggccaggugaccggguucuucgacgcccacguggaguucacggccgggugggccgagcccguccucucccggauccaggagaaccgcaagcgggugauccugccgagcaucgacaacaucaagcaggacaacuucgaggugcagcgcuacgagaacagcgcgcacggcuacuccugggagcuguggugcauguacaucagcccgcccaaggacuggugggacgccggcgaccccucccuccccauccggacccccgccaugaucgggugcagcuucgucgugaaccgcaaguucuucggcgagaucgggcugcuggaccccggcauggacgucuacgggggcgagaacaucgagcucggcaucaagguguggcugugcgggggcuccauggaggugcugcccugcagccgcgucgcccacaucgagcggaagaagaagccguacaacuccaacaucggguucuacaccaagcgcaacgcccuccggguggcggagguguggauggacgacuacaagagccacgucuacaucgccuggaaccugccccuggagaaccccggcaucgacaucggggacguguccgagcgccgggcccuccgcaagagccugaagugcaagaacuuccagugguaccuggaccacguguaccccgagaugcggcgcuacaacaacaccgucgccuacggcgagcuccggaacaacaaggccaaggacgugugccuggaccagggcccgcuggagaaccacacggcgauccucuaccccugccacggguggggcccccagcuggcccgcuacaccaaggagggguuccugcaccugggcgcccucgggaccaccacgcugcugcccgacacccggugccucguggacaacuccaagagccgccugccgcagcugcucgacugcgacaaggucaaguccagccuguacaagcgguggaacuucauccagaacggcgccaucaugaacaagggcaccgggcgcugccuggagguggagaaccggggccucgcggggaucgaccugauccugcgcuccugcaccggccagcgguggacgaucaagaacagcaucaaguga

SEQ ID NO: 38673 - RNA, 897 nt, Artificial Sequence
  derived and/or modified sequence opt1 from WBSCR22__Homo_sapiens__NP_001189489
auggccagccgcggccggcgccccgagcacgggggcccgcccgagcuguucuacgacgagaccgaggcccggaaguacgugcgcaacucccggaugaucgacauccagacccgcauggcggggcgggcccucgagcugcuguaccuccccgagaacaagcccugcuaccugcuggacaucggcugcgggacgggccucagcggcuccuaccugagcgacgaggggcacuacugggucggccuggacaucuccccggccaugcucgacgaggccguggaccgcgagaucgagggggaccugcugcucggcgacauggggcagggcauccccuucaagcccggcaccuucgacgggugcaucagcaucuccgccgugcaguggcugugcaacgcgaacaagaaguccgagaaccccgccaagcggcuguacugcuucuucgccagccucuucagcguccuggugcgcggcucccgggccgugcugcagcucuacccggagaacagcgagcagcuggagcugaucaccacccaggcgacgaaggccggguucuccggcggcauggucguggacuaccccaacagcgccaaggccaagaaguucuaccucugccuguucuccgggcccagcaccuucauccccgagggccuguccgagaaccaggacgagguggagccgcgcgagagcgucuucaccaacgagcgggagggcggggccuucgagcgccgggggauccgcggccaccagacccggcgcuucccccuccggaugucccgccggggcauggugcgcaagagccgcgcgugggugcuggagaagaaggagcggcaccgccggcaggggcgcgagguccggcccgacacgcaguacaccggccgcaagcggaagccccgcuucuga

SEQ ID NO: 38674 - RNA, 1203 nt, Artificial Sequence
  derived and/or modified sequence opt1 from WDFY2__Homo_sapiens__NP_443182
auggccgccgagauccagcccaagccgcugacccgcaagcccauccuccugcagcggauggagggcagccaggagguggucaacauggcggugaucgugcccaaggaggagggggucaucuccgugagcgaggaccgcaccgugcgggucuggcugaagcgcgacuccggccaguacuggcccagcguguaccacgccaugccgucccccugcagcugcauguccuucaaccccgagacgcggcgccucagcaucgggcuggacaacggcaccaucuccgaguucauccugagcgaggacuacaacaagaugacccccgugaagaacuaccaggcccaccagucccgggucaccaugauccucuucgugcuggagcuggagugggugcucagcacggggcaggacaagcaguucgccuggcacugcuccgagagcggccagcgccugggcggguaccggaccuccgccgucgcgagcggccugcaguucgacguggagacccgccacguguucaucggggaccacuccggccaggucaccauccucaagcuggagcaggagaacugcacgcuggugaccaccuuccgggggcacaccggcggcgugacggcccucugcugggacccgguccagcgcgugcuguucagcggguccagcgaccacagcgugaucaugugggacaucggcgggcggaagggcaccgccaucgagcugcagggccacaacgaccgcguccaggcccucuccuacgcgcagcacacccggcagcugaucagcugcgggggcgacgggggcaucgugguguggaacauggacgucgagcgccaggagacccccgaguggcuggacuccgacagcugccagaagugcgaccagcccuucuucuggaacuucaagcagaugugggacuccaagaagaucgggcuccggcagcaccacugccgcaagugcggcaaggccgugugcggcaagugcagcuccaagcggagcuccaucccccugaugggguucgaguucgagguccgcgugugcgacagcugccacgaggccaucacggacgaggagcgggccccgaccgccaccuuccacgacuccaagcacaacaucgugcacguccacuucgacgcgacccgcggcuggcugcucacgagcgggaccgacaaggugaucaagcugugggacaugacccccguggucuccuga

SEQ ID NO: 38675 - RNA, 9555 nt, Artificial Sequence
  derived and/or modified sequence opt1 from WDFY4__Homo_sapiens__NP_065996
auggaggccgaggaccugagcaaggccgaggaccgcaacgaggaccccggcuccaagaacgaggggcagcucgcggccgugcagccggacgucccccacggcgggcagagcuccagccccaccgcccugugggacaugcuggagcggaaguuccucgaguaccagcagcugacccacaagucccccaucgagcgccagaagagccugcucucccugcugccgcucuuccugaaggccugggagcacagcgugggcaucaucugcuuccccucccugcagcggcucgccgaggacgugagcgaccagcuggcgcagcagcugcagaaggcccucgucgggaagcccgccgagcaggcccgccuggcggccggccagcugcucugguggaagggcgacguggaccaggacggguaccugcugcucaaguccguguacguccugacgggcaccgacagcgagacccuggggcggguggccgaguccggccuccccgcccugcugcuccagugccuguaccuguucuucguguucccgcucgacaaggacgagcugcuggagagcgaccuccagguccagaagauguucgugcagaugcugcugaacaucugcuccgacagccaggggcucgagggccugcuguccggcagcgagcuccagucccugcugaucgccaccacgugccuccgcgagcacagcugcugcuucuggaaggagcccaccuucugcgugcugcgggcgaucagcaaggcccagaaccuguccaucauccaguaccuccaggccaccgacugcguccgccugagccugcagaaccucucccggcugaccgacacgcugcccgcccccgaggugagcgaggccgugucccugauccucggguucgucaaggacagcuacccgguguccagcgcgcuguuccuggaguucgagaacuccgagggcuacccccuccugcugaaggugcuccugcgcuacgacgggcugacccagagcgaggucgacccccaccucgaggagcugcugggccucgugguguggcugaccaccugcggccgguccgagcugaaggucuucgacagcaucacguacccccagcucgagggguucaaguuccaccacgaggccuccggcgugaccgugaagaaccugcaggccuuccagguccugcagaacguguuccacaaggccagcgacuccguccucugcauccaggugcugagcgugauccgcaccaugugggccuggaacgcgcggaacuucuuccugcucgaguggacccugcagccgaucucccaguucgucgagaucaugccccugaagcccgcccccgugcaggagcacuucuuccagcuccuggaggcccugguguucgagcuccacuacgucccgcacgagauccugcgcaaggugcagcaccugaucaaggagagccccgggcccuccugcacgcucauggcccugcagagcauccugagcaucgccggcggggacccccucuucaccgacaucuuccgggacuccggccugcugggccuccugcuggcgcagcuccgcaagcaggccaagaucaugcggaagagcgggaacaagguguccaccccgggcguccaggaccccgagcgcgagcugaccugcgugaugcugcggaucguggucacgcuccugaaggggagcgugcgcaacgccgugguccugaaggaccacggcauggugcccuucaucaagaucuuccucgacgacgagugcuaccgggaggccucccugagcauccuggagcagcucuccgcgaucaacgccgaggaguacaugagcaucaucgugggggcccugugcuccagcacccagggcgagcugcagcucaagcuggaccugcucaagucccugcugcgcauccucgucacccccaagggccgcgccgccuuccgggugagcuccggguucaacggccugcugagccuccuguccgaccuggaggggagccuccaggagccgccccugcaggcguggggcgccguguccccccgccagacccuggagcucguccuguacacgcugugcgccgugagcgccgcccuccacugggacccggugaacggguacuucuuccggcgcaacggccuguucgagaagcuggcggaggaccucugccugcugggcugcuucggggcccucgaggaggagggcaaccugcugcggagcugggucgacaccaaggcccgccccuucgccgaccuccuggggaccgccuucuccagcuccggcagccugcccccccggauccaguccugccuccagauccugggcuuccuggacagcauggcguccgggacccuccaccugcgcggcgaccugaaggagagccuccggacgaagcaggggccggugguggacguccagaagggcgagaccggguccgacccccagcgcaacuucaagcaguggcccgaccuggaggagcggauggacgagggcgacgccgccaucaugcaccccggcguggugugcaucaugguccgccugcucccgcggcuguaccacgaggaccacccccagcugagcgaggagauccagugcucccucgccagccacauccagucccuggugaagagcgagaagaaccgccaggugaugugcgaggcggggcugcugggcacccucauggccuccugccaccgggcccuggucaccagcggguccccccugcacagccgccucauccggaucuucgagaagcuggccucccaggccaucgagcccgacgugcugcgccaguuccucggccuggggaucccgagcagccuguccgcgacgaccaagauccucgacagcucccacacccaccggggcaaccccggcugcagcgggucccagaccgcccagggccuggccgaggggcccuggcccgccgccccggacgcgggccugcaccccggggugacgcaggccccccagccccucggcgagagccaggacuccaccaccgcccugcagaccgcccugagccucaucuccaugaccagcccgcgcaaccugcagccccagcgcgccgcgcuggcccccuccuucgucgaguucgacaugagcguggagggcuacgggugccucuucauccccacgcuguccaccgugaugggcaccagcaccgaguacuccgucagcgggggcaucgggacgggcgccacccggccguucccccccccgggcgggcugaccuucuccugcugguuccucaucagccgccacggcgccgcgaccgaggggcacccccugcgguuccugacgcucgugcgccaccuggcccggaccgagcagcccuucgugugcuucuccgucagccugugccccgacgaccucagccuggugguguccaccgaggagaaggaguuccagccgcuggacgucauggagcccgaggacgacagcgagcccuccgccggcugccagcuccaggugcgcugcggccagcugcuggccugcgggcaguggcaccaccucgccguggucgugaccaaggagaugaagcggcacugcacggugagcaccugccuggacggccaggucaucggguccgcgaagaugcuguacauccaggcccuccccggcccguuccugagcauggaccccuccgccuucguggacgucuacggguacaucgccaccccccgcguguggaagcagaagagcucccugaucuggcggcucggccccaccuaccuguucgaggaggccaucagcauggagacgcuggaggugaucaacaagcucggcccgcgcuacugcgggaacuuccaggcgguccacgugcagggcgaggaccuggacuccgaggccacccccuucguggccgaggagcgggucagcuucgggcugcacaucgccuccagcuccaucaccagcguggccgacauccgcaacgcguacaacgagguggacucccggcucaucgccaaggagaugaacaucagcucccgcgacaacgccaugcccgucuuccugcugcggaacugcgccggccaccucagcgggagccugcgcaccaucggcgccguggcggugggccagcuggggguccggguguuccacuccagccccgccgccuccagccucgacuucaucggcgggccggccauccugcugggccucaucucccuggcgacggacgaccacaccauguacgccgccgugaagguccugcacagcgugcucaccuccaacgccaugugcgacuuccugaugcagcacaucugcggguaccagaucauggccuuccugcuccgcaagaaggcgagccugcugaaccaccggaucuuccagcucauccuguccguggccggcaccgucgagcugggcuuccgcagcuccgccaucacgaacaccgggguguuccagcacauccucugcaacuucgagcuguggaugaacaccgccgacaaccuggagcucagccuguucucccaccugcucgagauccugcagagcccccgggagggcccccgcaacgccgaggcggcccaccaggcccagcugauccccaagcucaucuuccuguucaacgagccgucccugauccccagcaagaucuccaccaucaucgggauccucgccugccagcugcgcggccacuucagcacgcaggaccugcuccggaucggccuguucguggucuacacccugaagcccuccagcgugaacgagcgccagaucugcauggacggggcccucgaccccagccugccggcgggcucccagaccagcgggaagaccaucuggcugcggaaccagcuccuggagaugcugcucuccgugaucagcuccccccagcugcaccugagcuccgagagcaaggaggagauguuccucaagcugggccccgacugguuccugcuccugcugcaggggcaccuccacgccuccacgaccguccuggcccugaagcugcuccuguacuuccuggccagccccucccuccgcacccgguuccgcgacggccugugcgcgggcagcuggguggagcgguccaccgaggggguggacaucgucauggacaaccugaagagccaguccccgcuccccgagcagagccccugccugcugccgggcuuccgcgugcucaacgacuuccuggcccaccacgugcacauccccgaggucuaccugaucguguccacguucuuccuccagaccccccugaccgagcugauggacgggcccaaggacagccucgacgccaugcugcaguggcugcuccagcggcaccaccaggaggaggugcugcaggccggccugugcaccgagggggcccuccugcugcucgagaugcugaaggcgaccaugucccagccgcuggccggcagcgaggacggcgccugggcccagacguuccccgccagcguccuccaguuccugucccuggugcaccgcaccuacccccaggaccccgcguggcgggccccggaguuccuccagacccuggccaucgccgccuucccccugggggcgcagaagggcgugggggccgagagcacccgcaacacguccagccccgaggccgccgcggagggcgacuccaccgucgaggggcuccaggcccccaccaaggcccacccggcccggcgcaagcugcgggaguucacccagcugcuccugcgcgagcugcuccugggcgccagcucccccaagcaguggcugccccucgaggugcugcuggaggcgagccccgaccacgccacgucccagcagaagcgggacuuccagagcgaggugcuccuguccgccauggagcuguuccacaugaccagcggcggggacgccgccauguuccgcgacggcaaggagccgcagcccuccgcggaggccgccgccgcccccagccucgcgaacaucuccugcuucacccagaagcuggucgagaagcuguacagcgggauguucuccgccgacccccggcacauccuccuguucauccuggagcacaucaugguggugaucgagaccgccagcagccagcgcgacacgguccucuccacccuguacagcucccugaacaaggugauccucuacugccugagcaagccgcagcagucccugagcgagugccucggccugcuguccauccucggguuccugcaggagcacugggacguggucuucgccaccuacaacagcaacaucuccuuccugcucugccugaugcacugccugcuccugcugaacgagcgcagcuaccccgagggcuucggccucgagcccaagccccggauguccaccuaccaccagguguuccugagcccgaacgaggacgugaaggagaagcgcgaggaccugcccucccucagcgacguccagcacaacauccagaagacggugcagacccuguggcagcagcugguggcccagcggcagcagacccucgaggacgcguucaagaucgaccuguccgucaagcccggggagcgcgaggugaagaucgaggaggucaccccccugugggaggagacgaugcucaaggccuggcagcacuaccuggccagcgagaagaagucccuggccagccgguccaacguggcgcaccacagcaaggugacccucuggagcggcucccugagcuccgccaugaagcugaugccggggcgccaggccaaggaccccgagugcaagaccgaggacuucgucagcugcaucgagaacuaccggcgccggggccaggagcucuacgccucccuguacaaggaccacgugcagcgccggaagugcggcaacaucaaggccgcgaacgccugggcccgcauccaggagcagcuguucggggagcucggccuguggagccagggggaggagaccaagcccugcuccccgugggagcuggacuggcgggagggccccgcccgcaugcggaagcgcaucaagcggcucagcccccuggaggcccuguccagcgggcgccacaaggagucccaggacaagaacgaccacaucagccagacgaacgcggagaaccaggacgagcucacccugcgggaggccgagggcgagcccgacgaggugggcgucgacugcacccagcugaccuucuucccggcccugcacgagucccuccacagcgaggacuuccuggagcugugccgcgagcggcaggugauccuccaggagcugcuggacaaggagaaggugacgcagaaguucucccucgucaucgugcaggggcaccuggugagcgagggcguccugcucuucgggcaccagcacuucuacaucugcgagaacuucacccugucccccaccggcgacguguacugcacccgccacugccugagcaacaucuccgaccccuucaucuucaaccucugcagcaaggaccgcagcacggaccacuacuccugccagugccacagcuacgccgacaugcgggagcugcgccaggcccgguuccugcuccaggacaucgcgcuggagaucuucuuccacaacggguacuccaaguuccugguguucuacaacaacgaccgcagcaaggccuucaaguccuucugcagcuuccagcccucccucaagggcaaggccaccagcgaggacacccugucccugcggcgcuacccgggcagcgaccggaucaugcuccagaaguggcagaagcgcgacaucuccaacuucgaguaccugauguaccugaacaccgccgcggggcggacgugcaacgacuacaugcaguaccccgucuuccccugggugcucgccgacuacaccagcgagacccugaaccuggccaaccccaagaucuuccgcgaccucuccaagccgaugggcgcccagaccaaggagcggaagcugaaguucauccagcgcuucaaggagguggagaagaccgagggggacaugacgguccagugccacuacuacacccacuacagcuccgccaucaucguggcgagcuaccuggugcggaugccccccuucacccaggccuucugcgcccuccagggcggguccuucgacgucgccgaccgcauguuccacagcgugaaguccaccugggagagcgccagccgggagaacauguccgacgugcgcgagcugacgcccgaguucuucuaccugccggaguuccucaccaacugcaacggcgucgaguucggcugcaugcaggacgggaccgugcugggcgacgugcagcugccccccugggcggacggggacccccggaaguucaucagccuccaccgcaaggcccuggaguccgacuucgucagcgccaaccugcaccacuggaucgaccucaucuucggcuacaagcagcaggggccggccgccguggacgcggugaacaucuuccaccccuacuucuacggcgaccggauggaccuguccagcaucaccgacccccugaucaaguccacgauccucggcuucgucagcaacuucgggcaggugcccaagcagcuguucaccaagccgcaccccgcccgcaccgccgccggcaagccccugccggggaaggacguguccacccccgucagccuccccggccacccccagccguucuucuacucccugcagagccugcgccccucccaggugacggugaaggacauguaccucuucagccugggcuccgagagccccaagggggcgaucggccacaucgucuccaccgagaagaccauccuggccguggagcggaacaaggugcuccugcccccgcuguggaaccgcaccuucagcuggggguucgacgacuucuccugcugccucggcagcuacgggagcgacaagguccugaugacguucgagaaccuggccgccuggggccggugccucugcgccgugugccccucccccaccaccaucgugaccagcggcacguccaccgucgugugcgugugggagcugagcaugaccaaggggcgcccccggggccugcgccuccggcaggcgcuguacgggcacacccaggccgucacgugccuggccgccuccgugaccuucagccuccugguguccggcagccaggacugcaccugcauccugugggaccucgaccaccugacccacgucacgcgccugccggcccaccgggaggggaucuccgcgaucaccaucagcgacguguccggcaccaucgugagcugcgccggcgcccaccucucccuguggaacgucaacgggcagccccuggccagcaucaccacggccuggggccccgagggggcgaucaccugcugcugccucauggagggccccgccugggacaccucccagaucaucaucaccgggagccaggacggcauggugcgcgucuggaagacggaggacgugaagauguccgugccgggccggcccgccggggaggagccccccgcccagccgcccagcccccgcggccacaagugggagaagaaccuggcccugucccgggagcucgacgucagcaucgcgcugaccgggaagcccagcaagaccuccccggccgugaccgcccuggccgugagccgcaaccacacgaagcuccuggucggcgacgagcggggccgcaucuucugcugguccgcggacggguga

SEQ ID NO: 38676 - RNA, 3021 nt, Artificial Sequence
  derived and/or modified sequence opt1 from WDHD1__Homo_sapiens__NP_001008397
auggacagcucccagcagaagaccuuccgcggccacgacgcccccgugcugagccucuccuucgacccgaaggacaucuuccuggccagcgcguccugcgacgggagcguccggguguggcagaucuccgaccagaccugcgccaucagcuggccccugcuccagaagugcaacgacgugaucaacgccaaguccaucugccgccuggccuggcagcccaagagcggcaagcugcucgccauccccgucgagaaguccgugaagcuguaccggcgcgagagcuggucccaccaguucgaccugagcgacaacuucaucucccagacgcucaacaucgugaccuggagcccgugcgggcaguaccuggcggccggcuccaucaacgggcugaucaucgucuggaacguggagaccaaggacugcauggagcgggugaagcacgagaagggcuacgccaucugcggccucgccuggcacccgaccugcgggcgcaucagcuacacggacgcggagggcaaccuggggcugcucgagaacgucugcgaccccuccggcaagaccagcagcuccaaggugagcucccggguggagaaggacuacaacgaccuguucgacggggacgacaugagcaacgccggcgacuuccugaacgacaacgccgucgagauccccuccuucagcaagggcaucaucaacgacgacgaggacgacgaggaccucaugauggccuccgggcgcccccggcagcgcagccacauccuggaggacgacgagaacuccguggacaucagcaugcugaagaccggcuccagccuccugaaggaggaggaggaggacgggcaggagggcuccauccacaaccugccccucgugaccagccagcggcccuucuacgacggccccaugccgacgccccgccagaagcccuuccaguccgggagcacgccccugcaccugacccaccgguucauggucuggaacuccaucggcaucauccgcugcuacaacgacgagcaggacaacgccaucgacguggaguuccacgacaccagcauccaccacgcgacccaccucuccaacacccugaacuacaccaucgccgaccugagccacgaggccauccuccuggccugcgagagcaccgacgagcuggccuccaagcuccacugccugcacuucagcuccugggacagcuccaaggaguggaucaucgaccugccgcagaacgaggacaucgaggcgaucugccucgggcagggcugggccgccgccgccacgagcgcgcugcugcuccggcuguucaccaucgggggcgugcagaaggaggucuucucccuggccggccccguggugagcauggccgggcacggcgagcagcuguucaucgucuaccaccgcgggaccggcuucgacggggaccagugccucggcgugcagcugcucgagcugggcaagaagaagaagcagauccugcacggggacccccucccccugacccggaaguccuaccuggccuggaucggcuucagcgccgaggggacgccgugcuacguggacuccgagggcaucguccgcaugcugaaccgggggcucggcaacaccuggacccccaucugcaacacccgcgagcacugcaagggcaagagcgaccacuacuggguggucgggauccacgagaacccccagcagcugcggugcauccccugcaagggcucccgcuucccgcccacgcugccccgccccgcgguggccauccucagcuucaagcugccguacugccagaucgccaccgagaaggggcagauggaggagcaguucuggcgguccgugaucuuccacaaccaccuggacuaccucgccaagaacggcuacgaguacgaggagagcaccaagaaccaggcgaccaaggagcagcaggagcugcugaugaagaugcucgcccuguccugcaagcuggagcgcgaguuccggugcgucgagcucgccgaccugaugacgcagaacgccgugaaccuggccaucaaguacgcgagccgcagccggaagcucauccuggcccagaagcuguccgagcucgccguggagaaggccgccgagcugaccgcgacccaggucgaggaggaggaggaggaggaggacuuccgcaagaagcugaacgccggcuacagcaacaccgccacggaguggucccagccccgguuccgcaaccagguggaggaggacgccgaggacagcggggaggccgacgacgaggagaagcccgagauccacaagccgggccagaacuccuucagcaaguccaccaacagcuccgacgugagcgcgaaguccggggccgucaccuucagcucccagggccgggugaaccccuucaaggugagcgccuccagcaaggagcccgccauguccaugaacagcgcgcgcuccaccaacauccucgacaacaugggcaagagcagcaagaaguccacggcccugagccggaccaccaacaacgagaagucccccaucaucaagccgcugauccccaagcccaagcccaagcaggccagcgccgccuccuacuuccagaagcgcaacagccagaccaacaagaccgaggaggucaaggaggagaaccucaagaacgugcuguccgagacgccggcgaucugcccgccccagaacaccgagaaccagcggcccaagaccggguuccagauguggcuggaggagaaccgcagcaacauccucuccgacaaccccgacuucagcgacgaggccgacaucaucaaggagggcaugauccgguuccgcgugcuguccaccgaggagcggaaggucugggccaacaaggccaagggggagacggccagcgagggcaccgaggcgaagaagcgcaagcgggugguggacgaguccgacgagaccgagaaccaggaggagaaggccaaggagaaccugaaccucagcaagaagcagaagccccuggacuucuccaccaaccagaagcugagcgccuucgccuucaagcaggaguga

SEQ ID NO: 38677 - RNA, 2241 nt, Artificial Sequence
  derived and/or modified sequence opt1 from WDPCP__Homo_sapiens__NP_056994
augcgccgggaguucugcugggacgccuacagcaaggccgccggcucccgcgccagcagcccccugccgcggcaggaccgcgacagcuucugccaccagauguccuucugccucaccgagcugcaccuguggagccucaagaacacccugcacaucgccgaccgggacaucgggaucuaccaguacuacgacaagaaggacccgcccgccaccgagcacggcaaccuggagaagaagcagaagcucgccgagucccgcgacuaccccuggacccugaagaaccggcgccccgagaagcugcgggacagccucaaggagcuggaggagcugaugcagaacucccgcugcgugcucagcaaguggaagaacaaguacgucugccagcugcuguucggguccggcgugcucgugagccugucccugagcgggccccagcucgagaaggucgugaucgaccggucccuggugggcaagcugaucagcgacaccaucuccgacgcgcuccugaccgacagcuucaucauccuguccuuccucgcccagaacaagcugugcuucauccaguucacgaagaagauggagagcagcgacgucaacaagcgccuggagaagcucuccgcccuggacuacaagaucuucuacuacgagauccccggccccaucaacaagaccaccgagcggcaccuggccaucaacugcgugcacgaccgcguggucugcugguggccgcucgugaacgacgacgcguggcccugggcccccaucagcuccgagaaggaccgggccaaccugcugcuccugggguacgcccagggccgccuggaggugcucagcuccguccggaccgagugggacccccuggacgugcgcuucgggacgaagcagccguaccagguguucaccgucgagcacagcguguccguggacaaggagcccauggccgacagcugcaucuacgagugcauccggaacaagauccagugcgucuccgugacccgcaucccccugaaguccaaggcgaucuccugcugccggaacgugaccgaggacaagcucauccugggcugcgaggacagcucccugauccucuacgagacgcaccgccgcgucacccugcuggcccagaccgagcuccugcccagccugaucuccugccacccgagcggggccauccuccuggugggcuccaaccagggcgagcugcagaucuucgacauggcccugagccccaucaacauccagcuccuggccgaggaccggcugccccgcgagacccuccaguucuccaagcuguucgacgcgagcagcucccuggugcagaugcaguggaucgcgccccaggucgugagccagaagggggagggcuccgacaucuacgaccuccuguuccugcgguucgagcgcgggccgcucggcguccugcuguucaagcucggcguguucacgcgggggcagcugggccugaucgacaucaucuuccaguacauccacugcgacgagaucuacgaggccaucaacauccucagcuccaugaacugggacacccuggggcaccagugcuucaucagcauguccgccaucgugaaccaccuccugcgccagaagcugacccccgagcgggaggcccagcuggagaccagccucggcacguucuacgcccccacccgcccccugcuggacuccaccauccucgaguaccgggaccagaucagcaaguacgcccgccgguucuuccaccaccuccugcgcuaccagcgguucgagaaggccuuccugcuggccgucgacgugggggcccgcgaccuguucauggacauccacuaccucgcgcuggacaagggcgagcuggcccucgccgagguggcccggaagcgcgcguccgacaucgacgccgagagcaucaccuccggcgucgagcugcuggggccgcucgaccggggcgacaugcugaacgaggccuucaucgggcugagccucgcgccccagggcgaggacuccuuccccgacaaccugcccccgagcugccccacgcaccgccacauccugcagcagcggauccucaacggguccagcaaccgccagaucaucgaccgccggaacgagcuggagaaggacaucugcagcggcuuccugaugaccaacacgugcaacgccgaggacggcgagcuccgcgaggacgggcgggagcaggagauccgcgacggcgggucccugaagaugauccacuucggccugguguga

SEQ ID NO: 38678 - RNA, 3675 nt, Artificial Sequence
  derived and/or modified sequence opt1 from WDR11__Homo_sapiens__NP_060587
augcugcccuacaccgugaacuucaaggucagcgcccgcacccucacgggcgcccugaacgcgcacaacaaggccgccguggacuggggguggcagggccugaucgccuacgggugccacucccucguggucgugaucgacagcaucaccgcccagacccuccaggugcuggagaagcacaaggcggacgucgugaaggugaagugggcccgggagaacuaccaccacaacaucggcuccccguacugccugcgccuggccagcgccgacgucaacgggaagaucaucgugugggacguggcggccggcgucgcccagugcgagauccaggagcacgccaagcccauccaggacgugcaguggcuguggaaccaggacgccucccgggaccuccugcuggcgauccacccgcccaacuacaucgugcucuggaacgccgacaccggcacgaagcuguggaagaaguccuacgccgacaacauccuguccuucagcuucgaccccuucgaccccucccaccucacccugcugaccagcgaggggaucgucuucaucuccgacuucagccccuccaagcccccgagcggccccgggaagaagguguacaucuccagcccccacuccagccccgcccacaacaagcucgccaccgcgacgggcgccaagaaggcccugaacaaggugaagauccugaucacccaggagaagccguccgccgaguucaucacccucaacgacugccugcagcuggccuaccuccccagcaagcgcaaccacaugcugcugcucuacccccgggagauccugauccuggaccucgaggucaaccagaccgugggggugaucgcgaucgagcgcacgggcguccccuuccuccaggugaucccgugcuuccagcgggacggccuguucugccugcacgagaacgggugcaucacccugcgcgugcggcgcagcuacaacaacaucuucaccaccuccaacgaggagcccgaccccgaccccguccaggagcugacguacgaccuccggagccagugcgacgccauccgcgugaccaagaccguccggccguucuccauggugugcugccccgugaacgagaacgccgccgcccuggucgugagcgacggccgcgugaugaucugggagcugaaguccgcggucugcaaccggaacagccgcaacuccagcuccggggugagcccccucuacucccccgugagcuucugcggcaucccggucggcgugcugcagaacaagcugcccgaccucucccuggacaacaugaucgggcagagcgccaucgccggcgaggagcacccccggggguccauccugcgcgaggugcaccucaaguuccugcugaccggccuccugagcgggcugcccgccccgcaguucgcgauccggaugugcccgccccugacgaccaagaacaucaagauguaccagccccuccuggccgucggcaccuccaacggcagcgugcugguguaccaccucaccuccgggcugcugcacaaggagcucagcauccacagcugcgaggucaagggcaucgaguggacgucccugaccagcuuccuguccuucgccaccagcacccccaacaacauggggcucgugcgcaacgagcugcagcugguggaccuccccacgggccgguccaucgccuuccgcggggagcgcggcaacgacgagagcgccaucgagaugaucaaggucucccaccugaagcaguaccuggcggugguguuccgggacaagccccucgagcugugggacguccggaccugcacccugcuccgcgagaugagcaagaacuucccgaccaucacggcccuggaguggucccccagccacaaccugaagucccuccgcaagaagcagcuggccacccgggaggccauggcccgccagaccguggugagcgacaccgagcuguccaucgucgagagcuccgugaucagccuccugcaggaggcggaguccaagagcgagcugagccagaacaucuccgcccgggagcacuucguguucacggacaucgacggccaggucuaccaccucaccguggaggggaacagcgugaaggacuccgcccgcaucccgcccgacggcagcaugggguccaucacgugcaucgccuggaagggcgacacccugguccugggggacauggacggcaaccucaacuucugggaccugaagggccgggugagccgcgggauccccacccaccgguccugggugcgcaagauccgguucgcccccggcaaggggaaccagaagcugaucgcgauguacaacgacggcgccgaggucugggacaccaaggaggugcagauggugagcucccuccgcagcggccggaacgucaccuuccgcauccuggacguggacuggugcaccuccgacaaggugauccuggccagcgacgacgggugcauccggguccucgagauguccaugaaguccgccugcuuccgcauggacgagcaggagcugaccgagcccguguggugccccuaccugcucgugccgcgggcgagccuggcccugaaggccuuccuccugcaccagcccuggaacggccaguacagccuggacaucucccacgucgacuaccccgagaacgaggagaucaagaaccuccugcaggagcagcugaacagccucuccaacgacaucaagaagcugcugcucgaccccgaguucacgcugcugcagcgcugccuccuggugagccgccuguacggggacgagagcgagcuccacuucuggaccguggccgcccacuaccugcacucccugagccaggagaaguccgcgagcaccaccgccccgaaggaggccgcgccccgggacaagcucuccaacccccuggacaucugcuacgacguccugugcgagaacgccuacuuccagaaguuccagcucgagcgcgugaaccugcaggaggugaagcggagcacguacgaccacacccgcaagugcaccgaccagcugcuccugcugggccagaccgaccgggccguccagcuccugcuggagacguccgccgacaaccagcacuacuacugcgacagccucaaggccugccuggugaccaccgugaccuccagcgggcccucccagagcacgaucaagcuggucgccaccaacaugaucgccaacggcaagcucgcggagggcgugcagcugcugugccucaucgacaaggccgccgacgccugccgcuaccugcagaccuacggggaguggaaccgggcggccuggcuggccaagguccgccucaacccggaggagugcgccgacgugcugcggcgcuggguggaccaccugugcagcccccaggucaaccagaaguccaaggcccuccuggugcugcucagccugggcugcuucuucagcguggcggagacccugcacuccaugcgguacuucgaccgcgccgcccucuucgucgaggccugccugaaguacggggccuucgaggugacggaggacaccgagaagcugaucaccgcgaucuacgccgacuacgcccggagccucaagaaccugggcuucaagcagggggccgugcuguucgccuccaaggcgggcgccgccggcaaggaccugcucaacgagcuggagagccccaaggaggagcccaucgaggaguga

SEQ ID NO: 38679 - RNA, 1272 nt, Artificial Sequence
  derived and/or modified sequence opt1 from WDR12__Homo_sapiens__NP_060726
auggcccagcugcagacccgcuucuacaccgacaacaagaaguacgccguggacgacguccccuucagcaucccggcggccuccgagaucgccgaccucagcaacaucaucaacaagcugcugaaggacaagaacgaguuccacaagcacguggaguucgacuuccucaucaagggccaguuccugcggaugccccuggacaagcacauggagauggagaacaucuccagcgaggagguggucgagaucgaguacguggagaaguacacggcgccccagcccgagcagugcauguuccacgacgacuggaucuccagcaucaagggggccgaggaguggauccucaccggcuccuacgacaagaccagccgcaucuggucccuggaggggaaguccaucaugaccaucgugggccacacggacgucgugaaggacguggccugggucaagaaggacucccugagcugccuccugcuguccgccagcauggaccagaccauccuccugugggaguggaacguggagcggaacaaggugaaggcccugcacugcugccgcgggcacgccggcuccgucgacagcaucgcgguggacggcuccgggaccaaguucugcagcggcuccugggacaagaugcucaagaucuggagcaccgugccgacggacgaggaggacgagauggaggagagcaccaaccggccccgcaagaagcagaagaccgagcagcuggggcugacccggacgcccaucgucacccucuccggccacauggaggccgugagcuccgugcuguggagcgacgccgaggagaucugcuccgccagcugggaccacaccauccgcgucugggacguggaguccgggagccugaaguccacccucacgggcaacaagguguucaacugcaucagcuacagcccccugugcaagcggcuggccagcggcuccaccgaccgccacauccggcucugggacccgcgcaccaaggacgggagccuggucucccugagccucaccucccacacgggcugggugaccagcgugaaguggucccccacccacgagcagcagcugaucagcgggagccuggacaacaucgucaagcucugggacacccgguccugcaaggcgccccuguacgaccuggccgcccacgaggacaaggugcucagcgucgacuggacggacaccggccugcugcucuccggcggggccgacaacaagcuguacagcuaccgcuacucccccaccaccagccacgugggcgccuga

SEQ ID NO: 38680 - RNA, 3969 nt, Artificial Sequence
  derived and/or modified sequence opt1 from WDR17__Homo_sapiens__NP_733828
auggccuggaugaccuacaucagcaacugguucgagcaggacgacugguacgagggccugcagcgcgccaacaugucccaggugcggcaggucgggcuccuggcggccggcugccagcccuggaacaaggacgugugcgccgccagcggggaccgcuucgccuacugcgcgacccuggccaucuacaucuaccagcucgaccaccgguacaacgaguucaagcugcacgccaucauguccgagcacaagaagacgaucaccgccaucagcuggugcccgcacaaccccgaccuguucgcguccggcagcaccgacaaccucgugaucaucuggaacgucgccgagcagaaggugaucgccaagcuggacuccaccaaggggauccccgccagccuguccuggugcuggaacgccgaggacguggucgcguucgugagccaccgcggcccccucuucaucuggacgaucuccggcccggacagcggggugaucguccacaaggacgcccacuccuuccugagcgacaucugcauguuccgguggcacacccaccagaagggcaaggugguguucgggcacaucgacggcucccugagcaucuuccaccccgggaacaagaaccagaagcacguccuccgccccgagucccuggagggcaccgacgaggaggaccccgugaccgcccuggagugggacccgcucagcacggacuaccugcugguggucaaccuccacuacggcauccggcugguggacuccgagagccugagcugcaucaccaccuucaaccuccccuccgccgccgcgagcgugcagugccuggccuggguccccuccgcccccgggauguucaucaccggcgacagccaggugggggugcugcgcaucuggaacgucucccggacgaccccgaucgacaaccucaagcugaagaagaccggcuuccacugccugcacgugcucaacagcccgccccgcaagaaguucuccgugcagagccccaccaagaaccacuacacguccagcaccuccgaggccgucccgccgcccacccugacccagaaccaggccuucagccugccgcccggccacgcggugugcugcuuccucgacgggggcgucgggcuguacgacaugggcgccaagaagugggacuuccugcgggaccucgggcacguggagacgaucuucgacugcaaguucaagcccgacgaccccaaccugcuggccaccgccuccuucgacggcaccaucaaggugugggacaucaacacccucacggccgucuacaccagccccggcaacgagggggugaucuacucccugagcugggcgcccggcgggcugaacugcaucgccggcgggaccucccgcaacggcgccuucaucuggaacgugcagaagggcaagaucauccagcgguucaacgagcacgggaccaacggcaucuucugcaucgccuggagccacaaggacuccaagcgcaucgcgacgugcagcagcgacggguucugcaucauccggaccaucgacggcaagguccuccacaaguacaagcaccccgccgccguguucgggugcgacuggucccagaacaacaaggacaugaucgccaccggcugcgaggacaccaacgugcgcgucuacuacguggccacgagcuccgaccagccccugaagguguucagcggccacaccgcgaaggucuuccacgugaaguggagcccccugcgggaggggauccucugcuccggcuccgacgacgggaccgugcgcaucugggacuacacccaggacgccugcaucaacauccugaacggccacacggccccgguccggggccugauguggaacaccgagauccccuaccuccugaucagcggguccugggacuacaccaucaaggugugggacacccgcgaggggaccugcguggacacggucuacgaccacggcgccgacguguacggccugaccugccaccccagccggccguucaccauggccuccugcagccgcgacuccaccgugcgccucuggagccugacggcgcuggucacccccgugcagaucaacauccuggccgaccgguccugggaggagaucaucgggaacaccgacuacgccaucgagcccggcaccccgccccuccugugcggcaaggugagccgcgacauccggcaggagaucgagaagcugacggccaacucccaggucaagaagcuccgcugguucagcgagugccugagcccgcccgggggcuccgacaaccuguggaaccucguggccgugaucaaggggcaggacgacagccugcugccccagaacuacugcaagggcaucaugcaccucaagcaccugaucaaguuccggaccuccgaggcgcaggagcugaccaccgucaagaugagcaaguucgggggcggcaucggggugcccgccaaggaggagcgccucaaggaggccgccgagauccaccuccggcugggccagauccagcgcuacugcgagcugaugguggagcugggggagugggacaaggcgcuguccaucgcccccggcgucagcgugaaguacuggaagaagcucaugcagcggcgcgccgaccagcugauccaggaggacaaggacgacgugauccccuacugcaucgccaucggggacgucaagaagcuggugcacuucuucaugucccggggccagcucaaggaggcccugcugguggcgcaggccgccugcgagggcaacaugcagccccuccacgucagcgugcccaagggggccuccuacagcgacgacaucuacaaggaggacuucaacgagcugcugcacaagguguccaaggagcucgccgagugguacuuccaggacggccgcgcgguccuggccgccugcugccaccuggccaucgacaacaucgagcucgccauggcguaccugauccgggggaacgagcuggagcucgccgugugcgugggcacgguccugggggagagcgccgcccccgcgacccacuacgcccuggagcuccuggcccgcaagugcaugaugaucuccgugugcuuccccugcgugggcuacagcguccccuucugcuacgugaaccggaaccuggccgccgaccuccugcugaugaucccggacaacgagcuccaccugaucaagcugugcgcguucuaccccggcugcaccgaggagaucaacgaccuccacgacaagugcaagcugcccaccguggaggagugcaugcagcuggccgagacggcccgcgccgacgacaacaucuucgagaccgucaaguacuaccuccugucccaggagcccgagaaggcccugccgaucgggaucagcuucgugaaggaguacaucuccagcuccgacuggacccucgacaccaucuaccccgugcuggaccugcucagcuacauccggacggagaagcugcugcuccacacgugcaccgaggcgcgcaacgagcugcugauccucugcggcuacaucggggcccugcuggccauccggcgccaguaccagagcaucguccccgcccucuacgaguacaccucccagcugcugaagcgccgggaggugagcgucccccucaagaucgaguaccuguccgaggagcuggacgccuggcgcgcgugcacccagagcaccaaccggucccucgaggacagcccguacaccccgcccuccgacagccagcgcaugaucuacgccacccugcugaagcggcucaaggaggagucccugaagggcaucaucggccccgacuacgugacggggagcaaccugcccucccacagcgacauccacaucuccugccucaccggccugaagauccaggggcccguguucuuccuggaggacggcaagagcgccaucucccucaacgacgcccugaugugggccaaggucaaccccuucagcccgcuggggaccggcauccgccucaaccccuucuga

SEQ ID NO: 38681 - RNA, 4029 nt, Artificial Sequence
  derived and/or modified sequence opt1 from WDR19__Homo_sapiens__NP_079408
augaagcgcaucuucagccugcucgagaagaccuggcugggcgcccccauccaguucgccuggcagaagaccuccgggaacuaccuggcggugacgggcgccgacuacaucgucaagaucuucgaccggcacgggcagaagcgcagcgagaucaaccucccgggcaacugcguggccauggacugggacaaggacggggacgugcuggccgucaucgccgagaaguccagcugcaucuaccugugggacgcgaacaccaacaagaccucccagcucgacaacggcaugcgggaccagaugagcuuccugcugugguccaaggugggcagcuuccucgccguggggaccgucaagggcaaccugcugaucuacaaccaccagacgucccgcaagauccccgugcucgggaagcacaccaagcggaucacgugcggcugcuggaacgccgagaaccugcuggcccucgggggcgaggacaagaugaucaccgugagcaaccaggagggcgacaccauccgccagacccagguccgguccgagcccagcaacaugcaguucuuccugaugaagauggacgaccgcaccuccgcggccgagagcaugaucuccguggugcuggggaagaagacccucuucuuccugaaccugaacgagcccgacaacccggccgaccucgaguuccagcaggacuucggcaacaucgucugcuacaacugguacggggacggccggaucaugaucggcuucagcugcgggcacuucguggugaucuccacgcacaccggcgagcuggggcaggagaucuuccaggcccgcaaccacaaggacaaccugaccagcaucgccgucucccagacccucaacaagguggcgacgugcggcgacaacugcaucaagauccaggaccugguggaccugaaggacauguacgucauccucaaccuggacgaggagaacaaggggcugggcacccucagcuggaccgacgacggccagcugcuggcccucagcacccagcgggggucccugcacguguuccugacgaagcuccccauccugggcgacgccugcagcacccgcaucgccuaccugaccucccuccuggaggugaccgucgccaaccccguggagggggagcugcccaucacggugagcgucgacguggagccgaacuucgucgcggugggccucuaccaccuggccguggggaugaacaaccgggccugguucuacguccugggcgagaacgccgugaagaagcucaaggacauggaguaccugggcaccguggccuccaucugccugcacagcgacuacgcggccgcccucuucgaggggaagguccagcugcaccugaucgaguccgagauccuggacgcccaggaggagcgcgagacccggcuguuccccgccguggacgacaagugccgcauccugugccacgcgcugaccagcgacuuccucaucuacggcacggacaccggggugguccaguacuucuacaucgaggacuggcaguucgugaacgacuaccggcaccccguguccgucaagaagaucuuccccgacccgaacggcacccgccugguguucaucgacgagaaguccgacggguucguguacugccccgucaacgacgccaccuacgagauccccgacuucagccccacgaucaagggcgugcugugggagaacuggccgauggacaagggcguguucaucgccuacgacgacgacaaggucuacaccuacguguuccacaaggacaccauccagggggccaaggugauccucgcgggcagcaccaagguccccuucgcccacaagccccugcugcucuacaacggggagcugacgugccagacccaguccggcaaggugaacaacaucuaccugagcacccacggcuuccucuccaaccugaaggacaccgggcccgacgagcugcggccgaugcucgcccagaaccugaugcugaagcgcuucagcgacgccugggagaugugccggauccucaacgacgaggccgcguggaacgagcuggcccgcgccugccugcaccacauggagguggaguucgccauccgcgucuaccggcgcaucggcaacguggggaucgugaugucccucgagcagaucaagggcaucgaggacuacaaccugcuggccgggcaccucgcgauguucaccaacgacuacaaccuggcccaggaccuguaccucgccagcuccugccccaucgccgcccuggagaugcggcgcgaccugcagcacugggacagcgcgcuccagcuggccaagcaccuggcccccgaccagauccccuucaucagcaaggaguacgccauccagcucgaguucgcgggcgacuacgucaacgcccuggcccacuacgagaagggcaucacgggggacaacaaggagcacgacgaggccugccuggccggcguggcgcagauguccauccggaugggggacauccgccggggcgugaaccaggcccucaagcacccgagccgcguccugaagcgggacugcggggccauccuggagaacaugaagcaguucuccgaggccgcccagcucuacgagaagggccuguacuacgacaaggcggccagcguguacauccgcuccaagaacugggccaaggugggcgaccugcucccccacgucagcucccccaagauccaccuccaguacgccaaggccaaggaggcggacgggcgguacaaggaggccgugguggccuacgagaacgccaagcaguggcagagcgucauccgcaucuaccuggaccaccucaacaaccccgagaaggcggugaacaucgugcgggagacccagucccuggacggcgccaagauggucgcccgcuucuuccugcagcucggggacuacggcagcgccauccaguuccuggugauguccaagugcaacaacgaggccuucacccuggcgcagcagcacaacaagauggagaucuacgccgacaucaucgggagcgaggacaccacgaacgaggacuaccaguccaucgcccucuacuucgagggcgagaagcgguaccugcaggccggcaaguucuuccugcucugcgggcaguacagccgcgcccugaagcacuuccugaagugcccguccagcgaggacaacguggcgaucgagauggccaucgagaccgucggccaggccaaggacgagcuccugaccaaccagcugaucgaccaccuccugggggagaacgacggcaugcccaaggacgccaaguaccuguuccggcucuacauggcccugaagcaguaccgcgaggcggcccagaccgccaucaucaucgcccgggaggagcaguccgccgggaacuaccgcaacgcgcacgacgugcuguucagcauguacgccgagcucaagagccagaagaucaagauccccuccgagauggccacgaaccugaugauccugcacagcuacauccucgugaagauccacgucaagaacggcgaccacaugaagggcgcccgcaugcugauccggguggcgaacaacaucuccaaguucccgagccacaucgugcccauccugaccuccaccgucaucgagugccaccgcgccgggcucaagaacagcgccuucuccuucgccgccaugcugaugcggcccgaguaccgcagcaagaucgacgcgaaguacaagaagaagaucgagggcauggugcggcgccccgacaucuccgagaucgaggaggccaccacgccgugccccuucugcaaguuccugcuccccgagugcgagcugcugugccccgggugcaagaacagcaucccguacugcaucgccaccggccggcacaugcucaaggacgacuggaccgugugcccccacugcgacuuccccgcccuguacuccgagcugaagaucaugcucaacaccgagagcacgugccccaugugcuccgagcgccugaacgccgcgcagcugaagaagaucagcgacugcacccaguaccuccggaccgaggaggagcuguga

SEQ ID NO: 38682 - RNA, 1401 nt, Artificial Sequence
  derived and/or modified sequence opt1 from WDR1__Homo_sapiens__NP_005103
augcccuacgagaucaagaagguguucgccagccugccgcaggucgagcgcggcguguccaagaucaucgggggcgaccccaaggggaacaacuuccucuacaccaacggcaagugcgugauccugcggaacaucgacgaccacagccgcuucgucaacugcgugcgguucucccccgacgggaaccgcuucgccaccgcgagcgccgacggccagaucuacaucuacgacggcaagacgggggagaaggugugcgcccugggcggguccaaggcccacgacggcgggaucuacgccaucagcuggucccccgacagcacccaccuccuguccgcgagcggcgacaagaccuccaagaucugggacgucagcgugaacuccguggucagcaccuucccgaugggcuccacggugcuggaccagcagcucgggugccuguggcagaaggaccaccuccugagcgugucccugagcggcuacaucaacuaccuggaccggaacaaccccuccaagccccuccacgucaucaaggggcacagcaagagcauccagugccugaccgugcacaagaacggcggcaaguccuacaucuacagcgggucccacgacggccacaucaacuacugggacagcgagaccggggagaacgacuccuucgccggcaaggggcacaccaaccaggugagccgcaugacggucgacgaguccggccagcugaucagcugcuccauggacgacaccgugcgguacaccagccucaugcugcgcgacuacuccggccaggggguggucaagcuggacgugcagcccaagugcguggccgucggccccgggggcuacgccgugguggucugcaucgggcagaucgugcuccugaaggaccagcggaagugcuucagcaucgacaacccgggcuacgagcccgaggucguggcggugcaccccggcggggacaccgucgccaucggcgggguggacggcaacgugcgccuguacuccauccucgggacgacccugaaggacgagggcaagcugcucgaggccaagggcccggucaccgacguggccuacagccacgacggggccuuccuggcggugugcgacgccuccaaggucgugaccguguucagcgucgccgacggcuacuccgagaacaacguguucuacgggcaccacgccaagaucgugugccuggccuggagccccgacaacgagcacuucgcguccggcggcauggacaugauggucuacguguggacgcucagcgaccccgagacccgggugaagauccaggacgcccaccgccugcaccacgucagcucccuggccuggcucgacgagcacacccuggugaccacgagccacgacgccuccgugaaggaguggaccaucaccuacuga

SEQ ID NO: 38683 - RNA, 588 nt, Artificial Sequence
  derived and/or modified sequence opt1 from WDR20__Homo_sapiens__NP_001229344
auggccaccgagggcgggggcaaggagaugaacgagaucaagacccaguucacgacccgcgaggggcuguacaagcuccugccccacagcgaguacucccggccgaaccgcgugcccuucaacagccagggcuccaaccccguccgggugagcuucgugaaccugaacgaccaguccgggaacggcgaccgccucugcuucaacgucggccgggagcuguacuucuacaucuacaagggggugcgcaaggccgcggaccugagcaagcccaucgacaagcggaucuacaagggcacccagccgaccugccacgacuucaaccaccucacggccaccgccgaguccgugagccugcuggucggguucuccgccggccaggugcagcucaucgaccccaucaagaaggagaccagcaagcuguucaacgaggagaacuccugccagcaccuguggaagguggacuggaacgaggagcgccagaacgaggggagcaagaccuccgaggaggcccucgucacggugcagcccgcggagcacuucugccggcaggaggaccgcaugcagggcgugcugcaggaccagaacuga

SEQ ID NO: 38684 - RNA, 1938 nt, Artificial Sequence
  derived and/or modified sequence opt1 from WDR26__Homo_sapiens__NP_001108585
augcaggccaacggcgccgggggcgggggcgggggcggcgggggcgggggcgggggcggcgggggcgggggcggccaggggcagacccccgagcuggcgugccucagcgcccagaacggcgaguccagcccguccagcuccagcuccgccggggaccuggcccacgccaacggccugcuccccagcgcgcccuccgccgccagcaacaacuccaacagccugaacgugaacaacgggguccccggcggcgccgcggccgccuccagcgccaccguggccgcggccuccgccacgaccgccgccagcuccagccuggcgaccccggagcucggguccagccugaagaagaagaagcgccugagccaguccgacgaggacgugauccggcucaucggccagcaccugaacgggcugggccucaaccagaccgucgaccugcugaugcaggagagcgggugccgccucgagcaccccuccgccacgaaguuccggaaccacgugauggagggcgacugggacaaggccgagaacgaccugaacgagcugaagccccucgugcacagcccccacgccaucguccgcaugaaguuccugcugcuccagcagaaguaccuggaguaccuggaggacggcaaggugcucgaggcccuccaggugcugcggugcgagcugaccccgcugaaguacaacaccgagcgcauccacguccuguccggguaccucaugugcagccacgcggaggaccugcgggccaaggccgagugggagggcaaggggaccgccucccgcagcaagcugcucgacaagcugcagacguaccugccgcccuccgugaugcucccgccccggcgccugcagacccugcuccggcaggccguggagcugcagcgcgaccggugccuguaccacaacaccaagcucgacaacaaccuggacagcgucucccugcucaucgaccacgugugcagccgccggcaguuccccugcuacacccagcagauccugacggagcacugcaacgaggugugguucugcaaguucuccaacgacggcaccaagcuggcgaccgggagcaaggacaccacggucaucaucuggcaggucgaccccgacacccaccuccugaagcugcugaagacccucgagggccacgccuacggcguguccuacaucgccuggagccccgacgacaacuaccugguggccugcgggcccgacgacugcuccgagcuguggcucuggaacgugcagaccggcgagcugcgcacgaagaugagccagucccacgaggacagccugaccagcguggcguggaaccccgacgggaagcgguucgucaccggcggccagcgcgggcaguucuaccagugcgaccucgacggcaaccugcuggacuccugggagggggugcgggugcagugccucuggugccugagcgacggcaagaccguccuggccuccgacacgcaccagcgcauccggggguacaacuucgaggaccucaccgaccgcaacaucgugcaggaggaccaccccaucaugagcuucaccaucuccaagaacggccgccuggcccugcucaacgucgccacccagggcgugcaccugugggaccugcaggaccgggugcucguccgcaaguaccagggggugacgcagggcuucuacaccauccacagcugcuucgggggccacaacgaggacuucaucgccuccgggagcgaggaccacaagguguacaucuggcacaagcgguccgagcugcccaucgcggagcugaccggccacacccgcacggucaacugcgugagcuggaacccgcagauccccuccaugauggccagcgccuccgacgacggcaccgugcggaucugggggcccgcccccuucaucgaccaccagaacaucgaggaggagugcagcuccauggacagcuga

SEQ ID NO: 38685 - RNA, 1104 nt, Artificial Sequence
  derived and/or modified sequence opt1 from WDR31__Homo_sapiens__NP_001012361
augcugcuccugcgcugccagcugaagcaggcgcccccgcagaaggugagcuuccgguucugcgucgugaugggcaagcagcaguccaagcucaagcacagcaccuacaaguacgggcgccccgacgagaucaucgaggagcggauccagaccaaggccuuccaggaguacucccccgcccacauggacacggugagcgucguggccgcccugaacuccgaccugugcgugagcggcgggaaggacaagaccgucguggccuacaacuggaagaccggcaacguggucaagcgcuucaaggggcacgagcacgagaucaccaagguggccugcauccccaaguccagccaguucuucuccgcgagccgggaccgcauggugaugaugugggaccuccacggcuccagccagccgcggcagcagcugugcggccacgccauggucgugacggggcuggccgugucccccgacagcucccagcucugcaccggcagccgcgacaacacccugcugcucugggacgucgugaccgggcaguccguggagcgggccagcgucucccgcaacguggugacgcaccugugcugggucccccgggagcccuacauccugcagaccagcgaggacaagacccuccgccugugggacagccggggccuccagguggcgcacauguucccggccaagcagcacauccagaccuacugcgagguguccgucgacgggcacaagugcaucagcugcuccaacggcuucggcggggagggcugcgaggccacgcugugggaccugcgccagacccggaaccgcaucugcgaguacaaggggcacuuccagaccguggccagcugcgucuuccugccccgggcccucgcgcugaugccccugaucgccaccuccagccacgacugcaaggugaagaucuggaaccaggacacgggcgccugccucuucacccugucccuggacggcagcgggccccucaccucccuggccgugggcgacgccaucagccugcucugcgcguccuucaaccgcgggauccaccuccugcggauggaccacagccagggccuggagcugcaggaggucgccgccuucuga

SEQ ID NO: 38686 - RNA, 1611 nt, Artificial Sequence
  derived and/or modified sequence opt1 from WDR34__Homo_sapiens__NP_443076
auggccacccgcgcccagcccggcccgcugagccaggcgggguccgccggcguggccgcccucgccaccgucgggguggcgagcggccccgggcccggccggcccggcccgcugcaggacgagacgcuggggguggccuccguccccagccaguggcgcgccgugcagggcauccggugggagaccaaguccugccagaccgccagcaucgcgaccgccuccgccagcgcccaggcccgcaaccacguggacgcgcagguccagacggaggcccccgugcccguguccguccagccgcccagccaguacgacaucccccggcucgccgccuuccugcgccggguggaggccauggugauccgcgagcugaacaagaacuggcagucccacgcguucgacggguucgaggucaacuggaccgagcagcagcagauggugagcugccucuacacccugggcuacccgcccgcccaggcccaggggcugcacgugaccuccaucagcuggaacuccacgggcagcgucguggccugcgccuacggccggcucgaccacggggacugguccacccucaagagcuucgugugcgcguggaaccuggaccgccgggaccugcgcccccagcagcccuccgccgucguggaggugcccagcgccguccugugccuggccuuccacccgacccagcccagccacguggccggcgggcucuacuccggcgaggugcuggucugggaccugagccggcucgaggacccccugcuguggcgcaccggccucacggacgacacccacaccgaccccgugucccaggucguguggcugccggagcccgggcacagccaccgguuccaggugcuguccgucgcgaccgacggcaaggugcuccuguggcaggggaucggcguggggcagcugcagcucacggagggcuucgcccuggucaugcagcagcugccccgcagcaccaagcucaagaagcacccccggggcgagaccgaggugggggccaccgccguggcguucuccagcuucgacccgcgccuguucauccugggcacggagggcggguucccccucaagugcucccuggccgccggggaggccgcccugacccggaugcccagcuccgucccccuccgcgcgccggcccaguucaccuucagcccccacggcggccccaucuacuccgugagcugcuccccguuccaccggaaccuguuccugagcgccgggaccgacggccacgugcaccucuacuccaugcugcaggccccgccccugacgagccuccagcugucccugaaguaccucuucgccguccgcuggagccccgugcgcccccugguguucgcggccgccagcgggaagggcgacguccagcuguucgaccuccagaaguccagccagaagcccaccgugcugaucaagcagacccaggacgagucccccguguacugccuggaguucaacagccagcagacccagcugcucgccgccggggacgcgcagggcacggucaagguguggcagcuguccaccgaguucaccgagcagggcccccgggaggccgaggaccuggacugccucgccgccgagguggcggccuga

SEQ ID NO: 38687 - RNA, 3546 nt, Artificial Sequence
  derived and/or modified sequence opt1 from WDR35__Homo_sapiens__NP_001006658
auguucuucuaccugagcaagaagaucuccauccccaacaacgugaagcuccagugcgucagcuggaacaaggagcagggcuucaucgccugcgggggcgaggacgggcugcugaaggugcucaagcuggagacccagaccgacgacgccaagcugcgcggccucgcggccccguccaaccugagcaugaaccagacgcuggaggggcacuccggcagcgugcaggucgugaccuggaacgagcaguaccagaagcucaccaccuccgacgagaacggccugaucaucguguggaugcuguacaaggggagcuggaucgaggagaugaucaacaaccggaacaaguccgucgugcgcagcauguccuggaacgccgacggccagaagaucugcaucguguacgaggacggggccgucaucgugggcagcguggacgggaaccggaucuggggcaaggaccucaagggcauccagcugucccacgucacguggagcgccgacuccaaggugcuccuguucgggauggcgaacggcgagauccacaucuacgacaaccaggggaacuucaugaucaagaugaagcugagcugccuggugaacgucaccggcgccaucuccaucgccggcauccacugguaccacgggaccgagggcuacguggagcccgacugccccugccucgccgugugcuucgacaacgggcgcugccagaucaugcggcacgagaacgaccagaaccccguccugaucgacaccggcauguacgugguggggauccaguggaaccacaugggcagcguccuggcgguggccggcuuccagaaggccgccaugcaggacaaggacgugaacaucguccaguucuacacgccguucggggagcaccucggcacccugaaggugcccgggaaggagaucuccgcccugagcugggagggcgggggccucaagaucgcgcuggccgucgacagcuucaucuacuucgccaacauccgccccaacuacaaguggggcuacugcuccaacaccgugguguacgccuacacccggcccgaccgcccggaguacugcgucguguucugggacacgaagaacaacgagaaguacgugaaguacgucaaggggcugaucagcaucacgaccugcggcgacuucugcauccucgccaccaaggcggacgagaaccacccccaggaggagaacgagauggagaccuucggggccaccuucgugcuggugcugugcaacuccaucggcacgccccucgaccccaaguacaucgacaucgucccgcuguucguggccaugaccaagacccacgugaucgccgccagcaaggaggcguucuacaccuggcaguaccgggucgccaagaagcugaccgcccucgagaucaaccagaucacccgcucccggaaggaggggcgcgagcggaucuaccacguggacgacacgcccagcggcuccauggacggcgugcuggacuacagcaagaccauccaggggacccgcgaccccaucugcgccaucaccgccuccgacaagauccugaucgucggccgggagagcgggacgauccagcgcuacucccuccccaacgugggccugauccagaaguacagccugaacugccgggcguaccagcucucccugaacugcaacagcucccgccuggccaucaucgacaucagcggcgugcucaccuucuucgaccuggacgcccgggucaccgacuccaccgggcagcaggucgugggcgagcugcucaagcuggagcgccgggacgugugggacaugaagugggccaaggacaacccggaccuguucgcgaugauggagaagacgcgcauguacguguuccgcaaccucgaccccgaggagcccauccagaccagcggguacaucugcaacuucgaggaccuggagaucaaguccgugcugcuggacgagauccucaaggaccccgagcacccgaacaaggacuaccugaucaacuucgagauccggagccugcgcgacagccgggcccucaucgagaaggucggcaucaaggacgccucccaguucaucgaggacaacccccacccccgccuguggcggcugcucgccgaggccgcgcugcagaagcuggaccucuacaccgccgagcaggccuucgugcgcugcaaggacuaccaggggaucaaguucgugaagcggcugggcaagcugcucagcgaguccaugaagcaggccgaggucgugggcuacuucgggcgcuucgaggaggccgagcggaccuaccuggagauggaccgccgggaccuggcgaucggccuccgccugaagcugggggacugguuccgggugcuccagcugcugaagacgggcagcggggacgccgacgacucccuccuggagcaggccaacaacgccaucggcgacuacuucgccgaccgccagaaguggcugaacgcgguccaguacuacgugcagggccggaaccaggagcgccucgccgagugcuacuacaugcuggaggacuacgaggggcuggagaaccucgccaucagccugcccgagaaccacaagcugcucccggagaucgcccagauguucgugcgggucggcaugugcgagcaggcggugaccgccuuccugaagugcucccagcccaaggccgccguggacacgugcguccaccugaaccaguggaacaaggccguggagcucgcgaagaaccacagcaugaaggagaucgggucccugcuggcccgcuacgccagccaccuccuggagaagaacaagacccuggacgccaucgagcucuaccggaaggccaacuacuucuucgacgcggccaagcugauguucaagaucgccgacgaggaggccaagaagggcuccaagccccugcgcgugaagaagcucuacguccugagcgcccugcucaucgagcaguaccacgagcagaugaagaacgcgcagcgcgggaaggugaagggcaaguccagcgaggccaccuccgcccuggccggccugcucgaggaggaggugcugagcaccaccgaccgguucaccgacaacgcguggcgcggggccgaggccuaccacuucuucauccuggcccagcggcagcucuacgagggcugcgucgacaccgcccugaagacggcgcugcaccucaaggacuacgaggacaucaucccgcccguggagaucuacucccugcuggcccucugcgccugcgccagccgcgccuucgggaccugcagcaaggcguucaucaagcugaagucccuggagacccucagcuccgagcagaagcagcaguacgaggaccuggcccuggagaucuucaccaagcacacgagcaaggacaaccggaagcccgagcucgacucccugauggagggcggggagggcaagcugccgaccugcguggccaccggcagccccaucaccgaguaccaguucuggaugugcuccgucugcaagcacggggugcucgcccaggagaucagccacuacuccuucugcccccugugccacagccccgugggcuga

SEQ ID NO: 38688 - RNA, 2856 nt, Artificial Sequence
  derived and/or modified sequence opt1 from WDR36__Homo_sapiens__NP_644810
augugcugcaccgagggcagccugcgcaagcgggacucccagcgcgcccccgaggccgugcucugccugcagcuguggcagcggaccgucccgcucgacacgcugaaggggcuggggaccugcuuccccagcggccccgagcuccgcggcgcggggaucgccgccgccauggagcgggccuccgagcgccggaccgcgagcgcccuguucgccggcuuccgcgcccugggccucuucuccaacgacaucccccacguggugcgguucagcgcgcugaagcgccgguucuacgucaccacgugcguggggaaguccuuccacaccuacgacgugcagaagcugagccucgucgccguguccaacagcgugccgcaggacaucugcugcauggccgccgacggccgccuggucuucgccgcguacgggaacguguucuccgccuucgcccggaacaaggagaucgugcacaccuucaagggccacaaggccgagauccacuuccugcagcccuucggggaccacaucaucagcgucgacaccgacggcauccucaucaucuggcacaucuacuccgaggaggaguaccugcagcugacguucgacaagagcguguucaagaucuccgccauccuccaccccagcaccuaccugaacaagauccugcucggcuccgagcaggggagccugcagcuguggaacgugaaguccaacaagcuccuguacaccuuccccggcuggaaggucggggugaccgcgcugcagcaggccccggccguggacgucguggccaucggccucaugagcggccaggugaucauccacaacaucaaguucaacgagacgcugaugaaguuccgccaggacugggggcccaucaccagcaucuccuuccggaccgacggccaccccgucauggccgcggggagccccugcggccacaucgggcugugggaccucgaggacaagaagcugaucaaccagaugcgcaacgcccacuccaccgccaucgccggccugacguuccuccaccgggagccgcugcuggugaccaacggcgccgacaacgcgcuccgcaucuggaucuucgacgggcccaccggcgaggggcggcugcugcgcuuccggaugggccacagcgcgccccucaccaacauccgcuacuacgggcagaacggccagcagauccuguccgccagccaggacggcacgcugcaguccuucagcaccgugcacgagaaguucaacaagucccucgggcacggccugaucaacaagaagcgcgucaagcggaaggggcugcagaacaccaugagcgugcgccugcccccgaucaccaaguucgccgccgaggaggcccgggaguccgacugggacggcaucaucgccugccaccaggggaagcugagcugcuccacguggaacuaccagaaguccaccaucggcgccuacuuccugaagcccaaggagcucaagaaggacgacaucaccgccaccgcggucgacaucacgagcugcggcaacuucgccgugaucgggcugagcuccggcaccguggacgucuacaacaugcagagcgggauccaccgcggcuccuucggcaaggaccaggcccacaaggggagcgugcggggcguggccgucgacgggcugaaccagcugaccgugaccacgggcagcgaggggcuccugaaguucuggaacuucaagaacaagauccugauccacuccgugagccucuccagcucccccaacaucaugcugcugcaccgcgacagcggcauccucggccuggcccuggacgacuucuccaucagcguccucgacaucgagacccggaagaucgugcgcgaguucuccgggcaccagggccagaucaacgacauggcguucagccccgacgggcgguggcugaucuccgccgccauggacugcagcauccgcaccugggaccugccguccggcugccucaucgacugcuuccugcuggacagcgcgccccucaacguguccaugagccccaccggggacuuccuggccacgucccacgucgaccaccugggcaucuaccucuggagcaacaucagccuguacuccguggugagccugcggccccucccggccgacuacguccccuccaucgugaugcugcccgggaccugccagacccaggacguggaggucagcgaggagaccguggagcccuccgacgagcugaucgaguacgacagcccggagcagcucaacgagcagcuggugacccugucccuccugcccgagagccgcuggaagaaccugcucaaccuggacgucaucaagaagaagaacaagcccaaggagccgcccaaggugcccaaguccgcccccuucuucaucccgacgauccccggccuggugccccgguacgccgcccccgagcagaacaacgacccgcagcagagcaaggucgugaaccucggcgugcuggcgcagaaguccgacuucugccugaagcucgaggaggggcuggucaacaacaaguacgacaccgcccugaaccuccugaaggagagcggccccuccgggaucgagaccgagcugcgcagccucucccccgacugcggcggcagcaucgaggugaugcaguccuuccugaagaugaucgggaugaugcuggaccggaagcgcgacuucgagcucgcccaggccuaccuggcccuguuccucaagcugcaccugaagaugcuccccagcgagccggugcugcuggaggagaucaccaaccucuccagccaggucgaggagaacuggacgcaccuccagagccuguucaaccaguccaugugcauccucaacuaccucaagagcgcgcugcuguga

SEQ ID NO: 38689 - RNA, 1485 nt, Artificial Sequence
  derived and/or modified sequence opt1 from WDR37__Homo_sapiens__NP_054742
augcccaccgagagcgccuccugcagcaccgcccgccagaccaagcagaagcggaagucccacagccuguccauccgccggaccaacagcuccgagcaggagcgcaccggccucccgcgggacaugcuggaggggcaggacagcaagcugcccuccagcgugcgcuccacccuccuggagcuguucggccagaucgagcgggaguucgagaaccucuacaucgagaaccuggagcugcgccgggagaucgacacgcucaacgagcgccuggcggccgaggggcaggccaucgacggcgccgagcugagcaaggggcagcucaagaccaaggccucccacagcaccucccagcugagccagaagcugaagaccacguacaaggcguccaccagcaagaucgucuccagcuucaagaccaccacgagccgggccgccugccagcucgugaaggaguacaucggccaccgcgacggcaucugggacguguccgucgccaagacccagcccguggugcuggggaccgcgagcgccgaccacaccgcccugcucugguccaucgagacgggcaagugccuggucaaguacgccgggcacgugggcagcgugaacuccaucaaguuccaccccagcgagcagcuggcccucaccgcguccggggaccagaccgcccacaucuggcgguacgccguccagcugccgacgccccagcccguggccgacaccagcaucuccggcgaggacgagguggagugcagcgacaaggacgagcccgaccuggacggcgacgucuccagcgacugcccgaccauccgcgugccccucaccucccucaagagccaccaggggguggucaucgccuccgacuggcuggugggcgggaagcaggcggugaccgccagcugggaccggacggccaaccuguacgacgucgagaccuccgagcuggugcacagccugaccggccacgaccaggagcucacccacugcugcacgcaccccacccagcgccugguggucaccuccagccgggacaccacguuccgccugugggacuuccgggaccccagcauccacuccgugaacguguuccagggccacaccgacaccgucaccagcgccguguucacggucggggacaacgugguguccggcagcgacgaccgcaccgucaaggugugggaccucaagaacaugcgguccccgaucgccaccauccgcaccgacagcgcgaucaaccgcaucaacgugugcgucgggcagaagaucaucgcccugccccacgacaaccgccaggugcggcuguucgacauguccggcgugcggcucgcccgccugccccggagcucccgccaggggcaccggcgcauggucugcugcagcgccugguccgaggaccaccccgugugcaaccuguucacgugcggcuucgaccggcaggccaucggcuggaacaucaacaucccggcgcuccugcaggagaaguga

SEQ ID NO: 38690 - RNA, 2034 nt, Artificial Sequence
  derived and/or modified sequence opt1 from WDR43__Homo_sapiens__NP_055946
auggccgccggcgggggcgggagcugcgacccccuggcgccggccggcgugcccugcgccuucagcccccacagccaggccuacuucgcccucgcguccaccgacgggcaccuccgcgucugggagaccgccaacaaccggcugcaccaggaguacgugcccagcgcccaccuguccggcacgugcacgugccuggccugggcgccggcccgccugcaggccaaggagagcccccagcggaagaagcgcaaguccgaggccgugggcaugagcaaccagaccgaccuccuggcccuggggaccgcggucggcuccauccuccuguacagcacggugaagggggagcugcacuccaagcucaucagcggcgggcacgacaaccgggugaacugcauccaguggcaccaggacuccggcugccuguacagcugcuccgacgacaagcacaucgucgaguggaacgugcagaccugcaaggugaagugcaaguggaagggcgacaacagcuccgucagcucccugugcaucagccccgacgggaagaugcuccugagcgccggccgcaccaucaagcugugggugcucgagaccaaggagguguaccggcacuucacggggcacgccacccccgucuccagccugauguucaccaccauccgcccgcccaacgagucccagcccuucgacggcaucacgggccuguacuuccucagcggggccgugcacgaccggcugcugaacguguggcagguccgcuccgagaacaaggagaaguccgccgugauguccuucaccgugaccgacgagcccgucuacaucgaccucacccugagcgagaacaaggaggagccggugaagcuggcgguggucugccgggacggccaggugcaccucuucgagcacauccugaacggguacugcaagaagccccugacguccaacugcaccauccagaucgccacccccggcaaggggaagaaguccacccccaagccgauccccauccucgccgccggcuucugcagcgacaagaugagccugcugcucguguacggcuccugguuccagcccacgaucgagcgcgucgcccugaacagccgggagccccacaugugccuggugcgcgacaucuccaacugcugggcgccgaaggucgagaccgccaucaccaaggugcggacccccgugaugaacagcgaggccaagguccucgugcccgggauccccggccaccacgccgccaucaagccggcgccgccccagacggagcaggucgaguccaagcgcaagagcgggggcaacgagguguccaucgaggagcggcugggggccauggacaucgacacccacaagaagggcaaggaggaccugcagaccaacagcuuccccgugcuccugacccagggccuggagagcaacgacuucgagaugcucaacaaggugcugcagacgcgcaacgucaaccugaucaagaagaccgugcuccggaugccccugcacaccaucaucccccugcuccaggagcugaccaagcgccugcaggggcaccccaacuccgccgugcugaugguccaguggcucaagugcgugcugacggugcacgccagcuaccuguccacccucccggaccuggucccccagcugggcacccucuaccagcugauggagagccgggugaagaccuuccagaagcugucccaccuccacgggaagcugauccugcucaucacccaggugaccgcgagcgagaagaccaagggcgccaccucccccgggcagaaggccaagcuggucuacgaggaggagagcuccgaggaggagagcgacgacgagaucgccgacaaggacuccgaggacaacugggacgaggacgaggaggagagcgaguccgagaaggacgaggacguggaggaggaggacgaggacgccgagggcaaggacgaggagaacggcgaggaccgcgacaccgcgagcgagaaggagcugaacggggacuccgaccucgaccccgagaacgagagcgaggaggaguga

SEQ ID NO: 38691 - RNA, 1035 nt, Artificial Sequence
  derived and/or modified sequence opt1 from WDR45B__Homo_sapiens__NP_062559
augaaccugcuccccugcaacccgcacggcaacgggcugcuguacgccggcuucaaccaggaccacgggugcuucgccugcggcauggagaacggguuccgcguguacaacaccgacccccucaaggagaaggagaagcaggaguuccuggagggcggcgucgggcacguggagaugcuguuccggugcaacuaccucgcgcuggugggcgggggcaagaagcccaaguacccgcccaacaaggucaugaucugggacgaccugaagaagaagaccgugaucgagaucgaguucagcacggaggugaaggccgucaagcuccgccgggaccgcaucguggugguccuggacuccaugaucaagguguucaccuucacccacaacccccaccagcugcacguguucgagaccugcuacaaccccaaggggcucugcguccugugccccaacagcaacaacucccugcucgccuucccgggcacgcacaccggccacgugcagcugguggaccuggccagcaccgagaagccgcccgucgacauccccgcccacgagggggugcucuccugcaucgcgcugaaccugcagggcacccggaucgccacggccagcgagaaggggacccucauccgcaucuucgacaccuccagcggccaccugauccaggagcugcggcgcggcucccaggccgcgaacaucuacugcaucaacuucaaccaggacgccagccucaucugcguguccagcgaccacgggaccguccacaucuucgccgccgaggaccccaagcggaacaagcaguccagccuggccuccgcgagcuuccugcccaaguacuucuccagcaagugguccuucagcaaguuccaggugcccagcggcucccccugcaucugcgccuucgggacggagccgaacgccgugaucgccaucugcgccgacggcagcuacuacaaguuccucuucaaccccaagggggagugcauccgcgacgucuacgcgcaguuccuggagaugaccgacgacaagcuguga

SEQ ID NO: 38692 - RNA, 1083 nt, Artificial Sequence
  derived and/or modified sequence opt1 from WDR45__Homo_sapiens__NP_001025067
augacccagcagccccugcgcggcgugaccagccuccgguucaaccaggaccaguccugcuucugcugcgccauggagacggggguccgcaucuacaacguggagccgcugauggagaagggccaccuggaccacgagcaggucgggagcaugggccucguggagaugcugcaccgguccaaccugcucgcccuggucgggggcggcagcucccccaaguucagcgagaucuccgugcugaucugggacgacgcgcgcgaggggaaggacagcaaggagaagcucgugcuggaguucaccuucaccaagcccgugcuguccgugcggaugcgccacgacaagaucgucaucgugcucaagaaccggaucuacguguacagcuuccccgacaacccgcgcaagcuguucgaguucgacacccgggacaaccccaagggccugugcgaccucugccccucccuggagaagcagcugcucgucuuccccgggcacaagugcggcagccugcagcugguggaccucgccuccacgaagccggggaccagcuccgcccccuucaccaucaacgcccaccagagcgacaucgccugcgugucccugaaccagcccggcaccgucguggcgagcgccucccagaagggcacgcugauccgccucuucgacacccagagcaaggagaagcugguggagcugcggcgcgggaccgaccccgccacccucuacugcaucaacuucagccacgacuccagcuuccugugcgccuccagcgacaagggcacgguccacaucuucgcgcugaaggacacccggcucaaccgccgguccgcccuggcccgcguggggaaggugggcccgaugaucggccaguacgucgacagccaguggucccuggccagcuucaccgugcccgccgaguccgcgugcaucugcgccuucgggcggaacaccagcaagaacgugaacuccgucaucgccaucugcguggacggcacguuccacaaguacgucuucacccccgacgggaacugcaaccgcgaggccuucgacguguaccucgacaucugcgacgacgacgacuucuga

SEQ ID NO: 38693 - RNA, 1833 nt, Artificial Sequence
  derived and/or modified sequence opt1 from WDR46__Homo_sapiens__NP_005443
auggagaccgcccccaagccgggcaaggacgugccgcccaagaaggacaagcugcagaccaagcgcaagaagccccggcgcuacugggaggaggagacgguccccaccaccgccggggcgagccccggcccgccccggaacaagaagaaccgcgagcuccggccccagcgccccaagaacgccuacauccugaagaagucccggaucagcaagaagccccaggugcccaagaagccgcgcgaguggaagaaccccgagucccagcgggggcugagcggcacccaggaccccuuccccgggccggcccccgugcccgucgagguggugcagaaguucugccgcaucgacaagucccggaagcucccccacagcaaggccaagacgcgcucccggcuggaggucgccgaggcggaggaggaggagaccagcaucaaggccgcccgcuccgagcugcuccuggccgaggagccgggcuuccuggagggcgaggacggggaggacaccgcgaagaucugccaggccgacaucguggaggccguggacaucgccagcgccgcgaagcacuucgaccucaaccugcggcaguucggccccuaccgccugaacuacucccggaccgggcgccaccucgccuucggcgggcggcgcggccacgucgccgcccuggacugggugacgaagaagcugaugugcgagaucaacgugauggaggccguccgggacauccgcuuccuccacagcgaggcgcugcuggccguggcccagaaccgcuggcuccacaucuacgacaaccagggcaucgagcugcacugcauccggcgcugcgaccgggugacccgccuggaguuccuccccuuccacuuccugcuggccaccgccuccgagaccggguuccucacguaccuggacgucagcgugggcaagaucguggcggcccugaacgcccgggccgggcgccucgacgucaugucccagaaccccuacaacgccgugauccaccugggccacagcaacggcaccgugucccuguggagcccggcgaugaaggagccccucgccaagauccugugccaccgcgggggcguccgggccguggccguggacuccaccgggaccuacauggcgacgagcggccuggaccaccagcucaagaucuucgaccugcgggggaccuaccagccccugagcacccgcacccucccccacggcgccggccaccuggccuucucccagcgggggcugcucgucgccggcaugggggacguggucaacaucugggccggccaggggaaggcgagcccgcccucccuggagcagcccuaccugacgcaccgccucagcggcccggugcacggccugcaguucugccccuucgaggacgugcugggggucggccacaccgggggcaucaccuccaugcucgugcccggggccggcgagcccaacuucgacggccuggagagcaacccguaccggucccgcaagcagcggcaggagugggaggugaaggcccugcucgagaagguccccgccgagcugaucugccuggacccccgcgcccuggcggagguggacgugaucagccucgagcaggggaagaaggagcagaucgagcggcugggcuacgacccccaggccaaggccccguuccagcccaagcccaagcagaaggggcgcuccagcaccgccucccuggucaagcggaagcgcaaggugauggacgaggagcaccgcgacaaggugcggcagagccuccagcagcagcaccacaaggaggccaaggcgaagcccacgggcgcccgcccguccgcccuggaccgguucguccgcuga

SEQ ID NO: 38694 - RNA, 1788 nt, Artificial Sequence
  derived and/or modified sequence opt1 from WDR48__Homo_sapiens__NP_001290331
auggagugccagagcgcccaggugaucagcgccagcuccgacaccaccgucaagguguggaacgcgcacaagggcuucugcaugagcacgcugcgcacccacaaggacuacgugaaggcccucgccuacgccaaggacaaggagcuggucgccuccgcggggcuggaccggcagaucuuccucugggacgugaacacccugaccgcccugacggccagcaacaacaccgugaccaccuccagccucuccggcaacaaggacagcaucuacucccuggccaugaaccagcuggggacgaucaucgucagcggcuccaccgagaaggugcuccgcgugugggacccccggaccugcgcgaagcugaugaagcugaaggggcacaccgacaacgucaaggcccuccugcugaaccgcgacggcacgcagugccucagcggcuccagcgacgggaccauccggcuguggucccugggccagcagcgcugcaucgccaccuaccgggugcacgacgagggggugugggcccuccaggucaacgacgccuucacccacguguacagcggcgggcgcgaccggaagaucuacugcacggaccugcgcaacccggacauccgggugcugaucugcgaggagaaggcgcccguccucaagauggagcuggaccgcuccgccgacccgccgcccgccaucuggguggccaccaccaagagcaccgugaacaaguggacgcugaagggcauccacaacuuccgggccagcggcgacuacgacaacgacugcaccaaccccaucacgccccucugcacccagcccgaccaggucaucaagggcggggcguccaucauccagugccacauccugaacgacaagcgccacauccugaccaaggacaccaacaacaacguggccuacugggacgugcucaaggccugcaaggucgaggaccuggggaagguggacuucgaggacgagaucaagaagcgguucaagaugguguacguccccaacugguucagcguggaccugaagaccggcaugcucaccaucacgcuggacgaguccgacugcuucgccgccugggucagcgcgaaggacgccggcuucuccagccccgacggguccgaccccaagcugaaccucggcgggcugcugcuccaggcccugcuggaguacuggccccgcacccacgugaacccgauggacgaggaggagaacgaggugaaccacgucaacggcgagcaggagaaccgggugcagaaggggaacggcuacuuccaggugccgccccacacccccgucaucuucggcgaggccgggggccgcacccucuuccggcugcugugccgcgacagcgggggcgagacggaguccaugcuccugaacgagaccgugccccagugggugaucgacaucaccgucgacaagaacaugcccaaguucaacaagauccccuucuaccugcagccccacgccagcuccggggcgaagacccucaagaaggaccggcugagcgccuccgacaugcuccaggugcgcaaggugauggagcacgucuacgagaagaucaucaaccuggacaacgagagccagacgaccuccagcuccaacaacgagaagccgggcgagcaggagaaggaggaggacaucgccgugcuggccgaggagaagaucgagcugcugugccaggaccaggugcucgaccccaacauggaccugcgcaccgucaagcacuucaucuggaaguccggcggggaccugacccuccacuaccggcagaaguccaccuga

SEQ ID NO: 38695 - RNA, 2094 nt, Artificial Sequence
  derived and/or modified sequence opt1 from WDR49__Homo_sapiens__NP_849146
auggccuggcgcgagaaguccaagaagcggcugaacaugaccagcuucaacaucgcccagggcauccacgcguucgacuaccacagccgccucaaccugaucgccaccgccgggaucaacaacaaggugugccuguggaaccccuacgucgugagcaagccggugggcguccucugggggcacagcgccuccgugaucgccgugcaguucuucgucgagcggaagcagcuguucagcuucuccaaggacaaggugcugcgccucugggacauccagcaccagcugagcauccagcggaucgcgugcuccuuccccaagagccaggacuuccgcugccuguuccacuucgacgaggcccacggccggcuguucaucuccuucaacaaccagcuggcccugcucgccaugaaguccgaggcgagcaagcgcgucaagagccacgagaaggccgugacgugcgugcuguacaacuccauccugaagcaggucaucagcuccgacaccgggagcaccguguccuucuggaugaucgacaccggccagaagaucaagcaguucacgggcugccacgggaacgccgagaucagcaccauggcccucgacgccaacgagacccggcugcugaccggcagcacggacgggaccgugaagaucugggacuucaacggcuacugccaccacacccucaacguggggcaggacggcgcggucgacaucucccagauccugauccugaagaagaagauccucgugaccggcugggagcgcgccaucacgguguuccggccccagaacuucaaccaguucuucauccagcccgaggaguggaagggcgggauccagcaccacgacgacauccugugcgccgccuuccugccgccccagacccucgucaccgggagcuacgacggcgagaucgugcuguggaacaacuccaccgagaacgcccaccacgugcugcaccccgacuaccagcgccuccucaagagcaagcuggacacgaagccccagaagcuccuguccgcgggccggagccagccgucccaccccauggccgaccacagcaccaccgggguccgcaacuucgagaucgacaccgagggcaagaacgccgugaugcggcugugcuuccucaaggcccgcaagaacacggccgugaccgggggcgcgaaccuggucuccugcgggggcagcggcuacgugcgguucugggacaucuacaagaagcagcugcucgccgaguuccuggcccacuccggggucggcagcaucaucauguccaccgacaagaugaaccgcuaccugaccacgggggaccucgacggcuggcugaagaucuggaacaucgaggaguacugccugaacagcuccaagaacaagaucaccaaggcccccacccucauccggagcuuccagccccacgaggaccgcaucuccagccuggagaugugcgagcccgggggccagcugcucaucaucuccagcagcgccgacugcuccaucugcgugaccggcgugugcaacgcgccggucuggaucuucgggcaggccaagcacuggcacaucgagaacugccuguuccugcccaagcgggacacgaaccucguggagagcgagauccagaaggagaucucccuguucagcaaggaggaguccugccuggaccccaccgagcacagccugcucaacaagaagaacaaggacgacuccaccuacaacgugcgcccgagcgaggacaucaaccuggacaucaaguacaaggagcgcuccacgugcaugaaggagacccagaagcccuacuacggcgaggucaucaagaaguccuucagcaccuuccggagccugaacaucggggcccucgaggagcugcccgaggugaacaagcccgccuuccugcucgacccggagaaguacuuccgcaaggagcccgaggaggagcggccccagauccuggaggcgcccucccuguucaagacccucaaggccguguucgacgagaagaaccuguucccgaaggagauccugcaccacgagcgcaaggccaagcagcucugccaggagaaguccugcgaggucaagaagaacaagaaguga

SEQ ID NO: 38696 - RNA, 1239 nt, Artificial Sequence
  derived and/or modified sequence opt1 from WDR4__Homo_sapiens__NP_387510
auggccggcagcguggggcuggcccucugcggccagacccuggucgugcgcgggggcucccgguuccuggcgaccagcaucgccuccagcgacgacgacucccucuucaucuacgacugcagcgccgccgagaagaagucccaggagaacaagggggaggacgcgccccuggaccagggcagcggcgccauccuggccuccacguucagcaaguccgggagcuacuucgcccucaccgacgacuccaagcgccugauccuguuccggaccaagccguggcagugccucagcgugcgcaccgucgcccggcgcugcacggcgcugaccuucaucgccuccgaggagaaggugcugguggccgacaagagcggcgacgucuacuccuucagcgugcucgagccccacgggugcggccggcuggagcuggggcaccucuccaugcugcuggacguggccgucagccccgacgaccgcuucauccucaccgccgaccgggacgagaagauccgcgugagcugggcggccgcgccccacuccaucgagagcuucugccugggccacaccgaguucgugucccggaucagcgucgugccgacgcagcccggccugcuccuguccagcuccggggacggcacccugcgccucugggaguaccggagcgggcgccagcugcacugcugccaccuggccucccuccaggagcugguggacccccaggcgccccagaaguucgccgccagccggaucgccuucuggugccaggagaacugcgucgcccugcucugcgacggcaccccggugguguacaucuuccagcuggacgcccgccggcagcagcuggucuaccgccagcagcucgccuuccagcaccaggugugggacguggccuucgaggagacccagggccuguggguccugcaggacugccaggaggcgccccucgugcuguaccggcccgugggggaccaguggcaguccguccccgagagcacggugcugaagaaggucuccggcgugcuccgcgggaacugggccaugcuggagggcagcgccggggccgacgccuccuucagcucccuguacaaggccaccuucgacaacgugaccagcuaccucaagaagaaggaggagcggcugcagcagcagcuggagaagaagcagcgccgccgguccccgccgcccggccccgacggccacgccaagaagaugcgccccggggaggcgacccucagcugcuga

SEQ ID NO: 38697 - RNA, 1152 nt, Artificial Sequence
  derived and/or modified sequence opt1 from WDR55__Homo_sapiens__XP_005268526
auggaccgcacgugcgaggagcggcccgccgaggacggcagcgacgaggaggacccggacuccauggaggcccccacccgcauccgggacacgcccgaggacaucgugcuggaggcgcccgccagcgggcucgccuuccacccggcccgcgaccugcuggccgcgggcgacgucgacggggacguguucguguucuccuacagcugccaggagggcgagaccaaggagcucugguccagcgggcaccaccugaaggccugccgggccgucgccuucuccgaggacggccagaagcugaucaccgugagcaaggacaaggcgauccacgugcucgacgucgagcagggccagcuggagcgccggguguccaaggcccacggggcccccaucaacagccugcuccugguggacgagaacguccuggccaccggcgacgacaccgggggcaucugccucugggaccagcgcaaggaggggccccugauggacaugcggcagcacgaggaguacaucgccgacauggcgcuggaccccgccaagaagcuccugcugaccgccuccggcgacggcugccucgggaucuucaacaucaagcgccggcgcuucgagcugcugagcgagccgcaguccggcgaccucaccagcgugacccugaugaagugggggaagaagguggccugcggcuccagcgagggcacgaucuaccuguucaacuggaacggguucggcgccaccuccgaccgguucgcgcuccgcgccgagagcaucgacugcaugguccccgugaccgagucccugcugugcaccgggagcacggacggcgugauccgggccgucaacauccuccccaaccgcgugguggggagcgucggccagcacaccggcgagcccguggaggagcuggcccugucccacugcgggcgguuccucgccagcuccggccacgaccagcgccugaaguucugggacauggcgcagcugcgggccguggucguggacgacuaccgccggcgcaagaagaagggcgggccgcuccgcgcccugagcuccaagaccuggagcaccgacgacuucuucgccgggcugcgggaggagggcgaggacuccauggcccaggaggagaaggaggagacgggcgacgacagcgacuga

SEQ ID NO: 38698 - RNA, 1005 nt, Artificial Sequence
  derived and/or modified sequence opt1 from WDR5__Homo_sapiens__XP_005272220
auggccaccgaggagaagaagcccgagaccgaggccgcgcgcgcccagccgacgcccagcagcagcgccacccaguccaagcccacccccgugaagccgaacuacgcccugaaguucacccucgccggccacacgaaggcggucagcuccgugaaguucagccccaacggggaguggcuggccuccagcuccgccgacaagcugaucaagaucuggggcgccuacgacgggaaguucgagaagaccaucagcggccacaagcucgggaucuccgacguggcguggagcuccgacagcaaccugcuggucuccgccagcgacgacaagacccucaagaucugggacguguccagcggcaagugccugaagacccugaagggccacuccaacuacguguucugcugcaacuucaacccccagagcaaccucaucgucagcggguccuucgacgagagcgugcggaucugggacgugaagacgggcaagugccugaagacccugcccgcccacuccgacccggucagcgccgugcacuucaaccgcgacgggucccucaucgugagcuccagcuacgacggccugugccggaucugggacaccgccuccgggcagugccugaagacccucaucgacgacgacaacccgcccgucagcuucgugaaguucucccccaacggcaaguacauccuggcggccacgcuggacaacacccucaagcugugggacuacagcaagggcaagugccugaagaccuacaccgggcacaagaacgagaaguacugcaucuucgccaacuucuccgugacgggcgggaaguggaucgucagcggcuccgaggacaaccucguguacaucuggaaccugcagaccaaggagaucgugcagaagcugcagggccacaccgacgucgugaucagcaccgccugccaccccacggagaacaucaucgccuccgcggcccucgagaacgacaagaccaucaagcuguggaaguccgacugcuga

SEQ ID NO: 38699 - RNA, 3201 nt, Artificial Sequence
  derived and/or modified sequence opt1 from WDR60__Homo_sapiens__NP_060521
auggagcccggcaagcgccggaccaaggacgacaccuggaaggccgacgaccugcgcaagcaccucugggccauccagagcgggggcuccaaggaggagcggaagcaccgcgagaagaagcugcggaaggagagcgagauggaccugccggagcacaaggagccccgcugccgggaccccgaccaggacgcgcgcucccgggaccgcguggccgagguccacacggccaaggagagcccccgcggggagcgggaccgggaccgccagcgggagcgccggcgcgacgccaaggaccgggagaaggagaagcucaaggagaagcaccgcgaggccgagaagucccacagccggggcaaggaccgcgagaaggagaaggaccgccgggcgcgcaaggaggagcugcggcagaccguggcccaccacaaccugcucgggcaggagacccgcgaccggcagcugcuggagcgcgccgagcggaagggccgcuccgugagcaagguccgguccgaggagaaggacgaggacagcgagcgcggcgacgaggaccgggagcgccgguaccgcgagcggaagcuccaguacggggacuccaaggacaacccgcugaaguacuggcuguacaaggaggagggcgagcgccggcaccgcaagccccgggagcccgaccgcgacaacaagcaccgcgagaaguccagcacccgggagaagcgcgagaaguacagcaaggagaaguccaacagcuucuccgacaagggggaggagcggcacaaggagaagcgccacaaggagggcuuccacuucgacgacgagcggcaccagagcaacguggaccgcaaggagaaguccgccaaggacgagccccggaagcgcgagagccagaacggggagcaccggaaccgcggcgcgagcuccaagcgggacggcacgagcucccagcacgccgagaaccucgugcgcaaccacgggaaggacaaggacagccggcgcaagcacggccacgaggagggguccagcgucugguggaagcuggaccagcggccgggcggcgaggagaccguggagaucgagaaggaggagaccgaccuggagaacgcccgcgccgacgccuacaccgcguccugcgaggacgacuucgaggacuacgaggacgacuucgaggugugcgacggggacgacgacgagagcuccaacgagcccgagagccgggagaagcucgaggagcugccccuggcccagaagaaggagauccaggagauccagcgcgccaucaacgccgagaacgagcggaucggcgagcucucccugaagcuguuccagaagcgcgggcggacggaguucgagaaggagccccgcaccgacaccaacagcuccccgagccgcgccuccgucugcggcaucuucguggacuucgcgagcgccucccaccggcagaagucccgcacccaggcccucaagcagaagaugcggagcacgaagcugcugcgccucaucgaccuggacuucagcuucaccuucagccugcucgaccugccgcccgugaacgaguacgacauguacauccggaacuucgggaagaagaacaccaagcaggccuacguccagugcaacgaggacaacguggagcgcgacauccagaccgaggagaucgagacgcgggagguguggacccagcaccccggcgaguccaccgucgugagcggcggguccgagcagcgcgacaccagcgacgccguggucaugcccaagaucgacacgccccggcugugcuccuuccuccgcgcggccugccaggugauggccgugcugcuggaggaggaccggcucgccgccgagcccagcuggaaccugcgcgcgcaggaccgggcccuguacuucuccgacagcuccagccagcucaacaccucccugcccuuccugcagaaccgcaaggucagcucccuccacaccagccgggugcagcgccagaugguggucuccgugcacgaccugccggagaaguccuucgucccccugcucgacagcaaguacgugcugugcgugugggacaucuggcagcccagcggcccccagaagguccugaucugcgagagccaggugaccugcugcugccucuccccgcugaaggccuuccuccuguucgccgggacggcgcacggcagcguggucgugugggaccugcgggaggacucccgccugcacuacagcgugacccuguccgacggguucuggaccuuccggaccgccacguucagcaccgacggcauccucaccuccgucaaccaccgcagcccccugcaggccguggagcccaucuccaccagcgugcacaagaagcaguccuucguccugagccccuucuccacgcaggaggagaugagcggccucuccuuccacaucgccagccuggacgaguccggggugcugaacgugugggucgugguggagcucccgaaggccgacaucgcgggcagcaucuccgaccuggggcugaugcccggcgggcgcgucaagcucgugcacagcgcccugauccagcugggcgacagccucucccacaagggcaacgaguucugggggaccacccagacccugaacgugaaguuccugcccagcgacccgaaccacuucaucaucggcacggacauggggcucaucucccacggcacccggcaggaccugcgcgucgcccccaagcuguucaagccccagcagcacggcauccggcccgugaaggugaacgucaucgacuucagcccguucggggagcccaucuuccucgccggcugcuccgacgggagcauccgccugcaccagcuguccagcgccuucccccuccugcagugggacuccagcaccgacucccacgcggugaccggccugcaguggagccccacccggccggccguguuccucguccaggacgacacguccaacaucuacaucugggaccugcugcagagcgaccucgggcccguggccaagcagcaggucucccccaaccgccugguggccauggccgcggugggcgagcccgagaaggccggcgggagcuuccuggcccucgugcuggcccgggcguccggcagcaucgacauccagcaccugaagcgccggugggccgccccggaggucgacgagugcaaccgccuccggcugcugcuccaggaggcccuguggcccgaggggaagcugcacaaguga

SEQ ID NO: 38700 - RNA, 4572 nt, Artificial Sequence
  derived and/or modified sequence opt1 from WDR62__Homo_sapiens__NP_001077430
auggccgccgugggcagcgggggcuacgcgcgcaacgacgccggggagaagcugcccuccgucauggccggcgugcccgcccggcgcgggcagagcagcccgccgcccgccccgcccaucugccuccggcgccggacccgccuguccaccgcguccgaggagacggugcagaaccgggucagccuggagaaggugcucggcaucaccgcccagaacuccagcggccugaccugcgaccccgggaccggccacguggccuaccuggccgggugcgucguggugauccucgaccccaaggagaacaagcagcagcacaucuucaacacggcgcgcaagucccugagcgcccuggccuucuccccggacggcaaguacaucgucaccggggagaacggccaccggcccgccgugcgcaucugggacguggaggagaagaaccaggucgccgagaugcucggccacaaguacgggguggcgugcguggccuucagccccaacaugaagcacaucgucuccaugggcuaccagcacgacauggugcugaacgugugggacuggaagaaggacaucgucguggccagcaacaagguguccugccgggucaucgcccugagcuucuccgaggacagcuccuacuucgugaccguggggaaccgccacguccgguucugguuccucgaggugagcaccgagacgaaggucaccagcaccgugccccuggugggccgcuccggcauccugggggagcuccacaacaacaucuucugcggcgucgccugcgggcggggccgcauggcggggagcaccuucugcguguccuacagcggccugcugugccaguucaacgagaagcgggugcucgagaaguggaucaaccugaaggucucccugagcuccugccucugcgugagccaggagcugaucuucugcggcugcacggacgggaucgugcgcaucuuccaggcccacucccugcacuaccucgccaaccugccgaagccccacuaccugggcgucgacguggcccaggggcucgagcccagcuuccuguuccaccggaaggccgaggcgguguaccccgacaccgucgcccugaccuucgacccgauccaccaguggcucuccugcguguacaaggaccacagcaucuacaucugggacgugaaggacaucaaccgcgucggcaaggugugguccgagcuguuccacagcuccuacguguggaacgucgagguguaccccgaguucgaggaccagcgggccugccugcccagcggguccuuccugaccugcagcuccgacaacacgauccgcuucuggaaccuggacagcagccccgacucccacuggcagaagaacaucuucagcaacacccugcucaagguggucuacguggagaacgacauccagcaccuccaggacaugucccacuucccggaccgcggcagcgagaacggcacccccauggacgugaaggccgggguccgggugaugcaggucucccccgacggccagcaccuggccagcggggaccgcuccggcaaccugcggauccacgagcuccacuucauggacgagcuggugaagguggaggcgcacgacgccgaggugcucugccuggaguacagcaagcccgagaccgggcugacgcuccuggccuccgccagccgcgaccggcugauccacguccucaacguggagaagaacuacaaccuggagcagacccuggacgaccacuccagcuccaucaccgcgaucaaguucgccggcaaccgcgacauccagaugaucagcugcggcgccgacaaguccaucuacuuccggagcgcccagcagggguccgacggccugcacuucgugcgcacccaccacgucgccgagaagacgacccucuacgacauggacaucgacaucacccagaaguacguggcgguggccugccaggaccggaacguccgcguguacaacaccgugaacgggaagcagaagaagugcuacaagggcagccagggcgacgaggggagccugcugaagguccacguggaccccuccggcacguuccucgccaccagcugcuccgacaagagcaucuccgugaucgacuucuacagcggggagugcaucgccaagauguucggccacuccgagaucaucaccagcaugaaguucaccuacgacugccaccaccugaucacggucuccggggacagcugcguguucaucuggcaccugggccccgagaucaccaacugcaugaagcagcaccuccuggagaucgaccaccggcagcagcagcagcacaccaacgacaagaagcgcuccggccacccccggcaggacaccuacgugagcacgcccuccgagauccacagccuguccccgggggagcagaccgaggacgaccucgaggaggagugcgagcccgaggagaugcugaagacccccagcaaggacucccuggacccggacccccgcugccuccugaccaacggcaagcugccccucugggccaagcggcugcugggggacgacgacgucgcggacggccucgccuuccacgccaagcgcagcuaccagccccacgggcggugggccgagcgcgccggccaggagccgcugaagaccauccuggacgcgcaggaccucgacugcuacuucacgcccaugaagcccgagucccuggagaacagcauccuggacagccucgagccccagucccuggccagccugcucuccgagagcgaguccccgcaggaggccggccgggggcaccccagcuuccugccccagcagaaggaguccagcgaggccuccgagcugauccucuacagccuggaggcggaggugaccgugaccggcaccgacucccaguacugccgcaaggaggucgaggccgggcccggcgaccagcagggggacagcuaccugcgcguguccagcgacuccccgaaggaccagagcccgcccgaggacuccggcgagagcgaggccgaccucgagugcuccuucgccgccauccacagccccgcgcccccgcccgaccccgcgccccgguucgccacgagccugccccacuuccccggcugcgccgggcccaccgaggacgagcugucccucccggagggccccagcgugcccuccagcucccugccgcagacccccgagcaggagaaguuccugcgccaccacuucgagacccucacggagagccccugccgggagcuguuccccgccgcccugggggacgucgaggccuccgaggccgaggaccacuucuucaacccgcgccucagcaucuccacccaguuccugagcucccugcagaaggccagccgguucacccacaccuucccgccccgcgccacgcagugccucgugaagucccccgaggucaagcugauggaccggggcgggagccagccccgcgcgggcaccggcuacgccucccccgaccggacccacgugcuggccgccgggaaggcggaggagacccucgaggccuggcgcccgccgccgcccugccugacgagccuggccuccugcgugcccgccagcuccguccuccccaccgaccggaaccugcccacccccaccagcgcccccacgcccggccuggcgcagggggugcacgcccccagcacgugcuccuacauggaggccaccgccagcucccgcgcccggaucagccgcuccaucagccucggcgacuccgagggccccaucguggcgacccuggcccagccccugcggcgccccagcuccgucggggagcucgccagccugggccaggagcugcaggccaucaccaccgccaccacccccucccucgacagcgaggggcaggagcccgcgcugcgguccuggggcaaccacgaggcccgcgccaaccugcggcucacgcugagcuccgccugcgacgggcugcuccagccgcccguggacacccagcccggcgugaccguccccgccgugagcuuccccgcgccgucccccguggaggagagcgcccugcgccugcacggcuccgccuuccggcccagccuccccgccccggagagccccgggcugcccgcgcaccccuccaacccgcagcugcccgaggcccgccccggcauccccgggggcaccgccagccuccuggagccgacguccggggcccugggccuccugcagggcagccccgcccgcugguccgagcccuggguccccguggaggcgcugccgcccagcccccucgagcugucccggguggggaacauccugcaccgccuccagaccaccuuccaggaggcccuggaccuguaccggguccucgugagcuccggccagguggacaccgggcagcagcaggcccgcacggagcuggucagcaccuuccuguggauccacucccagcucgaggccgagugccuggugggcaccagcguggcccccgcgcaggcccugccgucccccgggccgcccagcccgcccacccucuacccccuggccucccccgaccugcaggcccuccuggagcacuacagcgagcugcugguccaggccgugcggcgcaaggcgcggggccacuga

SEQ ID NO: 38701 - RNA, 3246 nt, Artificial Sequence
  derived and/or modified sequence opt1 from WDR64__Homo_sapiens__NP_653226
auggacauccgcaaggagaagcggcugaacauggcccuccagaugagcaacuucaagaaggcccugaaccgcuucgagaagcugguggagcagaccgcggcccagaagcgggacgagcgcgccggccucuucauccacaaggaggacgccaucggguacgacaaguucuacgccuccguccagaagcuguucggccccgacgugaagaaccaggacgugaagcgguucuaccgcaagcugugcaacaacaccgacgcgagcgccgacuggugcgagaucuucggguacuucuccagcgaggaggacccgaucgccucccagcucgacgaggagaaccuggucuucuucgugagccggaagcgccggauccugaucuccggcagccgccggcgcgacgugaucaaguccaucgucaagaucccccaccucgaccugcugaucacggccacccagaaggggcucaucaccguguucaacaaccaggacaccagcuggaucacgggcugcgacuaccugcugcagcucaagcggaucguggcgaccaccgagcgcaccaucaucgucugggacuacaaggcccagggcuccagccaggagaacuacuucgugaucaagcccauggaccacugccugcugugcgugugcgucgugccccucccggaccaccugugccgggacgacauccugcucggggacgacggcggguucgugaaccgcuucacggucaacuccgacgacuucggcaucaagcaggccaagagcaagcggaagcugcagaaccaggugcuggacuccaagaacuucaagagcgugaagcgcaagcuccacaacgacugggucaugaagauccgguacaucuccgcccugaacugcuucgggagcugcucccuggacagcaaccacagccucgugcuggagucccugaagcgccucgaggacaaccugcccgugcgggaguucagcaugccccgcggcgccaacaccuucugcuacugcgucaaggcgaacgugaucgugaccggcggggacgacaaggucauccgccuguggcaccccaacaucuccaccaagccggugggcaagcucgucgggcacauguucagcaucgccgagaucgugacgaacgagaaggaccagcacguggucucccugagcuccgccaagguguuccgggugugggacauccagacccugagccuccugcaggucuuccacgacucccagggcggccccggggacaugcagaucuacagcaugaucuacgacgccaaccacggcaugcugaucaccggguccagcgugauggacauguacccccucacccgcaugauccaggacacgaagcaggucccccacacccacgagcgggagaucaacgugaugcuguacaacaaguacuuccaccaggugcugaccaucugcuccgagagcaucauccgcgugugggagcucgagaccggccugcaggucuaccagauccuggagccgcacggguucaacacggaggugaccuccgccgcgguggacgagagcggcuuccucuucgccaccggcgccuacaacgggaccguccggaucugggacuucggcuccgggcaggagaugaaggugcugcccgagggcaaggacuggaaggaggacgagcacugccugcgccggcucaucuuccugaaggcccaggagaagcaccagcagcuggugcuggcccucgagcgcaacgggacgaucaagaugauccagggcaaggaggacgacaucuaccugauggucaucugggagcugcccgacguggugcccuuccuccaggacggcaagcacgcgguccaccuccggaugagcacccgcgaccggaacauggccaucccguuccccgacguggagcugaucguggagcgcaacuucucccagcccaccgacaaccccaccauggaccuccugcgggucaacugcaucgaccugcuccagguggagggguacaaccugaucgccgccggcacgcugaacggggugaucauccucuggaacuucgucaccagcaccgugaagaagguguaccgcccggaggacugcuucaccgucaaccccgaccugcaccccaagcacuucaagaucaacgacauccuguuccucuuccggacgcccgagugcgcccgccggagcucccaggacagcaucugcuccagcucccagugcgagagcuccaagggcccgcagagcuccaaggggagcaagcaguccauccacgacagcgaggugaagggcgagcagaccgacgugauggucggcaagcagcagcccauggacaagaagcaccccgggaucgcgaaccugcccgaggcccagccgcccauccuggugaccgcccacgaggacggccaccuccgccuguggacccuggaggggcggcuccugaaggacaugcugcccuucacgaagcacuccgccaucagccucaccucccuguacaccgacagcugcacccgcauccugcucgcgggcaacguggagggccacgucauccugugcaacaucuccagcuuccuggacccgccccacgacgagaagaaguucaagcagcuccugagcuggcgcgcccacucccuggagaucauccaggugaucuacguggaggagaagcaggucgugcucaccgccagcaucgacggguccgugcggcuguggcacgcccugaacggccacuacugcggguacuucggccagcgccggcuguucgagcugagccagacgcgcgacuucauccugcccugcgacgucaccgaguaccccaucgagaucaaggaggaguccaaguucaccgagaagcagaaguacgaguacccgcucaucuucgaccgggagaaguggcgcaagaugagcuccgugagccugcuguucaagcggaccccgcccaaggccuucgagguggagcaggacuucaaguucuucaagucccucagcucccccaagauccgccgguacccccuggagggguucgucacggagaaccgcgaggcgggcaucguguucggcagccugcccaucuacuccaucagcucccccaccagccuccgguuccugccccugaucgggguggaggcccagaaggacuccagcgacggcaucaccgggaagaagaagggcgggcacguccagcgcgagaaggccccgcggcgccggucccucaagaagaaccuggugccccagaucaaccuggccagcagcuucuuccccgccauccccaaguga

SEQ ID NO: 38702 - RNA, 2826 nt, Artificial Sequence
  derived and/or modified sequence opt1 from WDR66__Homo_sapiens__NP_001171474
augagcgacgccgccgaggcgccccgcgaggccaccggcgagaacggggagaccgagaugaaggaggaggaggagccgaaccccaacuacaaggagguggaggacccccagcaggaguccaaggacgacacgaucgccuggcgggagagccaggaggaggagcgcaagaccggcgaggaggagggggaggaggagggcaaggaggacaagaagaucgucauggaggagaccgaggagaaggccggggaggugcaggagaaggaggccuccggcauccaggaggagaccacgguggagccccaggaggucaccgcgagcaugauccggcuggagacccagaucaccgacucccagagcaucacguccggcaucuucccgaagacccagcgcgggagcaaguccaagcucagccugcagcuggaggacgccgagaccgacgagcuccugcgggaccuguccacccagaucgaguuccucgaccuggaccagaucagccccgaggagcagcagaucuccagccccgagcgccagcccuccggcgagcuggaggagaagacggaccggaugccgcaggacgagcucgggcaggagcgccgggaccuggagcccgagaaccgcgaggagggccaggagcggcgcgugagcgacauccaguccaaggccgggaucagccgggagucccuggugagcagcaccaccgaggacauccucuuccagaaggacaaguccacccccgucuacccccugacgaugaccuggagcuucggcuggaacuccagccugccgguguacuacauccgcgaggagcggcagcgcgugcuccuguacgucugcgcccacaccgcgaucaucuacaacguguuccggaacaaccaguaccaccuccagggccacgccaacaucaucuccugccugugcgugagcgaggaccgccgguggaucgccaccgccgacaaggggcccgacugccuggucaucaucugggacuccuucacgggcauccccgugcacaccaucuucgacagcugccccgaggggaacggcaucauggccauggcgaugacccacgacgccaaguaccuggccaccaucuccgacgccgaggugcagaaggucugcaucuggaaguggacgcucgccguggagaccccggcgugcacccuggagcugcccaccgaguacggcgugcagaacuacgucacguucaaccccaccaacaacaaggagcucgugagcaacuccaagacccgcgccaucuacuacgccugguacgaggagcgggacacccuggcccacagcgcgccccugcucacggagaagaccuucaacaagcugguggggaaguucucccagagcaucuuccaccugaaccucacccagauccuguccgccaccauggagggcaagcuggucgugugggacauccaccgcccgcccagcuccgccagcacguuccucggguuccccuacaucaagcccugcaagcuggugcaccuccagaaggagggcaucaccguccugaccaccaucgacuccuacaucgugaccggggacaucaagggcaacaucaaguucuacgaccacacgcugagcaucgucaacugguacagccaccugaagcucggcgccauccgcacccuguccuucagcaagaccccggccaccccgcccacggagaaguccaacuacccgcccgacugcacccugaagggggaccucuucgugcugcggaacuucaucaucggcaccagcgacgccgcgguguaccaccugaccacggacgggaccaagcucgagaagcuguucgucgagcccaaggacgccaucugcgccaucuccugccaccccuaccagccccugaucgccaucggcagcaucugcgggaugaucaagguguggaacuacgagaacaagcaguaccucuucucccgcguguucgagaagggccugggcguccagagccugaccuacaaccccgagggggcgcugcucggcgccggguucaccgagggcacgguguacauccuggacgccaugucccuggagaacgagagccccgagcccuucaaguacucccggaccagcgugacccacaucuccuucagccacgacucccaguacauggccaccgccgaccgcagcuucacggucgcgguguacaugcucgugguccggaacgggcagcgcgugugggaguaccuggcccggcugcgcucccaccgcaagagcauccggagccuccuguucggcguguaccuggacuccaacgagccgcggcuccugagccugggcaccgaccgccuccugaucgaguacgaccugcuccgguccuacaaggaccaccuggagguccuggacauccaccacaccgaccaggggugcuacccgaccugcauggugugguacccgccccucacgcgcgagcuguuccugcucaucugcaacagcggcuacaaggugaagcuguucaacgccaccaccaagaugugccggaagacccugcucgggcccgccuacggcucccccaucgagcagacgcagguccugcccgugcgcagcauggccgagcugcagaagcgguaccucguguucaucaaccgcgacaaggucggccugcagauccugcccguggacgggaacccccacaagaccuccgcgaucgugugccaccccaacggcgucgccgggauggccgugagcuacgacggcugcuacgccuucaccgccgggggccacgaccgguccgugguccaguggaagaucacccucagccaccccggcucccaggcgcccauccugagcccguccgacacgagccgcuccuga

SEQ ID NO: 38703 - RNA, 1965 nt, Artificial Sequence
  derived and/or modified sequence opt1 from WDR70__Homo_sapiens__NP_060504
auggagcgcagcggccccuccgaggugaccgggagcgacgccuccggcccggacccccagcuggccgucaccaugggguucacgggcuucgggaagaaggcgcggaccuucgaccucgaggccauguucgagcagacccgccggaccgccguggagcgcagccggaagacgcuggaggcccgcgagaaggaggaggagaugaaccgggagaaggagcugcgccggcagaacgaggacaucgagcccaccuccagccgcuccaacgugguccgggacugcagcaaguccagcucccgcgacaccagcuccagcgaguccgagcagagcuccgacagcuccgacgacgagcucaucgggcccccgcugccgcccaagauggugggcaagcccgugaacuucauggaggaggacauccugggcccccucccgccgccccugaacgaggaggaggaggaggccgaggaggaggaggaggaggaggaggaggaggagaaccccguccacaagauccccgacagccacgagaucacccugaagcacggcacgaagaccgugagcgcgcucgggcuggaccccuccggcgcccggcuggugaccgggggcuacgacuacgacgucaaguucugggacuucgccggcauggacgccagcuucaaggcguuccgcucccuccagcccugcgagugccaccagaucaagagccugcaguacuccaacaccggggacaugauccugguggugagcggcuccagccaggccaaggucaucgaccgggacggguucgaggugauggagugcaucaagggcgaccaguacaucguggacauggccaacacgaagggccacaccgccaugcuccacaccggguccuggcaccccaagaucaagggcgaguucaugaccugcagcaacgacgccacgguccgcaccugggagguggagaaccccaagaagcagaaguccguguucaagccccggaccaugcaggggaagaaggucauccccaccacgugcaccuacagccgcgacggcaaccugaucgcggccgccugccagaacggguccauccagaucugggaccggaaccugaccgugcacccgaaguuccacuacaagcaggcccacgacagcggcaccgacacguccugcgugaccuucagcuacgacggcaacguccucgccucccgcgggggcgacgacagccugaagcugugggacauccggcaguucaacaagccccucuucuccgcgagcgggcugcccaccauguuccccaugaccgacugcugcuucagcccggacgacaagcugaucgugacgggcaccuccauccagcgcgggugcggcagcggcaagcucguguucuucgagcgccggaccuuccagcgcgucuacgagaucgacaucaccgacgccuccgugguccggugccuguggcaccccaagcugaaccagaucaugguggggacgggcaacgggcucgccaagguguacuacgaccccaacaagagccagcgcggcgccaagcugugcgucgugaagacccagcggaaggccaagcaggcggagacccugacccaggacuacaucaucacgccccacgcccucccgauguuccgcgagccccggcagcgcuccacccggaagcagcuggagaaggaccgccuggacccccucaagagccacaagccggagccgcccguggccgggcccggccggggcgggcgcgucggcacccacgggggcacccuguccagcuacaucgugaagaacaucgcccuggacaagaccgacgacuccaacccccgggaggccauccuccgccacgcgaaggccgccgaggacagccccuacugggugucccccgccuacagcaagacgcagcccaagaccauguucgcgcaggucgaguccgacgacgaggaggccaagaacgagccggaguggaagaagcggaagaucuga

SEQ ID NO: 38704 - RNA, 3309 nt, Artificial Sequence
  derived and/or modified sequence opt1 from WDR72__Homo_sapiens__XP_011519737
augcgcaccagccugcaggccguggcccucuggggccagaaggcgcccccgcacuccaucaccgccaucaugaucacggacgaccagcggaccaucgucaccgggagccaggagggccagcugugccuguggaaccucucccacgagcugaagaucagcgccaaggagcugcuguucgggcacuccgccagcgugaccugccuggcccgcgcgcgggacuucuccaagcagcccuacaucgugagcgccgccgagaacggcgagaugugcgucuggaacgugacgaacgggcagugcauggagaaggccacccugcccuaccgccacaccgcgaucugcuacuaccacugcuccuuccggaugaccggcgagggcuggcuccugugcugcggggaguaccaggacgugcugaucaucgacgccaagacgcucgccgucgugcacagcuuccgcuccagccaguuccccgacuggaucaacugcaugugcaucgugcacuccaugcggauccaggaggacagccugcuggucguguccguggccggcgagcucaaggucugggaccugagcuccagcaucaacuccauccaggagaagcaggacguguacgagaaggagagcaaguuccuggagagccucaacugccagaccauccgcuucugcaccuacaccgagcggcugcugcucguggucuucuccaagugcuggaagguguacgacuacugcgacuucagccugcugcucacggaggugucccgcaacgggcaguucuucgccggcggggaggucaucgcggcccaccggauccugaucuggaccgaggacggccacagcuacaucuaccagcugcucaacuccggccugagcaaguccaucuacccggccgacgggcgcgugcugaaggagaccaucuacccccaccuccugugcagcaccuccgugcaggagaacaaggagcagagccggcccuucgucaugggcuacaugaacgagcgcaaggagcccuucuacaaggugcuguucuccggggaggugagcggccggaucacgcucuggcacaucccggacguccccguguccaaguucgacggcagcccccgcgagauccccgucaccgccaccuggacccugcaggacaacuucgacaagcacgacacgaugucccagagcaucaucgacuacuucuccgggcugaaggacggcgccgggaccgcgguggugaccagcuccgaguacaucccgagccucgacaagcugaucugcggcugcgaggacgggaccaucaucaucacgcaggcccugaacgccgccaaggcccggcuccuggagggcggcagccuggucaaggacuccccgccccacaaggugcucaaggggcaccaccagagcgugaccucccugcuguacccccacggccucagcuccaagcuggaccagagcuggaugcuguccggggaccucgacagcugcgucauccugugggacaucuucaccgaggagauccugcacaaguucuuccuggaggcgggccccgugaccucccuccugaugagccccgagaaguucaagcugcgcggggagcagaucaucugcugcgugugcggcgaccacuccgucgcccuccugcaccuggagggcaagagcugccuccugcacgcccggaagcaccuguuccccgugcgcaugaucaaguggcaccccguggagaacuuccucaucgucgggugcgccgacgacuccguguacaucugggagaucgagacgggcacccuggagcggcacgagaccggggagcgcgcccgcaucauccugaacugcugcgacgacagccagcucgugaaguccguccugccgaucgcgagcgagacccugaagcacaaguccaucgagcagcggagcagcucccccuaccagcucggcccccugcccugcccggggcuccagguggagagcuccugcaaggugacggacgccaaguucugcccccgccccuucaacguccuccccgugaagaccaaguggagcaacgugggcuuccacauccugcuguucgaccucgagaaccuggucgagcugcuccugccgacgccccuguccgacguggacagcuccagcuccuucuacggcggggaggugcuccggcgcgccaagagcaccgucgagaagaagacccugacccugcggaaguccaagaccgccugcggcccccucagcgcggaggcccuggccaagccgaucaccgagucccuggcccagggggacaacaccaucaaguucagcgaggagaacgacggcaucaagcgccagaagaagaugaagaucuccaagaagaugcagcccaagcccagccggaagguggacgccucccucacgaucgacaccgcgaagcuguuccugagcugccuccugcccuggggcguggacaaggaccuggacuaccucugcaucaagcaccugaacauccugaagcuccaggggccgaucucccugggcaucagccugaacgaggacaacuucagccucaugcugcccgggugggaccugugcaacuccggcaugaucaaggacuacagcggggucaaccucuucucccgcaaggugcuggaccugagcgacaaguacaccgccacccuccccaaccaggugggcaucccccggggccuggagaacaacugcgacucccugcgcgagagcgacacgaucgucuaccuccugucccggcuguuccucgugaacaagcuggugaacaugccgcuggagcucgccugccgcgucgggagcuccuuccggauggagagcauccacaacaagaugcgcggcgccgggaacgacauccugaacauguccagcuucuacuccugccugcggaacggcaagaacgagagccacgugcccgaggccgaccucucccugcugaagcucaucagcugcuggcgcgaccaguccgugcaggucaccgaggcgauccaggccgugcugcuggccgaggugcagcagcacaugaagucccucgggaagauccccgucaacagccagcccgugagcauggccgagaacggcaacugcgagaugaagcagaugcugccgaagcuggaguggaccgaggagcucgagcugcagugcgugcggaacacccugccccuccagacgcccgucagccccgugaagcacgacuccaacagcaacuccgccaacuuccaggacguggaggacaugccggaccgcugcgcgcuggaggagagcgagucccccggcgagccccggcaccacagcuggaucgccaaggucugccccugcaagguguccuga

SEQ ID NO: 38705 - RNA, 1158 nt, Artificial Sequence
  derived and/or modified sequence opt1 from WDR74__Homo_sapiens__NP_060563
auggccgccgcggccgcccgcuggaaccacgugugggucggcaccgagaccgggauccugaagggcgugaaccuccagcggaagcaggccgccaacuucacggccgggggccagccccgccgggaggaggcggugagcgcccugugcugggggaccggcggcgagacccagaugcuggucgggugcgccgaccgcaccgugaagcacuucuccacggaggacggcaucuuccaggggcagcggcacugcccgggcggggagggcauguuccgcggccucgcgcaggccgacgggacccugaucacgugcguggacagcggcauccugcgggucuggcacgacaaggacaaggacaccuccagcgacccccuccuggagcugcgcguggggcccggcgugugccggaugcgccaggaccccgcccacccgcacgucguggccaccggcgggaaggagaacgcccucaagaucugggaccugcagggcuccgaggagcccguguuccgggcgaagaacguccgcaacgacuggcuggaccuccgggugcccaucugggaccaggacauccaguuccugcccgggagccagaagcuggugaccugcaccggcuaccaccagguccgcguguacgacccggccagcccccagcggcgccccgugcucgagaccacguacggggaguacccccugaccgccaugacccugaccccgggcggcaacuccgucaucguggggaacacgcacggccagcucgccgagaucgaccugcggcaggggcgccugcucggcugccugaaggggcuggccggcuccgugcggggccuccagugccaccccagcaagccccugcuggcguccugcgggcucgaccgcguccugcggauccaccgcauccagaacccccgcggccuggagcacaagguguaccucaagagccagcugaacugccugcuccuguccgggcgggacaacugggaggacgagccgcaggagccccaggagcccaacaaggugccccuggaggacaccgagaccgacgagcucugggccagccuggaggccgccgccaagcgcaagcuguccggccucgagcagccgcagggggcgcugcagacccggcgccggaagaagaagcgccccggcagcacgucccccuga

SEQ ID NO: 38706 - RNA, 1881 nt, Artificial Sequence
  derived and/or modified sequence opt1 from WDR76__Homo_sapiens__NP_079184
augagccgcagcggcgccgccgcggagaaggccgacagccggcagcgcccccagaugaaggugaacgaguacaaggagaaccagaacaucgccuacgucucccugcggccggcccagaccaccgugcucaucaagacggccaagguguaccuggcgcccuucagccuguccaacuaccagcucgaccagcugaugugccccaagagccuguccgagaagaacagcaacaacgaggucgccugcaagaagaccaagaucaagaagaccugccgccggaucaucccgcccaagaugaagaacaccuccagcaaggccgaguccacgcuccagaacagcuccagcgccgugcacaccgaguccaacaagcugcagcccaagcgcaccgcggacgccaugaaccugagcguggacgucgaguccagccaggacggggacuccgacgaggacaccacgcccagccucgacuucagcggccugucccccuacgagcggaagcgccugaagaacaucagcgagaacgccgacuucuucgccucccuccagcugagcgaguccgccgcgcggcugcgcgagaugaucgagaagcggcagccgcccaagagcaagcgcaagaagcccaagcgggagaacgggaucggcugccgccgguccaugcgccuccugaagguggaccccagcggggugucccugccggccgcccccaccccgcccacccucgucgccgacgagacgccccugcugccgcccggcccccucgagaugaccagcgagaaccaggaggacaacaacgagcgguucaagggcuuccugcacaccugggccgggauguccaagcccagcuccaagaacaccgagaagggccugagcuccaucaagagcuacaaggcgaaccucaacgggauggugaucuccgaggacaccguguacaaggucacgaccggccccaucuucagcauggcccugcaccccuccgagacccgcacccugguggccgugggggccaaguucggccaggucggccucugcgaccugacgcagcagcccaaggaggacgggguguacguguuccacccgcacagccagcccgucagcugccuguacuucucccccgccaaccccgcgcacauccucagccuguccuacgacggcacccugcggugcggggacuucagccgcgccaucuucgaggagguguaccggaacgagcgcuccagcuucuccagcuucgacuuccucgccgaggacgccuccacccugaucgugggccacugggacggcaacaugagccuggucgaccgccggaccccggggacguccuacgagaagcucaccagcuccagcaugggcaagauccgcaccgugcacgugcaccccguccaccggcaguacuucaucaccgccgggcugcgcgacacgcacaucuacgacgcgcggcgccugaacucccggcgcagccagccccucaucucccugaccgagcacaccaagagcaucgccagcgccuacuucuccccgcugaccggcaaccggguggucacgaccugcgccgacugcaaccuccgcaucuucgacagcuccugcaucagcuccaagaucccccugcugaccaccauccggcacaacacguucaccgggcgcuggcucacccgguuccaggcgaugugggaccccaagcaggaggacugcgugaucgugggcagcauggcccacccccgccgggucgagaucuuccacgagaccggcaagcgcgugcacuccuucgggggcgaguaccuggugagcgucugcuccaucaacgccaugcacccgacccgguacauccuggccgggggcaacagcuccgggaagauccacguguucaugaacgagaaguccugcuga

SEQ ID NO: 38707 - RNA, 2448 nt, Artificial Sequence
  derived and/or modified sequence opt1 from WDR78__Homo_sapiens__XP_011540464
augacccccggcaagcacagcggggccuccgcccgggcggccaacggcggggccuggggcuaccgggacuuccgcgggggccagaagaagggcuggugcaccacgccgcagcugguggccaccaugcccgucagccccgccgggucccacaagcagcagaacuucggccucaacaacgcgacccagcccaagaaguccaucagcuucuucgccaccaugaaggccacgagcgugaagggguacaccggcgccaaccagucccggauggcggugagcaagaccguccugaucccgcccgagcugaagaccguggagaagcccaaccccaacaucaagacgacccagguguucgacaucaacgggaccgacgucaccccgcgcccccucuaccaccccgacccccugacgggcaccgccaagccguccaagcugcucaccagccaggagggcucccuggggagcgaguucaucuccagcuacucccuguaccagaacaccaucaaccccagcacgcucggccaguucacccgguccgugcuggggagcuccaccgugagcaagagcuccgucagcgccuccgagagcaucgccgaggaccuggaggagcccuccuacaagcgcgagcggcucaccagcuucacggaccuccaggugauccgcgccgcgcccgagaagaucgugaccaaggaggaccuggagaagaacaucgagaucauccugaccgagaccgagacgcugcgguucuucgaccugccgaccgucaugguguccguggagagcgaggaggccgagaaggucacccagcgcaacaagaacuacgaggugcucugccggaaccgccugggcaacgaccuguacguggagcggaugaugcagaccuucaacggcgcccccaagaacaaggacguccagugcgacaagaucaucauggaggacaaggggaucauguccacggccugggaccucuacgacagcuacaacgccauggagcuggugucccugagcgugaagcaguccgucguggagagcuccagcaaggcgaacgugcuccccaaggaccaggaccagcgccugcccggcuccaccaccgagaagaacagcgagaccuccagccugauggacaucgagaacgucauccucgccaagauccacgaggacgaggaggaccacagcgacgccauccugaaguccgacaaguuccaccaggaccuguucuucauggagcgggugcucauggagaacaucuuccagccgaagcuggccgccuaccgccagcugcccguccucaaggagcccgagcccgaggagccggaggacgugcuggagagcgcgaagcacgaggagguggaggaggaguccaagaaggaggaggaggaggagauccacgccgaggagagcacgauccccgccaaccuggagcggcucugguccuucagcugcgaccugaccaaggggcugaacgucuccagccucgccuggaacaagaccaaccccgaccugcuggccgugggcuacgggcacuucggcuucaaggagcagaagcgcggccucgcgugcugcugguccaucaagaaccccauguggccggagcggaucuaccagagccccuacggggugaccgccgucgacuucuccaucggcgcccccaaccugcuggccgugggguaccacaacggcacgaucgcgaucuacaacgugcgcagcaacuccaacgucccggugcucgacagcuccgagagcccccagaagcaccuggggcccguguggcagcugcaguggaucgagcaggaccggggcaccaccggcgacgggaagcgcgagauccucgucuccaucagcgccgacggccgcaucagcaagugggugauccggaaggggcuggacugcuacgaccugaugcgccugaagcggaccaccgccgccuccaacaagaagggcggggagaaggagaagaaggacgaggcccucaucagccgccaggcgcccggcaugugcuucgccuuccacccgaagggccccguguacaaggucacguggaaccccuucugccacgacguguuccuguccugcagcgccgacuggggcgugaucaucuggcagcaggagaacgucaagcccucccugagcuucuacccggccaccuccgugguguacgacgucgccuggagccccaaguccagcuacaucuucgcggccgccaacgagaaccggguggagaucugggaccuccacaucuccacccuggacccccugaucgugaacaccgccaaccccgggaucaaguucacgaccauccucuucgccaagcagaccgacugccugcuggucggggacagcgacggccagguguccguguacgagcuccgcaacaugccgaccguccuggagacgggccgcggggacaucauggacacccugcucggcagcaaguccaaccagagcgcguga

SEQ ID NO: 38708 - RNA, 4473 nt, Artificial Sequence
  derived and/or modified sequence opt1 from WDR7__Homo_sapiens__NP_056100
auggccggcaacagccuggugcuccccaucguccugugggggcgcaaggccccgacccacugcaucuccgcggugcugcucaccgacgacggcgccacgaucgugaccgggugccacgacggccagaucugccugugggaccugagcgucgagcuccagaucaacccccgggcccugcuguucgggcacaccgccuccaucaccugccucagcaaggccugcgcguccagcgacaagcaguacaucguguccgccagcgaguccggcgagaugugccugugggacgugagcgacggccgcugcaucgaguucacgaagcuggccugcacccacaccgggauccaguucuaccaguucuccgucggcaaccagcgggaggggcgccuccugugccacggccacuaccccgagauccuggugguggacgccaccagccucgagguccuguacucccuggugagcaagaucucccccgacuggaucagcuccaugagcaucauccggucccaccgcacgcaggaggacaccguggucgcgcucagcgugaccgggauccugaagguguggaucgucaccagcgagaucuccgacaugcaggacacggagccgaucuucgaggaggagagcaagcccaucuacugccagaacugccaguccaucagcuucugcgccuucacccagcggucccugcucguggugugcagcaaguacuggcgcgucuucgacgccggcgacuacucccugcugugcagcggccccuccgagaacgggcagaccuggaccggcggggacuucgugagcuccgacaaggugaucaucuggacggagaacggccagagcuacaucuacaagcuccccgccuccugccugccggccagcgacuccuuccggagcgacgucggcaaggcgguggagaaccugaucccccccgugcagcacauccuccuggaccgcaaggacaaggagcugcucaucugccccccggucacccgguucuucuacgggugccgcgaguacuuccacaagcugcugauccagggcgacuccagcgggcggcucaacaucuggaacaucuccgacaccgccgacaagcagggcagcgaggaggggcuggccaugaccacgagcaucucccugcaggaggccuucgacaagcucaaccccugccccgccggcaucaucgaccagcugagcgugauccccaacuccaacgagccgcugaaggucaccgcgagcguguacauccccgcccacggccgccucgugugcgggcgggaggacggcuccaucgucaucgugcccgccacccagaccgccaucgugcagcugcugcagggggagcacaugcuccgccggggcuggcccccgcaccgcacgcugcgggggcaccgcaacaaggucaccugccugcucuacccccaccaggugagcgcccgguacgaccagcgcuaccugaucuccggcggcguggacuucagcgucaucaucugggacaucuucuccggggagaugaagcacaucuucugcgugcacggcggggagaucacccagcugcucgugccccccgagaacugcagcgcgcgcguccagcacugcaucugcuccguggccagcgaccacuccgugggccugcugagccugcgggagaagaagugcaucaugcucgccucccgccaccuguucccgauccaggucaucaaguggcggcccagcgacgacuaccuggugguggggugcuccgacggcagcgucuacguguggcagauggacaccggcgcccucgaccgcugcgugauggggaucacggccgucgagauccugaacgcgugcgacgaggccgugcccgccgccguggacagccugucccaccccgcggucaaccucaagcaggccaugacccggcgcagccuggccgcccugaagaacauggcccaccacaagcuccagacccuggcgaccaaccugcucgccuccgaggccagcgacaagggcaaccugccgaaguacucccacaacagccugauggugcaggccaucaagacgaaccucaccgaccccgacauccacgugcuguucuucgacgucgaggcccugaucauccagcuccugaccgaggaggcgucccggcccaacaccgcccugaucagcccggagaaccuccagaaggccuccgggagcuccgacaagggcggcagcuuccugacggggaagcgcgccgccgugcuguuccagcaggugaaggagaccaucaaggagaacaucaaggagcaccuccuggacgacgaggaggaggacgaggagaucaugcggcagcgccgggaggaguccgaccccgaguaccgcagcuccaagagcaagccccugacccuccuggaguacaaccugaccauggacaccgcgaagcucuucauguccugccugcacgccuggggccugaacgagguccucgacgaggugugccuggaccggcuggggaugcucaagccccacugcacggugagcuucggccugcugucccgcgggggccacaugagccucaugcugccgggcuacaaccagcccgccugcaagcugagccacgggaagaccgaggucggccggaagcuccccgccuccgagggggugggcaaggggaccuacggcgugagccgcgcggucaccacgcagcaccugcuguccaucaucagccucgccaacacccugauguccaugaccaacgccaccuucaucggcgaccacaugaagaaggggcccacgcggccgccccgccccagcacccccgaccuguccaaggcccggggcagcccgcccaccuccagcaacaucgugcaggggcagaucaagcagguggccgcgcccgucguguccgcccgcagcgacgccgaccacuccggcagcgaccccccguccgcccccgcccuccacaccugcuuccuggugaacgagggguggagccagcuggcggccaugcacugcgucaugcuccccgaccugcugggccucgacaaguuccgccccccgcugcuggagaugcucgcccggcgcuggcaggaccggugccuggaggugcgcgaggccgcccaggcgcugcuccuggccgagcugcggcgcaucgagcaggccggccggaaggaggccaucgacgcgugggcccccuaccucccccaguacaucgaccacgugaucucccccggggucacgagcgaggccgcccagaccaucaccaccgccccggacgcguccggccccgaggccaaggugcaggaggaggagcacgaccugguggacgacgacaucacgaccgggugccugagcagcgucccccagaugaagaagaucuccaccagcuacgaggagcgccggaagcaggccaccgccaucgugcuccugggcgugaucggggccgaguucggcgcggagaucgagccgcccaagcugcucacgcgcccccgguccagcucccagauccccgagggcuucgggcugaccagcggcggguccaacuacagccuggcccgccacaccugcaaggcccucaccuuccugcugcuccagccgcccucccccaagcugcccccgcacagcacgauccggcgcaccgccaucgaccugaucggccggggcuucaccgucugggagcccuacauggacguguccgccguccucauggggcugcuggagcucugcgcggacgccgagaagcagcuggccaacaucaccaugggccugccccucagccccgccgccgacuccgcgcgcagcgcccggcacgcccugucccugaucgccacggcgcgcccgcccgccuucaucaccaccaucgccaaggaggugcaccggcacaccgcccucgccgcgaacacgcagagccagcagaacaugcacaccaccacccuggcccgcgccaagggggagauccugcgggugaucgagauccucaucgagaagaugcccacggacgucguggaccugcugguggaggucauggacaucaucauguacugccucgagggcucccuggugaagaagaaggggcugcaggagugcuuccccgccaucugccgcuucuacauggugagcuacuacgagcgcaaccaccggaucgccgucggcgcgcgccacggcuccguggcccuguacgacauccggaccgggaagugccagaccauccacggccacaaggggccgaucaccgccguggccuucgcccccgacggccgcuaccucgcgaccuacagcaacacggacagccacaucuccuucuggcagaugaacaccagccugcugggguccaucggcaugcucaacagcgccccccagcugcggugcaucaagaccuaccagguccccccggugcagcccgccucccccggcagccacaacgcccugaagcucgcgcgccugaucuggaccuccaaccggaacgugauccugauggcccacgacgggaaggagcaccgcuucauggucuga

SEQ ID NO: 38709 - RNA, 2217 nt, Artificial Sequence
  derived and/or modified sequence opt1 from WDR81__Homo_sapiens__NP_001157145
augcuggugcgcgucgugcucagccugacccccuccuucccggagcccagcgcccuguacaccgccugcaagauggugcgguggcucuccgcgaagcugggccccacggucgccagccgccacguggcccggaaccugcuccgccugcugaccuccugcuacguggggcccacccggcagcaguucaccgucagcuccggcgagagcccgccccucuccgccgggaacaucuaccagaagcgccccgugcugggcgacaucgugagcgggcccguccuguccugccuccugcacaucgcccggcuguacggcgagccggugcucacguaccaguaccugcccuacaucagcuaccugguggcgcccggcuccgccagcgggcccucccgccucaacagccggaaggaggccggccugcuggccgcggucacccucacccagaagaucaucguguaccuguccgacaccacgcugauggacauccucccgcgcaucagccacgaggugcugcugcccguccucuccuuccugaccagccuggugaccggguuccccagcggcgcccaggcccggaccauccucugcgugaagacgaucucccugaucgcccugaucugccuccgcaucgggcaggagaugguccagcagcaccugagcgagcccguggccaccuucuuccagguguucucccagcugcacgagcuccggcagcaggaccugaagcuggacccggcgggccgcggcgaggggcagcucccccaggucguguucagcgacggccagcagcggcccguggaccccgcccugcuggacgagcuccagaaggucuucacccuggagauggccuacaccaucuacgugccguucuccugccugcucggggacaucauccgcaagaucauccccaaccacgagcuggucggcgagcuggccgcccucuaccuggagagcaucucccccagcucccggaaccccgcgagcguggagccgacgaugcccggcaccgggcccgagugggacccccacggcgggggcugcccgcaggacgacgggcacuccggcaccuucggcagcgugcuggucgggaaccgcauccagauccccaacgacucccggcccgagaacccgggcccccuggggcccaucagcggcgucgggggcggcgggcucggcuccgggagcgacgacaacgcccugaagcaggagcugccccgcuccgugcacggccucagcgggaacuggcuggccuacuggcaguacgagaucggcgugucccagcaggacgcccacuuccacuuccaccagauccggcugcagagcuucccgggccacagcggggccgugaagugcguggcgccccucuccagcgaggacuucuuccuguccggcagcaaggaccgcaccguccgccuguggccccucuacaacuacggggacggcacguccgagaccgcgccccggcugguguacacccagcaccgcaagagcguguucuucgucggccagcuggaggccccgcagcacgugguguccugcgacggggccguccacgugugggaccccuucaccggcaagacgcuccggaccguggagccccuggacagccgcgucccccugaccgccguggccgugaugccggcgccccacaccuccaucacgauggccagcuccgacagcacccuccgguucgucgacugccgcaagcccgggcugcagcacgaguuccggcugggcgggggccucaaccccggccuggugcgcgcccuggccaucuccccgagcgggcgguccguggucgccggcuucagcuccggguucauggugcuccuggacacccgcaccggccuggugcuccggggguggcccgcccacgagggcgacauccugcagaucaaggccgucgagggcagcgugcuggugagcuccagcuccgaccacagccucacggucuggaaggagcuggagcagaagcccacccaccacuacaaguccgccagcgaccccauccacaccuucgaccuguacggguccgagguggugaccggcacggucagcaacaagaucggggugugcucccuccuggagccgcccagccaggcgaccaccaagcuguccagcgagaacuuccgcggcacccucaccucccuggcccugcuccccacgaagcggcaccuccugcuggggagcgacaacggcgugauccgccugcuggccuga

SEQ ID NO: 38710 - RNA, 948 nt, Artificial Sequence
  derived and/or modified sequence opt1 from WDR83__Homo_sapiens__NP_115708
auggccuuccccgagccgaagccccgcccgcccgagcugccccagaagcggcucaagacccuggacugcggccagggggccgugcgcgcgguccgguucaacguggacggcaacuacugccugaccugcgggagcgacaagacgcucaagcuguggaacccccugcgcggcacccuccugcggaccuacuccgggcacggcuacgaggugcuggacgccgccggcagcuucgacaacuccagccucugcuccgggggcggggacaaggccgucgugcugugggacguggccagcggccaggucgugcgcaaguuccgggggcacgcgggcaaggugaacaccguccaguucaacgaggaggccacggugauccuguccggcagcaucgacuccagcauccgcugcugggacugccggucccgccggcccgagcccgugcagacccucgacgaggcccgcgacggggucagcuccgugaaggugagcgaccacgagauccuggccggcuccgucgacgggcgggugcgccgguacgaccugcgcaugggccagcuguucagcgacuacgugggcuccccgaucacgugcacgugcuucagccgggacgggcagugcacccucgucuccagccuggacagcacccuccgccugcuggacaaggacaccggcgagcuccugggggaguacaagggccacaagaaccaggaguacaagcuggacugcugccucuccgagcgggacacccacguggugagcugcuccgaggacgggaaggucuucuucugggaccugguggagggcgcgcuggcccucgcccugcccgugggcagcggggucgugcagucccuggccuaccaccccaccgagcccugccuccugaccgccaugggcgggagcguccagugcuggcgcgaggaggcguacgaggccgaggacggcgccggguga

SEQ ID NO: 38711 - RNA, 834 nt, Artificial Sequence
  derived and/or modified sequence opt1 from WDR86__Homo_sapiens__NP_001271190
augagccgcgaguuccggggccaccgcaacugcgugcugacccucgccuacuccgcccccugggaccugcccagcacccccugcgcggaggaggccgccgccgggggccugcucgucacgggguccaccgacggcaccgccaagguguggcaggucgcgagcgggugcugccaccagacccugcggggccacacgggcgccgugcugugccucgugcuggacacccccgggcacaccgccuucaccggcuccacggacgccaccauccgcgcgugggacauccugagcggggagcagcuccggguguuccgcgagcaccggggcuccgucaucugccuggagugcagccgcgccgccgggacccuggcccccggcccguccacccggagccucgaguccugcggcgggugcagcggcgccacgcacuccagcuccaccgcgagccgcugcaccgcccggugcuccaccccgccccgcacgaccgcccccugcgccagcgggaccugcgccggcuccgaggugccccggggcccccugcgccccugcgcggccagccgggggagcuccgccacccgcugggccgcgcccccgcggcccugcagccgccccgaccccgccggcccgcugcagacgcccgcccagacccccuccgggagccaguccgcgcccccgugcuacccccggugguggcgccccauggccggcgaggggcggggcgcccgcaagcccggccgcgaggagagcccgucccaggccagcggguucucccucguggcccggcgccggugggagcgcgagugcagccccuggggcccgccgcccuuccccuucuga

SEQ ID NO: 38712 - RNA, 1977 nt, Artificial Sequence
  derived and/or modified sequence opt1 from WDR93__Homo_sapiens__NP_001271324
augagcuucccccgcggcucccagacccagaagaucaagcacccgaucgggacccggaagggcccccuggaggugccgccgcccacggagaaggacuggcccaaggacgacgagcaggaccacguccucguggaccccgacgaggagcuggacagccugccccagcccuaccgcaugaucaacaagcucgugaaccugcuguucgaccaguccugggagaucaucgaggagcggaacgcccuccgcgaggccgagagcucccagauccagcccaccgucuacccgccccugggggagauccagcugaacaagaugcccaacugcauggcggugagccaggacuacguguucaucggcggggccaagggcuucuccaucuacaaccucuacagcgccaagcagaucuacgccugggagaagcugaaggucgacgugaccuccaucugggccaccgaccugggcaacgagauccucaucgcgcccguggacgagauggggaucauccggcuguucuacuucuacaaggagggccuguaccucgucaaggccaucaacgagguggacgacacgagcaagcagacgaccugcaucaagauggagaucucccagggcggggacuucgccgccuuccugcugcagggggcgggcgacaucuggcucgacguguacaagcugcccaaggagaccuggcugaagaagcucgagcacccccagcugaccagcaacccgaagaagaagguccgccagccccagcugaacucccucggccccaucagcgccgacccccuggagauggacgccaacguguccuucaagggggacaucaagcugagccucccgguguacaucaugaagaucaagccgcccaagcccgucaccggcaccaccuucaagagcccccuggagguguucgccaagaucaaggacugcuacgggcugggcuccggccagaaccacuucaucaaggacucccagugggagcagcaggccgagaucuucaacgcgagcuacaagaaguaccucgaccgggagugggaggaggagccccugagcacggccaccuucuacuuccugcuccccuccugccuguucgccaugcccccggaggugaaggggcccagcggcauggccugcguccuggggauccacuggacccgcucccacaacuucuuccucuacagccugaaccggacccugaaggacaaggccgaccccgagggcguguggccgugcgcggcccccaucgccgugucccagcucagcugcuccagcuccuaccugguccuggccugcgaggacggggugcucacgcugugggaccuggccaagggccagaacauguaccccgagggccaggucaagagccagaugaagugcguggugcucugcaccgacgcgucccugcaccuggucgaggccagcgggacccagggccccaccaucuccgugcucguggagcgcccggucaagcaccuggacaagacgaucugcgccguggcccccgugcccgcccugcccgggaugguccugaucuucagcaagaacggcuccgugugccucauggacguggcgaagcgggagaucaucugcgccuucgccccgcccggggccuucccccuggagguccccuggaagccgguguucgcggugagccccgaccaccccugcuuccugcuccgcggcgacuacucccacgagaccgccagcaccgacgacgccggcauccaguacuccgucuucuacuucaacuucgaggccugcccccugcuggagaacaucagcaagaacugcaccaucccgcagcgggaccucgacaacauggccuucccccaggcgcugccccuggagaagcgcugcgagcgguuccuccagaaguccuaccgcaagcuggagaagaaccccgagaaggaggaggagcacugggcccggcugcagcgcuacagccucagccugcagcgggagaacuucaagaaguga

SEQ ID NO: 38713 - RNA, 1299 nt, Artificial Sequence
  derived and/or modified sequence opt1 from WEE1__Homo_sapiens__NP_001137448
auggacaccgagaaguccggcaagcgcgaguucgacgugcggcagacgccccaggucaacaucaacccguucacccccgacagccugcuccugcacagcuccgggcagugccgccggcgcaagcggaccuacuggaacgacagcugcggcgaggacauggaggccuccgacuacgagcuggaggacgagacccgccccgccaagcggaucaccaucacggagagcaacaugaagucccgcuacaccaccgaguuccacgagcucgagaagaucgggagcggcgaguucggguccguguucaagugcgugaagcggcuggacggcugcaucuacgcgaucaagcgcagcaagaagccccuggccggcuccgucgacgagcagaacgcccuccgggagguguacgcccacgccgugcuggggcagcacagccacgucgugcgcuacuucuccgcgugggccgaggacgaccacaugcugauccagaacgaguacugcaacggcgggagccucgccgacgccaucuccgagaacuaccggaucaugagcuacuucaaggaggcggagcugaaggaccugcuccuccaggugggccgcgggcugcgguacauccacuccaugagccugguccacauggacaucaagccguccaacaucuucaucagccgcaccagcauccccaacgccgccuccgaggagggcgacgaggacgacugggccagcaacaaggugauguucaagaucggcgaccuggggcacgugacgcggaucuccagcccccaggucgaggagggcgacucccgcuuccuggccaacgaggugcuccaggagaacuacacccaccuccccaaggcggacaucuucgcccuggcccugaccguggucugcgccgccggggcggagccgcugccccggaacggcgaccaguggcacgagauccgccagggccggcugccccgcaucccccaggugcucagccaggaguucaccgagcugcugaaggugaugauccacccggaccccgagcgccggcccuccgccauggcccucgucaagcacagcgugcugcuguccgccagccgcaaguccgccgagcagcuccggaucgagcugaacgcggagaaguucaagaacagccugcuccagaaggagcugaagaaggcccagauggccaaggccgccgcggaggagcgcgcccuguucacggaccggauggccacccgcuccaccacccagagcaaccggacgucccgccucaucgggaagaagaugaaccggagcgugucccugaccaucuacuga

SEQ ID NO: 38714 - RNA, 663 nt, Artificial Sequence
  derived and/or modified sequence opt1 from WFDC1__Homo_sapiens__NP_001269395
augccccugaccggcguggggcccggcagcugccgccggcagaucauccgcgcccucugccugcugcuccugcugcuccacgccggguccgcgaagaacaucuggaagcgggcccugcccgcccgccuggccgagaagucccgggccgaggaggcgggcgcccccgggggcccccgccagccgcgggccgaccgcugcccgccgccgccccggacccucccgcccggcgccugccaggcggcccgcugccaggccgacagcgagugcccccggcaccgccggugcugcuacaacgggugcgccuacgccugccuggaggcggugcccccgccgcccguccuggacuggcucgugcagcccaagccccgcuggcugggcgggaacggcuggcugcucgacgggcccgaggagguccugcaggccgaggccugcagcacgaccgaggacggcgccgagccccugcucugccccuccggcuacgagugccacauccugagccccggggacguggccgagggcauccccaaccgggggcagugcgugaagcagcgccggcaggcggacggccgcauccugcggcacaagcucuacaaggaguaccccgagggcgacuccaagaacgucgccgagcccgggcgcggccagcagaagcacuuccaguga

SEQ ID NO: 38715 - RNA, 375 nt, Artificial Sequence
  derived and/or modified sequence opt1 from WFDC2__Homo_sapiens__XP_011526797
augcccgccugccgccugggcccgcucgccgcggcccugcugcucagccugcuccuguucggguucacccugguguccggcaccggggccgagaagacgggcgucugccccgagcugcaggccgaccagaacugcacccaggagugcgugagcgacuccgagugcgccgacaaccucaagugcugcagcgcggggugcgccaccuucugcucccugcccaacgacaaggagggcagcugcccccaggugaacaucaacuucccgcagcugggccucugccgggaccagugccaggucgacucccagugccccgggcagaugaagugcugccgcaacggcugcgggaaggugagcugcgugacccccaacuucuga

SEQ ID NO: 38716 - RNA, 2673 nt, Artificial Sequence
  derived and/or modified sequence opt1 from WFS1__Homo_sapiens__NP_001139325
auggacagcaacaccgcgccccugggcccguccugcccccagccgcccccggcgccccagccccaggcccgcagccggcucaacgccaccgccucccuggagcaggagcgcagcgagcggccccgcgccccggggccccaggccggccccgggcccggcgugcgggacgccgccgccccggccgagccccaggcgcagcacacgcgcucccgggagcgcgccgacgggaccggccccaccaagggcgacauggagauccccuucgaggagguccuggagcgggccaaggccggggacccgaaggcccagaccgaggugggcaagcacuaccuccagcuggcgggggacacggacgaggagcugaacagcugcaccgccguggacuggcucguccuggccgccaagcagggccgccgggaggccgugaagcugcuccgccggugccuggcggaccgccgggggaucaccuccgagaacgagcgcgaggugcggcagcugagcuccgagaccgaccucgagcgcgccguccggaaggccgcccuggugauguacuggaagcugaaccccaagaagaagaagcaggucgccguggcggagcuccuggagaacgugggccaggugaacgagcacgacggcggggcccagcccggccccguccccaagagccugcagaagcagcgccggaugcucgagcgccugguguccagcgaguccaagaacuacaucgcccuggacgacuucguggagaucacgaagaaguacgccaagggggucauccccagcucccucuuccugcaggacgacgaggacgacgacgagcuggccggcaagagccccgaggaccucccccugcgccugaagguggugaaguacccgcuccacgcgaucauggagaucaaggaguaccugaucgacauggccucccgggccggcaugcacuggcugagcaccaucauccccacccaccacaucaacgcccucaucuucuucuucaucgucuccaaccugaccaucgacuucuucgcguucuucaucccccuggugaucuucuaccucagcuucaucagcauggugaucugcacgcugaaggucuuccaggacuccaaggccugggagaacuuccgcacccugaccgaccuccugcugcgguucgagcccaaccucgacguggagcaggccgaggugaacuucggguggaaccaccuggagccguacgcccacuuccugcucagcgucuucuucgugaucuucuccuuccccaucgccagcaaggacugcauccccugcuccgagcuggcggucaucaccggcuucuucacggugaccagcuaccugucccucagcacccacgccgagccguacacccgccgggcccuggccacggaggugaccgccgggcugcucucccugcugcccagcaugccccugaacuggcccuaccucaagguccugggccagaccuucaucaccgugccgguggggcaccuggucgugcucaacguguccguccccugccugcuguacguguaccuccuguaccuguucuuccgcauggcgcagcuccggaacuucaagggcacguacugcuaccuggugcccuaccuggucugcuucauguggugcgagcucagcguggugauccugcuggaguccaccggccucgggcugcugcgcgccagcaucggcuacuuccucuuccuguucgcccugcccauccucgucgccgggcuggcccuggugggcgugcuccaguucgcgcggugguucaccucccuggagcugaccaagaucgccgucacgguggccgugugcagcgucccgcuccugcugcgcugguggaccaaggccuccuucagcgugguggggauggucaagucccucacccggagcagcauggugaagcugauccugguguggcucaccgcgaucguccuguucugcugguucuacguguaccgcuccgagggcaugaagguguacaacagcacgcugaccuggcagcaguacggcgcccucugcgggccccgggccuggaaggagaccaacauggcccgcacccagauccugugcucccaccuggagggccaccgggucacguggaccgggcgcuucaaguacgugcgggugaccgacaucgacaacagcgccgaguccgcgaucaacaugcuccccuucuucaucggcgacuggaugcgcugccuguacggggaggccuaccccgccugcagcccgggcaacaccuccaccgccgaggaggagcugugccggcucaagcugcuggccaagcaccccugccacaucaagaaguucgaccgcuacaaguucgagaucacggucggcaugcccuucagcuccggggcggacggcagccgcucccgggaggaggacgacgugaccaaggacaucgugcuccgcgccagcuccgaguucaagagcguccugcugucccuccggcaggggagccugaucgaguucuccaccauccuggagggccgccucggcagcaaguggcccguguucgagcugaaggccaucagcugccugaacugcauggcccagcucuccccgacccggcgccacgugaagaucgagcacgacuggcggagcacgguccacggggccgugaaguucgcguucgacuucuucuucuuccccuuccuguccgccgccuga

SEQ ID NO: 38717 - RNA, 1890 nt, Artificial Sequence
  derived and/or modified sequence opt1 from WHSC1__Homo_sapiens__NP_015627
auggaguucagcaucaagcagagcccccugagcgugcaguccgucgugaagugcaucaagaugaagcaggccccggagauccucggcagcgccaacgggaagacccccuccugcgaggugaaccgcgagugcagcgucuuccuguccaaggcgcagcugagcuccagccuccaggagggcgugaugcagaaguucaacgggcacgacgcccugcccuucauccccgccgacaagcugaaggaccucaccucccggguguucaacggcgagccgggggcccacgacgccaagcugcgcuucgagagccaggagaugaagggcaucggcacgccgcccaacaccacccccaucaagaacgggucccccgagaucaagcugaagaucaccaagacguacaugaacggcaagccccucuucgagagcuccaucugcggggacagcgcggccgacgucucccagagcgaggagaacggccagaagcccgagaacaaggcccggcgcaaccggaagcgcuccaucaaguacgacagccugcuggagcaggggcucguggaggccgcgcuggugagcaagaucuccagccccuccgacaagaagaucccggccaagaaggagagcugccccaacaccggccgggacaaggaccaccuccugaaguacaacgucggcgaccuggugugguccaaggugagcggguaccccugguggcccugcauggucuccgccgacccgcugcuccacagcuacaccaagcugaagggccagaagaaguccgcccgccaguaccacgugcaguucuucggggacgcccccgagcgggcguggaucuucgagaagucccugguggccuucgagggcgagggccaguucgagaagcucugccaggaguccgccaagcaggcccccaccaaggccgagaagaucaagcugcugaagcccaucagcgggaagcuccgcgcgcagugggagaugggcaucguccaggccgaggaggccgccuccaugagcguggaggagcggaaggccaaguucacguuccuguacgugggggaccagcugcaccucaacccgcaggucgcgaaggaggccggcaucgccgccgagucccugggggagauggccgagagcuccggcgugagcgaggaggcggccgagaaccccaaguccgugcgcgaggagugcauccccaugaagcggcgccggcgcgccaagcugugcagcagcgccgagacccucgagucccaccccgacaucggcaagagcaccccgcagaagaccgcggaggccgacccccggcgcggggucggcuccccgcccgggcggaagaagacgaccgugagcaugccccgcucccggaagggcgacgccgccagccaguuccugguguucugccagaagcaccgcgacgaggucguggccgagcaccccgacgcguccggggaggagaucgaggagcugcuccgcagccaguggucccugcugagcgagaagcagcgggcccgcuacaacaccaaguucgcccucgucgcccccgugcaggccgaggaggacuccggcaacgugaacggcaagaagcggaaccacaccaagcgcauccaggacccgacggaggacgcggaggccgaggacacgccccggaagcgccugcggaccgacaagcacagccugcgcaagcgggacaccaucaccgacaagaccgcccgcaccuccagcuacaaggccauggaggccgcguccagccucaagucccaggccgccaccaagaaccugagcgacgccugcaagccccugaagaagcggaaccgcgcgagcacggccgccuccagcgcccucggguucuccaagagcuccagccccuccgccagccugaccgagaacgaggucaaguga

SEQ ID NO: 38718 - RNA, 1938 nt, Artificial Sequence
  derived and/or modified sequence opt1 from WHSC1L1__Homo_sapiens__NP_060248
auggacuucagcuucuccuucaugcagggcaucauggggaacaccauccagcagcccccgcagcugaucgacagcgccaacauccgccaggaggacgccuucgacaacaacuccgacaucgcggaggacggcgggcagacccccuacgaggccacgcuccagcagggcuuccaguaccccgccaccaccgaggaccugcccccgcugaccaacggguaccccagcuccaucagcguguacgagacgcagaccaaguaccaguccuacaaccaguaccccaacggcagcgccaacggcuucggggccguccggaacuucucccccaccgacuacuaccacagcgagaucccgaacacccgcccccacgagauccucgagaagcccagcccgccccagcccccgccgccgcccagcgugccccagacggugauccccaagaagaccggcucccccgagaucaagcugaagaucaccaagaccauccagaacgggcgggagcuguucgagagcucccucugcggcgaccugcugaacgagguccaggcgagcgagcacacgaaguccaagcacgagagccgcaaggagaagcggaagaaguccaacaagcacgacagcagccgcuccgaggagcgcaagagccacaagauccccaagcucgagcccgaggagcagaaccggcccaacgagcggguggacaccguguccgagaagccccgcgaggagcccguccugaaggaggaggcccccgugcagcccauccugagcuccgugccgaccaccgaggucagcacgggggugaaguuccaggugggcgaccucgucugguccaaggugggcaccuaccccugguggcccugcauggugagcuccgacccgcagcuggagguccacaccaagaucaacacccgcggggcccgggaguaccacgugcaguucuucagcaaccagcccgagcgggccugggugcacgagaagcgcguccgggaguacaagggccacaagcaguacgaggagcugcucgcggaggccacgaagcaggccuccaaccacagcgagaagcagaagauccgcaagccccggccccagcgcgagcgggcccagugggacaucgggaucgcccacgcggagaaggcccugaagaugacccgcgaggagcggaucgagcaguacaccuucaucuacaucgacaagcagccggaggaggcccugucccaggccaagaaguccguggccuccaagaccgaggugaagaagacgcgccgcccccggagcguccucaacacccagcccgagcagaccaacgcgggcgagguggccuccagccuguccagcaccgagauccgccggcacagccagcgccggcacacguccgccgaggaggaggagcccccgcccgugaagaucgccuggaagaccgccgcggcccgcaagagccugcccgccuccaucaccaugcacaagggcagccucgaccugcagaagugcaacaugucccccgucgugaagaucgagcaggucuucgcccugcagaacgccaccggggacggcaaguucaucgaccaguucguguacagcacgaaggggaucggcaacaagaccgagaucuccgugcgggggcaggaccgccucaucaucagcaccccgaaccagcggaacgagaagcccacccaguccgucagcucccccgaggcgacgagcggcuccaccggcagcguggagaagaagcagcagcgccgguccauccgcacccggagcgaguccgagaaguccaccgaggugguccccaagaagaagaucaagaaggagcaggucgagaccgugccgcaggccacggugaagaccgggcugcagaagggcagcgccgaccgcggggugcagggcagcgugcgguucagcgacuccagcgucuccgccgcgaucgaggagaccguggacuga

SEQ ID NO: 38719 - RNA, 1140 nt, Artificial Sequence
  derived and/or modified sequence opt1 from WIF1__Homo_sapiens__NP_009122
auggcccgccggagcgccuuccccgcggccgcccuguggcucugguccauccugcugugccuccuggcccugcgcgccgaggcgggcccgccccaggaggagagccucuaccuguggaucgacgcccaccaggcccgggugcugaucggguucgaggaggacauccucaucgucuccgagggcaagauggcccccuucacccacgacuuccgcaaggcgcagcagcggaugcccgccaucccggugaacauccacagcaugaacuucaccuggcaggccgccgggcaggccgaguacuucuacgaguuccugucccugcgcagccucgacaagggcaucauggcggaccccacggugaacgucccccugcuggggaccgugccccacaaggccuccgugguccaggugggcuucccgugccucggcaagcaggacgggguggccgccuucgaggucgacgugaucgugaugaacagcgagggcaacaccauccugcagacgccccagaacgccaucuucuucaagaccugccagcaggcggagugccccgggggcugccggaacgggggcuucugcaacgagcgccggaucugcgagugccccgacggcuuccacgggccgcacugcgagaaggcccugugcaccccgcgcugcaugaacggcgggcucugcgucacccccggcuucugcaucugcccgcccggcuucuacggggugaacugcgacaaggccaacugcuccaccacgugcuucaacggcgggaccugcuucuaccccggcaagugcaucugcccgcccgggcuggagggcgagcagugcgagaucagcaagugcccccagcccugccggaacggcgggaagugcaucggcaaguccaagugcaagugcagcaagggguaccagggcgaccugugcuccaagcccgugugcgagcccgggugcggcgcccacgggaccugccacgagcccaacaagugccagugccaggagggcuggcacggccgccacugcaacaagcgguacgaggccagccucauccacgcgcugcgccccgccggggcccagcugcggcagcacacccccucccucaagaaggccgaggagcgccgggacccgcccgagagcaacuacaucugguga

SEQ ID NO: 38720 - RNA, 1512 nt, Artificial Sequence
  derived and/or modified sequence opt1 from WIPF1__Homo_sapiens__NP_003378
augcccgugccgcccccccccgccccgcccccccccccgaccuucgcccuggcgaacaccgagaagcccacgcucaacaagaccgagcaggccggccgcaacgcccugcugagcgacaucuccaaggggaagaagcucaagaagaccgucaccaacgaccggagcgcccccauccuggacaagcccaagggcgccggggcgggcgggggcggcgggggcuucgggggcgggggcggcuucgggggcgggggcggcgggggcgggggcggguccuucggcggcgggggcccgcccgggcugggcgggcucuuccaggccggcaugcccaagcugcgcagcacggccaaccgggacaacgacuccggcgggagccgccccccgcugcucccccccggcgggcgguccaccagcgccaagcccuucuccccgcccagcggccccgggcgcuuccccgugccgucccccggccaccggagcggcccccccgagccgcagcgcaaccggaugccccccccgcgccccgacgugggguccaagcccgacagcauccccccgcccguccccuccaccccccggccgauccagagcuccccccacaaccgcggcagcccccccgugccggggggcccccggcagcccucccccggcccgacccccccccccuucccggggaaccgcggcacggcgcuggggggcgggagcauccggcagagcccccuguccagcuccagccccuucuccaaccgccccccgcucccccccaccccgagccgggcccuggacgacaagcccccccccccgcccccccccgugggcaaccgcccguccauccaccgggaggccguccccccccccccgccccagaacaacaagccccccgugccgagcaccccccgccccuccgccagcucccaggcccccccgcccccccccccgcccagccggcccggccccccgccccugcccccguccagcuccgggaacgacgagaccccccgccucccccagcgcaaccugagccuguccagcuccacgcccccgcuccccagccccggccggagcgggccccugccgcccccccccuccgagcgcccgcccccccccgugcgggacccgcccggccgcagcgggccccugcccccgcccccccccgucucccggaacggcagcaccucccgcgcgcucccggccaccccccagcugcccagccgguccggcguggacagcccccgcuccgggccgcggcccccccugccgcccgaccgccccagcgccggcgcccccccgcccccccccccguccaccagcauccggaacggguuccaggacucccccugcgaggacgagugggagagccgcuucuacuuccaccccaucuccgaccuccccccgcccgagcccuacgugcagacgaccaagagcuaccccuccaagcuggcccggaacgagagccgcagcggcuccaaccggcgcgagcggggggcgccgccccugccccccaucccgcgcuga

SEQ ID NO: 38721 - RNA, 1323 nt, Artificial Sequence
  derived and/or modified sequence opt1 from WIPF2__Homo_sapiens__NP_573571
augcccaucccgcccccccccccgcccccccccggcccgcccccccccccgaccuuccaccaggccaacaccgagcagcccaagcugagccgcgacgagcagcgggggcgcggcgcccuccugcaggacaucugcaaggggacgaagcugaagaaggugaccaacaucaacgaccgguccgcgcccauccucgagaagcccaagggcagcuccgggggcuacggcagcgggggcgccgcccugcagccgaaggggggccuguuccaggggggcguccucaagcugcgccccgugggcgccaaggacggguccgagaaccuggccggcaagcccgcgcuccagauccccagcucccgggccgccgccccgcgcccccccgugagcgcggccuccgggcggccccaggacgacaccgacagcucccgcgccagccugccggagcugccccggaugcagcgccccucccuccccgaccugagccggccgaacaccacguccagcaccggcaugaagcacuccagcuccgccccccccccgcccccccccggccgccgggccaacgcgccgcccaccccccugcccaugcacagcagcaaggccccggccuacaaccgcgagaagccccucccccccaccccggggcagcggcugcaccccggccgcgaggggccccccgccccgccccccgucaagcccccgcccucccccgugaacauccggacgggccccagcgggcagucccuggccccgccccccccgcccuaccgccagccccccggcgugccgaacggccccagcucccccaccaacgagagcgcgcccgagcucccgcagcggcacaacucccugcaccgcaagacccccgggcccguccggggccuggcccccccgccccccaccagcgccucccccagccuccuguccaaccgcccgcccccccccgcccgcgacccgcccagccggggggccgcgccccccccgcccccccccgugauccgcaacggcgcccgggacgccccgccccccccgccccccuaccgcaugcacggguccgagcccccgagccggggcaagcccccccccccgcccucccgcacgcccgccggccccccgcccccccccccgcccccccugcggaacgggcaccgcgacagcaucaccaccgugcgguccuuccucgacgacuucgagagcaaguacuccuuccaccccgucgaggacuucccggcccccgaggaguacaagcacuuccagcgcaucuaccccagcaagaccaaccgggcggcccgcggcgcccccccgcugccccccauccugcgguga

SEQ ID NO: 38722 - RNA, 1452 nt, Artificial Sequence
  derived and/or modified sequence opt1 from WIPF3__Homo_sapiens__NP_001073998
augcccgugccgcccccccccccgcccccccugcccccgcccccccccccgcucggcgcccccccccccccgccccccagcgcccccccggucuccaccgacaccagcucccugcgccgggcggaccccaaggggcgcagcgcccugcucgccgacauccagcagggcacgcggcugcgcaaggugacccagaucaacgaccgguccgccccccagaucgagagcuccaaggggaccaacaaggagggcgggggcagcgccaacacccgcggcgcguccacgcccccgacccugggggaccucuucgccggcggguuccccgugcugcggcccgccggccagcgcgacgucgccgggggcaagaccggccaggggcccggcagccgggcgccguccccccgccugcccaacaagaccaucagcgggccgcucaucccccccgccuccccccggcugggcaacacgagcgaggcccacggcgccgcccgcaccgcgccgccccggcccaacgugcccgccccgcccccccccaccccgcccccccccccgcccccccugcccccgccccuccccuccagcucccccaucaagaccccgcuggugagcccccccgggccgcugacgaagggcaaccuccccgucguggccccccccgugccgugcgcccccccccccccgcccccccccccgccccccacccccccgccccugccccccgccuccguccugagcgacaaggcggugaagccgcagcucgccccccugcaccugccccccaucccgcccccccucccccugcugccgcccugcggguaccccggccucaaggccgagccggccagccccgcccaggacgcgcaggagccccccgccccgccccccccccugccgcccuacgccuccugcagcccccgcgccucccugcccgccccgccccuccccggggugaacagcuccagcgagacccccccgccccugccccccaaguccccgagcuuccaggcgcccccccagaaggccggcgcccaggcccugcccgcgccgcccgccccccccggcucccagccguuccuccagaagaagcggcacgggcgccccggcgccgggggcgggaagcugaaccccccgcccgccccccccgcccggagcccgaccacggagcuguccagcaagucccagcaggcgaccgccuggacccccacccagcagcccggcggccagcuccgcaacgggagccugcacaucaucgacgacuucgaguccaaguucacguuccacagcgucgaggacuuccccccgcccgacgaguacaagcccugccagaagaucuaccccuccaagaucccgcggagccgcacccccggccccuggcugcaggccgaggccguggggcaguccagcgacgacaucaagggccggaacagccagcucucccugaagacccugcgcuga

SEQ ID NO: 38723 - RNA, 1341 nt, Artificial Sequence
  derived and/or modified sequence opt1 from WIPI1__Homo_sapiens__NP_060453
auggaggccgaggccgcggacgccccgcccggcgggguggagagcgcccuguccugcuucagcuucaaccaggacugcaccucccucgccaccggcacgaaggccggguacaagcuguucagccuguccagcgucgagcagcucgaccaggugcacggcuccaacgagauccccgacguguacaucgucgagcgccuguucagcuccagccuggugguggucgugucccacaccaagccccggcagaugaacguguaccacuucaagaaggggaccgagaucugcaacuacagcuacuccagcaacauccucuccauccgccugaaccggcagcgccugcucgucugccuggaggagagcaucuacauccacaacaucaaggacaugaagcugcucaagacccugcuggacauccccgcgaaccccacgggccucugcgcccuguccaucaaccacagcaacuccuaccuggccuaccccggcagccucaccagcggggagaucgugcuguacgacggcaacucccugaagaccgugugcaccaucgccgcgcacgaggggacgcucgccgccaucaccuucaacgccagcggcuccaagcuggccagcgcguccgagaaggggaccgucauccggguguucagcgugcccgacggccagaagcuguacgaguuccgccggggcaugaagcgcuacgucaccaucuccagccucguguucuccauggacagccaguuccugugcgccuccagcaacacggagaccgugcacaucuucaagcuggagcaggucaccaacucccggcccgaggagccgagcaccugguccggguacaugggcaagauguucauggccgccacgaacuaccuccccacccaggugagcgacaugaugcaccaggaccgcgccuucgcgaccgcccggcugaacuucuccgggcagcgcaacaucugcacccugagcacgauccagaagcucccccggcugcugguggccuccagcagcggccaccucuacauguacaaccuggacccccaggacggcggggagugcguccugaucaagacccacucccuccugggcagcgggaccaccgaggagaacaaggagaacgaccugcgcccgucccucccccagagcuacgccgccacgguggcgcggcccuccgccagcuccgccagcaccgugcccggcuacuccgaggacgggggcgcccugcgcggcgaggucaucccggagcacgaguucgccaccgggcccgugugccuggacgacgagaacgaguucccgcccaucauccucugccggggcaaccagaaggggaagaccaagcagagcuga

SEQ ID NO: 38724 - RNA, 1332 nt, Artificial Sequence
  derived and/or modified sequence opt1 from WIPI2__Homo_sapiens__NP_001028690
augaaccuggccagccaguccggcgaggccggggcgggccagcuccuguucgccaacuucaaccaggacaacaccgaggugaagggggccagccgcgccgccggccuggggcggcgcgcggugguguggucccucgccgugggcagcaaguccggcuacaaguucuucagccuguccagcgucgacaagcuggagcagaucuacgagugcaccgacacggaggacgugugcaucguggagcgccucuucuccagcucccuggucgccaucgugagccugaaggcgccccggaagcucaaggugugccacuucaagaaggggaccgagaucugcaacuacuccuacagcaacaccauccuggccgucaagcugaaccggcagcgccucaucgugugccuggaggagucccuguacauccacaacauccgggacaugaaggugcuccacaccauccgcgagacgccgcccaaccccgccggccugugcgcccugagcaucaacaacgacaacugcuaccucgccuaccccggguccgccaccaucggcgagguccagguguucgacaccaucaaccugcgggcggccaacaugaucccggcccacgacagcccccuggccgcccucgcguucgacgccuccgggaccaagcuggccacggccagcgagaagggcaccgugauccgcgucuucagcauccccgagggccagaagcuguucgaguuccggcgcggggugaagcggugcguguccaucugcagccucgccuucuccauggacggcauguuccugagcgcguccagcaacaccgagaccguccacaucuucaagcuggagacggugaaggagaagcccccggaggagcccaccaccuggaccggguacuucggcaaggugcucauggccuccacgagcuaccugcccucccaggucaccgagauguucaaccagggccgcgccuucgccaccgugcggcugcccuucugcgggcacaagaacaucugcagccucgccaccauccagaagaucccgcgccugcuggugggcgcggccgacggguaccucuacauguacaaccuggacccccaggagggcggggagugcgcccugaugaagcagcaccggcucgacggcucccuggagacgaccaacgagauccuggacagcgccucccacgacugcccccucgucacccagaccuacggcgcggccgccgggaaggccuacacggacgaccugggcgccgucgggggcgcgugccuggaggacgaggccagcgcccuccgccuggacgaggacuccgagcacccgcccaugauccugcggaccgacuga

SEQ ID NO: 38725 - RNA, 468 nt, Artificial Sequence
  derived and/or modified sequence opt1 from WISP1__Homo_sapiens__NP_001191798
augcgcugguuccugcccuggacccucgccgccgugaccgcggccgccgccagcacgguccuggccaccgcgcuguccccggcccccaccaccauggacuucacgcccgcgccccucgaggacaccagcucccggccgcaguucugcaaguggcccugcgagugcccgcccagcccgccccgcugcccccugggcgugucccugaucaccgacgggugcgagugcugcaagaugugcgcccagcagcucggcgacaacugcaccgaggccgccaucugcgacccccaccgggggcuguacugcgacuacagcggcgaccgcccccgguacgccaucggggugugcgcccgccgggaggaggucuccggcugcgugcccgcccgcggcauccacgagcugcacacgugcgggcuccaccagcacacccugcugagcacccaggugcucuggucccugcacggccaguga

SEQ ID NO: 38726 - RNA, 753 nt, Artificial Sequence
  derived and/or modified sequence opt1 from WISP2__Homo_sapiens__XP_005260660
augcgcggcacccccaagacccaccuccuggccuucagccugcugugccuccuguccaaggugcggacccagcugugcccgacccccugcacgugccccuggcccccgccccgcugcccccucggggucccccuggugcuggacggcugcgggugcugccgggugugcgcccgccggcucggcgagccgugcgaccagcugcacgucugcgacgcgagccaggggcuggugugccagcccggcgccggccccgggggccgcggggcccucugccugcuggccgaggacgacuccagcugcgaggugaacggccggcucuaccgcgagggggagaccuuccagccccacugcuccauccggugccgcugcgaggacggcggcuucacgugcgucccgcugugcagcgaggacgugcggcugcccuccugggacugcccccacccccgccggguggagguccucgggaagugcugcccggagugggugugcggccagggcgggggccuggggacccagccccugcccgcccagggcccccaguucagcgggcucguguccagccugccgcccggcguccccugccccgagugguccaccgcgugggggccgugcagcacgaccugcggccugggcauggccacccgcguguccaaccagaaccgguucugccgccucgagacccagcggcgccugugccugagccggcccugcccgcccucccgcgggcggagcccccagaacuccgccuucuga

SEQ ID NO: 38727 - RNA, 1065 nt, Artificial Sequence
  derived and/or modified sequence opt1 from WISP3__Homo_sapiens__NP_003871
augcagggccuccuguucagcacccugcugcucgccgggcuggcccaguucugcugccgcgugcagggcaccgggccccuggacacgaccccggagggccggcccggggaggucuccgacgcgccccagcgcaagcaguucugccacuggcccugcaagugcccgcagcagaagccccggugcccgcccggcgugagccucgugcgcgacggcugcgggugcugcaagaucugcgccaagcagcccggcgagaucugcaacgaggccgaccugugcgacccccacaaggggcuguacugcgacuacuccgucgaccggccccgcuacgagaccggcgugugcgccuaccucguggccgucgggugcgaguucaaccaggugcacuaccacaacggccagguguuccagcccaacccgcuguucagcugccugugcgucuccggcgcgaucgggugcacgccccucuucauccccaagcuggccggcagccacugcuccggggccaagggcggcaagaaguccgaccagagcaacugcagccuggagccccuccugcagcagcuguccaccagcuacaagaccaugccggccuaccggaaccucccccugaucuggaagaagaagugccuggugcaggcgaccaaguggacccccugcucccgcacgugcgggaugggcaucagcaaccgggugaccaacgagaacuccaacugcgagaugcgcaaggagaagcggcucugcuacauccagcccugcgacagcaacauccugaagaccaucaagaucccgaaggggaagaccugccagcccacguuccagcuguccaaggccgagaaguucgucuucagcggcugcuccagcacccagagcuacaagcccaccuucugcgggaucugccucgacaagcgcugcugcauccccaacaaguccaagaugaucaccauccaguucgacugcccgaacgagggcagcuucaaguggaagaugcuguggaucacguccugcgugugccagcggaacugccgcgagcccggcgacaucuucagcgagcugaagauccucuga

SEQ ID NO: 38728 - RNA, 1638 nt, Artificial Sequence
  derived and/or modified sequence opt1 from WLS__Homo_sapiens__XP_011540493
auggccggcgccaucaucgagaacaugagcaccaagaagcugugcaucgucgggggcauccuccugguguuccagaucaucgcguuccuggucgggggccucaucgcccccgggccgaccacggccguguccuacaugagcgugaagugcguggacgcccgcaagaaccaccacaagaccaagugguucgugcccuggggccccaaccacugcgacaagauccgggacaucgaggaggccaucccccgcgagaucgaggcgaacgacaucgucuucuccgugcacaucccgcugccccacauggagaugagccccugguuccaguucaugcuguucauccuccagcuggacaucgccuucaagcugaacaaccagauccgggagaacgccgagguguccauggacgucagccucgccuaccgcgacgacgcguucgccgaguggaccgagauggcccacgagcgggugccccgcaagcugaagugcaccuucacguccccgaagacccccgagcacgagggccgguacuacgagugcgacgugcugcccuucauggagaucgggagcgucgcccacaaguucuaccuccugaacauccgccugcccgugaacgagaagaagaagaucaacgugggcaucggggagaucaaggacauccggcucgucggcauccaccagaacgggggcuucaccaaggugugguucgccaugaagaccuuccugacgccguccaucuucaucaucauggugugguacuggcgccggaucaccaugaugagccgcccgcccguccugcucgagaaggugaucuucgcgcugggcaucuccaugaccuucaucaacauccccguggagugguucagcaucggguucgacuggaccuggaugcuccuguucggcgacauccggcaggggaucuucuacgccaugcugcuguccuucuggaucaucuucugcggcgagcacaugauggaccagcacgagcgcaaccacaucgccggcuacuggaagcaggucgggcccaucgccgugggcagcuucugccucuucaucuucgacaugugcgagcgcggggugcagcugacgaaccccuucuacuccaucuggaccaccgacaucggcaccgagcuggccauggcguucaucaucgucgccgggaucugccucugccuguacuuccuguuccucugcuucaugguguuccaggucuuccggaacaucagcggcaagcaguccagccugcccgccauguccaaggugcggcgccugcacuacgagggccucaucuuccgguucaaguuccugaugcugaucacgcucgccugcgccgcgaugaccgugaucuucuucaucgucagccaggugaccgaggggcacuggaaguggggcggggugaccguccaggugaacagcgccuucuucacgggcaucuacgggauguggaaccuguacguguucgcccugauguuccucuacgcccccucccacaagaacuacggcgaggaccagagcaacggcaugcagcugccgugcaagucccgcgaggacugcgcccuguucgucagcgagcucuaccaggagcuguucuccgcgagcaaguacuccuucaucaacgacaacgccgccagcgggaucuga

SEQ ID NO: 38729 - RNA, 7929 nt, Artificial Sequence
  derived and/or modified sequence opt1 from WNK1__Homo_sapiens__NP_001171914
auguccggcggggccgccgagaagcaguccagcacccccggcucccuguuccugagcccgcccgcccccgcccccaagaacggguccagcuccgacagcuccgugggcgagaagcugggggccgccgccgccgacgccgucaccggccgcacggaggaguaccggcgccggcgccacaccauggacaaggacagccggggcgccgccgccaccaccacgaccaccgagcaccgcuucuuccggcgcuccgugaucugcgacagcaacgccaccgcccuggagcuccccgggcugccccugucccucccccagcccagcauccccgccgccgugccccaguccgccccgcccgagccgcaccgggaggagacggucaccgccaccgccaccagccagguggcccagcagccgcccgccgcggccgcccccggcgagcaggccguggccgggccggcgcccuccacgguccccagcuccaccagcaaggaccgccccgugagccagccgucccuggugggcagcaaggaggagccgccgcccgcccgguccgggagcggcggcggguccgccaaggagccgcaggaggagcgcagccagcagcaggacgacaucgaggagcuggagaccaaggccgucggcauguccaacgacgggcgguuccucaaguucgacaucgagaucggccgcggcagcuucaagaccguguacaaggggcuggacacggagaccaccguggaggucgccuggugcgagcugcaggaccggaagcucaccaaguccgagcgccagcgguucaaggaggaggcggagaugcugaagggccugcagcaccccaacaucgugcgcuucuacgacagcugggaguccacggugaaggggaagaagugcaucguccucgugaccgagcugaugaccagcggcacccugaagacguaccucaagcgguucaaggugaugaagaucaagguccugcgcuccuggugccggcagauccugaaggggcuccaguuccugcacacccgcaccccgcccaucauccaccgcgaccugaagugcgacaacaucuucaucaccggccccacgggcagcgugaagaucggggaccucggccuggccacccugaagcgggccuccuucgccaagagcgugaucgggacccccgaguucauggcgcccgagauguacgaggagaaguacgacgaguccgucgacguguacgccuucggcaugugcaugcucgagauggccaccagcgaguacccguacuccgagugccagaacgccgcccagaucuaccgccgggugacgagcggggucaagcccgcgagcuucgacaagguggccauccccgaggucaaggagaucaucgagggcugcauccgccagaacaaggacgagcgguacuccaucaaggaccugcugaaccacgccuucuuccaggaggagaccggcgugcgcguggagcucgccgaggaggacgacggggagaagaucgccaucaagcuguggcugcggaucgaggacaucaagaagcucaagggcaaguacaaggacaacgaggcgaucgaguucagcuucgaccuggagcgcgacguccccgaggacguggcccaggagaugguggaguccggguacgucugcgagggcgaccacaagaccauggccaaggccaucaaggaccgggugagccugaucaagcgcaagcgggagcagcgccagcucgugcgggaggagcaggagaagaagaagcaggaggaguccagccugaagcagcaggucgagcaguccagcgccucccagaccgggaucaagcagcugccgagcgcguccacgggcauccccaccgccagcaccaccuccgccagcguguccacccagguggagcccgaggagcccgaggccgaccagcaccagcagcuccaguaccagcagccgagcaucuccguccugagcgacggcacgguggacagcgggcagggcuccagcguguucaccgagucccgcgucagcucccagcagaccgugagcuacgggucccagcacgagcaggcgcacagcaccggcacggugcccggccacauccccuccaccguccaggcccagagccagccccacgggguguacccgcccuccagcgugccccaguccauggcccaccccugcggcgggaccccgaccuaccccgagagccagaucuucuuccccacgauccacgagcggcccgucuccuucagcccgccgcccacgugcccgcccaagguggccaucucccagcgccggaaguccaccuccuuccuggaggcccagacccaccacuuccagccccuccugcgcacggugggccagagccugcugccgcccggcgggagccccaccaacuggacccccgaggcggucgugaugcuggggaccacggccucccgggugaccggggagagcugcgagauccagguccaccccauguucgagcccucccagguguacagcgacuaccgccccggccuggugcuccccgaggaggcccacuacuucaucccccaggaggccgucuacguggccggggugcacuaccaggcgcgcgucgccgagcaguacgagggcauccccuacaacuccagcgugcuguccagccccaugaagcagauccccgagcagaagcccgugcagggcgggccgaccuccagcuccgucuucgaguuccccagcggccaggccuuccugguggggcaccuccagaaccuccggcuggacuccggccuggggcccggcagcccccucuccagcaucuccgccccgaucagcaccgacgccacgcgccugaaguuccaccccguguucgucccccacuccgcgcccgccgugcugacccacaacaacgagagccggagcaacugcguguucgaguuccacguccacaccccguccagcuccagcggggagggcggcgggauccucccccagcgcguguaccggaaccgccagguggccgucgaccugaaccaggaggagcugccgccccaguccgugggccuccacggguaccugcagccggugaccgaggagaagcacaacuaccacgcccccgagcugacggucagcgugguggagcccaucggccagaacuggcccaucggguccccggaguacagcuccgacagcucccagaucaccagcuccgaccccagcgacuuccagagcccgccgcccaccggcggcgcggccgcccccuucgggagcgacgucuccaugcccuucauccaccucccccagaccgugcugcaggagagcccccuguucuucugcuucccccagggcacgaccucccagcagguccucaccgccagcuucagcuccgggggcagcgcccugcacccccaggcgcagggccagucccaggggcagcccagcuccagcucccugaccggcgugagcuccagccagcccauccagcacccccagcagcagcaggggauccagcagacggcgccgccccagcagaccgugcaguacucccucagccagaccuccaccagcuccgaggccacgaccgcccagcccgucagccagccccaggcgccccaggugcugccccaggucuccgcgggcaagcagggguucccgccccggcugcccccgcaguaccccggcgacagcaacaucgcccccuccagcaacgucgccagcgugugcauccacuccaccgugcucuccccgcccaugcccaccgagguccuggccacccccggcuacuuccccacgguggugcagcccuacgucgaguccaaccugcucgugcccaugggcggcgucgggggccagguccaggugagccagcccgggggcucccuggcccaggcgccgaccaccagcucccagcaggccgugcuggagagcacccagggcgucucccagguggcccccgccgagcccguggccgucgcgcagacgcaggccacccagcccaccacccucgccagcuccguggacagcgcccacuccgacguggcgagcgggauguccgacggcaacgagaacgucccgagcuccagcgggcgccacgagggccggacgaccaagcgccacuaccggaaguccgugcgcagccggagccgccacgagaagaccucccggcccaagcugcgcauccugaacgugagcaacaagggggaccgggucguggagugccagcucgagacccacaaccgcaagauggugacguucaaguucgaccuggacggcgacaaccccgaggagaucgccaccaucauggucaacaacgacuucauccuggccaucgagcgggaguccuucguggaccaggugcgcgagaucaucgagaaggccgacgagaugcucagcgaggacgucuccguggagcccgagggcgaccaggggcuggagagccugcagggcaaggacgacuacggguucuccggcagccagaagcucgagggcgaguucaagcagccgauccccgccuccagcaugccccagcagaucgggauccccaccuccagccugacccaggugguccacuccgcgggccggcgcuucaucgugagcccggugcccgagucccgccugcgggagagcaaggucuuccccuccgagaucacggacaccguggccgccagcaccgcccagagccccgggaugaaccucucccacagcgccuccagccugucccugcagcaggcguucagcgagcuccgccgggcccagaugaccgagggcccgaacacggcgccgcccaacuucucccacaccgggcccaccuucccgguggugccgcccuuccugagcuccaucgccggcgugcccaccacggccgcggccaccgccccggugcccgccaccagcagcccgcccaacgacaucagcaccuccgucauccagagcgaggugacggugcccaccgaggagggcaucgcgggggucgccaccuccaccggcguggugacgagcgggggccugcccaucccgcccgucuccgagagccccgugcucuccagcgucgugagcuccaucaccauccccgccguggucagcaucuccaccaccagccccucccuccaggugcccacgagcaccuccgagaucguggucagcuccaccgcccuguaccccagcgugaccguguccgccaccagcgcguccgccgggggcagcacggccacccccggccccaagccgcccgccgucgugucccagcaggccgcggggagcaccaccgugggcgccacgcucaccuccgucagcaccaccacguccuuccccagcaccgccagccagcugugcauccagcuguccagcuccaccagcacccccacgcucgccgagaccgugguggucuccgcccacagccuggacaagaccucccacagcuccaccacggggcuggcguucagccucuccgcccccagcuccagcuccagccccggcgccgggguguccagcuacaucucccagcccggcggccugcacccccuggugaucccgagcgucaucgccagcacccccauccucccccaggcggccgggcccaccuccaccccgcugcugccccaggugcccagcaucccgccccucgugcagcccgucgccaacgugcccgccgugcagcagacgcugauccacucccagccccagcccgcccugcuccccaaccagccccacacccacugcccggaggucgacagcgacacccagcccaaggcgcccggcaucgacgacaucaagacccuggaggagaagcugcgcucccucuucagcgagcacuccagcuccggggcccagcacgccagcgugucccuggagacgagccuggugaucgaguccaccgucacccccggcaucccgaccacggccguggcccccagcaagcuccugaccuccaccaccagcacgugccugccgcccaccaaccucccgcuggggaccguggcgcugcccgucacccccguggugacgcccggccaggucuccaccccggugagcaccaccacguccggcgugaagcccgggaccgcccccagcaagcccccgcucaccaaggcccccguccugcccgugggcaccgagcugcccgccgggacccucccgagcgagcagcugccgcccuuccccggcccgucccugacgcagagccagcagccccucgaggaccuggacgcccagcugcggcgcacccucucccccgagaugaucaccgugaccagcgcggucggcccgguguccauggccgcccccacggccaucaccgaggccgggacccagccccagaagggcgugagccaggucaaggaggggcccgugcuggcgaccuccagcggcgccgggguguucaagaugggccgguuccaggucuccguggccgccgacggcgcgcagaaggaggggaagaacaagagcgaggacgccaaguccgugcacuucgagagcuccacgagcgaguccagcguccuguccagcuccagcccggagagcacccucgugaagcccgagcccaacggcaucaccauccccgggaucuccagcgacgugccggaguccgcccacaagaccacggccagcgaggccaaguccgacaccggccagcccaccaaggucgggcgcuuccaggugaccacgaccgcgaacaaggucggccgguucagcguguccaagaccgaggacaagaucaccgacacgaagaaggagggccccguggccuccccgcccuucauggaccuggagcaggccguccugcccgccgugauccccaagaaggagaagcccgagcucagcgagcccagccaccugaacgggcccuccagcgaccccgaggccgcguuccugucccgcgacguggacgacggcagcgggagcccccacagcccgcaccagcucuccagcaagagccugcccucccagaaccugagccagucccugagcaacuccuucaacagcuccuacaugagcuccgacaacgagagcgacaucgaggacgaggaccucaagcuggagcugcggcgccuccgggacaagcaccugaaggagauccaggaccugcagucccgccagaagcacgagaucgagagccucuacaccaagcugggcaaggugccgcccgccgugaucaucccgcccgccgcgccccuguccgggcggcgccggcgccccaccaagagcaagggcuccaagagcucccggagcuccagccucggcaacaagagcccgcagcuguccgggaaccugagcggccaguccgccgcgagcgugcuccacccccagcagacccugcacccgcccgggaacauccccgaguccggccagaaccagcugcuccagccccugaagcccagccccuccagcgacaaccuguacuccgccuucacgagcgacggggccaucuccguccccagccucuccgcccccggccagggcaccagcuccaccaacaccgugggggcgacggugaacagccaggccgcccaggcccagcccccggccaugaccuccagccgcaagggcaccuucaccgacgaccugcacaagcuggucgacaacugggcgcgcgacgccaugaaccucuccgggcggcgcggcagcaagggccacaugaacuacgaggggcccggcauggcccggaaguucagcgcccccgggcagcugugcaucuccaugacgagcaaccugggcggguccgcccccaucagcgcggccuccgccaccagccucggccacuucaccaaguccaugugcccgccccagcaguacggcuuccccgccacccccuucggggcccaguggagcggcaccgggggcccggcgccccagccccuggggcaguuccagcccgugggcaccgccucccugcagaacuucaacaucagcaaccuccagaaguccaucagcaacccgcccggcuccaaccugcgcaccaccuga

SEQ ID NO: 38730 - RNA, 6894 nt, Artificial Sequence
  derived and/or modified sequence opt1 from WNK2__Homo_sapiens__NP_001269323
auggacggcgacgggggccgccgggacgugcccgggacccugauggagcccggccgcggggccggccccgccggcauggccgagccccgggccaaggccgcccgccccgggccccagcgguuccuccgccggagcgucguggagagcgaccaggaggagccgcccggccuggaggccgccgaggcccccgggccccagccgccccagccccugcagcgccgggugcuccugcugugcaagacccgccggcucaucgccgagcgcgcccggggccgccccgccgcccccgcccccgccgcccuggucgcccagcccggggcccccggcgcccccgccgacgccggccccgagcccguggggacccaggagcccggccccgaccccaucgccgccgccguggagaccgcccccgcccccgacgggggcccccgggaggaggccgccgccaccguccgcaaggaggacgagggcgccgccgaggcgaagcccgagcccgggcggacccgccgggacgagcccgaggaggaggaggacgacgaggacgaccugaaggccguggccaccagccucgacggccgcuuccugaaguucgacaucgagcuggggcggggcuccuucaagaccguguacaaggggcucgacaccgagaccugggucgagguggccuggugcgagcugcaggaccgcaagcugacgaagcucgagcgccagcgguucaaggaggaggccgagaugcugaagggccugcagcaccccaacaucgugcgcuucuacgacuucugggagagcuccgccaagggcaagcggugcaucguccucgugaccgagcugaugaccagcgggacccugaagacguaccucaagcgcuucaaggugaugaagcccaagguccugcgguccuggugccgccagauccugaagggccuccuguuccugcacacccggaccccgcccaucauccaccgcgaccucaagugcgacaacaucuucaucaccgggcccacgggcagcgugaagaucggggaccugggccuggccacccucaagcgggccuccuucgccaagagcgugaucggcacccccgaguucauggcccccgagauguacgaggagcacuacgacgaguccgucgacguguacgccuucgggaugugcaugcuggagauggccaccagcgaguaccccuacuccgagugccagaacgccgcccagaucuaccgcaaggugacgugcggcaucaagcccgcgagcuucgagaagguccacgaccccgagaucaaggagaucaucggggagugcaucugcaagaacaaggaggagcgguacgagaucaaggaccugcucucccacgccuucuucgccgaggacaccggcgugcgcguggagcuggccgaggaggaccacgggcgcaagagcaccaucgcccugcgccucugggucgaggaccccaagaagcugaagggcaagcccaaggacaacggcgcgaucgaguucaccuucgaccuggagaaggagacgcccgacgagguggcccaggagaugaucgaguccggguucuuccacgagagcgacgucaagaucguggccaaguccauccgggaccgcguggcccucauccaguggcggcgcgagcggaucuggcccgcgcugcagcccaaggagcagcaggacgucggcagccccgacaaggcccgcgggccgcccgugccccuccaggugcaggucaccuaccacgcccaggccggccagcccgggccgcccgagcccgaggagcccgaggccgaccagcaccuccugccgcccacccugcccaccagcgcgacgucccucgccagcgacuccaccuucgacagcgggcagggcuccaccguguacagcgacucccagagcucccagcagagcgugaugcuggggucccuggccgacgccgcccccagccccgcgcagugcgucugcuccccgcccgugagcgagggccccgugcucccccagucccugcccagccugggggccuaccagcagcccaccgccgcccccggccugcccgucggcuccgugcccgcccccgcgugcccgcccagccuccagcagcacuuccccgaccccgccauguccuucgcccccgugcugcccccgcccagcacgcccaugcccaccgggcccggccagcccgcgccgcccgggcagcagcccccgccccucgcgcagcccacgccccucccccagguccuggcgccccagccgguggugccccugcagcccgucccgccccaccucccgcccuaccuggcccccgccagccaggugggcgcccccgcgcagcugaagccccugcagaugccccaggcgccccuccagccccuggcccaggugccgccccagaugcccccgauccccgucgugccgcccaucaccccgcucgccgggaucgacggccugccgcccgcccugcccgaccucccgaccgcgaccgugccgcccgugcccccgccccaguacuucucccccgccgucauccugcccagccuggccgcgccccugccgcccgccuccccggcgcugccccugcaggccgugaagcucccccacccgcccggcgcgccccucgccaugcccugccgcaccaucguccccaacgcccccgcgaccaucccccugcucgccguggcgccgcccgggguggccgcgcugagcauccacuccgccgucgcccagcugccgggccagcccguguaccccgccgccuucccccagauggcgccgaccgacgugccgcccagcccccaccacacgguccagaacaugcgggccaccccgccccagcccgcccucccgccccagcccacccugcccccgcagcccgugcugccgccccagccgacccugccgccccagcccgugcugccgccccagcccacgcggccgccccagcccguccugccgccccagcccaugcugccgccccagcccgugcugccgccccagcccgcccugcccgugcggccggagccccuccagccccaccuccccgagcaggccgcgcccgccgccacccccgggucccagauccugcucggccaccccgccccguacgccgucgacguggcggcccaggugcccaccguccccgugcccccggccgccgugcuguccccgccccugcccgagguccuccugccggcggcccccgagcugcucccccaguuccccuccagccuggccaccguguccgccagcgugcaguccgucccgacgcagaccgccacccugcugccgcccgcgaacccgccccugcccgggggccccggcaucgccagccccugccccaccgugcagcugacgguggagcccguccaggaggagcaggccucccaggacaagccgcccgggcucccgcagagcugcgaguccuacggcgggagcgacgugaccagcggcaaggagcuguccgacagcugcgagggggccuucggcggcgggcgccuggagggccgggccgcgcgcaagcaccaccggcgcuccacccgggcccgcagccggcaggagcgcgccucccggccccgccucaccauccugaacgucugcaacacgggggacaagaugguggagugccagcuggagacccacaaccacaagauggugaccuucaaguucgaccucgacggcgacgcccccgacgagaucgccaccuacauggucgagcacgacuucauccugcaggcggagcgggagacguucaucgagcagaugaaggacgugauggacaaggccgaggacaugcugagcgaggacaccgacgccgaccgcggcuccgacccggggaccuccccgccccaccucagcacgugcggccuggggaccggcgaggagucccggcagagccaggccaacgcgcccguguaccagcagaacguccugcacaccgggaagcgcugguucaucaucugcccgguggccgagcaccccgcccccgaggcccccgagagcuccccgccccucccccugagcucccugcccccggaggccagccagggccccugccggggccucacccugcccugccugcccuggcgccgggcggccugcggggccguguuccucucccuguucagcgccgaguccgcccagagcaagcagccgcccgacagcgcgcccuacaaggaccagcuguccagcaaggagcagcccuccuuccucgccagccagcagcugcugucccaggccggcccgagcaacccgcccggggccccgcccgcgccccucgcgcccuccagcccgcccgucaccgcccugccccaggacggcgccgcccccgccacguccaccaugcccgagcccgcgagcgggaccgccucccaggccggcggccccgggacgccccagggccugacgagcgagcucgagaccucccagccccuggccgagacccacgaggcgccccuggccgugcagccccucguggucgggcuggcccccugcaccccggcccccgaggccgcgagcacgcgcgacgccuccgcgccccgcgagccccugccgccgcccgcccccgagccgagcccccacuccggcacgccccagcccgcccucgggcagccggcgccccugcugcccgccgccgugggcgccgugagccucgccaccucccagcugcccagcccgccccugggccccaccgucccgccccagccgcccagcgcgcucgaguccgacggggagggcccgccgccccgggugggguucguggacagcaccaucaagucccuggacgagaagcugcgcacgcuccuguaccaggagcacguccccaccagcuccgccagcgccggcaccccgguggaggugggcgaccgggacuucacccuggagccccugcgcggggaccagccccgguccgaggucugcggcggggaccucgcccugcccccggugcccaaggaggcggugagcggccgcguccagcugccccagccccucguggagaaguccgagcuggccccgacgcggggcgccgugauggagcagggcaccagcuccagcaugaccgccgaguccagcccccgcuccaugcugggcuacgaccgggacgggcgccaggucgccagcgacucccacguggugcccagcgucccccaggacgugccggcguucgugcggcccgcccgcgucgagcccaccgaccgggacggcggggaggccggcgaguccagcgccgagcccccgcccagcgacauggggacggugggcggccaggccucccacccccagacccucggggcgcgcgcccugggcagcccccggaagcgcccggagcagcaggacguguccagccccgccaagaccgucgggcgguucuccguggugagcacccaggacgaguggacgcuggccagcccccacucccuccgcuacuccgccccgcccgacgucuaccuggacgaggcgcccagcucccccgacgugaagcuggccgugcggcgcgcccagaccgccagcuccaucgaggucggcgugggggagccggugagcuccgacagcggcgacgagggcccccgcgcgcggccgcccguccagaagcaggccucccucccggugagcggguccguggccggcgacuucgucaagaaggccaccgccuuccugcagcgccccagccgggcggggagccugggccccgagacccccucccgcguggggaugaaggugccgacgaucagcgucaccuccuuccacagccaguccagcuacaucuccagcgacaacgacuccgagcucgaggacgccgacaucaagaaggagcugcagagccugcgggagaagcaccucaaggagaucuccgagcugcagagccagcagaagcaggagaucgaggcccuguaccgccggcucggcaagccccugccgcccaacgugggcuucuuccacaccgccccgcccaccgggcgccggcgcaagacguccaagagcaagcugaaggccggcaagcuccugaacccccugguccggcagcucaaggugguggcguccagcaccgggcaccuggccgacuccagccgcggcccgcccgccaaggaccccgcccaggccuccgucggccugaccgcggacagcaccgggcucagcggcaaggccgugcagacgcagcagcccugcuccgugcgggccagccuguccagcgacaucugcuccgggcuggccagcgacggcgggggcgcccgcggccagggguggaccgucuaccaccccaccuccgagcgggugaccuacaagagcuccagcaagccccgcgcgcgguuccucuccggccccgugagcgucuccaucuggagcgcccugaagcgccugugccucgggaaggagcacuccagccgguccagcacgagcucccuggcccccggccccgagccggggccccagcccgcccugcacgugcaggcccaggugaacaacagcaacaacaagaagggcaccuucaccgacgaccuccacaagcuggucgacgaguggaccuccaagacggugggcgccgcccagcugaagccgacccucaaccagcugaagcagacccagaagcugcaggacauggaggcccaggccgggugggcggcccccggcgaggcccgcgccaugaccgcgccccgggcgggggugggcaugccccgccucccgcccgcccccgggccccugagcacgaccgucaucccgggcgccgcccccacccuguccgugcccacccccgacggcgcccucgggaccgcgcgccggaaccaggugugguucggccugcgcgucccgcccacggccugcugcgggcacagcacccagccccggggcgggcagcgcgugggcuccaagaccgccagcuucgccgcguccgaccccgugcggagcuga

SEQ ID NO: 38731 - RNA, 5403 nt, Artificial Sequence
  derived and/or modified sequence opt1 from WNK3__Homo_sapiens__NP_065973
auggccaccgacagcggcgaccccgccuccaccgaggacagcgagaagccggacgggaucuccuucgagaaccgggugccccagguggcggccacccugaccguggaggcccggcugaaggagaagaacagcaccuucuccgccagcggcgagaccguggagcgcaagcgguucuuccgcaaguccguggagaugacggaggacgacaagguggccgagagcucccccaaggacgagcggaucaaggcggccaugaacaucccccgcguggacaagcugcccagcaacguccugcgcggcgggcaggaggugaaguacgagcagugcuccaagagcaccuccgagaucagcaaggacugcuucaaggagaagaacgagaaggagauggaggaggaggccgagaugaaggccguggcgaccucccccagcgggcgcuuccugaaguucgacaucgagcuggggcggggcgccuucaagaccgucuacaaggggcuggacacggagaccuggguggagguggccuggugcgagcuccaggaccgcaagcugaccaaggccgagcagcagcgguucaaggaggaggccgagaugcugaagggccuccagcaccccaacaucguccgcuucuacgacuccugggagagcauccugaaggggaagaagugcaucgugcuggugaccgagcucaugacguccggcacccugaagaccuaccugaagcgguucaaggucaugaagcccaaggugcuccgcagcuggugccggcagauccugaaggggcugcaguuccuccacacccgcacgccgcccaucauccaccgggaccugaagugcgacaacaucuucaucaccggccccaccggcagcgugaagaucggggaccugggccucgcgacccugaugcgcacguccuucgccaagagcgucaucgggacccccgaguucauggccccggagauguacgaggagcacuacgacgaguccguggacguguacgccuucggcaugugcaugcuggagauggccaccagcgaguaccccuacuccgagugccagaacgcggcccagaucuaccggaaggucaccagcggcaucaagcccgccuccuucaacaaggugacggaccccgaggugaaggagaucaucgaggggugcauccgccagaacaagagcgagcggcucuccauccgcgaccugcugaaccacgccuucuucgccgaggacaccggccuccgcgucgagcuggcggaggaggacgacugcagcaacuccagccuggcccuccggcuguggguggaggacccgaagaagcugaaggggaagcacaaggacaacgaggccaucgaguucuccuucaaccucgagaccgacacccccgaggaggucgccuacgagauggugaaguccggcuucuuccacgaguccgacagcaaggccguggcgaaguccauccgcgaccgggucacgcccaucaagaagacccgcgagaagaagcccgccgggugccuggaggagcggcgcgacagccagugcaaguccaugggcaacguguucccgcagccccagaacaccacccugccccucgcccccgcccagcagacgggcgcggagugcgaggagaccgagguggaccagcacguccggcagcagcugcugcagcgcaagccgcagcagcacugcagcagcgugaccggggacaaccucuccgaggccggcgccgccagcgugauccacuccgacaccagcucccagcccagcgucgccuacuccagcaaccagacgauggggucccagauggugagcaacaucccccaggcggaggugaacguccccggccagaucuacuccagccagcagcugguggggcacuaccagcaggucuccggccugcagaagcacagcaagcucacccagccgcagauccugccccugguccagggccaguccaccgugcuccccgugcacguccuggggccgaccguggugagccagccccaggucagcccccugaccgugcagaaggugccccagaucaagccggucagccagcccgugggcgccgagcagcaggccgcccuccugaagcccgaccuggugcggagccugaaccaggacgucgccacgaccaaggagaacguguccagccccgacaacccguccgggaacggcaagcaggaccgcaucaagcagcggcgcgcgagcugcccccggcccgagaaggggaccaaguuccagcucaccgugcugcaggucuccacgagcggcgacaacaugguggagugccagcuggagacccacaacaacaagauggugaccuucaaguucgacgucgacggcgacgcccccgaggacaucgccgacuacaugguggaggacaacuucgugcucgaguccgagaaggagaaguucgucgaggagcugcgcgccaucguggggcaggcccaggagauccugcacgugcacuucgcgaccgagcgggccacgggcgucgacagcaucaccguggacuccaacagcucccagaccgggagcuccgagcagguccagaucaacagcaccuccacgcagaccagcaacgaguccgccccgcagagcucccccgucggccgcuggcgguucugcaucaaccagaccauccgcaaccgggagacccaguccccgcccagccuccagcacuccaugagcgccgugccgggccgccacccccugcccucccccaagaacacgagcaacaaggagaucucccgcgacacccugcucaccaucgagaacaacccgugccaccgggcgcuguucaccagcaaguccgagcacaaggacguggucgacgggaagaucagcgagugcgccuccguggagacgaagcagcccgccauccuguaccagguggaggacaaccgccagaucauggcccccgucaccaacagcuccagcuacuccaccaccagcgugcgggccgugcccgcggagugcgagggccucacgaagcaggccuccaucuucaucccggucuaccccugccaccagaccgccagccaggccgacgcccugaugucccaccccggggagagcacccagaccuccggcaacagccugacgacccucgcguucgaccagaagccgcagacccugagcgugcagcagcccgccauggacgccgaguucaucucccaggagggggagaccacggucaacaccgaggccagcucccccaagaccgugauccccacccagacgccgggccuggagcccaccacccuccagcccaccaccgugcuggagagcgacggcgagcgcccgcccaagcuggaguucgccgacaaccggaucaagacgcucgacgagaagcugcgcaaccugcucuaccaggagcacuccaucagcuccaucuaccccgagagccagaaggacacccaguccaucgacagccccuucuccagcuccgcggaggacacccugagcugccccgucaccgaggugaucgccaucucccacugcgggaucaaggacagccccgugcagucccccaacuuccagcagacgggcagcaagcugcucuccaacgucgccgccagccagcccgcgaacaucagcguguucaagcgggaccugaacgugaucaccuccguccccagcgagcugugccuccacgagauguccagcgacgccucccugccgggggaccccgaggccuaccccgccgccgugagcuccggcggggcgauccaccuccagaccggcggcggguacuucggccucagcuucacgugccccucccugaagaacccgaucagcaagaaguccuggacgcgcaagcucaagagcugggccuaccggcuccgccaguccaccagcuucuucaagcgguccaaggugcgccaggucgagaccgaggagaugcggagcgccaucgcccccgaccccaucccccugacccgcgaguccacggccgacacccgggcgcugaaccgcugcaaggccaugagcggguccuuccagcggggccgcuuccaggugaucaccaucccgcagcagcagagcgccaagaugaccagcuucgggaucgagcacaucuccguguucagcgagacgaaccacuccagcgaggaggccuucaucaagaccgccaagucccagcucgucgagaucgagcccgcgacccagaaccccaagaccagcuucuccuacgagaagcugcaggcccugcaggagacgugcaaggagaacaagggcgugcccaagcagggcgacaacuuccucagcuucuccgccgccugcgagaccgacgugagcuccgucaccccggagaaggaguucgaggagaccagcgccacgggguccagcaugcaguccggcagcgagcugcugcucaaggagcgggagauccugaccgcggggaagcagcccuccagcgacuccgaguucagcgccagccuggccggcuccggcaagagcguggccaagaccggccccgaguccaaccagugccucccgcaccacgaggagcaggcguacgcccagacccagagcucccuguucuacagccccuccagccccauguccagcgacgacgaguccgagaucgaggacgaggaccugaagguggagcuccagcgccugcgggagaagcacauccaggaggucgugaaccugcagacgcagcagaacaaggagcuccaggagcuguacgagcgccugcgcagcaucaaggacuccaagacccagagcaccgagaucccccucccgcccgccagcccccggcgcccccggagcuucaaguccaagcugcgcagccggccgcagagccugacccacguggacaacggcaucgucgccacggggaaguccugccucaucaacgagcuggagaacccccugugcguggagagcaacgccgcguccugccagcagagccccgccuccaagaagggcauguucaccgacgaccuccacaagcugguggacgacuggaccaaggaggccgucgggaacagccugaucaagcccucccucaaccagcugaagcagagccagcacaagcuggagaccgagaacuggaacaagguguccgagaacacgccgagcaccaugggcuacaccuccaccuggaucagcucccucagccagauccgcggcgccgugcccaccucccugccccaggggcugagccuccccuccuucccgggcccccugagcuccuacgggaugccccacgucugccaguacaacgccguggcgggcgccggguaccccgugcagugggucggcaucagcggcacgacccagcagagcguggugaucccggcccaguccgggggccccuuccagcccgggaugaacaugcaggccuuccccaccagcuccguccagaacccggccaccaucccgcccggccccaaguga

SEQ ID NO: 38732 - RNA, 3732 nt, Artificial Sequence
  derived and/or modified sequence opt1 from WNK4__Homo_sapiens__NP_115763
augcuggccagccccgccaccgagaccacggugcucaugucccagaccgaggcggaccuggcccugcgcccgccccccccccucggcaccgccgggcagccgcggcugggcccccccccccgccgggcccgccgguucagcgggaaggccgagccgcgcccccgguccagccgccugucccggcgcagcuccgucgaccucggccugcugagcuccuggagccuccccgcgucccccgccccggacccccccgaccccccggacagcgccgggcccggccccgcccggucccccccgcccagcuccaaggagccccccgagggcaccuggacggagggggcgccggugaaggccgccgaggacagcgcccgccccgagcugcccgacuccgccgugggccccgggagccgggagccgcugcgcguccccgaggcgguggcccucgagcggcgccgggagcaggaggagaaggaggacauggagacccaggccguggccaccucccccgacggccgcuaccugaaguucgacaucgagaucgggcggggcagcuucaagaccgucuaccgcggccuggacacggacaccaccguggagguggccuggugcgagcuccagacccggaagcugagccgcgcggagcgccagcgguucuccgaggaggucgagaugcugaaggggcuccagcacccgaacaucgugcgcuucuacgacagcuggaaguccgugcugcggggccaggucugcaucgugcuggugacggagcucaugaccagcgggacccugaagaccuaccugcgccgguuccgcgagaugaagccccggguccuccagcgcuggucccggcagauccugcgcggccugcacuuccuccacagccgggugccccccauccugcaccgcgaccugaagugcgacaacguguucaucacgggcccgaccggguccgucaagaucggcgaccucgggcuggccacccugaagcgggccagcuucgccaaguccgugaucggcacccccgaguucauggcccccgagauguacgaggagaaguacgacgaggcgguggacgucuacgccuucgggaugugcaugcucgagauggccacgagcgaguaccccuacuccgagugccagaacgccgcccagaucuaccgcaaggugaccagcggccggaagccgaacuccuuccacaaggugaagauccccgaggucaaggagaucaucgagggcugcauccgcaccgacaagaacgagcgguucaccauccaggaccugcuggcgcacgccuucuuccgcgaggagcggggggugcacgucgagcucgccgaggaggacgacggcgagaagcccgggcugaagcuguggcuccgcauggaggacgcccgccggggcgggcgcccccgggacaaccaggcgaucgaguuccuguuccagcugggccgcgacgccgccgaggagguggcccaggagaugguggcccucggccuggucugcgaggcggacuaccagccgguggcccgggccgugcgcgagcgggucgccgccauccagcgcaagcgggagaagcugcgcaaggcgcgggagcucgaggcccugccccccgagcccgggccgccccccgccacggugcccauggccccgggcccccccagcguguuccccccggagcccgaggagcccgaggccgaccagcaccagccguuccuguuccgccacgcguccuacagcuccaccaccagcgacugcgagaccgacggguaccucuccagcagcggcuuccuggacgccuccgaccccgcccugcagccccccgggggcgucccgagcucccuggccgagagccaccucugccugcccuccgcguucgcccugagcaucccccgguccggccccgggagcgacuucuccccgggcgacagcuacgccuccgacgccgccagcgggcucuccgacgugggcgagggcauggggcagaugcgccggccccccggccgcaaccugcggcgccggccccgcagccggcugcgcgugacguccgucagcgaccagaacgaccgcgugguggagugccagcuccagacccacaacuccaagauggucaccuuccgguucgaccuggacggggacagcccggaggagaucgcggccgccaugguguacaacgaguucauccugcccagcgagcgcgacggcuuccuccggcgcauccgggagaucauccagcgcguggagacccugcugaagcgggacacggggcccauggaggccgccgaggacacccucuccccccaggaggagccggcgccccugcccgcccugcccgucccgcuccccgaccccagcaacgaggagcugcaguccagcaccucccuggagcaccgcagcuggaccgccuucuccacgagcuccagcucccccggcaccccgcucagccccggcaaccccuucucccccgggaccccgaucagccccggccccaucuucccgaucaccuccccccccugccaccccagcccgucccccuucagccccaucuccagccaggugagcuccaaccccagcccgcaccccaccuccagcccccugcccuucuccagcuccacgccggaguuccccgugccccugagccagugccccugguccagccucccgaccaccuccccccccaccuucagccccacgugcucccaggucacccugagcuccccguucuucccccccugccccagcaccuccagcuucccguccaccacggccgccccccugcucagccuggcgagcgccuucucccuggccgugaugaccguggcccagagccuccugucccccagccccgggcugcucucccagagcccgcccgcgcccccguccccccugcccagccugccccucccgccccccgucgcccccggcgggcaggaguccccgagcccccacaccgccgagguggaguccgaggccagcccccccccggcccggccccugcccggcgaggcgcgccuggcccccaucuccgaggagggcaagccgcagcucguggggcgguuccaggucaccagcuccaaggagcccgccgagccccugccccugcagccgacgagccccacccucuccggcagccccaagcccuccaccccgcagcugaccagcgagagcuccgacacggaggacagcgccgggggcgggcccgagacccgcgaggcccuggcggaguccgaccgggccgccgagggccucggcgccgggguggaggaggagggcgacgacgggaaggagccccaggugggcgggagcccgcagccccugucccaccccagccccgucuggaugaacuacuccuacagcucccugugccucagcuccgaggagagcgaguccagcggcgaggacgaggaguucugggccgagcugcagucccugcgccagaagcaccucagcgagguggagacccugcagacccugcagaagaaggagaucgaggaccucuacucccggcugggcaagcagccgccccccgggaucguggcgcccgccgccaugcugagcucccgccagcggcgccucagcaagggcagcuucccgacgucccggcgcaacagccugcagcgcuccgagccccccgggcccggcaucaugcggcgcaacagccuguccggcagcuccaccgggagccaggagcagcgggccuccaagggcgucaccuucgccggggacgugggccgcauguga

SEQ ID NO: 38733 - RNA, 1254 nt, Artificial Sequence
  derived and/or modified sequence opt1 from WNT10A__Homo_sapiens__NP_079492
augggcagcgcccacccccgcccguggcugcggcuccgcccccagccccagccccggccggcccugugggugcuccuguucuuccugcugcuccuggcggccgccaugccccgcuccgcccccaacgacauccuggaccuccggcugcccccggagcccguccugaacgccaacaccgugugccucacccugcccgggcugagccgccggcagauggaggugugcguccgccaccccgacguggcggccuccgccauccagggcauccagaucgccauccacgagugccagcaccaguuccgggaccagcgcuggaacugcagcucccucgagacgcggaacaagaucccguacgagagccccaucuucucccgcggguuccgggagagcgcguucgccuacgccaucgccgccgcgggcgugguccacgccguguccaacgccugcgcccuggggaagcugaaggccugcggcugcgacgcgagccgccggggcgacgaggaggccuuccgccggaagcuccaccgccugcagcuggacgcccuccagcgggggaagggccugucccacggggugcccgagcaccccgcccugccgaccgccagccccggccuccaggacuccugggaguggggcgggugcagccccgacaugggcuucggggagcgcuucuccaaggacuuccuggacagccgggagccccaccgcgacauccacgcgcgcaugcggcugcacaacaaccgcgucggccggcaggccgugauggagaacaugcgccggaagugcaagugccacgggaccuccggcagcugccagcucaagaccugcuggcaggucacgccggaguuccgcaccgugggcgcccugcugcggucccgcuuccaccgggccacccucauccgcccccacaaccggaacgggggccagcuggagcccgggcccgccggcgcgccgagccccgcccccggggcccccggcccgcgccggcgcgccagccccgcggaccugguguacuucgagaagucccccgacuucugcgagcgggagccgcgccucgacagcgccggcaccguggggcggcugugcaacaaguccagcgccggcuccgacgggugcggcagcaugugcugcgggcgcggccacaacauccugcggcagacgcgcuccgagcgcugccacugccgguuccacuggugcugcuucgucgugugcgaggagugccgcaucaccgagugggugagcgucugcaaguga

SEQ ID NO: 38734 - RNA, 1170 nt, Artificial Sequence
  derived and/or modified sequence opt1 from WNT10B__Homo_sapiens__NP_003385
augcuggaggagccccgcccgcggcccccgcccagcggccucgccgggcugcuguuccucgcccugugcucccgcgcgcugagcaacgagauccucggccugaagcugcccggggagccgccccucaccgccaacaccgugugccugacgcuguccggccucagcaagcggcagcuggggcugugccuccgcaaccccgacgucaccgccuccgcccugcagggccugcacaucgccgugcacgagugccagcaccagcuccgggaccagcgcuggaacugcagcgcgcuggagggcgggggccggcugccccaccacuccgccauccucaagcgcggguuccgggagagcgccuucuccuucagcaugcuggccgcgggcgugaugcacgccgucgccaccgccugcucccuggggaagcucgugagcugcggcugcggcuggaagggguccggcgagcaggaccgccugcgggccaagcugcuccagcugcaggcgcugagccgcgggaaguccuucccccacagccuccccucccccggcccgggcagcucccccagccccgggccccaggacaccugggaguggggcgggugcaaccacgacauggacuucggcgagaaguucagccgggacuuccuggacucccgcgaggccccgcgggacauccaggcccgcaugcggauccacaacaaccgcguggggcggcaggucgugacggagaaccugaagcgcaagugcaagugccacggcaccagcggcuccugccaguucaagaccugcuggcgggccgcccccgaguuccgcgcggugggggccgcccuccgcgagcggcugggccgcgccaucuucaucgacacccacaaccggaacagcggggccuuccagccccgccugcggccccgccggcucuccggcgagcuggucuacuucgagaaguccccggacuucugcgagcgcgaccccacgauggggagccccggcacccggggccgcgcgugcaacaagaccagccggcugcucgacgggugcggcucccugugcugcgggcgcggccacaacgugcugcggcagacccgcguggagcggugccacugccgcuuccacuggugcugcuacguccucugcgacgagugcaaggugacggagugggugaacgucugcaaguga

SEQ ID NO: 38735 - RNA, 1065 nt, Artificial Sequence
  derived and/or modified sequence opt1 from WNT11__Homo_sapiens__NP_004617
augcgcgcccggccccaggugugcgaggcccuccuguucgcgcuggcccugcagaccggcgucugcuacgggaucaaguggcucgcccugagcaagaccccguccgcccuggcccucaaccagacgcagcacugcaagcagcuggagggccuggugagcgcccaggugcagcucugccgcuccaaccuggagcugaugcacaccgucgugcacgcggcccgggaggugaugaaggccugccgccgggcguucgccgacaugcgcuggaacugcagcuccaucgagcucgcccccaacuaccugcuggaccucgagcgggggacccgcgagagcgccuucgucuacgcccuguccgcggccgccaucagccacgccaucgcccgggcgugcaccuccggcgaccugcccgggugcagcugcggccccgugccgggcgagccgcccgggcccggcaaccgcuggggcgggugcgccgacaaccucuccuacgggcugcugaugggcgccaaguucagcgacgcccccaugaaggugaagaagacgggcucccaggccaacaagcucaugcggcugcacaacagcgaggucgggcgccaggcgcugcgggccucccucgagaugaagugcaagugccacggcgugagcggguccugcagcauccggaccugcuggaagggccugcaggagcugcaggacguggccgccgaccucaagacccgcuaccuguccgccaccaaggucgugcaccgccccaugggcacgcggaagcaccuggugcccaaggaccucgacauccgccccgucaaggacagcgagcugguguaccugcagagcuccccggacuucugcaugaagaacgagaagguggggagccacggcacccaggaccggcagugcaacaagaccuccaacgggagcgacuccugcgaccucaugugcugcggccgcggguacaaccccuacaccgaccgggucguggagcgcugccacugcaaguaccacuggugcugcuacgugacgugccgccggugcgagcgcaccgucgagcgguacgugugcaaguga

SEQ ID NO: 38736 - RNA, 1068 nt, Artificial Sequence
  derived and/or modified sequence opt1 from WNT16__Homo_sapiens__NP_057171
augcagcugacgaccugccuccgcgagacccuguucaccggcgccagccagaagaccucccugugguggcucgggaucgccagcuucggcgugcccgagaagcuggggugcgcgaaccugccgcucaacucccggcagaaggagcugugcaagcgcaagcccuaccugcuccccagcauccgggagggcgcccgccuggggauccaggagugcggcucccaguuccggcacgagcgcuggaacugcaugaucaccgccgccgccaccaccgcgcccaugggcgccagcccgcuguucggguacgagcucuccagcggcaccaaggagaccgccuucaucuacgccgucauggcggccgggcuggugcacuccgugacgcggagcugcuccgccggcaacaugaccgagugcagcugcgacaccacccugcagaacgggggcuccgccagcgagggcuggcacuggggcgggugcuccgacgacguccaguacgggaugugguucagccgcaaguuccucgacuuccccaucggcaacacgaccggcaaggagaacaaggugcugcuggccaugaaccuccacaacaacgaggcggggcggcaggccguggccaagcugauguccgucgacugccgcugccacggcgugagcggguccugcgccgugaagaccugcuggaagaccaugagcagcuucgagaagaucggccaccuccugaaggacaaguacgagaacuccauccagaucagcgacaagacgaagcggaagaugcgccggcgcgagaaggaccagcggaagauccccauccacaaggacgaccugcuguacgucaacaagucccccaacuacugcguggaggacaagaagcucgggaucccgggcacccagggccgcgagugcaaccggaccagcgagggggccgacggcugcaaccugcugugcugcgggcgcggcuacaacacccacgugguccggcacguggagcgcugcgagugcaaguucaucuggugcugcuacgugcggugccgccgcugcgaguccaugacggacguccacacgugcaaguga

SEQ ID NO: 38737 - RNA, 1113 nt, Artificial Sequence
  derived and/or modified sequence opt1 from WNT1__Homo_sapiens__NP_005421
augggccugugggcccuccugcccgggugggugagcgccacccugcuccuggcgcuggccgcccucccggccgcccuggcggccaacuccagcggccgcuggugggggaucgucaacguggccuccagcaccaaccugcucacggacuccaagagccugcagcuggugcucgagcccucccugcagcugcucagccggaagcagcgccggcugauccgccagaaccccggcauccugcacuccgucagcgggggccuccaguccgccgugcgggagugcaaguggcaguuccgcaaccggcgcuggaacugccccaccgcgccgggcccccaccuguucgggaagaucgugaaccggggcugccgcgagaccgccuucaucuucgccaucaccagcgccggggucacgcacuccguggcccggagcugcuccgagggcagcaucgaguccugcacgugcgacuaccgccggcgcgggcccggcggccccgacuggcacuggggcgggugcagcgacaacaucgacuucgggcggcuguucggccgcgaguucguggacuccggcgagaaggggcgggaccuccgcuuccugaugaaccugcacaacaacgaggcgggccggaccaccgucuucagcgagaugcgccaggagugcaagugccacgggaugagcggcuccugcaccgugcggaccugcuggaugcgccucccgacccugcgcgccgugggggacguccugcgggaccgcuucgacggcgccagccgggugcucuacggcaaccgcggguccaaccgggccagccgcgccgagcugcugcggcucgagcccgaggaccccgcgcacaagcccccgagcccccacgaccugguguacuucgagaagucccccaacuucugcaccuacuccggccgccuggggacggccggcaccgccgggcgggccugcaacagcuccagccccgcccucgacggcugcgagcugcugugcugcggccgcgggcaccggacccgcacccagcgggucacggagcgcugcaacugcaccuuccacuggugcugccacguguccugccggaacugcacccacacccgcgugcuccacgagugccuguga

SEQ ID NO: 38738 - RNA, 900 nt, Artificial Sequence
  derived and/or modified sequence opt1 from WNT2B__Homo_sapiens__NP_001278809
augcgcagcgugggcgagggggcccgggaguggauccgcgagugccagcaccaguuccggcaccaccgcuggaacugcaccacccuggaccgggaccacacggucuucggccgcgugaugcuccgguccagccgcgaggccgcguucguguacgccaucuccagcgccggggucgugcacgccaucacccgggccugcucccagggcgagcugagcgugugcuccugcgaccccuacacccgcgggcggcaccacgaccagcgcggcgacuucgacuggggcgggugcagcgacaacauccacuacggcguccgguucgcgaaggccuucguggacgccaaggagaagcgccugaaggacgcccgggcgcucaugaaccugcacaacaaccgcugcgggcggaccgccgugcgccgguuccugaagcucgagugcaagugccacggcgucuccgggagcugcacgcugcggaccugcuggcgcgcccuguccgacuuccgccgcaccggcgacuaccuccggcgccgguacgacggcgccguccaggugauggccacccaggacggggcgaacuucacggccgcccgccagggcuaccggcgcgccacccggaccgaccugguguacuucgacaacagcccggacuacugcgugcuggacaaggccgcggggucccucggcaccgccggccgcgugugcagcaagacguccaaggggaccgacggcugcgagaucaugugcugcgggcggggcuacgacaccacccgcgucacgcgggugacccagugcgagugcaaguuccacuggugcugcgccgugcgcugcaaggagugccggaacaccgucgacgugcacacgugcaaggcccccaagaaggccgaguggcuggaccagaccuga

SEQ ID NO: 38739 - RNA, 1083 nt, Artificial Sequence
  derived and/or modified sequence opt1 from WNT2__Homo_sapiens__NP_003382
augaacgcgccccugggcgggaucuggcucuggcugccgcugcuccugaccuggcugacccccgaggugaacagcuccuggugguacaugcgcgccacgggcgggagcucccgggucaugugcgacaacgugcccggccucgugagcucccagcgccagcugugccaccggcaccccgacgucaugcgcgccaucagccaggggguggccgaguggaccgccgagugccagcaccaguuccggcagcaccgcuggaacugcaacacccuggaccgggaccacucccucuucggccgcgugcugcugcggagcucccgcgagagcgccuucgucuacgccaucuccagcgcgggcgugguguucgccaucacccgggccugcucccagggggaggucaagagcugcuccugcgacccgaagaagaugggcagcgccaaggacuccaaggggaucuucgacuggggcgggugcagcgacaacaucgacuacggcaucaaguucgcgcgcgccuucguggacgccaaggagcggaagggcaaggacgcccgcgcccucaugaaccugcacaacaaccgggcggggcgcaaggccgugaagcgguuccugaagcaggagugcaagugccacggcgucuccgggagcugcacgcuccggaccugcuggcuggccauggccgacuuccgcaagaccggcgacuaccuguggcgcaaguacaacggcgccauccagguggugaugaaccaggacgggaccggcuucacggucgcgaacgagcgguucaagaagcccaccaagaacgaccucguguacuucgagaacagccccgacuacugcauccgcgaccgcgaggccgggucccugggcaccgccgggcgggugugcaaccugaccagccgcggcauggacuccugcgaggucaugugcugcggccggggguacgacacgagccacgugacccgcaugaccaagugcggcugcaaguuccacuggugcugcgccgugcggugccaggacugccucgaggcccuggacguccacacgugcaaggcgcccaagaacgccgacuggaccaccgccaccuga

SEQ ID NO: 38740 - RNA, 1059 nt, Artificial Sequence
  derived and/or modified sequence opt1 from WNT3A__Homo_sapiens__NP_149122
auggcgccccugggcuacuuccuccugcugugcagccucaagcaggcccugggguccuacccgaucugguggagccuggccgugggcccccaguacuccagccucgggucccagcccauccugugcgccagcauccccggccuggucccgaagcagcuccgcuucugccggaacuacguggagaucaugcccuccguggccgaggggaucaagaucggcauccaggagugccagcaccaguuccgcggccggcgcuggaacugcaccaccguccacgacagccuggccaucuucgggcccgugcuggacaaggccacccgggaguccgcguucgugcacgccaucgccagcgccggcgucgcguucgccgugacccgcuccugcgccgaggggaccgccgccaucugcggcugcagcucccggcaccaggggagccccggcaagggcuggaaguggggcgggugcuccgaggacaucgaguucgggggcauggugagccgcgaguucgcggacgcccgggagaaccgcccggacgcccgguccgccaugaaccgccacaacaacgaggccggccggcaggcgaucgccagccacaugcaccucaagugcaagugccacgggcuguccggcagcugcgaggucaagaccugcugguggagccagcccgacuuccgcgccaucggggacuuccugaaggacaaguacgacuccgccagcgagauggugguggagaagcaccgggagucccgcggcugggucgagacgcuccggccccgcuacaccuacuucaaggugcccaccgagcgggaccugguguacuacgaggccagcccgaacuucugcgagcccaaccccgagaccggguccuucggcacgcgcgaccggaccugcaacgucagcucccacggcaucgacgggugcgaccugcucugcugcggccgcgggcacaacgcgcgcgccgagcggcgccgggagaagugccgcugcguguuccacuggugcugcuacgugagcugccaggagugcacccgggucuacgacgugcacacgugcaaguga

SEQ ID NO: 38741 - RNA, 1068 nt, Artificial Sequence
  derived and/or modified sequence opt1 from WNT3__Homo_sapiens__NP_110380
auggagccccaccuccugggccugcugcucgggcugcugcucggcgggacccgcgugcuggccggcuacccgaucugguggagccuggcccucgggcagcaguacaccucccugggcagccagccccugcucugcggcuccauccccgggcugguccccaagcagcugcgguucugccgcaacuacaucgagaucaugccgagcguggcggagggcgugaagcucgggauccaggagugccagcaccaguuccggggccgccgguggaacugcaccaccaucgacgacucccuggccaucuucgggcccguccuggacaaggccacccgcgagagcgccuucgugcacgccaucgcguccgccggcguggccuucgccgucacccggagcugcgcggagggcacguccaccaucugcgggugcgacagccaccacaagggcccgcccggggagggcuggaaguggggcgggugcuccgaggacgccgacuucggcgugcucgugagccgcgaguucgccgacgcccgggagaaccgccccgacgcccgguccgcgaugaacaagcacaacaacgaggccgggcgcaccaccauccuggaccacaugcaccugaagugcaagugccacggccucagcggguccugcgaggucaagacgugcuggugggcccagcccgacuuccgggccaucggcgacuuccugaaggacaaguacgacagcgccuccgagauggugguggagaagcaccgcgagagccggggcugggucgagacccugcgcgcgaaguacucccucuucaagccgcccaccgagcgggaccugguguacuacgagaacagccccaacuucugcgagcccaaccccgagaccgggagcuucggcacgcgcgaccggaccugcaacgugaccucccacgggaucgacggcugcgaccugcucugcugcgggcgcggccacaacacccggacggagaagcgcaaggagaagugccacugcaucuuccacuggugcugcuacgucagcugccaggagugcauccgcaucuacgacgugcacacgugcaaguga

SEQ ID NO: 38742 - RNA, 1122 nt, Artificial Sequence
  derived and/or modified sequence opt1 from WNT4__Homo_sapiens__XP_011539899
augacccagcugacccccgccccgccgcccgccagcucccagggcagccucugcuccacccaggggaagcgcaacaagcggcugccccgcacccugcccaaccagcggggcuacgagggggaggacaccggccacaucccccgcuaccucgcgaagcugagcuccguggggagcaucuccgaggaggagaccugcgagaagcugaagggccucauccagcggcagguccagaugugcaagcgcaaccuggaggugauggacagcgugcggcgcggcgcccagcuggccaucgaggagugccaguaccaguuccggaaccgccgguggaacugcuccacgcucgacagccugcccgucuucgggaagguggugacccagggcacccgcgaggccgccuucgucuacgcgaucuccagcgccgggguggccuucgccgugacccgggcgugcuccagcggcgagcuggagaagugcgggugcgaccgcacgguccacggcgugagcccccagggcuuccagugguccgggugcuccgacaacaucgccuacggcguggccuucagccaguccuucgucgacgugcgggagcgcagcaagggggccagcuccagccgggcccucaugaaccugcacaacaacgaggcgggccgcaaggccauccugacccacaugcggguggagugcaagugccacggcgucuccgggagcugcgaggugaagaccugcuggcgcgccgugccgcccuuccggcaggucggccacgcccucaaggagaaguucgacggggccaccgagguggagccccgccgcgugggcuccagccgggcgcuggucccccgcaacgcccaguucaagccgcacacggacgaggaccugguguaccucgagcccucccccgacuucugcgagcaggacaugcggagcggggugcugggcacccgcggccggaccugcaacaagaccuccaaggccaucgacgggugcgagcugcucugcugcggccgcggguuccacacggcccaggucgagcuggccgagcggugcagcugcaaguuccacuggugcugcuucgugaagugccgccagugccagcggcuggucgagcuccacacgugccgcuga

SEQ ID NO: 38743 - RNA, 1098 nt, Artificial Sequence
  derived and/or modified sequence opt1 from WNT5A__Homo_sapiens__NP_001243034
auggccggcagcgccauguccagcaaguucuuccugguggcgcucgccaucuucuucuccuucgcccaggucgugaucgaggccaacagcugguggucccuggggaugaacaaccccgugcagaugagcgaggucuacaucaucggcgcccagccgcugugcucccagcucgcggggcugagccagggccagaagaagcugugccaccucuaccaggaccacaugcaguacaucggggagggcgccaagaccggcaucaaggagugccaguaccaguuccgccaccggcgcuggaacugcuccaccguggacaacacgagcguguucgggcgggucaugcagaucggcucccgcgagaccgccuucaccuacgccgugagcgcggccgggguggucaacgccaugucccgggccugccgcgagggcgagcugagcacgugcgggugcucccgggccgcgcgccccaaggaccugccccgggacuggcucuggggcggcugcggggacaacaucgacuacggcuaccgcuucgccaaggaguucguggacgcccgggagcgcgagcggauccacgccaaggggagcuacgaguccgcccgcauccugaugaaccugcacaacaacgaggcgggccggcgcaccguguacaaccucgccgacgucgccugcaagugccacggcgugagcggguccugcagccugaagaccugcuggcugcagcucgccgacuuccggaaggugggcgacgcccugaaggagaaguacgacagcgcggccgccaugcgccugaacucccgggggaagcucguccaggugaacagccgcuucaacucccccaccacccaggaccugguguacaucgacccgagccccgacuacugcguccggaacgaguccacgggcagccuggggacccagggccgccucugcaacaagaccuccgagggcauggacgggugcgagcugaugugcugcggccgcggguacgaccaguucaagaccgugcagacggagcggugccacugcaaguuccacuggugcugcuacgugaagugcaagaagugcaccgagaucgucgaccaguucgugugcaaguga

SEQ ID NO: 38744 - RNA, 1080 nt, Artificial Sequence
  derived and/or modified sequence opt1 from WNT5B__Homo_sapiens__NP_110402
augcccagccugcuccugcuguucaccgccgcccuccuguccagcugggcgcagcugcucaccgacgccaacuccugguggagccuggcccugaacccggugcagcgccccgagauguucaucaucggcgcccagcccgucugcucccagcuccccgggcugagcccgggccagcggaagcugugccagcucuaccaggagcacauggccuacaucggggagggcgcgaagacggggaucaaggagugccagcaccaguuccgccagcggcgcuggaacugcuccaccgccgacaacgccagcguguucggccgggugaugcagaucggcucccgcgagaccgccuucacccacgcggucagcgccgccgggguggugaacgccaucucccgggccugccgcgagggcgagcugagcacgugcgggugcucccggaccgcgcgccccaaggaccugccccgggacuggcucuggggcgggugcggcgacaacgucgaguacggcuaccgcuucgccaaggaguucguggacgcccgggagcgcgagaagaacuucgccaaggggagcgaggagcagggccgggugcugaugaaccugcagaacaacgaggccgggcgccgggcggucuacaagauggccgacguggccugcaagugccacggcguguccggcagcugcucccucaagaccugcuggcugcagcuggccgaguuccgcaaggucggggaccggcucaaggagaaguacgacagcgccgcggccaugcgcgugacccggaagggccgccuggagcuggugaacucccgcuucacgcagcccaccccggaggaccucgucuacguggaccccagccccgacuacugccugcggaacgagagcaccgggucccugggcacccaggggcgccucugcaacaagacgagcgagggcauggacggcugcgagcugaugugcugcgggcggggcuacaaccaguucaaguccgugcaggucgagcgcugccacugcaaguuccacuggugcugcuucgugcggugcaagaagugcaccgagaucguggaccaguacaucugcaaguga

SEQ ID NO: 38745 - RNA, 1098 nt, Artificial Sequence
  derived and/or modified sequence opt1 from WNT6__Homo_sapiens__NP_006513
augcugcccccgcuccccagccgccugggccugcuccugcugcuccugcugugccccgcccacgucgggggccucuggugggccguggggagcccccuggugauggacccgaccuccaucugccggaaggcgcgccggcuggccggccgccaggccgagcucugccaggccgagcccgagguggucgccgagcuggcgcgcggggcccggcugggcgugcgggagugccaguuccaguuccgcuuccggcgcuggaacugcuccagccacuccaaggccuucggccggauccuccagcaggacauccgcgagaccgccuucguguucgcgaucacggccgccggggccagccacgccgucacccaggcgugcuccaugggcgagcugcugcagugcgggugccaggcgccccggggccgcgcgcccccgcggcccagcgggcuccccggcacccccggcccgcccgggcccgccggcucccccgaggggagcgccgccugggaguggggcggcugcggggacgacguggacuucggcgacgagaagucccgccuguucauggacgcccggcacaagcgcgggcggggcgacauccgcgcccuggugcagcuccacaacaacgaggccgggcggcuggccguccgcagccacacccgcacggagugcaagugccacggccuguccggcagcugcgcccuccggaccugcuggcagaagcugccgcccuuccgcgaggugggggcccggcugcucgagcgcuuccacggcgccucccgggugauggggaccaacgacggcaaggcccugcugcccgccguccgcacccucaagcccccggggcgggcggaccugcuguacgccgccgacagccccgacuucugcgcccccaaccgccggacgggcucccccggcacccgcgggcgggcgugcaacagcuccgccccggaccucagcggcugcgaccugcugugcugcgggcgcggccaccggcaggagagcgugcagcucgaggagaacugccugugccgcuuccacuggugcugcgugguccagugccaccggugccgcgugcggaaggagcugucccucugccuguga

SEQ ID NO: 38746 - RNA, 1050 nt, Artificial Sequence
  derived and/or modified sequence opt1 from WNT7A__Homo_sapiens__NP_004616
augaaccgcaaggcccggcgcugccugggccaccucuuccugagccuggggaugguguaccuccggaucggcggguucuccagcgucguggcccugggcgcguccaucaucugcaacaagauccccgggcuggccccgcgccagcgggccaucugccagagccgccccgacgccaucaucgugaucggcgagggcucccagauggggcucgacgagugccaguuccaguuccggaacggccgcuggaacugcagcgcccugggggagcggaccgucuucggcaaggagcugaagguggggucccgcgaggcggccuucaccuacgccaucaucgccgcgggcguggcccacgccaucaccgccgccugcacccagggcaaccucagcgacugcgggugcgacaaggagaagcagggccaguaccaccgggacgagggguggaaguggggcggcugcuccgcggacauccgcuacgggaucggcuucgccaaggucuucguggacgcccgggagaucaagcagaacgcccgcacccugaugaaccugcacaacaacgaggccgggcggaagauccucgaggagaacaugaagcuggagugcaagugccacggcgugagcggguccugcaccacgaagaccugcuggaccacccugccccaguuccgcgagcucggcuacguccugaaggacaaguacaacgaggcggugcacguggagcccguccgggccagccgcaacaagcggccgacguuccugaagaucaagaagccccucuccuaccgcaagcccauggacaccgaccugguguacaucgagaagucccccaacuacugcgaggaggacccggugaccggcagcgucgggacccagggccgggccugcaacaagacggcgccccaggccagcgggugcgaccugaugugcugcggccgcggguacaacacccaccaguacgcccgcguguggcagugcaacugcaaguuccacuggugcugcuacgugaagugcaacacgugcuccgagcggaccgagauguacacgugcaaguga

SEQ ID NO: 38747 - RNA, 1050 nt, Artificial Sequence
  derived and/or modified sequence opt1 from WNT7B__Homo_sapiens__NP_478679
augcaccgcaacuuccggaaguggaucuucuacguguuccugugcuucggcguccucuacgugaagcugggggcccugagcuccguggucgcccucggcgcgaacaucaucugcaacaagauccccgggcuggccccgcgccagcgggccaucugccagagccgccccgacgccaucaucgugaucggcgagggggcccagaugggcaucaacgagugccaguaccaguuccgguucggccgcuggaacugcuccgcgcugggggagaagaccguguucggccaggagcuccgggucgggagccgcgaggccgccuucaccuacgccaucaccgcggccggcguggcccacgccgugaccgccgcgugcucccaggggaaccugagcaacugcggcugcgaccgggagaagcagggcuacuacaaccaggccgagggguggaaguggggcgggugcuccgccgacguccgcuacggcaucgacuucagccggcgcuucguggacgcccgggagaucaagaagaacgcccgccggcugaugaaccuccacaacaacgaggcgggccgcaaggugcuggaggaccggaugcagcuggagugcaagugccacggggucuccggcagcugcaccaccaagacgugcuggaccacccuccccaaguuccgcgagguggggcaccuccugaaggagaaguacaacgccgccgugcaggucgagguggugcgggccucccgccugcggcagcccaccuuccugcgcaucaagcagcugcgcagcuaccagaagccgauggagacggaccucgucuacaucgagaagucccccaacuacugcgaggaggacgccgcgaccggcagcguggggacccagggccggcugugcaaccgcaccucccccggcgccgacgggugcgacacgaugugcugcggccggggguacaacacccaccaguacaccaagguguggcagugcaacugcaaguuccacuggugcugcuucgucaagugcaacacgugcagcgagcgcaccgagguguucacgugcaaguga

SEQ ID NO: 38748 - RNA, 1056 nt, Artificial Sequence
  derived and/or modified sequence opt1 from WNT8A__Homo_sapiens__NP_490645
augggcaaccuguucaugcucugggccgcccuggggaucugcugcgcggccuucagcgccuccgccuggagcgugaacaacuuccugaucaccggccccaaggccuaccucaccuacacgaccuccgucgcgcugggggcccagagcggcaucgaggagugcaaguuccaguucgccugggagcgcuggaacugcccggagaacgcccugcagcucuccacccacaaccggcugcgcagcgcgacccgggagacguccuucauccacgccaucagcuccgccggggugauguacaucaucaccaagaacugcagcaugggcgacuucgagaacugcggcugcgacggguccaacaacggcaagaccgggggccacggguggaucuggggcggcugcagcgacaacguggaguucggggagcgcaucuccaagcuguucgucgacagccucgagaagggcaaggacgcccgggcccugaugaaccugcacaacaaccgcgcggggcggcucgccgugcgcgccaccaugaagcggacgugcaagugccacggcaucuccggcagcugcuccauccagaccugcuggcugcagcuggccgaguuccgcgagaugggggacuaccucaaggccaaguacgaccaggcgcugaagaucgagauggacaagcggcagcugcgcgccggcaacagcgccgaggggcacugggugcccgccgaggccuuccuccccuccgcggaggccgagcugaucuuccuggaggagagccccgacuacugcacgugcaacagcucccucggcaucuacgggaccgagggccgggagugccugcagaacagccacaacaccucccgcugggagcggcgcagcugcggccggcugugcaccgagugcgggcuccaggucgaggagcgcaagaccgaggugaucuccagcugcaacugcaaguuccaguggugcugcaccgugaagugcgaccagugccggcacgucguguccaaguacuacugcgcccgcagcccgggcuccgcccagagccuggggaagggcuccgccuga

SEQ ID NO: 38749 - RNA, 1056 nt, Artificial Sequence
  derived and/or modified sequence opt1 from WNT8B__Homo_sapiens__NP_003384
auguuccugagcaagcccuccguguacaucugccucuucacgugcguccugcagcugagccacuccuggagcgugaacaacuuccucaugaccggcccgaaggccuaccugaucuacuccagcuccguggccgcgggggcccagagcggcaucgaggagugcaaguaccaguucgccugggaccgcuggaacugccccgagcgggcccugcagcucuccagccacgggggccugcgcuccgccaaccgggagaccgcguucguccacgccaucagcuccgccggggugauguacacccugacccgcaacugcagccucggcgacuucgacaacugcggcugcgacgacucccggaacgggcagcugggcgggcagggcuggcuguggggcgggugcagcgacaacgugggcuucggggaggccaucuccaagcaguucgucgacgcgcucgagaccggccaggacgcccgcgccgccaugaaccugcacaacaacgaggccgggcggaaggcggugaagggcacgaugaagcggaccugcaagugccacggcgugagcggguccugcaccacccagacgugcuggcugcagcuccccgaguuccgcgaggucggcgcccaccugaaggagaaguaccacgccgcccugaagguggaccuccugcagggggccggcaacagcgcggccgggcgcggcgccaucgccgacaccuuccggagcaucuccacccgcgagcuggugcaccucgaggacagccccgacuacugccuggagaacaagacccugggccuccuggggacggagggccgggagugccugcgccgggggcgcgcccucggccggugggagcgccgguccugccgccggcugugcggggacugcggccuggcggucgaggagcgccgcgccgagaccgugagcuccugcaacugcaaguuccacuggugcugcgccgugcggugcgagcagugccgccggcgcgucaccaaguacuucugcagccgggccgagcgcccgcggggcggggccgcgcacaagcccggccgcaagcccuga

SEQ ID NO: 38750 - RNA, 1098 nt, Artificial Sequence
  derived and/or modified sequence opt1 from WNT9A__Homo_sapiens__NP_003386
augcuggacggcagcccccucgcccgcuggcuggccgcggccuucgggcugacccuccugcuggccgcccuccggccguccgccgcguacuucggccugaccgggagcgagccccugaccauccucccccugacccuggagcccgaggccgccgcccaggcgcacuacaaggccugcgaccgccucaagcuggagcggaagcagcgccggaugugccgccgggacccgggcguggccgagacccuggucgaggccguguccaugagcgcccucgagugccaguuccaguuccgcuucgagcgguggaacugcacccuggaggggcgcuaccgggcgucccugcucaagcgcggcuucaaggagacggccuuccuguacgccaucagcuccgccggccugacccacgcccucgcgaaggccugcagcgccgggcggauggagcgcugcacgugcgacgaggcccccgaccuggagaaccgggaggccuggcaguggggcgggugcggcgacaaccugaaguacuccagcaaguucgugaaggaguuccucgggcgccgguccagcaaggaccugcgcgcgcgggucgacuuccacaacaaccuggugggcgugaaggucaucaaggccggcguggagacgaccugcaagugccacgggguguccggcagcugcaccguccggaccugcuggcgccagcucgcccccuuccacgagguggggaagcaccugaagcacaaguacgagaccgcccugaaggugggcuccaccaccaacgaggccgcgggcgaggccggggccaucagcccgccccgcggccgcgccuccggggcgggcgggagcgacccccucccccggacccccgagcugguccaccuggacgacuccccgagcuucugccucgccggccgcuucagccccggcaccgccgggcggcgcugccaccgggagaagaacugcgaguccaucugcugcggccgcgggcacaacacgcagagccggguggugacccgccccugccagugccagguccgguggugcugcuacguggagugccgccagugcacccagcgggaggagguguacacgugcaagggcuga

SEQ ID NO: 38751 - RNA, 1074 nt, Artificial Sequence
  derived and/or modified sequence opt1 from WNT9B__Homo_sapiens__NP_003387
augcggcccccgcccgcccuggcccucgcgggccugugccugcucgcccugcccgccgccgccgcgagcuacuucgggcugaccggccgcgaggugcucacccccuucccggggcugggcacggccgccgcccccgcgcagggcggggcccaccugaagcagugcgaccuccugaagcugucccgccggcagaagcagcucugccgccgggagcccggccuggccgagacccugcgcgacgccgcccaccucgggcugcuggagugccaguuccaguuccggcacgagcgcuggaacugcagccucgagggccggauggggcugcugaagcgcggcuucaaggagaccgcguuccucuacgccgucuccagcgccgcccugacccacacgcuggcccgggcgugcuccgccgggcgcauggagcggugcacgugcgacgacagccccggccucgagucccgccaggccuggcaguggggcgugugcggggacaaccugaaguacagcaccaaguuccuguccaacuuccucggcagcaagcgggggaacaaggaccugcgcgcccgggccgacgcgcacaacacccacgugggcaucaaggccgucaaguccggccugcgcacgaccugcaagugccacggggugagcggcuccugcgccgugcggaccugcuggaagcagcucagcccguuccgcgagaccgggcagguccugaagcugcgguacgacuccgccgugaaggugagcuccgccaccaacgaggcgcucggccgccuggagcugugggcccccgcccgccaggggagccucaccaagggccuggcgccccgguccggcgaccuggucuacauggaggacagccccagcuucugccgcccguccaaguacagccccgggaccgccggccgggugugcucccgcgaggccagcugcuccagccucugcugcgggcggggcuacgacacccagucccgccugguggccuucagcugccacugccagguccaguggugcugcuacguggagugccagcagugcgugcaggaggagcuggucuacacgugcaagcacuga

SEQ ID NO: 38752 - RNA, 1647 nt, Artificial Sequence
  derived and/or modified sequence opt1 from WRAP53__Homo_sapiens__NP_001137462
augaagacccuggagacccagccccucgccccggacugcugccccagcgaccaggaccccgcccccgcgcacccgagcccccacgccucccccaugaacaagaacgccgacuccgagcugaugcccccgccgcccgagcgcggcgacccgccccggcugagccccgaccccguggccggguccgccgucagccaggagcuccgcgagggcgaccccgugucccugagcacgccccuggagaccgaguucgggucccccagcgagcucagcccccggaucgaggagcaggagcuguccgagaacaccucccugcccgcggaggaggccaacggcagccucuccgaggaggaggccaacgggccggagcugggcagcggcaaggccauggaggacaccuccggggagcccgcggccgaggacgagggcgacacggccuggaacuacagcuucucccagcugccccgcuuccucagcgggagcugguccgaguucagcacccagcccgagaacuuccugaagggcugcaagugggccccggacggguccugcauccugaccaacagcgccgacaacauccuccggaucuacaaccugccgcccgagcuguaccacgagggcgagcaggucgaguacgcggagauggugcccgugcuccgcaugguggagggcgacaccaucuacgacuacugcugguacucccugaugagcuccgcccagcccgacacgagcuacgucgccuccagcucccgggagaaccccauccacaucugggacgccuucaccggggagcugcgcgccagcuuccgggcguacaaccaccucgacgagcugaccgccgcccacucccugugcuucagccccgacggcucccagcuguucugcggguucaaccgcaccgugcggguguucagcacggcccgcccgggccgggacugcgagguccgcgccaccuucgcgaagaagcagggccaguccgggaucaucagcugcaucgccuucucccccgcccagccccucuacgccugcggcagcuacgggcggagccugggccucuacgccugggacgacgggagcccccuggcgcugcucggcggccaccagggcgggaucacccaccugugcuuccacccggacgggaaccgcuucuucuccggcgcccggaaggacgccgagcugcucugcugggaccugcgccaguccggguacccccuguggagccucggccgggaggugaccacgaaccagcgcaucuacuucgaccuggaccccaccggccaguuccugguguccgggagcaccuccggcgccgucagcgugugggacaccgacgggcccggcaacgacgggaagccggagcccgugcucuccuuccugccccagaaggacugcacgaacggcgucagccugcaccccucccucccgcugcuggcgaccgccagcggccagcggguguuccccgagcccaccgaguccggggacgagggcgaggagcucgggcugccccugcucagcacccgccacgugcaccuggagugccgccugcagcugugguggugcggcggcgccccggacuccagcauccccgacgaccaccagggggagaagggccagggcgggacggagggcggggucggcgagcucaucuga

SEQ ID NO: 38753 - RNA, 423 nt, Artificial Sequence
  derived and/or modified sequence opt1 from WRB__Homo_sapiens__NP_001139690
augagccgcgugcugcagaaggacgccgagcaggagucccagaugcgggccgagauccaggacaugaagcaggagcucagcaccgucaacaugauggacgaguucgcgcgcuacgcccggcuggagcgcaagaucaacaagaugaccgacaagcugaagacgcacgugaaggcccggaccgcccagcucgccaagaucaagugggugaucuccgucgcguucuacgugcugcaggccgcccugaugaucagccucaucuggaaguacuacuccgugcccgucgccguggugcccagcaaguggaucaccccgcuggaccgccuggucgcguuccccacccggguggccggcggggugggcaucacgugcuggauccucgucugcaacaaggugguggccaucguccugcaccccuucuccuga

SEQ ID NO: 38754 - RNA, 4299 nt, Artificial Sequence
  derived and/or modified sequence opt1 from WRN__Homo_sapiens__NP_000544
augagcgagaagaagcuggagaccaccgcccagcagcggaagugccccgaguggaugaacgugcagaacaagcggugcgccgucgaggagcgcaaggcgugcgugcggaaguccguguucgaggacgaccucccguuccuggaguucacgggcagcaucgucuacuccuacgacgccagcgacugcuccuuccugagcgaggacaucuccaugagccucuccgacggggacguggugggcuucgacauggaguggccgccccuguacaaccgcgggaagcugggcaaggucgcccucauccagcugugcgugagcgaguccaagugcuaccuguuccacgugagcuccaugagcgucuucccccaggggcucaagaugcugcuggagaacaaggccgugaagaaggccggcgugggcaucgagggggaccaguggaagcuccugcgggacuucgacaucaagcugaagaacuucgucgagcucaccgacguggcgaacaagaagcugaagugcaccgagaccuggucccugaacagccucgugaagcaccuccugggcaagcagcuccugaaggacaaguccauccgcugcagcaacugguccaaguucccccugacggaggaccagaagcucuacgccgccaccgacgccuacgcgggguucaucaucuaccggaaccuggagauccuggacgacaccguccagcgcuucgccaucaacaaggaggaggagauccuccugagcgacaugaacaagcagcugaccagcaucuccgaggaggugauggaccucgccaagcaccucccgcacgccuucagcaagcuggagaacccccggcgcguguccauccugcugaaggacaucagcgagaaccuguacucccuccggcgcaugaucaucggcagcacgaacaucgagaccgagcugcggcccuccaacaaccugaaccuccugagcuucgaggacuccaccaccgggggcguccagcagaagcagauccgcgagcacgaggugcugauccacguggaggacgagacgugggacccgacccucgaccaccuggccaagcacgacggcgaggacguccuggggaacaagguggagcggaaggaggacggcuucgaggacgggguggaggacaacaagcucaaggagaacauggagcgcgcgugccugaugagccuggacaucaccgagcacgagcuccagauccuggagcagcagucccaggaggaguaccugagcgacaucgccuacaaguccaccgagcaccugagccccaacgacaacgagaacgacacguccuacgucaucgagagcgacgaggaccucgagauggagaugcugaagcaccugucccccaacgacaacgagaacgacaccagcuacgugaucgaguccgacgaggaccucgagauggagaugcugaagucccuggagaaccugaacagcggcaccgucgagcccacccacagcaagugccugaagauggagcggaaccugggccuccccacgaaggaggaggaggaggacgacgagaacgaggccaacgagggggaggaggacgacgacaaggacuuccuguggcccgcccccaacgaggagcaggucacgugccugaagauguacuucggccacagcuccuucaagcccgugcaguggaaggugauccacagcgugcucgaggagcgccgggacaacguggccgucauggcgaccggguacggcaagucccugugcuuccaguacccgcccguguacguggggaagaucggccuggucaucagcccccucaucucccugauggaggaccaggugcugcagcucaagaugagcaacauccccgccugcuuccugggcuccgcccagagcgagaacgugcugaccgacaucaagcucgggaaguaccgcaucgucuacgugaccccggaguacugcuccggcaacauggggcugcugcagcagcucgaggccgacaucggcaucacccugaucgccguggacgaggcgcacugcaucagcgagugggggcacgacuuccgggacuccuuccgcaagcugggcagccucaagaccgcccugcccaugguccccaucguggcccugaccgccacggccuccagcuccauccgcgaggacaucgugcggugccucaaccugcgcaacccccagaucacgugcaccggcuucgaccggccgaaccuguaccucgagguccgccggaagaccgggaacauccugcaggaccugcagcccuuccucgugaagaccagcagccacugggaguucgagggccccaccaucaucuacugccccucccgcaagaugacccagcaggucaccggggagcugcggaagcugaaccucagcugcggcacguaccacgcggggauguccuucagcacccgcaaggacauccaccaccgguucgugcgcgacgagauccagugcgugaucgccaccaucgccuucggcaugggcaucaacaaggccgacauccgccaggugauccacuacggggcgccgaaggacauggaguccuacuaccaggagaucggccgggccgggcgggacggccugcagagcuccugccacguccugugggcccccgccgacaucaaccucaaccgccaccuccugaccgagauccggaacgagaaguuccgccuguacaagcugaagaugauggccaagauggagaaguaccugcacagcucccggugccgccggcagaucauccucagccacuucgaggacaagcagguccagaaggcgucccugggcaucauggggaccgagaagugcugcgacaacugccgcagccgccuggaccacugcuacuccauggacgacagcgaggacacguccugggacuucggcccccaggccuucaagcuccugagcgccguggacauccugggggagaaguucggcaucgggcucccgauccuguuccugcggggcuccaacagccagcgccucgccgaccaguaccggcgccacucccuguucggcaccgggaaggaccagaccgagagcugguggaaggccuucagccggcagcugaucaccgagggcuuccucguggaggugucccgcuacaacaaguucaugaagaucugcgcgcugacgaagaaggggcggaacuggcugcacaaggccaacaccgagagccagucccucauccugcaggccaacgaggagcugugccccaagaagcuccugcugcccagcuccaagaccgugagcuccggcaccaaggagcacugcuacaaccagguccccguggagcucagcacggagaagaaguccaaccuggagaagcuguacagcuacaagccgugcgacaagaucuccagcggguccaacaucagcaagaaguccaucauggugcagagccccgagaaggccuacuccagcucccagcccgucaucagcgcccaggagcaggagacccagaucgugcucuacggcaagcugguggaggcgcgccagaagcacgccaacaagauggacgugcccccggccauccuggccaccaacaagauccucgucgacauggcgaagaugcggcccaccacgguggagaacgucaagcgcaucgacggcgugagcgaggggaaggccgccaugcuggcgccccugcucgaggugaucaagcacuucugccagaccaacuccguccagaccgaccuguucagcuccaccaagccccaggaggagcagaagacgagccugguggccaagaacaagaucugcacccucucccagagcauggccaucaccuacucccuguuccaggagaagaagaugccgcucaagagcaucgccgagucccggauccugccccugaugaccaucggcaugcaccugagccaggccgugaaggccgggugcccccucgaccuggagcgcgccggccugacgcccgagguccagaagaucaucgcggacgugauccggaacccgcccgugaacuccgacaugagcaagaucucccucauccgcaugcugguccccgagaacaucgacaccuaccugauccacauggccaucgagauccucaagcacgggcccgacagcggccugcagccguccugcgacgugaacaagcggcgcugcuuccccggcagcgaggagaucugcuccagcuccaagcggagcaaggaggagguggggaucaacaccgagaccagcuccgccgagcgcaagcggcgccugcccgucugguucgccaagggcagcgacacguccaagaagcugauggacaagaccaagcgcgggggccucuucagcuga

SEQ ID NO: 38755 - RNA, 1998 nt, Artificial Sequence
  derived and/or modified sequence opt1 from WRNIP1__Homo_sapiens__NP_064520
auggaggugagcggccccgaggacgacccguuccugucccagcuccaccagguccagugccccgugugccagcagaugaugcccgccgcccacaucaacagccaccuggaccgcugccugcuccugcaccccgcggggcacgccgagccggccgccggcucccaccgggccggggagcgcgcgaagggccccagcccgcccggggccaagcggcgccggcuguccgagagcuccgcccucaagcagcccgccacccccaccgcggccgagagcuccgagggcgagggcgaggagggggacgacggcggggagacggagagccgcgaguccuacgacgccccgcccacccccagcggcgcccggcugauccccgacuuccccguggcccgcuccagcucccccgggcggaagggcagcggcaagcgcccggcggccgccgccgccgcgggguccgccagcccccgguccugggacgaggccgaggcccaggaggaggaggaggccgucggcgacggggacggcgacggcgacgcggacgccgacggggaggacgaccccggccacugggacgccgacgccgccgaggcggccaccgccuucggggccagcggcgggggccgcccccacccgcgggcgcuggccgccgaggagauccgccagaugcuccagggcaagccccuggccgacaccaugcggcccgacacgcugcaggacuacuucgggcagagcaaggccgugggccaggacacccuccugcgcucccugcucgagaccaacgagauccccagccugauccugugggggccgcccggcugcgggaagaccacgcucgcgcacaucaucgccuccaacagcaagaagcacuccauccgguucgugacccugagcgccaccaacgccaagaccaacgacguccgcgacgugaucaagcaggcccagaacgagaaguccuucuucaagcggaagacgauccuguucaucgacgagauccaccgcuucaacaagagccagcaggacaccuuccucccccacguggagugcggcaccaucacccugaucggcgcgacgaccgagaaccccuccuuccaggucaacgccgcccugcucagccggugccgcgugaucgugcuggagaagcugccggucgaggccauggugaccauccucaugcgcgccaucaacucccuggggauccacgugcuggacagcucccggcccaccgacccccucagccacuccagcaacuccagcuccgagccggcgauguucaucgaggacaaggccgucgacacgcuggccuaccugagcgacggcgacgcccgcgcggggcucaacggccugcagcuggccgugcucgcccggcugagcucccgcaagauguucugcaagaaguccgggcagagcuacagccccucccgggugcugaucaccgagaacgacgucaaggagggccuccagcgcagccacauccuguacgaccgggccggcgaggagcacuacaacugcaucuccgcccugcacaagagcaugcgcggguccgaccagaacgcgagccucuacuggcuggcccggaugcuggagggcggggaggacccccucuacguggcccgccggcuggugcgcuucgccuccgaggacaucggccuggccgaccccagcgcgcucacccaggccgucgccgccuaccagggcugccacuucaucgggaugccggagugcgaggugcugcuggcccagugcguggucuacuucgcgcgggcccccaaguccaucgagguguacagcgccuacaacaacgucaaggccugccugcgcaaccaccagggcccccugcccccggugccccugcaccuccggaacgcgcccacccgccucaugaaggaccugggguacggcaagggguacaaguacaaccccauguacuccgagccgguggaccaggaguaccugcccgaggagcuccggggcgucgacuucuucaagcagcgccggugcuga

SEQ ID NO: 38756 - RNA, 1266 nt, Artificial Sequence
  derived and/or modified sequence opt1 from WSB1__Homo_sapiens__NP_056441
auggccagcuucccgccccgcgugaacgagaaggagaucguccggcugcgcaccaucggcgagcuccuggcccccgcggcccccuucgacaagaagugcgggcgggagaacuggaccguggccuucgcccccgacggcuccuacuucgccuggagccaggggcaccgcaccgugaagcuggucccguggucccagugccuccagaacuuccugcugcacggcaccaagaacgugaccaacagcuccagccuccggcugccccgccagaacuccgacgggggccagaagaacaagccccgggagcacaucaucgacugcggcgacaucguguggagccuggcguucggguccagcguccccgagaagcagucccgcugcgugaacaucgaguggcaccgguuccgcuucggccaggaccagcuccugcuggccaccgggcucaacaacggccggaucaagaucugggacguguacacggggaagcugcugcucaaccuggucgaccacaccgagguggugcgcgaccugaccuucgccccggacggcagccucauccuggucuccgccagccgggacaagacccugcgcgugugggaccucaaggacgacggcaacaugaugaaggugcugcgggggcaccagaacugggucuacuccugcgcguucagccccgacuccagcaugcugugcuccgugggcgccagcaaggccguguuccucuggaacauggacaaguacacgaugauccgcaagcuggaggggcaccaccacgacgucguggccugcgacuucagccccgacggcgcccugcucgcgaccgccuccuacgacacccggguguacaucugggacccccacaacggcgacauccugauggaguucgggcaccuguucccgccgcccacccccaucuucgccggcggggccaacgaccgcuggguccggagcguguccuucagccacgacggccuccacguggccucccuggcggacgacaagaugguccgcuucuggcggaucgacgaggacuaccccgugcaggucgcgccccugagcaacgggcucugcugcgccuucuccacggacggcagcgugcuggccgccggcacccacgacggguccguguacuucugggccacgccccgccagguccccagccugcagcaccucugccgcauguccauccggcgcgugaugccgacccaggaggugcaggagcugcccauccccagcaagcugcucgaguuccuguccuaccggaucuga

SEQ ID NO: 38757 - RNA, 1728 nt, Artificial Sequence
  derived and/or modified sequence opt1 from WSCD1__Homo_sapiens__NP_056068
auggccaagcccuucuuccgccugcagaaguuccuccggcgcacccaguuccugcuguucuuccucaccgccgcguaccugaugacgggcagccugcuccugcugcagcgggugcgcgucgcccucccgcaggggccccgggcccccggcccccugcagacccugccgguggccgccguggcgcucggggucggccugcuggacucccgcgcccuccacgacccccgggugagccccgagcugcugcucgggguggacaugcugcagagcccccugacccgcccgcggcccggcccccgcuggcuccggucccgcaacuccgagcugcggcagcugcgccggcgcugguuccaccacuucaugagcgacucccaggggcccccggcccucggccccgaggccgcgcggcccgccauccacagccgcggcaccuacaucgggugcuucuccgacgacggccacgagcggacgcugaagggggccgucuucuacgaccugcgcaagaugaccgugagccacugccaggacgccugcgccgagcgguccuacguguacgcgggccucgaggccggcgccgagugcuacugcgggaaccgccugcccgccgucagcgugggccuggaggagugcaaccacgagugcaagggggagaagggcuccgugugcggcgccgucgaccgccucagcguguaccggguggacgagcugcagccggggucccgcaagcggcgcaccgcgaccuaccggggcugcuuccgccugcccgagaacaucacgcacgccuuccccagcucccucauccaggccaacgucaccguggggaccugcagcggcuucugcucccagaaggaguucccccuggccauccugcgggggugggagugcuacugcgccuacccgacgccccgcuucaaccuccgggacgcgauggacagcagcgugugcggccaggaccccgaggcccagcgccuggccgaguacugcgaggucuaccagacccccgugcaggacacccggugcaccgaccgccgguuccugccgaacaaguccaagguguucgucgcccucagcuccuuccccggcgccgggaacaccugggcgcgccaccugaucgagcacgccacgggcuucuacaccgggagcuacuacuucgacggcacccuguacaacaagggguucaagggcgagaaggaccacuggcggucccgccggaccaucugcgugaagacgcacgagagcggccgccgggagaucgagauguucgacuccgccauccuccugauccgcaaccccuaccgcagccugguggccgaguucaaccggaagugcgcggggcaccucggcuacgccgccgaccgcaacuggaaguccaaggaguggcccgacuucgucaacagcuacgccuccugguggagcucccacgugcuggacuggcugaaguacgggaagcggcuccuggucgugcacuacgaggagcugcgccggagccuggugccgacccuccgcgagauggucgccuuccugaacguguccgugagcgaggagcggcugcucugcgucgagaacaacaaggagggcuccuuccgccggcgcgggcggcgcagccacgaccccgagcccuucaccccggagaugaaggaccugaucaacggcuacauccggaccguggaccaggcgcugcgcgaccacaacuggacgggccucccccgggaguacgugccccgcuga

SEQ ID NO: 38758 - RNA, 1698 nt, Artificial Sequence
  derived and/or modified sequence opt1 from WSCD2__Homo_sapiens__NP_001291376
auggccaagcugugguucaaguuccagcgcuacuuccggcgcaagcccgugcgguucuucaccuuccucgcccuguaccugaccgcgggcagccucgucuuccugcacuccggguucgugggccagccggccgugagcgggaaccaggccaaccccgccgccgcgggcgggcccgccgagggcgccgagcuguccuuccucggcgacaugcaccuggggcgcggcuuccgggacacgggggaggccagcuccaucgcgcgccgguacggccccugguucaaggggaaggacggcaacgagcgcgccaagcugggcgacuacgggggcgccuggagccgggcccucaaggggcgcgucgugcgggagaaggaggaggagcgcgccaaguacaucggcugcuaccuggacgacacccagucccgggcgcugcgcggcgugagcuucuucgacuacaagaagaugaccaucuuccggugccaggacaacugcgccgagcgcggguaccucuacggcgggcuggaguucggcgccgagugcuacugcgggcacaagauccaggccaccaacgucuccgaggccgagugcgacauggagugcaagggcgagcggggcagcgugugcgggggcgcgaaccgccuguccguguaccggcuccagcuggcccaggagagcgcccgccgguacggguccgccgucuuccgcggcugcuuccgccggccggacaaccugagccucgcccugcccgugacggcggccaugcugaacauguccguggacaagugcgucgacuucugcaccgagaaggaguacccccucgccgcccuggccgggaccgcgugccacugcggcuuccccaccacgcgcuucccgcugcacgaccgggaggacgagcagcucugcgcccagaagugcagcgccgaggaguucgaguccugcggcacccccagcuacuucaucguguaccagacccaggugcaggacaaccgcugcauggaccggcgcuuccugcccgggaaguccaagcagcugaucgcccucgcgagcuuccccggcgccgggaacaccugggcccggcaccugaucgagcuggccacgggcuucuacaccgggagcuacuacuucgacggcucccucuacaacaagggcuucaagggggagcgcgaccacuggcggagcggccgcaccaucugcaucaagacccacgaguccgggcagaaggagaucgaggccuucgacgcggccauccugcugauccggaacccguacaaggcccucauggccgaguucaaccgcaaguacggcggccacaucggguucgccgcgcacgcccacuggaagggcaaggaguggcccgaguucguccggaacuacgcccccuggugggccacgcacacccuggacuggcugaaguucgggaagaaggugcucgugguccacuucgaggaccugaagcaggaccuguucgugcagcucggccgcauggugagccugcugggggucgccgugcgggaggaccgccuccugugcguggagucccagaaggacggcaacuucaagcggagcggccugcgcaagcucgaguacgaccccuacaccgcggacaugcagaagaccaucuccgccuacaucaagauggucgacgccgcccugaaggggcggaaccugacgggcgugccggacgacuacuacccccgcuga

SEQ ID NO: 38759 - RNA, 1494 nt, Artificial Sequence
  derived and/or modified sequence opt1 from WT1__Homo_sapiens__NP_000369
augcaggaccccgccagcaccugcgugccggagcccgccucccagcacacccugcgcagcggccccgggugccuccagcagcccgagcagcagggcguccgggacccggggggcaucugggcgaagcugggggccgccgaggccuccgccgagcgccugcagggccggcgcagccggggcgcguccgggagcgagccccagcagaugggcuccgacgugcgcgaccucaacgcccugcugcccgccgugcccagccucgggggcgggggcggcugcgcccugccggucuccggggcggcccagugggcccccgugcuggacuucgccccccccggcgccagcgcguacgggucccucggcggcccggcccccccccccgccccgcccccccccccgcccccccccccgcacagcuucaucaagcaggagcccuccugggggggcgccgagccccacgaggagcagugccugagcgccuucacggugcacuucuccgggcaguucaccggcaccgcgggggccugccgguacggccccuucggcccgccccccccgagccaggccuccagcgggcaggcccgcauguuccccaacgcccccuaccugcccuccugccucgagagccagccggcgauccggaaccagggcuacagcaccgucacguucgacgggacccccuccuacggccacacccccagccaccacgccgcccaguuccccaaccacuccuucaagcacgaggacccgauggggcagcagggcagccugggcgagcagcaguacuccgugcccccccccguguacgggugccacaccccgacggacagcugcaccggcucccaggcccugcuccugcgcacccccuacagcuccgacaaccuguaccagaugaccagccagcucgagugcaugacguggaaccagaugaaccugggggccacccugaagggccacuccaccggguacgagagcgacaaccacaccacgcccauccucugcggcgcgcaguaccggauccacacccacggcgucuuccgcgggauccaggacgugcggcgcgugcccggcgucgccccgacccuggugcgguccgccagcgagaccuccgagaagcgccccuucaugugcgccuaccccgggugcaacaagcgguacuucaagcugagccaccuccagaugcacucccgcaagcacacgggcgagaagcccuaccagugcgacuucaaggacugcgagcggcgcuucagccgguccgaccagcugaagcgccaccagcgccggcacaccggcgugaagccguuccagugcaagaccugccagcgcaaguucagccggagcgaccaccugaagacccacacgcgcacccacaccggggagaagcccuucuccugccgguggcccagcugccagaagaaguucgcgcgcuccgacgagcucguccggcaccacaacaugcaccagcgcaacaugaccaagcugcagcuggcccucuga

SEQ ID NO: 38760 - RNA, 1191 nt, Artificial Sequence
  derived and/or modified sequence opt1 from WTAP__Homo_sapiens__NP_001257460
augaccaacgaggagccccugccgaagaaggugcgccucagcgagaccgacuucaaggucauggcccgggacgagcugauccugcgcuggaagcaguacgaggccuacgugcaggcgcucgagggcaaguacacggaccugaacuccaacgacgugaccgggcugcgggagagcgaggagaagcucaagcagcagcagcaggaguccgcccgccgggagaacauccuggucaugcgccuggccaccaaggagcaggagaugcaggagugcaccacgcagauccaguaccucaagcagguccagcagcccagcguggcccagcugcgguccaccaugguggaccccgccaucaaccuguucuuccucaagaugaagggcgagcuggagcagaccaaggacaagcuggagcaggcgcagaacgagcucagcgccuggaaguucacccccgacucccagacggggaagaagcugauggccaagugccgcaugcugauccaggagaaccaggagcucggccggcagcugagccaggggcgcaucgcccagcuggaggcggagcucgcccugcagaagaaguacuccgaggagcucaagagcucccaggacgagcugaacgacuucaucauccagcuggacgaggagguggagggcaugcagagcaccauccuggugcuccagcagcagcugaaggagacccggcagcagcuggcccaguaccagcagcagcagucccaggccagcgccccguccaccagccgcacgaccgcguccgagcccgucgagcagagcgaggccaccuccaaggacugcagccggcucaccaacggccccagcaacggguccagcucccgccagcggacgagcggcuccggguuccaccgcgagggcaacaccaccgaggacgacuuccccagcuccccggggaacggcaacaagagcuccaacagcuccgaggagcggaccggccgcgggggcagcggguacgugaaccagcuguccgccggcuacgagagcguggacucccccacgggcagcgagaacucccugacccaccagagcaacgacaccgacuccagccacgacccccaggaggagaaggccgucagcgggaagggcaaccggaccguggggucccgccacgugcagaacggccucgacagcuccgucaacgugcaggggagcgugcuguga

SEQ ID NO: 38761 - RNA, 1293 nt, Artificial Sequence
  derived and/or modified sequence opt1 from WTIP__Homo_sapiens__NP_001073905
augcagcgcagccgggccggcgccgacgaggcggcccugcuccuggccgggcuggcccuccgcgagcuggagcccggcugcggguccccgggccgggggcgccggggcccccgccccggccccggggacgaggccgcgccggcccugggccggcgcgggaagggcagcgggggccccgaggccggcgccgacgggcucucccggggcgagcgcgggccccggcgcgcggccgugcccgagcugagcgcccagccggccggcagcccccgggccucccuggcgggcuccgacgggggcgggggcgggggcagcgcccgcuccagcggcaucucccucggguacgaccagcggcacggcagcccccgcuccgggcggagcgacccccgcccgggccccgggccgcccuccgucggcagcgcccgguccagcguguccagccugggcagccgcggguccgccggcgccuacgcggacuuccugccgcccggggccugccccgcccccgcccggagccccgagcccgccggccccgcgcccuucccgcuccccgcccugccccugcccccggggcgcgagggcggccccuccgccgccgagcgccggcucgaggcccugacccgcgagcuggagcgggcgcucgaggcccgcaccgcccgggacuacuucgggaucugcaucaagugcggccuggggaucuacggcgcccagcaggcgugccaggccaugggcagccuguaccacacggacugcuucacgugcgacuccugcgggcgccggcuccgcggcaaggccuucuacaacgugggggagaaggucuacugccaggaggacuuccuguacagcggcuuccagcagaccgccgacaagugcuccgugugcgggcaccugaucauggagaugauccuccaggcccugggcaagagcuaccaccccggcugcuuccggugcuccgugugcaacgagugccuggacggggucccguucaccguggacguggagaacaacaucuacugcguccgcgacuaccacaccguguucgcgcccaagugcgccagcugcgcccggcccauccuccccgcccagggcugcgagaccaccauccgcguggucuccauggaccgggacuaccacguggccugcuaccacugcgaggacugcgggcugcagcugagcggcgaggaggggcgccggugcuacccgcucgcgggccaccuccugugccgccggugccaccuccgccggcugcagcccggcccccugcccuccccgaccgugcacgucacggagcuguga

SEQ ID NO: 38762 - RNA, 3360 nt, Artificial Sequence
  derived and/or modified sequence opt1 from WWC1__Homo_sapiens__NP_001155133
augccccgccccgagcugccccuccccgagggcugggaggaggcccgggacuucgacgggaagguguacuacaucgaccacaccaaccgcaccacgagcuggaucgacccccgggaccgcuacaccaagccgcugaccuucgccgacugcaucuccgacgagcugccccucggcugggaggaggcguacgacccccaggucggggacuacuucaucgaccacaacaccaagacgacccagaucgaggacccccgggugcaguggcgccgggagcaggagcacaugcugaaggacuaccugguggucgcccaggaggcccucagcgcccagaaggagaucuaccaggugaagcagcagcgccuggagcuggcccagcaggaguaccagcagcuccacgcggugugggagcacaagcugggcucccaggucagccugguguccgggagcuccagcuccagcaaguacgacccggagauccucaaggccgagaucgccaccgccaagucccgggugaacaagcugaagcgcgagaugguccaccuccagcacgagcugcaguucaaggagcggggcuuccagacccugaagaagaucgacaagaagaugagcgacgcgcagggcuccuacaagcuggacgaggcccaggccgugcuccgcgagacgaaggccaucaagaaggccaucacgugcggggagaaggagaagcaggaccugaucaagagccuggcgaugcucaaggacggcuuccggaccgaccgcgggucccacagcgaccugugguccagcuccagcagccuggaguccagcuccuucccccuccccaagcaguaccuggacgugagcucccagaccgacaucagcggcuccuucgggaucaacagcaacaaccagcuggccgagaagguccggcuccgccugcgguacgaggaggccaagcgccggaucgccaaccugaagauccagcucgccaagcuggacuccgaggcguggcccggcgugcuggacagcgagcgcgaccggcucauccugaucaacgagaaggaggagcugcucaaggagaugcgcuucaucuccccgcgcaaguggacccagggcgagguggagcagcuggagauggcccggaagcgccuggagaaggaccuccaggccgcccgggacacccagagcaaggcccugaccgagcgccugaagcucaacuccaagcggaaccagcugguccgcgagcuggaggaggcgacccgccagguggccacgcuccacagccagcugaagucccugagcuccagcaugcagucccucagcagcggguccagccccggcucccugaccagcucccgggggagccugguggccuccagccuggacuccagcaccuccgccagcuucaccgaccucuacuacgaccccuucgagcagcuggacuccgagcugcagagcaaggucgaguuccuccugcuggagggcgccacgggcuuccggcccuccgggugcaucaccaccauccacgaggacgagguggcgaagacccagaaggccgagggcgggggccgccuccaggcccugcggagccuguccgggacgcccaagagcaugaccagccucagcccccgcuccucccugagcucccccagcccgccgugcagcccccugauggccgacccccuccuggcgggcgacgccuuccugaacucccucgaguucgaggaccccgagcuguccgccacccugugcgagcucagccugggcaacuccgcccaggagcgguaccgccuggaggagccggggaccgagggcaagcagcucgggcaggccgugaacacggcgcagggcugcgggcugaaggucgccugcgugagcgccgccguguccgacgagagcgucgccggcgacuccggcguguacgaggcgagcguccagcggcugggggccuccgaggccgccgccuucgacagcgacgaguccgaggcggugggcgccacccgcauccagaucgcccucaaguacgacgagaagaacaagcaguucgccauccugaucauccagcugagcaaccucagcgcgcugcugcagcagcaggaccagaaggugaacauccgggucgccgugcuccccugcuccgagagcacgaccugccuguuccgcacccggccccuggacgccuccgacacccucguguucaacgaggucuucugggugagcauguccuaccccgcccugcaccagaagacccugcgcguggacgucugcaccacggaccgcagccaccucgaggagugccucgggggcgcccagaucucccuggcggaggugugccggagcggggagcgcuccacccggugguacaaccugcugagcuacaaguaccugaagaagcagucccgcgagcucaagccggugggcgucauggcccccgccagcggccccgccuccaccgacgccgugagcgcgcugcuggagcagaccgccguggagcucgagaagcggcaggaggggcgcuccagcacccagacgcuggaggacuccuggcgguacgaggagaccagcgagaacgaggccgucgccgaggaggaggaggaggagguggaggaggaggagggcgaggaggacguguucaccgagaaggccuccccggacauggacggguaccccgcgcugaaggucgacaaggagaccaacacggagacccccgcccccagcccgaccguggugcgccccaaggaccggcgcgucggcacccccagccagggccccuuccuccggggguccacgaucauccgcagcaagaccuucuccccgggcccccagagccaguacgugugccggcugaaccgcuccgacagcgacuccagcacccuguccaagaagccgcccuucgugcggaacagccucgagcgccgguccguccgcaugaagcggcccagcccgccgccccagcccuccagcgugaagucccugcgcagcgagcggcugauccgcaccucccucgaccuggagcuggaccuccaggccacgcgcaccuggcacagccagcugacccaggagaucuccgugcugaaggagcucaaggagcagcuggagcaggccaagagccacggggagaaggagcugccccaguggcuccgggaggacgagcgcuuccggcugcugcuccgcaugcuggagaagcggcagauggaccgcgcggagcacaagggcgagcugcagaccgacaagaugaugcgggccgccgccaaggacguccaccgccuccgggggcagagcugcaaggagccgcccgaggugcaguccuuccgcgagaagauggccuucuucacgcggccccgcaugaacauccccgcgcugagcgccgacgacguguga

SEQ ID NO: 38763 - RNA, 3579 nt, Artificial Sequence
  derived and/or modified sequence opt1 from WWC2__Homo_sapiens__NP_079225
augccccgccgggccggcagcgggcagcugccgcucccccgcggcugggaggaggcccgggacuacgacgggaagguguucuacaucgaccacaacacccgccggaccuccuggaucgacccccgcgaccggcugacgaagccccugagcuucgcggacugcgucggcgacgagcucccgugggggugggaggccggcuucgacccccagaucggcguguacuacaucgaccacaucaacaagaccacccagaucgaggacccccgcaagcaguggcgcggggagcaggagaagaugcugaaggacuaccuguccguggcccaggacgcccuccggacccagaaggagcuguaccacgucaaggagcagcggcuggcccucgcgcuggacgaguacgugcgccugaacgacgccuacaaggagaaguccagcagccacacgucccucuucagcggcuccagcuccagcaccaaguacgaccccgacauccugaaggccgagaucuccaccacccggcugcgcgugaagaagcucaagcgggagcugagccagaugaagcaggagcugcucuacaaggagcagggguucgagacgcugcagcagaucgacaagaagauguccggcgggcagagcggcuacgagcuguccgaggccaaggcgauccucaccgagcucaagagcauccgcaaggccaucuccagcggcgagaaggagaagcaggaccugaugcagagccuggccaagcugcaggagcgguuccaccuggaccagaacaucgggcgcuccgagccggaccuccggugcagccccgucaacucccaccugugccugagccgccagacccucgacgccggcucccagaccagcaucuccggggacaucggcgugcggagccgcuccaaccuggccgagaaggugcgccugagccuccaguacgaggaggcgaagcgguccauggccaaccugaagaucgagcugagcaagcucgacuccgaggccuggcccggcgcccuggacaucgagaaggagaagcugaugcucaucaacgagaaggaggagcugcugaaggagcuccaguucgucacgccccagaagcgcacccaggacgagcuggagcggcuggaggccgagcgccagcggcucgaggaggagcugcugagcgugcgcgggaccccgucccgggcgcucgccgagcgccugcggcuggaggagcgccggaaggagcugcuccagaagcuggaggagaccacgaagcugaccaccuaccuccacagccagcugaagucccugagcgccuccacccucagcaugagcuccggcagcucccuggggagccuggccuccagccgcggcucccucaacacgagcucccgggggagccugaacucccugagcuccaccgagcucuacuacagcucccagagcgaccagaucgacguggacuaccaguacaagcuggacuuccugcuccaggagaaguccggcuacauccccagcggccccaucaccaccauccacgagaacgaggucgucaagagccccucccagccggggcagagcggccugugcgggguggccgcggccgccacgggccacaccccgccccuggccgaggcccccaaguccguggcgagccucuccagccgcuccagccuguccagccuguccccgcccgggagcccccucgugcuggagggcaccuuccccauguccagcucccacgacgccagccugcaccaguucaccgccgacuucgaggacugcgagcucuccagccacuucgccgacaucucccugaucgagaaccagauccugcucgacagcgacagcggcggggcgucccagagccuguccgaggacaaggaccugaacgagugcgcccgggagccccucuacgagggcacggccgacguggagaagucccugcccaagcgccgggucauccaccuccugggggagaagacgaccugcgugagcgccgccgugagcgacgaguccgucgcgggcgacagcgggguguacgaggccuucgugaagcagcccuccgagauggaggacgucaccuacagcgaggaggacguggccaucgucgagaccgcccaggugcagaucggccugcgcuacaacgccaaguccagcuccuucauggugaucaucgcgcagcugcggaaccuccacgccuuccugaucccccacaccagcaaggucuacuuccgcguggccgugcugccguccagcaccgacgucuccugccucuuccgcaccaaggugcacccgcccacggagagcauccuguucaacgacguguuccgggucgccaucucccagaccgcccugcagcagaagacccuccgcguggaccugugcagcgugagcaagcaccggcgcgaggagugccuggcgggcacccagaucucccucgccgaccugcccuucagcuccgaggucuucacccugugguacaaccuccugcccagcaagcagaugcccugcaagaagaacgaggagaacgaggacuccguguuccagcccaaccagccgcugguggacagcaucgaccucgacgccgucuccgcccugcuggcgcggacgagcgccgagcuccuggccguggagcaggagcuggcccaggaggaggaggaggaguccgggcaggaggagccccgcggccccgacggggacuggcucaccaugcugcgggaggccagcgacgagaucguggcggagaaggaggccgaggucaagcugcccgaggacuccagcugcaccgaggaccucuccagcugcaccuccgugccggagaugaacgaggacggcaaccgcaaggagagcaacugcgccaaggaccugcggucccagccgcccacgcgcauccccacccugguggacaaggagaccaacaccgacgaggccgccaacgacaacauggcgguccggcccaaggagcgcagcucccucagcagccggcagcaccccuucgugcgcuccagcgugaucguccggucccagacguucagccccggcgagcgcaaccaguacaucugccggcugaaccgcuccgacagcgacuccagcacccuggccaagaagucccucuucgugcggaacagcaccgagcgccggucccugcgcgugaagcgcaccgucugccagagcgugcugcggcgcacgacccaggagugccccgugcggaccucccucgaccuggagcuggaccuccaggccagccugacccgccagucccggcugaacgacgagcuccaggcccugcgcgaccugcggcagaagcucgaggagcugaaggcccagggggagacggaccugccgcccggcguccucgaggacgagcgcuuccagcggcugcugaagcaggcggagaagcaggccgagcagagcaaggaggagcagaagcaggggcucaacgccgagaagcugaugcgccagguguccaaggacgugugccggcugcgcgagcagagccagaaggucccccgccaggugcaguccuuccgggagaagaucgccuacuucacccgggcgaagaucagcauccccagccucccggccgacgacguguga

SEQ ID NO: 38764 - RNA, 906 nt, Artificial Sequence
  derived and/or modified sequence opt1 from WWOX__Homo_sapiens__NP_001278926
auggagauccugcagggccgcgacuucaccgggaagguggucguggugaccggcgccaacagcgggaucggcuucgagacggccaaguccuucgcgcuccacggggcccacgucauccuggccugccggaacauggcccgcgccagcgaggcggugucccggauccuggaggaguggcacaaggccaagguggaggccaugacccucgaccuggcccugcuccgcagcguccagcacuucgcggaggccuucaaggccaagaacgugccccugcacgugcuggucugcaacgccgccaccuucgcgcucccguggucccugaccaaggacggccuggagacgaccuuccaggugaaccaccucggccacuucuaccuggugcagcugcuccaggacguccugugccggagcgcccccgcccgcgugaucguggucuccagcgagucccaccgguucaccgacaucaacgacagccuggggaagcucgacuucucccgccugagccccaccaagaacgacuacugggccaugcuggccuacaaccgguccaagcucugcaacauccuguucagcaacgagcugcaccgccggcucagcccccgcggcgugacguccaacgcggugcacccggggaacaugauguacuccaacauccaccggagcuggugggucuacacccugcuguucacccucgcccgccccuucaccaaguccaugcagcagggcgccgccacgaccguguacugcgccgcggugcccgagcuggaggggcugggcggcauguacuucaacaacugcugccggugcaugcccagcccggaggcccagagcgaggagaccgcccgcacccucugggcccuguccgagcggcugauccaggagcgccucgggagccaguccggcuga

SEQ ID NO: 38765 - RNA, 2769 nt, Artificial Sequence
  derived and/or modified sequence opt1 from WWP1__Homo_sapiens__XP_005250817
auggccaccgccagcccccgcuccgacaccagcaacaaccacuccggccggcugcagcuccaggugaccgucagcuccgcgaagcugaagcgcaagaagaacugguucgggaccgccaucuacaccgaggugguggucgacggcgagaucaccaagacggccaagagcuccagcuccagcaacccgaagugggacgagcagcugaccgugaacgugacgccccagaccacccucgaguuccaggucuggucccaccggacccugaaggccgacgcccugcucgggaaggcgaccaucgaccugaagcaggcccugcucauccacaaccgcaagcuggagcgggugaaggagcagcugaagcucagccuggagaacaagaacggcaucgcccagaccggggagcugacggugguccucgacggccuggugaucgagcaggagaacaucaccaacugcuccagcucccccaccaucgagauccaggagaacggcgacgcccugcacgagaacggggagcccagcgcgcgcaccacggcccggcucgccguggagggcaccaacgggaucgacaaccacgucccgaccuccacccuggugcagaacagcugcugcuccuacguggucaacggcgacaacacgcccagcagccccucccagguggccgcccgccccaagaacaccccggcgcccaagccccuggccagcgagcccgccgacgacaccgugaacggggaguccagcuccuucgccccgaccgacaacgccagcgucacgggcacccccgugguguccgaggagaacgcgcucagccccaacugcaccuccaccacggucgaggacccgcccgugcaggagauccugaccagcuccgagaacaacgagugcauccccagcaccuccgccgagcuggagagcgaggcccgguccauccucgagcccgacaccagcaacucccgcagcuccagcgccuucgaggccgccaagagccggcagcccgacggcugcauggacccggugcgccagcaguccgggaacgcgaacacggagacccugcccagcggcugggagcagcggaaggacccccacgggcgcaccuacuacgucgaccacaacacccggacgaccaccugggagcgcccccagccgcugccgcccggcugggagcggcgcguggacgaccggcgccgggucuacuacguggaccacaacacccgcaccacgaccuggcagcgccccaccauggaguccgugcggaacuucgagcaguggcagagccagcgcaaccagcuccagggcgccaugcagcaguucaaccagcgguaccuguacuccgccagcaugcuggccgcggagaacgaccccuacgggccccugcccccgggcugggagaagcgcgucgacuccaccgaccggguguacuucgugaaccacaacacgaagaccacccagugggaggacccccgcacccaggggcugcagaacgaggagccccugcccgagggcugggagauccgguacacgcgcgaggggguccgguacuucguggaccacaacacccgcaccaccacguucaaggacccgcggaacggcaagagcuccgugaccaagggcgggccccagaucgccuacgagcgcggcuuccgguggaagcucgcccacuuccgcuaccugugccagagcaacgcccugcccucccacgucaagaucaacgugagccggcagacccucuucgaggacuccuuccagcagaucauggcgcugaagcccuacgaccugcgccggcgccucuacgugaucuuccggggcgaggagggccuggacuacgggggccuggcccgcgagugguucuuccuccugagccacgagguccugaacccgauguacugccucuucgaguacgccggcaagaacaacuacugccugcagaucaaccccgccuccaccaucaaccccgaccaccugagcuacuucugcuucaucgggcgcuucaucgccauggcgcuguuccacggcaaguucaucgacacgggguucucccugcccuucuacaagcggaugcugagcaagaagcugaccaucaaggaccucgagagcaucgacaccgaguucuacaacucccugaucuggauccgcgacaacaacaucgaggagugcggccuggagauguacuucagcguggacauggagauccucgggaaggugaccucccacgaccugaagcugggcggcagcaacauccucgucacggaggagaacaaggacgaguacaucgggcugaugaccgaguggcgguucucccgcggcgugcaggagcagaccaaggccuuccuggacggguucaacgagguggucccgcuccaguggcugcaguacuucgacgagaaggagcuggaggugaugcucugcggcaugcaggagguggaccuggccgacuggcagcggaacaccgucuaccgccacuacacgcggaacagcaagcagaucaucugguucuggcaguucgugaaggagaccgacaacgaggugcgcaugcggcugcuccaguucgucaccgggaccugccgccugccccucgggggcuucgccgagcucaugggguccaacggcccccagaaguucugcaucgagaagguggggaaggacacguggcugccccggagccacacgugcuucaaccgccuggaccucccgcccuacaaguccuacgagcagcugaaggagaagcuccucuucgccaucgaggagaccgagggcuucggccaggaguga

SEQ ID NO: 38766 - RNA, 1008 nt, Artificial Sequence
  derived and/or modified sequence opt1 from WWP2__Homo_sapiens__NP_001257384
auggccagcgccuccagcucccgcgcgggcguggcccugcccuucgagaagucccagcucacccugaaggucguguccgccaagcccaaggugcacaaccggcagccccgcaucaacagcuacgucgagguggccguggacgggcugcccuccgagaccaagaagacgggcaagcggaucgggagcuccgagcuccuguggaacgagaucaucauccugaacgucaccgcccagagccaccucgaccugaaggugugguccugccacacccugcgcaacgagcuccugggcaccgcgagcgugaaccuguccaacguccucaagaacaacgggggcaagauggagaacaugcagcugacgcugaaccuccagaccgagaacaagggcagcgugguguccgggggcgagcugaccaucuuccuggacgggcccaccgucgaccucggcaacgugccgaacgggagcgcccugacggacggcucccagcugcccagccgggacuccagcggcaccgccguggcccccgagaaccgccaccagcccccgagcaccaacugcuucgggggccggucccgcacccaccggcacagcggggcguccgcccgcacgacccccgccaccggcgagcagagccccggcgcccggucccgccaccggcagcccgucaagaacagcgggcacuccggccucgccaacgggaccgugaacgacgagccgacgaccgcgaccgaccccgaggagcccagcguggucggcgugaccagcccgcccgccgcgccccugagcgugacgcccaaccccaacaccaccucccugccggcccccgccacccccgccgagggggaggagcccagcacguccggcacccagcagcucccggccgccgcccaggcccccgacgcgcugcccgccggcugggagcagcgcgagcugcccaacgggcgggucuacuacguggaccacaacaccaagaccacgaccugggagcgcccgcucccgcccggcuga

SEQ ID NO: 38767 - RNA, 1203 nt, Artificial Sequence
  derived and/or modified sequence opt1 from WWTR1__Homo_sapiens__NP_001161750
augaaccccgccagcgccccgccgccccugcccccgcccggccagcaggucauccacgugacccaggaccucgacaccgaccuggaggcgcuguucaacuccgugaugaaccccaagcccagcuccuggcgcaagaagauccucccggagagcuucuucaaggagcccgacuccgggagccacucccggcagagcuccacggacagcuccggcgggcaccccggcccccgccuggccgggggcgcccagcacgugcggagccacuccagcccggccucccugcagcucggcaccggggccggcgcggccgggagccccgcccagcagcacgcccaccuccgccagcaguccuacgacgucaccgacgagcugccccugccgcccggcugggagaugaccuucacggcgaccgggcagcgguacuuccugaaccacaucgagaagaucaccaccuggcaggacccccgcaaggccaugaaccagccccugaaccacaugaaccuccaccccgccgugagcuccacgcccgugccccagcggagcauggccgucagccagcccaaccuggugaugaaccaccagcaccagcagcagauggcccccuccacccugagccagcagaaccacccgacccagaacccgcccgcgggccucauguccaugcccaacgcccugaccacgcagcagcagcagcagcagaagcugcgccuccagcggauccagauggagcgcgagcggauccgcaugcggcaggaggagcugaugcgccaggaggccgcccugugccggcagcuccccauggaggccgagacccuggcgcccgugcaggccgccgucaacccgcccaccaugacccccgacaugcgcagcaucacgaacaacuccagcgaccccuuccugaacggcgggcccuaccacucccgggagcagagcaccgacuccggccucgggcugggcugcuacagcgugccgaccacccccgaggacuuccuguccaacguggacgagauggacacgggcgagaacgccgggcagacccccaugaacaucaacccccagcagacccgcuucccggacuuccucgacugccugcccggcaccaacgucgaccuggggacgcucgagagcgaggaccugaucccccuguucaacgacguggaguccgcccucaacaagagcgagcccuuccugaccuggcuguga

SEQ ID NO: 38768 - RNA, 2568 nt, Artificial Sequence
  derived and/or modified sequence opt1 from XAB2__Homo_sapiens__NP_064581
augguggucauggcccgccugagccggcccgagcgcccggaccucguguucgaggaggaggaccugcccuacgaggaggagaucaugcggaaccaguucuccgugaagugcuggcugcgcuacaucgaguucaagcagggcgcccccaagccccggcucaaccagcuguacgagcgcgcgcugaagcuccugccgugcagcuacaagcugugguaccgguaccucaaggcccgccgggcccaggucaagcaccgcugcgugaccgaccccgccuacgaggacgugaacaacugccacgagcgggccuucgucuucaugcacaagaugccccgccuguggcuggacuacugccaguuccucauggaccaggggcgggugacccacacgcgccggaccuucgaccgcgcgcugcgggcccugcccaucacccagcacucccgcaucuggccgcucuaccugcgguuccugcgcagccacccccuccccgagaccgccgugcggggcuaccgccgcuuccugaagcugucccccgagagcgccgaggaguacaucgaguaccucaaguccagcgaccggcuggacgaggcggcccagcgccuggccacggucgugaacgacgagcgguucguguccaaggccgggaaguccaacuaccagcucuggcacgagcugugcgaccugaucagccagaacccggacaagguccagagccucaacguggacgccaucauccgcggcgggcugacccgguucaccgaccagcugggcaagcucuggugcucccuggcggacuacuacauccgcagcggccacuucgagaaggcccgggacguguacgaggaggccauccgcaccgucaugacggugcgggacuucacccagguguucgacuccuacgcccaguucgaggagagcaugaucgccgcgaagauggagaccgccuccgagcuggggcgcgaggaggaggacgacgucgaccucgagcugcggcuggcccgcuucgagcagcucaucagccggcgcccccugcugcucaacuccgugcugcugcggcagaacccccaccacgugcacgaguggcacaagcgcgucgcccuccaccagggccggccccgcgagaucaucaacaccuacacggaggccgugcagaccguggacccguucaaggcgaccgggaagccccacacccugugggucgccuucgccaaguucuacgaggacaacggccagcuggacgacgcccgggugauccucgagaaggccacgaaggucaacuucaagcaggucgacgaccuggcgagcguguggugccagugcggggagcuggagcuccgccacgagaacuacgacgaggcccugcgccugcugcggaaggccaccgcccuccccgcgcgccgggccgaguacuucgacggcagcgagcccgugcagaaccgcguguacaagucccugaagguguggagcaugcuggccgaccucgaggagucccugggcaccuuccagagcaccaaggccgucuacgaccggauccuggaccuccgcaucgccacgccgcagaucgugaucaacuacgcgauguuccuggaggagcacaaguacuucgaggaguccuucaaggccuacgagcgggggaucagccuguucaaguggcccaacguguccgacaucuggagcaccuaccucaccaaguucaucgcccgcuacggcgggcggaagcuggagcgcgcccgggaccuguucgagcaggcccucgacggcugcccgcccaaguacgcgaagacccuguaccugcucuacgcccagcuggaggaggaguggggccuggcccgccacgccauggccgucuacgagcgggcgacgcgcgccguggagcccgcccagcaguacgacauguucaacaucuacaucaagcgggccgcggagaucuacggggugacccacacccgcggcaucuaccagaaggccaucgagguccucuccgacgagcacgcccgggagaugugccugcgcuucgccgacauggagugcaagcugggggagaucgaccgggcccgcgcgaucuacagcuucugcucccagaucugcgacccccggaccacgggcgccuucuggcagaccuggaaggacuucgaggugcgccacgggaacgaggacaccaucaaggagaugcuccgcauccggcgcagcgugcaggccaccuacaacacgcaggucaacuucauggccucccagaugcugaaggugagcggcuccgccaccggcaccgugagcgaccuggcgcccgggcaguccggcauggacgacaugaagcuccuggagcagcgggccgagcagcuggccgccgaggccgagcgcgaccagccccuccgggcgcagagcaagauccuguucguccgcuccgacgccagccgggaggagcuggccgagcucgcccagcaggucaacccggaggagauccagcugggggaggacgaggacgaggacgagauggaccuggagcccaacgaggugcgccucgagcagcagagcgugcccgcggccguguucggcucccugaaggaggacuga

SEQ ID NO: 38769 - RNA, 906 nt, Artificial Sequence
  derived and/or modified sequence opt1 from XAF1__Homo_sapiens__NP_059993
auggagggcgacuucagcgugugccgcaacugcaagcggcacgucguguccgccaacuucacccugcacgaggccuacugccuccgcuuccuggugcugugccccgagugcgaggagccgguccccaaggagaccauggaggagcacugcaagcucgagcaccagcaggucgggugcacgaugugccagcagagcaugcagaaguccagccuggaguuccacaaggcgaacgagugccaggagcggcccguggagugcaaguucugcaagcuggacaugcagcucuccaagcuggagcugcacgagagcuacugcggcucccgcaccgagcucugccaggggugcggccaguucaucaugcaccggaugcuggcccagcaccgcgacgugugccggagcgagcaggcccagcuggggaagggcgagcgcaucuccgcccccgagcgggagaucuacugccacuacugcaaccagaugaucccggagaacaaguacuuccaccacaugggcaagugcugccccgacagcgaguucaagaagcacuuccccguggggaaccccgagauccucccguccagccugcccucccaggccgcggagaaccagaccagcaccauggagaaggacgugcgccccaagacgcgguccaucaaccgcuucccccugcacagcgaguccagcuccaagaaggccccgcggagcaagaacaagacccucgacccccugcugaugagcgagcccaagccccgcaccuccagcccgcggggcgacaaggccgccuacgacauccuccgccggugcucccagugcgggauccugcugccccuccccauccugaaccagcaccaggagaagugccgcuggcuggcgagcuccaagggcaagcagguccggaacuucagcuga

SEQ ID NO: 38770 - RNA, 210 nt, Artificial Sequence
  derived and/or modified sequence opt1 from XAGE1B__Homo_sapiens__NP_001091065
auggagagccccaagaagaagaaccagcagcugaaggugggcauccuccaccuggggucccgccagaagaagauccggauccagcugcgcagccagguccucggccgggagaugcgcgacauggagggggaccugcaggagcugcaccaguccaacaccggcgacaagagcggguucggcuuccggcgccagggcgaggacaacaccuga

SEQ ID NO: 38771 - RNA, 246 nt, Artificial Sequence
  derived and/or modified sequence opt1 from XAGE1E__Homo_sapiens__NP_001091073
auggagagccccaagaagaagaaccagcagcugaaggugggcauccuccaccuggggucccgccagaagaagauccggauccagcugcgcagccagugcgccaccuggaaggucaucugcaaguccugcaucagccagaccccgggcaucaaccucgaccugggguccggcgugaaggugaagaucauccccaaggaggagcacugcaagaugcccgaggccggggaggagcagccccaggucuga

SEQ ID NO: 38772 - RNA, 1131 nt, Artificial Sequence
  derived and/or modified sequence opt1 from XBP1__Homo_sapiens__NP_001073007
augguggucguggccgccgcgcccaacccggccgacggcacccccaaggugcugcuccugagcgggcagcccgccuccgccgccggcgcgcccgccgggcaggcccugccgcucaugguccccgcccagcgcggcgcgagccccgaggccgccuccgggggccugccccaggcccggaagcgccagcggcugacccaccucagcccggaggagaaggcccugcgccggaagcugaagaaccgcguggcggcccagacggcccgggaccgcaagaaggcccggauguccgagcucgagcagcaggucguggaccuggaggaggagaaccagaagcugcuccuggagaaccagcugcuccgcgagaagacccacggccuggugguggagaaccaggagcugcggcagcgccucgggauggacgcccuggucgcggaggaggaggccgaggccaagggcaacgaggugcggcccguggccgggagcgccgaguccgcggccggcgccgggcccgucgugacgcccccggagcaccuccccauggacagcggcggcaucgacuccagcgacuccgagagcgacauccugcuggggauccuggacaaccucgaccccgugauguucuucaagugccccuccccggagcccgccagccuggaggagcugcccgaggucuaccccgagggcccguccagccuccccgccucccugagccuguccguggggaccagcagcgcgaagcucgaggccaucaacgagcugauccgcuucgaccacaucuacaccaagccccuggugcucgagauccccuccgagaccgagagccaggccaacgucguggugaagaucgaggaggccccgcugucccccagcgagaacgaccaccccgaguucaucgucuccgugaaggaggagcccguggaggacgaccuggucccggagcucggcaucagcaaccugcuguccagcucccacugccccaagcccagcuccugccuccuggacgcguacagcgacugcggcuacgggggcucccugagcccguucuccgacaugagcucccuccugggggugaaccacagcugggaggacaccuucgccaacgagcuguucccccagcucaucuccgucuga

SEQ ID NO: 38773 - RNA, 345 nt, Artificial Sequence
  derived and/or modified sequence opt1 from XCL1__Homo_sapiens__XP_011508167
augcgccugcucauccuggcccugcucggcaucugcagccugaccgccuacaucguggagggggucggcuccgaggugagcgacaagcggaccugcgugucccugacgacccagcgccuccccgucagccggaucaagaccuacaccaucacggaggggucccugcgcgcggugaucuucaucaccaagcggggccugaaggugugcgccgacccgcaggccaccuggguccgcgacguggugcggagcauggaccgcaaguccaacacccggaacaacaugauccagacgaagcccaccgggacccagcagagcaccaacacggccgucacccucaccggcuga

SEQ ID NO: 38774 - RNA, 345 nt, Artificial Sequence
  derived and/or modified sequence opt1 from XCL2__Homo_sapiens__NP_003166
augcgccugcucauccuggcccugcucggcaucugcagccugaccgccuacaucguggagggggucggcuccgaggugagccaccggcggaccugcgugucccugacgacccagcgccuccccgucagccgcaucaagaccuacaccaucacggaggggucccugcgggcggugaucuucaucaccaagcgcggccugaaggugugcgccgacccgcaggccaccuggguccgggacguggugcgcagcauggaccggaaguccaacacccgcaacaacaugauccagacgaagcccaccgggacccagcagagcaccaacacggccgucacccucaccggcuga

SEQ ID NO: 38775 - RNA, 1002 nt, Artificial Sequence
  derived and/or modified sequence opt1 from XCR1__Homo_sapiens__NP_001019815
auggagagcuccggcaaccccgagagcaccaccuucuucuacuacgaccugcagucccagccgugcgagaaccaggccuggguguucgccacgcucgcgaccaccguccuguacugccugguguuccuccugagccugguggggaacucccucguccugugggugcuggugaaguacgagagccucgagucccugaccaacaucuucauccugaaccucugccugagcgaccuggucuucgccugccuccugcccguguggaucucccccuaccacuggggcugggugcugggggacuuccucugcaagcugcugaacaugaucuucagcaucucccucuacagcuccaucuucuuccugacgaucaugaccauccaccgcuaccugagcgucgugagcccccucuccacccugcgggugccgacccugcgcugccggguccucgugacgauggccgugugggucgccuccauccugagcuccauccuggacaccaucuuccacaaggugcucagcagcggcugcgacuacuccgagcugaccugguaccugaccagcguguaccagcacaaccucuucuuccugcugucccucgggaucauccuguucugcuacgucgagauccugcgcacccucuuccggagccgcuccaagcggcgccaccggacggugaagcugaucuucgccaucguggucgcguacuuccugagcuggggccccuacaacuucacccucuuccugcagacccuguuccgcacgcagaucauccgguccugcgaggccaagcagcagcucgaguacgcccugcugaucugccgcaaccucgccuucagccacugcugcuucaaccccgugcuguacguguucgucggcgugaaguuccggacccaccugaagcacguccugcgccaguucugguucugccggcuccaggcgcccuccccggccagcaucccccacucccccggggccuucgccuacgagggcgccagcuucuacuga

SEQ ID NO: 38776 - RNA, 4002 nt, Artificial Sequence
  derived and/or modified sequence opt1 from XDH__Homo_sapiens__NP_000370
augaccgccgacaagcugguguucuucgucaacggccgcaaggugguggagaagaacgccgaccccgagaccacgcuccuggcguaccugcggcgcaagcucgggcugagcggcaccaagcuggggugcggcgagggcgggugcggcgccugcaccgucaugcucuccaaguacgaccggcugcagaacaagaucgugcacuucagcgccaacgccugccuggccccgaucugcucccuccaccacguggcggucaccacgguggaggggaucggcagcaccaagacccgccugcaccccgugcaggagcggaucgccaagucccacgggagccagugcggcuucugcacccccgggaucgucauguccauguacacgcugcuccgcaaccagcccgagccgaccauggaggagaucgagaacgccuuccagggcaaccugugccggugcaccggcuaccgccccauccugcagggguuccggaccuucgcccgcgacggcgggugcugcggcggcgacgggaacaaccccaacugcugcaugaaccagaagaaggaccacagcgugucccucagccccucccuguucaagccggaggaguucacgccccuggaccccacccaggagcccaucuucccgcccgagcuccugcggcugaaggacacgccccgcaagcagcuccgguucgagggcgagcgcgugaccuggauccaggcgagcacccugaaggagcugcucgaccugaaggcccagcaccccgacgccaagcuggucguggggaacaccgagaucggcaucgagaugaaguucaagaacaugcuguucccgaugaucgugugccccgccuggauccccgagcugaacuccgucgagcacgggcccgacggcaucagcuucggcgccgcgugcccgcuguccaucguggagaagacccucguggacgccgucgccaagcugcccgcccagaagaccgagguguuccgcggggugcuggagcagcuccggugguucgccggcaagcaggucaagagcguggcguccgucgggggcaacaucaucacggccagccccaucuccgaccugaaccccguguucauggccagcggggccaagcugacccucgugagccggggcacccgccggaccguccagauggaccacacguucuucccgggcuaccgcaagacccugcugucccccgaggagauccuccugagcaucgagauccccuacucccgggagggggaguacuucagcgccuucaagcaggcgucccgccgcgaggacgacaucgccaaggugaccagcggcaugcgggugcuguucaagcccgggaccacggagguccaggagcucgcccugugcuacggcgggauggccaaccgcaccaucuccgcccugaagaccacccagcggcagcucagcaagcuguggaaggaggagcugcuccaggacgugugcgcgggccuggccgaggagcugcaccucccgcccgacgcccccggcgggaugguggacuuccgcugcacgcucacccuguccuucuucuucaaguucuaccugaccguccuccagaagcugggccaggagaaccuggaggacaagugcgggaagcucgacccgaccuucgccagcgcgacgcugcuguuccagaaggacccgcccgccgacgugcagcuguuccaggaggugcccaagggccaguccgaggaggacauggucggccggccccucccccaccuggccgccgacaugcaggccagcggggaggcgguguacugcgacgacaucccccgcuacgagaacgagcucucccugcggcuggugaccagcacccgcgcccacgccaagaucaaguccaucgacaccagcgaggccaagaagguccccggcuucgugugcuucaucuccgccgacgacgugccggggagcaacaucaccggcaucugcaacgacgagacggucuucgcgaaggacaaggugaccugcguggggcacaucaucggcgccgucguggccgacacccccgagcacacccagcgggccgcccagggcgugaagaucacguacgaggagcuccccgcgaucaucaccaucgaggacgccaucaagaacaacuccuucuacgggcccgagcugaagaucgagaagggcgaccugaagaagggguucagcgaggccgacaacgucgugagcggcgagaucuacaucgggggccaggagcacuucuaccucgagacccacugcaccaucgccgugccgaagggcgaggcgggggagauggagcuguucgucuccacgcagaacaccaugaagacccagagcuucguggccaagaugcugggcgugcccgccaaccgcaucgucgugcgggugaagcgcaugggcggcggguucgggggcaaggagacccgguccacggucgugagcaccgccguggcccucgcggccuacaagaccgggcgccccguccggugcaugcuggaccgcgacgaggacaugcugaucaccggcgggcggcaccccuuccucgcccgcuacaaggugggcuucaugaagacggggaccguggucgcccuggagguggaccacuucuccaacgugggcaacacccaggaccugagccaguccaucauggagcgggcccucuuccacauggacaacugcuacaagaucccgaacauccgcggcaccgggcgccugugcaagacgaaccugcccagcaacaccgcguuccggggcuucgggggcccccagggcaugcucaucgccgagugcuggauguccgaggucgccgugaccugcgggaugcccgccgaggaggugcgccggaagaaccuguacaaggagggcgaccugacccacuucaaccagaagcucgagggguucacgcugccgcgcugcugggaggagugccuggccagcucccaguaccacgcgcgcaagagcgaggucgacaaguucaacaaggagaacugcuggaagaagcggggccucugcaucauccccaccaaguucgggaucuccuucaccgugcccuuccugaaccaggccggcgcccugcuccacguguacaccgacggcagcguccugcugacgcacgggggcaccgagauggggcagggccuccacaccaagaugguccagguggccucccgggcgcugaagauccccaccagcaagaucuacaucuccgagacgagcaccaacaccgugccgaacaccagccccacggccgccuccgugagcgccgaccugaacgggcaggccguguacgcggccugccagaccauccucaagcgccuggagcccuacaagaagaagaacccguccggcagcugggaggacugggucaccgccgccuacauggacaccgugucccugagcgccaccggcuucuaccggacgcccaaccucggguacuccuucgagaccaacagcggcaaccccuuccacuacuucuccuacggggucgcgugcagcgagguggagaucgacugccugaccggcgaccacaagaaccugcgcaccgacaucgugauggacgucggguccagccucaaccccgccaucgacaucggccagguggagggcgccuucgugcaggggcugggccuguucacgcucgaggagcugcacuacuccccggaggggagccugcacacccggggccccuccaccuacaagauccccgccuucggcagcauccccaucgaguuccgcgucucccuccugcgggacugcccgaacaagaaggccaucuacgcgagcaaggccgugggggagccgccccuguuccucgccgccuccaucuucuucgccaucaaggacgcgauccgcgccgcccgggcccagcacaccggcaacaacgugaaggagcuguuccgccuggacagccccgcgacgcccgagaagauccggaacgccugcgucgacaaguucaccacccucugcgugaccggggugcccgagaacugcaagcccuggagcguccgcguguga

SEQ ID NO: 38777 - RNA, 588 nt, Artificial Sequence
  derived and/or modified sequence opt1 from XG__Homo_sapiens__NP_001135391
auggagagcugguggggccugcccugccucgccuuccugugcuuccugaugcacgcccgcgggcagcgggacuucgaccucgcggacgcccuggacgacccggagcccaccaagaagcccaacuccgacaucuaccccaagccgaagccgcccuacuacccccagcccgagaaccccgacagcggcgggaacaucuacccccgccccaagccgcggccccagccccagcccggcaacuccgggaacagcggcggcuacuucaacgacguggaccgcgacgacgggcgguacccgccccgcccccggccccgcccgcccgccggcgggggcgggggcggcuacuccagcuacgggaacuccgacaacacccacggccgcgggggcuaccggcugaacagccgguacggcaacacguacgggggcgaccaccacuccaccuacgggaaccccgagggcaacauggucgccaagaucgugagccccaucguguccgucgugguggucacccuccugggggccgcggccagcuacuucaagcugaacaaccgccggaacugcuuccgcacccacgagccggagaacguguga

SEQ ID NO: 38778 - RNA, 1494 nt, Artificial Sequence
  derived and/or modified sequence opt1 from XIAP__Homo_sapiens__XP_011529631
augaccuucaacagcuucgagggcuccaagaccugcgugcccgccgacaucaacaaggaggaggaguucgucgaggaguucaaccgccugaagacguucgccaacuucccgagcgggucccccgugagcgcguccacccucgcccgggccggcuuccuguacaccggggagggcgacaccgugcgcugcuucagcugccacgccgccgucgaccgguggcaguacggggacuccgcggugggccgccaccggaaggugagccccaacugccgcuucaucaacggcuucuaccuggagaacuccgccacgcagagcaccaacuccgggauccagaacggccaguacaaggucgagaacuaccucgggagccgggaccacuucgcccuggaccgccccuccgagacccacgccgacuaccugcuccggaccggccaggugguggacaucagcgacacgaucuacccgcgcaaccccgcgauguacuccgaggaggcccggcucaagagcuuccagaacuggcccgacuacgcccaccugacgccccgcgagcuggccuccgccgggcuguacuacaccggcaucggcgaccagguccagugcuucugcugcgggggcaagcugaagaacugggagccgugcgaccgggcguggagcgagcaccgccggcacuuccccaacugcuucuucgugcucgggcgcaaccugaacauccgguccgagagcgacgccgugagcuccgaccgcaacuuccccaacagcaccaaccugccccggaacccguccauggccgacuacgaggcccgcaucuucaccuucggcaccuggaucuacagcgucaacaaggagcagcucgcccgggcgggcuucuacgcccugggggagggcgacaaggugaagugcuuccacugcgggggcgggcugaccgacuggaagcccuccgaggaccccugggagcagcacgccaagugguaccccggcugcaaguaccuccuggagcagaagggccaggaguacaucaacaacauccaccugacccacagccucgaggagugccuggugcgcacgaccgagaagaccccgucccugacccgccggaucgacgacacgaucuuccagaaccccaugguccaggaggccauccgcaugggguucagcuucaaggacaucaagaagaucauggaggagaagauccagaucuccggcagcaacuacaagucccucgaggugcugguggccgaccuggucaacgcgcagaaggacagcaugcaggacgaguccagccagaccucccuccagaaggagaucagcaccgaggagcagcugcggcgccugcaggaggagaagcucugcaagaucugcauggaccggaacaucgccaucguguucgugcccugcgggcaccuggugaccugcaagcagugcgccgaggccgucgacaagugccccaugugcuacacggugaucaccuucaagcagaagaucuucauguccuga

SEQ ID NO: 38779 - RNA, 3366 nt, Artificial Sequence
  derived and/or modified sequence opt1 from XIRP1__Homo_sapiens__NP_001185550
auggccgacacccagacccagguggcccccacgccgaccaugcgcauggcgaccgccgaggaccugccccucccccccccgcccgcccuggaggaccugccccuccccccgcccaaggagagcuucuccaaguuccaccagcagcggcaggccagcgagcugcgccggcuguaccgccacauccaccccgagcuccggaagaaccuggccgaggcggucgccgaggaccuggccgaggugcucggcuccgaggagcccaccgagggggacgugcagugcaugcgcuggaucuucgagaacuggcggcuggacgccaucggcgagcacgagcgcccggcggccaaggagcccguccugugcggggacgugcaggccacgagccggaaguucgaggagggcuccuucgccaacagcaccgaccaggagcccacccgcccccagccggggggcggcgacgugcgggccgcgcgcuggcucuucgagaccaagccccuggacgagcugacggggcaggccaaggagcucgaggccaccguccgggagcccgccgccuccggcgacgugcaggggacccgcaugcuguucgagacccggccccuggaccgccucggcagccggccgucccugcaggagcagagcccccuggagcuccgcuccgagauccaggagcugaagggggacgugaagaagacggucaagcuguuccagaccgagccccucugcgcgauccaggacgccgagggcgccauccacgaggugaaggccgccugccgggaggagauccagagcaacgcggugcgcuccgcccgguggcuguucgagacccgcccccuggacgccaucaaccaggacccgagccagguccgcgugauccggggcaucucccucgaggagggggcccgccccgacgugagcgccacccgguggaucuucgagacgcagccccuggacgcgauccgcgagauccuggucgacgagaaggacuuccagcccuccccggaccucaucccccccggcccggacgugcagcagcagcagcaccuguucgagacccgggcccuggacacccucaagggggacgaggaggccggcgccgaggcgccccccaaggaggaggugguccccggcgacgugcgcagcacccuguggcuguucgagacgaagccgcucgacgccuuccgggacaaggugcaggucgggcaccugcagcgcguggacccccaggacggcgaggggcaccuguccagcgacagcuccagcgcccuccccuucucccagagcgccccccagcgggacgagcugaagggcgacgugaagaccuucaagaaccuguucgagacccucccgcuggacuccaucgggcagggcgagguccuggcccacggcagccccucccgcgaggaggggaccgacagcgcgggccaggcccaggggaucggcucccccguguacgccaugcaggacagcaaggggcggcuccacgcccugacguccgucagccgcgagcagaucgugggcggcgacgugcagggguaccgguggauguucgagacccagccccuggaccagcucggccgcuccccgagcaccaucgacgucgugcgggggaucacccgccaggagguggucgccggcgacguggggacggcgcgguggcuguucgagacccagccccuggagaugauccaccagcgcgagcagcaggagcggcagaaggaggagggcaagucccagggcgacccccagcccgaggccccgcccaagggggacgugcagaccauccgcuggcuguucgagaccugccccaugagcgagcucgccgagaagcagggcuccgaggucacggaccccaccgccaaggccgaggcgcagagcugcaccuggauguucaagccgcagcccguggaccgccccguggggucccgggagcagcaccugcaggucagccaggugcccgccggcgagcgccagaccgaccggcacguguucgagacggagccgcugcaggccagcggccgccccugcgggcggcgccccguccgguacugcucccgcguggagaucccgagcggccaggugucccggcagaaggaggucuuccaggcccucgaggcggggaagaaggaggagcaggagccccgcgugaucgccggcagcauccccgccggguccgugcacaaguucaccuggcuguucgagaacugccccaugggcagccuggccgccgaguccauccagggcgggaaccuccuggaggagcagccgaugagccccuccggcaaccggaugcaggagagccaggagaccgcggccgaggggacccugcgcacccuccacgccacgcccggcauccugcaccacgggggcauccugauggaggcccggggccccggggagcucugccuggccaaguacguccuguccggcaccgggcagggccacccguacauccgcaaggaggagcucgugagcggggagcugccccggaucaucugccaggugcugcgccggcccgacgucgaccagcagggccuccuggugcaggaggaccccaccggccagcugcagcucaagccgcugcgccugcccacccccggguccagcggcaacaucgaggacauggaccccgagcuccagcagcugcuggcgugcgggcucggcacguccguggcccggaccgggcuggucaugcaggagaccgagcagggccugguggcccucaccgccuacagccugcagccgcgccugacguccaaggccagcgagcggagcuccgugcagcuccuggcgagcugcaucgacaagggcgaccuguccgggcuccacagccugcgcugggagccccccgccgaccccuccccgguccccgccagcgagggcgcccagucccugcaccccaccgagagcaucauccacgugcccccgcucgaccccuccauggggaugggccaccugcgcgcgagcggcgccacccccugccccccgcaggccaucgggaaggccgugccccuggccggcgaggcggccgcccccgcccagcuccagaacaccgagaagcaggaggacucccacagcgggcagaagggcauggccguccuggggaaguccgagggcgcgacgaccaccccgcccggccccggggcccccgaccugcucgccgccaugcagagccugcggauggccaccgcggaggcccagucccugcaccagcaggugcucaacaagcacaagcagggcccgacgcccaccgccaccagcaaccccauccaggacgggcugcgcaaggccggcgccacccaguccaacauccggcccgggggcggcagcgacccgcgcauccccgcggccccccggaagcugcucuga

SEQ ID NO: 38780 - RNA, 2817 nt, Artificial Sequence
  derived and/or modified sequence opt1 from XIRP2__Homo_sapiens__NP_001073278
auguuccccaugcagaagggcagccugaaccuccugcgccagaagugggaguccugcgacuaccagcggagcgagugccacccgcgcgacucccacugcaccaucuuccagccccaggagagcaagcugcucgcccccgagggggagguggucuccgcgccccagagccuggacccgaccucccugcccuacagcacgggcgaggagaugugguccagcaagcccgaggagaaggacuccguggacaagagcaacaacacccgggaguacgggcgccccgaggugcucaaggaggacucccugagcucccggcgccggaucgagcgcuucagcaucgcccuggacgagcuccgguccgucuucgaggcccccaagagcggcaacaagcccgccgaguacgggggcaaggagguggagaucgagcgcucccugugcagccccgccuucaagagccaccccggcucccagcuggaggacagcgugaaggacuccgacaagaaggggaaggagaccagcuucgacaagauguccccggagagcggccacucccggaucuucgaggccaccgcggggcccaacaagcccgagagcggcuucgccgaggacuccgccgcccgcggggagggcgucagcgaccuccacgagguggugucccugaaggagcggauggcgcgcuaccaggccgccgucagccggggcgacugccgcuccuucagcgccaacaugauggaggaguccgagaugugcgccgugcccgggggccuggcgaaggugaagaagcaguucgaggacgagaucacgagcucccggaacaccuucgcccaguaccaguaccagcaccagaaccgcagcgagcaggaggccauccacuccagccaggucgggaccagccgguccagccaggagauggcccgcaacgagcaggagggcuccaaggugcagaagaucgacgugcacggcaccgagauggucagccaccucgagaagcacacggaggaggugaaccaggccucccaguuccaccaguacgugcaggagaccgucaucgacaccccggaggacgaggagauccccaaggugagcaccaagcugcugaaggagcaguucgagaaguccgcgcaggagaagauccucuacagcgacaaggagaugacgacccccgccaagcagaucaagaagcugcugcuccaggacaaggagaucugcauccugugccagaagaccguguaccccauggagugccuggucgccgacaagcagaacuuccacaaguccugcuuccggugccaccacugcaacagcaagcucucccuggggaacuacgccagccugcacggccagaucuacugcaagccgcacuucaagcagcuguucaaguccaaggggaacuacgacgagggcuucgggcacaagcagcacaaggaccgcuggaacugcaagaaccagagccgcuccguggacuucauccccaacgaggagcccaacaugugcaagaacaucgccgagaacacccucgugcccggcgaccggaacgagcaccuggacgcgggcaacagcgaggggcagcgcaacgaccuccggaagcugggcgagcgcgggaagcugaaggucaucuggccgcccuccaaggagauccccaagaagacgcuccccuucgaggaggagcugaagaugagcaagccgaaguggccgcccgagaugaccacccugcucagcccggaguucaaguccgagagccugcuggaggacgugcggacccccgagaacaagggccagcgccaggaccacuuccccuuccuccagcccuaccugcaguccacgcacgucugccagaaggaggacgugaucgggaucaaggagaugaagaugccggagggccggaaggacgagaagaaggagggccgcaagaacgugcaggaccggcccagcgaggccgaggacaccaaguccaaccgcaagagcgccauggaccugaacgacaacaacaacgucaucgugcaguccgccgagaaggagaagaacgagaagaccaaccagaccaacggggccgaggugcuccaggucacgaacaccgacgacgagaugaugcccgagaaccacaaggagaaccugaacaagaacaacaacaacaacuacguggcggugagcuaccugaacaacugccggcagaagaccuccauccucgaguuccuggaccugcucccccugagcuccgaggccaacgacaccgccaacgaguacgagaucgagaagcuggagaacacgagccgcaucuccgagcugcucggcaucuucgagagcgagaagaccuacucccggaacguccuggccauggcgcugaagaagcagaccgaccgcgccgccgccgggagcccggugcagcccgcccccaagcccucccucagccggggccugauggugaagggcggguccagcaucaucagcccggacaccaaccugcucaacaucaagggcucccacagcaaguccaagaaccugcacuucuucuucagcaacacggucaagaucaccgcguucuccaagaagaacgagaacaucuucaacugcgaccugaucgacagcguggaccagaucaagaacaugcccugccucgaccugcgcgaguucgggaaggacgugaagcccuggcacgucgagaccaccgaggccgcccggaacaacgagaacacgggcuucgacgcccugucccacgagugcaccgccaagccccucuucccgcgcguggaggugcagagcgagcagcugaccgucgaggagcagaucaagcggaaccgcugcuacuccgacaccgaguga

SEQ ID NO: 38781 - RNA, 1335 nt, Artificial Sequence
  derived and/or modified sequence opt1 from XK__Homo_sapiens__NP_066569
augaaguuccccgccagcgugcuggccuccgucuuccucuucguggcggagaccaccgccgcccugagccuguccagcacguaccgcuccggcggggaccggauguggcaggcccucacccugcuguucagccuccugccgugcgcccuggugcagcucacccugcuguucguccaccgcgaccucucccgggaccgcccccuggugcugcuccugcaccuccuccagcugggcccccuguuccggugcuucgagguguucugcaucuacuuccagagcgggaacaacgaggagcccuacgucuccaucaccaagaagcgccagaugccgaagaacggccucagcgaggagaucgagaaggagguggggcaggcggagggcaagcugaucacgcaccgguccgccuucagccgcgccuccgugauccaggccuuccugggcagcgcgccccagcucacccugcagcuguacaucuccgucaugcagcaggacgugaccguggggcggagccuccugaugaccaucucccugcucagcaucgucuacggcgcccugcgcugcaacauccuggccaucaagaucaaguacgacgaguacgaggugaaggugaagccccucgccuacgucugcaucuuccuguggcgguccuucgagaucgccacgcgcguggugguccuggugcuguucaccagcgugcugaagaccugggucguggugaucauccugaucaacuucuucagcuucuuccucuaccccuggauccuguucuggugcuccgggagcccguuccccgagaacaucgagaaggcgcugucccgggucggcaccacgaucgugcucugcuuccugacccugcucuacaccgggaucaacauguucugcuggagcgccguccagcugaagaucgacucccccgaccugaucagcaagucccacaacugguaccagcuccugguguacuacaugauccgcuucaucgagaacgccauccugcugcuccugugguaccuguucaagaccgacaucuacauguacgugugcgcgccccuccugguccugcagcuccugaucggcuacugcacggccauccuguucaugcucguguucuaccaguucuuccacccgugcaagaagcuguucagcuccagcguguccgagggcuuccagcgguggcugcgcugcuucugcugggccugccggcagcagaagcccugcgagcccaucgggaaggaggaccuccagagcucccgcgaccgggacgagacccccagcuccagcaagaccuccccggagcccggccaguuccugaacgccgaggaccugugcagcgccuga

SEQ ID NO: 38782 - RNA, 1953 nt, Artificial Sequence
  derived and/or modified sequence opt1 from XKR4__Homo_sapiens__NP_443130
auggccgccaagagcgacggccgccugaagaugaagaaguccagcgacguggcguucacgccccuccagaacuccgaccacagcggguccguccagggccuggcccccgggcugcccagcggcuccggggccgaggacgaggaggccgccggcggcgggugcugccccgacggcgggggcugcagccggugcugcugcugcugcgcgggguccggcggcagcgccggguccggcgggagcggcggcguggccgggcccggcgggggcggggccggcuccgcggcccucugccugcgccugggccgggagcagcgccgguacagccucugggacugccuguggauccuggccgccguggccgucuacuucgcggacguggggaccgacguguggcucgccgucgacuacuaccugcgcggccagcgguggugguucgggcugacccucuucuucguggugcugggcucccugagcguccagguguucuccuuccgcugguucgugcacgacuucagcaccgaggacuccgccaccgccgccgcggccagcagcugcccgcagcccggggccgacugcaagaccgucgugggcggcggguccgccgccggcgagggggaggcgcggcccagcacgccccagcgccaggccuccaacgccagcaaguccaacaucgccgccgcgaacagcggcuccaacagcuccggggccacccgggccagcggcaagcaccgcuccgccagcugcuccuucugcaucuggcuccugcagagccugauccacauccuccagcugggccagaucuggcgguacuuccacaccaucuaccuggggauccgcucccggcagagcggcgagaacgaccgcuggcgguucuacuggaagaugguguacgaguacgcggacgucuccaugcuccaccuccuggccaccuuccuggagagcgccccgcagcuggugcugcagcucugcaucaucgugcagacgcacucccugcaggcccugcagggguucaccgccgcggccagccucgucagccuggccugggcccuggccuccuaccagaaggcgcuccgcgacagccgggacgacaagaagcccaucuccuacauggccgugaucauccaguucugcuggcacuucuucaccaucgccgcccgcgugaucaccuucgcccuguucgcgagcgucuuccagcuguacuucggcaucuucaucgugcuccacuggugcaucaugacguucuggaucgugcacugcgagaccgaguucugcaucaccaagugggaggagaucgucuucgacaugguggucggcaucaucuacaucuucuccugguucaacgugaaggaggggcggacccgcugccgccuguucaucuacuacuucgugauccugcucgagaacacggcccugagcgcccugugguaccucuacaaggcgccccagaucgccgacgccuucgccauccccgcccugugcgucguguucuccagcuuccugaccggcguggucuucaugcucauguacuacgccuucuuccacccgaacgggccccgguucggccagucccccagcugcgcgugcgaggaccccgccgccgccuucacccugccgcccgacguggccaccuccacgcugcgcagcaucuccaacaaccggagcguggucuccgaccgcgaccagaaguucgcggagcgggacgggugcgugcccguguuccagguccgccccaccgccccgagcacccccuccagccggccgccccgcaucgaggagagcgugaucaagaucgaccucuuccggaaccgcuaccccgccugggagcggcacgugcuggaccgcucccugcggaaggccauccuggccuucgagugcagccccuccccgccccgccuccaguacaaggacgacgcgcugauccaggagcggcuggaguacgagaccacgcucuga

SEQ ID NO: 38783 - RNA, 1926 nt, Artificial Sequence
  derived and/or modified sequence opt1 from XKR6__Homo_sapiens__NP_775954
auggccgccaagagcgacggcgggggcgugggggucggcuucgcgcagcugcacaaccucgacgaggccgugggguccggcggcgaggaggacggggagcccggcgggggcgggugcggcggcgggggcgacgggagcgagccgggcgaguccagcuccaugcacaucugccacugcugcaacaccagcuccugcuacuggggcugccgcagcgccugccugcggucccugcucgggcgcaagccccggcgcagcgccgccgcggacggcggggaccagccccugcagcccccggccgcccccggcgccgggcggcagccgcccacccccuccgcggcccgccccgagcccccgccgccccagguggagcggcccuggcuggacugccucuggaucguccuggcccugcucguguucuucggcgacgugggcacggaccuguggcuggcccucgacuacuaccgcaagggggacuacgucuacuucggccugacccuguucuucgugcucgugcccagccugcugguccagucccucagcuuccggugguucgugcaggacuacaccgggggcgggcugggcgccguggagggccugaccucccgcgggccgcccaugaugggcgcgggguacguccacggcgccgcccgcgggggccccggcgugcgggugagccccacccccggggcccagcggcucugccgccuguccgucuggaucuggcagagcgugauccaccuccugcagaugggccagguguggcgguacauccgcaccauguaccuggggauccagucccagcggcgcaaggagcaccagcggcgcuucuacugggccaugauguacgaguacgcggacgucaacaugcugcggcuccuggagaccuuccuggagagcgcgccccagcucgugcugcagcuguacaucaugcuccagaagaacagcgccgagacccugcccugcguguccagcgucacgucccugaugagccucgccugggugcuggccuccuaccacaagcugcuccgcgacagccgcgacgacaagaaguccaugagcuaccggggcgccaucauccagguguucuggcgccuguucaccaucuccagccgggucaucuccuucgcccuguucgccagcaucuuccagcucuacuucggcaucuucguggucgugcacuggugcgccauggccuucuggaucauccacgggggcaccgacuucugcauguccaagugggaggagauccuguucaacaugguggucgggaucguguacaucuucugcugguucaacgugaaggagggccgcacccgguaccgcauguucgcguacuacacgaucguccugaccgagaacgccgcccucaccuuccugugguacuucuaccgggaccccgagaccacggacagcuacgccgugccggcgcugugcugcguguucaucuccuucgucgccgggaucgccaugaugcuccuguacuacggcgugcugcaccccaccggcccccgcgccaagauccuggccagcuccugcugcgcggagcuccugugggggaucccccugccgcccgacguggagcccauggccccggagauccccggcuaccgggggacccaggucacccccacgcgcgccgugaccgagcagcaggaggaccucaccgccgacacgugccugcccguguuccagguccggccgaugggcccgcccacgccccuggggcgccccuaccuccccgagggcccccugaucaagaucgacaugccccggaagcgcuacccggccugggacgcgcacuucguggaccggcgccugcggcgcaccaucaacauccuccaguacgugacccccaccgccgucggcauccgguaccgcgacgggccccugcuguacgagcuccugcaguacgagagcucccuguga

SEQ ID NO: 38784 - RNA, 1122 nt, Artificial Sequence
  derived and/or modified sequence opt1 from XKR9__Homo_sapiens__NP_001274188
augaaguacaccaagcagaacuucaugaugagcgugcugggcaucaucaucuacgucaccgaccucaucguggacaucuggguguccguccgcuucuuccacgaggggcaguacguguucagcgcccuggcccuguccuucaugcuguucggcacgcugguggcgcagugcuucagcuacuccugguucaaggccgaccugaagaaggccgggcaggagagccagcacugcuuccuccugcugcacugccuccagggcggggucuucacccgguacugguucgcccugaagcgcggcuaccacgccgcguucaaguacgacuccaacaccagcaacuucguggaggagcagaucgaccugcacaaggaggugaucgaccgggucaccgaccucuccaugcugcgccuguucgagacguaccucgagggcugcccccagcugauccugcagcucuacauccugcuggagcacgggcaggccaacuucagccaguacgccgccaucaugguguccugcugcgcgaucagcugguccaccguggacuaccaggucgcccuccgcaagagccugccggacaagaagcugcucaacggccugugccccaagaucaccuaccuguucuacaagcuguucacccuccuguccuggaugcucagcguggugcugcuccucuuccugaacgucaagaucgcccuguuccuccugcuguuccucuggcugcuggggaucaucugggccuucaagaacaacacgcaguucugcacgugcaucuccauggaguuccucuaccggaucguggugggcuucauccugaucuucaccuucuucaacaucaaggggcagaacaccaagugccccaugagcugcuacuacaucguccgggugcugggcacccucggcauccugaccguguucugggucugcccccugaccaucuucaacccggacuacuucauccccaucuccaucaccaucgugcucacgcugcugcuggggauccucuuccugaucguguacuacggcagcuuccaccccaaccgcagcgccgagaccaagugcgacgagaucgacgggaagcccguccugcgggagugccgcaugcgguacuuccucauggaguga

SEQ ID NO: 38785 - RNA, 822 nt, Artificial Sequence
  derived and/or modified sequence opt1 from XPA__Homo_sapiens__NP_000371
auggccgccgcggacggcgcccugcccgaggccgccgcccucgagcagccggcggagcugcccgccagcgugcgcgccuccaucgagcggaagcgccagcgggcccugaugcuccgccaggcgcggcuggccgcccgccccuacagcgccaccgccgcggccgccaccgggggcauggccaacgucaaggccgcgcccaagaucaucgacaccgggggcggguucauccuggaggaggaggaggaggaggagcagaagaucggcaagguggugcaccagccgggccccgucauggaguucgacuacgugaucugcgaggagugcgggaaggaguucauggacuccuaccucaugaaccacuucgaccugcccacgugcgacaacugccgggacgccgacgacaagcacaagcugaucaccaagaccgaggccaagcaggaguaccuccugaaggacugcgaccuggagaagcgcgagcccccgcucaaguucaucgugaagaagaacccccaccacagccaguggggcgacaugaagcuguaccugaagcuccagaucgucaagcggucccuggaggugugggggagccaggaggcccuggaggaggccaaggaggugcgccaggagaaccgggagaagaugaagcagaagaaguucgacaagaaggucaaggagcuccgccgggcggugcgcuccagcguguggaagcgggagacgaucguccaccagcacgaguacggccccgaggagaaccuggaggacgacauguaccgcaagaccugcaccaugugcgggcacgagcugaccuacgagaagauguga

SEQ ID NO: 38786 - RNA, 2823 nt, Artificial Sequence
  derived and/or modified sequence opt1 from XPC__Homo_sapiens__NP_004619
auggcccgcaagcgggccgcgggcggggagccccgcggccgggagcugcgcagccagaaguccaaggccaagagcaaggcccggcgcgaggaggaggaggaggacgccuucgaggacgagaagccgcccaagaagucccuccugagcaaggugucccaggggaagcggaagcgcggcugcagccaccccgggggcuccgccgacggccccgcgaagaagaaggucgccaaggugaccgucaagagcgagaaccugaaggugaucaaggacgaggcccucuccgacggggacgaccugcgggacuucccgagcgaccugaagaaggcccaccaccucaagcgcggcgcgaccaugaacgaggacuccaacgaggaggaggaggagagcgagaacgacugggaggagguggaggagcuguccgagcccgugcugggggacguccgggagagcacggccuucucccgcagccuccugcccgugaagcccguggagaucgagaucgagaccccggagcaggccaagacccgggagcgcuccgagaagaucaagcuggaguucgagaccuaccuccggcgcgccaugaagcgguucaacaagggcguccacgaggacacgcacaaggugcaccuccugugccugcuggccaacggguucuaccgcaacaacaucugcagccagcccgaccugcacgcgaucggccucuccaucauccccgcccgguucacccgcgugcugccccgggacgucgacaccuacuaccugagcaaccucgugaagugguucaucggcaccuucacggugaacgccgagcugagcgccuccgagcaggacaaccugcagaccacccucgagcgccgcuucgccaucuacagcgcgcgggacgacgaggagcugguccacaucuuccugcucauccugcgcgcccugcagcuccugacccggcuggugcucucccugcagccgaucccccucaagagcgccacggccaaggggaagaagcccuccaaggagcgccugaccgccgaccccggcgggagcuccgagaccagcucccaggugcuggagaaccacaccaagccgaagacgagcaagggcaccaagcaggaggagaccuucgcgaaggggaccugccggcccuccgccaagggcaagcgcaacaagggcgggcggaagaagcgcagcaagcccuccagcuccgaggaggacgagggccccggggacaagcaggagaaggccacgcagcggcgcccgcacggccgggagcgccgggucgccagccgcguguccuacaaggaggagagcggcuccgacgaggccgggagcggcagcgacuucgagcuguccagcggggaggcguccgaccccagcgacgaggacuccgagcccgggcccccgaagcagcggaaggcccccgcgccccagcgcaccaaggccggcagcaaguccgcgagccggacccaccgcggcucccaccggaaggaccccagccucccggccgccuccagcuccagcuccagcuccaagcgcggcaagaagaugugcagcgacggggagaaggccgagaagcgcagcaucgccggcaucgaccaguggcuggagguguucugcgagcaggaggagaagugggucugcguggacugcgugcacggggucgugggccagccccugaccugcuacaaguacgcgacgaagcccaugaccuacgucguggggaucgacuccgacggcugggugcgggacgucacccagcgcuacgacccgguguggaugaccgugacgcggaagugccgcgucgacgccgaguggugggccgagacccuccggcccuaccagagccccuucauggaccgcgagaagaaggaggaccuggaguuccaggccaagcacauggaccagccccugccgaccgccaucggccucuacaagaaccacccccuguacgcgcugaagcggcaccuccugaaguacgaggccaucuaccccgagaccgccgccauccugggguacugccgcggcgaggccguguacucccgggacugcgugcacacgcugcacagccgcgacaccuggcucaagaaggcgcgggucgugcgccugggggaggugcccuacaagauggucaagggcuucuccaaccgggcccgcaaggcccggcuggccgagccgcagcuccgcgaggagaacgaccugggccuguucggguacuggcagaccgaggaguaccagccgcccguggcgguggacggcaaggucccccggaacgaguucgggaacguguaccucuuccugccgagcaugaugcccaucggcugcgugcagcugaaccuccccaaccugcaccgcgucgcccggaagcuggacaucgacugcgugcaggccaucaccggguucgacuuccacggcggcuacucccaccccgugacggacggguacaucgucugcgaggaguucaaggacgugcuccugaccgccugggagaacgagcaggccgugaucgagcgcaaggagaaggagaagaaggagaagcgggcgcugggcaacuggaagcuccuggccaaggggcugcucauccgcgagcgccugaagcggcgcuacggccccaagagcgaggccgccgcgccccacaccgacgccgggggcggccuguccagcgacgaggaggaggggaccuccagccaggccgaggccgcccggauccucgccgccuccuggccccagaaccgcgaggacgaggagaagcagaagcugaagggcgggcccaagaagaccaagcgggagaagaaggccgccgccagccaccuguucccguucgagcagcucuga

SEQ ID NO: 38787 - RNA, 1929 nt, Artificial Sequence
  derived and/or modified sequence opt1 from XPNPEP1__Homo_sapiens__NP_001161076
auggccgccagccgcaagcccccgcgggugcgcgucaaccaccaggacuuccagcugcggaaccuccgcaucaucgagcccaacgaggugacccacuccggcgacaccgggguggagacggacggccggaugccgcccaaggucaccagcgagcugcugcgccagcuccggcaggcgaugcgcaacuccgaguacgugaccgagcccauccaggccuacaucauccccagcggggacgcccaccaguccgaguacaucgcccccugcgacugccggcgcgccuucgugagcggcuucgacggguccgcgggcaccgccaucaucacggaggagcacgccgccauguggaccgacggccgguacuuccugcaggcggccaagcagauggacagcaacuggacccugaugaagauggggcucaaggacacccccacgcaggaggacuggcuggucuccgugcugccggagggcagccgcgugggggucgacccccucaucauccccaccgacuacuggaagaagauggccaaggugcugcgguccgccggccaccaccugauccccgugaaggagaaccucgucgacaagaucuggaccgaccgcccggagcggcccugcaagccccugcugacccucgggcuggacuacacgggcaucagcuggaaggacaagguggccgaccugcgccucaagauggcggagcggaacgugaugugguucgucgugaccgcccuggacgagaucgccuggcuguucaaccuccgcggcuccgacguggagcacaaccccgucuucuucagcuacgccaucaucgggcuggagaccaucaugcuguucaucgacggcgaccggaucgacgccccguccgugaaggagcaccuccugcuggaccucgggcuggaggcggaguaccgcauccaggugcaccccuacaagagcauccuguccgagcucaaggcccugugcgccgaccugagcccccgggagaaggucuggguguccgacaaggccagcuacgccgugagcgagaccauccccaaggaccaccgcugcugcaugccguacacgcccaucugcaucgcgaaggccgucaagaacuccgccgagagcgagggcaugcgccgggcccacaucaaggacgccguggcgcucugcgagcuguucaacuggcuggagaaggagguccccaagggcggggugaccgagaucuccgccgccgacaaggccgaggaguuccgccggcagcaggcggacuucguggaccucagcuuccccaccaucuccagcaccggcccgaacggggccaucauccacuacgccgacggcacgaccgacgucacccgcaccaugcacuucgggacgcccaccgccuacgagaaggagugcuucaccuacgugcugaagggccacaucgccguguccgcggccgucuuccccaccggcacgaaggggcaccuccuggacagcuucgcccgguccgcccugugggacagcggccuggacuaccuccacgggaccggccacggggugggcuccuuccugaacgugcacgagggccccugcgggaucagcuacaagaccuucuccgacgagccgcuggaggccggcaugaucgucaccgacgagcccggguacuacgaggacggcgcguucgggauccgcaucgagaacguggugcucgucgugcccgugaagacgaaguacaacuucaacaaccggggcagccugaccuucgagccgcugacccucguccccauccagaccaagaugaucgacguggacucccugacggacaaggagugcgacuggcugaacaacuaccaccugaccugccgcgacgugaucggcaaggagcuccagaagcaggggcggcaggaggcccuggaguggcugauccgcgagacccagcccaucagcaagcagcacuga

SEQ ID NO: 38788 - RNA, 2025 nt, Artificial Sequence
  derived and/or modified sequence opt1 from XPNPEP2__Homo_sapiens__NP_003390
auggcccgcgcccacuggggcugcugccccuggcuggugcuccugugcgcgugcgccugggggcacaccaagccggucgaccugggcgggcaggacgugcggaacugcagcaccaacccgcccuaccuccccgugacggucgugaacaccaccaugucccugaccgcccugcgccagcagaugcagacgcagaaccucagcgccuacaucauccccggcaccgacgcccacaugaacgaguacaucgggcagcacgacgagcggcgcgcguggaucaccggcuucaccggcuccgccgggacggccguggucaccaugaagaaggccgcgguguggaccgacagccgguacuggacccaggccgagcgccagauggacugcaacugggagcugcacaaggaggugggcacgacccccaucgucaccuggcugcucaccgagauccccgccgggggccgggugggguucgaccccuuccugcuguccaucgacacgugggagagcuacgaccucgcccugcagggcuccaaccgccagcuggugagcaucaccaccaaccucgucgaccugguguggggcuccgagcggccgcccgugcccaaccagcccaucuacgcccugcaggaggcguucaccgggagcacguggcaggagaaggucuccggcgugcgcagccagaugcagaagcaccagaaggugccgaccgccguccuccuguccgcccuggaggagaccgccuggcuguucaaccuccgggccagcgacauccccuacaaccccuucuucuacuccuacacccugcucacggacagcuccauccgccuguucgcgaacaagagccgguucuccagcgagacccugagcuaccucaacuccagcugcaccgggcccaugugcgugcagaucgaggacuacucccaggugcgcgacagcauccaggccuacucccugggcgacguccggaucuggaucggcaccagcuacacgauguacgggaucuacgagaugaucccgaaggagaagcuggugaccgacaccuacucccccgugaugaugaccaaggccgucaagaacagcaaggagcaggcccuccugaaggccucccacgugcgcgacgcggucgccgugauccgguaccugguguggcucgagaagaacguccccaagggcacgguggacgaguucagcggggccgagaucguggacaaguuccgcggcgaggagcaguucuccagcgggcccuccuucgagaccaucagcgccuccggccugaacgccgcgcuggcccacuacagcccgaccaaggagcucaaccggaagcuguccagcgacgagauguaccugcucgacuccggcgggcaguacugggacggcaccacggacaucacccgcaccguccacugggggacccccagcgccuuccagaaggaggccuacacccgggugcugaucggcaacaucgaccugagccgccucaucuuccccgcggccacguccgggcgcaugguggaggccuucgcccggcgcgcccugugggacgcgggccugaacuacggccacgggaccggccacgggaucggcaacuuccucugcguccacgaguggcccgugggguuccagagcaacaacaucgccauggccaagggcauguucaccuccaucgagccgggcuacuacaaggacggggaguucggcauccggcuggaggacguggcccuggucguggaggccaagaccaaguaccccgggagcuaccucacguucgagguggucuccuucgugcccuacgaccgcaaccugaucgacgugagccugcugucccccgagcaccuccaguaccugaaccgguacuaccagaccauccgcgagaaggucggcccggagcugcagcggcgccagcuccuggaggaguucgaguggcugcagcagcacaccgagccccucgcggcccgggcccccgacaccgccagcugggccuccgugcugguggucagcacgcuggcgauccucggcugguccguguga

SEQ ID NO: 38789 - RNA, 1524 nt, Artificial Sequence
  derived and/or modified sequence opt1 from XPNPEP3__Homo_sapiens__NP_071381
augcccuggcugcucagcgccccgaagcuggugcccgccgucgcgaacgugcgcggccuguccgggugcaugcucugcagccagcggcgcuacucccugcagcccgugcccgagcggcgcaucccgaaccgguaccugggccagcccagccccuucacccacccccaccuccugcgcccgggggaggucacccccggccugucccagguggaguacgcccuccggcgccacaagcugaugagccugauccagaaggaggcccaggggcaguccggcacggaccagaccguggucgugcucagcaaccccaccuacuacauguccaacgacauccccuacaccuuccaccaggacaacaacuuccuguaccugugcggcuuccaggagccggacagcauccucgugcugcagucccugcccgggaagcagcuccccagccacaaggccauccuguucgucccccggcgcgacccgucccgggagcugugggacggcccccgcagcgggacggacggcgccaucgcgcucaccgggguggacgaggccuacacccuggaggaguuccagcaccuccugcccaagaugaaggccgagaccaacauggugugguacgacuggaugcggcccucccacgcccagcugcacagcgacuacaugcagccgcugacggaggcgaaggccaaguccaagaacaagguccgcggcgugcagcagcucauccagcggcugcgccugaucaagagccccgccgagaucgagcggaugcagaucgccggcaagcucaccucccaggccuucaucgagaccauguucaccagcaaggcgcccguggaggaggccuuccuguacgccaaguucgaguucgagugccgcgcccgcggggccgacauccuggcguacccgcccgucguggccggcgggaaccggagcaacacgcuccacuacgugaagaacaaccagcugaucaaggacggcgagaugguccugcucgacggcgggugcgaguccagcugcuacguguccgacaucacccggaccuggcccgugaacggccgcuucaccgcgccccaggccgagcuguacgaggccguccuggagauccagcgcgacugccucgcccugugcuuccccgggacgagccuggagaacaucuacuccaugaugcucacccugaucggccagaagcugaaggaccucgggaucaugaagaacaucaaggagaacaacgccuucaaggccgcccggaaguacugcccgcaccacgugggccacuaccugggcauggacgugcacgacacccccgacaugccccgcagccugccgcuccagcccgggauggucaucaccaucgagcccggcaucuacauccccgaggacgacaaggacgccccggagaaguuccgggggcugggcgugcgcaucgaggacgacgucguggugacgcaggacagcccccugauccuguccgcggacugccccaaggagaugaacgacaucgagcagaucugcucccaggccagcuga

SEQ ID NO: 38790 - RNA, 3216 nt, Artificial Sequence
  derived and/or modified sequence opt1 from XPO1__Homo_sapiens__XP_011531399
augcccgccaucaugaccaugcuggccgaccacgcggcccgccagcuccuggacuucagccagaagcuggacaucaaccuccuggacaacguggucaacugccuguaccacggcgagggggcccagcagcggauggcccaggaggugcucacccaccugaaggagcacccggacgccuggacgcgcguggacaccauccuggaguucucccagaacaugaacaccaaguacuacggccuccagauccuggagaacgucaucaagacccgguggaagauccugccccgcaaccagugcgaggggaucaagaaguacguggugggccucaucaucaagacgagcuccgacccgaccugcgucgagaaggagaagguguacaucgggaagcugaacaugauccuggugcagauccucaagcaggaguggcccaagcacuggcccaccuucaucagcgacaucgucggcgcgucccggaccagcgagucccugugccagaacaacauggugauccugaagcuccugagcgaggagguguucgacuucuccagcggccagaucacgcaggucaaguccaagcaccugaaggacagcaugugcaacgaguucucccagaucuuccagcucugccaguucgugauggagaacagccagaacgcgccccuggugcacgccacccuggagacccuccugcgcuuccugaacuggaucccccucggguacaucuucgagaccaagcugaucuccacgcugaucuacaaguuccucaacguccccauguuccggaacgugagccugaagugccugaccgagaucgccggcguguccgucagccaguacgaggagcaguucgugacccucuucacccugacgaugaugcagcugaagcagaugcucccgcugaacaccaacauccgccuggccuacuccaacgggaaggacgacgagcagaacuucauccagaaccucagccuguuccugugcaccuuccucaaggagcacgaccagcugaucgagaagcggcugaaccuccgcgagacccugauggaggcccugcacuacaugcuccuggugagcgaggucgaggagacggagaucuucaagaucugccuggaguacuggaaccaccuggccgccgagcucuaccgggagucccccuucagcaccuccgccagcccccugcuguccggcagccagcacuucgacgugcccccgcgccggcagcucuaccugcccaugcuguucaaggugcgccuccugauggucucccggauggcgaagcccgaggaggugcuggucguggagaacgaccagggggaggugguccgcgaguucaugaaggacaccgacagcaucaaccucuacaagaacaugcgggagacccugguguaccugacgcaccucgacuacguggacaccgagcgcaucaugaccgagaagcugcacaaccaggucaacggcaccgagugguccuggaagaaccugaacacgcucugcugggccaucggcagcaucuccggggccaugcacgaggaggacgagaagcgguuccuggugaccgugaucaaggaccugcucggccugugcgagcagaagcgcgggaaggacaacaaggccaucaucgccagcaacaucauguacaucgucggccaguacccccgguuccugcgcgcgcacuggaaguuccucaagaccguggugaacaagcuguucgaguucaugcacgagacccacgacggcguccaggacauggccugcgacacguucaucaagaucgcccagaagugccgccggcacuucgugcagguccaggugggggaggugaugccguucaucgacgagauccugaacaacaucaacaccaucaucugcgaccuccagccccagcagguccacaccuucuacgaggccgugggcuacaugaucggggcccagaccgaccagacggugcaggagcaccugaucgagaaguacaugcugcuccccaaccaggugugggacuccaucauccagcaggcgaccaagaacgucgacauccugaaggaccccgagaccgugaagcagcugggcagcauccucaagaccaacgugcgcgccugcaaggccgucgggcacccguucgugauccagcugggccggaucuaccuggacaugcucaacguguacaagugccuguccgagaacaucagcgccgccauccaggcgaacggcgagauggucaccaagcagccccugauccgcuccaugcggacggugaagcgcgagacccucaagcugaucagcgggugggugucccggagcaacgacccccagauggucgccgagaacuucgugcccccgcugcucgacgccgugcugaucgacuaccagcgcaacguccccgccgcgcgggagcccgaggugcugagcaccauggccaucaucgugaacaagcucggcgggcacaucaccgccgagaucccccagaucuucgacgccgucuucgagugcacgcugaacaugaucaacaaggacuucgaggaguacccggagcaccgcaccaacuucuuccugcuccugcaggccgugaacucccacugcuuccccgcguuccuggccaucccgcccacccaguucaagcucgugcuggacagcaucaucugggccuucaagcacaccaugcggaacgucgccgacacgggccugcagauccucuucacccugcugcagaacguggcccaggaggaggcggccgcccaguccuucuaccagaccuacuucugcgacauccuccagcacaucuucagcguggucaccgacacgucccacaccgccgggcugaccaugcacgccagcauccuggcguacauguucaaccucguggaggagggcaagaucuccaccagccugaaccccggcaaccccgugaacaaccagaucuuccugcaggaguacgucgccaaccuccugaaguccgccuucccccaccuccaggacgcccaggugaagcuguucgugacggggcuguucagccugaaccaggacaucccggcguucaaggagcaccuccgcgacuuccugguccagaucaaggaguucgccggcgaggacaccuccgaccuguuccucgaggagcgggagaucgcccugcgccaggccgacgaggagaagcacaagcggcagaugagcgugcccgggaucuucaacccccacgagauccccgaggagaugugcgacuga

SEQ ID NO: 38791 - RNA, 3456 nt, Artificial Sequence
  derived and/or modified sequence opt1 from XPO4__Homo_sapiens__NP_071904
augauggccgccgcgcugggcccgcccgaggugaucgcccagcucgagaacgccgccaagguccugauggccccgcccagcauggugaacaacgagcagcgccagcacgcggagcacaucuuccuguccuuccgcaagagcaagucccccuucgccgugugcaagcacauccucgagaccagcaaggucgacuacgugcuguuccaggccgccaccgcgaucauggaggccgugguccgggaguggauccugcucgagaagggguccaucgagagccugcggacguuccugcucaccuacgugcugcagcgccccaaccugcagaaguacgugcgggagcagauccuccuggccgucgccgugaucgugaagcgcggcucccuggacaagagcaucgacugcaaguccaucuuccacgaggucagccagcucaucuccagcgggaaccccaccgugcagacccuggccugcuccauccugacggcgcuccugagcgaguucuccagcuccagcaagaccuccaacaucggccugagcauggaguuccacgggaacugcaagcggguguuccaggaggaggaccuccgccagaucuucaugcugaccgucgaggugcugcaggaguucagccggcgcgagaaccucaacgcccagauguccagcguguuccagcgguaccuggcccuggccaaccagguccucuccuggaacuuccugccgcccaaccugggccgccacuacaucgccauguucgagagcucccagaacgugcuccugaagcccaccgagagcuggcgggagacgcugcucgacucccgcgugauggagcuguucuucaccguccaccggaagauccgcgaggacagcgacauggcgcaggacucccugcagugccucgcccagcuggccagccugcacggccccaucuuccccgacgaggggucccagguggacuaccucgcccacuucaucgagggccugcugaacaccaucaacgggaucgagaucgaggacagcgaggccgugggcaucuccagcaucaucuccaaccucaucaccgucuucccccggaacgugcugacggcgauccccagcgagcuguucuccagcuucgucaacugccucacccaccugaccugcuccuucgggcgcagcgccgcccuggaggaggugcucgacaaggacgacaugguguacauggaggccuacgacaagcugcuggagagcuggcugacccucguccaggacgacaagcacuuccacaagggcuucuucacgcagcacgccguccagguguucaacuccuacauccagugccaccuggcggcccccgacggcacccggaaccugaccgccaacgggguggccagccgcgaggaggaggagaucuccgagcuccaggaggacgaccgggaccaguucagcgaccagcuggcguccgugggcaugcuggggcgcaucgccgccgagcacugcaucccccuccugaccagccugcucgaggagcgcgugacgcggcugcacggccagcugcagcgccaccagcagcagcuccuggccucccccggcagcuccaccgucgacaacaagaugcuggacgaccucuacgaggacauccacuggcugauccuggugaccggguaccuccuggccgacgacacccagggcgagacgccgcugaucccgcccgagaucauggaguacagcaucaagcacuccagcgagguggacaucaacaccacccuccagauccuggggucccccggcgagaaggcgagcuccauccccggguacaaccggaccgacagcgucauccgccugcucuccgccauccugcgggugagcgagguggagagccgcgccauccgggccgaccugacgcaccuccugagcccccagaugggcaaggacaucgucugguuccugaagcgcugggccaagaccuaccuccugguggacgagaagcuguacgaccagaucucccuccccuucuccaccgcguucggcgccgacaccgaggggagccaguggaucaucggcuaccugcugcagaaggugaucuccaaccucagcgucugguccagcgagcaggaccuggccaacgacacggugcagcugcucgugacccuggucgagcggcgcgagcgggccaaccuggugauccagugcgagaacugguggaaccucgccaagcaguucgcgucccgcagcccgccccugaacuuccuguccagccccgugcagcggacccucaugaaggcccugguccucgggggcuucgcccacauggacaccgagacgaagcagcaguacuggaccgaggugcugcagccccugcagcagcgcuuccugcgggugaucaaccaggagaacuuccagcagaugugccagcaggaggaggucaagcaggagaucaccgccacccucgaggcgcugugcgggaucgccgaggccacccagaucgacaacguggccauccuguucaacuuccucauggacuuccugacgaacugcaucggccugauggagguguacaagaacacccccgagaccgucaaccucaucaucgagguguucguggaggucgcccacaagcagaucugcuaccugggcgaguccaaggcgaugaaccuguacgaggccugccucacccugcuccagguguacagcaagaacaaccuggggcgccagcggaucgacgugacggccgaggaggagcaguaccaggaccugcugcucaucauggagcugcugaccaaccuccuguccaaggaguucaucgacuucagcgacaccgacgaggucuuccgcggccacgagccggggcaggccgccaaccgguccgugagcgcggccgacgugguccuguacggcgugaaccucauccugccccugaugucccaggaccuccugaaguuccccacccugugcaaccaguacuacaagcucaucacguucaucugcgagaucuucccggagaagaucccccagcugcccgaggaccuguucaagagccucauguacagccuggagcuggggaugaccuccaugagcuccgaggugugccagcucugccuggaggcccugacgccccucgccgagcagugcgccaaggcgcaggagaccgacagcccgcuguuccuggccacccgccacuuccucaagcuggucuucgacaugcuggugcuccagaagcacaacaccgagaugaccaccgccgccggcgaggcguucuacacgcuggugugccugcaccaggccgaguacuccgagcuggucgagacccuccugagcucccagcaggaccccgugaucuaccagcgccuggccgacgccuucaacaagcucaccgccagcuccaccccgcccacgcuggaccggaagcagaagauggcguuccucaagagccuggaggaguucauggccaacgugggcgggcugcugugcgucaaguga

SEQ ID NO: 38792 - RNA, 3615 nt, Artificial Sequence
  derived and/or modified sequence opt1 from XPO5__Homo_sapiens__NP_065801
auggccauggaccaggugaacgcccugugcgagcagcucgucaaggcggugaccgugaugauggaccccaacagcacccagcgcuaccggcuggaggcccugaaguucugcgaggaguucaaggagaagugcccgaucugcguccccugcggccuccgccuggccgagaagacccagguggccaucgugcggcacuucgggcugcagauccucgagcacgucgugaaguuccgcuggaacggcaugucccggcuggagaagguguaccugaagaacagcgucauggagcucaucgccaacgggacgcugaacauccuggaggaggagaaccacaucaaggacgcgcucucccgcaucgugguggagaugaucaagcgggaguggccccagcacuggcccgacaugcugaucgagcuggacacccucagcaagcagggcgagacccagacggagcuggucauguucauccugcuccgccuggccgaggacguggugaccuuccagacccugccgccccagcggcgccgggacauccagcagacccucacgcagaacauggagcgcaucuucuccuuccugcugaacacccuccaggagaacgucaacaaguaccagcaggucaagaccgacaccagccaggaguccaaggcccaggccaacugccggguggggguggcggcccugaacacgcuggccggcuacaucgacugggugagcaugucccacaucaccgccgagaacugcaagcuccuggagauccugugccuccugcugaacgagcaggagcuccagcugggcgccgcggagugccugcucaucgccgugagccgcaaggggaagcuggaggaccggaagccccugaugguccucuucggcgacguggccaugcacuacauccuguccgccgcccagaccgcggacgggggcgggcugguggagaagcacuacgucuuccucaagcgccugugccaggugcugugcgcccucggcaaccagcugugcgcccugcucggcgccgacagcgacgucgagacccccuccaacuucgggaaguaccuggagagcuuccuggccuucacgacccacccgucccaguuccugcggagcuccacccagaugaccuggggcgcccucuuccgccacgagauccugagccgggacccccugcuccuggcgaucauccccaaguaccugcgcgccuccaugacgaaccucgugaagaugggguuccccagcaagaccgacagcccguccugcgaguacagccgguucgacuucgacuccgacgaggacuucaacgccuucuucaacagcucccgcgcccagcagggcgaggugaugcgccuggcgugccggcuggaccccaagaccagcuuccagauggccggcgaguggcucaaguaccagcuguccaccuuccuggacgccgggagcgucaacuccugcagcgccgugggcacgggggagggcucccucugcagcguguucucccccagcuucguccagugggaggcgaugacccuguuccuggaguccgugaucacccagauguuccgcacccucaaccgggaggagauccccgugaacgacgggaucgagcugcugcagaugguccucaacuucgacacgaaggacccgcugauccugagcugcgugcucaccaacguguccgcccuguuccccuucgucaccuaccgccccgaguuccugccccagguguucagcaagcuguucuccagcgugaccuucgagacggucgaggagagcaaggccccgcggacccgcgccgugcggaacgugcgccggcacgccugcuccagcaucaucaagaugugccgcgacuacccccagcucguccugcccaacuucgacaugcucuacaaccacgugaagcagcugcuguccaacgagcuccugcugacccagauggagaagugcgcgcucauggaggcccuggugcugaucagcaaccaguucaagaacuacgagcggcagaaggucuuccucgaggagcugauggcccccguggccuccaucuggcugagccaggacaugcaccgcgugcucuccgacgucgacgccuucaucgcguacgugggcaccgaccagaaguccugcgacccgggccuggaggaccccugcgggcugaaccgggcccgcaugagcuucugcguguacagcauccucggcgucgugaagcggacgugcuggcccaccgaccuggaggaggccaaggccgggggcuucguggucggguacaccuccagcggcaaccccaucuuccgcaacccgugcaccgagcagauccugaagcuccuggacaaccugcucgcccugauccggacccacaacacgcuguacgcgcccgagaugcucgccaagauggccgagcccuucaccaaggcccuggacaugcuggacgcggagaaguccgccauccucggccugccgcagccccugcucgagcugaacgacagccccguguucaagaccgugcuggagcgcaugcagcgguucuucuccacccucuacgagaacugcuuccacauccuggggaaggccggccccagcaugcagcaggacuucuacacggucgaggaccuggccacccagcuccuguccagcgccuucgugaaccugaacaacaucccggacuaccgccuccgccccaugcugcggguguucgucaagccccuggugcuguucugcccgcccgagcacuacgaggcgcucgugagccccauccuggggccccucuucaccuaccugcacaugcgccugucccagaaguggcaggucaucaaccagcggagccuccugugcggcgaggacgaggccgccgacgagaaccccgagucccaggagaugcuggaggagcagcucgugcgcaugcugacccgggaggugauggaccugaucacggucugcugcgugagcaagaagggggccgaccacuccagcgccccgcccgcggacggcgacgacgaggagaugauggccaccgaggugacccccuccgccauggccgagcucaccgaccugggcaagugccugaugaagcacgaggacgucugcacggcccuccugaucaccgcguucaacagccuggccuggaaggacacccucuccugccagcgcaccacgagccagcugugcuggccccugcucaagcagguccuguccgggacccugcucgccgacgccgugaccuggcuguucaccagcgugcugaagggccugcagaugcacgggcagcacgacggcugcauggcgucccucgugcaccuggccuuccagaucuacgaggcccugcggccgcgcuaccucgagauccgggccgugauggagcagauccccgagauccagaaggacagccuggaccaguucgacugcaagcugcucaaccccucccugcagaaggucgccgacaagcgccggaaggaccaguucaagcgccugaucgcgggcugcaucgggaagccccucggcgagcaguuccggaaggaggugcacaucaagaaccugccgagccuguucaagaagacgaagcccaugcucgagaccgagguccuggacaacgacgggggcgggcuggccaccaucuucgagcccuga

SEQ ID NO: 38793 - RNA, 3336 nt, Artificial Sequence
  derived and/or modified sequence opt1 from XPO6__Homo_sapiens__NP_001257869
augaccgaguucuuccacgacugcaccacgaacgagcgcaagcgggagaucgaggagcugcucaacaacuucgcccagcagaucggcgccuggcgcuucugccuguacuuccugagcuccacccggaacgacuacgugaugauguacagccucaccgucuucgagaaccugaucaacaagauguggcugggggugcccucccaggacaagauggagauccgcagcugccuccccaagcugcugcucgcgcaccacaagacccugcccuacuucauccggaacaagcugugcaaggugaucgucgacaucggccgccaggacuggcccauguucuaccacgacuucuucacgaacauccuccagcugauccagucccccgugaccaccccgcuggggcucaucaugcugaagaccacgagcgaggagcuggccugcccccgggaggaccucuccguggcccgcaaggaggagcugcggaagcugcuccuggaccagguccagaccgugcugggccuccugaccgggauccuggagaccgugugggacaagcacagcgucacggccgccaccccgccgcccucccccaccagcggcgaguccggcgaccuccugagcaaccugcuccagucccccagcuccgcgaagcugcugaaccagcccauccccauccucgacguggagagcgaguacaucugcucccuggcccuggagugccucgcccaccuguucagcuggaucccccuguccgccagcaucacccccagccuccugacgaccaucuuccacuucgcgcgcuucgggugcgacauccgggcccgcaagauggccuccgugaacggcagcucccagaacugcgucagcgggcaggagcggggccgccugggggugcucgccauguccugcaucaacgagcugaugagcaagaacugcgugcccauggaguucgaggaguaccugcuccggauguuccagcagaccuucuaccugcugcagaagaucaccaaggacaacaacgcccacacggucaagucccgccucgaggagcuggacgagagcuacaucgagaaguucaccgacuuccugcggcuguucguguccgugcaccuccgccggaucgagagcuacucccaguucccggucguggaguuccugacccuccucuucaaguacaccuuccaccagcccacgcacgagggcuacuucagcugccuggacaucuggacccuguuccucgacuaccugaccuccaagaucaagagccgccugggcgacaaggaggcggugcucaaccgguacgaggacgcccugguccugcuccugaccgaggugcugaaccgcauccaguuccgcuacaaccaggcccagcucgaggagcuggacgacgagacgcuggacgacgaccagcagaccgaguggcagcgguaccuccgccagucccuggagguggucgccaaggugauggagcugcuccccacccacgccuucagcacccuguuccccguccugcaggacaaccucgagguguaccuggggcugcagcaguucaucgugacguccggcagcgggcaccggcucaacaucaccgcggagaacgacugccgccggcugcacugcucccugcgcgaccucagcagccugcugcaggccgucggccggcucgccgaguacuucaucggcgacguguucgccgcccgcuucaacgacgcgcugaccguggucgagcggcuggugaaggugacccucuacgggucccagaucaagcuguacaacaucgagacggccgucccgagcgugcugaagcccgaccucaucgacgugcacgcccagucccuggccgcccugcaggcguacagccacuggcucgcccaguacugcuccgagguccaccgccagaacacccagcaguucgugacccugaucagcaccaccauggacgccaucacgccccugaucuccaccaaggugcaggacaagcuccugcugagcgccugccaccuccuggucucccuggcgaccaccgugcggcccguguuccucaucagcaucccggccguccagaagguguucaaccgcaucacggacgccuccgcccugcggcugguggacaaggcccagguccucgugugccgcgcgcugagcaacauccugcuccugcccuggcccaaccugcccgagaacgagcagcaguggccggugcgguccaucaaccacgccagccucaucuccgcccugagccgcgacuaccggaaccugaagcccuccgccgucgcgccccagcgcaagaugccgcucgacgacaccaagcugaucauccaccagacccugagcgugcucgaggacaucguggagaacaucagcggcgaguccaccaagagccggcagaucugcuaccagucccugcaggagagcguccaggugucccuggcccucuuccccgccuucauccaccagagcgacgugacggacgagaugcuguccuucuuccugacccucuuccgcgggcugcgcguccagaugggcgugcccuucaccgagcagaucauccagaccuuccugaacauguucacgcgggagcagcucgccgagagcauccugcacgagggguccaccggcugccgcguggucgagaaguuccugaagauccuccagguggugguccaggagcccggccagguguucaagccguuccugcccagcaucaucgcccugugcauggagcaggucuaccccaucaucgccgagcggcccuccccggacgugaaggcggagcuguucgagcugcuguuccgcacccuccaccacaacuggcgguacuucuucaagagcaccgugcuggccuccgugcagcgcgggaucgccgaggagcagauggagaacgagccccaguucagcgccaucaugcaggcguucggccaguccuuccugcagcccgacauccaccucuucaagcagaaccuguucuaccuggagacgcucaacaccaagcagaagcuguaccacaagaagaucuuccggaccgccaugcuguuccaguucgucaacgugcuccuccaggugcugguccacaagagccacgaccugcugcaggaggagaucgggaucgccaucuacaacauggccuccguggacuucgacggcuucuucgccgcguuccugcccgaguuccugaccagcugcgacgggguggacgccaaccagaaguccguccucggccgcaacuucaagauggaccgggaccugccgagcuucacgcagaacgugcaccgccuggugaacgaccuccgguacuaccgccugugcaacgacagccugccgcccggcaccgucaagcucuga

SEQ ID NO: 38794 - RNA, 3264 nt, Artificial Sequence
  derived and/or modified sequence opt1 from XPO7__Homo_sapiens__NP_055839
auggccgaccacgugcagagccuggcccagcucgagaaccugugcaagcagcuguacgagaccaccgacacgaccacccgccuccaggcggagaaggcccuggucgaguucaccaacucccccgacugccugagcaagugccagcuccugcuggagcggggcuccagcuccuacagccagcuccuggccgccacgugccugaccaagcucgugucccgcaccaacaacccgcugccccuggagcagcggaucgacauccgcaacuacgugcucaacuaccuggccacccggcccaagcuggcgacguucgucacccaggcccucauccagcuguacgcccgcaucaccaagcuggggugguucgacugccagaaggacgacuacguguuccggaacgccaucaccgacgugacgcgcuuccuccaggacagcgucgaguacugcaucaucggcgugaccauccugucccagcugaccaacgagaucaaccaggcggacaccacgcacccccucaccaagcaccggaagaucgccagcuccuuccgcgacagcucccuguucgacaucuucacccugagcugcaaccuccugaagcaggccuccgggaagaaccugaaccucaacgacgagagccagcacggccugcugaugcagcuccugaagcugacccacaacugccucaacuucgacuucaucgggacguccaccgacgagagcuccgacgaccugugcaccgugcagaucccgaccagcuggcggagcgccuuccuggacuccagcacgcuccagcuguucuucgaccuguaccacuccaucccgcccagcuucagcccccucguccugagcugccuggugcagaucgccuccgugcgccggagccucuucaacaacgcggagcgcgccaaguuccugucccaccuggucgacggcgugaagcggauccucgagaacccccagagccuguccgaccccaacaacuaccacgaguucugccgccugcuggcccggcucaagagcaacuaccagcugggcgagcuggugaaggucgagaacuaccccgaggugauccgccucaucgccaacuucaccgugaccucccugcagcacugggaguucgcccccaacagcguccacuaccugcucucccuguggcagcggcuggcggccagcgugccguacgugaaggccaccgagccccacaugcucgagacguacacccccgaggucaccaaggccuacaucaccucccgccuggagagcgugcacaucauccugcgggacgggcucgaggacccccuggaggacacgggccuggugcagcagcagcucgaccagcuguccaccaucgggcgcugcgaguacgagaagaccugcgcccugcucguccagcuguucgaccagagcgcgcagagcuaccaggagcugcuccaguccgccagcgccuccccgauggacaucgccgugcaggagggccgccugaccuggcuggucuacaucaucggggccgugaucggcggccgggugagcuucgcguccacggacgagcaggacgccauggacggggagcucgucugccgcgugcugcagcugaugaaccucaccgacagccggcuggcccaggccggcaacgagaagcuggagcucgcgaugcuguccuucuucgagcaguuccgcaagaucuacaucggggaccaggugcagaaguccuccaagcuguaccggcgccucagcgagguccugggccugaacgacgagaccauggugcucuccguguucaucggcaagaucaucaccaaccugaaguacugggggcggugcgagcccaucaccagcaagacgcugcagcuccugaacgaccuguccaucggcuacagcuccguccgcaagcucgugaagcugagcgccgugcaguucaugcugaacaaccacaccuccgagcacuucagcuuccucgggaucaacaaccagagcaaccugaccgacaugcggugccgcaccacguucuacaccgcccugggccggcuccugauggucgaccugggggaggacgaggaccaguacgagcaguucaugcucccccugaccgccgccuucgaggcgguggcccagauguucuccaccaacagcuucaacgagcaggaggccaagcgcacgcuggugggccucguccgggaccugcgcggcaucgccuucgccuucaacgcgaagaccuccuucaugaugcuguucgaguggaucuaccccagcuacaugccgauccuccagcgggccaucgagcugugguaccacgaccccgccugcaccacccccgugcugaagcucauggccgagcuggugcacaaccgcucccagcggcugcaguucgacgucagcucccccaacgggauccuccuguuccgcgagacgagcaagaugaucaccauguacggcaaccggauccugacccucggggaggugccgaaggaccagguguacgcccugaagcugaagggcaucuccaucugcuucagcaugcucaaggcggcccuguccgggagcuacgucaacuucggcguguuccgccuguacggcgacgacgcccucgacaacgcccugcagaccuucaucaagcugcuccuguccaucccccacagcgaccugcucgacuaccccaagcugucccagagcuacuacucccugcucgaggugcugacgcaggaccacaugaacuucaucgcgagccuggagccccacgucaucauguacauccucuccagcaucagcgaggggcugaccgcccuggacaccauggugugcaccggcugcugcuccugccucgaccacaucgugacguaccuguucaagcagcugagccgcuccaccaagaagcggaccaccccgcucaaccaggagagcgaccgcuuccugcacaucaugcagcagcaccccgagaugauccagcagaugcuguccacgguccucaacaucaucaucuucgaggacugccggaaccaguggagcaugucccgcccccugcuggggcugauccuccugaacgagaaguacuucagcgaccugcggaacuccaucgugaacagccagccgcccgagaagcagcaggccaugcaccucugcuucgagaaccugauggagggcaucgagcgcaaccugcucaccaagaaccgggaccgcuucacccagaaccuguccgccuuccggcgcgaggugaacgacagcaugaagaacuccaccuacggggucaacagcaacgacaugauguccuga

SEQ ID NO: 38795 - RNA, 1896 nt, Artificial Sequence
  derived and/or modified sequence opt1 from XPR1__Homo_sapiens__NP_001129141
augaaguucgccgagcaccugagcgcccacaucacccccgaguggcgcaagcaguacauccaguacgaggccuucaaggacaugcucuacuccgcccaggaccaggccccgagcguggaggucaccgacgaggacacggugaagcgguacuucgccaaguucgaggagaaguucuuccagaccugcgagaaggagcuggccaagaucaacaccuucuacuccgagaagcuggcggaggcccagcgccgguucgccacccuccagaacgagcugcagagcucccuggacgcccagaaggagagcacgggcgugaccacccuccgccagcggcgcaagcccgucuuccaccugucccacgaggagcgggugcagcaccgcaacaucaaggaccugaagcucgcguucagcgaguucuaccugucccugauccuccugcagaacuaccagaaccugaacuucaccggguuccggaagauccucaagaagcacgacaagauccuggagacgagccgcggcgccgacuggcggguggcccacgucgagguggcccccuucuacacgugcaagaagaucaaccagcugaucuccgagaccgaggccguggucaccaacgagcucgaggacggggaccgccagaaggcgaugaagcggcugcgcgugcccccgcugggcgccgcccagcccgcccccgccuggaccaccuuccgggugggccucuucugcgggaucuucaucguccugaacaucacccuggugcucgcggccguguucaagcuggagaccgaccgcagcaucuggccccugauccggaucuaccgcggcggguuccuccugaucgaguuccuguuccuccugggcaucaacacguacggguggcggcaggccggcgucaaccacgugcugaucuucgagcucaacccgcgcuccaaccugagccaccagcaccuguucgagaucgccggguuccucggcauccuguggugccugucccuccuggccugcuucuucgcgcccaucagcgugauccccaccuacgucuacccccuggcccucuacggcuucaugguguucuuccugaucaacccgaccaagaccuucuacuacaagucccgguucuggcugcucaagcugcuguuccgcguguucacggcccccuuccacaaggucggguucgccgacuucuggcucgccgaccagcugaacagccuguccgugauccugauggaccucgaguacaugaucugcuucuacagccuggagcugaagugggacgagagcaagggccuccugcccaacaacuccgaggagcgcgggcacagcgacaccaugguguucuucuaccuguggaucgucuucuacaucaucuccagcugcuacacccucaucugggaccugaagauggacuggggccuguucgacaagaacgcgggcgagaacaccuuccuccgggaggagaucguguacccccagaaggccuacuacuacugcgccaucaucgaggacgucauccugcgcuucgccuggacgauccagaucuccaucaccagcaccacccugcucccgcacuccggggacaucaucgcgacgguguucgcgccccuggagguguuccggcgcuucgucuggaacuucuuccggcuggagaacgagcaccucaacaacugcggcgaguuccgcgccgugcgggacaucagcguggcgccccugaacgccgacgaccagacccugcucgagcagaugauggaccaggacgacgggguccgcaaccggcagaagaaccgcuccuggaaguacaaccagagcaucucccugcggcgcccccggcuggccagccaguccaaggcccgcgacaccaaggugcucaucgaggacaccgacgacgaggccaacacguga

SEQ ID NO: 38796 - RNA, 1902 nt, Artificial Sequence
  derived and/or modified sequence opt1 from XRCC1__Homo_sapiens__NP_006288
augcccgagauccgccugcggcacguggucagcugcuccagccaggacuccacccacugcgccgagaaccuccugaaggccgacaccuaccgcaaguggcgggcggccaaggccggcgagaagacgaucagcguggugcugcagcucgagaaggaggagcagauccacuccgucgacaucgggaacgacggcagcgccuucguggaggugcuggucggguccagcgccggcggggcgggcgagcaggacuacgaggugcugcucgugaccuccagcuucauguccccgagcgagucccgcagcggcuccaaccccaaccggguccgcauguucgggcccgacaagcuggugcgggccgccgccgagaagcgcugggaccgggugaagaucgucugcagccagcccuacuccaaggacagcccguucggccuguccuucgugcgcuuccacagcccgcccgacaaggacgaggcggaggcccccagccagaaggugaccgucaccaagcucgggcaguuccgggugaaggaggaggacgaguccgccaacagccugcgccccggcgcccuguucuucucccggaucaacaagacgagccccgugaccgccuccgaccccgcggggcccagcuacgccgccgccacccuccaggccuccagcgcggccuccagcgccuccccggucagccgcgccaucggcuccaccagcaagccccaggagucccccaagggcaagcggaagcuggaccugaaccaggaggagaagaagacgcccagcaagccgcccgcccagcucucccccagcgugcccaagcgcccgaagcugcccgcgcccacccggacccccgccaccgccccggugcccgcccgcgcccagggggcggucacgggcaagccccgcggggagggcaccgagccccggcggccgcgcgccggccccgaggagcuggggaagauccuccagggcgugguggucgugcuguccggguuccagaaccccuuccgcagcgagcugcgggacaaggcccucgagcugggcgccaaguaccgcccggacuggacccgggacagcacccaccugaucugcgcguucgccaacacgcccaaguacucccagguccucgggcugggcggccgcaucgugcggaaggagugggugcuggacugccaccgcaugcggcgccggcuccccagccagcgcuaccugauggccgggcccggcuccagcuccgaggaggacgaggccagccacuccgggggcagcggggacgaggccccgaagcugccccagaagcagccccagaccaagaccaagcccacccaggcggccggcccguccagcccccagaagccgcccacgcccgaggagaccaaggccgccucccccguccuccaggaggacaucgacaucgagggcgugcagagcgaggggcaggacaacggcgccgaggacuccggggacaccgaggacgagcugcggcgcguggcggagcagaaggagcaccggcugccgcccggccaggaggagaacggggaggaccccuacgccggcagcaccgacgagaacacggacuccgaggagcaccaggagccgcccgaccuccccguccccgagcugcccgacuucuuccagggcaagcacuucuuccuguacggggaguuccccggcgacgagcgccggaagcucauccgcuacgugaccgccuucaacggggagcuggaggacuacaugagcgaccgggugcaguucgucaucaccgcccaggagugggaccccuccuucgaggaggcccugauggacaacccgagccucgcguucgugcgcccccgguggaucuacagcugcaacgagaagcagaagcugcugccccaccagcucuacggcguggucccgcaggccuga

SEQ ID NO: 38797 - RNA, 843 nt, Artificial Sequence
  derived and/or modified sequence opt1 from XRCC2__Homo_sapiens__NP_005422
augugcagcgccuuccaccgcgccgaguccggcaccgagcugcucgcgcggcuggaggggcgcagcucccugaaggagaucgagcccaaccucuucgccgacgaggacagcccggugcacggcgacauccuggaguuccacgggcccgagggcaccgggaagacggagaugcuguaccaccucaccgcccggugcauccugcccaaguccgagggcggccuggaggucgaggugcuguucaucgacaccgacuaccacuucgacaugcugcgccuggugaccauccucgagcaccggcugagccaguccagcgaggagaucaucaaguacugccuggggcgcuucuuccucgucuacugcuccagcuccacgcaccuccugcucacccuguacagccuggaguccauguucugcagccaccccucccucugccugcugauccucgacagccuguccgccuucuacuggaucgaccgggugaacggcggggagagcgugaaccugcaggaguccacccuccgcaagugcagccagugccuggagaagcuggucaacgacuaccggcucgugcuguucgccaccacgcagaccaucaugcagaaggcgagcuccagcuccgaggagccgagccacgccucccgccggcugugcgacguggacaucgacuaccgccccuaccucugcaaggccuggcagcagcuggucaagcaccggauguucuucagcaagcaggacgacucccagagcuccaaccaguucagccuggugucccgcugccucaagagcaacucccugaagaagcacuucuucaucaucggcgagagcgggguggaguucugcuga

SEQ ID NO: 38798 - RNA, 1041 nt, Artificial Sequence
  derived and/or modified sequence opt1 from XRCC3__Homo_sapiens__XP_005268103
auggaccuggaccugcuggaccugaacccccgcaucaucgccgccaucaagaaggcgaagcucaagagcgugaaggagguccugcacuucuccggccccgaccugaagcggcucaccaaccugagcucccccgagguguggcaccuccugcgcaccgccagccugcaccuccggggguccagcauccugacggcccugcagcugcaccagcagaaggagcgcuuccccacccagcaccagcggcucucccugggcugccccgugcuggacgcccuccugcgcgggggccugccgcucgacgggaucaccgagcuggccggccggagcuccgcgggcaagacccagcuggcccuccagcugugccuggccguccaguucccccgccagcacgggggccucgaggccggggcgguguacaucugcacggaggacgccuucccccacaagcggcugcagcagcugauggcccagcagccccgccuccggaccgacgugccgggcgagcugcugcagaagcuccgcuucgggagccagaucuucaucgagcacgucgccgacguggacacccugcuggagugcgugaacaagaagguccccgugcuccugucccggggcauggcccgccugguggucaucgacagcguggcggcccccuuccggugcgaguucgacucccaggccagcgcgccccgcgcccggcaccuccagucccugggcgccacccugcgcgagcucagcuccgccuuccagagcccggugcugugcaucaaccaggucacggaggccauggaggagcagggggccgcccacggcccccugggguucugggacgagcgggugucccccgcgcucggcaucaccugggccaaccagcugcuggugcgccuccuggccgaccggcugcgcgaggaggaggccgcccugggcugccccgcgcgcacccuccggguccugagcgccccgcaccucccgcccagcuccugcagcuacaccaucuccgccgagggggugcgcggcacgcccgggacccagagccacuga

SEQ ID NO: 38799 - RNA, 1005 nt, Artificial Sequence
  derived and/or modified sequence opt1 from XRCC4__Homo_sapiens__NP_072044
auggagcgcaagaucagccggauccaccugguguccgagcccagcaucacccacuuccuccaggucuccugggagaagacccuggagagcggcuucgugaucacgcugaccgacgggcacuccgccuggaccggcaccgugagcgaguccgagaucagccaggaggccgacgacauggccauggagaaggggaaguacgucggcgagcuccgcaaggcccugcuguccggggccggcccggccgacguguacacguucaacuucagcaaggaguccugcuacuucuucuucgagaagaaccucaaggacgugagcuuccggcugggcuccuucaaccuggagaaggucgagaaccccgccgaggugauccgcgagcucaucugcuacugccuggacaccaucgcggagaaccaggccaagaacgagcaccuccagaaggagaacgagcggcugcugcgcgacuggaacgacgugcaggggcgguucgagaagugcgucagcgccaaggaggcccuggagaccgaccucuacaagcgcuucauccuggugcugaacgagaagaagaccaagauccggucccuccacaacaagcugcugaacgcggcccaggagcgcgagaaggacaucaagcaggagggcgagacggccaucugcagcgagaugaccgccgaccgggaccccguguacgacgaguccaccgacgaggagagcgagaaccagaccgaccucuccgggcuggccagcgcggccgucagcaaggacgacuccaucaucagcucccuggacgugacggacaucgcccccagccgcaagcggcgccagcggaugcagcgcaaccucggcaccgagccgaagauggcgccccaggagaaccagcugcaggagaaggagaagcccgacuccagccugcccgagaccuccaagaaggagcacaucagcgccgagaacaugucccucgagacccugcggaacagcuccccggaggaccuguucgacgagaucuga

SEQ ID NO: 38800 - RNA, 2199 nt, Artificial Sequence
  derived and/or modified sequence opt1 from XRCC5__Homo_sapiens__NP_066964
auggugcgcagcggcaacaaggccgccgucgugcugugcauggacgugggguucaccauguccaacagcauccccggcaucgaguccccguucgagcaggcgaagaaggucaucaccauguucgugcagcgccagguguucgccgagaacaaggacgagaucgcccucguccuguucgggacggacggcaccgacaacccccugagcgggggcgaccaguaccagaacaucaccgugcaccggcaccucaugcugcccgacuucgaccugcucgaggacaucgaguccaagauccagcccggcagccagcaggccgacuuccuggacgcccugaucguguccauggacgucauccagcacgagaccaucgggaagaaguucgagaagcggcacaucgagaucuucacggaccucagcucccgcuucagcaagucccagcuggacaucaucauccacagccugaagaagugcgacaucucccuccaguucuuccugccguucagccugggcaaggaggacggguccggcgaccgcggggacggccccuuccggcucggcgggcacggccccagcuucccccugaaggggaucaccgagcagcagaaggagggccuggagaucgugaagauggugaugaucucccucgagggcgaggacgggcuggacgagaucuacagcuucuccgagagccugcggaagcucugcgucuucaagaagaucgagcgccacagcauccacuggccgugccggcugaccaucggcuccaaccugagcauccgcaucgcggccuacaaguccauccuccaggagcgggugaagaagaccuggacgguggucgacgccaagacccugaagaaggaggacauccagaaggagaccguguacugccugaacgacgacgacgagaccgaggugcucaaggaggacaucauccagggguuccgcuacggcagcgacaucguccccuucuccaagguggacgaggagcagaugaaguacaagagcgaggggaagugcuucuccgugcugggcuucugcaagagcucccagguccagcggcgcuucuucaugggcaaccaggugcugaagguguucgccgcgcgggacgacgaggccgccgccgucgcccucagcucccugauccacgcgcuggacgaccucgacaugguggccaucguccgcuacgccuacgacaagcgggccaacccccagguggggguggccuucccccacaucaagcacaacuacgagugccuggucuacgugcagcugccguucauggaggaccuccgccaguacauguucagcucccugaagaacagcaagaaguacgcgcccacggaggcccagcugaacgccguggacgcccucaucgacuccaugagccuggccaagaaggacgagaagaccgacacccuggaggaccucuuccccaccacgaagauccccaacccgcgguuccagcgccuguuccagugccugcuccaccgggcgcugcacccccgcgagccccugcccccgauccagcagcacaucuggaacaugcucaacccgcccgccgaggucaccaccaagucccagaucccccugagcaagaucaagacccuguucccccugaucgaggccaagaagaaggaccaggugacggcccaggagaucuuccaggacaaccacgaggacggccccaccgccaagaagcucaagaccgagcagggcggggcgcacuucuccgugagcagccuggccgagggguccgucaccagcgugggcuccgugaaccccgccgagaacuuccgcguccuggugaagcagaagaaggccagcuucgaggaggcguccaaccagcucaucaaccacaucgagcaguuccuggacacgaacgagacccccuacuucaugaaguccaucgacugcauccgggccuuccgcgaggaggccaucaaguucagcgaggagcagcgguucaacaacuuccugaaggcccuccaggagaagguggagaucaagcagcugaaccacuucugggagaucgucgugcaggacggcaucacccugaucaccaaggaggaggccagcggguccagcgugacggcggaggaggccaagaaguuccucgccccgaaggacaagcccuccggcgacaccgccgccgucuucgaggagggcggggacguggacgaccugcuggacaugaucuga

SEQ ID NO: 38801 - RNA, 741 nt, Artificial Sequence
  derived and/or modified sequence opt1 from XRCC6BP1__Homo_sapiens__NP_150592
auggccggcgcccccgacgagcgccggcgcgggccggcggccggcgagcagcugcagcagcagcacgugagcugccaggucuuccccgagcggcucgcccaggggaacccccagcagggcuucuucuccagcuucuucaccuccaaccagaagugccagcugcgccugcucaagacccuggagacgaaccccuacgugaagcugcuccuggacgccaugaagcacagcgggugcgccgugaacaaggaccggcacuucuccugcgaggacugcaacggcaacgucagcggcggguucgacgcguccaccagccagaucgugcugugccagaacaacauccacaaccaggcccacaugaaccgcguggucacccacgagcucauccacgccuucgaccacugccgggcccacguggacugguucaccaacauccgccaccuggcgugcuccgaggugcgggccgccaaccugagcggcgacugcucccucgucaacgagaucuuccgccugcacuucgggcugaagcagcaccaccagacgugcgugcgggaccgcgccacccucagcauccuggccgugcggaacaucuccaaggaggucgcgaagaaggccguggacgagguguucgagagcugcuucaacgaccacgagccguucggccgcaucccccacaacaagaccuacgcccgguacgcccaccgcgacuucgagaaccgggaccgcuacuacuccaacaucuga

SEQ ID NO: 38802 - RNA, 1830 nt, Artificial Sequence
  derived and/or modified sequence opt1 from XRCC6__Homo_sapiens__NP_001275905
augagcggcugggaguccuacuacaagaccgagggggacgaggaggccgaggaggagcaggaggagaaccuggaggccagcggcgacuacaaguacuccgggcgcgacagccucaucuuccugguggacgcguccaaggccauguucgagagccaguccgaggacgagcugacccccuucgacaugagcauccagugcauccaguccgucuacaucagcaagaucaucuccagcgaccgggaccuccuggccgugguguucuacggcacggagaaggacaagaacuccgucaacuucaagaacaucuacgugcugcaggagcucgacaacccgggggccaagcgcauccuggagcuggaccaguucaagggccagcagggccagaagcgguuccaggacaugauggggcacggcagcgacuacucccucagcgaggugcugugggucugcgccaaccuguucuccgacgugcaguucaagaugagccacaagcgcaucaugcuguucaccaacgaggacaacccccacgggaacgacuccgcgaaggccagccgggcccgcaccaaggccggcgaccuccgggacaccgggaucuuccuggaccucaugcaccugaagaagcccggcggcuucgacaucagccuguucuaccgcgacaucaucuccaucgcggaggacgaggaccuccgggugcacuucgaggagagcuccaagcuggaggaccugcuccgcaagguccgggccaaggagacgcgcaagcgggcccugagccgccugaagcucaagcugaacaaggacaucgugaucuccguggggaucuacaaccugguccagaaggcccucaagcccccgcccaucaagcuguaccgggagaccaacgagcccgugaagaccaagacccgcacguucaacaccagcaccggcgggcugcuccugcccuccgacaccaagcggagccagaucuacggcucccgccagaucauccuggagaaggaggagacggaggagcucaagcgguucgacgacccgggccugaugcugaugggguucaagccccucgugcugcugaagaagcaccacuaccuccgccccagccuguucgucuaccccgaggagucccuggugaucggcagcuccacccucuucagcgcccugcugaucaagugccucgagaaggagguggcggcccugugccgguacaccccgcgccgcaacaucccgcccuacuucgucgcccuggugccccaggaggaggagcucgacgaccagaagauccaggugaccccgcccggguuccagcuggucuuccugcccuucgccgacgacaagcggaagaugcccuucacggagaagaucauggccacccccgagcaggucggcaagaugaaggcgaucguggagaagcugcgcuucaccuaccgguccgacagcuucgagaaccccgugcuccagcagcacuuccgcaaccuggaggcccuggcccucgaccugauggagcccgagcaggccguggaccugacccuccccaaggucgaggccaugaacaagcggcuggggucccugguggacgaguucaaggagcucguguacccgcccgacuacaaccccgagggcaaggucacgaagcgcaagcacgacaacgagggcagcggguccaagcggcccaagguggaguacagcgaggaggagcugaagacccacaucagcaagggcacccuggggaaguucaccgugccgaugcucaaggaggcgugccgcgccuacggccugaaguccgggcugaagaagcaggagcuccuggaggcccugacgaagcacuuccaggacuga

SEQ ID NO: 38803 - RNA, 5085 nt, Artificial Sequence
  derived and/or modified sequence opt1 from XRN1__Homo_sapiens__NP_001269786
augggggugcccaaguucuaccgguggaucagcgagcgguacccgugccuguccgagguggugaaggagcaccagauccccgaguucgacaaccuguaccuggacaugaacgggaucauccaccagugcagccaccccaacgacgacgacgugcacuuccgcaucuccgacgacaagaucuucacggacaucuuccacuaccuggagguccuguuccggaucaucaagccccgcaagguguucuucauggccguggacggcgucgccccgcgggcgaagaugaaccagcagcgcgggcggcgcuuccggagcgccaaggaggccgaggacaagaucaagaaggccaucgagaagggcgagacccugcccacggaggcccgcuucgacuccaacugcaucacccccgggaccgaguucauggcccggcugcacgagcaccucaaguacuucgugaacaugaagaucagcaccgacaaguccuggcagggcgugacgaucuacuucagcggccacgagacccccggggagggcgagcacaagaucauggaguucauccgcuccgagaaggccaagccggaccacgaccccaacacccggcacugccuguacgggcuggacgccgaccucaucaugcugggccugaccagccacgaggcccacuucucccuccugcgcgaggagguccgguucgggggcaagaagacgcagcgcgugugcgcgcccgaggagaccaccuuccaccuccugcaccugagccugaugcgggaguacaucgacuacgaguucuccgugcucaaggagaagaucaccuucaaguacgacaucgagcgcaucaucgacgacuggauccugaugggcuuccuggucgggaacgacuucaucccccaccucccgcaccuccacaucaaccacgacgcccugccccuccuguacggcacguacgugaccauccugcccgagcucgggggcuacaucaacgagagcggccaccugaaccugccccgguucgagaaguaccucgugaagcuguccgacuucgaccgcgagcacuucagcgaggucuucguggaccugaagugguucgaguccaagguggggaacaaguaccucaacgaggccgccggcgucgccgcggaggaggcccggaacuacaaggagaagaagaagcugaaggggcaggagaacagccugugcuggaccgcccucgacaagaacgagggcgagaugaucaccuccaaggacaaccuggaggacgagacggaggacgacgaccuguucgagaccgaguuccgccaguacaagcgcaccuacuacaugaccaagauggggguggacguggucagcgacgacuuccucgccgaccaggccgcgugcuacgugcaggccauccaguggauccugcacuacuacuaccacggcgugcagagcugguccugguacuacccguaccacuacgcccccuuccugagcgacauccacaacaucuccacgcucaagauccacuucgagcugggcaagcccuucaagcccuucgagcagcugcucgccguccugccggccgcgagcaagaaccugcuccccgccugcuaccagcaccugaugaccaacgaggacucccccaucaucgaguacuacccgcccgacuucaagaccgaccugaacgggaagcagcaggagugggaggccgugguccugauccccuucaucgacgagaagcggcuccuggaggccauggagaccugcaaccacagccugaagaaggaggagcgcaagcggaaccagcacuccgagugccucaugugcugguacgaccgcgacacggaguucaucuaccccagccccuggccggagaaguuccccgccaucgagcggugcugcacccgcuacaagaucaucucccuggacgcguggcggguggacaucaacaagaacaagaucacccgcaucgaccagaaggcccuguacuucugcggcuuccccacccucaagcacauccggcacaaguucuuccugaagaaguccggggugcaggucuuccagcaguccagccgcggcgagaacaugaugcuggagauccucguggacgccgaguccgacgagcugacgguggagaacgucgccagcuccgugcugggcaagagcguguucgucaacuggccgcaccucgaggaggcgcgggugguggccgucuccgacggcgagaccaaguucuaccuggaggagccgcccggcacccagaagcuguacagcgggcgcaccgcgccgcccuccaagguggugcaccucggcgacaaggagcagagcaacugggccaaggagguccaggggaucagcgagcacuaccugcggcgcaagggcaucaucaucaacgagacguccgccgugguguacgcgcagcugcucaccgggcggaaguaccagaucaaccagaacggcgagguccgccuggagaagcaguggagcaagcaggucgugcccuucgucuaccagaccaucgugaaggacauccgggccuucgacucccgcuucagcaacaucaagacccuggacgaccucuucccccugcgguccaugguguucaugcugggcacgcccuacuacgggugcaccggcgagguccaggacagcggggacgugaucaccgagggccgcauccgcgugaucuucuccauccccugcgagcccaaccucgacgcccugauccagaaccagcacaaguacagcaucaaguacaaccccggcuacguccuggccucccggcucggggugagcggcuaccuggugucccgcuucaccgggagcaucuucaucggccgggggucccgccggaacccccacggcgaccacaaggccaacgucggccugaaccucaaguucaacaagaagaacgaggaggugcccggguacaccaagaaggugggcagcgaguggauguacuccagcgcggccgagcagcugcuggccgaguaccucgagcgcgcccccgagcuguucuccuacaucgccaagaacagccaggaggacgucuucuacgaggacgacaucuggcccggggagaacgagaacggcgcggagaaggugcaggagaucaucacguggcugaaggggcaccccgugagcacccucucccggagcuccugcgaccugcagauccuggacgccgccaucgucgagaagaucgaggaggagguggagaagugcaagcagcgcaagaacaacaagaaggugcgggucaccgugaagccgcaccuccuguaccgcccccuggagcagcagcacggcgugauccccgaccgggacgccgaguucugccucuucgaccgcgucgugaacgugcgggagaacuucagcguccccgugggccugcgcgggaccaucaucggcaucaagggggcgaaccgggaggccgacgugcuguucgagguccucuucgacgaggaguucccgggcgggcugacgauccgcugcucccccggccggggcuaccgccugcccaccagcgcccucgugaaccugucccacgggagccgguccgagaccggcaaccagaagcugaccgccaucgugaagccccagccggccguccaccagcacagcuccagcuccagcguguccagcgggcaccucggcgcgcugaaccacagcccccagagccuguucguccccacccaggugccgaccaaggacgacgacgaguucugcaacaucuggcagucccuccaggggagcggcaagaugcaguacuuccagcccaccauccaggagaagggcgccgugcugccccaggagaucagccaggucaaccagcaccacaaguccggguucaacgacaacagcgugaaguaccagcagcgcaagcacgacccccaccggaaguucaaggaggagugcaaguccccgaaggccgagugcuggagccagaagauguccaacaagcagcccaacagcggcaucgagaacuuccuggccucccucaacaucagcaaggagaacgaggugcaguccagccaccacggggagccgcccuccgaggagcaccugagcccgcaguccuucgccaugaagggcacccgcaugcugaaggagauccucaagaucgacggcagcaacacggucgaccacaagaacgagaucaagcagaucgcgaacgagauccccguguccagcaaccgccgggacgaguacgggcugcccucccagcccaagcagaacaagaagcuggccagcuacaugaacaagccgcacuccgccaacgaguaccacaacgugcagagcauggacaacaugugcuggcccgcccccagccagaucccgcccgucuccacccccgugaccgagcucagccgcaucugcucccuggugggcaugccccagcccgacuucagcuuccugcggaugccgcagaccaugacggucugccaggugaagcucuccaacgggcugcuggugcacggcccccagugccacagcgagaacgaggccaaggagaaggcggcccucuucgcccugcagcagcuggggucccucggcaugaacuucccccugcccagccaggucuucgccaacuacccguccgcggugccgcccggcaccaucccgcccgccuucccgccgcccaccgccaacaucaugcccagcuccagccaccuguucggguccaugcccuggggccccagcgugcccguccccgggaagcccuuccaccacacccucuacuccggcacgaugcccauggccgggggcauccccggcggggugcacaaccaguucaucccccuccaggugaccaagaagcgcgucgccaacaagaagaacuucgagaacaaggaggcgcagagcucccaggccacccccgugcagaccagccagcccgacuccagcaacaucgugaaggucagcccgcgggaguccagcuccgccagccugaaguccagccccaucgcccagcccgccuccagcuuccagguggagacggcgucccagggccacagcaucucccaccacaagagcacccccaucuccagcucccgccgcaagagccgcaagcucgccgugaacuucggggucuccaagccgagcgaguga

SEQ ID NO: 38804 - RNA, 2853 nt, Artificial Sequence
  derived and/or modified sequence opt1 from XRN2__Homo_sapiens__NP_036387
augggcgugcccgccuucuuccgcuggcugagccggaaguaccccuccaucaucgucaacugcguggaggagaagcccaaggagugcaacggggugaagauccccgucgacgccagcaagcccaacccgaacgacguggaguucgacaaccucuaccuggacaugaacggcaucauccaccccugcacccaccccgaggacaagcccgcgccgaagaacgaggacgagaugaugguggccaucuucgaguacaucgaccgccuguucuccaucguccggccccgccggcuccuguacauggccaucgacgggguggcgccccgcgccaagaugaaccagcagcggagccgccgguuccgcgccuccaaggagggcauggaggccgccguggagaagcagcggguccgcgaggagauccuggccaagggcggguuccugcccccggaggagaucaaggagcgguucgacagcaacugcaucacccccggcacggaguucauggacaaccuggcgaagugccugcgcuacuacaucgccgaccggcucaacaacgaccccggguggaagaaccugaccgugauccuguccgacgccagcgcccccggcgagggggagcacaagaucauggacuacauccgccggcagcgcgcccagccgaaccacgaccccaacacccaccacugccucugcggcgcggacgccgaccugaucaugcuggggcucgccacccacgagcccaacuucacgaucauccgggaggaguucaagcccaacaagccgaagcccugcggccugugcaaccaguucggccacgaggugaaggacugcgaggggcugccccgcgagaagaagggcaagcacgacgagcucgccgacucccugcccugcgccgagggggaguucaucuuccugcggcucaacguccugcgcgaguaccuggagcgcgagcucaccauggcgagccugccguucaccuucgacguggagcgguccaucgacgacuggguguucaugugcuucuucgucggcaacgacuuccugccccaccuccccagccuggagauccgcgagaacgccaucgaccggcuggugaacaucuacaagaacgugguccacaagaccggcggguaccucacggaguccggcuacgugaaccugcagcgcgugcagaugaucaugcuggccgucggggagguggaggacagcaucuucaagaagcggaaggacgacgaggacuccuuccgccggcgccagaaggagaagcggaagcgcaugaagcgggaccagcccgccuucaccccgagcggcauccucacgccccacgcccuggggucccgcaacagccccggcucccagguggcgagcaacccgcggcaggccgccuacgagaugcgcaugcagaacaacagcucccccagcaucucccccaacaccagcuucaccuccgacggcagccccuccccgcucgggggcaucaagcggaaggccgaggacagcgacuccgagcccgagcccgaggacaacguccgccucugggaggccggguggaagcagcgguacuacaagaacaaguucgacguggacgcggccgacgagaaguuccgccggaaggucgugcagagcuacguggagggccugugcuggguccugcgcuacuacuaccaggggugcgccuccuggaagugguacuaccccuuccacuacgccccguucgcgagcgacuucgagggcaucgccgacaugcccuccgacuucgagaagggcaccaagcccuucaagccccucgagcagcugauggggguguucccggccgccagcggcaacuuccugccgcccuccuggcgcaagcucaugagcgaccccgacuccagcaucaucgacuucuaccccgaggacuucgccaucgaccugaacgggaagaaguacgcguggcagggcguggcccugcuccccuucgucgacgagcggcgccugcgggccgcccuggaggagguguaccccgaccucacccccgaggagacccgccggaacucccucgggggcgacgugcuguucgucggcaagcaccacccgcugcacgacuucauccuggagcuguaccagacggggagcaccgagcccguggaggugccgcccgagcugugccacggcauccaggggaaguucagccucgacgaggaggccauccugcccgaccagaucgucugcucccccgugcccaugcugcgcgaccucacccagaacaccguggucagcaucaacuucaaggacccgcaguucgcggaggacuacaucuucaaggccgugaugcugcccggcgcccggaagcccgccgccgugcugaagcccuccgacugggagaaguccagcaacggccgccaguggaagccgcagcucggguucaaccgggaccgccggcccguccaccuggaccaggcggccuuccgcacgcugggccacgugaugccccgggggagcggcaccgggaucuacuccaacgccgcgcccccgcccgugaccuaccagggcaaccucuaccgcccccugcugcggggccaggcccagauccccaagcucaugagcaacaugcgcccgcaggacuccuggcgggggcccccgccccuguuccagcagcagcgcuucgaccggggcgucggggccgagccccugcuccccuggaaccgcaugcugcagacccagaacgccgccuuccagcccaaccaguaccagaugcuggccggccccgggggcuacccgccccggcgcgacgaccgcggcgggcggcagggcuacccccgcgaggggcggaaguacccccucccgccgcccagcggccgcuacaacuggaacuga

SEQ ID NO: 38805 - RNA, 1797 nt, Artificial Sequence
  derived and/or modified sequence opt1 from XRRA1__Homo_sapiens__NP_001257309
auggccuucagcggcaucuacaagcuggacgacgggaagcccuaccucaacaacugcuucccggcccgcaaccugcugcgggugcccgaggagggccaggggcacuggcucgucgugcagaagggcaaccugaagaagaagcccaaggggcuggugggcgcgcaggccgagcgccgggagucccucaaggccaccagcuucgaguucaagggcaagaaggagucccgccgggagaaccaggucgaccugcccgggcacauccuggaccaggccuuccuccugaagcaccacugcgugcgcaagccgagcgaccugugcaccaucaacgccaaggagaacgacuucaagcacuuccacuccgugaucuacaucaacgcgagcgagaaccuccugccccuggaggccuuccacacguuccccgcccucaaggagcuggaccuggccuucaacggcaucaagaccaucuacgucaaguacggggacuucaagcuccuggaguuccuggaccucuccuucaacagccugaccguggaggcgaucugcgaccugggcauccucccccaccuccgggugcugcuccugaccgggaacggccugacgucccucccgcccaaccuggccgucgccgagcaggaggccagcgugaccucccugaccagcaagcgcuacauccuccgguuccccgcccuggagacccugaugcucgacgacaaccgccuguccaaccccagcugcuucgcgucccuggccggccuccggcgccugaagaagcugagccucgacgagaaccggaucauccgcaucccguaccugcagcagguccagcuguacgacgaguccguggacuggaacgggggccgggggagcccccacaaggagccccaguucaugcuccaguccaagccccgcaugcuggaggacagcgacgagcagcuggacuacacggugcucccgaugaagaaggacguggaccggaccggcgucccgccccugcucaagagcuuccugcaggagcgccugggcauccaccugauccggcgcaagaucgugaagcccaagcaccacgugcugaugucccggaaggagagcuggaaggucaaguccgagauccccaaggugcccaagcagccccucgugcugcaccacccccgcaugaccaccaccaagagcccguccaaggacaugcuggagcccgaggccgagcucgccgaggaccugcccacgaccaagagcaccuccgucgagagcgagaugcccacggagaaccuggaggggcacuccccgagcugccgcaccuucgugccccugcccccgaucugcuccaacagcaccgugcacuccgaggagacccugagccaccuguccgacacgaccguccggcucagccccgagcgccccuccgacgaggacagcaaguccaccgagagcaucuuccugacccaggugagcgagcugcccuccagcgucauccacaaggacgaccucgagcugaaggagaaggaccagaagaagccgcccacggcgccccgggaggugaagggcacccgccggaagcugcccaccgccuuccucccguccaaguaccacggguacgaggagcugcugaccgccaagcccgaccccgccuucaucgagcccaagggcauccagaagaacgcccaggcccuccagcagaugcugaagcacccgcugcucugccacagcuccaagcccaagcuggacacgcugcagaagcccuacgugcacaaggagaagcgcguccucagcugcaccuccgggcagaacggcggcugguga

SEQ ID NO: 38806 - RNA, 1182 nt, Artificial Sequence
  derived and/or modified sequence opt1 from XXYLT1__Homo_sapiens__NP_689744
augggccugcuccgcgggggccugcccugcgcccgggccauggcgcgccugggggccgugcggagccacuacugcgcccuccugcuggccgccgcgcucgccgucugcgccuucuacuaccugggcuccgggcgcgagaccuucagcuccgccaccaagcggcugaaggaggcgcgcgccggcgccccggccgcccccagcccgcccgcgcucgagcuggcccggggcuccguggcccccgcccccggggccaaggccaagagccuggagggcgggggcgcggggcccguggacuaccaccuccugaugauguucacgaaggccgagcacaacgccgcccugcaggcgaaggcccgcgucgcccuccggucccugcugcgccucgccaaguucgaggcccacgaggugcugaaccugcacuucgugagcgaggaggcgucccgggaggucgccaagggccuccugcgcgagcugcugcccccggccgccggcuucaagugcaaggugaucuuccacgacguggcgguccucaccgacaagcuguuccccaucguggaggccaugcagaagcacuucagcgccgggcucggcaccuacuacuccgacagcaucuucuuccuguccguggccaugcaccagaucaugcccaaggagauccugcagaucauccagcucgaccuggaccugaaguucaagaccaacauccgggagcuguucgaggaguucgacagcuuccuccccggggccaucaucggcaucgcgcgcgagaugcagccggucuaccggcacacguucuggcaguuccgccacgagaacccccagacccgggugggcgggcccccgcccgagggccugcccggguucaacuccggcgugaugcuccugaaccuggaggccaugcgccagagcccccucuacucccggcugcuggagcccgcccagguccagcagcucgccgacaaguaccacuuccgcgggcaccugggcgaccaggacuucuucaccaugaucggcauggagcacccgaagcuguuccacgugcucgacugcaccuggaaccggcagcugugcacgugguggcgcgaccacggguacagcgacguguucgaggccuacuuccgcugcgagggccacgucaagaucuaccacgggaacugcaacacccccauccccgaggacuga

SEQ ID NO: 38807 - RNA, 1611 nt, Artificial Sequence
  derived and/or modified sequence opt1 from XYLB__Homo_sapiens__NP_005099
auggccgagcacgcgccccgccggugcugccugggcugggacuucagcacccagcaggucaaggugguggccguggacgccgagcucaacgucuucuacgaggaguccgugcacuucgaccgcgaccugcccgaguucgggacccagggcggggugcacguccacaaggacggccugacggugaccagccccgugcucauguggguccaggcccuggacaucauccuggagaagaugaaggccuccggguucgacuucagccaggugcucgcccuguccggcgcgggccagcagcacgggagcaucuacuggaaggccggcgcccagcaggcccugaccucccucagccccgaccugcggcugcaccagcagcuccaggacugcuucuccaucagcgacugccccguguggauggacuccagcaccacggcgcagugccgccagcuggaggccgccgucgggggcgcccaggcccuguccugccucaccgggagccgggcguacgagcgcuucaccggcaaccagaucgccaagaucuaccagcagaacccggaggccuacucccacaccgagcggaucagccugguguccagcuucgccgccucccuguuccucggcagcuacagccccaucgacuacuccgacgggagcggcaugaaccugcugcagauccaggacaagguguggucccaggcgugccucggggccugcgcgccccaccuggaggagaagcugagcccgcccguccccuccugcagcguggugggcgccaucuccagcuacuacguccagcgcuacggcuucccgcccgggugcaaggugguggccuucacgggcgacaaccccgccucccucgccgggaugcggcuggaggagggcgacaucgccgucagccuggggaccuccgacacccucuuccuguggcugcaggagcccaugcccgcccucgagggccacaucuucugcaaccccguggacagccagcacuacauggcccugcugugcuucaagaacggcucccucaugcgcgagaagauccggaacgagagcgugucccgcagcugguccgacuucagcaaggcgcugcaguccaccgagauggggaacggcgggaaccugggcuucuacuucgacgucauggagaucacgccggagaucaucgggcggcaccgcuucaacaccgagaaccacaagguggccgccuuccccggcgacgucgaggugcgggcccucaucgagggccaguucauggcgaagcgcauccacgccgaggggcugggcuaccgggugaugagcaagaccaagauccuggccaccgggggcgccagccacaaccgcgagauccuccagguccuggccgacguguucgacgcgcccguguacgucaucgacacggccaacuccgccugcguggggagcgccuaccgggccuuccacggccuggcgggcgggaccgacgugcccuucuccgaggucgugaagcucgccccgaacccccgccuggccgccacccccagccccggcgccucccagguguacgaggcgcugcucccgcaguacgccaagcuggagcagcggauccugagccagacccgcgggccgcccgaguga

SEQ ID NO: 38808 - RNA, 2880 nt, Artificial Sequence
  derived and/or modified sequence opt1 from XYLT1__Homo_sapiens__NP_071449
augguggccgcccccugcgcgcgccggcuggcccgccggagccacuccgcccuccuggccgcccugaccguccuccugcugcagacccucgugguguggaacuucagcucccuggacagcggcgcgggggagcgccggggcggggccgccgucggcgggggcgagcagccgccgcccgcccccgcgccgcgccgggagcgccgggaccugcccgccgagcccgccgccgcccgcggcgggggcgggggcgggggcggcgggggcgggggccggggcccccaggcgcgcgcccgcgggggcgggccgggcgagccccgggggcagcagcccgccucccggggcgcccuccccgcccgcgcgcuggacccgcaccccagcccccugaucacgcucgagacccaggacggcuacuucucccaccggcccaaggagaaggugcgcaccgacagcaacaacgagaacuccgugccgaaggacuucgagaacgucgacaacagcaacuucgcgccccggacccagaagcagaagcaccagcccgagcuggccaagaagcccccgucccgccagaaggagcugcucaagcggaagcuggagcagcaggagaaggggaagggccacacguuccccgggaagggccccggggaggugcugcccccgggcgaccgcgccgccgcgaacagcucccacggcaaggacgugagccgcccgccccacgcccggaagaccgggggcuccagccccgagaccaaguacgaccagccgcccaagugcgacaucuccgggaaggaggccaucagcgcccucucccgcgccaagagcaagcacugccggcaggagaucggcgagaccuacugccgccacaagcuggggcugcucaugcccgagaaggucacgcgguucugcccccuggagggcaaggcgaacaagaacgugcagugggacgaggacagcguggaguacaugcccgccaaccccguccgcaucgccuucgugcuggugguccacggccgggccucccgccagcuccagcggauguucaaggcgaucuaccacaaggaccacuucuacuacauccacguggacaagcgcagcaacuaccugcaccgccaggugcugcaggucucccggcaguacagcaacgugcgggugacccccuggcgcauggccaccaucuggggcggggccucccuccugagcaccuaccugcaguccaugcgggaccuccuggagaugacggacuggccgugggacuucuucaucaaccugagcgccgccgacuaccccauccgcaccaacgaccagcucgucgcguuccugucccgguaccgcgacaugaacuuccucaagagccacgggcgggacaacgcccgcuucauccgcaagcagggccuggaccggcuguuccuggagugcgacgcccacauguggcgccucggcgaccggcgcauccccgaggggaucgccguggacggcggguccgacugguuccugcugaaccggcgcuucguggaguacgucaccuucagcaccgacgaccucgugacgaagaugaagcaguucuacuccuacacccugcugcccgccgagagcuucuuccacaccguccucgagaacuccccgcacugcgacaccaugguggacaacaaccugcggaucacgaacuggaaccgcaagcugggcugcaagugccaguacaagcacaucguggacuggugcgggugcagccccaacgacuucaagccccaggacuuccaccgguuccagcagaccgcgcgccccaccuucuucgcccggaaguucgaggccgucgugaaccaggagaucaucggccagcucgacuacuaccuguacggcaacuacccggccgggacccccggccugcgcuccuacugggagaacguguacgacgagcccgacgggauccacagccuguccgacgucacgcucacccuguaccacagcuucgcccggcugggccuccgccgggcggagaccagccugcacaccgacggggagaacuccugccgcuacuaccccaugggccacccggccagcgugcaccuguacuuccucgccgaccgguuccagggcuuccugaucaagcaccacgccacgaaccuggcgguguccaagcucgagacccuggagaccugggucaugcccaagaagguguucaagaucgccagcccgcccuccgacuucgggcgccugcaguucagcgaggugggcaccgacugggacgccaaggagcgccucuuccggaacuucgggggccugcuggggcccauggacgagcccgucggcaugcagaaguggggcaaggggcccaacgugacggugaccgucaucuggguggaccccgugaacgucaucgccgccaccuacgacauccucaucgaguccaccgcggaguucacgcacuacaagccgccccugaaccugccccuccggccgggcguguggaccgugaagauccugcaccacuggguccccguggccgagaccaaguuccugguggcgccccucaccuucagcaaccgccagcccaucaagccggaggaggcccugaagcugcacaacgggccccuccgcaacgccuacauggagcaguccuuccagagccugaaccccguccugucccuccccaucaacccggcccagguggagcaggcccggcgcaacgccgccagcaccggcacggcccuggagggguggcuggacucccucgugggcggcauguggaccgccauggacaucugcgccaccgggcccaccgccugccccgucaugcagacgugcagccagaccgccugguccagcuucucccccgaccccaagagcgagcugggcgcggugaagcccgacgggcggcugcgcuga

SEQ ID NO: 38809 - RNA, 2598 nt, Artificial Sequence
  derived and/or modified sequence opt1 from XYLT2__Homo_sapiens__NP_071450
augguggccagcgcccgcguccagaagcuggugcggcgcuacaagcucgcgaucgccaccgcccuggccauccugcuccugcagggccugguggucugguccuucagcgggcucgaggaggacgaggccggcgagaaggggcggcagcgcaagccccggccgcuggaccccggcgagggguccaaggacaccgacagcuccgcgggccgccggggcagcacggggcgccggcacggccgcuggcgggggcgcgccgagucccccggcgugcccguggccaaggucgugcgggccgugaccagccgccagcgggcgucccgccgggucccgcccgcgcccccgcccgaggcccccgggcgccagaaccugagcggcgccgccgccggcgaggcccucgugggggccgccggcuucccgccccacggggacaccggcuccguggagggcgccccgcagcccaccgacaacggguucacgcccaagugcgagaucgucggcaaggacgcgcugagcgcccuggcccgggccuccaccaagcagugccagcaggagaucgccaacguggugugccuccaccaggcggggagccugaugcccaaggccgucccgcgccacugccagcugaccggcaagaugucccccgggauccagugggacgagagccaggcccagcagcccauggacgggcccccggugcggaucgccuacaugcucgugguccacggccgcgccauccgccagcugaagcggcugcucaaggcgguguaccacgagcagcacuucuucuacauccacguggacaagcgcuccgacuaccugcaccgggaggucguggagcuggcccagggcuacgacaacgugcgcgucacccccuggcggauggugacgaucuggggcggggccagccuccugcgcauguaccugcgguccaugcgcgaccuccuggagguccccggcugggccugggacuucuucaucaaccugagcgcgaccgacuaccccacccggaccaacgaggagcucguggccuuccugagcaagaaccgcgacaagaacuuccugaagucccacgggcgggacaacagccgcuucaucaagaagcagggccucgaccggcuguuccacgagugcgacucccacauguggcgccugggcgagcggcagaucccggccgggaucguggucgacggcgggagcgacugguucgugcucacgcgcuccuucguggaguacgucguguacaccgacgacccccugguggcccagcugcggcaguucuacaccuacacccuccugcccgccgagagcuucuuccacacgguccuggagaacucccucgcgugcgagacccugguggacaacaaccugcgcgugaccaacuggaaccggaagcucggcugcaagugccaguacaagcacaucgucgacuggugcgggugcagccccaacgacuucaagccgcaggacuuccugcgccugcagcaggucucccgccccaccuucuucgcccggaaguucgagagcacggugaaccaggaggugcucgagauccuggacuuccaccuguacggcuccuacccgcccggcacccccgcccucaaggccuacugggagaacaccuacgacgccgcggacgggcccagcggccuguccgacgugaugcugaccgccuacacggccuucgcccgccugagccuccaccacgccgcgaccgccgccccgcccauggggacgccccugugccgguucgagccccgcggccugcccuccagcgugcaccucuacuucuacgacgaccacuuccagggcuaccuggucacccaggccgugcagcccuccgcgcaggggcccgccgagacccuggagauguggcucaugccccagggcagccugaagcugcucgggcgguccgaccaggccagccgccugcagagccuggaggugggcaccgacugggaccccaaggagcgccucuuccggaacuucgggggccugcugggcccgcucgacgagcccgucgccgugcagcggugggcccgcgggcccaaccugaccgcgaccguggucuggaucgaccccacguacgugguggccaccuccuacgacaucaccgucgacaccgagacggaggugacccaguacaagccgccccugagccggccccuccgccccggcccguggaccgugcggcugcugcaguucugggagccccucggggagacccgcuuccugguccugccccucaccuucaaccggaagcugccccugcgcaaggacgacgccuccuggcuccacgccggcccgccccacaacgaguacauggagcagagcuuccaggggcuguccagcauccugaaccucccccagccggagcuggccgaggaggcggcccagcggcacacgcagcugaccggccccgcccucgaggccuggaccgaccgcgagcuguccagcuucugguccguggccggccugugcgcgaucgggcccagccccugcccgucccucgagcccugccggcugaccagcugguccagccugucccccgaccccaagagcgagcucggcccggugaaggccgacgggcgccugcgguga

SEQ ID NO: 38810 - RNA, 621 nt, Artificial Sequence
  derived and/or modified sequence opt1 from YAE1D1__Homo_sapiens__NP_001269375
augagcugggugcaggccgccucccugauccagggccccggggacaagggcgacgucuucgacgaggaggcggacgagagccuccuggcccagcgcgaguggcaguccaacaugcagcggcgcgugaaggagggguaccgggacggcaucgacgccgggaaggccgugacccugcagcagggcuucaaccagggcuacaagaagggggccgaggucauccucaacuacggccgccugcgggggacccugcgcaacagcacggacuggucccuccugggccugcgggcgccccuccgcagccccgagguggggacccagcugcugccccggccccucccggugcccggccacauggccuccggcgccacccccaagcagcccaccgagcuggaggccacgcugcucagccuggucccgcaguccgggcgcgcgacgccccgguuccccgcccgccugcgggcccccggcccggggacccccagccaccgccggcgcuuccggcgcaagccccaccgggaccccgccgccgcgugcccggccuggccgcccgaggcccccuccaacagcgagacccacuucuccaccuacaaccgcaucaucauccggggcggccacaucuga

SEQ ID NO: 38811 - RNA, 1515 nt, Artificial Sequence
  derived and/or modified sequence opt1 from YAP1__Homo_sapiens__NP_001123617
auggaccccggccagcagccgccgccccagcccgccccgcaggggcagggccagccgcccagccagccgccccaggggcagggcccgcccuccgggcccggccagcccgcccccgcggccacccaggccgcgccccaggccccgcccgccggccaccagaucgugcacguccgcggggacagcgagaccgaccuggaggcccucuucaacgccgugaugaaccccaagacggccaacgugccccagaccguccccaugcggcugcgcaagcugcccgacuccuucuucaagccgcccgagcccaagagccacucccggcaggcgagcaccgacgccggcaccgccggggcccucacgccccagcacgugcgcgcccacuccagccccgcgucccugcagcugggcgccgugagccccgggacccucacccccaccggcgucguguccggcccggccgccacgcccaccgcccagcaccuccggcagagcuccuucgagauccccgacgacgugccccugcccgcggggugggagauggccaagaccagcuccggccagcgcuacuuccugaaccacaucgaccagaccacgaccuggcaggacccccggaaggccaugcugagccagaugaacgucaccgcccccaccuccccgcccgugcagcagaacaugaugaacagcgccuccgggccccugcccgacggcugggagcaggcgaugacgcaggacggcgagaucuacuacaucaaccacaagaacaagaccaccagcuggcucgacccgcgccuggacccccgguucgccaugaaccagcgcaucagccaguccgcccccgugaagcagcccccgccccuggcgccccagagcccccagggcggggucaugggcggguccaacagcaaccagcagcagcagaugcggcuccagcagcugcagauggagaaggagcgccugcggcucaagcagcaggagcugcugcgccaggccaugcggaacaucaacccguccaccgccaacagccccaagugccaggagcucgcccugcgcucccagcugcccacgcucgagcaggacgggggcacccagaaccccgugagcuccccgggcaugagccaggagcugcggaccaugaccacgaacuccagcgaccccuuccugaacuccgggaccuaccacagccgcgacgaguccaccgacagcggccucuccaugagcuccuacagcgugccccggacccccgacgacuuccugaacagcgucgacgagauggacacgggggacaccaucaaccaguccacccugccgagccagcagaaccgcuuccccgacuaccucgaggccauccccggcaccaacguggaccuggggacgcuggagggcgacggcaugaacaucgagggggaggagcucaugccgucccugcaggaggcccugagcuccgacauccucaacgacauggagagcgugcuggcggccaccaagcuggacaaggaguccuuccucaccuggcuguga

SEQ ID NO: 38812 - RNA, 1434 nt, Artificial Sequence
  derived and/or modified sequence opt1 from YARS2__Homo_sapiens__NP_001035526
auggccgcccccauccugcgcagcuucuccuggggccgguggagcgggacccucaaccuguccgugcugcucccgcugggccugcgcaaggcgcacagcggggcccagggccuccuggccgcccagaaggcccgggggcuguucaaggacuucuuccccgagaccggcacgaagaucgagcuccccgagcuguucgaccgcggcaccgcguccuucccccagaccaucuacugcggguucgacccgaccgccgacagccugcacgucggccaccuccuggcccugcucgggcuguuccaccuccagcgggccggccacaacgugaucgcgcuggucgggggcgccacggcccgccugggcgaccccuccgggcggaccaaggagcgcgaggcccuggagaccgagcgggugcgcgccaacgcgcgggcccuccgccugggccuggaggcccucgccgccaaccaccagcagcuguucaccgacgggcggagcuggggcuccuucacggugcuggacaacagcgcgugguaccagaagcagcaccucguggacuuccuggccgccgucggcgggcacuuccgcaugggcacccugcucucccggcagagcgugcagcugcgccugaagucccccgaggggaugagccucgccgaguucuucuaccaggugcugcaggccuacgacuucuacuaccuguuccagcgguacggcugccgcguccagcucgggggcuccgaccagcugggcaacaucaugagcggguacgaguucaucaacaagcugaccggcgaggacguguucgggaucaccgugccccucaucacguccaccaccggcgcgaagcugggcaagagcgccgggaacgccgucuggcugaaccgggacaagaccuccccguucgagcucuaccaguucuucgugcgccagcccgacgacagcguggagcgguaccugaagcuguucacguuccucccccugcccgagaucgaccacaucaugcagcugcacgucaaggagccggagcgccgcggcccccagaagcggcucgccgccgaggugaccaagcuggugcacgggcgcgagggccuggacagcgcgaagcggugcacccaggcccuguaccacuccagcaucgacgcccucgaggucauguccgaccaggagcugaaggagcuguucaaggaggcccccuucagcgaguucuuccucgaccccgggaccuccgugcuggacacgugccgcaaggcgaacgccaucccggacggcccccggggguaccgcaugaucaccgagggcggcgugagcaucaaccaccagcaggucaccaaccccgaguccgugcugaucguggggcagcacauccucaagaacggccugagccugcucaagaucgggaagcggaacuucuacaucaucaaguggcugcagcuguga

SEQ ID NO: 38813 - RNA, 1095 nt, Artificial Sequence
  derived and/or modified sequence opt1 from YBX2__Homo_sapiens__NP_057066
augagcgagguggaggccgccgcgggcgccaccgccguccccgccgccaccgugccggcgacggccgccgggguggucgccguggugguccccgugcccgcgggcgagccccagaagggcggcggggccgggggcgggggcggggccgccuccggcccggccgcggggacccccagcgcccccggcucccgcacccccggcaacccggccaccgccgugagcgggacgcccgccccgcccgcgcggucccaggccgacaagcccguccuggccauccaggugcucggcaccgugaagugguucaacguccgcaacggguacggcuucaucaaccggaacgacaccaaggaggacguguucgugcaccagaccgccaucaagcgcaacaacccccggaaguuccugcgcagcgucggcgacggggagacgguggaguucgacguggucgagggcgagaagggggccgaggcgaccaacgugaccggccccgggggcgugcccgucaagggcucccgguacgccccgaaccgccgcaagagccggcgguucaucccccgcccgcccuccguggcgcccccgcccaugguggccgagauccccagcgccgggaccggccccggguccaagggcgagcgggccgaggacagcgggcagcgcccccggcgcuggugcccgccgcccuucuucuaccggcgccgguucguccgcggcccccggccgcccaaccagcagcagcccaucgagggcacggaccgcguggagcccaaggagaccgcgccccuggaggggcaccagcagcagggcgacgagcgcgugcccccgccccgguuccgcccccgguaccgccggcccuuccgcccccggccccgccagcagcccaccaccgagggcggggacggggagacgaagccgucccagggccccgccgacggcagccggcccgagccccagcgcccgcggaaccgccccuacuuccagcggcgccggcagcaggcccccgggccccagcaggccccgggcccccgccagcccgccgcccccgagaccuccgccccggucaacagcggggaccccaccaccacgauccucgaguga

SEQ ID NO: 38814 - RNA, 912 nt, Artificial Sequence
  derived and/or modified sequence opt1 from YBX3__Homo_sapiens__NP_001138898
augagcgaggccggcgaggccaccaccacgaccaccaccacgcugccccaggcgcccaccgaggccgccgccgccgcgccccaggaccccgcccccaaguccccgguggggagcggcgcgccccaggccgccgcccccgcccccgccgcccacgucgcggggaacccgggcggggacgccgcccccgccgccaccggcaccgcggccgccgccucccucgccacggcggccggcagcgaggacgccgagaagaaggugcuggccaccaaggugcuggggaccgucaagugguucaacgugcgcaacggcuacggguucaucaaccggaacgacaccaaggaggacguguucguccaccagacggccaucaagaagaacaacccccgcaaguaccuccgguccgugggcgacggggagaccguggaguucgacgucguggagggcgagaagggcgcggaggccgccaacgugaccgggcccgacggcgucccgguggaggggagccgcuacgccgcggaccggcgccgguaccgccggggcuacuacggccgccggcgcgggccgccccggaacgccggcgagaucggggagaugaaggacggcgugcccgagggggcccagcugcagggccccguccaccgcaaccccaccuaccggccccgcuaccggucccgcgggcccccgcggccccgccccgcccccgccgugggcgaggcggaggacaaggagaaccagcaggccacgagcggcccgaaccagcccuccgugcggcgcggguaccgccggcccuacaacuaccgccggcgcccccggccgcccaacgcccccagccaggacggcaaggaggccaaggccggggaggcgccgaccgagaaccccgccccgcccacccagcaguccagcgccgaguga

SEQ ID NO: 38815 - RNA, 972 nt, Artificial Sequence
  derived and/or modified sequence opt1 from YDJC__Homo_sapiens__NP_001017964
augagccgcccccggaugcgccugguggucaccgccgacgacuucggcuacugcccgcggcgcgacgaggggaucguggaggccuuccucgcgggcgccgugaccuccgucagccugcuggugaacggggccgccacggaguccgccgcggagcucgcccggcgccacagcauccccaccggccugcacgccaaccuguccgaggggcggcccgugggccccgcccgccggggcgcgagcucccuccuggggccggagggcuucuuccuggggaagaugggcuuccgcgaggccgucgccgccggggacguggaccucccccaggugcgggaggagcuggaggcccagcugagcugcuuccgcgagcuccugggccgggcgcccacccacgccgacggccaccagcacguccacgugcugcccggggugugccaggucuucgccgaggcccuccaggccuacggcgugcgcuucacccggcugccgcuggagcgcggggugggcggcugcacguggcucgaggcgcccgcccgggccuucgccugcgccgucgagcgcgacgcgcgggccgccguggggcccuucucccgccacggccugcgguggaccgacgccuucguggggcugagcacgugcggccgccacauguccgcccaccgcgucagcggggcgcucgcccgggugcuggagggcacccuggccggccacacccucaccgccgagcugauggcgcaccccggguacccguccgugccgcccaccggcgggugcggcgaggggcccgacgccuucagcugcuccugggagcgccugcacgagcuccggguccugaccgcccccacgcugcgcgcccagcucgcccaggacggcgugcagcugugcgcgcuggacgaccucgacagcaagcggcccggcgaggaggugcccugcgagcccacccuggagccguuccuggagcccucccuccuguga

SEQ ID NO: 38816 - RNA, 684 nt, Artificial Sequence
  derived and/or modified sequence opt1 from YEATS4__Homo_sapiens__NP_006521
auguucaagcgcauggccgaguucggccccgacagcgggggccgggugaagggggucaccaucgugaagccgaucguguacggcaacgucgcccgcuacuucgggaagaagcgggaggaggacggccacacccaccaguggacgguguacgugaagcccuaccgcaacgaggacauguccgcguacgucaagaagauccaguucaagcugcacgagagcuacggcaacccccuccggguggugaccaagcccccguacgagaucaccgagaccggguggggcgaguucgagaucaucaucaagaucuucuucaucgaccccaacgagcgccccgucacgcuguaccaccuccugaagcuguuccaguccgacaccaacgccaugcuggggaagaagaccguggugagcgaguucuacgacgagaugaucuuccaggaccccaccgccaugaugcagcagcuccugacgaccucccggcagcugacccucggcgccuacaagcacgagaccgaguucgccgagcuggaggucaagacgcgcgagaagcuggaggcggccaagaagaagaccagcuucgagaucgccgagcucaaggagcggcugaaggccucccgcgagaccaucaacugccugaagaacgagauccggaagcucgaggaggacgaccaggcgaaggacaucuga

SEQ ID NO: 38817 - RNA, 1632 nt, Artificial Sequence
  derived and/or modified sequence opt1 from YES1__Homo_sapiens__XP_011524038
augggcugcaucaagagcaaggagaacaagucccccgccaucaaguaccgcccggagaacacccccgagcccgugagcaccuccgucagccacuacggggccgagcccacgaccguguccccgugccccagcuccagcgcgaagggcaccgccgugaacuucuccagccuguccaugacccccuucgggggcagcuccggggucacgcccuucggcggcgccagcuccagcuucuccguggugccgagcuccuaccccgccgggcucaccggcggggucaccaucuucguggcccuguacgacuacgaggcgcggaccacggaggaccugagcuucaagaagggcgagcgcuuccagaucaucaacaacaccgagggggacuggugggaggcccggagcaucgccaccggcaagaacggcuacauccccuccaacuacguggcccccgcggacagcauccaggccgaggagugguacuucgggaagaugggccgcaaggacgccgagcggcuccugcugaacccggggaaccagcgcggcaucuuccucguccgggaguccgagaccacgaagggcgccuacagccuguccauccgcgacugggacgagauccgcggggacaacgugaagcacuacaagauccggaagcuggacaacggcggguacuacaucaccacccgggcccaguucgacacccuccagaagcuggugaagcacuacacggagcacgcggacggccugugccacaagcucaccaccgucugccccaccgugaagccccagacgcaggggcuggccaaggacgccugggagaucccccgcgagagccugcggcucgaggugaagcugggccagggcugcuucggggaggucuggaugggcaccuggaacgggaccaccaagguggccaucaagacgcugaagccgggcaccaugaugcccgaggccuuccuccaggaggcgcagaucaugaagaagcugcgccacgacaagcuggugccccucuacgccgucguguccgaggagcccaucuacaucgugaccgaguucaugagcaaggggucccugcuggacuuccucaaggagggcgacggcaaguaccugaagcugccgcagcucgucgacauggccgcccagaucgccgacgggauggcguacaucgagcggaugaacuacauccaccgcgaccugcgggccgccaacauccuggugggcgagaaccucgugugcaagaucgccgacuucgggcuggcccgccugaucgaggacaacgaguacaccgcgcggcagggcgccaaguuccccaucaaguggacggcccccgaggccgcgcucuacgggcgcuucaccaucaagagcgacgucugguccuucggcauccugcagaccgagcuggugaccaagggccggguccccuacccggggauggugaaccgcgaggugcucgagcaggucgagcgcggcuaccggaugcccugcccccaggggugccccgagagccugcacgagcugaugaaccucugcuggaagaaggacccggacgagcgccccacguucgaguacauccaguccuuccuggaggacuacuucaccgccaccgagccccaguaccagccgggcgagaaccuguga

SEQ ID NO: 38818 - RNA, 882 nt, Artificial Sequence
  derived and/or modified sequence opt1 from YIF1A__Homo_sapiens__NP_065203
auggccuaccacagcggcuacggggcccacggcuccaagcaccgcgcgcgggccgcccccgacccgccgccccuguucgacgacaccagcgggggcuacuccagccagcccgggggcuaccccgccaccggcgccgacguggcguucuccgucaaccaccuccugggggaccccauggccaacguggccauggccuacggcagcuccaucgcgagccacgggaaggacauggugcacaaggagcugcaccgcuucgucuccgugagcaagcucaaguacuucuucgccguggacacggccuacgucgccaagaagcugggccugcucguguuccccuacacccaccagaacugggaggugcaguacucccgggacgcgccccugccgccccgccaggaccugaacgcccccgaccucuacauccccaccauggccuucaucaccuacguccugcuggccgggauggcccucggcauccagaagcgguucagcccggaggugcugggccugugcgccuccacggcgcucgugugggucgugauggaggugcuggcccugcuccuggggcuguaccucgccaccguccgcagcgaccuguccaccuuccaccuccuggccuacagcggcuacaaguacguggggaugauccuguccgugcugaccggccuccuguucggcagcgacggguacuacgucgcccuggcguggacguccagcgcccucauguacuucaucgugcggagccugcgcaccgccgcccugggccccgacuccaugggcgggcccgugccccggcagcgccuccagcuguaccugacccucggggccgcggccuuccagccgcugaucaucuacuggcugaccuuccaccucguccgguga

SEQ ID NO: 38819 - RNA, 372 nt, Artificial Sequence
  derived and/or modified sequence opt1 from YIPF1__Homo_sapiens__XP_011539907
auguggcgcaacagcaaggugaugaacaucgucuccuacagcuuccuggagaucgugugcguguacggcuacucccucuucaucuacauccccaccgccauccuguggaucaucccgcagaaggccguccgguggauccuggugaugaucgcgcucgggaucagcggcucccugcuggccaugaccuucuggcccgccgugcgcgaggacaaccggcgcgucgcccucgccacgaucgugaccaucgugcugcugcacaugcuccugagcgucgggugccuggcguacuucuucgacgcccccgagauggaccaccuccccaccaccacggccaccccgaaccagaccguggccgcggccaaguccagcuga

SEQ ID NO: 38820 - RNA, 1053 nt, Artificial Sequence
  derived and/or modified sequence opt1 from YIPF3__Homo_sapiens__NP_056203
auggccaccaccgccgcgcccgccggcggggcccgcaacggcgccgggccggaguggggcggguucgaggagaacauccagggcggcgggagcgccgugaucgacauggagaacauggacgacacguccggcagcuccuucgaggacaugggggagcugcaccagcggcuccgcgaggaggaggucgacgcggacgccgccgacgccgcggccgccgaggaggaggacggcgaguuccuggggaugaagggcuucaagggccagcugagccgccagguggccgaccagauguggcaggccgggaagcggcaggcgucccgggccuucagccucuacgccaacaucgacauccugcgccccuacuucgacguggagcccgcccagguccggucccgccugcucgagagcaugauccccaucaagauggugaacuucccgcagaagaucgccggcgagcuguacgggccccugaugcucguguucacccuggucgcgauccugcuccacggcaugaagaccuccgacaccaucauccgggagggcacgcugauggggaccgccaucgggaccugcuucggcuacuggcugggcgugagcuccuucaucuacuuccucgccuaccugugcaacgcccagaucaccaugcugcagaugcucgcccugcugggguacggccucuucggccacugcaucgugcuguucaucacguacaacauccaccuccacgcccucuucuaccuguucuggcugcucgucgggggccugagcacccugcgcaugguggcggugcucgucucccggaccguggggcccacccagcgccugcugcucugcggcacgcuggccgcccugcacaugcuguuccugcuguaccuccacuucgccuaccacaagguggucgaggggauccuggacacccuggagggccccaacaucccgcccauccagcgggugccccgcgacauccccgcgaugcucccggccgcccggcugcccaccaccgugcugaacgccacggcgaaggccgucgccgugacccuccagagccacuga

SEQ ID NO: 38821 - RNA, 774 nt, Artificial Sequence
  derived and/or modified sequence opt1 from YIPF5__Homo_sapiens__NP_001020118
augagcggcuucgagaaccugaacaccgacuucuaccagaccuccuacagcaucgacgaccagucccagcagagcuacgacuacgggggcuccgggggccccuacagcaagcaguacgccggguacgacuacucccagcagggccgcuucgugccgcccgacaugaugcagccccagcagcccuacacgggccagaucuaccagccgacccaggccuacacccccgcgagcccccagcccuucuacgggaacaacuucgaggacgagccgccccuccuggaggagcugggcaucaacuucgaccacaucuggcagaagacccucacgguccugcacccccugaagguggccgacggguccaucaugaacgagaccgaccucgccggccccaugguguucugccuggccuucggggccacccugcuccuggcgggcaagauccaguucggcuacgucuacgggaucagcgccaucggcugccuggggauguucugccuccugaaccugauguccaugaccggcgugagcuucggcugcguggccuccguccucggguacugccugcugccgaugauccuccugagcuccuucgccgugaucuucagccugcagggcaugguggggaucauccucacggcgggcaucaucggguggugcuccuucagcgccuccaagaucuucaucagcgcccuggccauggagggccagcagcugcucgucgccuaccccugcgcgcugcuguacggcguguucgcccucaucagcguguucuga

SEQ ID NO: 38822 - RNA, 597 nt, Artificial Sequence
  derived and/or modified sequence opt1 from YKT6__Homo_sapiens__NP_006546
augaagcuguacagccucuccgugcuguacaagggcgaggccaaggucgugcugcucaaggccgcguacgacgugagcuccuucagcuucuuccagcgcuccagcguccaggaguucaugaccuucaccucccagcugaucguggagcggagcuccaaggggacgcgcgccagcgugaaggagcaggacuaccugugccacgucuacgugcggaacgacucccucgccggcguggucaucgccgacaacgaguaccccagccgcguggccuucacccugcuggagaaggugcucgacgaguucuccaagcaggucgaccggaucgacuggccgguggggagccccgcgaccauccacuaccccgcccuggacggccaccugucccgcuaccagaacccccgggaggccgacccgaugaccaaggugcaggccgagcucgacgagacgaagaucauccugcacaacaccauggagagccugcucgagcgcggggagaagcuggacgaccuggucuccaagagcgaggugcucggcacccaguccaaggcguucuacaagaccgcccggaagcagaacagcugcugcgccaucauguga

SEQ ID NO: 38823 - RNA, 6441 nt, Artificial Sequence
  derived and/or modified sequence opt1 from YLPM1__Homo_sapiens__NP_062535
auguaccccaacuggggccgcuacgggggcagcucccacuacccgcccccccccgugccgcccccccccccggucgcccugcccgaggccagccccgggcccggcuacuccagcuccaccaccccggcggcccccagcuccagcggguucauguccuuccgggagcagcaccucgcccagcugcagcagcugcagcagaugcaccagaagcagaugcagugcgugcuccagccccaccaccugcccccgcccccccugcccccgccccccgugaugcccggcggcggguacggcgacuggcagccgcccccccccccgaugccccccccgcccgggcccgcccucagcuaccagaagcagcagcaguacaagcaccagaugcugcaccaccagcgcgacggccccccggggcugguccccauggagcucgaguccccccccgagagcccgcccgugccccccggcuccuacaugccgcccagccaguccuacaugccccccccgcagcccccccccagcuacuacccgcccacguccagccagcccuaccugcccccggcccagcccucccccagccagagcccgcccucccagagcuaccuggcgcccacccccuccuacagcuccagcuccagcuccagccaguccuaccucagccacucccagagcuaccugccguccagccaggccucccccagccggcccucccagggccacagcaagagccagcugcucgcccccccgccccccuccgcccccccggggaacaagaccaccgugcagcaggagccccuggagagcggcgcgaagaacaaguccacggagcagcagcaggccgcccccgagcccgacccgagcaccaugaccccccaggagcagcagcaguacugguaccgccagcaccugcucucccugcagcagcggaccaagguccaccugcccgggcacaagaagggccccgugguggccaaggacacgccggagcccgucaaggaggaggugaccgugcccgccaccagccagguccccgaguccccgagcuccgaggagcccccccuccccccgcccaacgaggaggugcccccgccccugccccccgaggagccgcagagcgaggaccccgaggaggacgcgcgccugaagcagcuccaggccgccgccgcccacuggcagcagcaccagcagcaccgggugggcuuccaguaccaggggaucaugcagaagcacacccagcugcagcagauccugcagcaguaccagcagaucauccagccccccccgcacauccagacgauguccgucgacaugcagcuccgccacuacgagaugcagcagcagcaguuccagcaccuguaccaggagugggagcgggaguuccagcugugggaggagcagcuccacagcuacccccacaaggaccagcugcaggaguacgagaagcaguggaagaccuggcagggccacaugaaggcgacccaguccuaccugcaggagaaggugaacagcuuccagaacaugaagaaccaguacauggggaacauguccaugccccccccguucgugcccuacagccagaugccccccccgcuccccaccaugccccccccgguccugccccccucccugcccccgcccgugaugccccccgcccucccggccacggugccccccccgggcaugcccccccccgucaugccgcccagccugcccaccagcgugcccccgcccgggaugccccccucccugagcuccgccggcccgccccccgugcuccccccgcccagccuguccagcgccggcccccccccgguccugcccccccccucccucagcuccaccgcgccgccccccgugaugccgcugcccccccugagcuccgccacccccccgcccgggaucccccccccgggcgucccccaggggauccccccccagcucacggccgccccggugccccccgccagcuccagccaguccagccaggugcccgagaagccgcgccccgcgcugcugcccacccccgucuccuucggcagcgccccgcccaccaccuaccaccccccccuccaguccgccgggccgagcgagcaggugaacagcaaggccccccuguccaagagcgcgcugcccuacuccagcuucuccagcgaccagggccugggcgaguccagcgccgcccccucccagccgaucacggccgugaaggacaugcccguccggagcgggggccuccugcccgacccgccccgcuccagcuaccuggaguccccccgggggccccgcuucgacggcccgcggcgcuucgaggaccucgggagccggugcgagggcccccgccccaagggcccccgguucgaggggaaccgcccggacggcccccggccccgcuacgaggggcaccccgccgagggcaccaaguccaaguggggcaugaucccgcgcgggcccgcgagccaguucuacaucacccccuccaccagccuguccccccggcagagcggcccgcaguggaaggggcccaagcccgccuucggccagcagcaccagcagcagcccaagagccaggccgagccgcuguccgggaacaaggagccccucgccgacacgagcuccaaccagcagaagaacuucaagaugcagagcgccgcguucuccaucgccgccgacgugaaggacgugaaggccgcccagagcaacgagaaccuguccgacagccagcaggagccccccaaguccgaggucagcgagggcccgguggagcccuccaacugggaccagaacgugcagagcauggagacccagaucgacaaggcgcaggccgucacccagcccgugccccuggccaacaagccggugcccgcccaguccaccuuccccagcaagacgggcgggauggagggcgggaccgcggucgccaccuccagccucaccgccgacaacgacuucaagccggugggcaucgggcugccccacuccgagaacaaccaggacaagggccugccccgccccgacaaccgggacaaccgccucgagggcaaccgggggaacagcuccagcuaccgcggcccggggcagagccggauggaggacacgcgcgacaagggccuggugaaccgggggcgcggccaggccaucucccggggccccgggcuggucaagcaggaggacuuccgcgacaagaugaugggccggcgcgaggacagccgggagaagaugaaccgcggggagggcucccgggaccgcgggcucgugcggcccggcagcucccgcgagaaggugcccggcgggcugcagggcagccaggaccgcggggccgcgggcucccgggagcgcggcccgccccggcgcgccgggagccaggagcggggcccccugcgccgggccgggucccgcgagcggauccccccgcgccgggccggcagccgcgagcgggggcccccccgcggccccggcucccgggagcgcgggcucggccggagcgacuucgggcgcgaccggggcccguuccgccccgagcccggggacggcggcgagaagauguaccccuaccaccgggacgagccgccccgcgcccccuggaaccacggggaggagcgcggccacgaggaguucccccuggacgggcggaacgcgccgauggagcgcgagcggcuggacgacugggaccgcgagcgguacuggcgcgagugcgagcgggacuaccaggacgacacccucgagcuguacaaccgcgaggaccgguucuccgccccccccagccgcucccacgacggcgaccggcgcgggcccuggugggacgacugggagcgggaccaggacauggacgaggacuacaaccgcgagauggagcgggacauggaccgcgacgucgaccggaucagccgcccgauggacauguacgaccggucccuggacaacgagugggaccgcgacuacggccgcccccucgacgagcaggagagccaguuccgggagcgcgacauccccucccugccgccccugcccccccucccgccccugcccccccuggaccgguaccgcgacgaccgguggcgcgaggagcggaaccgcgagcacggcuacgaccgggacuuccgcgaccggggggagcuccgcauccgggaguacccggagcgcggcgacaccuggcgggagaagcgcgacuacgugcccgaccggauggacugggagcgcgagcggcugagcgaccgcugguaccccagcgacguggaccggcacucccccauggccgagcacaugccgagcucccaccacagcuccgagaugauggggagcgacgccucccuggacagcgaccagggccucggcggggucauggugcugucccagcgccagcacgagaucauccugaaggccgcgcaggagcucaagaugcugcgcgagcagaaggagcagcugcagaagaugaaggacuucggcagcgagccccagauggccgaccaccuccccccccaggagucccggcugcagaacaccagcucccgcccggggauguaccccccccccggcagcuaccggccgcccccccccauggggaagccgcccggcuccaucgugcgccccagcgccccgcccgcccgguccagcguccccgugacccgccccccggugcccaucccccccccgcccccccccccgccccugccccccccgccccccgucaucaagccccagacguccgcgguggagcaggagcggugggacgaggacagcuucuacggccucugggacaccaacgacgagcaggggcugaacagcgaguucaaguccgagaccgccgccaucccgagcgcccccgugcugccccccccgcccguccacuccagcaucccccccccgggccccgugcccauggggaugccgcccauguccaagccccccccggugcagcagaccgucgacuacggccacgggcgcgacaucagcacgaacaagguggagcagauccccuacggcgagcggaucacccuccgccccgacccccugccggagcgguccaccuucgagaccgagcacgccggccagcgcgaccgguacgaccgcgagcgggaccgcgagcccuacuucgaccggcagagcaacgugaucgcggaccaccgcgacuucaagcgggaccgcgagacgcaccgcgaccgggaccgcgaccggggggucaucgacuacgaccgcgaccgguucgaccgcgagcggcgcccccgggacgaccgcgcccaguccuaccgggacaagaaggaccacagcuccagccgccggggcggguucgaccgccccuccuacgaccggaagagcgaccgcccgguguacgagggccccuccauguucgggggcgagcggcgcaccuaccccgaggagcggaugccccugccggcccccagccucucccaccagccccccccggccccccgcguggagaagaagcccgagagcaagaacgucgacgacauccugaagcccccgggccgggagagccgccccgagcgcaucguggugaucaugcgggggcugcccggcuccgggaagacccacgucgccaagcucauccgcgacaaggagguggaguucggcgggcccgcgccgcgggugcugagccuggacgacuacuucaucaccgaggucgagaaggaggagaaggaccccgacuccggcaagaaggugaagaagaaggugauggaguacgaguacgaggccgagauggaggagacguaccgcaccagcauguucaagaccuucaagaagacccucgacgacggcuucuuccccuucaucauccuggacgccaucaacgaccggguccgccacuucgaccaguucugguccgccgccaagacgaagggguucgagguguaccuggcggagaugagcgccgacaaccagaccugcggcaagcggaacauccacgggcgcaagcucaaggagaucaacaagauggccgaccacugggagaccgccccgcggcacaugaugcgccuggacauccggucccugcuccaggacgccgcgaucgaggaggucgagauggaggacuucgacgccaacaucgaggagcagaaggaggagaagaaggacgccgaggaggaggagagcgagcugggcuacauccccaaguccaagugggagauggacaccagcgaggccaagcuggacaagcucgacggccugcgcacggggaccaagcggaagcgcgacugggaggcgaucgccucccggauggaggacuaccugcagcuccccgacgacuacgacacccgcgccagcgagcccggcaagaagcgggugcgcugggccgaccuggaggagaagaaggacgccgaccggaagcgcgcgaucggguucguggucggccagaccgacugggagaagaucacggacgaguccgggcaccuggccgagaaggcccucaaccgcaccaaguacaucuga

SEQ ID NO: 38824 - RNA, 2052 nt, Artificial Sequence
  derived and/or modified sequence opt1 from YME1L1__Homo_sapiens__NP_001240795
auguucagccuguccagcaccgugcagccccaggucaccgugccgcucucccaccugaucaacgccuuccacacgcccaagaacaccagcgugucccugagcggcgucuccgugagccagaaccagcaccgcgacgugguccccgagcacgaggcccccuccagcgagccgucccucaaccugcgggaccuggggcucagcgagcugaagaucggccagaucgaccagcugguggagaaccuccugcccggguucugcaagggcaagaacaucuccagccacuggcacaccucccacgugagcgcgcaguccuucuucgagaacaaguacgucuucauccagagccgcggguucaagacccugaagucccggacgcgccggcuccagagcaccagcgagcgccuggccgagacccagaacaucgcccccuccuucgugaagggcuuccugcuccgggaccgcggcagcgacguggagucccuggacaagcugaugaagaccaagaacauccccgaggcccaccaggacgccuucaagacgggguucgcggagggcuuccucaaggcccaggcccugacccagaagaccaacgacagccugcggcgcacccggcucauccuguucguccugcuccuguucgggaucuacggccugcucaagaacccguuccuguccgugcgcuuccggacgaccaccgggcuggacagcgccguggaccccguccagaugaagaacgugaccuucgagcacgugaagggcgucgaggaggcgaagcaggagcuccaggaggugguggaguuccugaagaacccccagaaguucacgauccugggcgggaagcuccccaagggcauccugcuggucgggccgcccggcaccggcaagacccuccuggcccgcgccguggccggggaggccgacgugcccuucuacuacgcguccggcagcgaguucgacgagauguucgucggggugggcgccucccggauccgcaaccuguuccgggaggccaaggccaacgcccccugcgucaucuucaucgacgagcucgacagcgugggcgggaagcgcaucgaguccccgaugcaccccuacagccggcagaccaucaaccagcugcuggcggagauggacggcuucaagcccaacgagggggugaucaucaucggcgccacgaacuuccccgaggcccucgacaacgcccugauccgcccggggcgguucgacaugcaggucaccgugccccgccccgacgugaagggccgcaccgagauccugaagugguaccucaacaagaucaaguucgaccaguccgucgaccccgagaucaucgcccgggggaccgugggcuucagcggcgcggagcuggagaaccuggugaaccaggccgcccucaaggccgccgucgacgggaaggagauggugacgaugaaggagcuggaguucuccaaggacaagauccugaugggcccggagcgccggagcguggagaucgacaacaagaacaagaccaucaccgcguaccacgaguccgggcacgccaucaucgccuacuacaccaaggacgccaugcccaucaacaaggcgacgaucaugccccgcggccccacccuggggcacgucagccuccugccggagaacgaccgguggaacgagacccgcgcccagcugcucgcccagauggacguguccaugggcggccggguggccgaggagcugaucuucgggaccgaccacaucacgaccggcgccagcagcgacuucgacaacgcgaccaagaucgccaagcgcauggucaccaaguucgggauguccgagaagcugggcgugaugacguacagcgacaccggcaagcucucccccgagacccagagcgccaucgagcaggagauccggauccugcugcgcgacuccuacgagcgggccaagcacauccucaagacccacgccaaggagcacaagaaccuggcggaggcccugcucaccuacgagacgcuggacgccaaggagauccagaucgugcuggaggggaagaagcucgagguccgcuga

SEQ ID NO: 38825 - RNA, 360 nt, Artificial Sequence
  derived and/or modified sequence opt1 from YPEL1__Homo_sapiens__NP_037445
auggugaagaugaccaagagcaagaccuuccaggccuaccugcccaacugccaccgcacguacuccugcauccacugccgggcccaccucgcgaaccacgacgagcugaucagcaaguccuuccagggcagccaggggcgcgccuaccuguucaacuccgucgugaacgugggcugcgggccggccgaggagcggguccuccugaccggccugcacgccguggccgacaucuacugcgagaacugcaagaccacccucggguggaaguacgagcacgcguucgagagcucccagaaguacaaggagggcaaguucaucaucgagcuggcccacaugaucaaggacaacggcugggaguga

SEQ ID NO: 38826 - RNA, 360 nt, Artificial Sequence
  derived and/or modified sequence opt1 from YPEL2__Homo_sapiens__NP_001005404
auggugaagaugacccgcagcaagaccuuccaggccuaccugcccuccugccaccggacguacagcugcauccacugccgcgcccaccucgcgaaccacgacgagcugaucuccaagagcuuccagggcucccaggggcgggccuaccuguucaacagcgucgugaacgugggcugcgggccggccgaggagcgcguccuccugaccggccugcacgccguggccgacaucuacugcgagaacugcaagaccacccucggguggaaguacgagcacgcguucgaguccagccagaaguacaaggagggcaaguacaucaucgagcuggcccacaugaucaaggacaacggcugggacuga

SEQ ID NO: 38827 - RNA, 360 nt, Artificial Sequence
  derived and/or modified sequence opt1 from YPEL3__Homo_sapiens__NP_001138996
auggugcgcaucagcaagcccaagaccuuccaggccuaccuggacgacugccaccggcgcuacuccugcgcccacugccgggcgcaccucgccaaccacgacgaccugaucagcaaguccuuccagggcagccaggggcgcgccuaccuguucaacuccgucgugaacgugggcugcgggccggccgaggagcggguccuccugaccggccugcacgccguggcggacauccacugcgagaacugcaagacgacccucggguggaaguacgagcaggccuucgagagcucccagaaguacaaggagggcaaguacaucaucgagcugaaccacaugaucaaggacaacggcugggacuga

SEQ ID NO: 38828 - RNA, 384 nt, Artificial Sequence
  derived and/or modified sequence opt1 from YPEL4__Homo_sapiens__NP_659445
augcccagcugcgacccgggccccgggcccgccugccugcccaccaagaccuuccgcuccuaccucccgcggugccaccgcacguacagcugcgugcacugccgggcccaccuggcgaagcacgacgagcugaucuccaagagcuuccagggcucccacgggcgcgccuaccucuucaacagcgucgugaacgugggcugcgggcccgccgagcagcggcugcugcucaccggccugcacuccgucgccgacaucuucugcgagagcugcaagaccacccugggcuggaaguacgagcaggccuucgagacgucccagaaguacaaggaggggaaguacaucaucgagaugagccacauggugaaggacaacggcugggacuga

SEQ ID NO: 38829 - RNA, 366 nt, Artificial Sequence
  derived and/or modified sequence opt1 from YPEL5__Homo_sapiens__NP_001120872
augggccgcaucuuccuggaccacaucgggggcacccgccucuucagcugcgccaacugcgacaccauccugacgaaccgguccgagcugaucagcacccgguucaccggggccaccggccgcgcguuccucuucaacaagguggucaaccugcaguacuccgaggugcaggaccgggugaugcugacggggcgccacaugguccgggacgugagcugcaagaacugcaacuccaagcucggcuggaucuacgaguucgccaccgaggacagccagcgcuacaaggagggccgggugauccuggagcgcgcccugguccgggaguccgagggguucgaggagcacgugcccagcgacaacuccuga

SEQ ID NO: 38830 - RNA, 2184 nt, Artificial Sequence
  derived and/or modified sequence opt1 from YTHDC1__Homo_sapiens__NP_001026902
auggccgccgacagccgcgaggagaaggacggcgagcugaacgugcucgacgacauccugaccgagguccccgagcaggacgacgagcuguacaaccccgaguccgagcaggacaagaacgagaagaaggggagcaagcggaaguccgaccgcauggagagcaccgacacgaagcggcagaagcccuccgugcacagccgccagcucguguccaagccccugagcuccagcgucuccaacaacaagcggaucgugagcaccaagggcaaguccgccaccgaguacaagaacgaggaguaccagcgcagcgagcggaacaagcgccuggacgccgaccggaagauccgccucuccagcuccgccagccgggagcccuacaagaaccagccggagaagaccugcgugcgcaagcgggaccccgagcgccgggccaagucccccacgcccgacgggagcgagcgcaucggccuggaggucgaccggcgcgccagccgguccagccaguccagcaaggaggaggugaacuccgaggaguacgggagcgaccacgagaccggcuccagcggcuccagcgacgagcaggggaacaacaccgagaacgaggaggagggcguggaggaggacgucgaggaggacgaggagguggaggaggacgcggaggaggacgaggagguggacgaggacggggaggaggaggaggaggaggaggaggaggaggaggaggaggaggaggaggaggaggaggaguacgagcaggacgagcgcgaccagaaggaggagggcaacgacuacgacacccgguccgaggccagcgacuccgggagcgaguccgucagcuucacggacggcuccgugcgcagcggcuccgggaccgacggcagcgacgagaagaagaaggagcgcaagcgggcccgcgggaucagcccgaucguguucgaccgguccggcagcuccgccagcgaguccuacgcgggcagcgagaagaagcacgagaagcuguccagcuccguccgcgccgugcggaaggaccagaccagcaagcucaaguacgugcugcaggacgcccgcuucuuccugaucaaguccaacaaccacgagaacgucagccucgccaaggccaagggggugugguccacccugcccgugaacgagaagaagcugaaccucgcguuccggagcgcccgcuccgucauccugaucuucagcgugcgggaguccggcaaguuccagggguucgcccgccugagcagcgagucccaccacggcgggagccccauccacugggugcuccccgccggcauguccgccaagaugcugggcggggucuucaagaucgacuggaucugccggcgcgagcugccguucaccaagagcgcgcaccucacgaaccccuggaacgagcacaagcccgugaagaucggccgggacgggcaggagaucgagcuggagugcggcacccagcugugccuccuguucccgcccgacgaguccaucgaccuguaccaggucauccacaagaugcgccacaagcggcgcaugcacagccagccccggucccgcgggcggcccagccgccgcgagcccgugcgggacgugggccgccggcgcccggaggacuacgacauccacaacucccggaagaagccccgcaucgacuacccgcccgaguuccaccagcggcccggcuaccucaaggacccccgcuaccaggaggucgaccggcgcuucagcggggugcggcgcgacguguuccugaacggcuccuacaacgacuacguccgggaguuccacaacauggggcccccgccgcccuggcagggcaugccgcccuaccccgggauggagcagccgccccaccaccccuacuaccagcaccacgcgcccccgccccaggcccacccgcccuacagcggccaccaccccgugccccacgaggcccgcuaccgggacaagcgcgugcacgacuacgacaugcgggucgacgacuuccugcgccggacccaggccgugguguccggccgccggagccgcccccgcgagcgggaccgcgagcgggagcgcgaccggccccgcgacaaccggcgcgaccgggagcgcgaccgggggcgcgaccgggagcgcgagcgggagcgccucugcgaccgggaccgcgaccggggcgagcgcgggcgcuaccggcgcuga

SEQ ID NO: 38831 - RNA, 4293 nt, Artificial Sequence
  derived and/or modified sequence opt1 from YTHDC2__Homo_sapiens__NP_073739
augagccgccccuccagcguguccccgcggcagcccgcccccggcgggggcgggggcgggggccccagcccgugcggccccgggggcgggggccgcgccaaggggcugaaggacauccggaucgacgaggaggucaagaucgcggugaacaucgcccucgagcgcuuccgguacggcgaccagcgcgagauggaguuccccuccagccugaccuccaccgagcgggccuucauccaccgccugagccagucccucggccuggugagcaaguccaaggggaagggcgccaaccgguaccugacggucaagaagaaggacgggagcgagaccgcccacgcgaugaugaccugcaaccucacccacaacacgaagcacgccgugcgcucccugauccagcgguuccccgugaccaacaaggagcgcaccgagcugcucccgaagaccgagcggggcaacgucuucgccguggaggccgagaaccgcgagaugagcaagacguccggccggcugaacaacgggaucccccagauccccgugaagcgcggcgagagcgaguucgacuccuuccggcagagccugcccgucuucgagaagcaggaggagaucgugaagaucaucaaggagaacaaggugguccucaucgugggggagaccggcuccgggaagaccacccagaucccgcaguuccugcuggacgacugcuucaagaacggcauccccugccgcaucuucugcacgcagccccggcgccucgcggccaucgccguggccgagcgggucgccgcggagcgccgcgagcggaucggccagaccaucggguaccagauccgccuggagagccgggugagccccaagacccugcucaccuucugcacgaacggcgugcugcugcgcacccucauggccggggacuccacccugagcaccgucacgcacgugaucguggacgagguccacgagcgggaccgcuucuccgacuuccugcucaccaagcugcgggaccugcuccagaagcacccgacccugaagcugauccucagcuccgccgcccuggacgugaaccuguucauccgcuacuucggcagcugccccgugaucuacauccaggggcggcccuucgaggucaaggagauguuccucgaggacauccugcgcaccacgggcuacaccaacaaggagaugcugaaguacaagaaggagaagcagcaggaggagaagcagcagaccacccucacggagugguacuccgcccaggagaacagcuucaagcccgagucccagcggcagcgcaccgugcugaacgucaccgacgaguacgaccugcucgacgacggcggggacgcgguguucagccagcugaccgagaaggacgugaacugccuggagccguggcucaucaaggagauggacgccugccuguccgacaucuggcugcacaaggacaucgacgccuucgcccaggucuuccaccucauccugacggagaacgugagcguggacuaccggcacuccgagaccagcgccaccgcgcugauggucgccgccggccgcggguucgccucccagguggagcagcucaucagcaugggcgccaacgugcacuccaaggcgagcaacggguggauggcccuggacugggccaagcacuucggccagaccgagaucgucgaccugcuggaguccuacagcgccacgcucgaguucggcaaccuggacgagagcucccuggugcagaccaacgggagcgaccucuccgcggaggaccgggagcugcugaaggccuaccaccacagcuucgacgacgagaagguggaccucgaccugaucaugcaccuccuguacaacaucugccacuccugcgacgccggcgccguccugaucuuccugcccggguacgacgagaucgugggccuccgcgaccggauccuguucgacgacaagcgcuucgccgacagcacccaccgguaccagguguucaugcugcacuccaacaugcagaccagcgaccagaagaagguccucaagaacccgcccgcgggcgugcgcaagaucauccuguccaccaacaucgccgagacgagcaucaccgugaacgacgucguguucgugaucgacuccgggaaggucaaggagaaguccuucgacgcccugaacuucgugaccaugcucaagaugguguggaucagcaaggccagcgccauccagcgcaagggccgggcggggcgcugccggcccggcaucugcuuccgccuguucucccggcugcgcuuccagaacaugcucgaguuccagacccccgagcugcugcggaugccccuccaggagcugugccugcacacgaagcuccuggcccccgucaacugcccgaucgccgacuuccugaugaaggcccccgagcccccgcccgcccucaucgugcgcaacgcggugcagaugcugaagaccaucgacgccauggacaccugggaggaccugaccgagcucggguaccaccuggccgaccugcccgucgagccccaccucggcaagauggugcugugcgccgugguccugaagugccucgacccgauccugacgaucgcgugcacccuggccuaccgggaccccuucgugcuccccacccaggccagccagaagcgcgccgccaugcugugccggaagcgcuucaccgcgggcgccuucuccgaccacauggcccugcuccgggccuuccaggccuggcagaaggcgcgcagcgacgggugggagcgggccuucugcgagaagaacuuccugagccaggccacgauggagaucaucaucggcaugcgcacccagcugcucgggcagcugcgggccuccggcuucgugcgcgcccgcgggggcggcgacauccgggacgucaacaccaacagcgagaacugggcgguggugaaggccgcccuggucgccgggauguaccccaaccucgugcacguggaccgggagaaccugguccugaccggcccgaaggagaagaaggugcgcuuccaccccgcguccgugcucagccagccccaguacaagaagaucccgcccgccaacgggcaggccgccgccaucaaggcgcugcccacggacuggcugaucuacgacgagaugacccgcgcccaccggaucgccaacauccgcugcugcuccgccgucacccccgugaccauccucguguucugcggccccgcccggcuggcgagcaacgcccugcaggagccguccagcuuccgcgucgacgggauccccaacgacuccagcgacuccgagauggaggacaagacgaccgccaaccucgccgcccugaagcuggacgaguggcuccacuucacccuggagcccgaggcggccagccugcuccugcagcugcggcagaaguggcacucccucuuccugcgccggaugcgcgcccccagcaagccguggucccagguggacgaggccaccauccgggccaucaucgcggugcugagcacggaggagcaguccgccggccuccagcagcccagcggcaucgggcagcgcccccggcccauguccagcgaggagcugccgcuggccagcuccuggcgcagcaacaacucccgcaagagcuccgccgacaccgaguucagcgacgagugcaccaccgcggagcggguccucaugaagucccccagccccgcccugcacccgccccagaaguacaaggaccggggcauccugcaccccaagcgcgggacggaggaccgguccgaccagagcucccucaagagcaccgacuccagcuccuaccccagcccgugcgccucccccagcccgcccuccagcggcaaggggagcaagucccccagcccccgccccaacaugcccgugcgguacuucaucaugaaguccagcaaccugcgcaaccuggagaucucccagcagaagggcaucuggagcaccaccccguccaacgagcgcaagcucaaccgggccuucugggagagcuccaucguguaccuggucuucagcgugcagggcuccgggcacuuccagggcuucagccgcauguccagcgagaucgggcgggagaagucccaggacuggggcagcgccggccucgggggcgucuucaagguggaguggauccgcaaggagucccugcccuuccaguucgcgcaccaccuccugaaccccuggaacgacaacaagaaggugcagaucagccgggacgggcaggagcuggagccccuggucggcgagcagcugcuccagcugugggagcgccugccgcucggggagaagaacacgaccgacuga

SEQ ID NO: 38832 - RNA, 741 nt, Artificial Sequence
  derived and/or modified sequence opt1 from YWHAB__Homo_sapiens__NP_647539
augaccauggacaagagcgagcuggugcagaaggccaagcucgccgagcaggcggagcgcuacgacgacauggccgccgccaugaaggccgucaccgagcagggccacgagcuguccaacgaggagcggaaccugcucagcguggcguacaagaacguggucggggcccgccgguccagcuggcgcgugaucuccagcaucgagcagaagacggagcggaacgagaagaagcagcagaugggcaaggaguaccgcgagaagaucgaggccgagcugcaggacaucugcaacgacgugcuggagcuccuggacaaguaccugauccccaacgccacccagccggaguccaaggucuucuaccucaagaugaagggggacuacuuccgguaccugagcgagguggcguccggcgacaacaagcagaccaccgugagcaacucccagcaggccuaccaggaggccuucgagaucagcaagaaggagaugcagcccacgcaccccauccgccuggggcucgcccugaacuucuccgucuucuacuacgagauccugaacagccccgagaaggccugcucccucgcgaagaccgccuucgacgaggccaucgccgagcuggacacccugaacgaggagagcuacaaggacuccacccucaucaugcagcugcugcgggacaaccucacgcuguggaccagcgagaaccagggcgacgagggcgacgccggggagggcgagaacuga

SEQ ID NO: 38833 - RNA, 768 nt, Artificial Sequence
  derived and/or modified sequence opt1 from YWHAE__Homo_sapiens__NP_006752
auggacgaccgcgaggaccugguguaccaggccaagcucgccgagcaggcggagcgguacgacgagauggucgagagcaugaagaagguggccggcauggacguggagcugaccgucgaggagcgcaaccugcucuccguggccuacaagaacgugaucggggcccggcgcgccagcuggcggaucaucuccagcaucgagcagaaggaggagaacaagggcggggaggacaagcugaagaugauccgcgaguaccggcagauggucgagaccgagcugaagcucaucugcugcgacauccuggacgugcuggacaagcaccucauccccgcggccaacacgggcgaguccaagguguucuacuacaagaugaagggggacuaccaccgcuaccuggccgaguucgccaccggcaacgaccggaaggaggcggccgagaacagccuggucgccuacaaggccgccuccgacaucgcgaugaccgagcucccgcccacccaccccauccgccugggccuggcccucaacuucagcguguucuacuacgagauccugaacucccccgaccgggccugccgccuggccaaggccgcguucgacgacgccaucgccgagcucgacacgcugagcgaggaguccuacaaggacagcacccugaucaugcagcuccugcgggacaaccugacccucuggaccuccgacaugcagggggacggcgaggagcagaacaaggaggcccugcaggacguggaggacgagaaccaguga

SEQ ID NO: 38834 - RNA, 744 nt, Artificial Sequence
  derived and/or modified sequence opt1 from YWHAG__Homo_sapiens__NP_036611
augguggaccgcgagcagcugguccagaaggcccggcucgccgagcaggcggagcgcuacgacgacauggccgccgccaugaagaacgugaccgagcugaacgagccccugagcaacgaggagcggaaccuccuguccguggccuacaagaacgucgugggcgcgcgccggagcuccuggcgcgugaucagcuccaucgagcagaagaccagcgccgacgggaacgagaagaagaucgagaugguccgggccuaccgcgagaagaucgagaaggagcuggaggccgugugccaggacgugcucucccugcuggacaacuaccucaucaagaacugcagcgagacgcaguacgaguccaaggucuucuaccugaagaugaagggcgacuacuaccgguaccuggcggagguggccaccggggagaagcgcgccaccguggucgagagcuccgagaaggccuacagcgaggcccacgagaucuccaaggagcacaugcagccgacccaccccauccggcucggccuggcgcugaacuacagcguguucuacuacgagauccagaacgcccccgagcaggccugccaccucgccaagacggccuucgacgacgcgaucgccgagcuggacacccugaacgaggacuccuacaaggacagcacccucaucaugcagcugcugcgcgacaaccucacccuguggacguccgaccagcaggacgacgacgggggcgagggcaacaacuga

SEQ ID NO: 38835 - RNA, 741 nt, Artificial Sequence
  derived and/or modified sequence opt1 from YWHAH__Homo_sapiens__NP_003396
augggcgaccgcgagcagcugcuccagcgggcccgccuggccgagcaggcggagcgguacgacgacauggccagcgccaugaaggccgugaccgagcugaacgagccccucuccaacgaggaccgcaaccugcugagcgucgccuacaagaacguggugggggcgcggcgcuccagcuggcgggucaucuccagcaucgagcagaagaccauggccgacggcaacgagaagaagcucgagaaggugaaggccuaccgcgagaagaucgagaaggagcuggagacggugugcaacgacguccugucccuccuggacaaguuccugaucaagaacugcaacgacuuccaguacgagagcaagguguucuaccucaagaugaagggggacuacuaccgguaccuggccgagguggcguccggcgagaagaagaacagcgucguggaggccuccgaggccgccuacaaggaggccuucgagaucagcaaggagcagaugcagccgacccaccccauccgccuggggcucgcgcugaacuucuccguguucuacuacgagauccagaacgcccccgagcaggccugccugcucgccaagcaggccuucgacgacgcgaucgccgagcuggacacccugaacgaggacagcuacaaggacuccacccucaucaugcagcugcugcgggacaaccucacgcuguggaccagcgaccagcaggacgaggaggccggcgagggcaacuga

SEQ ID NO: 38836 - RNA, 738 nt, Artificial Sequence
  derived and/or modified sequence opt1 from YWHAQ__Homo_sapiens__NP_006817
auggagaagaccgagcugauccagaaggccaagcucgccgagcaggcggagcgcuacgacgacauggcgaccugcaugaaggccgugacggagcagggcgccgagcugagcaacgaggagcggaaccugcucuccgucgccuacaagaacguggucgggggccgccggagcgccuggcgcgugaucuccagcaucgagcagaagaccgacaccuccgacaagaagcugcagcugaucaaggacuaccgggagaagguggagagcgagcuccgcuccaucugcaccacggugcuggagcugcucgacaaguaccugaucgccaacgccaccaaccccgagagcaaggucuucuaccugaagaugaagggggacuacuuccgguaccucgccgagguggcgugcggcgacgaccgcaagcagaccaucgacaacucccagggggccuaccaggaggccuucgacaucagcaagaaggagaugcagccgacccaccccauccggcugggccuggcccucaacuucuccguguucuacuacgagauccugaacaaccccgagcuggccugcacgcucgcgaagaccgccuucgacgaggccaucgccgagcuggacacccugaacgaggacagcuacaaggacuccacccucaucaugcagcugcugcgcgacaaccucacgcuguggaccagcgacuccgccggcgaggagugcgacgcggccgagggggccgagaacuga

SEQ ID NO: 38837 - RNA, 738 nt, Artificial Sequence
  derived and/or modified sequence opt1 from YWHAZ__Homo_sapiens__NP_001129172
auggacaagaacgagcuggugcagaaggccaagcucgccgagcaggcggagcgcuacgacgacauggccgccugcaugaaguccgucaccgagcagggcgccgagcugagcaacgaggagcggaaccugcucagcguggccuacaagaacguggucggggcgcgccgguccagcuggcgcgugguguccagcaucgagcagaagaccgagggcgccgagaagaagcagcagauggcccgggaguaccgcgagaagaucgagacggagcugcgggacaucugcaacgacguccugucccuccuggagaaguuccugauccccaacgccagccaggcggaguccaagguguucuaccucaagaugaagggggacuacuaccgcuaccuggccgagguggccgccggcgacgacaagaaggggaucgucgaccagagccagcaggccuaccaggaggcguucgagaucuccaagaaggagaugcagccgacccaccccauccggcugggccucgcccugaacuucagcguguucuacuacgagauccugaacucccccgagaaggccugcagccucgccaagaccgccuucgacgaggcgaucgccgagcuggacacccuguccgaggagagcuacaaggacuccacgcucaucaugcagcugcugcgcgacaaccucacccuguggaccagcgacacccagggcgacgaggccgaggccggggagggcggggagaacuga

SEQ ID NO: 38838 - RNA, 2667 nt, Artificial Sequence
  derived and/or modified sequence opt1 from YY1AP1__Homo_sapiens__NP_001185832
auggccggcguggggcgcagcggcgggcccuggggccggacccgcgggggccgguccggccgccugggggucagccucggcgcccuguccagccugccgcucgaggagcugccccggccccugugcugccgccggugccgccggcacuucggguucgcgcuccgcggcgagaccauccccguguccguggccgggagcgccuccagccaguucgccccgcuggcccugcaccucucccugcugcucagccggaucuccgcgagccgccugacgcgguggcccccgcccgacaagcgcgagggcuccgccgucgaccccggcaagcggcgcagccuggccgccacccccuccagcucccuccccugcacccugaucgcgcuggggcuccggcacgagaaggaggccaacgagcugauggaggaccuguucgagaccuuccaggacgagaugggcuucagcaacauggaggacgacgggcccgaggaggaggagcgcguggccgagccgcaggccaacuucaacacgccccaggcccuccgguucgaggagcugcuggcgaaccuccugaacgagcagcaccagaucgccaaggagcuguucgagcagcucaagaugaagaagcccuccgccaagcagcagaaggagguggagaaggucaagccccagugcaaggaggugcaccagacccugauccuggacccggcccagcgcaagcggcuccagcagcagaugcagcagcacgugcagcugcugacccagauccaccuccuggcgaccugcaaccccaaccugaaccccgaggccagcagcacgcgcaucugccucaaggagcugggcaccuucgcccaguccagcaucgcccugcaccaccaguacaaccccaaguuccagacccucuuccagccgugcaaccugaugggcgccaugcagcugaucgaggacuucuccacccacgucagcaucgacugcagcccccacaagacggugaagaagaccgccaacgaguuccccugccuccccaagcaggucgcguggauccuggccaccuccaagguguucauguacccggagcugcuccccgugugcucccugaaggccaagaacccccaggacaagauccuguucaccaaggccgaggacaaccuccuggcccuggggcugaagcacuucgagggcacggaguuccucaacccccugaucagcaaguaccugcugaccugcaagaccgcgcgccagcucaccgugcggaucaagaaccugaacaugaaccgcgccccggacaacaucaucaaguucuacaagaagacgaagcagcuccccguccuggggaagugcugcgaggagauccagccccaccaguggaagccgcccaucgagcgggaggagcaccgccugcccuucuggcucaaggccucccugcccagcauccaggaggagcugcggcacauggccgacggcgcgcgcgagguggggaacaugaccggcaccaccgagaucaacuccgaccagggccucgagaaggacaacagcgagcugggguccgagacgcgguacccgcugcuccugcccaagggcgugguccugaagcucaagcccguggccgaccgcuuccccaagaaggccuggcggcagaagcgcagcuccgugcugaagccgcugcucauccagcccagccccucccugcagcccagcuucaacccggggaagacccccgcccaguccacccacagcgaggccccgcccagcaagaugguccugcggaucccccaccccauccagcccgcgaccgugcuccagacggugcccggcgucccgccccuggggguguccggcggcgagagcuucgagucccccgccgcccugcccgccaugccgcccgaggcccgcaccagcuucccccucuccgagagccagacccugcuguccagcgcgccgguccccaaggugaugaugcccucccccgccagcuccauguuccggaagccguacgugcgccggcgccccagcaagcggcgcggggcccgggccuuccgcugcaucaagcccgcccccgucauccacccggcguccgugaucuucaccgugcccgccacgaccgucaagaucgugagccucggcgggggcugcaacaugauccagcccgugaacgccgccgucgcgcagagcccccagaccaucccgaucgccacccugcuggugaaccccacguccuuccccugcccccucaaccagccgcugguggccuccagcgucagcccccugaucguguccgggaacagcgugaaccuccccauccccuccaccccggaggacaaggcccacaugaacgucgacaucgccugcgcgguggccgacggcgagaacgccuuccagggccuggagcccaagcuggagccccaggagcucagcccccuguccgccaccguguucccgaaggucgagcacagccccgggcccccgcccguggacaagcagugccaggagggccuguccgagaacagcgccuaccgcuggaccguggucaagaccgaggaggggcggcaggcgcucgagccccugccccagggcauccaggagucccugaacaacagcuccccgggcgaccucgaggagguggugaagauggagcccgaggacgccacggaggagaucagcggguuccuguga

SEQ ID NO: 38839 - RNA, 1245 nt, Artificial Sequence
  derived and/or modified sequence opt1 from YY1__Homo_sapiens__NP_003394
auggccagcggcgacacccuguacaucgccaccgacggguccgagaugcccgcggagaucguggagcuccacgagaucgaggucgagacgaucccgguggagaccaucgagaccaccguggucggcgaggaggaggaggaggacgacgacgacgaggacgggggcgggggcgaccacggcgggggcgggggccacgggcacgccggccaccaccaccaccaccaccaccaccaccaccacccgcccaugaucgcccugcagccccuggugacggacgacccgacccaggugcaccaccaccaggaggucauccucgugcagacccgcgaggagguggucggcggggacgacagcgacggccugcgggccgaggacggguucgaggaccagauccugauccccgugcccgcccccgcgggcggcgacgacgacuacaucgagcagacccucgugacggucgccgccgccgggaaguccggcgggggcgggagcuccagcuccggcggcgggcgcgugaagaagggcgggggcaagaaguccgggaagaaguccuaccugagcggcggcgcgggggccgccggcgggggcggggccgacccgggcaacaagaagugggagcagaagcagguccagaucaagacccuggagggcgaguucagcgugaccauguggagcuccgacgagaagaaggacaucgaccacgagaccgugguggaggagcagaucaucggggagaacagcccgcccgacuacuccgaguacaugacgggcaagaagcucccgcccgggggcauccccggcaucgaccugagcgaccccaagcagcuggccgaguucgcgcggaugaagccccgcaagaucaaggaggacgacgcgccccggaccaucgccugcccccacaaggggugcaccaagauguuccgcgacaacuccgccaugcggaagcaccuccacacccacggcccccgcguccacgugugcgccgagugcgggaaggccuucguggagagcuccaagcugaagcggcaccagcugguccacacgggcgagaagcccuuccagugcaccuucgaggggugcggcaagcgcuucagccucgacuucaaccugcggacccacgugcgcauccacaccggcgaccggcccuacgugugccccuucgacgggugcaacaagaaguucgcccagagcacgaaccugaagucccacauccucacccacgccaaggccaagaacaaccaguga

SEQ ID NO: 38840 - RNA, 1239 nt, Artificial Sequence
  derived and/or modified sequence opt1 from ZACN__Homo_sapiens__NP_851321
augauggcccuguggagccuccugcaccugaccuuccucggcuucuccaucacccugcugcucgugcacgggcagggcuuccaggggacggccgccaucuggcccagccuguucaacgucaaccuguccaagaaggugcaggagagcauccagaucccgaacaacggcuccgcgccccuccugguggacguccgcguguucgugagcaacgucuucaacguggacauccugcgguacaccauguccagcaugcuccugcugcgccucuccuggcuggacacccggcuggccuggaacaccagcgcccacccccgccacgccaucacgcuccccugggagucccuguggaccccgcggcugaccauccucgaggcccuguggguggacuggcgcgaccagagcccccaggcccgggucgaccaggacgggcacgugaagcugaaccucgcccuggccaccgagacgaacugcaacuucgagcugcuccacuucccccgcgaccacuccaacugcagccuguccuucuacgcgcugagcaacaccgccauggagcucgaguuccaggcccacguggucaacgagaucguguccgugaagcgggaguacgucguguacgaccugaagacccaggugcccccgcagcagcugguccccugcuuccaggugacccuccgccugaagaacacggcccucaagagcaucaucgcccugcuggugcccgcggaggcccugcuccuggccgacgucugcggcggccugcucccccugcgggccaucgagcgcaucggguacaaggugacccugcuccuguccuaccuggugcuccacagcagccugguccaggcccugccguccagcuccagcugcaacccccugcucaucuacuacuucaccauccugcugcuccugcuguuccucuccaccaucgagacggugcugcuggcgggccuccuggcccgggggaaccugggcgccaagagcgggcccucccccgccccgcgcggcgagcagcgggagcacggcaaccccgggccccaccccgccgaggagccgagccgcggcgucaaggggucccagcggagcuggcccgagaccgcggaccgcaucuucuuccucguguacguggucggcgugcugugcacccaguucguguucgccggcaucuggaugugggccgccugcaaguccgacgccgcgcccggggaggccgcgccccacggccggcgcccgcggcuguga

SEQ ID NO: 38841 - RNA, 1368 nt, Artificial Sequence
  derived and/or modified sequence opt1 from ZAK__Homo_sapiens__NP_598407
augagcucccugggcgccagcuucgugcagaucaaguucgacgaccuccaguucuucgagaacugcgggggcggguccuucggcagcgucuaccgcgccaaguggaucucccaggacaaggagguggcggugaagaagcugcugaagaucgagaaggaggccgagauccucagcguccugucccaccggaacaucauccaguucuacggggugauccuggagcccccgaacuacggcaucgugaccgaguacgccagccucggcucccuguacgacuacaucaacagcaaccgcuccgaggagauggacauggaccacaucaugaccugggccacggacgucgccaaggggaugcacuaccugcacauggaggcgcccgugaaggugauccaccgggaccucaagagccgcaacgucgugaucgccgccgacggcgugcugaagaucugcgacuucggggccucccgguuccacaaccacaccacccacaugagccuggucggcaccuuccccuggauggcgcccgaggugauccagucccucccggugagcgagacgugcgacaccuacuccuacggggucgugcugugggagaugcugacccgcgaggugcccuucaagggccucgagggccugcaggucgccuggcuggugguggagaagaacgagcggcucaccauccccagcuccugcccccgcagcuucgccgagcugcugcaccagugcugggaggccgacgccaagaagcggccgagcuucaagcagaucaucuccauccucgagagcauguccaacgacacgagccugcccgacaagugcaacuccuuccugcacaacaaggcggaguggcgcugcgagaucgaggccacccucgagcggcugaagaagcuggagcgcgaccucagcuucaaggagcaggagcugaaggagcgggagcgccggcugaagaugugggagcagaagcucaccgagcaguccaacacgccccugcugcucccccuggccgcccgcaugagcgaggaguccuacuucgagagcaagaccgaggaguccaacagcgccgagauguccugccagaucaccgcgaccagcaacggggagggccacgggaugaacccgucccugcaggccaugaugcucaugggcuucggcgacaucuucagcaugaacaaggccggggccgucaugcacuccggcaugcagaucaacaugcaggccaagcagaacagcuccaagaccacgagcaagcggcgcgggaagaaggugaacauggcgcugggcuucagcgacuucgaccuguccgagggggacgacgacgacgacgacgacggcgaggaggaggacaacgacauggacaacagcgaguga

SEQ ID NO: 38842 - RNA, 1860 nt, Artificial Sequence
  derived and/or modified sequence opt1 from ZAP70__Homo_sapiens__NP_001070
augcccgaccccgccgcccaccuccccuucuucuacggcagcaucucccgcgcggaggccgaggagcaccugaagcuggccgggauggccgacggccuguuccuccugcggcagugccugcgcagccucgggggcuacgugcugucccugguccacgacgugcgguuccaccacuuccccaucgagcgccagcucaacgggaccuacgccaucgcgggcggcaaggcccacugcgggcccgccgagcugugcgaguucuacagccgggacccggacggccugcccugcaaccuccgcaagcccugcaaccggcccuccgggcuggagccgcagcccggcguguucgacugccugcgcgacgccaugguccgggacuacgugcgccagaccuggaagcucgagggggaggcgcuggagcaggccaucaucagccaggcgccccagguggagaagcugaucgccacgaccgcccacgagcggaugcccugguaccacuccagccucacccgcgaggaggccgagcggaagcuguacuccggcgcccagaccgacggcaaguuccugcuccgcccgcggaaggagcaggggacguacgcccugagccugaucuacggcaagaccgucuaccacuaccucaucucccaggacaaggccgggaaguacugcauccccgagggcaccaaguucgacacccuguggcagcugguggaguaccucaagcugaaggccgacggccugaucuacugccucaaggaggcgugccccaacagcuccgccagcaacgccuccggggccgccgcgcccacgcugccggcccaccccagcacccugacccacccccagcgccggaucgacacccucaacuccgacggcuacacgcccgagccggcccgcaucaccagccccgacaagccccggcccaugccgauggacaccuccguguacgagagccccuacagcgaccccgaggagcugaaggacaagaagcuguuccucaagcgcgacaaccugcugaucgccgacaucgagcucgggugcggcaacuucggguccguccggcagggcguguaccgcaugcgcaagaagcagaucgacguggccaucaagguccugaagcagggcaccgagaaggcggacacggaggagaugaugcgggaggcccagaucaugcaccagcuggacaaccccuacaucgugcgccucaucggggugugccaggccgaggcccugaugcuggucauggagauggcgggcgggggcccgcuccacaaguuccugguggggaagcgggaggagauccccgugagcaacgucgccgagcugcuccaccagguguccaugggcaugaaguaccuggaggagaagaacuucgugcaccgcgaccuggccgcccggaacguccugcucgugaaccgccacuacgccaagaucagcgacuucggccuguccaaggcgcugggggccgacgacagcuacuacaccgcccgguccgccggcaaguggccccucaagugguacgccccggagugcaucaacuuccgcaaguucagcucccggagcgacgugugguccuacggggucaccaugugggaggcgcugagcuacggccagaagcccuacaagaagaugaaggggcccgaggugauggccuucaucgagcagggcaagcgcauggagugcccgcccgagugcccgcccgagcuguacgcccucauguccgacugcuggaucuacaagugggaggaccggcccgacuuccugaccgucgagcagcgcaugcgggccugcuacuacagccuggccuccaagguggagggcccgcccgggagcacgcagaaggcggaggccgccugcgccuga

SEQ ID NO: 38843 - RNA, 1275 nt, Artificial Sequence
  derived and/or modified sequence opt1 from ZAR1__Homo_sapiens__NP_783318
auggccgcccugggcgacgaggugcucgacggguacgucuuccccgcgugcccgcccugcagcuaccgcuaccccuaccccgccgccaccaagggcaagggggccgccggcggguccuggcagcagcggggccgcggcugccugccggcgagcucccccugcagcgccggggccgccucccugagcuuccccggcugcgggcggcucaccgcggccgaguacuucgacuccuaccagcgcgagcggcugauggcccugcucgcccaggugggccccgggcugggcccgcgcgcccggcgcgcgggcagcugcgacguggccguccagguguccccgcggaucgacgccgccgugcagugcagccuggggcgccggacgcuccagcgccgggcccgcgaccccgagucccccgcgggccccggggccgagggcaccaccggcgggggcagcuucucccagcagcccagccggcgcgggcuggagcagggcagcccccagaacggggcgccccggccgaugcgcuucccccggaccgucgccguguacagcccccuggcccuccgccggcugacggccuuccuggagggccccggcccggccgccggggagcagcgcuccggcgccagcgacggggagcgcggcccgccgcccgcccggcuccaggggcccgaggagggcgagguguggaccaagaaggcgccccgccggccccaguccgacgacgacggcgaggcccaggccgccguccgcgcgagcugggagcagcccgccgacgggcccgagcugccgccccgggaggcccaggagggcgaggccgcgccccgcagcgcccugcggucccccgggcagccgcccagcgccggccgcgcccgggacgggggcgacggccgcgaggccgccguggcgggggagggccccagcccccggucccccgagcucgggaaggagcgccugcgguuccaguuccuggagcagaaguacggcuacuaccacugcaaggacugcaacauccgcugggaguccgccuacguguggugcguccagggcaccaacaagguguacuucaagcaguucugccggaccugccagaaguccuacaaccccuaccgcguggaggacaucacgugccaguccugcaagcagacccggugcagcugcccggucaagcuccgccacguggaccccaagcggccccaccgccaggaccugugcgggcgcugcaagggcaagcggcuguccugcgacagcaccuucuccuucaaguacaucaucuga

SEQ ID NO: 38844 - RNA, 966 nt, Artificial Sequence
  derived and/or modified sequence opt1 from ZAR1L__Homo_sapiens__NP_001130043
auggagcgcuucgugcggguccccuacggccuguaccagggguacggcagcaccgugccgcucgggcagcccggccuguccgggcacaagcagcccgacuggcgccagaacauggggcccccgaccuuccuggcccggcccggccuccuggugcccgccaacgcgcccgacuacugcaucgacccguacaagcgcgcccagcugaaggccauccucagccagaugaaccccucccugagcccccggcugugcaagcccaacacgaaggaggucggcguccagguguccccgcgcguggacaaggccgugcagugcagccucggcccccggacccuguccagcugcucccccugggacgggcgcgacccccaggagccgcugcccgccugcggcgugaccagccccgcgaccgggcggcgcggccucauccggcugcgccgggacggcgacgaggccgaguccaaggcccugcccgggccggccgaggcgagccagccccagccgcccucccgccggagcggcgccgaccgccaggaggagcccgggcagcucgaggaguccggcgagaaggacgcccccugcccccaggagaccaagagcaagcagguccccggcgacgccgccuccgagccgcugcggcgccccaacuuccaguuccuggagcccaaguacggguacuuccacugcaaggacugcaagacgcggugggagagcgcguacguguggugcaucuccggcaccaacaagguguacuucaagcagcucugcugcaagugccagaaguccuucaacccguaccgcgucgaggccauccagugccagaccugcagcaagagccacugcagcugcccccagaagaagcggcacaucgaccugcgccgcccccaccggcaggagcugugcgggcgcugcaaggacaagcgguucuccugcggcaacaucuacagcuucaaguacgugauguga

SEQ ID NO: 38845 - RNA, 507 nt, Artificial Sequence
  derived and/or modified sequence opt1 from ZASP__Homo_sapiens__NP_001276862
augcccgccagccacgccccgggcgcguccgccaacccgcccugccaccuccccagcgugaucgccgacuccuuccuggccagccaccugucccccagccccgagcgcaccgucaugcugggguccgcccccgacccccucccgcaggcgggcagccggcgcgggcaccggggcgaggccaaccccgcccccagcccccgcucccacugcgccuccccgaccacgagcuggaagcggcgcgggccccgggagggcgcgucccccaccagccugcuguccagcacccccugcuggaccggccuccgcggggagggcgggggcacggggccgaccccgcccggcacccccggcgccgaggacgcccccgggcugcgggcccugcgcgaggcccggggcgagggcgggcucggccuggggacccugggccuccccgcguggcugccccuggggucccgcguguggguggagggcccccgggucagccagguguccugccagccgcaguga

SEQ ID NO: 38846 - RNA, 2085 nt, Artificial Sequence
  derived and/or modified sequence opt1 from ZBED1__Homo_sapiens__NP_001164606
auggagaacaagagccuggaguccagccagaccgaccucaagcugguggcccacccccgcgccaaguccaagguguggaaguacuucggcuucgacaccaacgcggaggggugcauccugcaguggaagaagaucuacugccggaucugcauggcccagaucgccuacagcggcaacacguccaaccucagcuaccaccuggagaagaaccacccggaggaguucugcgaguucgugaaguccaacaccgagcagaugcgcgaggccuucgccaccgcguucagcaagcugaagcccgaguccagccagcagcccgggcaggacgcccucgccgugaaggccggccacggguacgacuccaagaagcagcaggagcugaccgcggccguccugggccucaucugcgagggccuguaccccgccagcaucguggacgagccgacguucaaggugcugcucaagaccgccgacccccgguacgagcugcccucccgcaaguacaucagcaccaaggccauccccgagaaguacggggcgguccgggaggugauccugaaggagcucgccgaggccaccuggugcggcaucuccacggacauguggcgcagcgagaaccagaaccgggccuacgugacccuggccgcgcacuuccuggggcucggcgccccgaacugccuguccauggggagccgcugccugaagaccuucgagguccccgaggagaacaccgccgagacgaucacccgggugcucuacgagguguucaucgaguggggcaucuccgccaaggucuucggcgccaccaccaacuacgggaaggacaucgugaaggcgugcagccugcuggacguggccguccacaugcccugccucggccacacguucaacgccgggauccagcaggccuuccagcugcccaagcugggcgcccuccugagccgcugccggaagcugguggaguacuuccagcaguccgcgguggccauguacaugcucuacgagaagcagaagcagcagaacgucgcccacugcaugcuggugagcaaccgcguguccugguggggcagcacccuggccaugcuccagcggcugaaggagcagcaguucgucaucgcgggggugcugguggaggacuccaacaaccaccaccucaugcuggaggccagcgagugggccaccaucgagggccuggucgagcuccugcagccguucaagcaggucgccgagaugcuguccgccagccgcuaccccaccaucuccauggugaagccccuccugcacaugcugcucaacacgacccugaacaucaaggagaccgacagcaaggagcuguccauggcgaaggaggugaucgccaaggagcucagcaagaccuaccaggagacgcccgagaucgacauguuccugaacguggccaccuuccuggacccgcgguacaagcgccugcccuuccucuccgccuucgagcggcagcaggucgagaaccgcgugguggaggaggccaaggggcugcuggacaaggucaaggacggcggguaccggcccgcggaggacaagaucuuccccgugccggaggagccgcccgugaagaagcucaugcgcaccagcacgccgccgcccgccuccgucaucaacaacaugcuggccgagaucuucugccagaccggcggcguggaggaccaggaggaguggcacgcccagguggucgaggagcugagcaacuucaagucccagaaggugcucgggcugaacgaggacccccugaagugguggagcgaccggcucgcccuguucccccugcuccccaaggugcugcagaaguacuggugcgucaccgcgacccgcguggcccccgagcgccuguucggcuccgccgccaacguggucagcgcgaagcggaaccgccucgcccccgcccacguggacgagcaggucuuccuguacgagaacgcccggagcggggccgaggcggagcccgaggaccaggacgagggcgagugggggcuggaccaggagcaggucuucucccucggcgacggcgugagcgggggcuucuucgggauccgcgacuccagcuuccuguga

SEQ ID NO: 38847 - RNA, 3516 nt, Artificial Sequence
  derived and/or modified sequence opt1 from ZBED4__Homo_sapiens__NP_055653
auggagaacaaccugaagaccugccccaaggaggacggcgacuucgugagcgacaagaucaaguucaagaucgaggaggaggacgacgacgggaucccgcccgacucccucgagcgcauggacuucaagagcgagcaggaggacaugaagcagaccgacuccggcggggagcgggccggccucgggggcacgggcugcagcugcaagccgcccgggaaguaccuguccgccgagagcgaggacgacuacggcgcccuguucucccaguacagcuccacccuguacgacgucgccauggaggccgugacccagagccugcucuccagccgcaacauguccagccggaagaagucccccgccuggaagcacuucuucaucagcccccgcgacuccaccaaggccaucugcauguacugcgugaaggaguucagccgggggaagaacgagaaggaccuguccacgagcugccugaugcgccacguccggcgcgcgcaccccaccgugcucauccaggagaacggcagcguguccgccgucagcuccuuccccagcccgucccugcugcucccgccccagcccgccgacgccggggaccugagcaccauccugucccccaucaagcucgugcagaagguggcgagcaagauccccucccccgaccggaucaccgaggagagcgucuccguggugagcuccgaggagaucagcuccgacaugagcgucuccgagaagugcggccgcgaggaggcccuggugggcagcagcccccaccucccggcccuccacuacgacgagcccgccgagaaccuggccgagaagucccugccccuccccaaguccacguccgggagccggcgccgguccgcgguguggaagcacuucuaccugagcccgcuggacaacuccaaggccgucugcauccacugcaugaacgaguucagccgcggcaagaacgggaaggaccucggcaccuccugccugauccggcacauguggcgcgcccaccgggccaucgugcugcaggagaacggcgggaccggcaucccgccccucuacagcaccccgcccacgcugcugcccucccuccugccgcccgagggggagcugagcuccgugagcuccagccccgucaagcccgugcgcgagucccccagcgccuccagcagccccgaccggcugaccgaggaccugcagagccaccugaaccccggcgacgggcucauggaggacguggcggcguucagcuccagcgacgacaucggcgaggccuccgccagcucccccgagaagcagcaggccgacggccugagcccccgccuguucgaguccggggcgaucuuccagcagaacaagaaggucaugaagcggcucaagagcgagguguggcaccacuucucccuggccccgauggacagccugaaggccgagugccgcuacugcggcugcgccaucucccgcgggaagaagggcgacguggggaccagcugccucaugcggcaccuguaccgccggcaccccgaggucgugggcucccagaagggcuuccugggggccagccucgcgaacucccccuacgccacccuggccagcgccgaguccagcagcuccaagcugacggaccuccccaccgucgugaccaagaacaaccaggugauguucccggucaacagcaagaagaccuccaagcuguggaaccacuucagcaucugcuccgcggacagcacgaagguggugugccugcacugcggccgcaccaucucccgggggaagaagcccaccaaccugggcaccagcugccuccugcgccaccuccagcgguuccacuccaacguccugaagacggaggugagcgagaccgcccgccccuccagccccgacacccgggugccgcgcgggaccgagcuguccggcgccagcuccuucgacgacacgaacgagaaguucuacgacagccaccccgucgccaagaagaucaccucccugaucgccgagaugaucgcgcucgaccugcagcccuacagcuucguggacaacgugggcuucaaccggcugcucgaguaccugaagccccaguacucccugccggcccccagcuacuucagccgcaccgccauccccgggauguacgacaacgucaagcagaucaucaugucccaccucaaggaggccgagagcggcgugauccacuucaccuccgggaucuggaugagcaaccagacgcgggaguaccugacccugaccgcccacuggguguccuucgagagccccgcgcgcccgcggugcgacgaccaccacugcuccgcccuccuggacgucagccagguggacugcgacuacuccggcaacagcauccagaagcagcuggagugcuggugggaggccugggugaccuccacgggccuccaggucgggaucaccgugaccgacaacgccagcaucggcaagacccugaacgagggggagcacuccagcgugcagugcuucucccacaccgucaaccugaucgugagcgaggccaucaagucccagcgcauggugcagaaccuccugagccuggcgcggaagaucugcgagcgcguccaccggucccccaaggccaaggagaagcucgccgagcugcagcgcgaguacgcccugccccagcaccaccucauccaggacgugcccagcaaguggagcacguccuuccacaugcuggagcgccugaucgagcagaagcgggcgaucaacgagaugagcguggagugcaacuuccgcgagcucaucuccugcgaccagugggaggucaugcagagcgugugccgggcccugaagccguucgaggccgccucccgcgagaugagcacccagauguccacccugagccaggugauccccaugguccacauccucaaccggaagguggagaugcuguucgaggagaccaugggcaucgacacgaugcugcgcucccucaaggaggccauggugagccggcuguccgcgacccugcacgacccccgcuacgucuucgccacccuccuggacccgcgguacaaggccagccuguucaccgaggaggaggccgagcaguacaagcaggaccucauccgcgagcuggagcugaugaacuccacgagcgaggacguggccgcgucccaccggugcgacgccgggagccccuccaaggacagcgccgccgaggagaaccucuggucccugguggccaaggucaagaagaaggacccccgcgagaagcugcccgaggcgauggugcucgccuaccuggaggaggaggugcuggagcacagcugcgacccgcucaccuacuggaaccugaagaaggccagcuggcccggccuguccgcccucgcgguccgguuccugggcugcccgcccagcaucgugcccuccgagaagcuguucaacacccccaccgagaacgggagccucggccagucccgccugaugauggagcacuucgagaagcugaucuuccucaaggugaaccugccccugaucuacuuccaguacuga

SEQ ID NO: 38848 - RNA, 2082 nt, Artificial Sequence
  derived and/or modified sequence opt1 from ZBED5__Homo_sapiens__NP_001137139
augaucgccccgcugcucugcauccugagcuacaacuucaacaccuucgccauccugaacguguacuccaagcucaccauguucugcacgaccaacagccugcccauggaccugcuccugaagcagggcucccugaagcaggaggucgagagcuucugcuaccagaucguguccgagagcaacgaccagaagguggggauccuccaguccgaggacaagcagcugcagcccagcgucuccaagaaguccgagggcgagcugagccgcgugaaguucaucagcaacuccaacaagaucaccuucagcaagaagcccaagcggcgcaaguacgacgaguccuaccucagcuucggguucaccuacuucggcaaccgggacgcgccccacgcccagugcgugcugugcaagaagauccuguccaacagcucccucgccccgagcaagcugcgccggcaccuggagacgaagcacgccgccuacaaggacaaggacaucagcuucuucaagcagcaccucgacucccccgagaacaacaagccgcccacccccaagaucgucaacaccgacaacgagagcgcgaccgaggccuccuacaacgugagcuaccacaucgcccuguccggggaggcccacacgaucggcgagcugcucaucaagcccugcgcgaaggacguggucaugcgcauguucgacgagcaguacagcaagaagaucgacgccgugcagcuguccaacagcaccguggcccggcgcaucaaggaccuggccgccgacaucgaggaggagcucgucugccggcugaagaucugcgacggcuucucccugcagcucgacgagagcgcggacguguccgggcuggccgugcugcucgucuucgugcgcuaccgguucaacaagagcaucgaggaggaccugcugcucugcgagucccugcagagcaacgccaccggcgaggagaucuucaacugcaucaacuccuucaugcagaagcacgagaucgagugggagaagugcguggacgucugcagcgacgccucccgcgccguggacgggaagaucgcggaggccgugacccugaucaaguacgucgcccccgagagcacguccagccacugccuccuguaccggcacgcccuggccgugaagaucaugcccaccagccucaagaacgugcuggaccaggcgguccagaucaucaacuacaucaaggcccgcccgcaccagucccggcugcucaagauccugugcgaggagaugggcgcccagcacaccgcccugcuccugaacaccgaggugcgcuggcugagccgggggaagguccucgugcgccuguucgagcugcggcgcgagcugcucguguucauggacuccgccuuccggcugagcgacugccugacgaacuccagcuggcuccugcgccuggcguaccucgccgacaucuucaccaagcugaacgaggucaaccuguccaugcagggcaagaacgugaccguguucaccgucuucgacaagaugagcucccuccugcgcaagcuggaguucugggccagcuccguggaggaggagaacuucgacugcuuccccacgcucagcgacuuccugaccgagaucaacuccaccguggacaaggacaucugcagcgccaucguccagcaccuccggggccugcgcgcgacccugcugaaguacuuccccgugacgaacgacaacaacgccugggugcggaaccccuucaccgucaccgugaagccggccucccucguggcccgcgacuacgagagccugaucgaccugaccuccgacagccaggucaagcagaacuucagcgagcucucccugaacgacuucuggagcucccugauccaggaguaccccagcaucgcccggcgcgcggugcgggugcuccugcccuucgccacgaugcaccugugcgagaccggguucuccuacuacgccgccaccaagaccaaguaccgcaagcggcucgacgccgcgccccacaugcgcauccggcugagcaacaucacgccgaacaucaagcgcaucugcgacaagaagacccagaagcacugcucccacuga

SEQ ID NO: 38849 - RNA, 1065 nt, Artificial Sequence
  derived and/or modified sequence opt1 from ZBP1__Homo_sapiens__NP_001153890
auggcccaggcccccgcggacccggggcgcgaggccgagcggccccagcagcacgccgccaccauccccgagacccccgggccgcaguucagccagcagcgcgaggaggacaucuaccgguuccugaaggacaacggcccccagcgcgcccucgugaucgcgcaggcccuggggaugcggacggccaaggacgucaaccgcgaccuguaccggaugaagucccgccaccuccuggacauggacgagcagagcaaggccuggaccaucuaccggcccgaggacuccggccgccgggccaagagcgcguccaucaucuaccagcacaaccccaucaacaugaucugccagaacgggccgaacagcuggaucuccaucgccaacagcgaggccauccagaucggccacggcaacaucaucacccgccagaccgugucccgggaggacgggagcgccggcccccgccaccuccccuccauggcgcccggggacagcuccacguggggcacccugguggacccgugggggccccaggacauccacauggagcagagcauccugcggcgcguccagcugggccacuccaacgagaugcggcuccacggcgugcccagcgaggggcccgcccacaucccgcccggcuccccgcccgugagcgccaccgccgccgggcccgaggcguccuucgaggcccgcauccccagccccggcacccaccccgagggcgaggccgcccagcggauccacaugaaguccugcuuccuggaggacgccacgaucgggaacagcaacaagaugagcaucuccccgggcgucgcggggcccggcgggguggccggcagcggcgagggggagcccggcgaggacgccgggcgccggcccgccgacacccagucccgcagccacuucccgcgcgacaucggccagcccaucacccccucccacagcaagcugaccccgaagcucgagacgaugacccuggggaaccggucccacaaggccgcggagggcagccacuacguggacgaggccucccacgagggcagcugguggggcggcgggaucuga

SEQ ID NO: 38850 - RNA, 2616 nt, Artificial Sequence
  derived and/or modified sequence opt1 from ZBTB10__Homo_sapiens__NP_001099009
augagcuucuccgagaugaaccgccggacccuggccuuccgcggcgggggccucgugaccgccagcgggggcggguccacgaacaacaacgcgggcggcgaggccagcgccuggcccccgcagccccagccccggcagcccccgccgcccgcgcccccggcccugcagccgcccaacgggcgcggcgccgacgaggaggucgagcuggaggggcucgagccccaggaccuggaggccuccgccggccccgccgcgggggccgccgaggaggccaaggagcugcuccugccccaggacgccggcggccccaccagccucgggggcggggcgggcggcccccugcuggccgagcggaaccgccggacccuggccuuccgcgggggcgggggcgggggccucggcaacaacggguccagccggggccgcccggagaccuccguguggccccugcggcacuucaacgggcgcggccccgccacgguggaccuggagcucgacgcccuggaggggaaggagcugaugcaggacggcgcgagccucuccgacagcaccgaggacgaggaggagggcgccucccugggggacggcagcggggccgagggcggguccugcagcuccagccggcgcuccggcggcgacgggggcgacgaggucgaggggagcggcgugggcgccggggagggcgagaccgugcagcacuucccccuggcccggcccaagagccucaugcagaagcugcagugcuccuuccagaccagcuggcugaaggacuuccccuggcuccgcuacuccaaggacacggggcugaugagcugcggcuggugccagaagacccccgcggacgggggcuccgucgaccugcccccggugggccacgacgagcucagccgggggacccgcaacuacaagaagacccugcugcuccggcaccacguguccacggagcacaagcugcacgaggccaacgcccaggagagcgagauccccuccgaggagggcuacugcgacuucaacagccgccccaacgagaacuccuacugcuaccagcugcuccggcagcugaacgagcagcgcaagaaggggauccugugcgacgucagcaucgugguguccggcaagaucuucaaggcccacaagaacauccucgucgccgggagccgcuucuucaagacccuguacugcuucuccaacaaggagagccccaaccagaacaacaccacccaccuggacaucgcggccgugcagggcuucuccgugauccucgacuuccuguacagcggcaaccugguccucacgucccagaacgccaucgaggugaugaccguggccagcuaccugcagaugagcgaggucgugcagaccugccggaacuucaucaaggacgcgcugaacaucuccaucaagagcgaggccccggaguccguggucguggacuacaacaaccgcaagcccgugaaccgggacgggcucagcuccagccgcgaccagaagaucgccuccuucugggccacccggaaccugacgaaccuggccagcaacgucaagaucgagaacgacggcugcaacguggacgaggggcagaucgagaacuaccagaugaacgacuccagcuggguccaggacggcucccccgagauggcggagaacgagagcgaggggcagaccaagguguucaucuggaacaacaugggcucccagggcauccaggagaccgggaagacccgccggaagaaccagacgaccaagcgcuucaucuacaacaucccgcccaacaacgagaccaaccucgaggacugcagcgugaugcagccgcccgucgccuaccccgaggagaacacccugcugaucaaggaggagcccgaccuggacggcgcccuccuguccgggcccgacggcgaccggaacgugaacgccaaccugcucgccgaggcggggacgagccaggacggcggcgacgccgggaccucccacgacuucaaguacggccugaugcccgggccgagcaacgacuucaaguacggccugauccccggcaccagcaacgacuucaaguacgggcucauccccggcgccuccaacgacuucaaguacgggcugcugcccgagagcuggccgaagcaggagaccugggagaacggcgaguccagccucaucaugaacaagcugaagugcccccacugcuccuacguggccaaguaccgccggacgcugaagcgccaccuccugauccacaccgggguccggagcuucuccugcgacaucugcggcaagcuguucacccgccgggagcacgugaagcgccacagccucgugcacaagaaggacaagaaguacaagugcauggucugcaagaagaucuucaugcuggccgcguccgugggcauccggcacgggagccgccgguacggcgugugcgucgacugcgccgacaagucccagcccgggggccaggaggggguggaccagggccaggacaccgaguucccccgcgacgaggaguacgaggagaacgaggugggcgaggccgacgaggagcuggucgacgacggggaggaccagaacgacccgagccgcugggacgaguccggcgaggugugcaugagccucgacgacuga

SEQ ID NO: 38851 - RNA, 1380 nt, Artificial Sequence
  derived and/or modified sequence opt1 from ZBTB12__Homo_sapiens__NP_862825
auggccagcggcguggagguccugcgcuuccagcuccccgggcacgaggccgcgacccugcggaacaugaaccagcugcgcgccgaggagcgguucugcgacgugaccaucguggccgacucccucaaguuccgcggccacaaggucauccuggccgccugcagcccguuccugcgggaccaguuccuccugaaccccuccagcgagcuccaggugucccucaugcacagcgcgcgcaucguggccgaccugcugcucuccugcuacacgggggcccuggaguucgccguccgggacaucgugaacuaccugaccgcggccagcuaccuccagauggagcacguggucgagaagugccgcaacgcccugucccaguucaucgagcccaagaucggccugaaggaggacggggugagcgaggccucccucgugagcuccaucagcgccaccaagucccugcugcccccggcgcggacccccaagcccgcccccaagccgcccccgcccccgccccugcccccgccccugcugcgccccgucaagcucgaguucccccuggacgaggaccuggagcucaaggccgaggaggaggacgaggacgaggacgaggacgugagcgacaucugcaucgugaaggucgaguccgcccuggagguggcccaccggcugaagcccccgggcggccucgggggcgggcugggcaucgggggcagcgugggcgggcaccugggcgagcucgcgcaguccagcgucccgcccagcacgguggccccgccccaggggguggucaaggccugcuacucccugagcgaggacgccgagggcgagggccugcuccugauccccgggggccgcgccuccgugggggcgaccagcggccugguggaggccgccgccgucgccauggcggcccgcggggccggcggcucccucggggccggcgggagccggggcccccugcccgggggcuucuccggcgggaacccccugaagaacaucaagugcaccaagugccccgagguguuccagggcgucgagaagcucguguuccacaugcgggcgcagcacuucaucuucaugugcccccgcugcgggaagcaguucaaccacagcuccaaccugaaccggcacaugaacgugcaccgcggcgucaagagccacuccugcgggaucugcggcaagugcuucacccagaaguccacgcugcacgaccaccucaaccugcacagcggcgcccggcccuaccgcugcagcuacugcgacgugcgguucgcccacaagcccgccauccgccgccaccugaaggagcagcacgggaagaccaccgccgagaacgugcucgaggcguccgucgccgagaucaacgugcugauccgguga

SEQ ID NO: 38852 - RNA, 1350 nt, Artificial Sequence
  derived and/or modified sequence opt1 from ZBTB14__Homo_sapiens__NP_001137295
auggaguucuucaucagcauguccgagaccaucaaguacaacgacgacgaccacaagacccuguuccucaagacgcugaacgagcagcgccuggagggcgaguucugcgacaucgccaucgugguggaggacgugaaguuccgggcccaccgcugcgugcucgcggccugcagcaccuacuucaagaagcuguucaagaagcuggaggucgacuccagcuccgugaucgagaucgacuuccuccggagcgacaucuucgaggaggugcugaacuacauguacaccgccaagaucuccgucaagaaggaggacgugaaccugaugaugagcuccgggcagauccucggcauccgcuuccuggacaagcugugcagccagaagcgggacguguccagccccgacgagaacaacgggcaguccaagagcaaguacugccucaagaucaaccgcccgaucggcgacgccgccgacacccaggacgacgacgucgaggagaucggggaccaggacgacucccccagcgacgacacgguggagggcaccccgcccucccaggaggacggcaagagccccaccaccacgcugcgggugcaggaggcgauccugaaggagcucggguccgaggagguccgcaaggugaacugcuacggccaggagguggagagcauggagacccccgagagcaaggaccuggggucccagacgccccaggcccugaccuucaacgacggcaugagcgaggucaaggacgagcagacccccggguggaccaccgccgccuccgacaugaaguucgaguaccuccuguacggccaccaccgggagcagaucgcgugccaggccugcggcaagaccuucagcgacgaggggcgccugcggaagcacgagaagcuccacacggccgaccgcccguucgugugcgagaugugcaccaagggcuucaccacccaggcccaccugaaggagcaccugaagauccacacgggguacaagcccuacuccugcgaggugugcggcaagagcuucauccgggcccccgaccucaagaagcacgagcgcguccacuccaacgagcggcccuucgcgugccacaugugcgacaaggccuucaagcacaagagccaccugaaggaccacgagcgccggcaccgcggcgagaagccguucgugugcggguccugcaccaaggccuucgccaaggccagcgaccugaagcggcacgagaacaacaugcacuccgagcgcaagcaggucacccccagcgcgauccaguccgagaccgagcagcuccaggccgccgccauggccgcggaggccgagcagcagcuggagacgaucgccugcagcuga

SEQ ID NO: 38853 - RNA, 2022 nt, Artificial Sequence
  derived and/or modified sequence opt1 from ZBTB16__Homo_sapiens__NP_001018011
auggaccugaccaagaugggcaugauccagcuccagaaccccagccacccgaccgggcugcugugcaaggccaaccagaugcgccucgccggcacgcugugcgacguggucaucaugguggacucccaggaguuccacgcgcaccggaccgugcuggccugcaccagcaagauguucgagauccucuuccaccgcaacucccagcacuacacccuggacuuccugagccccaagacguuccagcagauccucgaguacgccuacaccgccacccugcaggccaaggcggaggaccuggacgaccuccuguacgccgccgagauccuggagaucgaguaccucgaggagcagugccugaagaugcuggagaccauccaggccuccgacgacaacgacacggaggcgaccauggccgacgggggcgccgaggaggaggaggaccggaaggcccgcuaccucaagaacaucuucaucagcaagcacuccagcgaggaguccggguacgccagcgucgcgggccagucccugcccggccccaugguggaccagagcccguccgugagcaccuccuucgggcugagcgccaugucccccaccaaggccgccgucgacagccucaugacgaucggccagucccugcugcaggggacccuccagccccccgccggcccggaggagcccacccuggcggggggcggccggcaccccgggguggccgaggugaagaccgagaugaugcaggucgacgaggugcccagccaggacagcccgggcgccgccgaguccagcaucuccgggggcaugggcgacaagguggaggagcgcgggaaggagggccccgggacgcccacccggagcuccgucaucaccagcgcccgcgagcugcacuacggccgggaggaguccgcggagcaggugcccccgcccgccgaggccgggcaggcccccaccggccgccccgagcacccggcccccccccccgagaagcaccucggcaucuacagcgugcugccgaaccacaaggcggacgccguccuguccaugcccagcuccgugacgagcgggcuccacgugcagcccgcccuggccgucuccauggacuucagcaccuacggcgggcugcucccccagggcuucauccagcgggagcuguucuccaagcugggggagcucgcggugggcaugaagagcgagucccgcaccaucggcgagcagugcagcgugugcggggucgagcugccggacaacgaggccguggagcagcaccggaagcugcacuccggcaugaagaccuacgggugcgagcucugcggcaagcgcuuccuggacagccugcggcuccgcaugcaccugcuggcccacagcgccggggccaaggcguucgugugcgaccagugcggcgcccaguucuccaaggaggacgcccucgagacgcaccggcagacccacaccggcaccgacauggccgucuucugccugcugugcgggaagcgcuuccaggcccagagcgcgcuccagcagcacauggaggugcacgccggcguccgguccuacaucugcagcgagugcaaccgcacguuccccucccacaccgcccugaagcggcaccugcgcagccacaccggggaccaccccuacgagugcgaguucugcggcuccugcuuccgcgacgagagcacccugaagucccacaagcggauccacacgggcgagaagccguacgagugcaacgggugcggcaagaaguucagccucaagcaccagcuggagacccacuaccgcgugcacaccggggagaagcccuucgagugcaagcugugccaccagcggucccgcgacuacagcgccaugaucaagcaccuccggacccacaacggcgccucccccuaccagugcacgaucugcaccgaguacugccccagccuguccagcaugcagaagcacaugaaggggcacaagccggaggagaucccccccgacuggcgcaucgagaagaccuaccuguaccucugcuacguguga

SEQ ID NO: 38854 - RNA, 2205 nt, Artificial Sequence
  derived and/or modified sequence opt1 from ZBTB17__Homo_sapiens__XP_011540387
auguacaccgccaagcugagccucucccccgagaacguggacgacguccuggccguggcgaccuuccugcagaugcaggacaucaucacggccugccacgcccucaagagccuggccgagcccgccaccucccccggcgggaacgcggaggcccuggccaccgagggcggggacaagcgcgccaaggaggagaagguggcgaccagcacgcucucccggcuggagcaggccggccgcagcacccccaucgggcccucccgggaccugaaggaggagcgcggcggccaggcccagagcgccgccuccggggcggagcagaccgagaaggccgacgccccgcgggagcccccgcccgucgagcucaagcccgaccccaccagcggcauggccgccgcggaggccgaggccgcccuguccgagagcuccgagcaggagauggagguggagcccgcccgcaagggggaggaggagcagaaggagcaggaggagcaggaggaggagggcgcggggcccgccgaggugaaggaggagggcagccagcuggagaacggcgaggccccggaggagaacgagaacgaggaguccgccgggacggacagcggccaggagcucggguccgaggcccggggccugcgcagcggcaccuacggggaccggaccgaguccaaggcguacggcagcgucauccacaagugcgaggacugcgggaaggaguucacccacacgggcaacuucaagcgccacauccggauccacaccggggagaagcccuucagcugccgcgagugcuccaaggccuucagcgaccccgccgccugcaaggcgcacgagaagacccacagcccccugaagccguacggcugcgaggagugcggcaaguccuaccggcucaucucccugcugaaccuccacaagaagcgccacagcggggaggcccgguaccgcugcgaggacugcggcaagcuguucaccacguccgggaaccugaagcggcaccagcucgugcacagcggcgagaagcccuaccagugcgacuacugcgggcgcuccuucagcgaccccaccuccaagaugcggcaccuggagacccacgacaccgacaaggagcacaagugcccccacugcgacaagaaguucaaccaggugggcaaccugaaggcccaccucaagauccacaucgccgacggcccgcugaagugccgcgagugcgggaagcaguucacgaccagcggcaaccugaagcggcaccuccgcauccacuccggggagaagcccuacgucugcauccacugccagcgccaguucgccgaccccggcgcgcugcagcggcacgugcgcauccacaccggggagaagcccugccagugcgugaugugcggcaaggccuucacccaggccagcucccugaucgcccacguccggcagcacacgggcgagaagccguacgugugcgagcgcugcgggaagcgguucgugcagagcucccagcucgccaaccacauccgccaccacgacaacauccggccccacaagugcagcgucugcuccaaggcguucgugaacgugggcgaccugagcaagcacaucaucauccacaccggggagaagcccuaccugugcgacaagugcggccgcggcuucaaccgggucgacaaccuccgcagccacgugaagaccgugcaccaggggaaggccggcaucaagauccuggagcccgaggagggguccgaggucagcguggugaccgucgacgacauggugacgcuggccaccgaggcccucgccgcgaccgccgucacccagcugacgggcccggccacccugcccgccguggugcccgucggggcggccgugaccgccgacgagaccgaggugcucaaggccgagaucuccaaggccgucaagcagguccaggaggaggacccgaacacgcacauccuguacgcgugcgacagcugcggcgacaaguuccuggacgccaacucccucgcccagcacgugcggauccacaccgcccaggcccuggugauguuccagaccgacgcggacuucuaccagcaguacggccccgggggcaccuggcccgccggccaggugcugcaggccggggagcucguguuccgcccccgggacggggccgagggccagccggcccuggcggagaccagccccacggcccccgagugcccgccgcccgccgaguga

SEQ ID NO: 38855 - RNA, 1596 nt, Artificial Sequence
  derived and/or modified sequence opt1 from ZBTB18__Homo_sapiens__NP_991331
augugccccaagggcuacgaggacagcauggaguucccggaccacucccgccaccuccugcagugccugagcgagcagcggcaccagggguuccugugcgacugcaccgugcucgugggcgacgcccaguuccgcgcccaccgggcggugcuggccuccugcagcauguacuuccaccuguucuacaaggaccagcucgacaagcgcgacaucgugcaccugaacuccgacaucgucaccgcccccgccuucgcccugcuccuggaguucauguacgaggggaagcugcaguucaaggaccuccccaucgaggacgugcuggcggccgccagcuaccugcacauguacgacaucgugaaggucugcaagaagaagcucaaggagaaggccacgaccgaggcggacuccaccaagaaggaggaggacgccagcuccugcagcgacaagguggagucccugagcgacggcuccagccacaucgccggggaccugcccuccgacgaggacgagggcgaggacgagaagcucaacauccugccgagcaagcgggaccuggccgccgagcccggcaacauguggaugcgccuccccuccgacagcgcggggaucccccaggccggcggggaggccgagccgcacgccaccgccgcgggcaagacgguggccucccccugcagcagcaccgagucccugagccagcgguccgucaccagcgugcgcgacuccgccgacguggacugcguccuggaccucagcgugaaguccagccuguccgggguggagaaccugaacagcuccuacuucagcucccaggacguccuccggagcaaccugguccaggugaagguggagaaggaggccuccugcgacgagagcgacgugggcaccaacgacuacgacauggagcacuccacggugaaggagagcgucuccaccaacaaccgcgugcaguacgagcccgcccaccuggcgccccuccgggaggacagcgugcugcgcgagcuggaccgggaggacaaggccagcgacgacgagaugaugaccccggaguccgagcgcguccagguggagggcgggauggagagcucccuccugcccuacgucagcaacauccugucccccgccggccagaucuucaugugcccccucugcaacaagguguucccgagcccccacauccugcagauccaccuguccacccacuuccgggagcaggacgggauccgcagcaagcccgccgccgacgugaacguccccacgugcucccucugcggcaagaccuucagcugcauguacacccugaagcggcacgagcgcacccacuccggcgagaagccguacacgugcacccagugcggcaagagcuuccaguacucccacaaccugagccggcacgcgguggugcacacccgcgagaagccccacgccugcaaguggugcgagcggcgcuucacccaguccggggaccucuaccgccacauccggaaguuccacugcgagcuggucaacagccuguccgucaagagcgaggcccucagccugcccacggugcgcgacuggacccuggaggacuccagccaggagcucuggaaguga

SEQ ID NO: 38856 - RNA, 2226 nt, Artificial Sequence
  derived and/or modified sequence opt1 from ZBTB20__Homo_sapiens__NP_001157814
augcuggagcgcaagaagcccaagaccgccgagaaccagaaggccagcgaggagaacgagaucacccagcccggcggguccagcgcgaagcccggccuccccugccugaacuucgaggccgugcugucccccgaccccgcccucauccacagcacgcacucccugaccaacagccacgcccacaccggguccagcgacugcgacaucuccugcaagggcaugaccgagcggauccacagcaucaaccugcacaacuucuccaacagcguccucgagacgcugaacgagcagcgcaaccgggggcacuucugcgacgugaccgugcgcauccacggcuccaugcugcgggcccaccgcugcguccucgcggccggcagccccuucuuccaggacaagcugcugcucggguacuccgacaucgagauccccagcgugguguccguccagagcgugcagaagcugaucgacuucauguacuccggcgugcugcgggucagccagagcgaggcccuccagauccugaccgccgcguccauccugcagaucaagaccgugaucgacgagugcacgcgcaucgugagccagaacgucggggacguguuccccggcauccaggacuccgggcaggacaccccgcggggcacccccgagagcggcaccuccgggcagagcuccgacacggagagcggcuaccuccagucccacccccagcacagcguggaccgcaucuacuccgcccuguacgccugcagcaugcagaacggguccggcgagcggagcuucuacuccggcgccgucgugagccaccacgagaccgcccuggggcucccccgcgaccaccacauggaggacccguccuggaucacccggauccacgagcgcagccagcagauggagcgguaccuguccaccacgcccgagaccacccacugccgcaagcagccccggcccgugcgcauccagacccuggucggcaacauccacaucaagcaggagauggaggacgacuacgacuacuacgggcagcagcgggugcagauccucgagcgcaacgagagcgaggagugcacggaggacaccgaccaggcggagggcaccgagagcgagccgaagggggaguccuucgacagcggcguguccagcuccaucggcaccgagcccgacagcgucgagcagcaguucgggcccggcgccgcccgggacucccaggccgagcccacgcagccggagcaggccgcggaggcccccgccgagggcgggccccagaccaaccagcuggagaccggggccagcucccccgagcgcagcaacgagguggagauggacuccaccgugaucacggucagcaacuccagcgacaaguccgugcugcagcagccgagcgucaacaccuccaucggccagccccuccccagcacccagcuguaccugcgccagaccgagacgcucaccagcaaccugcggaugccccugacccucaccuccaacacccaggugaucggcaccgccgggaacaccuaccugccggcgcuguucaccacccagcccgccggcagcgggcccaagccguuccucuucucccugccccagccccuggccggccagcagacgcaguucgugaccgucagccagcccgggcucuccaccuucaccgcccagcugccggcgccccagccccuggccagcuccgccggccacagcacggccuccggccagggggagaagaagcccuacgagugcacccucugcaacaagaccuucaccgccaagcagaacuacgugaagcacauguucgugcacacgggcgagaagccgcaccagugcagcaucugcuggcgcuccuucagccugaaggacuaccugaucaagcacauggucacccacaccggggugcgggcguaccagugcuccaucugcaacaagcgcuucacccagaaguccagccucaacgugcacaugcggcugcaccgcggcgagaaguccuacgagugcuacaucugcaagaagaaguucagccacaagacgcugcucgagcggcacgucgcccugcacagcgccuccaacggcaccccgcccgccgggacgccgcccggcgcccgcgcggggccgcccggcgugguggccugcaccgaggggacgaccuacgucugcagcgugugccccgccaaguucgaccagaucgagcaguucaacgaccacaugcggaugcacgugagcgacggcuga

SEQ ID NO: 38857 - RNA, 3201 nt, Artificial Sequence
  derived and/or modified sequence opt1 from ZBTB21__Homo_sapiens__NP_001091872
auggagggccugcuccacuacaucaaccccgcccacgccaucagccugcuguccgcgcucaacgaggagcgccugaaggggcagcugugcgacgugcuccugaucgucggcgaccagaaguuccgggcccacaagaacgugcuggccgccagcuccgaguacuuccagagccucuucaccaacaaggagaacgagucccagaccguguuccagcuggacuucugcgagcccgacgccuucgacaacguccugaacuacaucuacagcuccagccucuucguggagaaguccagccuggcggccgugcaggagcugggguacucccucggcaucagcuuccugacgaacaucgucuccaagacgccccaggcccccuucccgaccugcccgaaccgcaagaagguguucguggaggacgacgagaacagcucccagaagcggagcgucaucgugugccagucccgcaacgaggcccaggggaagaccgugagccagaaccagcccgacgucucccacaccagccggcccagccccuccaucgcggugaaggccaacaccaacaagccgcacgugcccaagcccaucgagccccugcacaaccucagccugaccgagaaguccuggccgaaggacagcuccgucguguacgccaagagccuggagcacuccggcagccucgacgaccccaaccgcaucucccuggugaagcggaacgccguccugcccagcaagccccuccaggaccgcgaggccauggacgacaagccgggcguguccgggcagcugcccaagggcaaggcgcuggagcucgcccugaagcggccccggcccccggugcugagcgucugcuccagcuccgagacccccuaccuccugaaggagacgaacaaggggaacggccagggggaggaccgcaaccugcucuacuacagcaagcugggccuggugauccccuccagcggcuccgggagcggcaaccagagcaucgaccgcuccgggccccucgucaagagccugcugcggcgcucccucagcauggacucccaggucccgguguacagccccuccaucgaccucaagagcucccagggcagcuccagcguguccagcgacgcccccggcaacgugcugugcgcccucucccagaaguccagccugaaggacugcagcgagaagaccgcccuggacgaccggccccaggugcuccagccccaccgccugcggagcuucuccgcgagccaguccaccgaccgcgagggggccagccccgucaccgaggugcggaucaagacggagcccuccagcccgcuguccgaccccagcgacaucauccgcgugaccgucggcgacgccgccaccaccgccgcggccuccagcuccagcgugacgcgggaccucucccugaagaccgaggacgaccagaaggacaugagccgccugcccgccaagcgccgguuccaggccgaccgccggcugcccuucaagaagcucaaggugaacgagcacggguccccggucagcgaggacaacuucgaggagggcuccagccccacccugcuggacgccgacuuccccgacuccgaccucaacaaggacgaguucggggagcuggagggcacccgccccaacaagaaguucaagugcaagcacugccugaagaucuuccggagcacggcgggccuccaccgccacgugaacauguaccacaacccggagaagcccuacgccugcgacaucugccacaagcgguuccacaccaacuucaagguguggacccacugccagacccagcacgggaucgucaagaaccccagccccgccuccagcucccacgccgugcuggacgagaaguuccagcgcaagcugaucgacaucgugcgggagcgcgagaucaagaaggcgcucaucaucaagcugcggcgcggcaagccgggguuccagggccagagcuccagccaggcccagcaggucaucaagcggaaccugcgcucccgggccaagggggccuacaucugcacguacugcggcaaggccuaccgcuuccucagccaguucaagcagcacaucaagaugcaccccggcgagaagccccugggggugaacaagguggcgaagcccaaggagcacgccccgcuggccucccccgucgagaacaaggagguguaccagugccggcucugcaacgccaagcugagcucccugcucgagcagggcagccacgagcgccugugccggaacgccgcggugugccccuacugcucccugcgcuucuucagccccgagcucaagcaggagcacgaguccaagugcgaguacaagaagcugaccugccuggagugcaugcgcaccuucaagagcuccuucagcaucuggcggcaccaggucgaggugcacaaccagaacaacauggccccgaccgagaacuucucccuccccgugcuggaccacaacggggacgucacgggcagcagccgcccccagucccagcccgagccgaacaaggugaaccacaucgugaccaccaaggacgacaacgucuucagcgacuccagcgagcaggucaacuucgacuccgaggacagcuccugccugcccgaggaccucagccuguccaagcagcugaagauccaggugaaggaggagcccguggaggaggccgaggaggaggccccggaggccagcaccgcgcccaaggaggccgggcccuccaaggaggccagccucuggcccugcgagaagugcggcaagauguucacggugcacaagcagcuggagcggcaccaggagcugcucugcuccgugaagccguucaucugccacgucugcaacaaggccuuccgcaccaacuuccggcuguggagccacuuccagucccacaugagccaggcguccgaggagagcgcccacaaggaguccgaggugugccccgugcccaccaacagccccagcccgccgccccugcccccgcccccgccccuccccaagauccagccccuggagcccgacucccccaccggccugagcgagaacccgacgcccgccaccgagaagcuguucgucccccaggaguccgacacccuguucuaccacgccccgccccugagcgccaucaccuucaagcgccaguucaugugcaagcucugccaccggaccuucaagacggcguucucccuguggagccacgagcagacccacaacuga

SEQ ID NO: 38858 - RNA, 1905 nt, Artificial Sequence
  derived and/or modified sequence opt1 from ZBTB22__Homo_sapiens__NP_001138810
auggagcccagcccccugucccccagcggcgccgcccucccccugccccugucccucgcgccgccgccccugccccugcccgccgccgccgugguccacgugagcuuccccgaggugaccuccgcccuccuggagagccugaaccagcagcgccuccaggggcagcugugcgacgucuccauccgggugcagggccgcgaguuccgggcgcaccgcgccgugcuggccgccagcucccccuacuuccacgaccagguccuccugaaggggaugaccagcaucucccugcccagcgugauggacccgggcgcguucgagacggugcucgccuccgccuacaccgggcggcugagcauggccgccgcggacaucgucaacuuccugaccgugggcuccgugcuccagauguggcacaucgucgacaagugcaccgagcugcugcgcgagggccgggccagcgccacgaccaccaucaccacggccgccgcgaccuccgugaccgugcccggggccggcguccccagcggguccggcgggaccguggcccccgccacgaugggcagcgcccgcagccacgcguccagccgggccuccgagaaccagagcccguccagcuccaacuacuucagcccccgcgaguccaccgacuucagcuccagcucccaggaggccuucgccgccagcgcggugggcuccggggagcggcgcggcgggggccccgucuuccccgccccgguggugggcagcgggggcgccaccuccgggaagcuccugcuggaggccgacgagcucugcgacgacggcggggacggccggggcgcggucgugcccggggccggccugcgccggcccaccuacacgcccccgagcaucaugccccagaagcacuggguguacgucaagcgcgggggcaacugccccgcccccaccccgcuggugccccaggaccccgaccucgaggaggaggaggaggaggaggaccugguccugaccugcgaggacgacgaggacgaggagcucgggggcuccagccgggugccggugggcgggggccccgaggccacccugagcaucuccgacguccgcacgcugagcgagccgcccgacaagggggaggagcaggucaacuucugcgaguccagcaacgacuucggccccuacgagggcgggggccccguggccgggcucgacgacuccggcgggcccacccccagcuccuacgcgccgagccacccgccccggccccugcugccccucgacaugcagggcaaccagauccugguguuccccuccagcuccagcuccagcuccagccaggcccccggccagcccccggggaaccaggccgagcacggcgccgugaccgucgggggcaccuccguggggagccugggcgugcccggcagcgucgggggcgugcccgggggcacgggguccggcgacggcaacaagaucuuccucugccacugcgggaaggccuucagccacaaguccaugcgcgaccggcacgugaacaugcaccugaaccugcgccccuucgacugcccggugugcaacaagaaguucaagaugaagcaccaccucaccgagcacaugaagacccacaccggccugaagcccuacgagugcggggucugcgcgaagaaguucauguggcgcgacagcuucaugcggcaccgcggccacugcgagcggcgccaccggcucgggggcgugggcgccgugcccgggcccggcacgccgaccgggcccucccugcccagcaagcgcgaguccccgggcgucgggggcggcagcggggacgaggccuccgccgccaccccgcccagcucccggcgcguguggagcccgccccgggugcacaaggucgagaugggcuucgggggcggcgggggcgcgaacuga

SEQ ID NO: 38859 - RNA, 2094 nt, Artificial Sequence
  derived and/or modified sequence opt1 from ZBTB24__Homo_sapiens__NP_055612
auggccgagaccagccccgagcccuccggccagcuggugguccacagcgacgcccacuccgacaccgugcuggcgagcuucgaggaccagcgcaagaagggguuccugugcgacaucacccugaucguggagaacguccacuuccgggcccacaaggcccuccuggccgccuccagcgaguacuucuccaugauguucgcggaggagggcgagaucgggcagagcaucuacaugcuggagggcaugguggccgacaccuucgggauccuccuggaguucaucuacaccggcuaccugcacgccuccgagaaguccaccgagcagauccucgccacggcgcaguuccugaagguguacgaccuggucaaggccuacaccgacuuccagaacaaccacagcagccccaagcccaccacccucaacacggccggcgcccccgugguggucaucuccaacaagaagaacgacccgcccaagcgcaagcgggggcgccccaagaaggugaacacccugcaggaggagaaguccgagcuggccgcggaggaggagauccagcuccgggugaacaacagcguccagaaccgccagaacuucguggugaagggcgacagcgggguccugaacgagcagaucgccgccaaggagaaggaggaguccgagccgaccugcgagcccagccgggaggaggagaugcccguggagaaggacgagaacuacgaccccaagaccgaggacggccaggccucccagagccgcuacagcaagcggcgcaucuggcgguccgugaagcugaaggacuacaagcucgucggggaccaggaggaccacggcagcgccaagcgcaucugcggccggcgcaagcggcccgggggcccggaggcgcgcugcaaggacugcgggaagguguucaaguacaaccacuuccuggccauccaccagcggucccacacgggcgagcgccccuucaagugcaacgagugcggcaagggguucgcccagaagcacagccuccaggugcacacccggaugcacaccggcgagcgccccuacacgugcaccgucugcuccaaggcccugaccaccaagcacagccugcuggagcacaugucccuccacagcgggcagaaguccuucacgugcgaccagugcggcaaguacuucagccagaaccggcagcugaagucccacuaccgcgugcacaccgggcacagccugcccgagugcaaggacugccaccgcaaguucauggacgugucccagcucaagaagcaccuccggacccacaccggcgagaagccguucacgugcgagaucugcggcaagagcuucaccgccaaguccagccugcagacccacauccgcauccaccgcggggagaagcccuacuccugcggcaucugcggcaagagcuucuccgacagcagcgcgaagcggcggcacugcauccugcacaccgggaagaagcccuucuccugccccgagugcaaccugcaguucgcccgccuggacaaccucaaggcccaccugaagauccacagcaaggagaagcacgccuccgacgccagcuccaucagcggguccagcaacaccgaggagguccggaacauccugcagcuccagccguaccagcuguccacgagcggcgagcaggagauccagcugcucgugaccgacuccguccacaacaucaacuucaugcccggccccagccaggggaucuccaucgugaccgcggagagcucccagaacaugaccgccgaccaggccgccaaccugacgcugcucacccagcagcccgagcagcugcagaaccugauccucagcgcgcagcaggagcagaccgagcacauccagucccugaacaugaucgagagccagaugggcccgagccagaccgagcccgugcacgucaucacgcuguccaaggagacccucgagcaccuccacgcccaccaggagcagaccgaggagcugcaccuggccaccagcaccuccgaccccgcccagcaccuccagcugacgcaggagcccgggccgccgccgcccacccaccacgugccccagcccacgccccugggccaggagcagagcuga

SEQ ID NO: 38860 - RNA, 1545 nt, Artificial Sequence
  derived and/or modified sequence opt1 from ZBTB2__Homo_sapiens__NP_065912
auggaccuggccaaccacggccucauccugcugcagcagcucaacgcccagcgcgaguucggguuccugugcgacugcaccguggcgaucggcgacgucuacuucaaggcccacaagagcgugcuggccuccuucagcaacuacuucaagaugcuguucgugcaccagaccuccgagugcguccggcugaagcccacggacauccagcccgacaucuucagcuaccugcuccaccugauguacaccgggaagauggcgccccagcugaucgaccccgugcgccucgagcagggcaucaaguuccugcacgccuacccccugauccaggaggcgucccucgccagccagggggccuucucccacccggaccagguguucccccuggccagcucccuguacggcauccagaucgcggaccaccagcuccggcaggccaccaagaucgccagcgcccccgagaagcugggccgcgacccccggccgcagaccucccgcaucagccaggagcagguccccgaggccucccagcugagccagcucacguccaaccuggcccaggugaaccggaccaacaugacccccagcgacccccugcagaccucccucagcccggagcugguguccacgcccgucccgcccccgccgcccggggaggagaccaaccuggaggccagcagcuccgacgagcagcccgccagccucaccaucgcccacgugaagcccuccaucaugaagcgcaacggcagcuuccccaaguacuacgccugccaccugugcgggcggcgcuucacccugcgguccagccuccgcgagcaccuccagauccacacgggcgugcccuucaccuccagccagcagggggagucccgggucccccugacccucugcagcaacgcggccgaccugggcaaggacgccauggaggugccggaggccggcaugaucuccgacagcgagcugcagcacaucuccgacagccccaucaucgacgggcagcagcaguccgagaccccgccgcccagcgacaucgccgacaucgacaaccucgagcaggcggaccaggagcgcgaggugaagcggcgcaaguacgagugcacgaucugcggccggaaguucauccagaagucccacuggcgcgagcacauguacauccacaccgggaagcccuucaagugcagcacgugcgacaaguccuucugccgggccaaccaggccgcccgccacgucugccugaaccagagcaucgacaccuacaccaugguggacaagcagacccuggagcucugcaccuucgaggagggcagccagauggacaacaugcuggugcagaccaacaagcccuacaagugcaaccugugcgacaagacguucuccacccccaacgaggucgugaagcacagcugccagaaccagaacuccgacguguucgcccucgacgagggccggagcauccugcugggguccggcgacagcgaggucaccgagcccgaccaccccgugcucgcguccaucaagaaggagcaggagaccgugcugcuggacuga

SEQ ID NO: 38861 - RNA, 1464 nt, Artificial Sequence
  derived and/or modified sequence opt1 from ZBTB32__Homo_sapiens__NP_055198
augagccugcccccgauccgccuccccucccccuacggcagcgaccggcuggugcagcuggccgcccgccuccggcccgcgcugugcgacacccugaucaccgucgggucccaggaguucccggcccacagccucgugcuggccggcgugucccagcagcuggggcgccggggccagugggcccucggggagggcaucagccccuccacguucgcccagcugcugaacuucgucuacggcgagagcguggagcuccagcccggggagcugcgcccccugcaggaggcggcccgggcccucggcgugcagucccuggaggaggccugcuggcgcgcgcgcggggaccgggccaagaagccggaccccggccugaagaagcaccaggaggagcccgagaagcccagccggaacccggagcgcgagcucggggaccccggcgagaagcagaagcccgagcaggucucccggaccggcgggcgcgagcaggagaugcugcacaagcacagcccgccccggggccgccccgagauggccggggccacccaggaggcccagcaggagcagacccgguccaaggagaagcgccugcaggcgcccgugggccagcggggcgccgacgggaagcacggcgugcucacguggcugcgcgagaaccccgggggcagcgaggagucccugcggaagcucccggggccccugccgcccgccggcagccugcagaccuccgucacgccccgccccagcugggccgaggcccccuggcucgugggcgggcagcccgcgcugugguccauccugcucaugccgccccgcuacggcauccccuucuaccacagcaccccgaccaccggggccuggcaggagguguggcgggagcagcgcaucccccugagccugaacgcccccaagggccucuggucccagaaccagcuggccagcuccagccccaccccggggucccugccccagggccccgcccagcucagccccggcgagauggaggaguccgaccaggggcacaccggcgcgcuggccacgugcgccgggcacgaggacaaggccggcugcccgccccggccccacccgccgcccgccccgcccgcgcgcagccggcccuacgccugcuccgucugcgggaagcgcuucagccugaagcaccagauggagacccacuaccgggugcacaccggcgagaagcccuucuccugcagccucugcccccagcgcucccgggacuucagcgccaugaccaagcaccuccgcacgcacggcgccgcgcccuaccggugcucccugugcggggccggcugccccagccuggccuccaugcaggcccacaugcgcgggcacagccccucccagcugccgcccggcuggaccauccggagcaccuuccuguacagcuccagccgccccucccggcccagcaccucccccugcugcccgagcuccagcacgaccuga

SEQ ID NO: 38862 - RNA, 2019 nt, Artificial Sequence
  derived and/or modified sequence opt1 from ZBTB33__Homo_sapiens__NP_006768
auggagagccgcaagcugaucuccgccaccgacauccaguacagcggcucccuccugaacagccugaacgagcagcgggggcacggccucuucugcgacgugaccgucaucguggaggaccgcaaguuccgggcccacaagaacauccuguccgcgagcuccacguacuuccaccagcuguucagcguggccgggcaggucguggagcucuccuucauccgcgccgagaucuucgccgagauccugaacuacaucuacagcuccaagaucgugcggguccgcagcgaccugcucgacgagcugaucaaguccggccagcugcucggggugaaguucaucgccgagcugggcgugccccugagccaggucaaguccaucagcggcaccgcgcaggacgggaacaccgagccgcucccgcccgacuccggcgacaagaaccuggugauccagaaguccaaggacgaggcccaggacaacggggccaccaucaugcccaucaucacggagagcuucagccugagcgccgaggacuacgagaugaagaagaucaucgugaccgacuccgacgacgacgacgacgacgucaucuucugcagcgagauccuccccaccaaggagacccugcccuccaacaacacgguggcccaggugcagagcaaccccggccccgucgcgaucuccgacguggccccgagcgccuccaacaacagcccgccccugaccaacaucacccccacccagaagcuccccacgcccgugaaccaggccacccugucccagacccaggggagcgagaagcugcucgucuccagcgcgcccacccaccugacgcccaacaucauccugcucaaccagaccccgcuguccaccccgcccaacgugagcuccagccugcccaaccacaugcccuccagcaucaaccuccuggugcagaaccagcagacccccaacuccgccauccugacgggcaacaaggccaacgaggaggaggaggaggagaucaucgacgacgacgacgacaccaucagcagcucccccgacagcgccgucuccaacaccagccucgugccccaggccgacaccucccagaacacgagcuucgacggcucccugauccagaagaugcagaucccgacccugcuccaggagccccugagcaacucccugaagaucagcgacaucaucacccggaacaccaacgaccccggggugggcuccaagcaccucauggaggggcagaagaucaucacgcuggacaccgcgaccgagaucgagggccugagcaccggcugcaaggucuacgccaacaucggggaggacacguacgacaucgugauccccgucaaggacgacccggacgagggcgaggcccgccucgagaacgagauccccaagaccuccgggagcgagauggccaacaagcggaugaaggugaagcacgacgaccacuacgagcugaucguggacggccgcgucuacuacaucugcaucgugugcaagcgguccuacgugugccugaccagccuccgccggcacuucaacauccacuccugggagaagaaguaccccugccgcuacugcgagaaggucuucccgcuggccgaguaccggaccaagcacgagauccaccacacgggggagcgccgguaccagugccuggcgugcggcaagagcuucaucaacuaccaguucaugagcucccacaucaagagcgugcacucccaggaccccagcggcgacuccaagcucuaccgccugcaccccugccggagccugcagauccgccaguacgccuaccuguccgaccggagcuccaccauccccgccaugaaggacgacgggaucggcuacaagguggacaccgggaaggagccgcccgucggcaccaccacgagcacccagaacaagcccaugaccugggaggacaucuucauccagcaggagaacgacuccaucuucaagcagaacgugaccgacgggagcacggaguucgaguucaucauccccgaguccuacuga

SEQ ID NO: 38863 - RNA, 1503 nt, Artificial Sequence
  derived and/or modified sequence opt1 from ZBTB34__Homo_sapiens__NP_001092740
auggacagcuccagcuucauccaguucgacgugcccgaguacuccagcaccguccugucccagcucaacgagcugcgccugcagggcaagcucugcgacaucaucgugcacauccaggggcagccguuccgggcccacaaggccgugcuggcggccagcucccccuacuuccgcgaccacagcgcccuguccaccaugagcggccucuccaucagcgucaucaagaaccccaacguguucgagcagcugcuguccuucugcuacacggggcggaugagccuccagcugaaggacguggucuccuuccugaccgccgccagcuuccuccagaugcagugcgugaucgacaagugcacccagauccuggaguccauccacagcaagaucuccgugggcgacgucgacagcgugaccgugggggcggaggagaaccccgagagccgcaacggcgucaaggacuccagcuucuucgccaacccgguggagaucuccccgcccuacugcagccagggccggcagcccacggccuccagcgaccugcgcauggagaccacccccuccaaggcccuccggagccgccugcaggaggaggggcacuccgaccggggcagcuccgggagcguguccgaguacgagauccagaucgagggcgaccacgagcagggggaccugcucguccgcgagagccagaucaccgaggugaaggugaagauggagaaguccgaccggcccagcugcuccgacagcuccagccugggcgacgacggcuaccacacggagauggucgacggggagcaggucguggcggugaacgugggcagcuacggguccgugcugcagcacgccuacagcuacucccaggccgccagccagcccaccaacgucuccgaggccuucggcagccucuccaacagcucccccagccgcuccaugcugagcugcuuccggggcgggcgcgcgcggcagaagcgcgcccuguccgugcaccuccacagcgaccugcagggccugguccagggguccgacagcgaggccaugaugaacaacccgggcuacgaguccagcccccgggagcgcagcgcccgggggcacugguaccccuacaacgagcgccucaucugcaucuacugcggcaaguccuucaaccagaagggcagccuggaccggcacaugcgccugcacauggggaucacccccuucgugugcaaguucugcggcaagaaguacacccgcaaggaccagcucgaguaccacauccgggggcacacggacgacaagccguuccgcugcgagaucugcggcaagugcuuccccuuccaggggacccugaaccagcaccuccggaagaaccaccccggcguggccgagguccgcucccggaucgagagccccgagcgcaccgacguguacguggagcagaagcuggagaacgacgcguccgccagcgagaugggccuggacucccggauggagauccacaccgucagcgacgccccggacuga

SEQ ID NO: 38864 - RNA, 3588 nt, Artificial Sequence
  derived and/or modified sequence opt1 from ZBTB38__Homo_sapiens__NP_001073881
augaccgugaugagccugucccgcgaccucaaggacgacuuccacagcgacaccguccuguccauccugaacgagcagcggauccgcggcauccucugcgacgugacgaucaucguggaggacaccaaguucaaggcccacagcaacguccuggccgcguccagccuguacuucaagaacaucuucuggucccacaccaucugcaucagcucccacgugcucgagcuggacgaccugaaggccgagguguucaccgagauccucaacuacaucuacagcuccacggucguggugaagcggcaggagaccgucaccgaccuggccgccgccgggaagaagcugggcaucagcuuccucgaggaccugaccgaccgcaacuucuccaacagccccgggccguacguguucugcaucacggagaagggcguggucaaggaggagaagaacgagaagcggcacgaggagcccgcgaucaccaacgggccccgcaucaccaacgccuucuccaucaucgagaccgagaacagcaacaacauguucagcccccuggaccuccgggccagcuucaagaagguguccgacagcaugcgcacggccagccugugccuggagcggaccgacgugugccacgaggcggagccgguccgcacccucgccgagcacuccuacgccgugagcuccguggccgaggccuaccggagccagcccguccgcgagcacgacggcuccagccccggcaacaccgggaaggagaacugcgaggcgcuggccgccaagcccaagacgugccggaagccgaagaccuucuccaucccccaggacagcgacuccgccaccgagaacaucccgccgccgcccgugagcaaccuggaggugaaccaggagcgcagcccccagcccgccgcgguccucacccgguccaagucccccaacaacgagggcgacgugcacuucagccgcgaggacgagaaccaguccagcgacgugcccgggccgcccgccgccgaggucccgccccugguguacaacugcuccugcugcagcaaggccuucgacuccagcacgcugcucagcgcccacaugcagcugcacaagcccacccaggagccccuggucugcaaguacugcaacaagcaguucaccacccucaaccggcuggaccgccacgagcagaucugcaugcgguccagccacaugcccauccccggcgggaaccagcgcuuccuggagaacuaccccacgaucggccagaacggcggguccuucaccggccccgagccccuccugagcgagaaccggaucggggaguucuccagcaccggcuccacccugcccgacacggaccacauggugaaguucgugaacggccagaugcucuacagcugcgucgugugcaagcgcuccuacgugacccugagcucccugcgccggcacgcgaacguccacagcuggcgccggaccuaccccugccacuacugcaacaagguguucgcccucgccgaguaccgcacccggcacgagaucuggcacacgggggagcgccgguaccagugcaucuucugccuggagaccuucaugaccuacuacauccugaagaaccaccagaaguccuuccacgccaucgaccaccgccucagcaucuccaagaagaccgccaacggcgggcugaagccgagcguguaccccuacaagcuguaccggcuccugcccaugaagugcaagcgcgcgcccuacaaguccuaccggaacagcagcuacgagaacgcccgcgagaacucccagaugaacgagagcgccccgggcacguacgucgugcagaacccccacuccagcgagcugcccacccucaacuuccaggacaccgugaacacccugaccaacucccccgccaucccgcuggagacgagcgcgugccaggacauccccaccuccgccaacguccagaacgccgaggggaccaaguggggcgaggaggcccucaagauggaccuggacaacaacuucuacagcaccgagguguccgugagcuccacggagaacgccgucagcuccgaccugcgggcgggcgacgugcccgugcugagccucuccaacagcuccgagaacgccgccagcgucaucuccuacagcgggagcgcccccuccgugaucgugcacagcucccaguucagcuccgucaucaugcacagcaacgccaucgcggccaugaccuccagcaaccaccgcgccuucuccgacccggccgugagccagucccugaaggacgacagcaagcccgagcccgacaaggugggccgguucgccucccgccccaagagcaucaaggagaagaagaagaccaccucccacacgcgcggggagaucccggaggagagcaacuacgucgcggaccccggcgggucccugagcaagaccaccaacaucgccgaggagaccuccaagaucgagacguacaucgccaagcccgcccuccccggcaccagcaccaacagcaacguggcgccgcugugccagaucaccgugaagaucggcaacgaggccaucgucaagcggcacauccugggguccaagcuguucuacaagcggggccgccgccccaaguaccagaugcaggaggagccccucccccaggggaacgacccggagcccagcggcgacagcccccuggggcucugccaguccgagugcauggagauguccgagguguucgacgacgccagcgaccaggacuccacggacaagccguggcggcccuacuacaacuacaagcccaagaagaagucccgccagcugaagaagaugcggaaggugaacuggcgcaaggagcacggcaaccggucccccagccacaagugcaaguacccggccgagcuggacugcgccgucggcaaggcgccccaggacaagcccuucgaggaggaggagaccaaggagaugcccaagcuccagugcgagcugugcgacggggacaaggccgugggcgccgggaaccagggccgcccgcaccggcaccugaccucccgccccuacgccugcgagcucugcgccaagcaguuccagagccccuccacccugaagaugcacaugcggugccacacgggcgagaagcccuaccagugcaagaccugcgggcgcugcuucagcgugcagggcaaccugcagaagcacgagcggauccaccucgggcugaaggaguucgucugccaguacugcaacaaggcguucacccugaacgagacccucaagauccacgagcgcauccacacgggcgagaagcgguaccacugccaguucugcuuccagcgcuuccuguaccuguccaccaagcggaaccacgagcagcgccacauccgggagcacaacgggaagggcuacgccugcuuccagugcccgaagaucugcaagaccgccgccgcccucggcaugcaccagaagaagcaccuguucaagagccccucccagcaggagaagaucggggacgugugccacgagaacagcaacccccuggagaaccagcacuucaucggcuccgaggacaacgaccagaaggacaacauccagaccgggguggagaacgucgugcucuga

SEQ ID NO: 38865 - RNA, 2730 nt, Artificial Sequence
  derived and/or modified sequence opt1 from ZBTB41__Homo_sapiens__NP_919290
augaagaagcgccggaaggugaccagcaaccuggagaagauccaccucggcuaccacaaggacuccagcgaggggaacgucgccguggagugcgaccaggugaccuacacgcacuccgccggccgccccaccccggaggcgcugcacugcuaccaggagcugccgcccagccccgaccagcggaagcuccuguccagccugcaguacaacaagaaccuccugaaguaccugaacgacgaccgccagaagcagcccuccuucugcgaccuccugaucaucgucgaggggaaggaguucagcgcccacaaggugguggucgccgugggcuccagcuacuuccacgccugccuguccaagaaccccagcaccgacguggucacccucgaccacgugacgcacuccguguuccagcaccuccuggaguuccuguacaccagcgaguucuucgucuacaaguacgagaucccccuggugcuggaggccgcgaaguuccucgacaucaucgacgccgugaagcugcugaacaacgagaacgucgcccccuuccacuccgagcucaccgagaaguccagcccggaggagacccugaacgagcugacggggcggcucagcaacaaccaccagugcaaguucugcucccgccacuucugcuacaagaagucccuggagaaccaccuggccaagacccaccggagccuccugcugggcaagaagcacggccucaagaugcuggagcgcagcuucagcgcgcggcgcuccaagcggaaccgcaagugccccgugaaguucgacgacaccagcgacgacgagcaggaguccggggacggcagcgacaaccugaaccaggagaacuucgacaaggagaaguccgaccggaacgacagcgaggaccccggguccgaguacaacgccgaggaggacgagcucgaggaggagaugagcgacgaguacuccgacaucgaggagcagagcgagaaggaccacaacgacgccgaggaggagcccgaggccggcgacuccguggggaacguccacgagggccugaccccgguggugauccagaacagcaacaagaagauccugcagugccccaagugcgacaagacguucgaccgcaucggcaaguacgagucccacacccggguccacaccggggagaagcccuucgagugcgacaucugccaccagcgcuacagcaccaaguccaaccucacggugcaccggaagaagcacagcaacgagaccgaguuccacaagaaggagcacaagugccccuacugcaacaagcugcacgccuccaagaagacccuggcgaagcacgugaagcgcuuccacccggagaacgcccaggaguucaucagcaucaagaagaccaagagcgaguccuggaagugcgacaucugcaagaaguccuucacgcggcgcccccaccucgaggagcacaugauccugcacagccaggacaagcccuucaagugcaccuacugcgaggagcacuucaagagccgguucgcccgccugaagcaccaggagaaguuccaccucggccccuucccgugcgacaucugcgggcgccaguucaacgacaccggcaaccugaagcggcacaucgagugcacccacggcgggaagcgcaaguggacgugcuucaucugcggcaaguccguccgggagcgcaccacccugaaggagcaccuccggauccacagcggggagaagccccaccugugcuccaucugcggccagagcuuccgccacggguccagcuaccggcugcaccuccgcgugcaccacgacgacaagcgguacgagugcgacgagugcggcaagaccuucauccgccacgaccaccugacgaagcacaagaagauccacuccggcgagaaggcccaccagugcgaggagugcgggaagugcuucggccggcgcgaccaccugaccguccacuacaagagcgugcaccugggggagaagguguggcagaaguacaaggccaccuuccaccagugcgacgucugcaagaagaucuucaagggcaaguccagccucgagaugcacuuccggacccacuccggggagaagcccuacaagugccagaucugcaaccagagcuuccgcaucaagaagacgcugaccaagcaccuggugauccacuccgacgcgcggcccuucaacugccagcacugcaacgccaccuucaagcgcaaggacaagcucaaguaccacaucgaccacgugcacgagaucaagagcccggacgacccccugagcaccuccgaggagaagcuggucagccuccccguggaguacuccagcgacgacaagaucuuccagacggagaccaagcaguacauggaccagcccaagguguaccaguccgaggccaagaccaugcugcagaacgucagcgccgaggugugcgugccggucacccuggugcccgugcagaugcccgacaccccguccgaccucguccggcacacgaccacccugccgcccagcucccacgagauccugagcccccagccccaguccaccgacuacccccgcgccgcggaccucgccuuccuggagaaguacacgcugacgccccagcccgccaacaucgugcacccggugcggcccgagcagaugcucgacccccgcgagcagagcuaccugggcacccugcucggccuggacuccaccaccgggguccagaacaucagcaccaacgagcaccacuccuga

SEQ ID NO: 38866 - RNA, 1770 nt, Artificial Sequence
  derived and/or modified sequence opt1 from ZBTB46__Homo_sapiens__XP_005260254
augaacaaccgcaaggaggacauggagaucaccagccacuaccggcaccuccuccgcgagcugaacgagcagcggcagcacggcgugcugugcgacgucugcgugguggucgaggggaagguguucaaggcccacaagaacgugcuccugggcuccagccgcuacuucaagacccuguacugccagguccagaagacguccgagcaggccaccgugacccaccucgacaucgugaccgcgcagggguucaaggccaucaucgacuucauguacagcgcccaccuggcccugacgucccggaacgucaucgaggugaugagcgccgcguccuuccuccagaugaccgacaucgugcaggccugccacgacuucaucaaggccgcccuggacaucagcaucaaguccgacgcgagcgacgagcuggccgaguucgagaucggcgccuccagcuccagcuccaccgaggcccucaucagcgccgucauggcggggcgcuccaucagccccuggcuggcccggcgcaccuccccggccaacagcagcggcgacuccgccaucgccagcugccacgacggcggguccagcuacggcaaggaggaccaggagcccaaggcggacgggcccgacgacguguccagccagccccuguggccgggcgacgugggguacggcccccuccggaucaaggaggagcaggucucccccagccaguacggcggguccgagcugcccagcgccaaggacggcgccgugcagaacuccuucagcgagcaguccgccggggacgccuggcagccgacgggccgccggaagaaccgcaagaacaaggagaccgugcggcacaucacccagcaggucgaggacgacagccgcgcguccagccccgugcccuccuuccugcccaccagcggcuggccguucuccagccgggacagcaacgccgaccucuccgugacggaggccagcuccagcgacucccgcggggagcgggccgagcuguacgcccaggucgaggagggccugcucgggggcgaggcgagcuaccuggggccgccccugacccccgagaaggacgacgcccuccaccaggccaccgccguggcgaaccugcgcgccgcccugauguccaagaacagccuccugucccugaaggccgacgugcucggcgacgacggcagccugcuguucgaguaccucccccgcggggcccacucccugagccugaacgaguucaccgucauccggaagaaguucaagugccccuacugcuccuucagcgcgaugcaccagugcauccucaagcggcacaugcgcucccacacgggcgagcgccccuaccccugcgagaucugcgggaagaaguucacccggcgcgagcacaugaagcggcacacccuggugcacagcaaggacaagaaguacgucugcaaggugugcucccgcguguucaugagcgccgccagcgucggcauccggcacgggucccgccggcacggcgugugcaccgacugcgccggccgcgggauggccggcccgcuggaccacgggggcgggggcggcgaggggagccccgaggcgcuguuccccggcgacgggcccuaccuggaggacccggaggacccccggggcgaggccgaggagcugggcgaggacgacgaggggcucgcccccgaggacgcccugcuggccgacgacaaggacgaggaggacagcccccgcccgcgguccccgcccggcgggcccgacaaggacuucgcguggcucuccuga

SEQ ID NO: 38867 - RNA, 1140 nt, Artificial Sequence
  derived and/or modified sequence opt1 from ZBTB48__Homo_sapiens__XP_011539612
augcgcaagcacaccggcgagaagcccuucgagugcccgaagugcgggaagugcuacuuccggaaggagaaccugcucgagcacgaggcccgcaacugcaugaaccggagcgagcaggucuucacgugcuccgugugccaggagaccuuccgccggcgcauggagcugcgggugcacauggugagccacaccggcgagaugcccuacaagugcuccagcugcucccagcaguucaugcagaagaaggaccugcagagccacaugaucaagcuccacggggcccccaagccccacgcgugcccgaccugcgccaagugcuuccugucccgcaccgagcugcagcuccacgaggccuucaagcaccggggcgagaagcuguucgucugcgaggagugcgggcaccgcgccagcucccggaacggccugcagaugcacaucaaggccaagcaccgcaacgagcggccccacgugugcgaguucugcagccacgcguucacgcagaaggccaaccucaacaugcaccuccgcacccacaccggcgagaagcccuuccagugccaccugugcgggaagaccuuccggacgcaggccucccuggacaagcacaaccgcacccacaccggcgagcggcccuucagcugcgaguucugcgagcagcgcuucaccgagaaggggccgcugcugcggcacguggccucccgccaccaggagggccggccccacuucugccagaucugcgggaagacguucaaggcggucgagcagcuccgcgugcacgugcgccggcacaagggcguccgcaaguucgagugcaccgagugcggcuacaaguucacccggcaggcccaccuccgccggcacauggagauccacgaccgcguggagaacuacaacccccggcagcgcaagcugcggaaccugaucaucgaggacgagaagaugguggucguggcccugcagcccccggccgagcuggagguggggagcgccgaggucaucguggagucccucgcgcagggcgggcuggccagccagcugcccggccagcgccucugcgccgaggaguccuucaccggccccggggugcuggagcccagccugaucaucacggccgccgucccggaggacugcgacaccuga

SEQ ID NO: 38868 - RNA, 2298 nt, Artificial Sequence
  derived and/or modified sequence opt1 from ZBTB49__Homo_sapiens__NP_660334
auggaccccguggccacccacagcugccaccuccugcagcagcugcacgagcagcgcauccagggccugcucugcgacugcaugcuggucgugaagggggugugcuucaaggcccacaagaacguccuggcggccuucucccaguacuuccggagccucuuccagaacuccagcucccagaagaacgacguguuccaccuggacgugaagaacgucagcggcaucgggcagauccuggacuucauguacaccucccaccucgaccugaaccaggacaacauccaggugaugcuggacacggcccagugccuccaggugcagaacguccugagccugugccacaccuuccucaaguccgccaccguggugcagccgcccggcaugcccugcaacagcacccugucccugcagagcacgcucacccccgacgcgaccugcgucaucuccgagaacuacccgccccaccuccugcaggagugcagcgccgacgcccagcagaacaagacccuggacgagucccacccccacgccagccccuccgugaaccgccaccacagcgccggggagaucuccaagcaggcgccggacacgagcgacggcagcugcaccgagcugcccuucaagcagcccaacuacuacuacaagcugcggaacuucuacuccaagcaguaccacaagcacgccgccggccccagccaggagcgcguggucgagcagccguucgccuucuccaccagcaccgaccucacgaccguggagucccagcccugcgccgugagccacuccgagugcauccuggagagccccgagcaccuccccuccaacuuccuggcgcagccggucaacgacagcgccccgcaccccgaguccgacgcgaccugccagcagcccgugaagcagaugcggcugaagaaggccauccaccugaagaagcucaacuuccucaagagccagaaguacgccgagcaggucuccgagcccaagagcgacgacgggcugaccaagcgccuggaguccgccagcaagaacacgcuggagaaggccuccagccaguccgccgaggagaaggagagcgaggagguggugagcugcgagaacuucaacugcaucuccgagaccgagcggcccgaggaccccgccgcccuggaggaccagagccagacccuccagucccagcgccaguacgcgugcgagcugugcggcaagcccuucaagcacccgagcaaccuggagcuccacaagcggucccacaccggggagaagcccuucgagugcaacaucugcggcaagcacuucagccaggccgggaaccugcagacgcaccuccgccggcacuccggcgagaagcccuacaucugcgagaucugcggcaagcgcuucgccgccagcggggacgugcagcggcacaucaucauccacuccggcgagaagccccaccugugcgacaucugcgggcgcggcuucagcaacuucuccaaccugaaggagcacaagaagacccacaccgccgacaaggucuucacgugcgacgagugcggcaagagcuucaacaugcagcggaagcuggugaagcaccgcauccggcacaccggggagcgcccguacuccugcagcgcgugcggcaagugcuucgggggcuccggggaccuccggcgccacguccggacccacaccggcgagaagcccuacacgugcgagaucugcaacaagugcuucacccgcagcgccgugcugcgccggcacaagaagaugcacugcaaggccggcgacgagucccccgacgugcuggaggagcucagccaggccaucgagaccagcgaccuggagaagucccagagcuccgacagcuucucccaggacaccagcgucacccugaugccgguguccgugaagcugcccguccaccccguggagaacagcguggcggaguucgacucccacagcgggggcuccuacugcaagcuccgcagcaugauccagccccacggggucuccgaccaggagaagcugagccuggacccgggcaagcucgccaagccccagaugcagcagacgcagccccaggccuacgccuacuccgacguggacacccccgccgggggcgagccgcugcaggcggacggcauggccaugauccggagcucccuggccgcccucgacaaccacgggggcgacccccuggggagccgcgccuccagcaccaccuaccggaacagcgagggccaguucuucuccagcaugacgcugugggggcucgcgaugaagacccugcagaacgagaacgagcuggaccaguga

SEQ ID NO: 38869 - RNA, 3042 nt, Artificial Sequence
  derived and/or modified sequence opt1 from ZBTB4__Homo_sapiens__NP_065950
augcccccgcccgccgaggugaccgaccccagccacgcccccgcgguccugcgccagcucaacgagcagcggcugcgcggccuguucugcgacgugacccucaucgccggggacacgaaguucccggcccaccgguccgugcuggccgccagcucccccuucuuccgcgaggcgcugcucaccagcgccccccugccccugccgcccgccaccggcggggccgcgcccaaccccgccaccacgaccgccgccuccagcuccagcuccagcuccagcuccagcuccagcuccagcuccagcgccagcuccagcuccagcuccagcuccagcuccccgccccccgcgagccccccggccuccagccccccccggguccucgagcugcccggcgugccggccgccgccuucuccgacgugcugaacuucaucuacagcgcgcgccucgcccugcccgggggcggcggggacggcgccgccgucgccgagaucggggcgcugggccggcgccucgggaucucccggcugcagggccugggcgaggggggcgacgccugggugccccccaccccggcccccauggccaccagccagcccgaggaggacuccuucgggcccggcccgcgccccgccggcgagugggagggggaccgggcggaggcccaggcccccgaccuccagugcagccugccgcgccggccccugcccugcccccagugcggcaaguccuucauccacccgaagcgccuccagacgcacgaggcccagugccggcgcggggcgagcacccggggcagcaccgggcugggcgccggcggggccggccccgggggccccgccgggguggacgccuccgcgcugcccccgcccgucggcuuccgcggcgggcccgagcacguggugaaggucgugggcgggcacgugcucuacgucugcgccgccugcgagcggagcuacgugacccuguccagccugaagcgccacuccaacgugcacagcuggcggcgcaaguaccccugccgcuacugcgagaaggucuucgcccucgccgaguaccggacgaagcacgagguguggcacaccggcgagcgccgguaccagugcaucuucugcugggagaccuucgugaccuacuacaaccugaagacgcaccagcgcgcguuccacgggaucuccccgggccugcucgccagcgagaagacccccaacggcggguacaagcccaagcugaacacccugaagcucuaccggcugcugcccaugcgcgccgccaagcggccguacaagaccuacucccagggcgcccccgaggcgccccucagccccacgcugaacaccccggcccccgucgccaugcccgccucccccccgcccgggcccccgcccgcgcccgagcccggcccgccccccagcgugaucaccuucgcccaccccgccccguccgugaucguccacggcgggagcuccagcggcgggggcggguccggcaccgccagcacgggcgggagccaggccgcguccgugaucaccuacaccgcccccccccgccccccgaagaagcgggaguaccccccccccccgcccgagcccgccgccacccccacgagcccggccaccgcggucucccccgccaccgccgccggccccgccauggcgaccacgaccgaggaggccaaggggcgcaacccccgggccggccgcacccugaccuacacggccaagccgguggggggcaucggcgggggcgggggcccccccaccggggcgggccggggccccagccagcuccaggccccgcccccccugugccagaucaccgugcgcaucggggaggaggccaucgucaagcggcgcaucuccgagaccgaccugcggccgggcgagcucagcggggaggagauggaggaguccgaggaggacgaggaggaggaggacgaggaggaggaggaggaggacgaggaggagagcaaggccggcggggaggaccagcuguggcgccccuacuacuccuacaagcccaagcggaaggccggcgcggccggcggggccagcgugggcggguccggccugccccgcggccgccggccgccccgcuggcggcagaagcucgagcgccggagcugggaggagacccccgccgccgagucccccgcggggcgcgcccggacggagcgccggcaccgcugcggcgacugcgcccagaccuucaccacccugcggaagcugcgcaagcaccaggaggcccacgggggcgggagccacuccagccgggccggccgccggccguccacgcgcuucaccugcccccacugcgcgaaggugugcaagaccgccgccgcccucagccggcacggccagcgccacgccgcggagcggcccgggggcacccccacgccggucaucgccuacuccaaggggagcgccggcacccgccccggggacgugaaggaggaggccccccaggagaugcaggugagcuccagcuccggcgaggcgggcgggggcagcaccgccgccgaggaggccuccgagaccgccagccugcaggaccccaucaucuccgggggcgaggagccgcccgucguggcgagcgggggcuccuacguguacccccccguccaggaguucccgcuggcccugaucggcgggggccgggagcccgggggcggccgcgggaagagcggcuccgaggggcccgugggcgccggggagggcgaccgcauggagggcaucggggccgccaaggugacguucuaccccgagccguacccccucgucuacggcccccagcugcuggcggccuaccccuacaacuucagcaaccucgccgcccugccgguggcccugaacauggugcuccccgacgagaagggggcgggcgcccugcccuuccugccgggggucuucggcuacgccgugaacccccaggccgcgccccccgccccgcccaccccccccccgcccacccucccccccccgaucccccccaagggcgagggggagcgggccggcguggagcgcacccagaagggggacgucggcuga

SEQ ID NO: 38870 - RNA, 2034 nt, Artificial Sequence
  derived and/or modified sequence opt1 from ZBTB5__Homo_sapiens__NP_055687
auggacuuccccggccacuucgagcagaucuuccagcagcugaacuaccagcgccuccacgggcagcugugcgacugcgugaucgucgugggcaaccggcacuucaaggcccaccgcagcgugcuggccgcgugcuccacccacuuccgggcccucuucagcgucgccgagggggaccagaccaugaacaugauccagcuggacuccgagguggugacggccgaggccuucgcggcccugaucgacaugauguacaccagcacccucaugcugggcgaguccaacgucauggacgugcugcucgccgccagccaccuccaccugaacuccguggucaaggcgugcaagcacuaccugaccacgcgcacccugccgaugagcccgcccuccgagcgggugcaggagcagagcgcccgcaugcagcgguccuucaugcugcagcagcucgggcugagcaucguguccagcgcccugaacuccagccagaacggcgaggagcagcccgcccccauguccagcuccaugcgcagcaaccucgaccagcggacccccuuccccaugcgccggcugcacaagcgcaagcagagcgccgaggagcgggcgcgccagcggcugcgccccuccaucgacgagagcgccaucuccgacgucaccccggagaacggccccagcggggugcacucccgggaggaguucuucagccccgacucccucaagaucguggacaaccccaaggccgacggcaugacggacaaccaggaggacagcgccaucauguucgaccaguccuucgggacccaggaggacgcccaggucccgagccaguccgacaacagcgcgggcaacauggcccagcuguccauggccagccgcgccacccagguggagaccuccuucgaccaggaggccgcgcccgagaaguccuccuuccagugcgagaaccccgagguggggcugggcgagaaggagcacaugcgggucguggucaagagcgagccccucuccagcccggagccccaggacgaggugagcgacgugacgucccaggccgagggcagcgaguccguggaggucgaggggguggucgugagcgccgagaagaucgaccugucccccgagagcuccgaccgcagcuucuccgacccccagagcuccaccgaccgggugggcgacauccacauccuggaggucaccaacaaccucgagcacaagagcaccuucuccaucagcaacuuccugaacaagucccgcgggaacaacuucacggccaaccagaacaacgacgacaacaucccgaacaccaccagcgacugccgccuggaguccgaggcccccuaccuccugagccccgaggcgggccccgccggcgggccgagcuccgcccccggcagccacguggagaaccccuucuccgagcccgccgacagccacuucgugcggccgaugcaggaggucauggggcugcccugcgugcagaccuccggcuaccagggcggggagcaguucggcauggacuucagccgcuccgggcucggccugcacagcuccuucagccgggugaugaucgggagcccccgcggcggggcgagcaacuucccguacuaccggcgcaucgcccccaagaugcccgucgugacguccgugcggagcucccagauccccgagaacagcaccuccagccagcugaugaugaacggcgccaccuccagcuucgagaacggccacccgagccagcccgggccgccccagcucacccgcgccuccgccgacguccugagcaagugcaagaaggcgcuguccgagcacaacgugcucguggucgagggcgcccggaaguacgccugcaagaucugcugcaagacguuccugacccugaccgacugcaagaagcacauccgcgugcacaccggggagaagcccuacgccugccucaagugcggcaagcgguucagccaguccagccaccuguacaagcacuccaagacgaccugccugcgcuggcagagcuccaaccuccccagcacccugcuguga

SEQ ID NO: 38871 - RNA, 1860 nt, Artificial Sequence
  derived and/or modified sequence opt1 from ZBTB7C__Homo_sapiens__NP_001034449
auggccaacgacaucgacgagcugaucggcauccccuucccgaaccacagcuccgaggugcucugcagccugaacgagcagcgccacgacgggcugcucugcgacguccugcugguggugcaggagcaggaguaccggacccaccgcuccguccucgccgcgugcagcaaguacuucaagaagcuguucaccgccggcacgcuggccucccagcccuacguguacgagaucgacuucgugcagcccgaggcccucgccgcgauccuggaguucgccuacaccagcacccugaccaucacggccgggaacgucaagcacauccucaacgccgcgcggaugcuggagauccagugcaucgugaacgugugccuggagaucauggagcccggcggggacggcggcgaggaggacgacaaggaggacgacgacgacgacgaggacgacgacgacgaggaggacgaggaggaggaggaggaggaggaggaggacgacgacgacgacaccgaggacuucgccgaccaggagaaccucccggacccccaggacaucuccugccaccagagccccuccaagaccgaccaccugaccgagaaggccuacagcgacacgccccgcgacuucccggacuccuuccaggccgggagccccggccaccugggggucauccgggacuucuccaucgagagccuccugcgcgagaaccuguaccccaaggccaacauccccgaccggcgcccgucccucagccccuucgcgcccgacuucuucccccaccuguggccgggcgacuucggggccuucgcccagcugcccgagcagcccauggacuccggcccccucgaccuggugaucaagaaccggaagaucaaggaggaggagaaggaggagcugccgcccccgcccccgccgcccuuccccaacgacuucuucaaggacauguuccccgaccuccccggcgggccccugggcccgaucaaggccgagaacgacuacggggccuaccugaacuuccucagcgcgacccaccugggcggccuguucccgcccuggccccucguggaggagcgcaagcugaagcccaaggccucccagcagugccccaucugccacaaggucaucaugggggccggcaagcugccccggcacaugcgcacccacaccggggagaagcccuacaugugcacgaucugcgaggugcgguucacccgccaggacaagcucaagauccacaugcggaagcacaccggcgagcgcccguaccugugcauccacugcaacgccaaguucgugcacaacuacgaccugaagaaccacaugcggauccacaccgggguccgccccuaccagugcgaguucugcuacaagagcuucacgcggagcgaccaccuccaccgccacaucaagcggcaguccugccgcauggcccgcccccggcgcggccggaagcccgcggccuggcgcgccgccagccugcuguucggccccgggggccccgcccccgacaaggcggccuucgugaugcccccggcccucggggaggugggcgggcaccugggcggcgccgcggucugccugcccgggcccucccccgccaagcacuuccucgccgccccgaagggcgcccugagccugcaggagcucgagcggcaguucgaggagacccagaugaagcuguucgggcgcgcgcagcuggaggccgagcggaacgccggcgggcugcucgccuucgcccuggcggagaacguggccgccgcccgccccuacuucccccugcccgacccgugggccgcgggccucgccggccugcccgggcuggccggccucaaccacguggccuccaugagcgaggcgaacaacuga

SEQ ID NO: 38872 - RNA, 1422 nt, Artificial Sequence
  derived and/or modified sequence opt1 from ZBTB9__Homo_sapiens__NP_689948
auggagacccccaccccgcugccgcccgugcccgccagccccacgugcaaccccgcgccccgcaccauccagaucgaguucccccagcacuccagcucccuccuggagagccugaaccggcaccgccucgagggcaaguucugcgacgucucccugcuggugcaggggcgggagcuccgcgcccacaaggccgugcuggccgccgccagcccguacuuccacgacaagcugcuccugggcgacgcgccccggcugacccuccccuccgucaucgaggccgacgccuucgaggggcugcugcagcucaucuacagcggccgccugcggcugccccucgacgcccugccggcgcaccuccugguggccuccgggcugcagauguggcaggucguggaccagugcagcgagauccugcgcgagcucgagaccuccggcggcgggaucagcgcccggggcgggaacuccuaccacgcccugcugagcacgaccuccagcaccggcggguggugcauccgcuccagccccuuccagacccccgugcaguccagcgccagcacggagucccccgcgagcaccgaguccccggugggcggcgaggggagcgagcucggcgagguccugcagauccagguggaggaggaggaggaggaggaggaggacgacgacgacgaggaccagggguccgccacccugagccagacgccccagccccagcggguguccggcgucuucccccgcccgcacggcccccacccccuccccaugaccgccaccccgcggaagcugcccgagggggagagcgcgccccuggagcuccccgccccgcccgcccugcccccgaagaucuucuacaucaagcaggagcccuucgagcccaaggaggagaucuccggcagcgggacccagcccggcggggccaaggaggagaccaagguguucuccggcggcgacacggaggggaacggcgagcugggguuccuccugccgagcggccccgggcccaccuccggcggcgggggccccagcuggaagccgguggaccugcacgggaacgagauccucuccggcgggggcggccccgggggcgccgggcaggccguccacggccccgugaagcugggcgggacgcccccggccgacggcaagcgcuucgggugccugugcggcaagcgguucgcggugaagcccaagcgcgaccggcacaucaugcucaccuucagccugcgccccuucgggugcggcaucugcaacaagcgguucaagcugaagcaccaccucaccgagcacaugaagacccacgccggcgcccugcacgccugcccccacugcgggcgccgguuccgcguccacgccugcuuccugcgccaccgggaccucugcaagggccaggggugggcgaccgcccacuggaccuacaaguga

SEQ ID NO: 38873 - RNA, 669 nt, Artificial Sequence
  derived and/or modified sequence opt1 from ZC2HC1B__Homo_sapiens__NP_001013645
auggccggcgccgagcccuuccuggcggacgggaaccaggagcuguuccccugcgaggugugcggccgccgguucgccgccgacguccucgagcgccacgggcccaucugcaagaagcuguucaaccggaagcgcaagcccuucagcucccucaagcagcggcugcagggcaccgacauccccaccgugaagaagacgccgcagagcaaguccccgcccgugcgcaagagcaacuggcggcagcagcacgaggacuucaucaacgccauccgcuccgccaagcagugcaugcuggcgaucaaggaggggcggccccucccgcccccgccgccgcccagccugaaccccgacuacauccagcgccccuacugcaugcggcgcuucaacgaguccgccgccgagcggcacaccaacuucugcaaggaccagagcucccgccgggucuucaaccccgcccagaccgcggccaagcuggccagccgcgcccagggccgggcccagaugggccccaagaaggagcccaccgugacguccgcggugggggcccuccugcagaaccgcguccugguggccaccaacgaggugcccaccaagagcggccucgccauggaccccgccuccggggcgaagcugcggcagggcuucagcaaguccagcaagaaggacuga

SEQ ID NO: 38874 - RNA, 1305 nt, Artificial Sequence
  derived and/or modified sequence opt1 from ZC3H10__Homo_sapiens__NP_116175
augcccgaccgcgacagcuacgccaacggcaccggguccagcggcgggggccccgggggcggcggguccgaggaggccagcggcgcgggggugggcuccgggggcgccagcuccgacgccaucugccgggacuuccugcgcaacgucugcaagcggggcaagcgcugccgguaccgccaccccgacaugagcgagguguccaaccucggggugagcaagaacgaguucaucuucugccacgacuuccagaacaaggagugcucccggcccaacugccgcuucauccacggcagcaaggaggacgaggacggguacaagaagaccggcgagcugcccccgcggcugcgccagaaggucgccgccggccucgggcugucccccgcggaccugcccaacggcaaggaggaggugcccaucugccgggacuuccucaagggggacugccagcgcggcgccaagugcaaguuccggcaccuccagcgcgacuucgaguucgacgcccgcgggggcggcgggacgggcgggggcagcaccggguccgugcugccgggccggcggcacgaccuguacgacaucuacgaccugcccgaccgcggcuucgaggaccacgagcccgggcccaagcggcgccggggcgggugcugcccgcccgacggcccccacuucgagagcuacgaguacucccuggcgcccccgcgcggggucgagugccgccuccuggaggaggagaacgccaugcugcggaagcgcguggaggagcucaagaagcaggucagcaaccugcuggccaccaacgaggugcuccuggagcagaacgcccaguuccggaaccaggccaaggugaucacccuguccagcacggcccccgcgaccgagcagacccucgcccccaccgugggcacggucgccaccuucaaccacggcaucgcccagacccacaccacgcugagcucccaggcccugcagccccgcccggugagccagcaggagcucguggcgcccgccggggcccccgccgcgccgcccaccaacgccgccccgcccgccgcgcccccgcccccgccgccccaccugacccccgagaucacgccccuguccgccgcccucgcccagaccaucgcccagggcauggcgcccccgcccgucagcauggcccccguggccguguccgucgcccccguggcccccguggccgucagcauggcgcagccccuggccgggaucaccaugucccacaccaccacgcccauggugaccuacccgaucgccagccaguccaugcggaucaccgccaugccccacuga

SEQ ID NO: 38875 - RNA, 2433 nt, Artificial Sequence
  derived and/or modified sequence opt1 from ZC3H11A__Homo_sapiens__NP_055642
augcccaaccagggcgaggacugcuacuucuucuucuacagcacgugcaccaagggggacuccugccccuuccgccacugcgaggccgccaucggcaacgagaccgugugcacccuguggcaggaggggcggugcuuccgccaggucugccgguuccgccacauggagaucgacaagaagcggagcgagauccccugcuacugggagaaccagcccaccggcugccagaagcucaacugcgcguuccaccacaaccgcgggcgguacguggacggccuguuccugcccccguccaagaccgugcuccccacgguccccgagagccccgaggaggaggugaaggccucccagcugagcgugcagcagaacaagcuguccguccagagcaacccgagcccccagcuccgcagcgugaugaagguggaguccagcgagaacguccccucccccacccacccgcccguggugaucaacgccgccgacgacgacgaggacgacgacgaccaguucagcgaggagggcgacgagaccaagacccccacgcugcagcccaccccggagguccacaacgggcugcgggugaccuccgugcgcaagcccgccgucaacaucaagcagggcgagugccucaacuucgggaucaagacccuggaggagaucaagagcaagaagaugaaggagaaguccaagaagcagggcgaggggagcuccggcgugagcagccugcuccugcaccccgagcccgugccgggccccgagaaggagaacguccggacgguggugcgcaccgucacccuguccaccaagcagggggaggagccccucgugcggcugagccugacggagcgccucggcaagcggaaguucuccgccgggggcgacagcgacccgccccugaagcgcucccuggcgcagcggcucggcaagaagguggaggcccccgagaccaacaucgacaagacccccaagaaggcccaggucagcaagucccugaaggagcgccuggggaugagcgcggaccccgacaacgaggacgccaccgacaaggugaacaaggucggcgagauccacgugaagacgcucgaggagauccugcuggagcgggccucccagaagcgcggggagcuccagaccaagcugaagaccgagggcccgagcaagaccgacgacuccacgagcggggcccgguccagcuccaccauccgcaucaagaccuucagcgaggugcuggccgagaagaagcaccgccagcaggaggcggagcggcagaaguccaagaaggacaccacgugcaucaagcucaagaucgacagcgagaucaagaagaccgucgugcugccgcccaucguggccucccgcggccagagcgaggagcccgccggcaagaccaagagcaugcaggagguccacaucaagacccuggaggagaucaagcucgagaaggcccugcgggugcagcaguccagcgaguccagcacguccagccccucccagcacgaggccacccccggggcgcgccggcugcuccgcaucaccaagcggaccggcaugaaggaggagaagaaccugcaggaggggaacgagguggacagccaguccagcauccgcacggaggccaaggaggccuccggcgagaccaccggggucgacaucaccaagauccaggugaagcggugcgagaccaugcgcgagaagcacaugcagaagcagcaggagcgggagaaguccgugcugacgccccuccgcggcgacgucgccuccugcaacacccagguggccgagaagccggugcugaccgcgguccccggcaucacccggcaccugacgaagcgccuccccaccaagagcucccagaagguggagguggagaccagcgggaucggcgacucccugcugaacgucaagugcgccgcccagacccucgagaagcgggggaaggccaagcccaaggugaacgugaagccgagcgucgugaagguggucagcucccccaagcuggcccccaagcgcaaggcgguggagaugcacgccgccgugaucgccgcggucaagccccugagcuccagcuccgugcuccaggagccgcccgccaagaaggccgccguggccgucgugccccuggugagcgaggacaaguccgucacggugcccgaggcggagaacccgcgggacagccuggugcugccgcccacccaguccagcuccgacagcuccccgcccgaggucagcggccccuccagcucccagaugagcaugaagacccgccggcucuccagcgccagcaccgggaagccgccccuguccguggaggacgacuucgagaagcugaucugggagaucagcggcggcaagcucgaggccgagaucgaccuggaccccgggaaggacgaggacgaccugcuccuggagcuguccgagaugaucgacagcuga

SEQ ID NO: 38876 - RNA, 2652 nt, Artificial Sequence
  derived and/or modified sequence opt1 from ZC3H12C__Homo_sapiens__NP_203748
augcccggcgggggcagccaggaguacggggugcugugcauccaggaguaccgcaagaacuccaaggucgagagcuccacccggaacaacuucaugggccucaaggaccaccuggggcacgaccugggccaccucuacguggagagcaccgacccccagcugucccccgccgugcccuggagcacggucgagaaccccuccauggacaccgugaacgugggcaaggacgagaaggaggccagcgaggagaacgcguccagcggggacuccgaggagaacaccaacagcgaccacgaguccgagcagcugggcagcaucuccgucgagccggggcucaucaccaagacgcaccgccagcugugccggagccccugccuggagccccacauccucaagcgcaacgagauccugcaggacuucaagcccgaggagucccagaccaccagcaaggaggccaagaagccgcccgacguggugcgggaguaccagaccaagcuggaguucgcccucaagcugggcuacuccgaggagcagguccagcuggugcucaacaagcuggggacggacgcccugaucaacgacauccucggcgagcuggugaagcugggcaacaagagcgaggccgaccagaccgucagcaccaucaacaccaucacgcgcgagaccuccagccucgagucccagcggagcgagucccccaugcaggagaucgugaccgacgacggggagaaccugcgccccaucgugaucgacggcagcaacgucgcgaugucccacgggaacaaggagguguucagcugccggggcaucaagcuggccguggacugguuccucgagcgcggccacaaggacaucaccgucuucgugccggccuggcggaaggagcagucccgccccgacgcccugaucacggaccaggagauccugcggaagcucgagaaggagaagauccugguguucacccccagccgccggguccaggggcgccggguggugugcuacgacgaccgcuucaucgucaagcuggcguucgaguccgacggcaucaucgugagcaacgacaacuaccgggaccucgccaacgagaagcccgaguggaagaaguucaucgacgagcgccugcugauguacuccuucgucaacgacaaguucaugccgcccgacgacccccucgggcggcacggccccagccuggacaacuuccugcgcaagaagccgaucgugcccgagcacaagaagcagcccugccccuacgggaagaagugcaccuacggccacaagugcaaguacuaccacccggagcgcggcucccagccccagcggagcguggccgacgagcuccgcgccaugucccggaacaccgccgcgaagacggccaacgagggcgggcuggucaagagcaacuccgugcccugcagcaccaaggccgacagcaccuccgacgugaagcgcggggcccccaagcggcagagcgacccguccauccgcacccaggucuaccaggaccuggaggagaagcuccccacgaagaacaagcuggagacccggagcgugcccucccuggugagcaucccggccaccuccaccgcgaagccccagagcacgaccucccucagcaacggccugcccuccgggguccacuucccgccccaggaccagcgcccccagggccaguaccccagcaugaugauggccaccaagaaccacggcacccccaugccguacgagcaguaccccaagugcgacucccccguggacaucggguacuacagcaugcugaacgccuacuccaaccucagccuguccggcccccggagcccggagcgccgguucagccuggacacggacuaccgcaucuccagcguggccuccgacugcagcuccgaggggagcauguccugcggcagcuccgacagcuacgucggguacaacgaccgguccuacgugagcucccccgacccccagcucgaggagaaccugaagugccagcacaugcacccccacagccgccugaacccgcagcccuuccugcagaacuuccacgacccccucacccggggccaguccuacagccacgaggagcccaaguuccaccacaagccgccccugccccaccuggcccuccaccucccccacuccgcggugggcgcccgcagcuccugcccgggggacuaccccagcccgcccagcuccgcccacagcaaggcgccccaccugggccggucccuggucgccacccgcaucgacagcaucuccgacagccggcuguacgacuccagccccucccgccagcgcaagcccuacagccggcaggaggggcugggcuccugggagcgcccgggcuacgggaucgacgccuacggcuaccggcagaccuacagccuccccgacaacuccacgcagcccugcuacgagcaguucaccuuccagagccugcccgagcagcaggagccggccuggcgcauccccuacugcgggaugccccaggacccgccccgguaccaggacaaccgcgagaagaucuacaucaaccugugcaacaucuucccgcccgaccucgugcggaucgugaugaagcgcaacccccacaugaccgacgcccagcagcuggccgcggccauccuggucgagaagucccagcucggcuacuga

SEQ ID NO: 38877 - RNA, 1584 nt, Artificial Sequence
  derived and/or modified sequence opt1 from ZC3H12D__Homo_sapiens__NP_997243
auggagcaccccagcaagauggaguucuuccagaagcugggcuacgaccgcgaggacgugcuccggguccuggggaagcugggcgagggggcccucgugaacgacgugcugcaggagcugauccgcaccggcucccggccgggggcccucgagcaccccgcggcgccccgccuggucccccggggcagcugcggcgugccggacuccgcccagcgcgggcccggcaccgcccuggaggaggacuuccggacgcucgccagcucccugcgccccaucgugaucgacgggagcaacgucgccaugucccacggcaacaaggagaccuucagcugccgggggaucaagcuggccguggacugguuccgcgaccggggccacaccuacaucaagguguucguccccuccuggcgcaaggacccgccccgggccgacacccccauccgcgagcagcacgugcucgccgagcuggagcggcaggcggugcuggucuacacgcccagccgcaaggugcacggcaagcggcucgugugcuacgacgaccgcuacaucgucaagguggccuacgagcaggacggggugaucgucuccaacgacaacuaccgggaccugcagagcgagaacccggaguggaagugguucaucgagcagcgccugcucauguucuccuucgugaacgaccgguucaugccgcccgacgacccccugggccgccacgggcccagccuguccaacuuccucagccgcaagcccaagccgcccgagcccuccuggcagcacugccccuacggcaagaagugcaccuacggcaucaagugcaaguucuaccaccccgagcggccccaccacgcccagcuggccguggccgacgagcugcgcgcgaagaccggggcccggccgggcgccggggccgaggagcagcgcccgccccgggcccccggcgggagcgcgggcgcccgcgccgcgccccgggagcccuucgcccacucccugcccccggcccgcggcagccccgaccucgccgcccugcgggggagcuucucccgccucgccuucagcgacgaccugggcccccuggggcccccgcuccccguccccgccugcucccugacgccccggcugggcgggccggacugggugagcgcgggcggccgcgugcccgggccccucucccugcccagcccggagucccaguucagccccggcgaccugcccccgccgcccgggcuccagcugcagccccggggcgagcaccgcccccgggaccugcacggggaccuccugagcccccgccggccgcccgacgaccccugggcccgcccgccccgguccgaccgcuuccccggccgcuccgucugggccgagcccgccuggggcgacggggcgaccggcgggcugagcguguacgccaccgaggacgacgagggcgacgcccgggcccgcgcccggaucgcgcucuacuccgucuucccccgcgaccagguggaccgggugauggccgccuuccccgagcugagcgaccuggcccgccucauccugcugguccagcggugccaguccgccggcgcgccccucgggaagccguga

SEQ ID NO: 38878 - RNA, 2208 nt, Artificial Sequence
  derived and/or modified sequence opt1 from ZC3H14__Homo_sapiens__NP_001153575
auggagaucggcaccgagaucagccgcaagauccgguccgccaucaaggggaagcugcaggagcucggcgccuacguggacgaggagcugcccgacuacaucauggucaugguggcgaacaagaagucccaggaccagaugaccgaggaccugagccucuuccuggggaacaacacgauccgcuucaccguguggcugcacggcguccucgacaagcugcggagcgugaccaccgagccguccagccugaaguccagcgacacgaacaucuucgacuccaacgugcccagcaacaaguccaacuucagccgcggggacgagcggcgccacgaggccgccgucccgccccucgccauccccuccgcccggcccgagaagcgcgacagccggguguccaccagcucccaggagagcaagaccaccaacgugcgccagacguacgacgacggcgcggccacccggcugauguccaccgucaagccccugcgcgagcccgccccgagcgaggacgugaucgacaucaagcccgagcccgacgaccucaucgacgaggaccugaacuucgugcaggagaacccccugagccagaagaagccgaccgucacgcucaccuacggcuccagccggcccuccaucgagaucuaccgcccgcccgccagccggaacgcggacuccggggugcaccugaaccgccugcaguuccagcagcagcagaacagcauccacgccgccaagcagcucgacaugcaguccagcuggguguacgagaccggccggcugugcgagcccgagguccugaacucccucgaggagaccuacagccccuucuuccgcaacaacuccgagaagaugagcauggaggacgagaacuuccggaagcgcaagcugcccgugguguccagcgucgugaaggugaagaaguucaaccacgacggggaggaggaggaggaggacgacgacuacggcucccggacggggagcaucuccagcuccgucagcgugcccgccaagccggagcgccgccccagccugccgcccuccaagcaggccaacaagaaccucauccugaaggcgaucagcgaggcccaggaguccgugaccaagaccaccaacuacagcacggucccccagaagcagacccugcccguggcgccccggacccgcaccucccaggaggagcuccuggccgaggucgugcagggccagagccggacgccccgcaucuccccgcccaucaaggaggaggagaccaagggcgacagcguggagaagaaccaggggacccagcagcggcagcugcucucccgccugcagaucgaccccgucauggccgagacccugcagaugagccaggacuacuacgacauggaguccauggugcacgccgacacgcggagcuucauccucaagaagccgaagcuguccgaggagguggucguggcccccaaccaggagagcggcaugaagaccgccgacucccugcgcgugcucagcgggcaccugaugcagacccgggaccugguccagcccgacaagcccgccuccccgaaguucaucgugacccucgacggcgugcccagcccgcccggcuacaugagcgaccaggaggaggacaugugcuucgaggggaugaagcccgucaaccagacggccgcguccaacaagggccugcgcgggcugcuccacccccagcagcugcaccuccugagccggcagcuggaggaccccaacggcuccuucagcaacgccgagauguccgagcugagcguggcccagaagcccgagaagcuccuggagcgcugcaaguacuggccggccugcaagaacggggacgagugcgccuaccaccaccccaucucccccugcaaggcguuccccaacugcaaguucgccgagaagugccuguucgugcacccgaacugcaaguacgacgccaagugcaccaagcccgacugccccuucacccacgucagccggcgcauccccgugcuguccccgaagcccguggccccgcccgcgccgcccagcuccagccagcucugccgguacuuccccgccugcaagaagauggagugccccuucuaccaccccaagcacugccgcuucaacacccagugcacgcggcccgacugcaccuucuaccaccccaccaucaacgucccgccccgccacgcccugaaguggauccggccccagaccuccgaguga

SEQ ID NO: 38879 - RNA, 1281 nt, Artificial Sequence
  derived and/or modified sequence opt1 from ZC3H15__Homo_sapiens__NP_060941
augcccccgaagaagcaggcccaggccggcgggagcaagaaggcggagcagaagaagaaggagaagaucaucgaggacaagaccuucggccugaagaacaagaagggggccaagcagcagaaguucaucaaggccgugacccaccaggucaaguucggccagcagaacccccgccagguggcccaguccgaggccgagaagaagcucaagaaggacgacaagaagaaggagcugcaggagcugaacgagcuguucaagcccguggucgcggcccagaagaucagcaagggggccgaccccaaguccguggugugcgccuucuucaagcagggccagugcacgaagggcgacaagugcaaguucagccacgaccucacccuggagcggaagugcgagaagcgcuccgucuacaucgacgcgcgggacgaggagcucgagaaggacaccauggacaacugggacgagaagaagcuggaggagguggugaacaagaagcacggggaggccgagaagaagaagccgaagacccagaucgucugcaagcacuuccuggaggccaucgagaacaacaaguacggcugguucugggugugccccgggggcggggacaucugcauguaccgccacgcccucccgcccggcuucgugcugaagaaggacaagaagaaggaggagaaggaggacgagaucagccuggaggaccucaucgagcgggagcgcuccgcccugggccccaacgucacgaagaucacccuggagagcuuccucgcguggaagaagcggaagcgccaggagaagaucgacaagcuggagcaggacauggagcggcgcaaggccgacuucaaggccgggaaggcccuggugaucuccggccgggagguguucgaguuccgccccgagcucgucaacgacgacgacgaggaggccgacgacacccgguacacccaggggacgggcggcgacgagguggacgacagcguguccgucaacgacaucgaccugagccuguacaucccccgcgacguggacgagaccgggaucaccguggcgucccucgagcgguucagcaccuacacguccgacaaggacgagaacaagcugagcgaggccuccggcgggcgcgccgagaacggcgagcggagcgaccuggaggaggacaacgagcgcgaggggaccgagaacggcgccaucgacgccguccccguggacgagaaccucuucaccggcgaggaccuggacgagcuggaggaggagcucaacacccuggaccuggaggaguga

SEQ ID NO: 38880 - RNA, 2847 nt, Artificial Sequence
  derived and/or modified sequence opt1 from ZC3H3__Homo_sapiens__NP_055932
auggaggagaaggagauccugcgccggcagauccgccuccugcagggccugaucgacgacuacaagacccuccacgggaacgcccccgccccgggcacccccgccgccagcggguggcagccgcccacguaccacuccggccgggccuucagcgcccgcuacccccggcccucccgccggggguacagcucccaccacggccccagcuggcgcaagaaguacucccuggugaaccggcccccgggccccagcgacccgcccgccgaccacgcgguccgcccccugcacggggcccggggcgggcagccgcccgugccccagcagcacgugcucgagcgccagguccagcugucccagggccagaacguggugaucaaggucaagccgcccagcaaguccgggagcgccuccgccagcggcgcgcagcggggcucccuggaggaguucgaggagacccccuggagcgaccagcgcccccgggagggggagggcgagccgccccgcgggcagcuccagcccucccggcccacccgcgcccgggggaccugcagcguggaggacccccugcuggugugccagaaggagcccggcaagccccgcauggucaaguccgugggcagcgugggcgacagcccccgggagccgcgccgcacggucuccgagagcgugaucgccgugaaggccuccuuccccagcuccgcccugcccccgcggaccggggucgcgcucggccgcaagcuggggagccacuccguggccagcugcgcgccccagcuccugggcgaccggcgcguggacgccggccacaccgaccagcccguccccuccgggagcgugggcgggccggcccggcccgccuccggcccccgccaggcccgggaggccagccugguggugaccugccgcacgaacaaguuccggaagaacaacuacaagugggucgccgccuccagcaagagcccccgcguggcgcggcgcgcccucuccccgcgggucgccgccgagaacgugugcaaggccuccgcggggauggccaacaaggucgagaagccccagcugaucgccgaccccgagcccaagccgcgcaagcccgccaccagcuccaagcccggcagcgcgcccagcaaguacaaguggaaggccuccagcccguccgccagcuccagcuccagcuuccgguggcaguccgaggccagcuccaaggaccacgccagccagcugucccccgugcucagccgcucccccagcggcgaccggcccgcgguggggcacuccggccugaagccgcugagcggggagacgccccucagcgccuacaaggucaagucccgcaccaagaucauccggcgccgcagcuccaccagccugcccggcgacaagaaguccgggaccagccccgccgccaccgccaagucccaccugagccuccggcgccggcaggcgcugcgcggcaaguccagcccggugcugaagaagacccccaacaagggccucgugcaggucacgacccaccggcugugccgccugcccccgucccgggcccaccuccccaccaaggaggccagcucccugcacgccgugcgcaccgcccccacgagcaaggugaucaagacccgguaccgcaucgucaagaagacccccgcguccccgcugagcgccccgcccuucccccucucccugcccagcuggcgggcccgccggcugucccucagccgcagccuggugcugaaccggcuccgccccguggccuccgggggcgggaaggcgcagcccggcagccccugguggcgguccaagggcuaccgcugcaucgggggcguccuguacaaggugagcgccaacaagcuguccaagaccagcgggcagccguccgacgccggcagccggccccuccugcgcacggggcggcuggaccccgccggcuccugcagccgcucccucgccagccgcgcggugcagcggucccuggccaucauccgccaggcccggcagcgccgggagaagcgcaaggaguacugcauguacuacaaccgguucggccgcugcaaccgcggggagcggugccccuacauccacgacccggagaaggucgccgugugcacccgguucgugcgcgggaccugcaagaagaccgacggcacgugccccuucagccaccacgucuccaaggagaagaugcccgugugcagcuacuuccugaagggcaucugcuccaacagcaacugccccuacucccacguguacgucagccggaaggccgaggugugcagcgacuuccugaagggguacugcccgcucggcgcgaagugcaagaagaagcacacccugcugugccccgacuucgcccgccggggcgccugcccccgcggggcccagugccagcuccugcaccggacccagaagcgccacucccggcgcgccgcgaccagccccgccccgggccccuccgacgccacggcccgcagccggguguccgcgagccacgggccccgcaagcccuccgccagccagcggccgacccgccagacccccuccagcgccgcccugaccgccgcggccgucgccgcgcccccgcacugccccggcggguccgccagccccuccagcuccaaggccagcuccagcuccagcagcuccagcagcccgcccgccucccucgaccacgaggcccccucccugcaggaggccgcccuggcggccgccugcagcaaccggcucugcaagcugcccuccuucaucagccugcaguccagccccuccccgggcgcccagccccgcgugcgggcgccccgcgcgccccucacgaaggacagcggcaagccgcugcacaucaagccccggcuguga

SEQ ID NO: 38881 - RNA, 3912 nt, Artificial Sequence
  derived and/or modified sequence opt1 from ZC3H4__Homo_sapiens__NP_055983
auggaggccgcccccggcaccccgcccccccccccgagcgagucccccccccccccgagccccccccccccguccacccccagcccccccccgugcucccccgacgcgcgccccgccacgccccaccugcuccaccaccggcugccgcugcccgacgaccgcgaggacggggagcucgaggagggcgagcuggaggacgacggggccgaggagacccaggacaccagcggcgggcccgagcggucccgcaaggagaagggcgagaagcaccacagcgacuccgacgaggagaagagccaccggcgccugaagcggaagcgcaagaaggagcgggagaaggagaagcgccgguccaagaagcgccggaagagcaagcacaagcgccacgccuccagcuccgacgacuucagcgacuucuccgacgacagcgacuucucccccagcgagaagggccaccggaaguaccgcgaguacagcccgcccuacgcccccucccaccagcaguaccccccgagccacgcgaccccccuccccaagaaggccuacuccaagauggacagcaaguccuacgggauguacgaggacuacgagaacgagcaguacggcgaguacgagggggacgaggaggaggacaugggcaaggaggacuacgacgacuucacgaaggagcugaaccaguaccggcgcgccaaggaggggagcucccggggccgcggcagccgggggcgcggccgcggguaccggggccgcggcucccgggggggcagccgcgggcggggcauggggcgcggcucccggggccgcgggcggggcagcauggggggcgaccacccggaggacgaggaggacuucuacgaggaggagauggacuacggggaguccgaggagcccaugggcgacgacgacuacgacgaguacagcaaggagcugaaccaguaccgccgguccaaggacagccgcggccgggggcucucccgcggccgggggcgcggcagccgggggcgcggcaagggcauggggcggggccgcgggcgcggcggcucccgggggggcaugaacaaggggggcaugaacgacgacgaggacuucuacgacgaggacaugggggacggcggcgggggcagcuaccgcagccgggaccacgacaagccccaccagcaguccgacaagaaggggaaggugaucugcaaguacuucgucgagggccgcugcaccuggggggaccacugcaacuucagccacgacaucgagcugcccaagaagcgggagcugugcaaguucuacaucaccggcuucugcgcccgcgcggagaacugcccguacaugcacggcgacuuccccugcaagcucuaccacaccacggggaacugcaucaacggcgacgacugcauguucucccacgacccccugaccgaggagacccgggagcugcucgacaagaugcuggccgacgacgccgaggccggggccgaggacgagaaggagguggaggagcugaagaagcagggcaucaacccccucccgaagcccccccccggggugggccugcugccgacccccccccgccccccgggcccccaggcgcccacgagccccaacgggcggccgaugcagggcgggcccccccccccgccccccccgcccccccccccgcccggccccccccagaugccgaugcccguccacgagccccucuccccccagcagcugcagcagcaggacauguacaacaagaagaucccgagccuguucgagaucguggugcgccccaccgggcagcucgccgagaagcugggcguccgguuccccggccccgggggcccgcccgggcccaugggccccggcccgaacauggggccccccggccccauggggggcccgaugcaccccgacaugcaccccgacaugcaccccgacaugcacccggacaugcacgccgacaugcacgccgacaugcccauggggcccggcaugaacccgggcccccccauggggcccggcgggccgcccaugaugcccuacggccccggggacuccccgcacagcggcaugaugccccccauccccccggcccagaacuucuacgagaacuucuaccagcagcaggagggcauggagauggagcccgggcugcucggcgacgcggaggacuacgggcacuacgaggagcugcccggcgagcccggggagcaccuguucccggagcacccccucgagcccgacuccuucagcgagggcggccccccggggcgccccaagcccggcgccggggugcccgacuuccugccguccgcccagcgggcccuguaccuccgcauccagcagaagcagcaggaggaggaggagcgggcccgccggcuggcggagagcuccaagcaggaccgcgagaacgaggagggcgacaccggcaacugguacagcuccgacgaggacgaggggggcagcuccgugaccagcauccugaagacgcuccggcagcagaccagcucccgcccccccgccagcgucggggagcuguccagcuccggccugggggacccccggcuccagaagggccacccgaccggcagccgccuggccgacccccgccugucccgggacccccgccucacccggcacguggaggccagcgggggcuccgggccgggcgacagcgggcccuccgacccccgccuggcccgggcgcugcccacgagcaagccggagggcucccuccacagcucccccgugggccccagcuccagcaagggguccggccccccgcccaccgaggaggaggagggggagcgcgcccugcgggagaaggccgucaacaucccccuggacccccucccgggccacccccugcgcgacccccggagccagcugcagcaguucagccacaucaagaaggacgugacccuguccaagcccagcuucgcccgcaccgugcucuggaacccggaggaccugaucccccugcccauccccaagcaggacgcggucccgcccgugcccgccgcccuccaguccaugcccacgcuggacccgcggcugcaccgcgccgccaccgcggggccccccaacgcccggcagcgcccgggcgccagcaccgacuccagcacccagggcgccaaccuccccgacuucgagcugcugucccggauccucaagacggugaacgccaccgggagcuccgcggcccccggcagcuccgacaagcccagcgacccgcgcguccggaaggcccccaccgacccccgccugcagaagcccaccgacuccacggccagcucccgggccgcgaagccggggcccgccgaggcccccagccccaccgccuccccgagcggcgacgcguccccccccgccaccgcccccuacgacccgcgcgugcuggccgccgggggccucggccaggggggcgggggcggccagagcagcgugcuguccgggaucagccuguacgacccccgcacccccaacgcgggcgggaaggccacggagcccgccgccgacaccggcgcccagccgaagggggcggagggcaacggcaaguccagcgccuccaaggccaaggagccccccuucguccggaagagcgcccucgagcagcccgagaccgggaaggccggcgcggacgggggcaccccgaccgaccgcuacaacuccuacaaccggccccgccccaaggccgccgccgcgcccgccgccacgaccgccaccccgccccccgagggggccccgccccagcccggcgugcacaaccugcccgugccgacccuguucggcacggucaagcagacccccaagaccgggagcggcucccccuucgcggggaacagccccgcccgggagggcgagcaggacgccgccucccucaaggacguguucaagggguucgacccgaccgccagccccuucugccaguga

SEQ ID NO: 38882 - RNA, 2916 nt, Artificial Sequence
  derived and/or modified sequence opt1 from ZC3H7A__Homo_sapiens__NP_054872
augagcaacguguccgaggagcgccggaagcgccagcagaacaucaaggagggccugcaguucauccagagcccccucuccuacccggggacccaggagcaguacgccgucuaccugcgggcccuggugcgcaaccucuucaacgagggcaacgacguguaccgggagcacgacuggaacaacagcaucucccaguacaccgaggcgcugaacaucgccgacuacgccaagagcgaggagauccugauccccaaggagaucaucgagaagcucuacaucaaccgcaucgccugcuacuccaacaugggguuccacgacaagguccuggaggacugcaacaucgugcugagccucaacgccuccaacugcaaggcgcuguaccgcaagagcaaggcccuguccgaccucggccgguacaagaaggccuacgacgccguggcgaagugcagccuggccgucccccaggacgagcacgugaucaagcugacgcaggagcucgcccagaagcugggguucaagauccggaaggccuacgugcgcgccgagcugucccucaagagcguccccggcgacggcgcgaccaaggcccugaaccacuccguggaggacaucgagccggaccugcucacgccccggcaggaggccgugcccgucgugagccugcccgccccguccuucagccacgaggugggguccgagcuggccagcguccccgugaugccccucaccagcauccugccccuccagguggaggaguccgcgcugccgagcgccguccuggccaacggcgggaagaugcccuucaccaugcccgaggccuuccuggacgacggcgacauggugcucggggacgagcuggacgaccugcucgacuccgcccccgagaccaacgagaccgugaugccgagcgcgcugguccgcggcccccugcagaccgccuccgugagccccuccaugcccuucagcgccucccuccugggcacgcugccgaucggggcccgguacgccccgccgcccagcuucuccgaguucuacccgccccucaccagcucccuggaggacuucugcagcucccugaacagcuucuccaugagcgaguccaagcgcgaccucagcaccagcaccucccgggagggcacgccccugaacaacagcaacuccagccugcuccugaugaacgggcccggcucccuguucgcgagcgagaacuuccucggcaucuccagccagccccgcaacgacuucgggaacuucuucggcuccgccgugaccaagcccagcuccagcgucacgccccggcacccccuggaggggacccacgagcugcgccaggccugccagaucugcuucgugaaguccggccccaagcugauggacuucaccuaccacgccaacaucgaccacaagugcaagaaggacauccucaucgggcggaucaagaacgucgaggacaagagcuggaagaagauccgcccccggcccaccaagaccaacuacgagggcccguacuacaucugcaaggacguggcggccgaggaggagugccgcuacuccggccacugcaccuucgccuacugccaggaggagaucgacguguggacgcuggagcgcaagggggccuucagccgggaggccuucuucggcgggaacggcaagaucaaccugaccgucuucaagcuccugcaggagcaccugggggaguucaucuuccucugcgagaagugcuucgaccacaagccccgcaugaucuccaagcggaacaaggacaacagcaccgcgugcagccaccccgugaccaagcacgaguucgaggacaacaagugccuggugcacauccugcgcgagacgaccgucaaguacuccaagauccggagcuuccacggccagugccagcucgaccugugccgccacgaggugcgguacggcugccugcgcgaggacgagugcuucuacgcccacucccucguggagcugaaggucuggaucaugcagaacgagaccgggaucagccacgacgccaucgcccaggaguccaagcgguacuggcagaaccuggaggccaacgugcccggcgcccaggugcucgggaaccagaucaugccgggcuuccugaacaugaagaucaaguucgucugcgcgcagugccugcgcaacggccaggugaucgagcccgacaagaaccggaaguacugcagcgccaaggcccgccacuccuggaccaaggaccggcgcgccaugcgggugaugagcaucgagcgcaagaaguggaugaacauccggccccuccccacgaagaagcagaugccgcugcaguucgaccugugcaaccacaucgcguccgggaagaagugccaguacgucggcaacugcagcuucgcccacucccccgaggagcgcgagguguggaccuacaugaaggagaacgggauccaggacauggagcaguucuacgagcucuggcucaagagccagaagaacgagaaguccgaggacaucgccagccaguccaacaaggagaacggcaagcagauccacaugcccaccgacuacgccgaggugaccgucgacuuccacugcuggaugugcgggaagaacugcaacagcgagaagcaguggcagggccacaucuccagcgagaagcacaaggagaagguguuccacacggaggacgaccaguacugcuggcagcaccgguuccccaccggcuacuucuccaucugcgaccgcuacaugaacgggaccugcccggagggcaacagcugcaaguucgcgcacgggaacgccgagcugcacgagugggaggagcgccgggacgcccugaagaugaagcugaacaaggcccgcaaggaccaccugaucggccccaacgacaacgacuucgggaaguacagcuuccucuucaaggaccugaacuga

SEQ ID NO: 38883 - RNA, 2934 nt, Artificial Sequence
  derived and/or modified sequence opt1 from ZC3H7B__Homo_sapiens__NP_060060
auggagcgccagaagcggaaggccgacaucgagaagggccugcaguucauccagagcacccucccccugaagcaggaggaguacgaggccuuccugcucaagcuggugcagaaccuguucgcggaggggaacgaccucuuccgcgagaaggacuacaagcaggcccugguccaguacauggagggccugaacguggccgacuacgccgccuccgaccagguggcgcucccgcgggagcugcugugcaagcuccacgucaaccgcgccgccugcuacuucaccauggggcuguacgagaaggcccuggaggacagcgagaaggcgcucggccuggacuccgagagcauccgggcccuguuccgcaaggcccgggcccucaacgagcuggggcgccacaaggaggccuacgagugcuccagccggugcucccuggcgcucccccacgacgagagcgugacgcagcugggccaggagcuggcccagaagcucggccugcgcgugcggaaggccuacaagcgcccccaggagcuggagaccuucucccuccugagcaacgggaccgccgccggcgucgcggaccaggggaccuccaacggccuggggagcaucgacgacaucgagacggacugcuacguggacccccggggcuccccggcccuccugcccagcacccccaccaugccccuguucccgcacgugcucgaccugcuggcgccccucgacuccagccgcacccugcccuccacggacagccuggacgacuucuccgacggcgacgucuucgggcccgagcucgacacccugcuggacagccucagccuggugcagggcgggcuguccggcagcggcgugccguccgagcucccccagcugauccccgucuuccccgggggcaccccgcugcucccgcccguggucgggggcagcauccccguguccagcccccugccgcccgccuccuucgggcuggugauggaccccagcaagaagcuggccgccuccgugcucgacgcccuggacccgcccggccccacccuggacccccucgaccugcugcccuacagcgagacgcggcucgacgcccuggacuccuucggcagcacccgcgggucccuggacaagcccgacagcuucauggaggagaccaacucccaggaccaccggcccccgagcggcgcccagaagcccgcccccucccccgagccgugcaugcccaacaccgcgcuccugaucaagaacccccuggccgccacgcacgaguucaagcaggccugccagcucugcuaccccaagaccgggccgcgcgcgggcgacuacaccuaccgggaggggcuggagcacaagugcaagcgcgacauccugcucggccggcugcgcagcuccgaggaccagaccuggaagcgcauccggccccgccccacgaagaccagcuucgucggcagcuacuaccugugcaaggacaugaucaacaagcaggacugcaaguacggggacaacugcaccuucgccuaccaccaggaggagaucgacguguggaccgaggagcggaagggcacgcucaaccgcgaccugcuguucgacccccucgggggcgugaagcgggggucccugaccaucgccaagcugcucaaggagcaccagggcaucuucaccuuccugugcgagaucugcuucgacagcaagccgcgcaucaucuccaagggcaccaaggacagccccuccgucugcagcaaccuggccgccaagcacuccuucuacaacaacaagugccucgugcacaucgugcggagcacgucccugaaguacagcaagauccgccaguuccaggagcacuuccaguucgacgucugccggcacgaggugcgcuacgggugccugcgggaggacuccugccacuucgcgcacagcuucaucgagcucaaggucuggcugcugcagcaguacuccggcaugacccacgaggacaucgugcaggagagcaagaaguacuggcagcagauggaggcccacgccgggaaggccuccagcuccaugggcgcgccccgcacccacggccccagcaccuucgaccuccagaugaaguucgugugcgggcagugcuggcggaacggccaggucguggagccggacaaggaccugaaguacugcagcgccaaggcccgccacugcuggacgaaggagcggcgcgugcugcucgucauguccaaggccaagcggaagugggugagcgugcgcccccugcccuccauccggaacuucccccagcaguacgaccugugcauccacgcccagaacgggcgcaagugccaguacgucggcaacugcagcuucgcccacuccccggaggagcgcgacauguggaccuucaugaaggagaacaagauccucgacaugcagcagaccuacgacauguggcugaagaagcacaaccccgggaagcccggcgagggcacccccaucagcucccgggagggggagaagcagauccagaugccgacggacuacgcggacaucaugaugggcuaccacugcuggcugugcgggaagaacagcaacuccaagaagcaguggcagcagcacauccagagcgagaagcacaaggagaagguguucaccuccgacagcgacgccuccggcugggccuuccgcuuccccaugggggaguuccggcucugcgaccgccugcagaagggcaaggccugccccgacggcgacaagugccggugcgcgcacgggcaggaggagcugaacgaguggcucgaccgccgggaggugcugaagcagaagcuggccaaggcccgcaaggacaugcuccugugcccgcgggacgacgacuucggcaaguacaacuuccugcuccaggaggacggggaccuggccggcgccacccccgaggcgcccgccgccgccgccaccgcgaccacgggggaguga

SEQ ID NO: 38884 - RNA, 2709 nt, Artificial Sequence
  derived and/or modified sequence opt1 from ZC3HAV1__Homo_sapiens__NP_064504
auggccgaccccgaggugugcugcuucaucaccaagauccugugcgcccacggcgggcgcauggcgcucgacgcccugcugcaggagaucgcccucagcgagccgcagcugugcgagguccuccagguggccggccccgaccgguucgugguccuggagaccgggggcgaggccgggaucacgcgcuccgugguggcgaccacccgggcccgcgucugccggcgcaaguacugccagcggcccugcgacaaccugcaccugugcaagcucaaccugcugggccgcugcaacuacagccaguccgagcggaaccucugcaaguacagccacgaggugcuguccgaggagaacuucaaggugcugaagaaccacgagcucagcggccugaacaaggaggagcuggccguccuccugcugcaguccgaccccuucuucaugccggagaucugcaagagcuacaagggggagggccgccagcagaucugcaaccagcagccgcccugcucccggcuccacaucugcgaccacuucacccgcgggaacugccgguuccccaacugccugcgcagccacaaccugauggaccggaaggugcucgccaucaugcgcgagcacggccugaaccccgacgugguccagaacauccaggacaucugcaacuccaagcacaugcagaagaacccgcccgggccccgggcgcccagcucccaccgccggaacauggccuaccgcgcccggagcaagucccgcgaccgcuucuuccagggcagccaggaguuccuggccuccgccagcgcguccgccgagcggagcugcacgcccagccccgaccagaucucccaccgcgccagccucgaggacgcccccguggacgaccugacccggaaguucaccuaccugggcucccaggaccgcgcccggccgcccagcggguccagcaaggcgaccgaccucggcgggacgucccaggccggcaccagccagcgcuuccuggagaacggcucccaggaggaccugcuccacgggaaccccggcagcaccuaccuggccuccaacagcaccuccgcccccaacuggaagucccugacgagcuggaccaacgaccagggggcccggcgcaagaccguguucagcccgacccuccccgcggcccgguccagccugggcucccugcagacgcccgaggccgucaccacccgcaaggggaccggccuccugagcagcgacuaccggaucaucaacggcaaguccgggacgcaggacauccagcccggcccgcuguucaacaacaacgccgacgggguggccaccgacaucaccagcacccgcucccucaacuacaagagcacguccagcggccaccgggagaucuccagcccccgcauccaggacgcggggcccgccucccgggacgugcaggccaccggccgcaucgccgacgacgcggacccccgggucgcccuggugaacgacagccuguccgacgugaccagcaccacguccagccgcgucgacgaccacgacuccgaggagaucugccucgaccaccugugcaagggcugcccgcugaacgggagcugcuccaaggugcacuuccaccuccccuaccgguggcagaugcugaucggcaagaccuggaccgacuucgagcacauggagaccaucgagaagggguacugcaaccccggcauccaccugugcagcguggggagcuacacgaucaacuuccgcgucauguccugcgacagcuucccgauccgccggcuguccacccccagcuccgugaccaagcccgccaacagcgucuucaccacgaaguggaucugguacuggaagaacgaguccggcaccuggauccaguacggcgaggagaaggacaagcgcaagaacagcaacguggacuccagcuaccucgagucccuguaccagagcugcccccgcgggguggucccguuccaggccggcucccggaacuacgagcugagcuuccaggggaugauccagaccaacaucgccuccaagacccagaaggacgugauccggcgccccaccuucgugccccagugguacguccagcagaugaagcggggccccgaccaccagccggcgaagacgagcuccgugagccucaccgccaccuuccgcccccaggaggacuucugcuuccuguccagcaagaaguacaagcugagcgagauccaccaccuccaccccgaguacgugcgggucuccgagcacuucaaggccagcaugaagaacuucaagaucgagaagaucaagaagaucgagaacuccgagcugcuggacaaguucaccuggaagaagucccagaugaaggaggagggcaagcuccuguucuacgccacgagccgcgccuacguggagagcaucugcuccaacaacuucgacagcuuccugcacgagacccacgagaacaaguacgggaagggcaucuacuucgcgaaggacgccaucuacucccacaagaacugccccuacgacgccaagaacguggucauguucguggcccaggugcucgucgggaaguucaccgagggcaacaucaccuacacgagcccgccgccccaguucgacuccugcguggacacccggagcaaccccuccguguucgucaucuuccagaaggaccagguguacccccaguacgugaucgaguacaccgaggacaaggccugcgucaucagcuga

SEQ ID NO: 38885 - RNA, 1446 nt, Artificial Sequence
  derived and/or modified sequence opt1 from ZC3HC1__Homo_sapiens__NP_001269119
augcgcggccugccccggaagcgcgaggccuggacccagccgcacccccucgaggcccuguacgagagccugcgggugcucgagaaggacaccuccgcgacgagccaguccgucaacgggagcccccaggccgagcagcccucccuggagagcaccuccaaggaggccuucuucagccgcguggagaccuucuccagccugaagugggccggcaagccguucgagcucagcccccuggugugcgccaaguacgggugggucaccguggagugcgacaugcugaagugcuccuccugccaggcguuccucugcgccagccugcagcccgccuucgacuucgaccgguacaagcagcgcugcgccgagcugaagaaggcgcucugcacggcccacgagaaguucugcuucuggcccgacuccccgagccccgaccgguucggcaugcugccccuggacgagcccgccauccucguguccgaguuccuggaccgcuuccagagccugugccaccucgaccugcagcugccgucccuccggcccgaggaccugaagaccaugugccugaccgaggacaagaucagccuccugcugcaccuccuggaggacgagcuggaccaccgcaccgacgagcggaagacgaccaucaagcucgggagcgacauccagguccacgugaccgccugcauccuguccgugugcggcugggccugcagcuccagccuggaguccaugcagcucagccugaucacgugcucccagugcaugcgcaaggucggccuguggggguuccagcagaucgagagcuccaugaccgaccucgacgcgagcuucggccugaccuccagccccauccccgggcuggagggccggccggagcgccucccccuggugcccgagagcccccggcgcaugaugacccggucccaggacgccaccuucuccccggggagcgagcaggccgagaagucccccggccccaucgugagccgcacgcgguccugggacagcagcucccccgucgaccgcccggagcccgaggccgccagccccaccacccggacccgccccgugacgcgcuccaugggcaccggggacaccccgggccuggaggugcccagcagcccccuccggaaggcgaagcgcgcccggcugugcuccuccagcuccagcgacaccuccagccgcuccuucuucgacccgacgagccagcaccgggacuggugccccugggucaacaucacccuggggaaggagucccgcgagaacggcggcaccgagcccgacgccagcgcccccgccgagccgggguggaaggcggugcucaccauccugcuggcccacaagcaguccagccagcccgccgagacggacagcaugucccucagcgagaagucccggaagguguuccgcaucuuccggcagugggagagccugugcuccugcuga

SEQ ID NO: 38886 - RNA, 531 nt, Artificial Sequence
  derived and/or modified sequence opt1 from ZC4H2__Homo_sapiens__NP_001171504
auggccgacgagcaggagaucaugugcaagcuggagagcaucaaggagauccgcaacaagacccuccagauggagaagaucaaggcccggcugaaggcggaguucgaggcccuggaguccgaggagcgccaccucaaggaguacaagcaggagauggaccugcugcuccaggagaagauggcccacguggaggagcugcggcugauccacgccgacaucaacgucauggagaacaccaucaagcagagcgagaacgaccucaacaagcugcuggaguccacgcgccggcuccacgacgaguacaagccgcugaaggagcacguggacgcccugcgcaugacccucggccugcagcggcugccggaccucugcgaggaggaggagaagcugagccuggagcccgcgugccacgugaccuccaaguucaccgggaugcaccucuacgcccuguucgcccgcccccgggucggccccgggacgcccaagagccgcaacggcucccggaugaacaaggagcgcgagagcaccuga

SEQ ID NO: 38887 - RNA, 3915 nt, Artificial Sequence
  derived and/or modified sequence opt1 from ZCCHC11__Homo_sapiens__XP_011539402
auggaggagagcaagacccugaaguccgagaaccacgagcccaagaagaacgugaucugcgaggagagcaaggccguccaggugaucggcaaccagacccucaaggcccgcaacgacaaguccgugaaggagaucgagaacagcuccccgaaccggaacagcuccaagaagaacaagcagaacgacaucugcaucgagaagacggaggucaagagcugcaaggugaacgcggccaaccugcccgggcccaaggaccugggccucgugcugcgcgaccagucccacugcaaggccaagaaguuccccaacagcccggucaaggccgagaaggccaccaucucccaggccaagagcgagaaggcgaccucccugcaggccaaggccgagaagucccccaagucccccaacagcgugaaggcggagaaggccuccagcuaccagaugaaguccgagaaggugcccagcagcccggccgaggccgagaaggggcccucccuccugcugaaggacaugcggcagaagaccgagcuccagcagaucggcaagaagauccccagcuccuucacgagcgucgacaaggugaacaucgaggccgucgggggcgagaagugcgcgcugcagaacagcccccgcagccagaagcagcagaccugcaccgacaacaccggcgacuccgacgacagcgccuccgggaucgaggacgugagcgacgaccuguccaagaugaagaacgacgagagcaacaaggagaacuccagcgagauggacuaccucgagaacgccacggugaucgacgaguccgcccugaccccggagcagcggcugggccucaagcaggccgaggagcgccuggagcgggaccacaucuuccgccuggagaagcggagccccgaguacaccaacugccgcuaccucugcaagcugugccugauccacaucgagaacauccagggggcgcacaagcacaucaaggagaagcggcacaagaagaacauccucgagaagcaggaggaguccgagcugcgcagccugcccccgcccucccccgcccaccucgccgcccugagcguggccgucaucgagcuggcgaaggagcacggcaucaccgacgacgaccuccgggugcgccaggagaucguggaggagaugagcaaggucaucacgaccuuccugcccgagugcucccugcggcucuacgggagcucccugacccgcuucgcccucaagagcuccgacgugaacaucgacaucaaguucccgcccaagaugaaccaccccgaccugcugaucaaggugcugggcauccucaagaagaacguccuguacguggacguggagagcgacuuccacgccaagguccccguggucgugugccgggaccgcaaguccggccugcucugccgggugagcgccgggaacgacauggccugccugaccacggaccugcucaccgcgcugggcaagaucgagcccgucuucaucccgcuggugcucgccuuccgcuacugggccaagcugugcuacaucgacucccagaccgacgggggcauccccagcuacugcuucgcccugauggugauguucuuccuccagcagcggaagccgccccugcugcccugccugcucggcuccuggaucgagggguucgaccccaagcgcauggacgacuuccagcugaagggcaucgucgaggagaaguucgugaagugggagugcaacagcuccagcgcgaccgagaagaacuccaucgccgaggagaacaaggccaaggccgaccagcccaaggacgacacgaagaagaccgagaccgacaaccagagcaacgccaugaaggagaagcacgggaaguccccgcuggcgcucgagacccccaaccgcgugagccugggccagcuguggcucgagcugcugaaguucuacacgcucgacuucgcccuggaggaguacgucaucugcgugcggauccaggacauccugacccgcgagaacaagaacuggcccaagcggcgcaucgccaucgaggaccccuucagcgugaagcggaacgucgcccgcucccucaacagccagcugguguacgaguacguggucgagcgguuccgcgccgcguaccgguacuucgccugcccgcagaccaagggcgggaacaaguccaccguggacuucaagaagcgcgagaagggcaagaucagcaacaagaagcccgugaaguccaacaacauggccacgaacgggugcauccugcucggcgagaccaccgagaagaucaacgccgagcgggagcagcccguccagugcgacgagauggacugcaccagccagcgcugcaucaucgacaacaacaaccugcuggugaacgagcucgacuucgccgaccacgggcaggacuccagcucccugagcacguccaagagcuccgagaucgagcccaagcuggacaagaagcaggacgaccucgcgccgagcgagaccugccugaagaaggagcugucccagugcaacugcaucgaccucagcaagucccccgaccccgacaagagcaccggcaccgacugccgguccaaccuggagacggagagcagccaccaguccgugugcaccgacaccagcgccaccuccugcaacugcaaggccaccgaggacgccagcgaccugaacgacgacgacaaccuccccacgcaggagcuguacuacgucuucgacaaguucauccugaccuccgggaagccgcccaccaucgugugcagcaucugcaagaaggacggccacuccaagaacgacugccccgaggacuuccgcaagaucgaccucaagccccugccgcccaugaccaaccgguuccgcgagauccuggaccucgugugcaagcggugcuucgacgagcugagcccgcccugcuccgagcagcacaaccgcgagcagauccugaucggccucgagaaguucauccagaaggaguacgacgagaaggcgcggcugugccuguucgggagcuccaagaacggcuucggguuccgcgacagcgaccucgacaucugcaugacgcuggagggccacgagaacgccgagaagcugaacugcaaggagaucaucgagaaccucgccaagauccugaagcgccaccccgggcugcggaacauccuccccaucaccaccgccaagguccccaucgugaaguucgagcaccgccgguccggccuggagggcgacaucagccuguacaacacccucgcccagcacaacacgcgcaugcuggcgaccuacgccgccaucgacccccgggugcaguaccugggguacaccaugaaggucuucgccaagcgcugcgacaucggcgacgccucccgggggagccucuccagcuacgcguacauccugauggugcuguacuuccuccagcagcgcaagccgcccgugauccccguccugcaggagaucuucgacggcaagcagaucccgcagcggaugguggacggcuggaacgccuucuucuucgacaagaccgaggagcugaagaagcgccuccccucccuggggaagaacacggagagccugggcgagcucuggcuggggcugcuccgguucuacaccgaggaguucgacuucaaggaguacgugaucagcauccgccagaagaagcugcugaccaccuucgagaagcaguggacguccaagugcaucgccaucgaggaccccuucgaccucaaccacaaccugggcgccggggucagccggaagaugaccaacuucaucaugaaggccuucaucaacggccgcaagcuguucggcacccccuucuacccgcucaucgggcgggaggcgaccaucucccccacgaagaccggcuucaugagcgugcgcuucaccuacuuccaguacauccacuccguguggcggaucgggugcaccaaguga

SEQ ID NO: 38888 - RNA, 1209 nt, Artificial Sequence
  derived and/or modified sequence opt1 from ZCCHC12__Homo_sapiens__NP_776159
auggccagcaucaucgcccgcgugggcaacucccggcgccugaacgcgccccucccgcccugggcccacagcaugcugcggucccuggggcgcagccucggccccaucauggccuccauggccgaccggaacaugaagcuguucagcgggcgcgucgugcccgcccagggcgaggagaccuucgagaacuggcugacccaggugaacgggguccucccggacuggaacauguccgaggaggagaagcugaagcggcugaugaagacgcuccgcggccccgcgcgggaggugaugcgcgugcugcaggccaccaaccccaaccugagcgucgccgacuuccuccgggccaugaagcugguguucggcgaguccgagagcuccgugaccgcgcacgggaaguucuucaacacccugcaggcccagggcgagaaggccagccucuacgucauccgccuggaggugcagcugcagaacgccauccaggccgggaucaucgcggagaaggacgccaaccggacgcgccuccagcagcugcugcucggcggggagcugucccgggaccugcgccuccggcugaaggacuuccugcgcauguacgccaacgagcaggagcggcuccccaacuuccuggagcugauccgcauggugcgggaggaggaggacugggacgacgccuucaucaagcgcaagcgcccgaagcggagcgaguccauggucgagcgcgccgugagccccguggcguuccagggcuccccgcccaucgucaucggcagcgccgacugcaacgugaucgagaucgacgacacccucgacgacuccgacgaggacgugauccuggucgagagccaggacccgccccugcccagcuggggcgcgccgccccuccgggaccgcgcccggccccaggacgaggugcuggugaucgacagcccccacaacucccgcgcccaguuccccuccaccagcggcggguccggguacaagaacaacggccccggggagaugcggcgcgcccggaagcgcaagcacaccauccggugcagcuacugcggcgaggaggggcacuccaaggagacgugcgacaacgagagcgacaaggcccaggucuucgagaaccugaucaucacccuccaggagcugacccacaccgagauggagcgcucccggguggcccccggcgaguacaacgacuucagcgagccccuguga

SEQ ID NO: 38889 - RNA, 2850 nt, Artificial Sequence
  derived and/or modified sequence opt1 from ZCCHC14__Homo_sapiens__NP_055959
auggccagcaaccaccccgccuucuccuuccaccagaagcaggugcugcgccaggagcucacccagauccagagcucccugaacggcgggggcgggcacggcgggaagggcgcgccgggccccgggggcgcccugcccaccugccccgccugccacaagaucacgccgcggaccgaggcccccgucagcuccgugagcaacucccucgagaacgcccugcacaccagcgcgcacuccaccgaggagagccugcccaagcgcccccucgggaagcacuccaaggugagcgucgagaagaucgaccugaagggccugucccacacgaagaacgaccggaacguggagugcagcuucgaggugcucugguccgacagcuccaucaccagcgucaccaaguccagcagcgaggugaccgaguucaucuccaagcugugccagcuguacccggaggagaaccucgagaagcugauccccugccuggccgggcccgacgccuucuacguggagcgcaaccacgucgaccucgacagcggccugcgguaccuggccucccuccccagccacgugcugaagaacgaccacgugcgccgguuccuguccacgagcuccccgccccagcagcuccagagccccucccccggcaacccgagccuguccaaggucgggaccgugaugggcgugagcgggcgccccgucugcggcguggcgggcauccccuccagccaguccggggcccagcaccacggccagcaccccgccgggagcgccgccccgcugccccacugcucccacgcgggcagcgccggguccgcccucgccuaccggacccagauggacaccagccccgccauccugaugcccagcucccugcagacgccgcagacccaggagcagaacggcauccucgacuggcugcgcaagcugcggcuccacaaguacuaccccguguucaagcagcugagcauggagaaguuccugucccucaccgaggaggaccugaacaaguucgagagccugaccaugggcgcgaagaagaagcucaagacgcagcuggagcuggagaaggagaaguccgagcgccggugccucaaccccagcgcccccccgcuggucaccuccagcgggguggcccgcgugccccccaccucccacgucggcccggugcagagcgggcggggcucccacgccgccgagcugcgcguggaggucgagcagccccaccaccagcucccccgggaggggagcuccagcgaguacuccagcuccagcagcucccccaugggcgugcaggcgcgcgaggagagcuccgacagcgccgaggagaacgaccggcgcgucgagauccaccuggaguccagcgacaaggagaagccggugaugcugcucaaccacuucaccuccagcuccgcccggcccacggcccaggugcugcccguccagaacgaggccagcuccaaccccagcggccaccacccgcugcccccccagaugcucuccgcggccagccacaucacccccauccgcaugcugaacuccgugcacaagccggagcgcgggagcgccgacaugaagcugcuguccagcuccgugcacagccuccugagccuggaggagcggaacaagggcuccgggccccgcagcuccaugaaggucgacaagagcuucggcuccgccaugauggacgugcuccccgcgagcgccccccaccagccggugcagguccuguccgggcugagcgaguccagcuccaugagccccaccguguccuucggcccccggaccaaggugguccacgccagcacgcucgaccgcgugcugaagaccgcccagcagcccgcccugguggucgagaccuccaccgcggccacgggcaccccgagcaccgugcuccacgccgcccggccccccaucaagcugcugcucuccagcuccgugcccgccgacagcgcgaucagcgggcagaccuccugcccgaacaacguccagaucagcgugccccccgccaucaucaacccgcgcacggcccuguacaccgccaacaccaagguggccuucuccgcgaugagcuccaugcccgucggcccccugcaggggggcuucugcgccaacagcaacaccgccucccccagcucccacccgagcacguccuucgccaacauggcgacccuccccagcugccccgcccccuccagcuccccggcccugagcuccgugcccgagagcuccuucuacagcagcuccggcgggggcgggagcaccggcaacauccccgccuccaaccccaaccaccaccaccaccaccaccaccagcagccgcccgcccccccccagccggcgcccccccccccggggugcaucgugugcaccagcugcggcugcuccggcagcugcggguccagcggccugaccgucuccuacgccaacuacuuccagcaccccuucagcgggcccuccguguucacguuccccuuccucccguucagccccaugugcuccagcggcuacguguccgcccagcaguacgggggcggcagcaccuuccccgucgugcacgcccccuacuccagcuccgggaccccggaccccgugcugagcggccagagcaccuucgccguccccccgaugcagaacuucauggcggggacggccggcguguaccagacccaggggcuggugggcuccagcaacggcuccagccacaagaaguccgggaaccucagcugcuacaacugcggcgccaccgggcaccgggcccaggacugcaagcagcccuccauggacuucaaccgccccggcaccuuccggcugaaguacgcccccccggcggagagccuggacuccacggacuga

SEQ ID NO: 38890 - RNA, 3537 nt, Artificial Sequence
  derived and/or modified sequence opt1 from ZCCHC2__Homo_sapiens__NP_060212
augcugcgcaugaagcucccccugaagccgacccaccccgccgagccccccccggaggccgaggagcccgaggcggacgcccggcccggcgccaaggcccccagccgccggcgccgggacugccgcccgcccccccccccgcccccccccgccgggccgucccggggcccccugccccccccgccccccccccgcgggcucggcccgcccguggcggggggcgccgccgccggcgcggggaugcccggcgggggcgggggccccagcgccgcccugcgggagcaggagcgcgucuacgagugguucggccuggugcucggguccgcccagcggcuggaguucaugugcggccugcucgaccugugcaacccgcuggagcuccgcuuccuggggagcugccuggaggaccucgcccggaaggacuaccacuaccugcgcgacuccgaggcgaaggccaacggccugagcgaccccggcccccucgccgacuuccgggagccggccgugcgcucccggcugaucgucuaccuggcccuccuggggagcgagaaccgcgaggcggccggccggcugcaccgccuccugccccagguggacuccgugcugaagagccuccgggccgcccgcggggagggcucccgcgggggcgccgaggacgagcggggcgaggacggggacggcgagcaggacgcggagaaggacgggagcggccccgaggggggcaucgucgagccccgcgugggcgggggccuggggucccgggcccaggaggagcugcuccugcuguucaccauggccagccuccacccggccuucuccuuccaccagcgcgugacgcugcgggagcaccuggagcgccuccgggccgcgcugcgcggcgggcccgaggacgccgaggucgagguggagcccugcaaguucgccggcccccgggcccagaacaacagcgcgcacggcgacuacaugcagaacaacgaguccagccugaucgagcaggccccgaucccccaggacgggcucaccguggccccccaccgcgcccagcgggaggccguccacaucgagaagaucaugcugaagggcgugcagcgcaagcgggcggacaaguacugggaguacaccuucaaggugaacugguccgaccugagcgucaccacggugaccaagacccaccaggagcuccaggaguuccugcugaagcuccccaaggagcugagcuccgagaccuucgacaagacgauccugcgcgcccucaaccaggggagccugaagcgggaggagcgccggcacccggaccuggagcccauccugcgccagcucuucuccagcuccagccaggccuuccugcagucccagaaggugcacagcuucuuccaguccaucagcuccgacagccugcacuccaucaacaaccuccagagcucccugaagaccagcaagauccuggagcaccucaaggaggacuccagcgaggccuccagccaggaggaggacguccugcagcacgccaucauccacaagaagcacaccggcaagagccccaucgugaacaacaucggcaccuccugcagcccccuggacgggcucacgaugcaguacuccgagcagaacggcaucguggacuggcggaagcagagcugcaccaccauccagcacccggagcacugcgucaccuccgcggaccagcacagcgccgagaagcgcucccugagcuccaucaacaagaagaaggggaagccccagacggagaaggagaagaucaagaagaccgacaaccgccugaacagccggaucaacggcauccgccucuccaccccccagcacgcccacgggggcaccgugaaggacgugaaccuggacaucggcagcgggcacgacacgugcggcgagaccuccagcgaguccuacagcucccccagcagcccgcggcacgacgggcgcgaguccuucgagagcgaggaggagaaggaccgggacaccgacuccaacagcgaggacuccggcaaccccagcaccacgcgcuucaccggguacggcuccgucaaccagaccgugaccgucaagccccccgugcagaucgccagccugggcaacgagaacgggaaccuccuggaggacccgcugaacucccccaaguaccagcacaucagcuucaugcccacgcuccacugcgugaugcacaacggcgcccagaaguccgaggucguggugccggcgcccaagcccgccgacgggaagaccaucggcaugcugguccccagcccgguggccaucuccgccauccgggagagcgcgaacuccacccccguggggauccugggccccaccgccugcacgggcgagagcgagaagcaccucgagcugcuggccuccccccucccgauccccagcaccuuccugccccacuccagcacccccgcccugcaccucaccguccagcgccugaagcugccgcccccccaggggagcuccgagagcugcacggugaacaucccccagcagccgcccggcucccucagcaucgccucccccaacaccgcguucauccccauccacaacccggggagcuuccccggcucccccguggccaccaccgaccccaucaccaagagcgccucccaggucguggggcugaaccagauggugccgcagaucgagggcaacacgggcaccgucccccagcccaccaacgugaaggugguccugcccgccgccgggcucagcgcggcccagccgcccgccuccuacccccugccgggcagcccccuggccgccggggugcuccccucccagaacagcuccgugcugagcaccgcggccacguccccccagccggccagcgccggcaucucccaggcgcaggccaccgucccccccgccgugcccacccacaccccgggccccgcccccagccccagcccggcccugacgcacuccaccgcgcagagcgacuccaccagcuacaucuccgccguggggaacaccaacgccaacggcacggucgugcccccccagcagauggggagcggccccugcggguccugcggccggcgcugcagcugcggcaccaacgggaaccuccagcugaacuccuacuacuacccgaaccccaugcccggccccauguaccgggugccgagcuucuucacccugcccuccaucugcaacgggagcuaccucaaccaggcccaccaguccaacggcaaccagcugcccuucuuccugccccagaccccguacgccaacgggcucguccacgaccccgugaugggcagccaggcgaacuacggcaugcagcagauggccggguucggccgcuucuaccccguguaccccgccccgaacgucguggccaacacguccgggagcggccccaagaagaacgggaacguguccugcuacaacugcggcgucagcggccacuacgcccaggacugcaagcaguccagcauggaggcgaaccagcaggggaccuaccggcugcgcuacgcccccccgcugccccccagcaacgacacccucgacuccgccgacuga

SEQ ID NO: 38891 - RNA, 1212 nt, Artificial Sequence
  derived and/or modified sequence opt1 from ZCCHC3__Homo_sapiens__NP_149080
auggccaccggcgggggcgccgaggaggagcgcaagcgggggcgcccccagcugcucccgcccgcgcggcccgccgcccgcggcgaggaggccgacgggggccgggagaagaugggcugggcccagguggucaagaaccuggcggagaagaagggggaguuccgcgagccccggccgccccgccgggaggaggagagcggcgggggcgggggcuccgccggccucgggggccccgccgggcuggccgcgcccgaccugggcgacuucccgcccgccggccgcggggaccccaagggccggcgccgggaccccgccggggaggccguggacccgcgcaagaagaagggcgccgcggaggccgggcggcgcaagaaggccgaggccgccgcggccgccauggccacccccgcccggcccggcgaggcggaggacgccgccgagcgcccccugcaggacgagccggccgccgcggccggccccgggaagggccgguuccucgugcgcaucugcuuccagggggacgagggcgccugccccacgcgggacuucgucgugggggcccugauccugcgcagcaucggcauggaccccuccgacaucuacgcggugauccagaucccgggcagccgcgaguucgacgucuccuuccggagcgccgagaagcucgcccuguuccugcgcguguacgaggagaagcgggagcaggaggacugcugggagaacuucgugguccucgggcgcuccaagagcucccugaagacccuguucauccucuuccggaacgagaccguggacguggaggacaucgucaccuggcugaagcgccacugcgacgugcuggccgugcccgucaaggugacggaccgguucggcaucuggaccggggaguacaagugcgagaucgagcuccgccagggcgagggcggggugcggcaccuccccggcgccuucuuccugggggcggagcgcggcuacagcugguacaaggggcagcccaagaccugcuucaagugcggcucccggacccacaugagcggcuccugcacgcaggaccgcugcuuccggugcggggaggagggccaccugagcccguacugccgcaaggggaucgucugcaaccugugcggcaagcgggggcacgccuucgcccagugccccaaggccgugcacaacuccguggccgcgcagcugaccggcgucgccggccacuga

SEQ ID NO: 38892 - RNA, 4488 nt, Artificial Sequence
  derived and/or modified sequence opt1 from ZCCHC6__Homo_sapiens__NP_001171988
augggcgacaccgccaagcccuacuucgugaagcgcaccaaggaccgggggacgauggacgacgacgacuuccgccggggccacccgcagcaggacuaccugaucaucgacgaccacgccaaggggcacggcagcaagauggagaaggggcuccagaagaagaagaucacccccggcaacuacggcaacacgccccgcaaggggcccugcgcggucuccagcaacccguacgccuucaagaaccccaucuacucccagcccgccuggaugaacgacagccacaaggaccaguccaagcgguggcugagcgacgagcacaccggcaacuccgacaacuggcgcgaguucaagcccgggccgcggauccccgugaucaaccgccagcggaaggacagcuuccaggagaacgaggacggcuaccgcuggcaggacacccgggggugccgcaccgugcggcgccuguuccacaaggaccucaccucccuggagaccacgagcgagauggaggccggcucccccgagaacaagaagcagcggagccgcccccggaagccgcgcaagacccggaacgaggagaacgagcaggacggcgaccuggaggggcccgucaucgacgaguccgugcucagcaccaaggagcugcugggccuccagcaggccgaggagcgccugaagcgggacugcaucgaccgccugaagcgccggccccgcaacuaccccaccgcgaaguacacgugccggcucugcgacgugcugaucgaguccaucgccuucgcccacaagcacaucaaggagaagcgccacaagaagaacaucaaggagaagcaggaggaggagcugcucaccacccugccgccgcccacccccagccagaucaacgccgucgggaucgcgaucgacaagguggugcaggaguucggccugcacaacgagaaccucgagcagcggcuggagaucaagcgcaucauggagaacgucuuccagcacaagcugcccgacugcucccuccggcuguacggcagcuccugcagccgccugggguucaagaacagcgacgugaacaucgacauccaguuccccgccaucaugucccagcccgacgugcuccugcugguccaggagugccucaagaacagcgacuccuucaucgacguggacgccgacuuccacgcccgggugcccgucguggugugccgcgagaagcagagcggccugcugugcaaggucuccgccgggaacgagaacgcgugccucacgaccaagcaccugaccgcccugggcaagcucgagccgaagcuggugccccuggugaucgccuuccgguacugggccaagcucugcagcaucgaccgccccgaggagggcgggcugcccccguacgucuucgcccugauggcgaucuucuuccuccagcagcggaaggagccccugcugcccguguaccucggcuccuggaucgagggguucagccuguccaagcugggcaacuucaaccuccaggacaucgagaaggacguggucaucugggagcacaccgacagcgccgccggggacacgggcaucaccaaggaggaggccccgcgcgagacccccaucaagcggggccaggugucccugauccuggacgucaagcaccagcccagcgugcccguggggcagcucugggucgagcugcugcgcuucuacgcccuggaguucaaccucgcggaccuggugaucuccauccgggugaaggagcuggucagccgcgagcucaaggacuggccgaagaagcggaucgccaucgaggaccccuacuccgugaagcgcaacguggcccgcacccugaacagccagcccgucuucgaguacauccugcacugccuccggacgaccuacaaguacuucgcccugccccacaagaucaccaaguccagccugcucaagccgcugaacgccaucacgugcaucuccgagcacagcaaggaggugaucaaccaccaccccgacgugcagaccaaggacgacaagcugaagaacagcguccucgcgcagggccccggggccaccuccagcgccgccaacacgugcaaggugcagccccugacccugaaggagaccgcggaguccuucggcagcccgcccaaggaggagauggggaacgagcacaucuccgugcaccccgagaacagcgacugcauccaggccgacgucaacuccgacgacuacaagggcgacaagguguaccaccccgagaccgggcgcaagaacgagaaggagaaggugggccggaagggcaagcaccuccugaccgucgaccagaagcgcggggagcacguggugugcggcagcacccggaacaacgaguccgagagcacgcuggaccucgagggguuccagaacccgaccgccaaggagugcgagggccuggccacccuggacaacaaggccgaccucgacggcgaguccaccgaggggaccgaggagcuggaggacagccugaaccacuucacgcacuccguccagggccagaccagcgagaugauccccuccgacgaggaggaggaggacgacgaggaggaggaggaggaggaggagccccgccucaccaucaaccagcgggaggacgaggacgggauggcgaacgaggacgagcuggacaacaccuacacgggcagcggggacgaggacgcccuguccgaggaggacgacgagcucggcgaggccgccaaguacgaggacgugaaggagugcggcaagcacguggagcgcgcccugcuggucgagcucaacaagaucagccugaaggaggagaacgugugcgaggagaagaacagccccguggaccaguccgacuucuucuacgaguucagcaagcugaucuucaccaaggggaaguccccgaccgucgugugcagccucugcaagcgggagggccaccugaagaaggacugccccgaggacuucaagcgcauccagcuggagccccugcccccgcugacccccaaguuccugaacauccucgaccaggugugcauccagugcuacaaggacuucucccccacgaucaucgaggaccaggcgcgggagcacauccgccagaaccuggagagcuucauccggcaggacuucccggggaccaagcugucccucuucggcagcuccaagaacggguucggcuucaagcagagcgaccuggacgucugcaugaccaucaacggccuggagaccgccgaggggcucgacugcgugcgcacgaucgaggagcuggcccgggugcugcgcaagcacuccggccuccggaacauccugcccaucaccaccgccaagguccccaucgugaaguucuuccaccuccgcagcgggcucgagguggacaucucccuguacaacacccuggcccuccacaacacgcggcugcugagcgcguacuccgccaucgacccccgcgucaaguaccucugcuacaccaugaagguguucaccaagaugugcgacaucggcgacgccagccgggggucccugagcuccuacgccuacacccugauggugcucuacuuccugcagcagcgcaacccgcccgucauccccgugcugcaggagaucuacaagggcgagaagaagcccgagaucuucguggacggcuggaacaucuacuucuucgaccagaucgacgagcucccgacguacuggagcgagugcgggaagaacaccgagagcgucggccagcuguggcuggggcuccugcgcuucuacaccgaggaguucgacuucaaggagcacgugaucuccauccggcgcaagagccugcucaccacguucaagaagcaguggaccuccaaguacaucgugaucgaggaccccuucgaccugaaccacaaccugggcgcggggcucagccggaagaugaccaacuucaucaugaaggccuucaucaacggccgccgggucuucggcauccccgugaagggguuccccaaggacuacccguccaagauggaguacuucuucgaccccgacgugcugaccgagggcgagcuggcccccaacgaccgcugcugccggaucugcgggaagaucggccacuucaugaaggacugccccaugcgccggaagguccgccggcgccgggaccaggaggacgcccucaaccagcgcuacccggagaacaaggagaagcggagcaaggaggacaaggagauccacaacaaguacacggagcgcgagguguccaccaaggaggacaagcccauccagugcacgccccagaaggccaagcccaugcgggcggccgccgaccugggccgcgagaagauccugcggccgcccguggagaaguggaagcgccaggacgacaaggaccuccgcgagaagcggugcuucaucugcgggcgcgagggccacaucaagaaggagugcccccaguucaaggggagcuccggcagccuguccagcaaguacaugacccaggggaaggccuccgccaagcggacccagcaggagagcuga

SEQ ID NO: 38893 - RNA, 2124 nt, Artificial Sequence
  derived and/or modified sequence opt1 from ZCCHC8__Homo_sapiens__NP_060082
auggccgccgagguguacuucggcgaccuggagcuguucgagcccuucgaccacccggaggagagcauccccaagcccguccacacccgcuucaaggacgacgacggggacgaggaggacgagaacggcgugggggacgcggagcugcgggagcgccugcggcagugcgaggagaccaucgagcagcuccgcgccgagaaccaggagcugaagcggaagcugaacauccucacgcgccccuccggcauccuggugaacgacaccaagcuggacgggccgauccuccagauccuguucaugaacaacgccaucagcaagcaguaccaccaggagaucgaggaguucgucuccaaccuggugaagcgguucgaggagcagcagaagaacgacguggagaagaccagcuucaaccuccugccccagcccuccagcaucguccuggaggaggaccacaagguggaggaguccugcgccaucaagaacaacaaggaggccuucagcguggucggcuccgugcucuacuucaccaacuucugccuggacaagcugggccagccccuccugaacgagaacccgcagcugagcgaggggugggagauccccaaguaccaccagguguucucccacaucgucagccucgagggccaggagauccaggugaaggcgaagcgccccaagccccacugcuucaacugcggguccgaggagcaccagaugaaggacugcccgaugccccggaacgccgcccgcaucagcgagaagcggaaggaguacauggacgccugcggcgaggcgaacaaccagaacuuccagcagcgcuaccacgccgaggagguggaggagcgguucgggcgcuucaagcccggcgucaucuccgaggagcuccaggacgcccugggcgugacggacaagagccugcccccguucaucuaccggaugcgccagcucggguacccgcccggcuggcugaaggaggccgagcucgagaacuccgggcuggcccuguacgacggcaaggacggcaccgacggggagaccgaggugggcgagauccagcagaacaagagcgucaccuacgaccucuccaagcuggugaacuaccccggguucaacaucagcacgccccggggcauccccgacgaguggcgcaucuucgggagcauccccaugcaggcgugccagcagaaggacguguucgccaacuaccugaccuccaacuuccaggcccccggcgucaagagcggcaacaagcgguccagcucccacagcuccccggggagccccaagaagcagaagaacgaguccaacagcgccggcucccccgccgacauggagcucgacagcgacauggaggugccccacgggucccagagcuccgagagcuuccaguuccagccgccccugcccccggacaccccgccccugccccgcggcacgcccccgcccguguucaccccgccccuccccaaggggaccccgccccugacccccuccgacagcccccagacccggacggcguccggcgccgucgacgaggacgcccugacccucgaggagcuggaggagcagcagcgccgcaucugggccgcccuggagcaggcggagagcgugaacagcgacuccgacguccccguggacacgccccucaccggcaacagcguggccuccagccccugccccaacgagcuggaccugcccguccccgaggggaagaccuccgagaagcagacccucgacgagccggaggugcccgagaucuucaccaagaaguccgaggccggccacgccagcagccccgacuccgaggugaccagccugugccagaaggagaaggccgagcuggcgcccgucaacacggagggggcccuccuggacaacggcuccguggugccgaacugcgacaucagcaacgggggcucccagaagcuguuccccgccgacaccagccccuccaccgccaccaagauccacagcccgauccccgacauguccaaguucgcgacgggcaucacccccuucgaguucgagaacauggccgagagcaccgggauguaccugcggauccgcagccuccugaagaacagcccccggaaccagcagaagaacaagaaggccuccgaguga

SEQ ID NO: 38894 - RNA, 654 nt, Artificial Sequence
  derived and/or modified sequence opt1 from ZCRB1__Homo_sapiens__NP_149105
augagcggcgggcuggcccccuccaagagcaccguguacgucuccaaccucccguucagccugaccaacaacgaccuguaccgcaucuucuccaaguacggcaagguggugaaggucacgaucaugaaggacaaggacacccgcaagagcaaggggguggccuucauccucuuccuggacaaggacuccgcgcagaacugcacccgggccaucaacaacaagcagcuguucggccgggugaucaaggccagcaucgccaucgacaacgggcgcgccgcggaguucauccggcgccggaacuacuucgacaaguccaagugcuacgagugcggcgagagcggccaccucuccuacgccugccccaagaacaugcugggggagcgcgagccgcccaagaagaaggagaagaagaagaagaagaaggcccccgagcccgaggaggagaucgaggaggucgaggagagcgaggacgagggcgaggaccccgcccuggacucccucagccaggcgaucgccuuccagcaggccaagaucgaggaggagcagaagaaguggaagcccuccagcggggugccguccaccagcgacgacucccggcgcccccggaucaagaaguccacguacuucagcgacgaggaggagcugagcgacuga

SEQ ID NO: 38895 - RNA, 1575 nt, Artificial Sequence
  derived and/or modified sequence opt1 from ZCWPW1__Homo_sapiens__NP_001244937
augaugaccacccugcagaacaaggaggagugcggcaaggggcccaagcgcaucuucgccccgcccgcccagaaguccuacagccugcugcccugcagccccaacagcccgaaggaggagacgcccggcaucagcucccccgagaccgaggcgcggaucagccugcccaaggccucccucaagaagaaggaggagaaggccaccaugaagaacgugccgagccgcgagcaggagaagaagcggaaggcccagaucaacaagcaggccgagaagaaggagaaggagaaguccagccugaccaacgcggaguucgaggagaucguccagaucgugcugcagaagucccuccaggagugccuggggaugggcagcgggcuggacuucgccgagacguccugcgcccagcccguggucagcacccaguccgacaaggagcccggcaucaccgccagcgcgaccgacacggacaacgccaacggcgaggaggugccccacacccaggagaucuccgugagcugggagggggaggccgccccggagauccgcaccuccaagcucggccagcccgaccccgcccccagcaagaagaaguccaaccggcugacccugagcaagcgcaagaaggaggcgcaggacgagaaggucgagaagacgcagggcgggcacgagcaccggcaggaggaccgccucaagaagaccgugcaggaccacagccagauccgggaccagcagaagggggagaucuccggcuucggccagugccugguguggguccagugcagcuucccgaacugcgggaaguggcgccggcugugcggcaacaucgaccccuccgugcuccccgacaacuggagcugcgaccagaacaccgacgugcaguacaaccgcugcgacauccccgaggagaccuggacggggcuggaguccgacgucgccuacgccagcuacaucccgggcuccaucaucugggccaagcaguacggcuaccccugguggcccgggaugaucgagagcgaccccgaccugggcgaguacuuccucuucaccucccaccuggacagccugccguccaaguaccacgugaccuucuucggggagaccgugagccgggccuggauccccgucaacaugcucaagaacuuccaggagcugucccuggagcucagcgugaugaagaagcgccggaacgacugcucccagaagcugggcguggcgcugaugauggcccaggaggccgagcagaucagcauccaggagcgcgucaaccucuucggguucuggucccgguucaacggcagcaacagcaacggcgagcgcaaggaccugcagcuguccgggcucaacagccccggcuccugccuggagaagaaggagaaggaggaggagcuggagaaggaggagggggagaagacggcccuccggaagaaccugaagcugccccgcgcccggccguggcagcccgcguuccagcgcgagaagaagcucgagcagugccagcgcaccugggccuaccagcgggugcgcggccccgccccgcaccuccggaagaagucccccgacaccgggaaccccuga

SEQ ID NO: 38896 - RNA, 7065 nt, Artificial Sequence
  derived and/or modified sequence opt1 from ZDBF2__Homo_sapiens__NP_065974
augcagaagcgccagggcuacugcagcuacugccgcgugcaguacaacaaccuggagcagcaccuguucagcgcccagcaccgcagccugacccggcagagccgccggcagaucugcaccagcucccugauggagcgcuuccuccaggacgugcugcagcaccaccccuaccacugccaggagagcuccagcacgcaggacgagacccacgugaacaccggguccagcuccgagguggugcaccuggacgacgccuucagcgaggaggaggaggaggacgaggacaagguggaggacgaggacgccaccgaggagcggcccuccgaggugagcgagcccaucgaggagcuccacucccgcccccacaagagccaggagggcacgcaggaggucuccgugcggcccagcgugauccagaagcuggagaaggggcagcagcagccccuggaguucguccacaagaucggcgccuccgugcgcaagugcaaccucguggacaucgggcaggccaccaacaaccggagcaaccugguccggccgcccgugaucugcaacgcccccgccagcugccugcccgaguccagcaacgaccggcccgugaccgcgaacaccacgucccugccgcccgccgcccaccuggacagcgucuccaagugcgaccccaacaagguggagaaguaccuggagcagcccgacggcgccagccgcaaccccgugcccuccagccacgucgagaccaccuccuucagcuaccagaagcacaaggaguccaaccgcaagagccuccgcaugaacuccgacaagcuggugcuguggaaggacgucaagagccagggcaagacccucuccgcggggcugaaguuccacgagcggaugggcacgaaggggagccugcgcgucaaguccccgagcaagcucgccgugaaccccaacaagaccgacaugcccuccaacaagggcaucuucgaggacaccaucgccaagaaccacgaggaguucuucagcaacauggacugcacccaggaggagaagcaccugguguucaacaagacggccuucugggagcagaagugcagcgucuccagcgagaugaaguucgacugcaucucccugcagagcgccuccgaccagccccaggagaccgcgcaggaccucagccuguggaaggaggagcagaucgaccaggaggacaacuacgagucccgggggagcgagauguccuucgacugcagcuccagcuuccacucccugaccgaccagagcaagguguccgccaaggaggucaaccucagcaaggaggugcgcaccgacgugcaguacaagaacaacaaguccuacgucagcaagaucagcuccgacugcgacgacauccugcaccuggugacgaaccagagccagaugaucgugaaggagaucucccuccagaacgcccggcacaucagccuggucgaccaguccuacgagagcuccagcuccgagaccaacuucgacugcgacgccagcccgcaguccaccagcgacuacccccagcaguccgugaccgaggugaaccugcccaaggagguccacaucggccucguggacaagaacuacggcagcuccagcuccgaggugagcgccgacuccgucuucccccugcagagcgugguggaccgcccgcccgucgcggugacggagaccaagcugcgcaagaaggcccacaccagccucguggacaacuacggguccagcugcuccgagaccagcuucgacugcgacgucucccuggagagcgugguggaccacccccagcugacggucaagggccggaaccucaaggggcgccaggugcaccugaagcacaagaagcggaagcccuccagcgccaaggcccaccuggacugcgacgugucccucggcaccgucgccgacgagagccagcgcgcgguggagaagaucaaccugcugaaggagaagaacgccgaccucauggacaugaacugcgagucccacggcccggagaugggguuccaggccgacgcccagcuggccgaccagagccagguggcggagaucgagcggcagaaggucgacguggaccuggagaacaaguccgugcagagcucccgcagcucccucagcuccgacagccccgccagccuguaccacuccgcccacgacgagccccaggaggcccuggacgaggucaaccugaaggagcucaacaucgacauggaggugcggagcuacgacugcuccagcuccgagcugaccuucgacagcgacccgccccugcucuccgugaccgagcagagccaccuggacgcggagggcaaggagcgccacaucgaccuggaggacgaguccugcgagagcgacuccagcgagaucacguucgacuccgacaucccccucuacagcgucaucgaccagcccgagguggccguguacgaggaggagaccgucgaccuggaguccaagagcaacgaguccugcgugagcgagaucaccuucgacuccgacaucccgcugcacagcgggaacgaccaccccgagguggccgucaaggaggugauccagaaggaggaguacauccaccucgagcggaagaacgacgagcccagcggcuccgagaucagcuccgacagccacgcgccccuccacuccgugaccaacagcccggaggucgccgugaagaagcugaacccccagaaggaggagcagguccaccucgagaacaaggagaacgagcccaucgacuccgaggucagccuggacuacaacaucaucuuccacuccgugacggggcgcagcgaggaccccaucaaggagaucucccugcacaccaaggagcacauguaccucgagaacaagagcguguucgagaccucccuggacagcgacgucccgcugcaggccgccacccacaagcccgaggugaucgugaaggagaccuggcuccagcgggagaagcacgccgaguuccagggccgcuccacggaguucagcggcuccaagaccagccuggacuccggggucccccacuacagcgugaccgagccccaggucgccgugaacaagaucaaccggaagaagcaguacgugcuggagaacaagaacgacaagugcagcggcuccgagaucauccucgacagcaacgucccgccccaguccaugaccgaccagccccagcuggccuuccugaaggagaagcacgugaaccucaaggacaagaacagcaaguccggggacagcaagaucacguucgacuccgagcagcugcaggaggcggugaagaagaucgaccaguggaaggaggaggucaucggccugaagaacaagaucaacgagcccagcaccuacaagcucauccaccacccggacguguccgugcagagcgucgccgaccagcccaagguggccaucaagcacgugaaccuggggaacgagaaccacauguaccuggaggucaagaacucccaguacagcugcuccgagaugaaccucgacagcggcuuccugggccaguccaucgugaaccgcccccagaucaccauccuggagcaggagcacaucgagcucgaggggaagcacaaccagugcugcggcagcgagguguccuucgacagcgacgacccccugcaguccgucgccgaccggcugcgcgagaccgugaaggagaucagccucuggaaggacgaggagguggacacggaggaccggcgcaacgaggccaagggguucgagaucauguacgacagcgacguccugcagccgguggcgggccagcccgaggagguggucaaggaggugucccuguggaaggagcacguggaccucgagaacaagaucgucaagcccaccgacagccggaucaacuucgacucccacgagccgcugcagagcgugaccaacaagauccccggggccaacaaggagaucaaccugcuccgcgaggagcacgugugccuggacgacaagggcuacguccccuccgacagcgagaucaucuacguguccaacaucccccugcagagcgugaucaagcagccgcacauccucgaggaggagcacgccucccuggaggacaagagcuccaacagcuacucccccgaggagagcuccgacagcaacgacuccuuccaggccgcggccgacgagcugcagaagcccgucaaggagaucaaccucuggaaggaggaccacaucuaccuggaggacaagagcuacaagcugggcgacuucgacgugagcuacgccucccacauccccgugcaguucgucaccgaccagagcuccgugccggugaaggagaucaaccuccagaagaaggaccacaacgaccuggagaacaagaacugcgaggucugcgggagcgagaucaagugccacuccugcgugcaccuccagagcgagguggaccagccccaggucuccuacaaggaggccgaccuccagaaggaggagcacguggugauggaggagaagacggaccagcccagcgacuccgagaugauguacgacagcgacguccccuuccagaucguggugaaccaguucccgggcuccgucaaggagacccaccuccccaagguggugcuggucgaccucgugcccggggacagcgacuacgaggugaucuccgacgacaucccccugcagcuggucaccgacccgccccagcucaccgugaaggacaucagcugcaucaacacggagugcaucgacaucgaggacaaguccugcgacuucuucggcagcgagguccgcugcaacugcaaggccuccacccccagcaugaccaaccagugcaaggagaccuucaagaucaucaaccggaagaaggacuacaucauccugggcgagcccuccugccagagcugcgggagcgagaugaacuucaacguggacgcguccgaccagagcaugacguacgagucccagggcccggacgagaagauggugaaguacaucgacagcgaggacaaguccugcggguacaacggcagcaaggggaaguucaaccuggaggacaccucccaccgcaccacccaccggcuccagaaggcccacaaggaggccagccugcgcaaggacccccggaacgccggccugaagggcaaguccugccagagcuccgccagcgcggucgacuucggggccuccagcaaguccgcccuccaccgccgggccgacaagaagaagcgcagcaagcugaagcaccgggaccuggagguguccugcgagcccgacggcuucgagaugaacuuccagugcgcgccgccccuccccagcgacacggaccagccccaggagaccgugaagaagcgccaccccugcaagaaggucuccagcgaccugaaggagaagaaccacgacagccaguccagcuccgugcugaagguggacagcguccggaaccucaagaaggcgaaggacgugaucgaggacaaccccgacgagcccgugcuggaggcccugccccacgucccgcccuccuucguggggaagaccuggagccagaucaugcgcgaggacgacaucaagaucaacgcccucgugaaggaguuccgggagggccgcuuccacugcuacuucgacgacgacugcgagaccaagaaggucuccagcaaggggaagaagaaggugacgugggccgaccugcagggcaaggaggacaccgcgcccacccaggccguguccgagagcgacgacaucgucugcggcaucuccgacaucgacgaccugagcguggcccucgacaagcccugccaccggcacccgcccgccgagcggccgcccaagcagaaggggcggguggccucccagugccagaccgcgaagaucagccacuccacgcagaccagcugcaagaacuacccggucaugaagcgcaagaucauccggcaggaggaggacccgcccaaguccaagugcagccgccugcaggacgaccggaagaccaagaagaaggugaagaucggcaccguggaguuccccgccuccugcacgaagguccugaagccgaugcagcccaaggcccucgugugcgugcugagcagccugaacaucaagcucaaggagggggagggccugcccuuccccaagaugcgccaccacuccugggacaacgacauccgcuucaucugcaaguacaagcggaacaucuucgacuacuacgagccgcugaucaagcagaucgucaucuccccgccccuguccgugaucgugcccgaguucgagcgccggaacugggucaagauccacuucaaccgcagcaaccagaacuccagcgccggggacaacgacgccgacggccagggcuccgcgagcgccccgcugauggccgugcccgcccgguacggguucaacucccaccagggcaccagcgacuccagccuguuccucgaggaguccaaggugcugcacgcccgcgagcugcccaagaagcggaacuuccagcucaccuuccugaaccacgacgucgugaagaucagccccaaguccgugcgcaacaagcugcuggagagccaguccaagaagaagauccacgggaagcgggucaccaccagcuccaacaagcucggcuucccgaagaagguguacaagcccaucauccugcagcagaagccccgcaaggcgagcgagaagcagagcaucuggauccggacgaagcccuccgacaucauccgcaaguacaucagcaaguacuccguguuccugcggcaccgcuaccagagccgguccgccuuccucgggcgcuaccugaagaagaagaaguccgucgugucccggcugaagaaggccaagcgcaccgccaaggugcuccugaacagcuccgucccgcccgccggcgcggaggagcugagcuccgccauggccaacccgccgcccaagcggcccgugcgcgccagcugccgcguggcgcggcgccggaagaagaccgacgaguccuaccacggccgccagaaggggcccagcacccccguccgggccuacgaccuccgcuccagcuccugccugcagcagcgggagcgcaugaugacgcggcuggccaacaagcuccgcggcaacgaggugaaguga

SEQ ID NO: 38897 - RNA, 1239 nt, Artificial Sequence
  derived and/or modified sequence opt1 from ZDHHC11__Homo_sapiens__NP_079062
auggacacccgcagcggcucccagugcagcgugacccccgaggccauccugaacaacgagaagcucguccugccgccccggaucucccgcgugaacggguggagccugccccuccacuacuuccagguggucacgugggccguguucgugggccuguccagcgcgaccuucgggaucuucauccccuuccugccgcacgccuggaaguacaucgccuacgucgugaccggcgggaucuucuccuuccaccucgugguccaccugaucgccagcugcaucgaccccgccgacuccaacgugcggcugaugaagaacuacagccagcccaugccccucuucgaccgcuccaagcacgcgcacgugauccagaaccaguucugccaccugugcaaggucaccgugaacaagaagacgaagcacugcaucagcugcaacaagugcguguccggcuucgaccaccacugcaaguggaucaacaacugcgucggcagccggaacuacugguucuucuucuccaccguggccagcgccaccgccgggaugcugugccucaucgcgauccugcuguacgugcucguccaguaccuggugaacccgggcgugcugcgcaccgacccccgguacgaggacgucaagaacaugaacacguggcuccuguuccugccccucuuccccguccaggugcagacccugaucguggugaucaucgggaugcugguccuccugcuggacuuccucggccuggugcaccuggggcagcuccugaucuuccacaucuaccugaaggccaagaagaugaccaccuucgaguaccucaucaacaaccgcaaggaggaguccagcaagcaccaggccgugcggaaggacccguacguccagauggacaagggcgugcugcagcagggcgccggggcccugggcuccagcgcgcagggggugaaggccaagagcucccuccugauccacaagcaccugugccacuucugcacgagcgucaaccaggacggcgacuccaccgcccgcgagggcgacgaggaccccugccccagcgcccucggggccaaggcgcggaacucccgccugaucugccggcgccugugccaguucagcacccgggugcaccccgacggcggguccauggcccaggaggccgacgacgccccgagcaucuccacccucggccugcagcaggagacgaccgagcccaugaagaccgacagcgccgaguccgaggacuga

SEQ ID NO: 38898 - RNA, 804 nt, Artificial Sequence
  derived and/or modified sequence opt1 from ZDHHC12__Homo_sapiens__NP_116188
auggcccccugggcccugcucagcccgggcgugcugguccgcaccgggcacaccgugcugacguggggcaucacccucgugcuguuccugcacgacaccgagcuccggcagugggaggagcagggggagcugcugcucccccugaccuuccugcuccugguccugggcucccuccugcuguaccucgcggugagccugauggaccccggguacgugaacguccagccccagccgcaggaggagcugaaggaggagcagacggccauggugccgcccgccaucccccuccgccggugccgcuacugccuggugcugcagccccuccgggcccgccacugccgggagugccgccggugcguccgccgguacgaccaccacugccccuggauggagaacugcgugggcgagcgcaaccacccccuguucguggucuaccuggcccuccagcugguggugcugcucuggggccuguaccuggcgugguccgggcuccgguucuuccagcccuggggccuguggcugcgcagcuccgggcuccuguucgccaccuuccugcuccugagccuguucucccucgucgccagccugcugcucgugucccaccuguaccugguggccagcaacaccaccacgugggaguucaucuccagccaccggaucgcguaccuccgccagcggccguccaaccccuucgaccgcggccugacccggaaccuggcccacuucuucugcggguggcccagcggcuccugggagacccugugggccgaggaggaggaggagggcagcucccccgccgucuga

SEQ ID NO: 38899 - RNA, 1479 nt, Artificial Sequence
  derived and/or modified sequence opt1 from ZDHHC13__Homo_sapiens__NP_001001483
auggugauccugcuccugcagcacggcgccgaccccacccugaucgacggggagggcuucagcuccauccaccucgccguccuguuccagcacaugccgaucaucgcguaccugaucagcaaggggcaguccgugaacaugaccgacgugaacggccagacgccccucaugcugagcgcccacaaggucaucgggcccgagcccaccggcuuccugcucaaguucaacccgucccugaacgugguggacaagauccaccagaacacgccccugcacugggccgucgccgccggcaacgugaacgcgguggacaagcuccuggaggccgggagcucccuggacauccagaacgucaagggcgagacgccccucgacauggcccugcagaacaagaaccagcugaucauccacaugcucaagaccgaggccaagaugcgcgcgaaccagaaguuccggcuguggcgcuggcugcagaagugcgagcuguuccuccugcucaugcugagcgugaucaccaugugggccaucggguacauccuggacuucaacuccgacagcuggcuccugaagggcugccugcucgugacccuguucuuccugaccucccucuucccccgguuccuggucggguacaagaaccugguguaccucccgaccgccuuccugcugagcuccguguucuggaucuucaugaccugguucauccucuucuuccccgaccuggccggcgcccccuucuacuucagcuucaucuucuccaucgucgcguuccuguacuucuucuacaagaccugggccaccgaccccggcuucacgaaggccagcgaggaggagaagaaggugaacaucaucacccucgccgagaccgggucccuggacuuccgcaccuucugcacgagcugccugauccggaagccgcuccgcucccugcacugccacgugugcaacugcugcgucgcccgguacgaccagcacugccuguggaccggccgcugcaucggguucggcaaccaccacuacuacaucuucuuccucuucuuccugagcauggugugcggcuggaucaucuacgggagcuucaucuaccuguccagccacugcgcgaccaccuucaaggaggacggccuguggacguaccucaaccagaucguggccugcucccccuggguccuguacauccugaugcucgccaccuuccacuucagcugguccaccuuccugcugcucaaccagcuguuccagaucgccuuccuggggcucaccagccacgagcggaucucccugcagaagcagagcaagcacaugaagcagacgcugucccuccgcaagacccccuacaaccugggcuucaugcagaaccuggccgacuucuuccagugcgggugcuucggccucgugaagcccugcguggucgacuggaccagccaguacaccaugguguuccacccggcgcgggagaagguccugcgcuccguguga

SEQ ID NO: 38900 - RNA, 1467 nt, Artificial Sequence
  derived and/or modified sequence opt1 from ZDHHC14__Homo_sapiens__NP_078906
augcccccgggcgggggcgggcccaugaaggacugcgaguacagccagaucuccacccacagcuccagccccauggagagcccccacaagaagaagaagaucgccgcccgccggaagugggagguguucccgggccgcaacaaguucuucugcaacgggcggaucaugauggcgcgccagaccggcgucuucuaccugacgcucgugcugauccuggugaccuccggccucuucuucgccuucgacugccccuaccuggccgucaagaucacccccgccauccccgccguggcggggauccuguucuucuucgugaugggcacccuccugcggacguccuucagcgacccggggguccugccccgcgccacccccgacgaggccgccgaccucgagcggcagaucgacaucgcgaacggcaccuccagcgggggcuaccggcccccgccccgcaccaaggaggugaucaucaacggccagacggugaagcugaaguacugcuucacgugcaagaucuuccgcccgccccgggccucccacugcagccugugcgacaacugcgucgagcgcuucgaccaccacugccccuggguggggaacugcgugggcaagcggaacuaccgcuucuucuacauguucauccucucccugagcuuccugaccgucuucaucuucgccuucgugaucacccacgugauccuccggucccagcagaccggguuccugaacgcccugaaggacagccccgccuccguccucgaggcgguggugugcuucuucagcgucugguccaucgugggccugagcggcuuccacaccuaccugaucagcuccaaccagaccaccaacgaggacaucaaggggagcugguccaacaagcgcggcaaggagaacuacaaccccuacagcuacgggaacaucuucacgaacugcugcguggcccucugcggccccaucuccccgagccugaucgaccggcgcggguacauccagcccgacacgccccagcccgccgccccguccaacggcaucaccauguacggcgccacccagagccaguccgacaugugcgaccaggaccagugcauccagagcaccaaguucguccugcaggcggccgccacgccccuccugcaguccgagcccagccugaccuccgacgagcuccaccuccccgggaagccgggccuggggacccccugcgccagccugacccuggggcccccgaccccgcccgccuccaugcccaaccuggcggaggccacccucgccgacgugaugccccggaaggacgagcacaugggccaccaguuccugacccccgacgaggcccccagcccgccccgccugcucgccgcgggcagcccccuggcccacucccggacgaugcacgugcugggccucgccucccaggacagccugcacgaggacagcguccgcgggcuggugaagcucuccagcgucuga

SEQ ID NO: 38901 - RNA, 987 nt, Artificial Sequence
  derived and/or modified sequence opt1 from ZDHHC15__Homo_sapiens__NP_001139728
augcgccggggcuggaagauggcccugagcgggggccuccgcugcugccggcgcgugcuguccuggguccccgugcuggugaucguccucguggugcuguggagcuacuacgccuacgucuucgagcugugccucgugaucuaccugauccuguaccacgcgaucuucguguucuucaccuggaccuacuggaaguccaucuucacgcucccgcagcagcccaaccagaaguuccaccugagcuacaccgacaaggagcgguacgagaacgaggagcgccccgagguccagaagcagaugcugguggacauggccaagaagcuccccguguacacccggaccggguccggcgccguccgcuucugcgaccggugccaccugaucaagccggaccgcugccaccacugcagcgugugcgccaugugcgugcugaagauggaccaccacugccccugggucaacaacugcaucggguucuccaacuacaaguucuuccuccaguuccuggccuacagcgugcuguacugccucuacaucgcgacgaccguguucuccuacuucaucaaguacuggcggggcgagcugcccagcguccgcuccaaguuccacgugcuguuccuccuguucguggccugcauguucuucgucagccuggugauccucuucggcuaccacugcuggcuggugucccggaacaagaccacccuggaggccuucugcacgcccgucuucaccagcgggccggagaagaacggcuucaaccucggguucaucaagaacauccagcaggucuucggcgacaagaagaaguucuggcugauccccaucggguccagccccggcgacggccacuccuuccccaugcgcagcaugaacgagucccagaacccgcugcucgccaacgaggagaccugggaggacaacgaggacgacaaccaggacuaccccgaggggagcagcucccuggcgguggagaccgagacguga

SEQ ID NO: 38902 - RNA, 1899 nt, Artificial Sequence
  derived and/or modified sequence opt1 from ZDHHC17__Homo_sapiens__NP_056151
augcagcgcgaggagggcuucaacaccaagauggccgacgggcccgacgaguacgacaccgaggccggcugcgugccgcugcuccaccccgaggagaucaagccccagagccacuacaaccacggguacggcgagccccuggggcggaagacgcacaucgacgacuacuccaccugggacaucgucaaggccacccaguacggcaucuacgagcgcugccgggagcugguggaggccggcuacgacgugcgccagccggacaaggagaacgucacccuccugcacugggccgccaucaacaaccggaucgaccuggugaaguacuacaucagcaagggggccaucguggaccagcucggcggggaccugaacuccacgccccugcacugggcgacccgccagggccaccucagcauggucgugcagcugaugaaguacggggccgaccccucccugaucgacggcgagggcugcagcugcauccaccucgccgcccaguucgggcacaccuccaucguggcguaccugaucgccaagggccaggacgucgacaugauggaccagaacgggaugacgccccugaugugggccgccuaccggacccacagcguggacccgacccgccuccugcugaccuucaacguguccgucaaccucggcgacaaguaccacaagaacaccgcccugcacugggcggugcuggccggcaacacgaccgugaucagccuccugcuggaggccggggccaacgucgacgcccagaacaucaagggcgaguccgcgcucgaccuggccaagcagcggaagaacguguggaugaucaaccaccuccaggaggcccgccaggccaagggguacgacaaccccagcuuccugcggaagcugaaggccgacaaggaguuccgccagaaggugaugcugggcacccccuuccucgucaucuggcuggugggguucaucgcggaccugaacaucgacuccuggcucaucaagggccugauguacggcggggugugggccaccguccaguuccugagcaaguccuucuucgaccacagcaugcacuccgcccucccccugggcaucuaccuggccacgaaguucuggauguacgugaccugguucuucugguucuggaacgaccucaacuuccuguucauccaccucccguuccuggccaacagcguggcgcuguucuacaacuucgggaaguccuggaaguccgaccccggcaucaucaaggccaccgaggagcagaagaagaagaccaucgucgagcuggccgagacggggagccucgaccugagcaucuucugcagcacgugccugauccggaagcccgugcgcuccaagcacugcggcgucugcaaccggugcaucgccaaguucgaccaccacugccccugggugggcaacugcgugggggcgggcaaccaccgcuacuucaugggguaccucuucuuccugcuguucaugaucugcuggaugaucuacggcugcaucagcuacugggggcugcacugcgagaccaccuacaccaaggacggcuucuggaccuacaucacccagaucgcgaccugcuccccguggauguucuggauguuccucaacagcgucuuccacuucauguggguggccgugcugcugaugugccagauguaccagaucuccugccucggcaucacgaccaacgagcggaugaacgcccgccgguacaagcacuucaaggucaccaccacgagcaucgagucccccuucaaccacgggugcgugcgcaacaucaucgacuucuucgaguuccggugcugcggccuguuccgccccgugaucgucgacuggacccgccaguacaccaucgaguacgaccagaucagcggguccggcuaccagcugguguga

SEQ ID NO: 38903 - RNA, 1458 nt, Artificial Sequence
  derived and/or modified sequence opt1 from ZDHHC1__Homo_sapiens__NP_037436
auguacaagaugaacaucugcaacaagcccagcaacaagaccgcccccgagaaguccguguggaccgcccccgcccagcccagcggccccuccccggagcugcaggggcagcgcagccggcgcaacggcugguccuggccgccccacccccuccagaucgucgccuggcugcuguaccucuucuucgccgugaucggguucggcauccuggugccccugcucccccaccacuggguccccgccggguacgccugcaugggcgcgaucuucgccggccaccugguggugcaccugacggccgucagcaucgaccccgccgacgcgaacgugcgggacaaguccuacgccgggccgcuccccaucuucaaccgcagccagcacgcccacgugaucgaggaccugcacugcaaccugugcaacgucgacguguccgcccggagcaagcacugcuccgccugcaacaagugcgugugcggcuucgaccaccacugcaaguggcucaacaacugcgucggggagcgcaacuaccggcuguuccugcacagcguggcguccgcccuccugggcgugcugcuccugguccugguggccaccuacguguucgucgaguucuucgugaaccccaugcgccuccggaccaaccgccacuucgaggugcugaagaaccacaccgacgucugguucguguuccugcccgccgccccgguggagacgcaggcgcccgccauccucgcccuggccgcccugcucauccugcuggggcuccugagcaccgcgcugcucggccaccuccugugcuuccacaucuaccugauguggcacaagcugaccaccuacgaguacaucguccagcaccggccgccccaggaggccaagggcgugcaccgcgagcuggaguccugcccgcccaagaugcggcccauccaggagauggaguucuacaugcgcacguuccggcacaugcgccccgagccgcccgggcaggccggccccgccgccgucaacgcgaagcacagccggcccgccucccccgaccccacccccgggcgccgggacugcgccggcccgcccguccagguggagugggaccgcaagaagccccuccccuggcggagcccgcugcugcuccuggccauguggggcccccaggcgccgcccugccugugccgcaagcgcgggcggggcgccugcaucaagugcgagcgccuccggccccgcauccggcgccgggggcugggcccgcccgccgccgcccccgcgcgccggcgcaucccccggacccccgcccugugcacgccccucgcccugcccgccccgaccacccgccggcgccagucccccuggacccgguuccaguggcgccggcgcgccugggcggcgccccuguggcccccgcgcggggccggcgccgacagcccccgguggcgcggccggcgcgugcggccgcccuucagcuga

SEQ ID NO: 38904 - RNA, 1104 nt, Artificial Sequence
  derived and/or modified sequence opt1 from ZDHHC2__Homo_sapiens__NP_057437
auggcccccagcggcccgggguccagcgcccgccggcgcugccggcgcgugcuguacuggauccccgucguguucaucacccuccugcugggcugguccuacuacgcguacgccauccagcucugcaucgugagcauggagaacaccggggagcaggucgugugccugauggccuaccaccuccuguucgccauguucgugugguccuacuggaagacgaucuucacccugcccaugaaccccagcaaggaguuccaccuguccuacgccgagaaggaccuccuggagcgggagccgcgcggcgaggcgcaccaggagguccugcggcgcgccgccaaggaccuccccaucuacacccggaccaugagcggggccauccgcuacugcgaccggugccagcugaucaagcccgaccgcugccaccacugcuccgugugcgacaagugcauccugaagauggaccaccacugccccugggugaacaacugcgucggcuucagcaacuacaaguucuuccuccuguuccuggcguacucccuccuguacugccuguucaucgccgccacggaccuccaguacuucaucaaguucuggaccaacggccugccggacacccaggccaaguuccacaucauguuccuguucuucgccgcggccauguucagcgugucccucagcucccuguucggguaccacugcuggcuggugagcaagaacaaguccacccucgaggccuuccggagccccgucuuccgccacggcacggacaagaacggguucucccugggcuucagcaagaacaugcgccagguguucggggacgagaagaaguacuggcugcuccccaucuucagcucccugggcgacggcugcagcuucccgaccugccuggugaaccaggaccccgagcaggccuccacccccgccgggcucaacagcaccgcgaagaaccuggagaaccaccaguuccccgccaagccccugcgggagucccagagccaccuccugacggacucccagagcuggaccgaguccagcaucaacccgggcaagugcaaggccgggauguccaaccccgcccugaccauggagaacgagaccuga

SEQ ID NO: 38905 - RNA, 1038 nt, Artificial Sequence
  derived and/or modified sequence opt1 from ZDHHC7__Homo_sapiens__NP_001139020
augcagcccagcggccaccgccugcgggacguggagcaccacccgcuccuggccgagaacgacaacuacgacuccagcuccagcuccagcuccgaggccgacgucgcggaccgcgugugguucauccgggacgggugcggcaugaucugcgccgugaugaccuggcugcucgucgccuacgccgacuucguggugaccuucgucaugcugcugcccagcaaggacuucugguacuccguggugaacggggucaucuucaacugccucgccgugcuggcgcugagcucccaccuccgcacgaugcugaccgaccccgagaaguccagcgacugccggcccagcgccugcaccgugaagaccggccuggacccgacgcucgucgggaucugcggcgagggcaccgaguccgugcagagccugcugcucggggccgugcccaagggcaacgccaccaaggaguacauggagucccugcagcugaagcccggggaggucaucuacaagugccccaagugcugcugcaucaagccggagcgcgcgcaccacugcagcaucugcaagcggugcauccgcaagauggaccaccacugccccugggugaacaacugcgugggcgagaagaaccagcgguucuucguccucuucaccauguacaucgcccuguccagcgugcacgcccugauccucugcggguuccaguucaucagcugcgugcgcggccaguggacggagugcuccgacuucagcccgcccaucaccgucauccugcugaucuuccucugccuggagggccugcuguucuucaccuucaccgccgugauguucgggacgcagauccacuccaucugcaacgacgagaccgagaucgagcggcucaagagcgagaagcccaccugggagcgccggcugcgcugggagggcaugaaguccguguucgggggcccgcccagccuccuguggaugaaccccuucgucggcuuccgguuccgccggcugcccacccgcccccggaagggcgggcccgaguucuccguguga

SEQ ID NO: 38906 - RNA, 2298 nt, Artificial Sequence
  derived and/or modified sequence opt1 from ZDHHC8__Homo_sapiens__NP_037505
augccccgcagcccgggcacccggcugaagcccgccaaguacauccccguggccaccgcggccgcccuccuggucggguccagcacgcuguucuucguguucacgugccccuggcucacccgcgccguguccccggccguccccguguacaacggcaucaucuuccuguucgugcuggcgaacuucagcauggccaccuucauggaccccggggucuucccccgggccgacgaggacgaggacaaggaggacgacuuccgcgccccgcucuacaagaacguggacgugcggggcauccagguccgcaugaaguggugcgcgacgugccacuucuaccggccgccccgcugcucccacugcagcgugugcgacaacugcguggaggacuucgaccaccacugccccugggucaacaacugcaucgggcggcgcaacuaccgguacuucuuccuguuccugcucucccugagcgcccacauggugggcguggucgccuucggccugguguacgugcucaaccacgccgaggggcugggcgccgcgcacaccaccaucaccauggccgucaugugcguggccgggcuguucuucauccccgugaucggccucacgggguuccacgucgugcuggugacccgcggccggaccaccaacgagcaggucacgggcaaguuccgcgggggcgugaaccccuucacccgggggugcugcggcaacgucgagcacgugcugugcagcccccucgcgccccgcuacguggucgagccgccccggcugccccuggccgugucccucaagcccccguuccugcgccccgagcugcucgaccgggccgcgccccugaaggugaagcuguccgacaacggccucaaggccgggcugggccgcagcaaguccaaggggagccuggaccggcucgacgagaagccccuggaccugggcccgccccucccgcccaagaucgaggccgggaccuucuccagcgaccugcagacgccccgccccggcuccgccgagagcgcccuguccguccagcgcaccagcccgcccacccccgccauguacaaguuccggcccgccuuccccaccggcccgaaggugcccuucugcgggcccggcgagcagguccccgggccggacagccucacccugggcgacgacuccauccgcagccuggacuucguguccgagcccagccucgaccugcccgacuacgggcccggcggccugcacgccgccuacccgcccuccccgccccucagcgcguccgacgccuucagcggggcccugcggucccugagccucaaggccuccagccgccggggcggggaccacguggcgcugcagccccugcgcuccgagggcgggccgcccacgccccaccggagcaucuucgcgccccacgcccuccccaaccgcaacggcucccugagcuacgacucccugcugaaccccggcagccccgggggccacgccugcccggcccaccccgccgugggggucgccggcuaccacucccccuaccuccacccgggcgccaccggggacccgccccggccccugccccgcagcuucagccccgugcugggcccccggccccgcgagccgucccccgugcgguacgacaaccucagccgcaccaucauggccuccauccaggagcggaaggaccgcgaggagcgggagcgccugcugcggagccaggccgacucccucuucggggacagcggcgucuacgacgcgcccuccagcuacucccugcagcaggccagcgugcuguccgaggggccccgcggcccggcccuccgcuacggcagccgggacgaccugguggccgggcccggcuucgggggcgcccgcaaccccgcgcugcagaccucccucagcucccugagcuccagcgucagccgggcgccccgcaccuccagcuccagccugcaggccgaccaggccuccagcaacgccccggggccccggcccuccagcggcucccaccgcagccccgcccggcagggccucccguccccgcccgggacgccccacagccccuccuacgccggccccaaggccguggccuucauccacaccgaccugcccgagcccccgcccagccugaccgugcagcgcgaccacccccagcucaagaccccgcccuccaagcugaacgggcagagccccggccuggcgcggcucgggcccgccaccggcccgcccggccccuccgccagccccacccgccacacccuggucaagaagguguccggggugggcgggacgaccuacgagaucagcgucuga

SEQ ID NO: 38907 - RNA, 1095 nt, Artificial Sequence
  derived and/or modified sequence opt1 from ZDHHC9__Homo_sapiens__NP_001008223
augagcgugauggucgugcgcaagaaggugacccggaagugggagaagcugcccggccgcaacaccuucugcugcgacgggcgggucaugauggcccgccagaagggcaucuucuaccucacgcuguuccugauccucgggaccugcacccuguucuucgccuucgagugccgguaccuggcggugcagcucucccccgccauccccguguucgccgccaugcuguuccuguucagcauggccacccuccugcgcacguccuucagcgaccccggcgucaucccccgggcgcugccggacgaggccgccuucaucgagauggagaucgaggccaccaacggggcggugccccagggccagcggcccccgccccgcaucaagaacuuccagaucaacaaccagaucgugaagcucaaguacugcuacacgugcaagaucuuccgcccgccccgggccucccacugcagcaucugcgacaacugcgucgagcgcuucgaccaccacugccccugggugggcaacugcguggggaagcggaacuaccgcuacuucuaccuguucauccugucccucagccugcugaccaucuacgucuucgccuucaacaucguguacguggcccucaagucccugaagaucggcuuccuggagacccucaaggagacccccgggaccguccuggaggugcugaucugcuucuucacccucuggagcguggucggccugacgggguuccacaccuuccugguggcccucaaccagaccaccaacgaggacaucaagggcuccuggacgggcaagaaccgggugcagaaccccuacagccacgggaacaucgucaagaacugcugcgaggugcugugcggcccccugcccccguccgugcucgaccgccgggggauccugccccuggaggagagcggcucccgcccgcccagcacccaggagaccuccagcucccuccugccccagagccccgcgcccaccgagcaccugaacagcaacgagaugcccgaggacuccagcacgccggaggagaugcccccgcccgagccgcccgagccgccccaggaggccgccgaggccgagaaguga

SEQ ID NO: 38908 - RNA, 3327 nt, Artificial Sequence
  derived and/or modified sequence opt1 from ZEB1__Homo_sapiens__NP_001121600
augaaggugaccaacuacaacaccgugguggagacgaacagcgacuccgacgacgaggacaagcugcacaucguggaggaggagagcgucaccgacgccgccgacugcgagggcgugcccgaggacgaccucccgaccgaccagaccgugcugcccgggcgcuccagcgagcgggagggcaacgcgaagaacugcugggaggacgacacggggaaggagggccaggagauccuggggcccgaggcccaggccgacgaggccggcugcaccgucaaggacgacgagugcgaguccgacgccgagaacgagcagaaccacgaccccaacguggaggaguuccuccagcagcaggacaccgcggugaucuucccggaggcccccgaggaggaccagcgccagggcacccccgaggccagcgggcacgacgagaacggcacgcccgacgccuucucccagcugcugaccugcccguacugcgaccggggguacaagcgcuucaccagccucaaggagcacaucaaguaccggcacgagaagaacgaggacaacuucuccugcagccugugcuccuacaccuucgcguaccgcacgcagcuggagcggcacaugaccagccacaaguccggccgcgaccagcggcacgucacccagagcgggugcaaccgcaaguucaagugcaccgagugcggcaaggccuucaaguacaagcaccaccucaaggagcaccuccggauccacuccggcgagaagcccuacgagugccccaacugcaagaagcgcuucagccacuccgggagcuacuccagccacaucagcuccaagaagugcaucagccugauccccgugaacggccggccgcgcacggggcugaagaccucccagugcagcucccccagccuguccgccagccccggcucccccacccggccgcagauccgccagaagaucgagaacaagccccugcaggagcagcucagcgugaaccagaucaagaccgagcccgucgacuacgaguucaagcccaucgugguggccuccggcaucaacugcagcacgccgcugcagaacggggucuucaccggcgggggcccccugcaggccaccuccagcccccaggggauggugcaggcggugguccuccccaccgugggccugguguccccgaucagcaucaaccuguccgacauccagaacguccucaagguggccguggacggcaacgucauccgccaggugcuggagaacaaccaggccaaccuggccagcaaggagcaggagacgaucaacgccucccccauccagcagggcgggcacagcgucaucagcgcgaucucccucccccugguggaccaggacgggaccaccaagaucaucaucaacuacagccuggagcagcccucccagcuccagguggucccgcagaaccugaagaaggagaaccccguggccaccaacagcugcaaguccgagaagcugcccgaggaccucacggucaagagcgagaaggacaaguccuucgagggcggggugaacgacagcacgugccugcugugcgacgacugcccgggcgacaucaacgcccuccccgagcugaagcacuacgaccugaagcagcccacccagcccccgccccuccccgccgccgaggcggagaagcccgaguccagcguguccagcgccaccggcgacgggaaccuguccccgagccagccgccccugaagaaccuccugucccugcucaaggccuacuacgcccugaacgcccagcccagcgcggaggagcuguccaagaucgccgacagcgugaaccucccccuggacgucgugaagaagugguucgagaagaugcaggccggccagaucagcgugcaguccagcgagcccuccagccccgagcccgggaaggucaacaucccggccaagaacaacgaccagccccaguccgcgaacgccaacgagccccaggacagcaccgugaaccugcagagcccccucaagaugaccaacagcccggugcugcccgucggcuccaccaccaacgggagccgguccagcacgcccucccccagcccgcugaaccuguccagcucccggaacacccagggcuaccucuacaccgccgagggcgcccaggaggagccccagguggagccccuggaccugagccucccgaagcagcagggggagcugcuggagcgcuccaccaucaccagcguguaccagaacagcgucuacuccgugcaggaggagccccucaaccugagcugcgccaagaaggagccccagaaggacuccugcgugacggacagcgagcccgucgugaacgugaucccgcccuccgcgaaccccaucaacaucgccauccccaccgucaccgcccagcugccgaccaucguggccaucgccgaccagaacagcgugcccugccuccgggcgcuggccgccaacaagcagacgauccugaucccccaggucgccuacaccuacuccaccaccgugagccccgccgugcaggagccgccccucaaggucauccagcccaacggcaaccaggacgagcgccaggacacguccagcgaggggguguccaacguggaggaccagaacgacagcgacuccacgcccccgaagaagaagaugcgcaagaccgagaacggcauguacgcgugcgaccugugcgacaagaucuuccagaaguccuccagccugcuccggcacaaguacgagcacaccggcaagcgcccccacgagugcgggaucugcaagaaggccuucaagcacaagcaccaccugaucgagcacaugcggcugcacuccggcgagaagcccuaccagugcgacaagugcgggaagcgcuucagccacuccggcagcuacagccagcacaugaaccaccgguacuccuacugcaagcgcgaggccgaggagcgggacagcaccgagcaggaggaggccgggcccgagauccucuccaacgagcacgucggcgcgcgcgccagcccgucccagggcgacagcgacgagcgggagucccugacccgcgaggaggacgaggacagcgagaaggaggaggaggaggaggacaaggagauggaggagcugcaggaggagaaggagugcgagaagccccagggggacgaggaggaggaggaggaggaggaggagguggaggaggaggagguggaggaggccgagaacgagggcgaggaggccaagaccgaggggcucaugaaggacgaccgggccgagucccaggcgagcucccugggccagaaggucggggagagcuccgagcaggucagcgaggagaagaccaacgaggccuga

SEQ ID NO: 38909 - RNA, 3573 nt, Artificial Sequence
  derived and/or modified sequence opt1 from ZEB2__Homo_sapiens__NP_001165124
augaagcagcccaucauggccgacggcccgcgcugcaagcggcgcaagcaggccaacccccggcgcaagaacguggucaacuacgacaacgugguggacaccgggagcgagaccgacgaggaggacaagcugcacaucgcggaggacgacggcaucgccaacccccucgaccaggagacgucccccgccagcgucccgaaccacgaguccagcccccacgugucccaggcccugcugccccgggaggaggaggaggacgagauccgcgagggcgggguggagcaccccuggcacaacaacgagauccuccaggccagcgucgacgggccggugaagaacgcgaacugcaccuccgacuucgaggaguacuucgccaagcggaagcuggaggagcgcgacggccacgccgugagcaucgaggaguaccugcagcgguccgacaccgccaucaucuaccccgaggcgcccgaggagcucagccgccugggcacccccgaggccaacgggcaggaggagaacgaccugccgcccggcacgcccgacgccuucgcccagcuccugaccugccccuacugcgaccggggguacaagcgccugaccucccucaaggagcacaucaaguaccggcacgagaagaacgaggagaacuucagcugcccgcugugcuccuacaccuucgccuaccgcacgcagcuggagcggcacauggucacccacaagcccggcaccgaccagcaccagaugcucacccagggggcgggcaaccgcaaguucaagugcacggagugcggcaaggccuucaaguacaagcaccaccugaaggagcaccuccggauccacagcggggagaagcccuacgagugccccaacugcaagaagcgcuucucccacagcggcuccuacagcucccacaucagcagcaagaagugcaucgggcugaucuccgugaacggccggaugcgcaacaacaucaagaccggcagcuccccgaacagcguguccagcucccccaccaacagcgccaucacccagcugcggaacaagcuggagaacgggaagccccucuccaugagcgagcagacgggccugcugaagaucaagaccgagccccucgacuucaacgacuacaagguccugauggccacccacggguucuccggcaccagcccguucaugaacgggggccugggcgccacgagcccccucggggugcaccccuccgcgcagucccccaugcagcaccugggcguggggauggaggccccgcugcucggcuuccccaccaugaacagcaaccuguccgagguccagaaggugcugcagaucguggacaacaccgucagccgccagaagauggacugcaaggccgaggagaucuccaagcucaagggguaccacaugaaggaccccugcagccagccggaggagcagggcgugaccagccccaacaucccgcccgugggccugcccgucgugucccacaacggggccaccaagagcaucaucgacuacacccuggagaaggugaacgaggccaaggcgugccuccagucccugaccaccgacagccgccggcagaucuccaacaucaagaaggagaagcugcgcacgcucaucgaccuggucaccgacgacaagaugaucgagaaccacaacaucagcacccccuucuccugccaguucugcaaggagagcuuccccggccccaucccgcugcaccagcacgagcgguaccucugcaagaugaacgaggagaucaaggccgugcugcagccccacgagaacaucguccccaacaaggccgggguguucguggacaacaaggcccugcuccuguccagcguccuguccgagaagggcaugaccagccccaucaacccguacaaggaccacauguccgugcucaaggccuacuacgcgaugaacauggagcccaacagcgacgagcugcugaagaucuccaucgccguggggcugccccaggaguucgucaaggagugguucgagcagcgcaagguguaccaguacagcaacucccggagccccagccucgagcgcuccagcaagccgcuggcccccaacuccaacccgcccacgaaggacagccugcucccccggucccccgugaagcccauggacagcaucaccucccccagcaucgccgagcugcacaacuccgucaccaacugcgacccgccccugcgccucaccaagcccagccacuucacgaacaucaagccgguggagaagcuggaccacucccggagcaacacccccagcccccugaaccucuccuccaccagcuccaagaacagccacuccagcagcuacacccccaacuccuucagcuccgaggagcugcaggcggagccgcuggaccucagccugcccaagcagaugaaggagcccaaguccaucaucgccaccaagaacaagacgaaggccagcuccaucagccuggaccacaacuccgugagcuccagcuccgagaacagcgacgagccccucaaccugaccuucaucaagaaggaguucuccaacagcaacaaccuggacaacaaguccaccaacccggucuucagcaugaaccccuucuccgccaagccccucuacaccgcccugcccccgcagagcgcguucccgcccgccacguucaugccgcccgugcagaccagcauccccggccugcgccccuaccccggccucgaccagauguccuuccugccccacauggccuacaccuaccccaccggggccgccacguucgcggacaugcagcagcggcgcaaguaccagcggaagcagggcuuccagggggagcugcucgacggcgcccaggacuacaugagcggccuggacgacaugaccgacuccgacagcugccugucccgcaagaagaucaagaagaccgagagcgggauguacgccugcgaccucugcgacaagaccuuccagaaguccagcucccugcugcggcacaaguacgagcacacgggcaagcgcccccaccagugccagaucugcaagaaggccuucaagcacaagcaccaccucaucgagcacagccggcugcacuccggggagaagcccuaccagugcgacaagugcggcaagcgcuucagccacuccgggagcuacucccagcacaugaaccaccgguacagcuacugcaagcgcgaggccgaggagcgcgaggcggccgagcgggaggcccgcgagaagggccaccuggagccgaccgagcuccugaugaaccgggccuaccugcaguccaucacgccccagggcuacagcgacuccgaggagcgcgagagcaugccccgggacggggagagcgagaaggagcacgagaaggagggcgaggacggguacggcaagcucgggcgccaggacggcgacgaggaguucgaggaggaggaggaggaguccgagaacaagagcauggacaccgaccccgagacgauccgggacgaggaggagaccggcgaccacuccauggacgacagcuccgaggacgggaagauggagaccaagagcgaccacgaggaggacaacauggaggacggcauguga

SEQ ID NO: 38910 - RNA, 684 nt, Artificial Sequence
  derived and/or modified sequence opt1 from ZFAND3__Homo_sapiens__NP_068762
augggcgacgccgggagcgagcgcuccaaggcccccagccugccgccccggugccccugcggcuucuggggguccagcaagaccaugaaccucugcuccaagugcuucgcggacuuccagaagaagcagcccgacgacgacagcgccccguccaccagcaacucccagagcgaccuguucuccgaggagacgaccagcgacaacaacaacaccuccaucaccacgcccacccugagccccucccagcagccccucccgaccgagcugaacgugaccagccccuccaaggaggagugcggccccugcacggacaccgcccacgucagccugaucacccccaccaagcgcuccugcgggacggacagccagagcgagaacgaggccuccccggugaagcggccccgccuccuggagaacaccgagcggagcgaggagaccucccgcagcaagcagaagucccggcgccggugcuuccagugccagaccaagcuggagcucgugcagcaggagcugggcagcugccgcugcggcuacgucuucugcaugcugcaccggcuccccgagcagcacgacugcacguucgaccacauggggcgcggccgggaggaggccaucaugaagauggugaagcuggaccgcaagguggggcgguccugccagcgcaucggcgaggggugcagcuga

SEQ ID NO: 38911 - RNA, 642 nt, Artificial Sequence
  derived and/or modified sequence opt1 from ZFAND5__Homo_sapiens__NP_001095891
auggcccaggagaccaaccagacccccggcccgaugcugugcagcacggggugcggcuucuacgggaacccccgcaccaacggcaugugcuccgugugcuacaaggagcaccuccagcggcagcagaacagcgggcgcaugucccccaugggcaccgccagcggcuccaacagccccaccuccgacagcgcguccguccagcgggccgacacgagccugaacaacugcgagggggccgccggcuccaccagcgagaagucccgcaacgugccgguggccgcgcugcccgucacccagcagaugaccgagaugagcaucucccgggaggacaagaucacgacccccaagaccgaggugagcgagcccguggucacccagccgucccccagcgugucccagcccagcacgagccaguccgaggagaaggcccccgagcucccgaagcccaagaagaaccgcugcuucaugugccggaagaagguggggcugaccggcuucgacugccgcugcgggaaccuguucugcggccuccaccgguacagcgacaagcacaacugccccuacgacuacaaggccgaggccgcggccaagauccgcaaggagaaccccgucgugguggccgagaagauccagcggaucuga

SEQ ID NO: 38912 - RNA, 591 nt, Artificial Sequence
  derived and/or modified sequence opt1 from ZFAND6__Homo_sapiens__NP_001229846
auggcccaggagaccaaccacagccaggugcccaugcugugcuccaccggcugcggguucuacggcaacccgcgcacgaacgggaugugcagcgucugcuacaaggagcaccuccagcggcagaacuccagcaacggccgcaucuccccgcccgugcagugcaccgacgggagcgugcccgaggcccaguccgcgcuggacagcaccuccagcuccaugcagcccagccccgucuccaaccagagccugcucuccgagagcguggccuccagccagcuggacuccaccagcguggacaaggccguccccgagacggaggacgugcaggccagcguguccgacaccgcccagcagcccagcgaggagcaguccaagagccuggagaagccgaagcagaagaagaaccggugcuucaugugccgcaagaaggucggccucaccggcuucgagugccggugcgggaacguguacugcggcgugcaccgcuacuccgacguccacaacugcagcuacaacuacaaggcggacgccgccgagaagauccggaaggagaaccccgugguggucggggagaagauccagaagaucuga

SEQ ID NO: 38913 - RNA, 3696 nt, Artificial Sequence
  derived and/or modified sequence opt1 from ZFAT__Homo_sapiens__NP_001025110
augugcaagugcugcaaccuguucagccccaaccaguccgagcuccugagccacguguccgagaagcacauggaggagggcgucaacguggacgagaucaucaucccgcugcgcccccucagcacccccgagcccccgaacuccagcaagaccggggacgaguuccuggugaugaagcggaagcgcggccggcccaagggguccacgaagaagagcuccaccgaggaggagcuggccgagaacaucgucagccccaccgaggacuccccccucgccccggaggagggcaacagccugccccccuccagccuggagugcuccaagugcugccgcaaguucagcaacacccggcagcuccgcaagcacaucugcaucaucgugcugaaccugggggaggaggagggcgaggcgggcaacgaguccgaccucgagcuggagaagaagugcaaggaggacgaccgggagaaggccagcaagcgcccccggucccagaagacggagaaggugcagaagaucagcgggaaggaggcccgccagcugagcggcgccaagaagccgaucaucuccgucgugcucaccgcccacgaggcgauccccggggccaccaagaucgugcccgucgaggccggccccccggagaccggggccacgaacagcgagaccaccuccgcggaccuggugccccggcgcggcuaccaggaguacgccauccagcagacccccuacgagcagcccaugaagagcucccggcugggcccgacgcagcucaagaucuucaccugcgaguacugcaacaagguguucaaguucaagcacagccugcaggcccaccugcgcauccacaccaacgagaagcccuacaagugcccccagugcuccuacgccagcgccaucaaggcgaaccucaacguccaccugcggaagcacaccggggagaaguucgccugcgacuacugcuccuucacgugccugagcaagggccaccucaaggugcacaucgagcgcgugcacaagaagaucaagcagcacugccgguucugcaagaagaaguacuccgacgucaagaaccugaucaagcacauccgcgacgcccacgacccccaggacaagaaggugaaggaggcccuggacgagcucugccugaugacccgggaggggaagcgccagcugcucuacgacugccacaucugcgagcggaaguucaagaacgagcuggaccgcgaccgccacaugcuggugcacggcgacaaguggccguucgccugcgagcucugcggccacggggcgaccaaguaccaggcccuggagcugcacguccggaagcaccccuucguguacgugugcgccgucugccgcaagaaguucgugagcuccauccggcuccgcacccacaucaaggaggugcacggcgccgcccaggaggcgcuggucuucacgagcuccaucaaccagagcuucugccugcucgagcccgggggcgacauccagcaggaggcccugggggaccagcugcagcucguggaggaggaguucgcccugcagggcgucaacgcccugaaggaggaggccugccccggcgacacccagcucgaggaggggcggaaggagccggaggcgcccggcgagaugcccgccccggccgugcaccuggccuccccccaggcggagagcaccgcccugccccccugcgagcucgagaccacgguggucuccagcagcgaccugcacucccaggagguggugagcgacgacuuccugcugaagaacgacaccuccagcgccgaggcccacgccgcgccggagaagccccccgacaugcagcaccgcuccagcguccagacccagggggaggugaucacccuccugcuguccaaggcccagagcgccggcuccgaccaggagagccacggggcccaguccccccucggcgagggccagaacauggccgugcugagcgcgggggacccggaccccucccggugccugcgcagcaaccccgccgaggccuccgaccuccugcccccggucgccggcgggggcgacacgaucacccaccagcccgacagcugcaaggccgcgcccgagcaccgguccgggaucaccgccuucaugaaggugcugaacagccuccagaagaagcagaugaacaccagccugugcgagcgcauccggaagguguacggcgaccuggagugcgaguacugcggcaagcucuucugguaccagguccacuucgacaugcacgugcgcacgcacacccgggagcaccuguacuacugcucccagugccacuacagcuccaucaccaagaacugccugaagcgccacgugauccagaagcacagcaacauccuccugaagugccccaccgacgggugcgacuacuccacgccggacaaguacaagcugcaggcccaccucaagguccacaccgcccuggacaagcggagcuacuccugccccgugugcgagaagagcuucuccgaggaccgccugaucaagagccacaucaagaccaaccaccccgagguguccaugagcaccaucuccgagguccucggccggcgcgugcagcugaaggggcugaucggcaagcgggcgaugaagugccccuacugcgacuucuacuucaugaagaacggcagcgaccuccagcgccacaucugggcccacgagggggugaagccguucaagugcucccugugcgaguacgccacccgcagcaaguccaaccugaaggcccacaugaaccggcacagcacggagaagacccaccucugcgacaugugcggcaagaaguucaaguccaaggggacccugaagagccacaagcugcuccacaccgccgacggcaagcaguucaagugcacggucugcgacuacaccgcggcccagaagccccagcugcugcgccacauggagcagcacgugagcuucaagcccuuccggugcgcccacugccacuacuccugcaacaucagcgggucccucaagcgccacuacaaccggaagcaccccaacgaggaguacgccaacgugggcaccggcgagcuggccgcggagguccugauccagcaggggggccucaagugcccggugugcagcuucguguacgggaccaagugggaguucaaccgccaccugaagaacaagcacggccugaaggucguggagaucgacggggaccccaagugggagacggccaccgaggcccccgaggagccguccacccaguaccuccacaucaccgaggccgaggaggacgugcagggcacgcaggccgcggucgccgcccugcaggaccugcgguacaccagcgaguccggcgaccgccucgaccccaccgccgugaacauccugcagcagaucaucgagcugggggcggagacccacgacgccacggcccucgccagcguggucgccauggcgcccggcaccgugaccguggucaagcaggugaccgaggaggagcccuccagcaaccacacggugaugauccaggagaccguccagcaggccuccguggagcuggccgagcagcaccaccugguggucagcuccgacgacguggaggggaucgagaccgugaccgucuacacgcagggcggggaggccagcgaguucaucguguacgugcaggaggccaugcagccggucgaggagcaggcgguggagcagcccgcccaggagcucuga

SEQ ID NO: 38914 - RNA, 5970 nt, Artificial Sequence
  derived and/or modified sequence opt1 from ZFC3H1__Homo_sapiens__NP_659419
auggccaccgccgacacccccgcgcccgccagcagcggccugagccccaaggaggagggggagcucgaggacggcgagaucuccgacgacgacaacaacagccagauccggucccggagcuccagcuccagcuccgggggcgggcugcugcccuacccccgccggcgcccgccccacagcgcccggggcggcggguccggcgggggcgggggcagcuccagcuccagcuccagcagccagcagcagcuccgcaacuucucccggagccgccacgccuccgagcggggccaccuccgcgggcccagcuccuaccggcccaaggagcccuuccgcagccacccgcccuccgugcggaugcccagcuccagccuguccgagagcagcccccgccccuccuucugggagcggucccaccucgcccuggaccgcuuccgguuccgcggccggcccuaccgcgggggcagccgguggucccgcggccgcggggugggcgagcgcggcgggaagcccgggugccgcccgccccucggcggcggggcgggcagcggguucuccagcagccaguccuggcgggagcccagcccgccccgcaaguccagcaaguccuucggccggagccccucccgcaagcagaacuacagcuccaagaacgagaacugcguggaggagaccuucgaggaccuccugcugaaguacaagcagauccagcucgagcuggagugcaucaacaaggacgagaagcuggcccucagcuccaaggaggagaacgugcaggaggaccccaagacccugaacuucgaggaccagaccagcaccgacaacgucuccaucacgaaggacagcuccaaggagguggcccccgaggagaagacccaggugaagaccuuccaggccuucgagcugaagccccuccggcagaagcugacccugcccggggacaagaaccgccucaagaaggucaaggacggcgcgaagccccugagccugaaguccgacacgaccgacagcagccagggccuccaggacaaggagcagaaccugacccggcgcaucuccaccagcgacauccuguccgagaagaagcucggggaggacgaggaggagcugagcgagcugcagcuccggcugcuggcccuccaguccgccagcaagaaguggcagcagaaggagcagcaggucaugaaggaguccaaggagaagcugacgaagaccaagaccgugcagcagaaggucaagaccagcacgaagacccacuccgccaagaaggugagcaccaccgccaagcaggcgcugcgcaagcagcagacgaaggccuggaagaagcuccagcagcagaaggagcaggagcggcagaaggaggaggaccagcgcaagcaggccgaggaggaggagcggcgcaagcgggaggaggagauccgcaagauccgggaccuguccaaccaggaggagcaguacaaccgcuucaugaagcuggugggcgggaagcgccggagccgcuccaagagcuccgaccccgaccuccggcgcagccuggacaagcagcccaccgacuccggcgggggcaucuaccaguacgacaacuacgaggaggucgccauggacaccgacagcgagaccuccagccccgcccccagccccgugcagccgcccuucuucuccgagugcagccugggcuacuucucccccgcgccgagccucucccugccgccgccgccccaggugagcucccugccgccccucagccagcccuacgucgaggggcugugcgugucccuggagccccugccgccccugccgccccugccgccccugccgcccgaggaccccgagcagccgcccaagccgcccuucgccgacgaggaggaggaggaggagaugcuccugcgggaggagcugcucaagagccuggccaacaagcgcgccuucaagcccgaggagacguccagcaacuccgacccgcccuccccgcccgugcugaacaacucccacccggucccccggagcaaccucuccaucgugagcaucaacaccgugucccagccccgcauccagaaccccaaguuccaccggggcccccgccugccccggaccgucaucagccugcccaagcacaagagcgugguggucacccucaacgacuccgacgacagcgaguccgacggggaggccagcaaguccacgaacagcguguucggcggccuggaguccaugaucaaggaggcgcgccggaccgccgagcaggccagcaagcccaaggucccgcccaaguccgagaaggagaacgacccccugcgcacccccgaggcccucccggaggagaagaagaucgaguaccggcugcugaaggaggagaucgccaaccgcgagaagcagcggcucaucaagagcgaccagcugaagaccuccagcuccagccccgcgaacuccgacguggagaucgacgggaucggccgcaucgccauggugacgaagcaggucaccgacgccgagagcaagcugaagaagcaccggauccuccugaugaaggacgaguccgugcugaagaaccucgugcagcaggaggccaagaagaaggagagcguccgcaacgcggaggccaagaucaccaagcugaccgagcagcugcaggccacggagaagauccucaacgugaaccggauguuccugaagaagcugcaggagcagauccaccgcgugcagcagcgcgucaccaucaagaaggcccucacccugaaguacggggaggagcuggcccgggcgaaggccguggccuccaaggagaucggcaagcgcaagcucgagcaggaccgguucgggcccaacaagaugaugcgccuggacagcagccccguguccagcccgcggaagcacuccgccgagcugaucgccauggagaagcgccggcuccagaagcuggaguacgaguacgcgcugaagauccagaagcucaaggaggcccgcgcccugaaggccaaggagcagcagaacaucagccccgucguggaggaggagcccgaguucucccugccccagccgagccuccacgaccugacccaggacaagcugacccucgacacggaggagaacgacguggacgacgagauccuguccggcagcucccgggagcgccggcgcagcuuccuggaguccaacuacuucaccaagcccaaccucaagcacaccgacaccgccaacaaggagugcaucaacaagcugaacaagaacacggucgagaagcccgagcuguuccucggccugaagaucggggagcugcagaagcucuacagcaaggcggacucccugaagcagcugauccucaagaccaccaccggcaucacggagaaggugcugcacgggcaggagaucagcguggacgucgacuucgugaccgcccaguccaagaccauggaggugaagcccugcccguuccggcccuaccacagcccccugcucgucuucaaguccuaccgcuucagcccguacuaccggaccaaggagaagcugccccuguccagcgugagcuacuccaacaugaucgagcccgaccagugcuucugccgcuucgaccucacggggaccugcaacgacgacgacugccaguggcagcacauccaggacuacacccugagccggaagcagcuguuccaggacauccucuccuacaaccugagccugaucgggugcgccgagaccuccacgaacgaggagaucaccgccagcgcggagaaguacguggagaagcuguucggcgucaacaaggaccgcauguccauggaccagauggccgugcugcuggugagcaacaucaacgaguccaagggccacacgccgcccuucaccacguacaaggacaagcggaaguggaagcccaaguucuggcgcaagcccaucagcgacaacuccuucagcuccgacgaggagcagagcaccgggcccaucaaguacgccuuccagcccgagaaccagaucaacguccccgcccucgacaccguggugacccccgacgacguccgcuacuucacgaacgagaccgacgacaucgccaaccuggaggcguccgugcuggagaaccccagccacgugcagcucuggcugaagcuggccuacaaguaccucaaccagaacgagggcgagugcuccgagagccuggacuccgcccugaacguccucgcccgggcccuggagaacaacaaggacaacccggagaucuggugccacuaccugcgccucuucagcaagcgggggaccaaggacgaggugcaggagaugugcgagaccgcgguggaguacgcccccgacuaccagagcuucuggacguuccugcaccuggaguccaccuucgaggagaaggacuacgucugcgagcgcaugcucgaguuccugaugggcgccgccaagcaggagaccagcaacauccuguccuuccagcuccuggaggcccuccuguuccgggugcagcugcacaucuucaccgggcgcugccagagcgcgcuggccauccuccagaacgcccugaaguccgccaacgacggcaucguggcggaguaccugaagacgagcgaccggugccuggccuggcucgccuacauccaccugaucgaguucaacauccugcccuccaaguucuacgaccccagcaacgacaacccgucccgcaucgucaacaccgagagcuucgugaugcccuggcaggccgugcaggacgucaagaccaaccccgacaugcuccuggccguguucgaggacgcggugaaggccugcaccgacgagucccuggccgucgaggagcggaucgaggccugccucccccuguacacgaacaugaucgcccugcaccagcuccuggagcgcuacgaggcggccauggagcugugcaagagccuccuggaguccugcccgaucaacugccagcugcucgaggcccugguggcccuguaccuccagaccaaccagcacgacaaggcccgggcgguguggcugaccgccuucgagaagaacccccagaacgccgaggucuucuaccacaugugcaaguucuucauccugcagaaccgcggcgacaaccuccugcccuuccugcggaaguucaucgccagcuucuucaagcccggguucgagaaguacaacaaccucgaccuguuccgcuaccugcucaacaucccgggccccaucgacauccccucccggcugugcaaggggaacuucgacgacgacauguucaaccaccaggugcccuaccuguggcucaucuacugccugugccacccgcugcagagcuccaucaaggagaccguggaggccuacgaggcggcccucggcgucgccaugcgcugcgacaucgugcagaagaucuggauggacuaccuggucuucgccaacaaccgggcggccgggagccgcaacaaggugcaggaguucaaguucuucaccgaccuggugaaccggugccucgucacggugcccgcccgcuaccccaucccguucagcuccgccgacuacuggagcaacuacgaguuccacaaccgggugaucuucuucuaccuguccugcguccccaagacccagcacagcaagacccuggagcgcuucugcuccgugaugcccgccaacagcggccucgcgcugcgccugcuccagcacgagugggaggaguccaacgugcagauccugaagcugcaggccaagauguucaccuacaacauccccacgugccucgccaccuggaagaucgccaucgccgcggagaucguccugaagggccagcgggaggugcaccgccuguaccagcgggcccuccagaagcugccgcugugcgccagccucuggaaggaccagcugcuguucgaggccuccgagggcggcaagaccgacaaccuccgcaagcuggugagcaagugccaggagaucggggucucccugaacgagcuccugaaccugaacagcaacaagaccgaguccaagaaccacuga

SEQ ID NO: 38915 - RNA, 4569 nt, Artificial Sequence
  derived and/or modified sequence opt1 from ZFHX2__Homo_sapiens__XP_006720345
augaccuucaccacgaaggugcugagcgcccccacccucuccccgcuggacaacggccaggagccccccacccacgggcccgagccgacccccagccgcgaccaggccgcggagggccccaaccugacgcccgaggccuccccggacccccuccccgagcccccgcuggccagcgucgaggugcccgacaagcccuccgggagccccggccagccgcccucccccgcccccagcccggugcccgagcccgacgcccaggcggaggacgucgcccccccgcccaccauggccgaggaggaggaggggaccaccggcgagcugcgguccgccgagcccgcgcccgccgacagccgccacccgcucacguaccggaagaccaccaacuucgcccuggacaaguuccuggaccccgcccgccccuacaagugcaccgugugcaaggaguccuucacgcagaagaacauccuccuggugcacuacaacagcgucucccaccugcacaagaugaagaaggccgcgaucgacccgagcgcccccgcccggggcgaggccggggccccccccaccaccaccgcggccacggacaagccguucaagugcaccgugugccgcguguccuacaaccagagcuccacccucgagauccacaugcggagcguccugcaccagacccgcucccggggcacgaagaccgacagcaagaucgaggggcccgagcgcagccaggaggagcccaaggagggcgagaccgagggggaggugggcaccgagaagaagggccccgacacguccggguucaucagcggccugccguuccucucccccccccccccgccccuggaccugcaccgguuccccgccccccucuucaccccgcccgugcugccccccuucccgcugguccccgagagccuccugaagcugcagcagcagcagcuccugcugcccuucuaccuccacgaccugaagguggggcccaagcugacccucgccggcccggcccccgugcugucccugcccgcggccaccccgcccccccccccgcagccccccaaggccgagcucgccgagcgcgagugggagcggcccccgauggccaaggagggcaacgaggcggggcccagcuccccccccgacccgcugcccaacgaggccgcccgcacggccgcgaaggcccugcucgagaacuucggcuucgagcuggucauccaguacaacgaggggaagcaggccgugccccccccgcccaccccccccccgcccgaggcccugggcgggggcgacaagcucgccugcggcgcgugcgggaagcuguucagcaacaugcugauccucaagacccacgaggagcacgugcaccggcgcuuccugcccuucgaggcccugucccgguacgccgcccaguuccgcaagagcuacgacucccucuaccccccgcuggccgagccccccaagcccccggacggcagccuggacucccccgucccccaccucgggccgcccuuccuggugcccgagcccgaggcgggcgggacccgggccccggaggagcgcagccgggccggcggccacuggcccaucgaggaggaggaguccagccgcgggaaccugcccccccuggugccggccggccgccgguucucccgcacgaaguucaccgaguuccagacccaggcccuccagagcuucuucgagaccuccgcguaccccaaggacggggaggucgagcggcuggccagccugcucggccuggccagccgcgugguggucgugugguuccagaacgcccggcagaaggcgcgcaagaacgccugcgaggggggcuccaugcccacgggcgggggcaccgggggcgccagcggcugccggcgcugccacgccaccuucuccugcgucuucgagcuggugcggcaccucaagaagugcuacgacgaccagacccuggaggaggaggaggaggaggccgagcgcggggaggaggaggaggagguggaggaggaggaggucgaggaggagcagggccuggagcccccggcggggcccgagggcccccuccccgagccgcccgacggggaggagcugagccaggccgaggccaccaaggccggcggcaaggagcccgaggagaaggccacgcccuccccgagccccgcgcacaccugcgaccagugcgccaucuccuucagcucccaggaccugcucaccagccaccggcgccugcacuuccugcccucccuccagcccagcgccccgccccagcugcuggaccucccccugcugguguucggggagcggaacccccucguggccgccaccuccccgaugcccggccccccgcugaagcgcaagcacgaggacgggagccugucccccacgggcagcgaggcggggggcggcggggagggcgagcccccccgggacaagcgccuccggaccaccauccugccggagcagcuggagauccucuaccgcugguacaugcaggacuccaaccccacccggaagaugcuggacugcaucagcgaggaggucgggcugaagaagcgcguggugcaggucugguuccagaacacgcgcgcccgggagcgcaagggccaguuccggagcacccccgggggcgugcccuccccggccgugaagccccccgccaccgcgacccccgccagccucccgaaguucaaccugcugcucggcaaggucgacgacgggacgggccgcgaggcccccaagcgggaggcccccgccuuccccuacccgaccgcgacccuggccuccgggccccagcccuuccugcccccgggcaaggaggccaccacgcccacccccgagcccccgcucccccugcugcccccgcccccccccagcgaggaggaggggccggaggagccccccaaggccucccccgagagcgaggccugcucccucagcgcgggcgaccuguccgacagcuccgccagcucccuggccgagccggagagccccggcgccgggggcaccuccgggggccccggcgggggcaccggggugcccgacggcauggggcagcgccgguaccgcacgcagaugagcucccuccagcugaagaucaugaaggccugcuacgaggcguaccggaccccgaccaugcaggagugcgaggugcugggcgaggagaucggccuccccaagcgcgucauccaggugugguuccagaacgcccgggccaaggagaagaaggccaagcugcaggggaccgccgcgggcagcacggggggcuccagcgaggggcugcucgccgcccagcgcaccgacugccccuacugcgacgugaaguacgacuucuacgucagcugccggggccaccuguucucccgccagcaccuggccaagcucaaggaggcggugcgggcccagcugaagagcgaguccaagugcuacgaccuggcccccgccccggaggccccccccgcgcucaaggcccccccggccaccacccccgccagcaugccccugggcgccgcgcccacgcugccgcgccucgcccccgugcugcuguccgggcccgcccucgcccagcccccgcugggcaaccuggcccccuucaacagcgggcccgcggccuccagcggccuccuggggcuggccaccuccguccucccgaccaccacgguggugcagaccgccggccccggccggccccugccccagcgcccgaugcccgaccagaccaacaccagcacggcggggaccaccgaccccguccccggcccgcccaccgagccccugggggacaagguguccagcgagcggaagcccguggccggcccgaccuccagcuccaacgacgcccucaagaaccugaaggcccugaagacgaccguccccgcccuccugggcgggcaguuccugcccuucccccucccgcccgcgggcgggaccgccccccccgccguguucggcccgcagcugcagggggccuacuuccagcagcuguacggcaugaagaagggccucuuccccaugaaccccaugaucccccagacccugaucgggcugcucccgaacgcccugcugcagccccccccccagccgcccgagcccacggcgaccgccccgcccaagccccccgagcucccggcccccggcgagggggaggccggcgagguggacgagcugcugaccgggagcaccggcaucuccacggucgacgugacccaccgcuaccucugccggcagugcaagauggccuucgacggcgaggcgcccgccaccgcccaccagcgcagcuucugcuucuucgggcgcggcuccgggggcagcaugcccccgccccugcgggugcccaucugcaccuaccacugccuggccugcgagguccuccugagcgggcgcgaggcgcuggccucccaccuccggagcuccgcccaccgccggaaggccgcccccccgcagggcggcccccccaucagcaucacgaacgcggccaccgccgccuccgccgcgguggccuucgccaaggaggaggcccgccugccccacaccgacagcaacccgaagaccacgaccaccuccacccugcuggcccucuga

SEQ ID NO: 38916 - RNA, 8370 nt, Artificial Sequence
  derived and/or modified sequence opt1 from ZFHX3__Homo_sapiens__NP_001158238
augcgccugggcgggggccagcucgugagcgaggagcugaugaaccugggggaguccuucauccagaccaacgaccccagccucaagcuguuccagugcgccgugugcaacaaguucaccaccgacaaccuggacaugcucggccugcacaugaacguggagcgcucccugagcgaggacgaguggaaggccgugaugggggacuccuaccagugcaagcucugccgcuacaacacccagcugaaggccaacuuccagcugcacugcaagaccgacaagcacgugcagaaguaccagcucguggcccacaucaaggagggcggcaaggccaacgaguggcggcugaagugcguggccaucgggaaccccguccaccugaagugcaacgccugcgacuacuacaccaacagccucgagaagcugcgccugcacaccgugaacucccggcacgaggccagccucaagcuguacaagcaccuccagcagcacgaguccggcguggagggggagagcugcuacuaccacugcguccucugcaacuacuccaccaaggccaagcugaaccugauccagcacgugcgcagcaugaagcaccagcgguccgagagccuccgcaagcugcagcggcugcagaagggccuccccgaggaggacgaggaccuggggcagaucuucaccauccgccggugccccuccaccgaccccgaggaggccaucgaggacguggagggccccagcgagacggccgcggaccccgaggagcuggccaaggaccaggagggcggggccuccagcucccaggccgagaaggagcucaccgacagccccgccaccagcaagcgcaucuccuuccccggcagcuccgagagcccccuguccagcaagcggcccaagaccgcggaggagaucaagcccgagcagauguaccagugccccuacugcaaguacuccaacgccgacgucaaccgccugcgggugcacgccaugacgcagcacagcgugcagcccaugcuccgcugcccccugugccaggacaugcugaacaacaagauccaccuccagcugcaccugacccaccuccacuccgucgcccccgacugcguggagaagcugaucaugaccgugaccacgcccgagauggucaugcccagcuccauguuccugcccgccgcggugcccgaccgggacgggaacagcaaccucgaggaggccggcaagcagcccgagaccuccgaggaccugggcaagaacauccugcccagcgccuccaccgagcagagcggggaccucaagcccucccccgccgaccccggcagcgugcgcgaggacuccggguucaucugcuggaagaagggcugcaaccaggucuucaagaccagcgccgcgcugcagacgcacuucaacgaggugcacgccaagcggccgcagcugcccgugagcgaccgccacgucuacaaguaccggugcaaccagugcucccucgccuucaagaccaucgagaagcugcagcugcacagccaguaccacgugauccgcgccgccaccaugugcugccugugccagcgcuccuuccggaccuuccaggcgcucaagaagcaccuggagacgagccaccuggagcucuccgaggccgacauccagcagcuguacgggggccugcucgccaacggcgaccugcuggccaugggggaccccacccucgcggaggaccacaccaucaucgucgaggaggacaaggaggaggagagcgaccuggaggacaagcagucccccaccggcagcgacuccgggagcgugcaggaggacuccggcagcgagcccaagcgcgcccugcccuuccggaaggggcccaacuucacgauggagaaguuccucgaccccucccgccccuacaagugcaccgugugcaaggagagcuucacccagaagaacauccugcugguccacuacaacuccgugagccaccuccacaagcugaagcgggcccugcaggaguccgccaccggccagcccgagcccacgagcagccccgacaacaagcccuucaagugcaacacgugcaacguggccuacucccagagcuccacccucgagauccacaugcgcagcguccugcaccagaccaaggcgcgggccgccaagcuggaggccgccuccggcagcuccaacgggacgggcaacagcuccagcaucucccucagcuccagcacccccucccccgugagcaccuccgggagcaacaccuucaccacguccaaccccagcagcgcgggcaucgcccccuccagcaaccugcugucccaggugcccaccgagagcgucgggaugccgccccucggcaaccccaucggcgccaacaucgccucccccagcgagcccaaggaggccaaccgcaagaagcuggcggacaugaucgccucccggcagcagcagcagcagcagcagcagcagcagcagcagcagcagcagcagcagcagcaggcccagacccuggcccaggcgcaggcccaggugcaggcccaccuccagcaggagcugcagcagcaggccgcccugauccagagccagcuguucaaccccacccugcugccccacuuccccaugacgaccgagacccuccugcagcugcagcagcagcagcaccuccuguuccccuucuacauccccuccgcggaguuccagcugaaccccgaggugagccuccccgucaccuccggggcccugacgcugaccggcaccgggcccggccuccuggaggaccugaaggcccagguccaggugccgcagcagagccaccagcagauccucccccagcagcagcagaaccagcuguccaucgcccagagccacuccgcccugcuccagcccagccagcacccggagaagaagaacaagcuggucaucaaggagaaggagaaggagucccagcgcgagcgggacagcgcggagggcggggagggcaacaccgggcccaaggagacgcugcccgacgcccucaaggccaaggagaagaaggagcuggcccccggcgggggcuccgagccgagcaugcugccgccccgcaucgccagcgacgcgcggggcaacgccaccaaggcccuccuggagaacuucggguucgagcuggugauccaguacaacgagaacaagcagaaggugcagaagaagaacggcaagaccgaccagggggagaaccucgagaagcuggagugcgacuccugcggcaagcuguucagcaacauccucauccugaagucccaccaggagcacguccaccagaacuacuuccccuucaagcagcuggagcgcuucgccaagcaguaccgggaccacuacgacaagcucuacccgcugcgcccccagacccccgagcccccgccgccgcccccgcccccgcccccgccgccccuccccgcggccccgccccagcccgccagcacgcccgccaucccggccuccgcgccgcccaucaccagcccgaccaucgcccccgcccagcccuccgugccccucacccagcugagcaugccgauggagcugcccaucuucagcccccucaugaugcagacgaugccccugcagacccugccggcccagcugccgccccagcuggggcccguggagccgcugcccgccgaccucgcgcagcuguaccagcaccagcugaaccccacccuccugcagcagcagaacaagcggccccgcacccggaucacggacgaccagcugcgcguccuccgccaguacuucgacaucaacaacagcccguccgaggagcagaucaaggagauggccgacaagagcggccugccccagaaggugaucaagcacugguuccggaacacccuguucaaggagcgccagcggaacaaggacucccccuacaacuucagcaacccgcccaucaccucccucgaggagcugaagaucgacagccggccgcccucccccgagccgcccaagcaggaguacuggggcagcaagcgguccagccgcacccgguucacggacuaccagcugcgcgugcuccaggacuucuucgacgccaacgccuaccccaaggacgacgaguucgagcagcugagcaaccugcucaaccugcccacccgggucaucguggugugguuccagaacgcccgccagaaggcgcggaagaacuacgagaaccagggggagggcaaggacggggagcgccgggagcugaccaacgaccgcuacauccggaccuccaaccucaacuaccagugcaagaagugcagccuggucuuccagcgcaucuucgaccugaucaagcaccagaagaagcugugcuacaaggacgaggacgaggagggccaggacgacucccagaacgaggacagcauggacgccauggagauccucacgcccaccuccagcuccugcagcacccccaugcccucccaggccuacagcgccccggcccccuccgcgaacaacaccgccagcuccgccuuccugcagcugacggccgaggcggaggagcucgccaccuucaacagcaagaccgaggccggggacgagaagcccaagcuggccgaggcccccuccgcgcagccgaaccagacccaggagaagcagggccagcccaagcccgagcugcagcagcaggagcagcccgagcagaagaccaacacgccgcagcagaagcucccccagcuggugagccugcccucccucccccagccgccgccccaggcgcccccgccccagugcccccugccccagagcucccccagccccagccagcugucccaccucccccugaagccccugcacaccagcaccccgcagcagcucgccaaccugccgccccagcugaucccguaccagugcgaccagugcaagcucgccuuccccuccuucgagcacuggcaggagcaccagcagcugcacuuccugagcgcccagaaccaguucauccacccccaguuccucgaccggucccuggacaugcccuucaugcuguucgacccgagcaacccccuccuggcgucccagcugcucagcggcgccaucccccagauccccgccuccagcgccaccuccccgagcacgcccaccuccaccaugaacacccugaagcgcaagcuggaggagaaggccagcgcgucccccggggagaacgacagcggcaccgggggcgaggagccccagcgggacaagcgccuccggaccaccaucaccccggagcagcuggagauccuguaccagaaguaccuccuggacuccaaccccacgcgcaagaugcuggaccacaucgcccacgagguggggcucaagaagcgcgucguccaggugugguuccagaacacccgggcccgcgagcggaagggccaguuccgcgccgucggccccgcgcaggcccaccggcgcugccccuucugccgggcccuguucaaggccaagaccgcccuggaggcgcacauccgcagccggcacuggcacgaggccaagcgcgccggguacaaccucacccuguccgccaugcugcucgacugcgacggcgggcugcagaugaagggcgacaucuucgacggcacgagcuucagccaccucccgcccuccagcuccgacgggcagggcgugccccugagccccguguccaagaccauggagcugagcccccggacccugcucucccccagcuccaucaaggucgaggggaucgaggacuucgagagccccuccaugagcuccgugaaccugaacuucgaccagaccaagcuggacaacgacgacugcagcuccgugaacacggccaucaccgacaccaccacgggcgacgaggggaacgcggacaacgacagcgccaccggcaucgccaccgagaccaaguccagcagcgcccccaacgagggccucacgaaggccgcgaugauggccauguccgaguacgaggaccgccugagcuccgggcuggucagccccgcccccuccuucuacagcaaggaguacgacaacgagggcaccguggacuacuccgagaccagcucccucgccgaccccugcagccccuccccgggggcgagcggcuccgccgggaaguccggcgacuccggcgaccggcccgggcagaagcgcuuccggacccagaugacgaaccugcagcugaaggugcucaagagcugcuucaacgacuaccgcacccccaccaugcuggagugcgagguccugggcaacgacaucgggcucccgaagcggguggugcaggucugguuccagaacgcccgcgccaaggagaagaaguccaagcugagcauggccaagcacuucggcaucaaccagaccuccuacgaggggcccaagacggagugcacccugugcggcaucaaguacagcgcgcggcucagcgugcgcgaccacaucuucucccagcagcacaucagcaaggugaaggacaccaucggcucccagcuggacaaggagaaggaguacuucgaccccgccaccguccgccagcugauggcccagcaggagcucgaccggaucaagaaggccaacgaggugcuggggcuggccgcgcagcagcagggcauguucgacaacacgccccuccaggcccugaaccugccgacggccuaccccgcccuccaggggaucccgcccgugcugcugccgggccucaacagccccucccugcccggcuucacccccagcaacaccgcccugaccuccccgaagcccaaccucauggggcugcccagcacgaccguccccuccccgggccugcccaccagcgggcuccccaacaagcccuccagcgcgucccugagcuccccgacccccgcccaggccacgauggccaugggcccccagcagcccccgcagcagcagcagcagcagcagcagccccaggugcagcagccgccgcccccgcccgccgcgcagcccccgcccacgccccagcugccgcuccagcagcagcagcagcgcaaggacaaggacagcgagaaggucaaggagaaggagaaggcccacaaggggaagggcgagccccugcccgugcccaagaaggagaagggcgaggccccgaccgccaccgcggccacgaucuccgcgccccugcccaccauggaguacgccguggaccccgcccagcuccaggcgcugcaggccgcccugaccagcgacccgaccgcccuccugacgucccaguuccugcccuacuucguccccggguucagccccuacuacgccccgcagauccccggcgcgcuccagagcggguaccugcagcccauguacggcauggaggggcuguuccccuacuccccggcccucagccaggcccugaugggccugucccccggcagccuccugcagcaguaccagcaguaccagcagucccugcaggaggccauccagcagcagcagcagcggcagcugcagcagcagcagcagcagaaggugcagcagcagcagcccaaggccagccagacccccgugccgcccggggcgcccucccccgacaaggacccggccaaggagagccccaagcccgaggagcagaagaacaccccgcgcgaggucagcccccuccugcccaagcugcccgaggagccggaggccgagagcaaguccgccgacagccucuacgaccccuucaucgugcccaaggugcaguacaagcuggucugccggaagugccaggcgggcuucuccgacgaggaggccgcccgcagccaccugaagucccucugcuucuucgggcagagcguggugaaccugcaggagaugguccugcacgugcccaccggcgggggcggcgggggcuccgggggcgggggcggcgggggcgggggcggcgggggcgggggcagcuaccacugccucgccugcgaguccgcccugugcggggaggaggcgcugagccagcaccucgagagcgcccugcacaagcaccggacgaucacccgcgccgcccggaacgccaaggagcacccgucccugcucccccacagcgcgugcuuccccgaccccuccaccgccagcaccucccagagcgccgcccacuccaacgacagcccgccgccgcccuccgccgcggccccgagcuccgccagcccccacgccucccgcaagagcuggccccagguggucucccgggcgagcgccgccaagcccccguccuucccgccccugagcuccagcagcacggugaccuccagcuccugcagcaccuccggcgugcagcccagcaugccgaccgacgacuacuccgaggagagcgacacggaccugucccagaaguccgacggccccgccucccccgucgaggggccgaaggaccccagcugccccaaggacuccggccucaccagcguggggaccgacaccuuccgccuguga

SEQ ID NO: 38917 - RNA, 10851 nt, Artificial Sequence
  derived and/or modified sequence opt1 from ZFHX4__Homo_sapiens__XP_011515897
auggagaccugcgacuccccgcccaucucccgccaggagaacggccagagcaccuccaagcugugcgggacgacccagcucgacaacgaggugcccgagaagguggccggcauggagcccgaccgggagaacuccuccaccgacgacaaccugaagaccgacgagcgcaagagcgaggcccugcucggguucuccguggagaacgcggccgccacccaggugaccagcgccaaggagauccccugcaacgagugcgccaccuccuuccccagccugcagaaguacauggagcaccacugccccaacgcccggcugcccguccucaaggacgacaacgaguccgagaucagcgagcuggaggacuccgacguggagaaccugaccggcgagaucguguaccagcccgacgggagcgccuacaucaucgaggacuccaaggagagcggccagaacgcccagaccggcgccaacuccaagcuguucagcaccgccauguuccuggacucccuggccagcgccggggagaaguccgaccaguccgccagcgcccccauguccuucuacccccagaucaucaacaccuuccacaucgccagcucccucggcaagcccuucaccgccgaccaggccuuccccaacacgagcgcccuggccggggucggccccgugcugcacuccuuccggguguacgaccuccggcacaagcgcgagaaggacuaccugaccagcgacggguccgcgaagaacagcugcgucuccaaggacgugcccaacaacguggaccugagcaaguucgacggcugcgucuccgacggcaagcggaagcccgugcucaugugcuuccugugcaagcugagcuucggguacauccgcuccuucgugacccacgccguccacgaccaccggaugacccucaacgacgaggagcagaagcugcugagcaacaagugcguguccgccaucauccagggcaucgggaaggacaaggagccccucaucagcuuccuggagcccaagaaguccaccagcguguacccccacuucagcaccaccaaccugaucggccccgaccccaccuuccgcggccucugguccgccuuccacgucgagaacggggacagccugcccgccggcuucgcguuccugaagggguccgccagcaccuccagcuccgccgagcagccccucggcaucacccagaugcccaaggccgaggugaaccucggcgggcugagcucccucguggucaacacccccaucaccagcgugucccugagccacuccagcuccgagagcuccaagaugagcgagagcaaggaccaggagaacaacugcgagcggcccaaggaguccaacgugcugcaccccaacggcgagugccccgucaagagcgagcccaccgagcccggggacgaggacgaggaggacgccuacuccaacgagcucgacgacgaggaggugcugggcgagcugaccgacagcaucgggaacaaggacuucccccuccugaaccaguccaucagcccccuguccagcuccguccucaaguucaucgagaagggcaccagcuccagcuccgcgaccgugagcgacgacacggagaagaagaagcagaccgccgccgugcgcgccuccgggagcgucgcguccaacuacggcaucagcggcaaggacuucgccgacgccuccgccagcaaggacagcgccaccgcggcccaccccuccgagaucgcccgcggggacgaggacagcuccgccacgccccaccagcacggcuucacgcccagcacccccgggacccccggccccgggggcgacggcucccccgggagcggcaucgagugccccaagugcgacaccgugcugggguccagccgcucccugggcggccacaugacgaugaugcacagccggaacuccugcaagacccucaagugccccaagugcaacuggcacuacaaguaccagcagacccuggaggcccacaugaaggagaagcaccccgagcccgggggcagcugcguguacugcaagaccgggcagccccacccccgccuggcgcggggcgaguccuacacgugcggguacaagcccuuccgcugcgaggucugcaacuacagcacgaccaccaagggcaaccucuccauccacaugcagagcgacaagcaccugaacaacgugcagaaccugcagaacggcaacggggagcaggucuucggccacuccgcccccgcccccaacaccagccuguccgggugcggcacgcccagccccagcaagcccaagcagaagcccaccuggcggugcgaggucugcgacuacgagaccaacguggcccgcaaccuccggauccacaugaccuccgagaagcacaugcacaacaugaugcugcugcagcagaacaugaagcagauccagcacaaccuccaccuggggcuggcccccgcggaggccgagcucuaccaguacuaccuggcccagaacaucggccugacgggcaugaagcucgagaaccccgccgacccccagcugaugaucaaccccuuccagcuggaccccgcgaccgccgccgcccucgcccccgggcuggugaacaacgagcugccgcccgagauccgccucgcgagcggccagcugaugggggacgaccugucccuccugaccgccggcgagcugagccccuacaucuccgaccccgcccucaagcuguuccagugcgccgucugcaacaaguucaccagcgacucccuggaggcccucagcgugcacguguccagcgagcgcucccugcccgaggaggaguggcgggcggucaucggggacaucuaccagugcaagcugugcaacuacaacacgcagcucaaggccaacuuccagcugcacugcaagaccgacaagcacaugcagaaguaccagcugguggcccacaucaaggagggcggcaagagcaacgaguggcgccucaagugcaucgccaucgggaaccccgugcaccugaagugcaacgccugcgacuacuacaccaacuccgucgacaagcugcggcuccacaccacgaaccaccgccacgaggcggcccugaagcuguacaagcaccuccagaagcaggagggcgccgugaaccccgagagcugcuacuacuacugcgccgugugcgacuacaccaccaaggucaagcugaaccuggugcagcacgugcgguccgucaagcaccagcagaccgaggggcuccgcaagcugcagcugcaccagcagggccucgcgcccgaggaggacaaccugagcgagaucuucuucgugaaggacugcccgcccaacgagcuggagacggccucccucggggcccggaccugcgacgacgaccugaccgagcagcagcugcgcagcaccuccgaggagcagagcgaggaggccgagggcgccaucaagcccacggcgguggccgaggacgacgagaaggacaccagcgagcgggacaacuccgagggcaagaacagcaacaaggacuccgggaucaucacccccgagaaggagcucaaggucagcguggccggcgggacccagccccugcugcucgccaaggaggaggacguggccacgaagcgcuccaagcccaccgaggacaacaaguucugccacgagcaguucuaccagugccccuacugcaacuacaacagccgggaccagucccgcauccagaugcacguccugagccagcacuccgugcagcccgugaucugcugcccccugugccaggacguccucagcaacaagaugcaccuccagcugcaccucacccaccuccacuccgugagcccggacugcguggagaagcugcucaugaccguccccgugcccgacgugaugaugcccaacuccaugcugcugccggcggccgccagcgagaaguccgagcgggacacgcccgccgccgucaccgcggagggcagcggcaaguacuccggggagagccccauggacgacaaguccauggccggccucgaggacagcaaggccaacguggaggugaagaacgaggagcagaagcccaccaaggagccgcuggaggucagcgaguggaacaagaacuccagcaaggacgugaagauccccgacacccugcaggaccagcucaacgagcagcagaagcgccagccccuguccgugagcgaccggcacgucuacaaguaccgcugcaaccacugcucccuggccuucaagacgaugcagaagcuccagauccacagccaguaccacgccauccgggcggccaccaugugcaaccugugccagcgcuccuuccggaccuuccaggcccugaagaagcaccucgaggccgggcaccccgagcugagcgaggcggagcugcagcagcucuacgccucccugccggugaacggcgagcugugggccgagagcgagaccaugucccaggacgaccacgggcucgagcaggagauggagcgcgaguacgagguggaccacgagggcaaggccagccccgucggcuccgacagcuccagcauccccgacgacaugggguccgagccgaagcgcacccugcccuuccggaagggccccaacuucacgauggagaaguuccuggaccccagccgcccguacaagugcaccgugugcaaggaguccuucacccagaagaacauccuccuggugcacuacaacagcgucagccaccuccacaagcucaagaaggugcugcaggaggccuccagccccgucccccaggagaccaacuccaacacggacaacaagcccuacaagugcagcaucugcaacguggcguacucccagagcuccacccuggagauccacaugcggagcgugcuccaccagaccaaggcccgcgccgccaagcuggagccguccgggcacgucgccggcgggcacagcaucgcggccaacgugaacucccccggccagggcaugcuggacagcaugucccucgccgccgugaacagcaaggacacccaccuggacgccaaggagcugaacaagaagcagacgcccgaccucaucuccgcgcagcccgcccaccacccgccccagagccccgcccagauccagaugcagcugcagcacgagcugcagcagcaggccgcguucuuccagccccaguuccugaacccggccuuccucccccacuuccccaugacccccgaggcccugcugcaguuccagcagccgcaguuccucuuccccuucuacauccccgggaccgaguucucccugggccccgaccuggggcucccgggcagcgccaccuucgggaugcccggcaugacgggcauggccgggagccugcuggaggaccucaagcagcagauccagacccagcaccacgucggccagacccagcugcagauccugcagcagcaggcgcagcaguaccaggccacccagccccagcuccagccccagaagcagcagcagcagccgccgccgccccagcagcagcagcagcagcaggccuccaagcugcugaagcaggagcagagcaacaucguguccgccgacugccagaucaugaaggacgugcccagcuacaaggaggccgaggacaucuccgagaagcccgagaagcccaagcaggaguucaucagcgagggggagggccucaaggagggcaaggacacgaagaagcagaagucccuggagcccagcaucccgccgccccggaucgcguccggggcccgcggcaacgccgccaaggcccugcucgagaacuucggguucgagcuggucauccaguacaacgagaaccggcagaaggugcagaagaagggcaagagcggggagggcgagaacaccgacaagcuggagugcgggaccugcgggaagcuguucuccaacgugcugauccucaagagccaccaggagcacguccacggccaguucuucccguacgcggcccuggagaaguucgcccgccaguaccgggaggccuacgacaagcuguaccccaucucccccagcucccccgagaccccgccgccgcccccgcccccgccgccccugccgcccgcgccgccccagcccagcuccauggggcccgugaagauccccaacacggugagcacgccccugcaggcgccgccgcccacgcccccgcccccgcccccgccgcccccgcccccgcccccgcccccgcccccgcccccgcccuccgcgccgccccagguccagcugcccgugagccuggaccucccccuguuccccagcaucaugaugcagcccgugcagcacccggcccugccgccccagcucgcccugcagcugccccagauggacgcgcucuccgccgaccugacccagcugugccagcagcagcucggccuggacccgaacuuccugcgccacagccaguucaagcggccccgcacgcggaucaccgacgaccagcucaagauccugcgcgccuacuucgacaucaacaacucccccagcgaggagcagauccaggagauggccgagaaguccgggcugagccagaaggucaucaagcacugguuccggaacacccucuucaaggagcgccagcggaacaaggacucccccuacaacuucagcaacccgcccaucaccgugcuggaggacauccgcaucgacccccagcccacgucccuggagcacuacaagagcgacgccuccuucagcaagcgguccagccgcacccgguucaccgacuaccagcuccgcgugcugcaggacuucuucgacaccaacgcguacccgaaggacgacgagaucgagcagcuguccacgguccucaaccugcccacccgcgugaucguggucugguuccagaacgcccggcagaaggcccgcaagagcuacgagaaccaggccgagaccaaggacaacgagaagcgggagcugaccaacgagcgcuacauccggacguccaacaugcaguaccagugcaagaagugcaacgugguguucccccgcaucuucgaccucaucacccaccagaagaagcagugcuacaaggacgaggacgacgacgcccaggacgagagccagaccgaggacuccauggacgcgaccgaccaggucguguacaagcacugcaccgugagcggccagacggacgccgccaagaacgccgccgcgcccgccgccagcuccggcagcgggaccuccaccccgcugauccccagccccaagcccgagccggagaagaccucccccaagcccgaguaccccgccgagaagccgaagcagagcgaccccagcccgcccagccagggcacgaagccggcgcugccccucgccuccaccagcuccgacccgccccaggccagcaccgcccagccccagccccagccccagccgcccaagcagccccagcugaucgggcggccgcccuccgccagccagacccccguccccuccagcccccugcagaucuccaugacgagccuccagaacucccugccgccccagcugcuccaguaccagugcgaccagugcaccguggcguuccccacccuggagcuguggcaggagcaccagcacaugcacuuccucgccgcccagaaccaguuccugcacagccccuuccuggagcgccccauggacaugcccuacaugaucuucgaccccaacaacccccucaugaccggccagcugcuggggagcucccucacgcagaugccgccccaggccagcuccagccacaccaccgcccccaccacgguggcggccucccugaagcggaagcuggacgacaaggaggacaacaacugcagcgagaaggagggcggcaacuccggggaggaccagcaccgcgacaagcggcuccgcaccaccaucacccccgagcagcuggagauccuguacgagaaguaccuccuggacagcaacccgacgcggaagaugcuggaccacaucgcccgcgaggucggccucaagaagcggguggugcaggucugguuccagaacacccgcgcccgggagcgcaaggggcaguuccgggccgugggccccgcgcagucccacaagcgcugccccuucugccgcgcccuguucaaggccaagagcgcccuggagucccacauccggagccgccacuggaacgaggggaagcaggcgggcuacucccucccgcccagcccccugaucuccaccgaggacggcggggagagcccccagaaguacaucuacuucgacuaccccucccugccccucaccaagaucgaccugagcuccgagaacgagcuggccagcacggugagcacccccgucuccaagaccgccgagcucagccccaagaaccugcuguccccgagcuccuucaaggccgagugcagcgaggacguggagaaccucaacgcgccgcccgcggaggccggcuacgaccagaacaagaccgacuucgacgagacguccagcaucaacaccgccaucuccgacgccaccaccggggacgagggcaacacggagauggagagcaccaccggcuccagcggggacgugaagcccgcccuguccccgaaggagcccaagacccuggacacgcuccccaagcccgcgaccaccccgaccacggaggucugcgacgacaaguuccuguucagccugaccucccccagcauccacuucaacgacaaggacggcgaccacgaccaguccuucuacaucaccgacgaccccgacgacaacgccgaccggagcgagaccuccagcaucgccgaccccagcuccccgaaccccuucgggagcuccaaccccuucaagagcaaguccaacgaccgccccggccacaagcgguuccgcacccagaugagcaaccuccagcugaaggugcugaaggccugcuucuccgacuaccggacgccgaccaugcaggagugcgagaugcuggggaacgagaucggccuccccaagcgcgugguccaggugugguuccagaacgcccgggcgaaggagaagaaguucaagaucaacaucggcaagcccuucaugaucaaccagggcggcaccgaggggaccaagcccgagugcacgcugugcggcgugaaguacagcgcccgccuguccauccgggaccacaucuucagcaagcagcacaucuccaagguccgcgagaccguggggagccagcucgaccgggagaaggacuaccuggccccgaccaccgugcgccagcugauggcccagcaggagcucgaccggaucaagaaggcguccgacguccugggccugacggugcagcagcccggcaugauggacagcuccagccuccacgggaucucccugcccaccgccuacccgggccugcccgggcugccgcccguccugcugccgggcaugaacgggcccagcagccuccccggcuucccccagaacuccaacacccugaccccgcccggcgccgggaugcugggcuuccccacgagcgccaccuccagccccgcccucucccugagcuccgcgccgaccaagccccugcuccagacgccgccgccgcccccgcccccgcccccgccgccgcccagcuccagccuguccgggcagcagacggagcagcagaacaaggagagcgagaagaagcagaccaagcccaacaaggugaagaagaucaaggaggaggagcuggaggccaccaagcccgagaagcaccccaagaaggaggagaagaucuccagcgcccucuccgugcugggcaaggucgugggggagacccacguggaccccauccagcugcaggcccuccagaacgccaucgcgggcgaccccgccagcuucaucggcgggcaguuccugcccuacuucauccccggcuucgccuccuacuucacgccccagcugcccgggaccguccagggcggcuacuucccgcccgugugcgggauggagagccucuuccccuacggccccaccaugccccagacccuggccgggcugucccccggcgcccuccugcagcaguaccagcaguaccagcagaaccugcaggagagccuccagaagcagcagaagcagcagcaggagcagcagcagaagcccgugcaggcgaagacgagcaaggucgaguccgaccagccccagaacagcaacgacgccuccgagaccaaggaggacaagagcaccgccaccgaguccacgaaggaggagccgcagcuggagagcaaguccgccgacuucagcgacaccuacguggugcccuucgucaaguacgaguucaucugccgcaagugccagaugauguucaccgacgaggacgccgcggugaaccaccagaaguccuucugcuacuucgggcagccccugaucgacccccaggagaccgugcuccgggucccggugagcaaguaccagugccuggccugcgacguggccaucuccggcaacgaggcccugagccagcaccuccaguccagccugcacaaggagaagacgaucaagcaggcgaugcgcaacgccaaggagcacguccggcugcucccccacuccgugugcagccccaaccccaacaccaccuccaccagccaguccgccgccagcagcaacaacacguacccgcaccuguccugcuucagcaugaaguccuggcccaacauccuguuccaggccagcgcgcgccgggccgccagcccgcccagcuccccgcccagccucucccugcccagcaccgugaccuccagccugugcuccaccagcggcguccagaccucccuccccacggagagcugcuccgacgagagcgacuccgagcugagccagaagcuggaggaccucgacaacagccuggaggugaaggccaagccggccuccgggcuggacggcaacuucaacagcauccgcauggacauguucuccguguga

SEQ ID NO: 38918 - RNA, 1302 nt, Artificial Sequence
  derived and/or modified sequence opt1 from ZFP1__Homo_sapiens__XP_011521223
augcacugcuacggcgccuucaagauguggcugagcuccgccuucaucgugcucugccugugccccaagcugcagaagaugaacaagagccagggguccgucagcuucaccgacgugaccguggacuucacgcaggaggagugggagcagcucgacccgucccagcgcauccuguacauggacgucaugcuggagaacuacagcaaccuccuguccguggagguguggaaggcggacgaccagauggagcgggaccaccgcaaccccgacgagcaggcccggcaguuccugauccucaagaaccagacccccaucgaggagcgcggcgaccuguucgggaaggcccugaaccucaacaccgacuucgucagccugcgccaggugcccuacaaguacgaccuguacgagaagacccucaaguacaacuccgaccugcugaacagcaaccgguccuacgccggcaagcagacggacgagugcaacgaguucgggaaggcccuccuguaccugaagcaggagaagacccacagcggcguggaguacuccgaguacaacaagagcggcaaggcgcucucccacaaggccgccaucuucaagcaccagaagaucaagaaccugguccagccguucaucugcaccuacugcgacaaggccuucagcuucaagucccugcucaucagccacaagcggauccacaccggggagaagcccuacgagugcaacgugugcaagaagacguucucccacaaggcgaaccugaucaagcaccagcgcauccacaccggcgagaagcccuucgagugccccgagugcgggaaggccuucacccaccagagcaaccugaucgugcaccagcgggcccacauggagaagaagccguacgagugcagcgagugcggcaagaccuucgcccagaaguucgagcucacgacccaccagcgcauccacaccggggagcggcccuacgagugcaacgagugcgccaagaccuucuucaagaaguccaaccugaucauccaccagaagauccacacgggcgagaagcgcuacgagugcagcgagugcggcaaguccuucauccagaacagccagcugaucauccacaugcggacccacaccggggagaagcccuacgagugcaccgagugcggcaagacguucucccagcgcagcacccuccggcugcaccuccgcauccacaccggggagaagcccuacgagugcuccgagugcggcaaggcguucagccggaagucccgccugagcguccaccagcgggugcacaucggcgagaagccguga

SEQ ID NO: 38919 - RNA, 1560 nt, Artificial Sequence
  derived and/or modified sequence opt1 from ZFP30__Homo_sapiens__NP_055713
auggcccgcgaccuggugauguuccgggacgucgccguggacuucagccaggaggagugggagugccucaacuccuaccagcgcaaccuguaccgggacgugauccuggagaacuacagcaaccucgucucccuggcgggcugcagcaucuccaagcccgacgugaucacccugcucgagcaggggaaggagccguggauggugguccgcgacgagaagcggcgcuggacccuggaccuggagagccgguacgacacgaagaagcuguuccagggcaaggacaucuacgagaugaaccucucccaguggaaggugauggagcgcaucaagagcugcgggcuggaggagcaggagagcccccacgaggugugcuuccggcaggucaccaagaccaccagcgagaagaugcccacguaccgcaagcucaccucccugccccuguaccagaagucccacaaccgggagaagccguacgagugcggcgagugcgggaaggccuuccgcgugcggcagcagcucaccuuccaccagcgcauccacaccggcgagaagcccuacgagugcaaggagugcggcaaggccuuccggcagugcgcccaccugucccgccaccagcggauccacacgagcgacaagcuguacgagugcaagaagugcgggaagaucuucacgugcggcuccgaccuccgcgugcaccagcggauccacaucggggagaagcccuacgagugcaaggagugcggcaaggccuuccgcguccgggggcagcugaaccugcaccagcgcauccacaccggcgagaagcccuacgagugcaaggagugcggcaaggcguuccgccaguacgcccaccucacccggcaccagcgccugaacaucgccgagaagugcuacgagugcaaggagugcgggcaggccuuccugugcagcaccggccuccggcugcaccacaagcugcacaccggggagaagccguacgagugcaaggagugcggcaaggcguuccgcgugcggcagcagcucacccugcaccagcgcauccacaccggcgagaagcccuacgacugcaaggagugcgggaagacguucucccggggcuaccaccugacccuccaccagcgcauccacaccggggagaagcccuacgagugcaaggagugccagaaguucuuccggcgcuacagcgagcugaucucccaccagggcauccacaucggggagaagcccuacgagugcaaggagugcggcaaggccuuccggcuguucagccagcucacccagcaccagagcauccacuucggcgagaagccguucaagugcaaggagugcgagaagacguuccgccugcugucccagcucacccagcaccagagcauccacaccggggagaagcccuacgacugcaaggagugcggcaaggccuuccggcugcacuccagccugauccagcaccagcgcauccacuccggggagaagcccuacaagugcaaggagugcaagaaggccuuccggcagcacagccaccucaccuaccaccagcgcauccacaacgugacguga

SEQ ID NO: 38920 - RNA, 999 nt, Artificial Sequence
  derived and/or modified sequence opt1 from ZFP36__Homo_sapiens__NP_003398
auggccaaccgcuacaccauggaccugaccgccaucuacgagagccugcugucccugagccccgacgugccgguccccuccgaccacggcgggacggagagcucccccggcugggggagcuccggccccuggagccucuccccgagcgacuccagccccuccggggugaccagccggcugcccggccgcuccaccagccugguggagggccgguccugcgggugggugcccccgccgcccggcuucgcgccccucgccccgcgccuggggcccgagcugagccccucccccaccagcccgacggccaccagcaccacccccucccgguacaagacggagcucugccgcaccuucagcgaguccggccggugccgcuacggggccaagugccaguucgcccacggccugggcgagcugcggcaggcgaaccgccaccccaaguacaagaccgagcucugccacaaguucuaccugcaggggcggugccccuacggcagccgcugccacuucauccacaacccguccgaggaccuggccgcccccgggcacccgcccguccuccggcagagcaucuccuucagcggccugcccuccggccgccggaccagcccgcccccgcccgggcuggccggccccucccucagcuccagcuccuucagccccuccagcuccccgcccccgcccggggaccugccccugagccccagcgcguucuccgccgcccccggcacgccccucgcccgccgggaccccacccccgugugcugccccagcugccgccgggccacccccaucuccgucugggggccccugggcggccuggugcgcacccccagcgugcagucccucgggagcgaccccgacgaguacgcguccagcggcuccagccucgggggcuccgacagccccgucuucgaggccgggguguucgccccgccccagcccguggccgccccgcggcgccugcccaucuucaaccgcaucuccgucagcgaguga

SEQ ID NO: 38921 - RNA, 1224 nt, Artificial Sequence
  derived and/or modified sequence opt1 from ZFP36L1__Homo_sapiens__NP_001231630
augggccgcgcccggaaguccgggcugggccagcgcucccggcccaccgccagccgcuccgaggcggccgugcagccggggguccggaaggcccgcggcgccgggaacuggcgggugggccuccagaccggcgaggccgcgcccagcccccaccgcgaccugcgggacacgcccgacccgcgccccuggcuggcccggacccaccgcaugaccaccacgcucguguccgccaccaucuucgaccugagcgagguccugugcaaggggaacaagaugcucaacuacuccgcccccagcgcgggcgggugccugcuggaccggaaggccgugggcacccccgccgggggcggcuucccgcgccggcacuccgugacccuccccagcuccaaguuccaccagaaccagcugcugagcucccucaagggggagcccgcccccgcccugagcucccgcgacagccgguuccgcgaccgguccuucagcgagggcggggagcgccugcucccgacgcagaagcagcccggcggcgggcaggucaacuccagccgguacaagaccgagcugugccgccccuucgaggagaacggcgcgugcaaguacggggacaagugccaguucgcccacggcauccacgagcugcgcagccucacccggcaccccaaguacaagaccgagcugugccgcacguuccacaccaucggguucugcccguacggcccccggugccacuucauccacaacgccgaggagcgccgggcccuggccggcgcgcgcgaccucuccgccgaccggccccgccugcagcacagcuucuccuucgccggguuccccagcgccgccgcgaccgccgccgccaccggccugcucgacuccccgacgagcaucaccccgccgcccauccuguccgccgacgaccugcucgggagccccacccugcccgacggcaccaacaaccccuucgcguucuccagccaggagcuggccucccucuucgcccccagcauggggcugcccggcggcgggucccccacgaccuuccuguuccggcccaugagcgaguccccgcacauguucgacagcccgcccagcccccaggacagccucuccgaccaggagggcuaccugagcagcuccagcuccagccacuccgggagcgacucccccacccuggacaacagccgccggcuccccaucuucucccgccugagcaucuccgacgacuga

SEQ ID NO: 38922 - RNA, 1485 nt, Artificial Sequence
  derived and/or modified sequence opt1 from ZFP36L2__Homo_sapiens__NP_008818
augagcaccacccugcucuccgccuucuacgacguggacuuccugugcaagacggagaagagccuggccaaccucaaccugaacaacaugcuggacaagaaggcggucggcacccccguggccgccgccccguccagcggguucgcccccggcuuccuccgccggcacuccgcgagcaaccugcacgcccuggcccaccccgcccccuccccggggagcugcucccccaaguuccccggcgcggccaacgggagcuccugcggcagcgccgccgccggcgggcccaccuccuacggcacccucaaggagccgagcgggggcgggggcacggcgcugcugaacaaggagaacaaguuccgcgaccgguccuucagcgagaacggcgaccgcucccagcaccuccugcaccugcagcagcagcagaaggggggcgggggcagccagaucaacuccacccgguacaagaccgagcucugccgccccuucgaggagagcggcaccugcaaguacggggagaagugccaguucgcccacggcuuccacgagcugcggagccugacgcgccaccccaaguacaagaccgagcucugccggaccuuccacaccaucggguucugccccuacggcccgcgcugccacuucauccacaacgccgacgagcggcgccccgcccccuccgggggcgccagcggcgaccugcgggcguucgggacgcgcgacgcccugcaccucggcuucccccgggagccgcgccccaagcugcaccacucccugagcuucuccggguuccccagcggccaccaccagcccccggggggccucgaguccccccugcugcucgacagccccaccucccggacccccccgccccccagcugcuccagcgccuccagcugcuccagcuccgccagcuccugcagcagcgccuccgcggccagcacccccuccggcgccccgacgugcugcgccagcgccgcggccgccgccgcggccgcccugcuguacgggaccggcggggccgaggaccuccuggcccccggcgcgcccugcgccgccugcuccagcgccuccugcgccaacaacgcguucgccuucgggccggagcugagcucccucaucaccccccuggccauccagacccacaacuucgccgccguggcggccgccgccuacuaccgcagccagcagcagcagcagcagcagggccuggcgccccccgcccagccgcccgccccccccuccgccacgcucccggccggcgcggccgccccccccagccccccguucuccuuccagcugccccggcgccugagcgacucccccgucuucgacgcccccccgagcccccccgacucccucagcgaccgggacagcuaccuguccgggagccuguccagcggcucccucagcggguccgagagccccucccuggacccgggccgccgccugcccaucuucagccggcucuccaucagcgacgacuga

SEQ ID NO: 38923 - RNA, 1938 nt, Artificial Sequence
  derived and/or modified sequence opt1 from ZFP37__Homo_sapiens__NP_001269444
augagcguguccagcggcguccagauccugaccaagcccgagaccguggaccgccggcgcuccgccgagacgaccaaggaggccgggcggccgcucgagauggcggugagcgagcccgaggccuccgccgccgucagcgugaccuucaagcacgugaccauggccuucacgcagaaggaguggaagcagcuggaccccgcgcaguccaaccuguacaacgacgucaugcucgagaacuacugcaaccaggccagcaugggcugccaggcccccaagccggacaugaucuccaagcuggagaagggggaggcccccuggcugggcaaggggaagcgccccagccagggcugccccuccaagaucgcgcggccgaagcagaaggagaccgacggcaaggugcagaaggacgacgaccagcucgagaacauccagaagucccagaacaagcugcugcgcgagguggccgucaagaagaagacccaggccaagaagaacgggagcgacugcggcagccucgggaagaagaacaaccugcacaagaagcacgugcccuccaagaagcggcugcucaaguucgagagcugcggcaagauccugaagcagaaccuggaccuccccgaccacucccgcaacugcgugaagcgcaagagcgacgccgccaaggagcacaagaaguccuucaaccacagccugagcgacacccggaaggggaagaagcagacgggcaagaagcacgagaagcuguccagccacuccagcuccgacaagugcaacaagaccggcaagaagcacgacaagcucugcugccacagcuccagccacaucaagcaggacaagauccagaccggggagaagcacgagaagucccccagccuguccagcuccaccaagcacgagaagccgcaggcgugcgucaagcccuacgagugcaaccagugcggcaaggugcugagccacaagcaggggcucaucgaccaccagcgggugcacacgggcgagaagcccuacgagugcaacgagugcggcaucgccuucucccagaagucccaccuggucgugcaccagcgcacccacaccggggagaagcccuacgagugcauccagugcggcaaggcccacgggcacaagcacgcccugaccgaccaccuccggauccacacgggcgagaagccguacgagugcgccgagugcgggaagaccuuccgccacagcagcaaccugauccagcacgugcggucccacaccggcgagaagcccuacgagugcaaggagugcggcaagagcuuccgcuacaacagcucccugaccgagcacguccggacgcacaccggggagauccccuacgagugcaacgagugcggcaaggcguucaaguacagcuccagccucaccaagcacaugcgcauccacaccggggagaagcccuucgagugcaacgagugcggcaaggccuucuccaagaagucccaccugaucauccaccagcggacgcacaccaaggagaagccguacaagugcaacgagugcgggaaggccuucggccacagcagcucccugaccuaccacaugcgcacccacacgggcgagagccccuucgagugcaaccagugcgggaagggcuucaagcagaucgaggggcucacccagcaccagcgggugcacaccggcgagaagcccuacgagugcaacgagugcgggaaggccuucucccagaagucccaccugaucgugcaccagcgcacccacacgggcgagaagcccuacgagugcaacgagugcgagaaggccuucaacgccaagagccagcuggucauccaccagcgcagccacaccggcgagaagccguacgagugcaacgagugcgggaagaccuucaagcagaacgcgucccucaccaagcacgugaagacgcacagcgaggacaagucccacgaguga

SEQ ID NO: 38924 - RNA, 933 nt, Artificial Sequence
  derived and/or modified sequence opt1 from ZFP42__Homo_sapiens__NP_001291287
augagccagcagcugaagaagcgcgccaagacccggcaccagaagggccucgggggccgcgcccccuccggggcgaagccgcggcagggcaagagcucccaggaccugcaggccgagaucgagcccgugagcgccgucugggcccugugcgacggguacgugugcuacgagcccggcccccaggcccucggcggggacgacuucuccgacugcuacaucgagugcgugauccgcggcgaguucagccagccgauccuggaggaggacucccuguucgagagccucgaguaccugaagaagggguccgagcagcagcugagccagaaggucuucgaggcguccagccucgagugcucccuggaguacaugaagaagggcgugaagaaggagcugccccagaagaucgugggggagaacagccucgaguacuccgaguacaugaccggcaagaagcugccgcccggcgggauccccggcaucgaccugagcgaccccaagcagcucgccgaguucgcccggaagaagccgcccaucaacaaggaguacgacucccugagcgccaucgcgugcccccaguccgggugcacgcgcaagcugcggaaccgcgccgcccuccggaagcaccuccugauccacggcccccgcgaccacgucugcgccgagugcggcaaggccuucguggagagcagcaagcugaagcggcacuuccuggugcacaccggggagaagcccuuccgcugcaccuucgagggcugcgggaagcgguucucccuggacuucaaccuccgcacccacguccggauccacacgggcgagaagcgcuucgugugccccuuccaggggugcaaccggcgcuucauccagagcaacaaccugaaggcgcacauccugacccacgccaacaccaacaagaacgagcaggagggcaaguga

SEQ ID NO: 38925 - RNA, 1395 nt, Artificial Sequence
  derived and/or modified sequence opt1 from ZFP57__Homo_sapiens__XP_006715150
augagcgagaccuucaagaaccugaccuccguggcccgcaucuuccuccacaagcccgagcugaucaccaagcuggagcaggaggaggagcaguggcgggaguucguccaccuccccaacaccgagggccugagcgaggggaagaagaaggagcugcgcgagcagcaccccucccuccgggacgagggcaccagcgacgacaagguguuccuggccugccgcggggcgggccagugcccccuguccgcccccgccgggaccauggaccggacgcgcgugcuccaggccagccaggccggcccgcccuucuucugcuacacgugcggcaagugcuucucccggcgcagcuaccuguacucccaccaguucguccacaaccccaagcugaccaacagcugcucccagugcgggaagcuguuccggagccccaagucccucagcuaccaccgccggaugcaccugggcgagcgcccguucugcugcacccucugcgacaagaccuacugcgacgcguccgggcugagccggcaccgccgggugcaccugggcuaccgcccccacuccugcagcgugugcgggaaguccuuccgggaccagagcgagcucaagcgccaccagaagauccaccagaaccaggagcccgucgacggcaaccaggagugcacccugcggauccccggcacccaggccgaguuccagaccccgaucgcccgcagccagcgguccauccaggggcugcucgacgugaaccacgcccccguggcgcgcagccaggagcccaucuuccgcacggagggccccauggcccagaaccaggccuccguccugaagaaccaggccccggugacccggacccaggcccccaucaccgggacgcugugccaggacgcgcgcagcaacucccaccccgugaagcccagccggcucaacgucuucugcugcccgcacugcucccugaccuucagcaagaaguccuaccugagccgccaccagaaggcccaccucaccgagccgcccaacuacugcuuccacugcuccaagagcuucuccagcuucucccggcuggugcgccaccagcagacccacuggaagcagaaguccuaccugugccccaucugcgaccucagcuucggcgagaaggagggccugauggaccacuggcggggguacaagggcaaggaccugugccagagcucccaccacaagugccgcgugauccucgggcaguggcugggcuucagccacgacguccccacgauggccggggaggaguggaagcacggcggcgaccagagcccgccccggauccacacgccccgccggcgcgggcugcgggagaaggccugcaagggcgacaagaccaaggaggccguguccauccucaagcacaaguga

SEQ ID NO: 38926 - RNA, 2046 nt, Artificial Sequence
  derived and/or modified sequence opt1 from ZFP64__Homo_sapiens__NP_060667
augaacgccagcuccgagggcgagagcuucgccggguccgugcagauccccggcgggaccaccguccugguggagcucacgccggacauccacaucugcggcaucugcaagcagcaguucaacaaccuggacgcguucguggcccacaagcagagcgggugccagcugaccggcaccuccgccgccgcccccagcaccguccaguucguguccgaggagacggugcccgcgacccagacccagaccacgacccgcaccaucaccagcgagacgcagaccaucaccgucuccgcccccgaguucguguucgagcacggcuaccagaccuaccucccgacggagagcaacgagaaccagaccgccaccgugaucucccugcccgccaagagccggaccaagaagcccacgacgcccccggcgcagaagcgccugaacugcugcuaccccgggugccaguucaagaccgccuacggcaugaaggacauggagcggcaccucaagauccacaccggggacaagccccacaagugcgaggucugcggcaagugcuucucccgcaaggacaagcugaagacccacaugcggugccacaccggggugaagcccuacaagugcaagaccugcgacuacgccgccgccgacagcuccagccugaacaagcaccuccgcauccacuccgacgagcggccguucaagugccagaucugccccuacgcgagccgcaacuccagccagcugaccgugcaccuccggagccacacgggcgacgcccccuuccagugcuggcugugcuccgccaaguucaagaucagcuccgaccugaagcgccacaugcggguccacagcggcgagaagcccuucaagugcgaguucugcaacgugcgcugcaccaugaaggggaaccugaagucccacauccggaucaagcacagcggcaacaacuucaagugcccgcacugcgacuuccucggggacuccaaggccacccugcgcaagcacagccgggugcaccaguccgagcaccccgagaagugcagcgagugcuccuacagcugcuccagcaaggccgcgcugcgcauccacgagcggauccacugcaccgaccgccccuucaagugcaacuacugcuccuucgacacgaagcagcccagcaaccucuccaagcacaugaagaaguuccacggcgacauggucaagaccgaggcccuggagcggaaggacaccggccgccagagcucccgccagguggccaagcuggacgccaagaaguccuuccacugcgacaucugcgacgccagcuucaugcgggaggacagccuccgcagccacaagcggcagcacuccgaguacagcgaguccaagaacagcgacgugaccguccugcaguuccagaucgacccguccaagcagcccgcgacgccccugaccguggggcaccuccaggugccccugcagccgagccaggucccccaguucuccgagggccgcgugaagaucaucguggggcaccaggucccccaggccaacaccaucgugcaggccgccgccgcggccgucaacaucgugcccccggcccugguggcccagaaccccgaggagcuccccggcaacagccggcugcagauccugcgccaggucucccucaucgcgccgccccagagcucccggugccccagcgaggccggggccaugacccagcccgccgugcugcugaccacgcacgagcagaccgacggcgccacccuccaccagacccugaucccgacggcguccggcgggccccaggagggcagcgggaaccagaccuucaucaccuccagcggcaucacgugcaccgacuucgaggggcugaacgcccucauccaggagggcaccgccgaggugaccgucgugagcgacggcgggcagaacaucgccguggccaccacggcgccgcccgucuucuccagcuccagccagcaggagcugcccaagcagaccuacuccaucauccagggcgccgcccaccccgcccugcucugccccgccgacagcauccccgacuga

SEQ ID NO: 38927 - RNA, 1599 nt, Artificial Sequence
  derived and/or modified sequence opt1 from ZFP82__Homo_sapiens__NP_597723
auggcccugcgcagcgugauguucuccgacgucagcaucgacuucucccccgaggagugggaguaccucgaccuggagcagaaggaccuguaccgggacgugaugcucgagaacuacagcaaccuggugucccugggcugcuucaucagcaagccggacgucaucuccagccucgagcaggggaaggagcccuggaagguggugcgcaagggccggcgccaguaccccgaccuggagaccaaguacgagaccaagaagcugucccucgagaacgacaucuacgagaucaaccugagccaguggaagaucauggagcggaucgagaaccacgggcugaagggccucauccugaagaacgacugggaguccacggggaagaucgagggccaggagcgcccccaggagggcuacuucagcuccgucaagaugccgagcgagaagguguccagcuaccagaagcggaccuccgugacgccccaccagcgccugcacuucgucgacaagcccuacgagugcaaggagugcgggaaggccuuccgggugcgccagcagcucaccuuccaccaccggauccacaccggcgagaagcccuacgagugcaaggagugcgggauggcguuccgccagaccgcccaccugacccggcaccagcgccugcacagcggcgagaagcucuacgagugcaaggagugcggggaggccuucaucugcggcgccgaccugcgggugcaccagaagaugcacaucggcgagaagccguacgagugcaaggagugcgggaaggccuuccgcguccggggccagcugacccuccaccagcgcauccacacgggggagaagcccuacgugugcaaggagugcggcaaggcguuccggcaguacgcccaccugacccgccaccagaagcugaacuccgccgaccggcucuacgagugcaaggagugcggcaaggccuuccugugcgggagcggccugcgcgugcaccacaagcuccacaccggggagaagcccuacgagugcaaggagugcggcaaggcguuccgcguccggcagcagcugacccugcaccagcgcauccacacgggggagaagcccuacgagugcaaggagugcggcaagaccuucagccggggcuaccaccucauccugcaccaccgcauccacaccggggagaagccguacgagugcaaggagugcuggaaggccuucucccgguacagccagcugaucucccaccagagcauccacaucggcgugaagcccuacgacugcaaggagugcgggaaggccuuccgccuccugucccagcugacccagcaccagagcauccacaucggcgagaagcccuacaagugcaaggagugcgggaaggccuuccggcuccgccagaagcugacgcugcaccaguccauccacaccggcgagaagcccuucgagugcaaggagugccggaaggccuuccgccucaacagcucccugauccagcaccuccggauccacagcggcgagaagccguacgagugcaaggagugcaagaaggcguuccgccagcacucccaccugacccaccaccugaagauccacaacgugaagaucuga

SEQ ID NO: 38928 - RNA, 1713 nt, Artificial Sequence
  derived and/or modified sequence opt1 from ZFP91__Homo_sapiens__NP_444251
augcccggcgagaccgaggagccgcgcccgcccgagcagcaggaccaggagggcggggaggccgccaaggcggcccccgaggagccccagcagcggccgcccgaggccguggccgccgcgcccgccgggaccacgagcucccgcguccugcggggcgggcgcgaccggggccgcgccgccgcggccgccgccgccgcggccgugagccggcgccggaaggccgaguacccccgccggcgccgguccagccccuccgcccgcccgcccgacgugcccggccagcagccccaggccgccaagagccccucccccguccaggggaagaaguccccgcggcuccugugcaucgagaaggugaccaccgacaaggaccccaaggaggagaaggaggaggaggacgacagcgcgcugccccaggaggugagcaucgccgccucccgccccagccggggcuggcgcuccagccggaccuccgucagccgccaccgggacacggagaacacccgcuccagccgcuccaagaccgggagccuccagcugaucugcaagagcgagccgaacaccgaccagcuggacuacgacgugggcgaggagcaccagucccccgggggcaucagcuccgaggaggaggaggaggaggaggaggagaugcucaucagcgaggaggagauccccuucaaggacgacccccgggacgagacguacaagccgcaccuggagcgcgagacccccaagccccggcgcaaguccggcaaggugaaggaggagaaggagaagaaggagaucaaggucgagguggagguggaggucaaggaggaggagaacgagauccgggaggacgaggagcccccgcgcaagcgggggcgccggcgcaaggacgacaagagcccccggcugcccaagcgccggaagaagccgcccauccaguacgugcgcugcgagauggagggcugcgggaccgugcucgcccacccccgguaccugcagcaccacaucaaguaccagcaccuccugaagaagaaguacgucugcccccacccguccugcggccgccuguuccggcugcagaagcagcuccugcgccacgcgaagcaccacaccgaccagcgggacuacaucugcgaguacugcgcccgcgccuucaagagcucccacaaccuggccgugcaccgcaugauccacacgggcgagaagccccuccagugcgagaucugcggguucacgugccggcagaaggccagccugaacuggcacaugaagaagcacgacgcggacuccuucuaccaguucagcugcaacaucugcggcaagaaguucgagaagaaggacuccguggucgcccacaaggccaagagccaccccgaggugcugaucgccgaggcgcucgccgccaacgccggggcccugaucaccuccaccgacauccugggcaccaaccccgagagccucacccagccguccgacgggcagggccugccccugcuccccgagccccugggcaacagcaccuccggggagugccugcuccuggaggcggagggcaugagcaagagcuacugcuccgggaccgagcgcgugagccugauggccgacggcaagaucuucgucggguccggcagcuccggcgggacggagggccucgugaugaacagcgacauccugggggccaccaccgaggugcugaucgaggacuccgacagcgccggcccguga

SEQ ID NO: 38929 - RNA, 3021 nt, Artificial Sequence
  derived and/or modified sequence opt1 from ZFPM1__Homo_sapiens__NP_722520
augagccgccggaagcagagcaacccccgccagaucaagcggagccugggcgacauggaggcccgcgaggaggugcagcucgucggcgccucccacauggagcagaaggccaccgcccccgaggcccccuccccgcccuccgccgacgugaacagcccgccgccccucccgccgcccaccucccccggcgggcccaaggagcuggagggccaggagcccgagccccggcccacggaggaggagcccgggagccccugguccggccccgacgagcucgagcccgugguccaggacggccagcgccggauccgcgcccggcugagccuggccaccgggcucuccuggggccccuuccacgggagcgugcagacccgcgccuccagcccccggcaggccgagcccucccccgcccugacccugcuccugguggacgaggccugcuggcugcgcacgcucccccaggcccugaccgaggccgaggccaacaccgagauccaccggaaggacgacgcccuguggugccgcgucaccaagcccgugcccgccggcgggcuccugagcgugcugcucacggccgagccccacuccacccccggccaccccgucaagaaggagcccgccgagccgaccugccccgcccccgcccacgaccugcagcugcucccccagcaggccggcauggccagcauccuggccaccgccgugaucaacaaggacguguuccccugcaaggacugcgggaucugguaccgguccgagcgcaaccugcaggcccaccuccuguacuacugcgccagccggcagggcacggggagccccgccgccgccgccaccgacgagaagcccaaggagaccuaccccaacgagcgcgucugccccuucccgcagugccggaaguccugccccagcgccuccagccuggagauccacaugcgcucccacagcggcgagcggcccuucgugugccucaucugccuguccgccuucaccacgaaggccaacugcgagcgccaccugaaggugcacaccgacacccucagcggcgucugccacuccugcggguucaucagcaccacgcgcgacauccuguacucccaccuggugaccaaccacauggugugccagcccggcagcaagggggagaucuacuccccgggcgccgggcaccccgccaccaagcugccgcccgacagccugggcuccuuccagcagcagcacaccgcccugcagggcccgcucgccagcgccgaccuggggcuggcccccacgcccucccccggccucgaccggaaggcccuggccgaggccaccaacggggaggcccgcgccgagccgcuggcgcagaacggcgggagcuccgagccgcccgccgcgccccggagcaucaaggucgaggccguggaggagccggaggccgcgcccauccucggccccggcgagccggggccccaggcccccagccgcacccccuccccgcggagccccgcccccgcccgcgugaaggcggagcuguccagccccaccccgggcuccagccccguccccggggagcugggccucgccggggcccuguuccugccccaguacguguucggcccggacgccgcgccgcccgcguccgagauccucgccaagaugagcgagcuggugcacucccggcugcagcagggcgccggggccggcgccgggggcgcgcagacgggccuguuccccggggccccgaagggcgcgaccugcuucgagugcgagaucaccuucagcaacgucaacaacuacuacgugcacaagcgccucuacugcuccgggcggcgcgcccccgaggacgcccccgcggcccggcgccccaaggccccgcccggccccgcccgggcgcccccggggcagcccgccgagcccgacgcgccccgcagcuccccgggccccggcgcccgggaggagggggccggcggggcggccacccccgaggacggcgccgggggccgcggcagcgaggggucccagagcccgggcuccagcgucgacgacgccgaggacgaccccagccggacgcugugcgaggccugcaacauccgcuucucccggcacgagaccuacaccgugcacaagcgcuacuacugcgcgagccgccacgacccgccgccccggcgccccgccgcgccgcccgggccgcccggccccgccgcgccgcccgcgcccucccccgccgcccccgugcggacccgccggcgccggaagcuguacgagcuccacgccgccggggcgcccccgccgccgccgcccggccacgcccccgcccccgagagcccccgccccggcuccgggagcggcuccgggcccggccuggcccccgcgcggagccccgggcccgccgccgacggccccaucgaccuguccaagaagccccgccggccccuccccggcgcccccgccccggcgcuggccgacuaccacgagugcacggccugccgcgucagcuuccacucccuggaggccuaccucgcccacaagaaguacagcugccccgcggcgccgccgcccggggcccugggccugcccgccgccgcgugccccuacugcccgcccaacgggcccgugcggggcgaccuccuggagcacuuccgccuggcccacggccuccugcugggggcgccccucgccggccccgggguggaggcgcggacccccgccgaccgcggccccucccccgcccccgcccccgccgcgagcccccagcccgggucccggggcccccgcgacggccuggggccggagccccaggagcccccgcccgggccgccgcccagccccgccgccgcccccgaggccgucccgcccccgcccgcgccgcccuccuacagcgacaagggggugcagacccccuccaagggcacccccgcgccccugcccaacgggaaccaccgguacugccgccucugcaacaucaaguucagcagccuguccaccuucaucgcccacaagaaguacuacugcagcucccacgccgccgagcacgugaaguga

SEQ ID NO: 38930 - RNA, 3456 nt, Artificial Sequence
  derived and/or modified sequence opt1 from ZFPM2__Homo_sapiens__NP_036214
augagccgccggaagcaguccaagccccgccagaucaagcggccgcuggaggacgccaucgaggacgaggaggaggagugccccagcgaggagaccgacaucaucuccaagggcgacuucccccucgaggagagcuucuccaccgaguucgggcccgagaaccugagcugcgaggagguggaguacuucugcaacaagggcgacgacgaggggauccaggagacggccgaguccgacggcgacacccagagcgagaagccggggcagcccggcgucgagaccgacgacugggacggccccggggagcuggagguguuccagaaggacggcgagcgcaagauccagucccggcagcagcuccccguggggaccacguggggcccguuccccgggaagauggaccugaacaacaacagccugaagaccaaggcgcagguccccauggugcucaccgccggccccaaguggcugcuggacgugaccuggcagggcgucgaggacaacaagaacaacugcaucguguacuccaagggcgggcagcucuggugcacgaccaccaaggccaucagcgagggggaggagcugaucgccuucguggucgacuucgacucccgccugcaggccgcgagccagaugacccucacggagggcauguacccggcccggcugcuggacuccauccagcuccugccccagcaggccgccauggcgagcauccugcccaccgccaucgugaacaaggacaucuuccccugcaaguccugcggcaucugguaccgcagcgagcggaaccuccaggcccaccugauguacuacugcuccgggcgccagcgggaggccgccccggugagcgaggagaacgaggacagcgcgcaccagaucuccagccugugccccuucccccagugcaccaaguccuucagcaacgcccgcgcccucgagaugcaccugaacucccacagcggcgucaagauggaggaguuccugcccccgggggccucccucaagugcaccgugugcagcuacacggccgacuccgugaucaacuuccaccagcaccuguucagccaccugacccaggcggccuuccggugcaaccacugccacuucggcuuccagacccagcgcgagcuccugcagcaccaggagcugcacguccccuccgggaagcucccccgggagagcgacauggagcacucccccagcgccaccgaggacucccugcagccggccacggaccugcucacccgcagcgagcugccccagucccagaaggccaugcagaccaaggacgcgagcuccgacaccgagcuggacaagugcgagaagaagacgcagcuguuccucaccaaccagcggcccgagauccagcccaccaccaacaagcagagcuucagcuacacgaagaucaaguccgagccgagcagcccccgccuggccuccucccccgugcagccgaacaucggccccagcuuccccgugggccccuuccucucccaguucagcuucccgcaggacaucaccauggucccccaggccuccgagauccuggccaagaugagcgagcuggugcaccggcgccuccggcacggguccagcuccuacccgcccgugaucuacagcccccugaugcccaagggcgcgaccugcuucgagugcaacaucaccuucaacaaccuggacaacuaccucguccacaagaagcacuacugcuccagccgcuggcagcagauggccaagucccccgaguuccccagcgugagcgagaagaugccggaggcccugucccccaacacggggcagaccagcaucaaccugcucaaccccgccgcccacuccgcggaccccgagaacccgcugcugcagaccagcugcaucaacuccagcaccgugcuggaccucaucggccccaacgggaagggccacgacaaggacuucuccacgcagaccaagaagcugagcaccuccagcaacaacgacgacaagaucaacggcaagcccgucgacgugaagaaccccuccgucccgcugguggacggggagagcgaccccaacaagacgaccugcgaggccugcaacaucaccuucucccgccacgagaccuacauggugcacaagcaguacuacugcgccacccggcacgacccgccccucaagcgcagcgccuccaacaagguccccgccaugcagcggaccaugcgcacgcggaagcgccggaagauguacgagaugugccugcccgagcaggagcagcggcccccgcuggugcagcagcgcuuccucgacguggcgaaccugaacaaccccugcaccagcacccaggagcccaccgagggccugggggagugcuaccacccccgcugcgacaucuucccgggcaucgucuccaagcaccucgagacgagccugaccaucaacaagugcgugcccguguccaagugcgacaccacccacagcagcgucuccugccuggagauggacgugcccaucgaccucagcaagaagugccugucccagagcgagcggacgaccaccucccccaagcgccugcucgacuaccacgagugcaccgugugcaagaucagcuucaacaaggucgagaacuaccuggcccacaagcagaacuucugcccggugacggcccaccagcggaacgaccuggggcagcucgacggcaagguguuccccaaccccgaguccgagcgcaacagccccgacgucuccuacgagcggagcaucaucaagugcgagaagaacggcaaccugaagcagccgucccccaacgggaaccuguucagcucccaccucgccacccugcagggccugaagguguucagcgaggccgcgcagcucaucgccaccaaggaggagaaccgccaccuguuccugccccagugccucuaccccggggccaucaagaaggccaagggcgccgaccagcuguccccguacuacggcaucaagcccagcgacuacaucuccgggagccuggugauccacaacaccgacaucgagcagucccggaacgcggagaacgagagccccaagggccaggccagcuccaacgggugcgccgcccucaagaaggacagccugccccugcucccgaagaaccgcggcauggucaucgugaacgggggccugaagcaggacgagcggcccgcggccaacccccagcaggagaacaucucccagaacccccagcacgaggacgaccacaagagcccguccuggaucagcgagaacccccuggccgccaacgagaacgugucccccggcauccccagcgccgaggagcagcucuccagcaucgcgaagggggucaacggcuccagccaggccccgacguccgggaaguacugccgccugugcgacauccaguucaacaaccugagcaacuucaucacccacaagaaguucuacugcuccagccacgccgccgagcacgugaaguga

SEQ ID NO: 38931 - RNA, 213 nt, Artificial Sequence
  derived and/or modified sequence opt1 from ZFR2__Homo_sapiens__NP_001139112
auggccaccagccaguacuucgacuucgcccagggcgggggcccccaguacuccccggagguggagaccacgccgcccgcgcuggccagcgggcuccccugcgcccugcccuggaccgucggcugcuccgggagcgacgccgugaccgcccugugccccucccuccgcggccuggcgugcaucugcagcauccugugggaccccgccugguga

SEQ ID NO: 38932 - RNA, 3225 nt, Artificial Sequence
  derived and/or modified sequence opt1 from ZFR__Homo_sapiens__NP_057191
augauccccaucugcccgguggucagcuucaccuacgugcccucccgccugggcgaggacgccaagauggccaccgggaacuacuucggcuucacgcacagcggggcggccgccgccgccgcggccgcccaguacucccagcagcccgccagcggcguggcguacucccaccccaccaccgucgccagcuacaccgugcaccaggccccgguggccgcccacacggucaccgcggccuacgcccccgccgccgcgaccguggccguggcccggcccgcccccgucgccguggcggccgccgccaccgccgcggccuacgggggcuacccgacggcccacaccgccaccgacuacggcuacacccagcgccagcaggaggcgcccccgccgcccccgcccgccacgacccagaacuaccaggacuccuacagcuacgugcgguccaccgcccccgccgucgccuacgacagcaagcaguacuaccagcagcccaccgcgacggccgccgccguggccgcggccgcccagccccagcccuccguggccgagaccuacuaccagaccgcccccaaggcgggguacagccagggcgccacccaguacacgcaggcccagcagacccgccaggucaccgccaucaagcccgcgacccccucccccgccacgaccaccuucagcaucuaccccguguccagcaccgugcagccggucgccgccgccgcgacgguggugcccuccuacacccagagcgccaccuacuccaccacggccgucaccuacagcgggaccagcuacuccggcuacgaggccgccguguacagcgcggccuccagcuacuaccagcagcagcagcagcagcagaagcaggccgccgccgcggccgccgccgcggccgccaccgccgccuggacggggaccaccuucaccaagaaggcgcccuuccagaacaagcagcucaagcccaagcagccgcccaagcccccgcagauccacuacugcgacgugugcaagaucuccugcgccggcccccagaccuacaaggagcaccuggagggccagaagcacaagaagaaggaggccgcccugaaggccagccagaacacguccagcuccaacagcuccacccgggggacccagaaccagcuccgcugcgagcugugcgacgucagcugcaccggcgcggacgccuacgccgcccacauccggggcgccaagcaccagaagguggucaagcugcacacgaagcucggcaagcccauccccuccaccgagccgaacguggugagccaggcgaccuccagcaccgccgucuccgccagcaagcccacggccucccccagcagcaucgccgcgaacaacugcaccgugaacaccuccagcguggccaccuccagcaugaagggccugacgaccaccgggaacuccagccugaacuccaccagcaacacgaaggucuccgccgugcccaccaacauggccgcgaagaagaccagcaccccgaagaucaacuucgugggcgggaacaagcuccaguccacgggcaacaaggccgaggacaucaaggggaccgagugcgucaagagcacccccgugaccuccgccgugcagauccccgaggucaagcaggacacggugagcgagcccgugaccccggccucccuggccgcgcugcagagcgacguccagcccgugggccacgacuacguggaggagguccgcaacgacgagggcaaggugauccgguuccacugcaagcucugcgagugcuccuucaacgaccccaacgccaaggagaugcaccugaaggggcgccggcaccgccugcaguacaagaagaaggugaaccccgaccuccaggucgaggugaagccgagcauccgggcccgcaagauccaggaggagaagaugcggaagcagaugcagaaggaggaguacuggcgccggcgcgaggaggaggagcgguggcgcauggagaugcggcgcuacgaggaggacauguacuggcgccggauggaggaggagcagcaccacugggacgaccgccggcgcaugcccgacggcggguacccccacgggcccccggggccccugggccugcucggcgugcggcccgggaugcccccgcagccccagggccccgccccgcugcgccggcccgacagcuccgacgaccgcuacgucaugaccaagcacgccaccaucuaccccacggaggaggagcugcaggcggugcagaagaucgugagcaucaccgagcgggcccucaagcuggucuccgacagccuguccgagcacgagaagaacaagaacaaggagggggacgacaagaaggagggcgggaaggaccgcgcccucaagggcgugcugcgggugggcguccuggccaaggggcuccugcugcgcggcgaccggaacgugaaccucgugcugcugugcagcgagaagcccuccaagacccuccugagccgcaucgccgagaaccugccgaagcagcucgcggucaucucccccgagaaguacgacaucaagugcgccgugagcgaggccgccaucauccugaacuccugcguggagcccaagaugcaggucaccaucacgcugaccagccccaucauccgggaggagaacaugcgcgagggggacgugaccuccggcauggugaaggacccgcccgacguccucgaccggcagaagugccuggacgcgcuggccgcccuccgccacgccaagugguuccaggcccgggcgaacggccugcagagcugcgugaucaucauccgcauccugcgcgaccucugccagcgggugcccaccugguccgacuuccccagcugggccauggagcugcuggucgagaaggccaucuccagcgccuccagcccgcagagccccggggacgcccuccgccggguguucgagugcaucuccagcggcaucauccugaaggggucccccggccugcuggaccccugcgagaaggacccguucgacacgcucgcgaccaugaccgaccagcagcgcgaggacaucaccagcuccgcccaguucgcccugcggcugcucgccuuccgccagauccacaaggugcuggggauggacccccugccccagaugagccagcgguucaacauccacaacaaccgcaagcggcgccgggacuccgacggcgucgacggcuucgaggccgaggggaagaaggacaagaaggacuacgacaacuucuga

SEQ ID NO: 38933 - RNA, 1731 nt, Artificial Sequence
  derived and/or modified sequence opt1 from ZFX__Homo_sapiens__NP_001171557
augaccauggacaccgagagcgagaucgaccccugcaagguggacggcacgugcccggaggucaucaagguguacaucuucaaggccgaccccggggaggacgaccugggcgggaccguggacaucgucgaguccgagcccgagaacgaccacggcguggagcuccuggaccagaacagcuccauccgcgugccccgggagaagauggucuacaugaccgugaacgacagccagccggaggacgaggaccugaacguggccgagaucgcggacgaggucuacauggaggugaucgugggggaggaggacgccgccgccgccgcggccgccgccgcgguccacgagcagcagauggacgacaacgagaucaagaccuucaugcccaucgccugggccgccgccuacggcaacaacuccgacggcaucgagaaccgcaacgggacggcgagcgcccuccugcacaucgacgaguccgccggccuggggcggcucgccaagcagaagcccaagaagcgccggcgccccgacagccggcaguaccagaccgccaucaucaucggcccggacgggcacccccugaccguguaccccugcaugaucugcggcaagaaguucaagucccgcggcuuccugaagcggcacaugaagaaccaccccgagcaccucgcgaagaagaaguaccgcugcaccgacugcgacuacacgaccaacaagaagaucagccugcacaaccaccuggagucccacaagcucaccagcaaggccgagaaggccaucgagugcgacgagugcgggaagcacuucucccacgccggcgcccuguucacccacaagauggugcacaaggagaagggggcgaacaagaugcacaagugcaaguucugcgaguacgagacggccgagcagggccugcucaaccggcaccuccuggccguccacagcaagaacuucccgcacaucugcguggagugcggcaagggguuccgccaccccuccgagcugaagaagcacaugcggauccacaccggcgagaagcccuaccagugccaguacugcgaguaccgcagcgccgacuccagcaaccugaagacccacgugaagaccaagcacuccaaggagaugcccuucaagugcgacaucugccugcucacguucagcgacaccaaggagguccagcagcacgcccugauccaccaggagagcaagacccaccagugccugcacugcgaccacaaguccagcaacuccagcgaccucaagcggcacaucaucuccgugcacaccaaggacuacccgcacaagugcgacaugugcgacaagggguuccaccgccccagcgagcugaagaagcacguggcggcccacaagggcaagaagaugcaccagugccggcacugcgacuucaagaucgccgaccccuucguccugucccgccacauccucagcgugcacacgaaggaccugcccuuccggugcaagcgcugccggaagggguuccgccagcaguccgagcugaagaagcacaugaagacccacagcggccgcaagguguaccagugcgaguacugcgaguacuccaccaccgacgccagcggcuucaagcggcacgucaucuccauccacacgaaggacuacccgcaccgcugcgaguacugcaagaagggguuccggcgccccagcgagaagaaccagcacaucaugcggcaccacaaggaggugggccuccccuga

SEQ ID NO: 38934 - RNA, 2175 nt, Artificial Sequence
  derived and/or modified sequence opt1 from ZFY__Homo_sapiens__NP_001138747
auggacggcgaccagaucguggucgagauccaggaggccguguucgugagcaacaucgucgacuccgacaucaccgugcacaacuucgugcccgacgacccggacagcgucgugauccaggacguggucgaggacguggugaucgaggaggacguccagugcuccgacauccuggaggaggccgacgugagcgagaacgugaucauccccgagcagguccucgacuccgacgugaccgaggaggugagccugccccacugcacgguccccgacgacgugcuggcguccgacaucaccagcaccuccaugagcaugccggagcacgugcucaccuccgagagcaugcacgucugcgacaucgggcacguggagcacauggugcacgacuccgucguggaggccgagaucaucacggacccccugaccagcgacaucgucuccgaggaggugcugguggccgacugcgcccccgaggccgucaucgacgcgagcggcaucuccguggaccagcaggacaacgacaaggccagcugcgaggacuaccucaugaucucccuggacgacgccgggaagaucgagcacgacggcagcaccggggugaccaucgacgccgagagcgagauggaccccugcaaggucgacuccacgugcccggaggugaucaagguguacaucuucaaggcggaccccggcgaggacgaccugggcgggaccgucgacaucguggagagcgagcccgagaacgaccacggcguggagcuccuggaccagaacuccagcauccgcgucccccgggagaagaugguguacaugaccgugaacgacucccagcaggaggacgaggaccugagcaacaacuccgacgggaucgagaaccgcaacggcaccgccagcgcccuccugcacaucgacgaguccgccgggcugggccggcucgccaagcagaagccgaagaagaagcgccggcccgacagccgccaguaccagacggcgaucaucaucggccccgacgggcacccccugaccgucuacccgugcaugaucugcggcaagaaguucaagucccggggguuccugaagcgccacaugaagaaccaccccgagcaccucgccaagaagaaguaccacugcaccgacugcgacuacaccacgaacaagaagaucagccugcacaaccaccuggagucccacaagcucaccagcaaggccgagaaggccaucgagugcgacgagugcggcaagcacuucucccacgccggcgcgcuguucacccacaagauggugcacaaggagaagggggccaacaagaugcacaagugcaaguucugcgaguacgagaccgccgagcagggccugcucaaccggcaccuccuggccgugcacagcaagaacuucccccacaucugcgucgagugcgggaagggcuuccgccaccccuccgagcugcggaagcacaugcgcauccacacgggggagaagccguaccagugccaguacugcgaguaccggagcgccgacuccagcaaccugaagacccacaucaagaccaagcacagcaaggagaugcccuucaagugcgacaucugccugcucaccuucuccgacacgaaggaggugcagcagcacacccuggugcaccaggagagcaagacccaccagugccugcacugcgaccacaaguccagcaacuccagcgaccucaagcgccacgucaucuccgugcacaccaaggacuacccccacaagugcgagaugugcgagaagggcuuccaccggcccagcgagcugaagaagcacguggcgguccacaagggcaagaagaugcaccagugccgccacugcgacuucaagaucgccgacccguucgugcugucccggcacauccucagcgugcacacgaaggaccugcccuuccgcugcaagcggugccgcaagggguuccggcagcagaacgagcugaagaagcacaugaagacccacuccggccgcaaggucuaccagugcgaguacugcgaguacagcaccaccgacgccuccggguucaagcgccacgugaucagcauccacacgaaggacuacccccaccggugcgaguacugcaagaagggcuuccgccggcccuccgagaagaaccagcacaucaugcgccaccacaaggagguggggcucccguga

SEQ ID NO: 38935 - RNA, 1416 nt, Artificial Sequence
  derived and/or modified sequence opt1 from ZFYVE19__Homo_sapiens__NP_001070736
augaacuacgacagccagcagcccccgcugccgccccuccccuacgccggcugccgccgggccuccggguuccccgcgcugggccgcgggggcaccgugcccgucgggguguggggcggcgccgggcagggccgggaggggcgcagcuggggcgaggggccccggggccccggccuggggcgccgggaccucuccagcgccgacccggccgugcugggcgccaccauggagucccgcugcuacgggugcgcggucaaguucacgcuguucaagaaggaguacggcugcaagaacugcggccgggccuucugcagcgggugccucuccuucagcgccgccgugccccgcaccggcaacacccagcagaaggugugcaagcagugccacgagguccugacccggggguccagcgcgaacgccuccaaguggagcccgccccagaacuacaagaagcgcguggccgcccuggaggccaagcagaagcccuccacgagccagucccagggccucacccggcaggaccagaugaucgcggagcgccuggcccggcugcgccaggagaacaagcccaagcucgugcccagccaggccgagaucgaggcccggcuggccgcgcugaaggacgagcgccagggguccauccccagcacccaggagauggaggcccggcucgccgcccugcagggccgcguccugccgucccagacgccccagcccgcccaccacacccccgacacccggacccaggcgcagcagacccaggaccuccugacgcagcuggccgccgagguggccaucgacgagagcuggaagggcgggggcccggccgcgagccuccagaacgaccugaaccagggcgggcccggguccaccaacagcaagcgccaggccaacuggucccuggaggaggagaagucccgccuccuggccgaggccgcgcuggagcuccgggaggagaacacccgccaggagcggauccuggcccuggccaagcgccucgccaugcugcggggccaggaccccgagcgcgugacccugcaggacuaccggcuccccgacagcgacgacgacgaggacgaggagacggccauccagcgcguccugcagcagcugaccgaggaggcgagccucgacgaggccuccggcuucaacaucccggccgagcaggccagccggcccuggacccagccccgcggggccgagcccgaggcgcaggacguggacccgcggcccgaggccgaggaggaggagcugcccuggugcugcaucugcaacgaggacgccacccugcgcugcgccggcugcgacggggaccucuucugcgcccggugcuuccgcgagggccacgacgcguucgagcugaaggagcaccagacguccgccuacagcccgccccgggccgggcaggagcacuga

SEQ ID NO: 38936 - RNA, 759 nt, Artificial Sequence
  derived and/or modified sequence opt1 from ZFYVE21__Homo_sapiens__NP_001185882
augagcuccgaggugagcgcccgccgggacgccaagaagcugguccgcucccccagcggccuccggauggugccggagcaccgcgcguucgggucccccuucggccuggaggagccccagugggugcccgacaaggagugccggcgcugcaugcagugcgacgccaaguucgacuuccugacccggaagcaccacugccgccggugcgggaagugcuucugcgaccgcugcugcagccagaaggucccgcuccggcgcaugugcuucguggaccccgugcggcagugcgccgagugcgcccuggucucccugaaggaggccgaguucuacgacaagcagcucaaggugcugcugagcggcgcgaccuuccucgugacguucgggaacuccgagaagcccgagaccaugaccugccgccugagcaacaaccagcgguaccuguuccucgacggcgacucccacuacgagaucgagaucguccacaucagcaccgugcagauccugacggagggcuucccgcccggggagaaggacauccacgccuacaccucccugcgcggcagccagcccgccuccgagggcgggaacgcccgggcgaccgggauguuccuccaguacaccgugcccggcacggagggcgucacccagcugaagcugaccgugguggaggacgucaccguggggcgccggcaggccguggccuggcucgucgccaugcacaaggccgcgaagcugcuguacgagagccgcgaccaguga

SEQ ID NO: 38937 - RNA, 7620 nt, Artificial Sequence
  derived and/or modified sequence opt1 from ZFYVE26__Homo_sapiens__NP_056161
augaaccaccccuucggcaaggaggaggccgccucccagaagcagcuguucggguucuucugcgagugccugcgccggggcgagugggagcuggcgcaggccugcgugccccagcugcaggaggggcagggcgacauccccaagcgcguggaggacauccugcaggcccugguggugugccccaaccugcugcggugcgggcaggacaucaacccccagcgcguggccuggguguggcugcuggugcucgagaaguggcuggcccgggagaagaagcugcuccccgucguguuccgccggaagcuggaguuccugcuccuguccgaggaccugcagggcgacauccccgagaacauccucgaggagcuguacgagacccugacccagggcgcgguggggcacguccccgacggcaacccccgccgggagagcuggacgccccgccucuccagcgaggccguguccgugcugugggaccugcuccggcagagcccccagcccgcccaggcccugcuggagcuccugcuggaggaggacgacgggaccggccucugccacuggccccugcagaacgcgcuggucgaccucauccgcaaggcccugcgggcccugcaggggcccgacuccgugccgcccggcguggucgacgccaucuacggcgcccuccgcacccugcggugccccgcggagccccuggggguggagcuccaccuccugugcgaggagcuccuggaggccugccgcaccgagggcagcccccugcgggaggagcgccuccuguccugccugcuccacaaggccagccgggggcugcugucccuguacggccacacguacgccgagaaggugaccgagaagccgccccgggccaccgcgagcggcaaggucucccccgaccaccucgaccccgagcgggccaugcuggcccuguucagcaaccccaaccccgccgaggccuggaagguggcguacuucuacugccucuccaacaacaagcacuuccuggagcagauccuggugaccgcccucacgcugcugaaggaggaggacuuccccaaccucgggugccugcuggaccgcgaguuccgcccccucagcugccugcugguccuccugggcuggacccacugccagucccuggagagcgccaagcggcuccugcagacccugcaccgcacccaggggcccggcugcgacgagcuccugcgggacgccugcgacgggcugugggcccaccucgaggugcuggaguggugcauccagcaguccagcaaccccaucccgaagcgcgaccugcucuaccaccuccacggcggcgacagccacuccgugcuguacacgcuccaccaccugaccaaccugcccgcgcuccgggaggaggacguccugaagcugcuccagaaggugcccgccaaggacccgcagcaggagcccgacgccgucgacgcccccgugcccgagcaccugagccagugccagaaccugacccucuaccagggguucugcgcgaugaaguacgccaucuacgcccugugcgugaacucccaccagcacagccagugccaggacugcaaggacucccugagcgaggaccucgccuccgccaccgagccggcgaacgacagccuguccagccccggcgccgccaaccuguucuccacguaccucgcccgcugccagcaguaccugugcagcauccccgacucccugugccucgagcugcuggagaacaucuucagccuccugcugaucaccuccgccgaccuccaccccgagccgcaccuccccgaggacuacgcggaggacgacgacaucgaggggaagucccccuccggccugcggagccccuccgagagcccgcagcacaucgcccaccccgagcgcaagagcgagcgggggucccucggcguccccaagacccuggccuacaccaugcccagccacgugaaggccgagccgaaggacuccuaccccggcccccaccgccacagcuuccuggaccucaagcacuucacguccgggaucagcggcuuccuggccgacgaguucgcgaucggggccuuccugcggcuccugcaggagcagcuggacgagaucuccagccgcagcccgcccgagaagcccaagcaggagucccaguccugcagcggcucccgggacgggcuccagagccgccugcaccggcuguccaagguggucagcgaggcccaguggcgccacaagguggugaccuccaaccaccggagcgaggagcagcccagccgccgguaccagcccgccacccgccacccgucccuccgccggggccgccggacccgccggagccaggcggacggccgcgaccggggguccaaccccagccuggaguccacgagcuccgagcugagcaccuccaccagcgagggcucccucagcgccauguccgggcgcaacgagcugcacagccggcugcacccccacccgcaguccagccucauccccaugauguucagcccgcccgagagccugcuggccuccugcauccuccgcggcaacuucgccgaggcccaccagguccuguucaccuucaaccucaagagcagcccguccagcggcgagcugauguucauggagcgguaccaggaggugauccaggagcuggcccagguggagcacaagaucgagaaccagaacuccgacgccgggagcuccacgauccgccggaccggcagcgggcgcuccacccugcaggccaucggcagcgccgccgcggccgggauggucuucuacuccaucagcgacgugaccgacaagcuccugaacacguccggcgaccccauccccaugcugcaggaggacuucuggaucagcaccgcccucguggagcccaccgccccgcugcgggagguccuggaggaccucagcccgcccgccauggcggccuucgaccuggccugcagccagugccagcuguggaagaccugcaagcagcuccuggagacggccgagcgccggcugaacuccagccuggagcgccggggccgccggaucgaccacgugcuccugaacgcggacgggauccgcggcuuccccgugguccugcagcagaucuccaagagccucaacuaccugcugauguccgccagccagaccaagagcgaguccguggaggagaagggcggcgggccgccccgcugcagcaucaccgagcuccugcagaugugcuggcccucccugagcgaggacugcguggccucccacaccacccucagccagcagcuggaccagguccugcagucccuccgggaggcccuggagcugcccgagccgcgcacgccgccccugagcucccugguggagcaggccgcgcagaaggcccccgaggccgaggcccacccggugcagauccagacccagcugcuccagaagaaccuggggaagcagacccccagcggcucccggcagauggacuaccuggggaccuucuucagcuacugcuccacgcucgccgcgguccugcugcagagccucuccagcgagcccgaccacguggaggugaaggucggcaaccccuucgugcugcugcagcaguccagcucccagcucgugagccaccuccuguucgagcgccaggucccgcccgagcggcucgccgcccugcuggcccaggagaaccucagccuguccgugccccaggugaucgucagcugcugcugcgagccccuggcccucugcuccagccgccagucccagcagaccagcucccugcugacccggcucgggacccuggcgcagcugcacgccagccacugccucgacgaccugccgcuguccacgcccagcagcccccgcaccaccgagaacccgacccucgagcggaagcccuacagcagcccccgcgacagcucccugcccgcccugacgagcuccgcccucgccuuccugaagucccgguccaagcugcucgcgaccguggccugccugggcgccagcccgcgccugaaggugagcaagcccucccucagcuggaaggagcugcgggggcgccgggaggucccccuggccgcggagcaggucgcccgcgagugcgagcggcuccuggagcaguucccccuguucgaggccuuccuccuggccgccugggagccgcugcgcggcucccuccagcagggccagagccuggcggugaaccugugcgggugggccucccucagcaccguccugcugggccuccacucccccaucgcccuggacgugcugagcgaggccuucgaggagucccucguggcccgggacuggagccgcgcgcugcagcugaccgaggucuacgggcgcgacguggacgaccucuccagcaucaaggacgccgugcuguccugcgccgucgccugcgacaaggagggcuggcaguaccuguuccccgugaaggacgccagccuccggucccgccuggcgcugcaguucguggaccgguggccccucgagagcugccuggagauccuggccuacugcaucuccgacacggccguccaggaggggcucaagugcgagcugcagcgcaagcuggccgagcuccagguguaccagaagauccugggccugcagagcccgcccguguggugcgacuggcagacccuccgguccugcugcgucgaggaccccagcaccgugaugaacaugauccuggaggcgcaggaguacgagcugugcgaggaguggggcugccucuaccccaucccgcgcgagcaccugaucagccugcaccagaagcaccuccugcaccuccuggagcggcgcgaccacgacaaggcccugcagcugcugcggcgcauccccgaccccaccaugugccuggaggucacggagcagucccuggaccagcacaccagccuggccaccucccacuuccucgccaacuaccugaccacgcacuucuacgggcagcugaccgccgugcggcaccgcgagauccaggcgcucuacgugggcagcaagauccugcugacccuccccgagcagcaccgggccuccuacagccaccuguccagcaacccgcuguucaugcucgagcagcugcugaugaacaugaaggucgacugggccaccguggccgugcagacgcuccagcagcugcuggucgggcaggagaucggcuucaccauggacgagguggacucccuccugagccgcuacgccgagaaggcgcuggacuuccccuacccccagcgggagaagcgcuccgacagcgugauccaccuccaggagaucguccaccaggccgccgaccccgagacccugccgcggucccccagcgccgaguucucccccgccgcgcccccgggcaucagcuccauccacagccccagccugcgcgagcgguccuucccgcccacccagcccagccaggaguucgugccgcccgccacgccgcccgcccgccaccagugggugcccgacgagaccgaguccaucugcauggucugcugccgggagcacuucaccauguucaaccgccgccaccacugccggcgcugcgggcggcucgugugcagcuccugcagcaccaagaagaugguggucgagggcugccgcgagaaccccgcccgggugugcgaccagugcuacuccuacugcaacaaggacgugcccgaggagcccagcgagaagcccgaggcgcuggacuccagcaagaacgagagcccgcccuacagcuucgucgugcgcgugcccaaggccgacgaggucgaguggauccuggaccucaaggaggaggagaacgagcuggugcgguccgaguucuacuacgagcaggcccccagcgccucccugugcaucgccauccucaaccugcaccgcgacagcaucgcgugcgggcaccagcugaucgagcacugcugccggcucuccaagggccugacgaaccccgagguggacgccgggcugcucaccgacaucaugaagcagcugcuguucagcgccaagaugauguucgucaaggccggccagucccaggaccucgcccugugcgacagcuacaucagcaagguggacgugcugaacauccucgucgcggccgccuaccgccacgugcccucccuggaccagauccugcagcccgccgccgugacccggcuccgcaaccagcugcuggaggcggaguacuaccagcucggcgucgaggugagcaccaagaccgggcuggacacgaccggcgccuggcacgccugggggauggccugccugaaggccggcaaccucaccgcggcccgggagaaguucucccgcugccugaagccgcccuucgaccugaaccagcucaaccacgggagccggcuggugcaggacgucguggaguaccuggaguccaccgugcgcccguucgucagccuccaggacgacgacuacuucgccacgcugcgggagcuggaggccacccuccgcacccagucccugagccuggcggugauccccgagggcaagaucaugaacaacaccuacuaccaggagugccucuucuaccugcacaacuacuccacgaaccuggccaucaucagcuucuacgugcggcacuccugccuccgcgaggcccugcugcaccuccugaacaaggaguccccgcccgaggucuucaucgagggcaucuuccagccguccuacaagagcgggaagcugcacacccucgagaaccugcuggaguccaucgaccccacccucgagagcuggggcaaguaccugaucgccgccugccagcaccuccagaagaagaacuacuaccacauccucuacgagcugcagcaguucaugaaggaccaggugcgcgcggccaugaccugcauccgguucuucucccacaaggccaagagcuacacggagcugggggagaagcucuccuggcugcugaaggccaaggaccaccucaagaucuaccugcaggagaccagccgcagcuccggccggaagaagaccaccuucuuccgcaagaagaugacggccgcggacgugagccggcacaugaacacccugcagcuccagauggaggucacccgcuuccugcaccggugcgaguccgccgggaccagccagaucacgacccugccccucccgacccuguucggcaacaaccacaugaagauggacguggccugcaaggugaugcugggcgggaagaacgucgaggacggcuucgggaucgccuuccgcgugcuccaggacuuccagcuggacgccgcgaugaccuacugccgggccgcccgccagcugguggagaaggagaaguacuccgagauccagcagcuccugaagugcgucagcgaguccggcauggccgcgaaguccgacggcgacacgauccugcugaacugccucgaggccuucaagcggaucccgccccaggagcuggaggggcugauccaggccauccacaacgacgacaacaaggugcgcgccuaccucaucugcugcaagcugcgguccgccuaccugaucgcggugaagcaggagcacagccgcgccaccgcccucguccagcagguccagcaggccgccaaguccagcggcgacgcggucgugcaggacaucugcgcccaguggcugcugaccucccacccccgcggggcgcacggcccggggagccgcaaguga

SEQ ID NO: 38938 - RNA, 1251 nt, Artificial Sequence
  derived and/or modified sequence opt1 from ZFYVE27__Homo_sapiens__NP_001002261
augcagaccagcgagcgcgagggcuccgggcccgagcugagcccguccgugaugcccgaggcgccccucgagagcccgcccuuccccaccaagucccccgccuucgaccuguucaaccugguccucagcuacaagcggcuggagaucuaccuggagccccucaaggacgccggcgacggggugcgcuaccugcugcgguggcagaugccgcucugcucccugcugacgugccucggccugaacgugcuguuccucacccugaacgagggggccugguacagcgucggcgcccugaugaucuccgugcccgcccuccugggcuaccugcaggaggugugccgcgcccggcuccccgacagcgagcugaugcgccggaaguaccacuccguccgccaggaggaccugcagcgggggcgccucagccggcccgaggcgguggccgaggugaaguccuuccugauccagcuggaggccuuccucagccgccugugcugcacgugcgaggccgcguaccggguccugcacugggagaacccggugguguccagccaguucuacggcgcccuccuggggaccgucugcaugcuguaccuccugccccugugcugggugcucacccugcugaacuccacccucuuccugggcaacguggaguucuuccgcgucgugagcgaguaccgggccucccugcagcagcgcaugaaccccaagcaggaggagcacgccuucgagagcccgcccccgcccgacgucgggggcaaggacggccucauggacagcacccccgcccugacccccacggagucccugagcucccaggaccucacccccgggagcguggaggaggcggaggaggccgagcccgacgaggaguucaaggacgccaucgaggagacccaccugguggugcuggaggacgacgagggcgcccccugcccggccgaggacgagcucgcgcugcaggacaacggguuccuguccaagaacgagguccugcggagcaaggugucccgccucaccgagcggcugcgcaagcgguaccccacgaacaacuucggcaacugcaccggcugcagcgccaccuucuccgugcugaagaagcgccgcagcugcuccaacugcgggaacagcuucugcucccggugcugcagcuucaagguccccaaguccagcaugggcgccaccgcccccgaggcccagcgcgagacgguguucgucugcgcguccugcaaccagacccucagcaaguga

SEQ ID NO: 38939 - RNA, 2574 nt, Artificial Sequence
  derived and/or modified sequence opt1 from ZFYVE28__Homo_sapiens__NP_001166127
augaugaaccgcuuccggaaguggcuguacaagcccaagcgcagcgacccgcagcuccuggcccgguucuacuacgccgacgaggagcugaaccagguggccgccgagcucgacucccuggacggccgcaaggacccccagcggugcacccugcucgucagccaguuccgcuccugccaggacaacgugcugaacaucaucaaccagaucauggacgagugcaucccccaggaccgggcgccccgcgacuucugcgugaaguucccggaggagauccggcacgacaaccuggccgggcagcucugguucggcgccgagugccuggccgccgggagcaucaucaugaaccgcgagcuggaguccauggccaugcggccccucgccaaggagcugacccgcagccuggaggacguccggggcgcgcuccgcgaccaggcccugcgggaccugaacacguacaccgagaagaugcgcgaggcccuccggcacuucgacgugcuguucgccgaguucgagcuguccuacgugagcgccaugguccccgugaaguccccgcgcgaguacuacgugcagcaggaggucaucguccucuucugcgagaccguggagagcgggcuggugguguacgcggacggcccccugaaccucgaccggaagguggaggacauguccgagcuguuccgccccuuccacacccugcuccggaagauccgcgaccugcugcagacgcucaccgaggaggagcugcacacccuggagcgcaaccucugcaucagccaggacgucgaguuccccauccgggccgacgugcagggccccgccgcccuggccccggcgcuguccgcgccccucccgcccgaggggccccugagcgccaaggccaaggaccccgacgccgagcuggccugcuccaugcaguacgacgaccaggagcucgagcagcugagccgcauggugcaccgggccggcgacgagauguccagccugcucuccccgcccaucgccugccagagccccgcccaccgccccggggccgagggcagccccgggggcgaggcgucccccggccggccgcgccugcggagcggguccgacgaggaggagcgcgucuucuucauggacgacguggagggcaccgccgaggcccuggcccggcccgagagccccgcggggcccuucggcugggccggcuccacgugggccgacccgcaggagaaggggcagggcgggcccggcggggccgccggcaucagccuccccgcguccgagaaggaggaggaccugagcaacaacaaccuggaggccgagggcaccgacggggccucccucgccggcaccagcuccugcagcugccuggacucccgccugcaccuggacgggugggaggugggcgccgacgacgcggagaccgccgagaugaucgcccaccggaccgggggcaugaagcucagcgccacggucaucuucaacccgaagucccccaccagccuggacuccgccguggcgacccaggaggccgccagcgagcccguggccgagggcauggacgggggcccccacaagcuguccacgggggcgaccaacugccuccugcacagcugcgucugcugcggcagcugcggggacucccgcgaggacguggucgagcggcugcgcgagaagugcagcccgggcggcgugaucggggccuccuacgccgccggccucgccaaggcgagcgaccgggcccccgagcgccaggaggaggccccgccgcccuccgaggacgccagcaacgggcgggagcccaaggcccccaccuccgacaagugccugccccacaccagcggcucccagguggacacggcgagcggccugcagggggaggccggcgucgccgggcagcaggagcccgaggcccgcgagcuccacgccggcucccccagcgcgcacgaggcgccccaggcccuguccgggagcuccagcuccaccgccggcagcugcagcuccgacaagaugggccccgaggccgccccggccgccacccacgccgcgccccaggccacccgggagaagauccgcagccgcuuccacgggucccacgaccugauccaccgccucuucgugugcaucagcggcguggccgaccagcugcagacgaacuacgccuccgaccugcggagcauccucaagacccuguucgaggucauggccaccaagcccgagaccgacgacaaggagaagcugcggaaggugacgcagacccuccgcuccgcggcccuggaggacugcgcccugugccaggagacccucagcuccagcgagcuggccgccaagacccgggacggggacuucgaggacccgcccgagugggugcccgacgaggcgugcggcuucugcacggccugcaaggcccccuucaccgucauccgccggaagcaccacugccgcuccugcgggaagaucuucugcagccggugcuccagccacuccgcgccccugccgcgcuacggccaggugaagcccgugcgggucugcacccacugcuacauguuccacgugacccccuucuacagcgacaaggccggccucuga

SEQ ID NO: 38940 - RNA, 4278 nt, Artificial Sequence
  derived and/or modified sequence opt1 from ZFYVE9__Homo_sapiens__XP_011540739
auggagaacuacuuccaggccgaggccuacaaccuggacaaggugcucgacgaguucgagcagaacgaggacgagaccgucagcuccacccugcuggacacgaaguggaacaagauccucgacccgccgagccaccgccuguccuucaaccccacccuggcgagcgugaacgaguccgccgugagcaacgagucccagccccagcucaaggucuucagccuggcccacuccgcgccccugaccaccgaggaggaggaccacugcgccaacggccaggacugcaaccucaacccggagaucgccacgauguggaucgacgagaacgccguggccgaggaccagcugaucaagcggaacuacagcugggacgaccagugcuccgccguggaggucggggagaagaagugcggcaaccuggcgugccuccccgacgagaagaacgugcugguggucgccgugaugcacaacugcgacaagcgcacccugcagaacgaccuccaggacugcaacaacuacaacagccagucccugauggacgccuucagcugcucccuggacaacgagaaccggcagaccgaccaguucagcuucuccaucaacgagagcaccgagaaggacaugaacuccgagaagcagauggacccccucaaccgccccaagacggaggggcggagcgugaaccaccugugcccgaccagcuccgacagccuggccuccgucugcagccccucccagcucaaggacgacggcagcaucgggcgcgaccccuccaugagcgccaucaccucccugaccguggacagcgugaucuccagccagggcacggacggcugccccgcggucaagaagcaggagaacuacaucccggacgaggaccugaccgggaagaucuccagcccccggaccgaccucggcucccccaacagcuucucccacaugagcgaggggauccugaugaagaaggagcccgccgaggaguccaccacggaggagagccugcgcagcggccucccgcugcugcucaagcccgacaugcccaacggguccggccggaacaacgacugcgagcgcugcagcgacugccuggugcccaacgaggugcgggccgacgagaacgagggcuacgagcacgaggagacccuggggaccaccgaguuccucaacaugacggagcacuucuccgagagccaggacaugaccaacuggaagcugaccaagcugaacgagaugaacgacucccaggucaacgaggagaaggagaaguuccuccagaucagccagccggaggacaccaacggcgacuccgggggccagugcgugggccuggccgacgccgggcuggaccucaagggcacgugcaucagcgaguccgaggagugcgacuucagcaccgugaucgacacccccgcggccaacuaccuguccaacgggugcgacagcuacggcaugcaggaccccggggucuccuucgugcccaagacccugccgagcaaggaggacuccgugacggaggagaaggagaucgaggagagcaaguccgagugcuacagcaacaucuacgagcagcgcggcaacgaggccaccgagggcagcgggcuccugcugaacuccaccggcgaccucaugaagaagaacuaccugcacaacuucugcagccagguccccuccgugcuggggcagagcucccccaaggucguggccagccuccccuccaucagcgugccguucggcggggcccggcccaagcagcccuccaaccugaagcugcagaucccgaagccccugagcgaccaccuccagaacgacuuccccgcgaacuccggcaacaacaccaagaacaagaacgacauccugggcaaggccaagcugggggagaacagcgccacgaacgucugcucccccagccucggcaacaucuccaacguggacaccaacggggagcaccuggagagcuacgaggccgagaucuccacccgcccgugccuggcccucgcgcccgacagccccgacaacgaccugcgggccggccaguucgggaucuccgcccgcaagcccuucaccacgcugggcgagguggccccggucugggugcccgacagccaggcgcccaacugcaugaagugcgaggcccgguucaccuucaccaagcgccggcaccacugccgcgccugcggcaagguguucugcgccagcugcugcucccucaagugcaagcugcuguacauggaccggaaggaggcccgcgucugcgugaucugccacagcgugcucaugaacgcgcaggccugggagaacaugauguccgccagcucccagagccccaacccgaacaaccccgccgaguacugcuccaccaucccgccccugcagcaggcccaggcgagcggggcccuguccagcccgccgcccaccgucauggugcccgugggcguccucaagcaccccggggccgagguggcccagccccgcgagcagcggcgcgugugguucgccgacggcauccugcccaacggcgaggucgcggacgccgccaagcugacgaugaacgggaccuccagcgccggcacccucgcggugucccacgaccccgugaagcccgucaccacgagcccccugcccgccgagaccgacaucugccuguucuccgggagcaucacccaggugggcuccccgguggggagcgccaugaaccucauccccgaggacggccugccgcccauccugaucuccaccggcgucaagggggacuacgccguggaggagaagcccagccagaucagcgugaugcagcagcucgaggacggcgggcccgacccccuggucuucgugcugaacgccaaccuccuguccauggugaagaucgucaacuacgugaaccggaagugcuggugcuucacgaccaagggcaugcacgcgguggggcagagcgagaucgucauccugcuccagugccugcccgacgagaagugccugccgaaggacaucuucaaccacuucgugcagcucuaccgcgacgcccuggccggcaacguggucuccaaccugggccacagcuucuucucccagagcuuccucggguccaaggagcacggcggguuccuguacgugaccagcaccuaccagucccugcaggaccucgugcugcccacgccgcccuaccuguucggcauccucauccagaagugggagacccccugggccaaggucuuccccauccggcugaugcugcgccucggggccgaguaccggcuguaccccugcccccuguucagcgugcgcuuccggaagccccucuucggcgagaccggccacaccaucaugaaccugcuggcggacuuccgcaacuaccaguacacgcuccccgugguccaggggcuggugguggacauggagguccggaagaccuccaucaagauccccagcaaccgcuacaacgagaugaugaaggccaugaacaaguccaacgagcacgugcuggccggcggggccugcuucaacgagaaggccgacagccaccucgugugcguccagaacgacgacggcaacuaccagacccaggcgaucuccauccacaaccagccccggaaggugaccggggccagcuucuucguguucuccggcgcccucaagagcuccagcggcuaccuggccaagagcuccaucgucgaggacggggugaugguccagaucacggcggagaacauggacagccugcgccaggcccugcgggagaugaaggacuucaccaucacgugcggcaaggccgacgccgaggagccgcaggagcacauccacauccaguggguggacgacgacaagaacguguccaagggggucgugagccccaucgacggcaaguccauggagaccaucaccaacgugaagaucuuccacggcagcgaguacaaggccaacgggaaggucauccgcuggaccgagguguucuuccuggagaacgacgaccagcacaacugccucuccgaccccgcggaccacagccggcugaccgagcacguggccaaggccuucugccuggcccucugcccccaccugaagcugcucaaggaggacggcaugaccaagcuggggcugcgcgucacgcucgacuccgaccaggugggcuaccaggccgggagcaacggccagccgcugcccucccaguacaugaacgaccuggacagcgcgcucgugcccgucauccacggcggggccugccagcuguccgagggccccguggugauggagcugaucuucuacauccucgagaacaucgucuga

SEQ ID NO: 38941 - RNA, 627 nt, Artificial Sequence
  derived and/or modified sequence opt1 from ZG16B__Homo_sapiens__NP_660295
augggcgcccagggggcccaggagagcaucaaggcgauguggcgcgugcccggcaccacccggcgccccgucacgggggagucccccggcaugcaccggcccgaggccaugcugcuccugcugacccucgcccugcucgggggccccaccugggccggcaagauguacgggccgggcgggggcaaguacuucagcaccacggaggacuacgaccacgagaucaccgggcugcgcguguccgugggccugcugcucgucaagagcguccaggugaagcugggcgacuccugggacgugaagcugggggcccucggcgggaacacccaggaggugacccugcagcccggcgaguacaucacgaagguguucgucgcguuccaggccuuccugcggggcauggugauguacaccagcaaggaccgcuacuucuacuucgggaagcucgacggccagaucuccagcgccuaccccucccaggagggccaggugcuggucgggaucuacgggcaguaccagcugcucggcaucaagagcaucggcuucgaguggaacuacccccuggaggagccgaccaccgagccgcccgugaaccugacguacuccgccaacagccccguggggcgguga

SEQ ID NO: 38942 - RNA, 816 nt, Artificial Sequence
  derived and/or modified sequence opt1 from ZGLP1__Homo_sapiens__NP_001096637
augaccgagccccaggugggcugcgucgccugcccgcgcgugcacaaggagcccgcccagguggggacccccuggcccgcgaagccgcggagccacccccgcaagcgggaccccaccgcccugcucccccgcucccuguggccggccugccaggagagcgucaccgcccugugcuuccuccaggagaccguggagcggcugggccagucccccgcccaggacacccccgugcuggggcccugcugggacccgauggcgcucggcacgcaggggcgccugcugcucgaccgggacagcaaggacacccagacccgcaucucccagaagggccggcgccugcagccgcccggcacccccagcgccccgccccagcggcgcccccggaagcagcugaaccccugccgcgggacggagcgggucgaccccggcuucgagggggugacccucaaguuccagaucaagcccgacuccagccugcagaucauccccaccuacucccugcccugcagcucccgcagccaggaguccccggccgacgccgugggcgggcccgcggcccaccccggcggcaccgaggcccacagcgccggguccgaggcccucgagccccggcgcugcgcgagcugccggacgcagcgcaccccgcuguggcgggacgccgaggacggcacgccccugugcaacgccugcgggauccgcuacaagaaguacggcacccgcugcuccagcugcuggcucgucccccggaagaacgugcagccgaagcgccugugcggccggugcggggugucccuggaccccauccaggagggcuga

SEQ ID NO: 38943 - RNA, 1536 nt, Artificial Sequence
  derived and/or modified sequence opt1 from ZGPAT__Homo_sapiens__NP_001076582
auggacgaggagagccuggaguccgcccuccagaccuaccgcgcccagcugcagcaggucgagcuggcgcucggcgccgggcuggacagcuccgagcaggccgaccugcggcagcuccagggcgaccugaaggagcugaucgagcucaccgaggccagccugguguccgugcgcaagagcucccugcucgccgcgcuggacgaggagcggcccgggcgccaggaggacgccgaguaccaggccuuccgggaggccaucacggaggcgguggaggccccggccgccgcccgcggcagcggguccgagaccguccccaaggcggaggccggccccgagagcgccgccggcgggcaggaggaggaggagggcgaggacgaggaggagcuguccgggaccaaggugagcgcccccuacuacuccagcuggggcacccucgaguaccacaacgcgaugguggucgggacggaggaggccgaggacggcuccgccggcgugcgggugcuguaccuguacccgacccacaagagccucaagcccugccccuucuuccuggaggggaagugccgcuucaaggagaacugccgguucucccacggccaggucgugagccuggacgagcuccgccccuuccaggacccggaccuguccagccugcaggccgggagcgccugccucgcgaagcaccaggacggccuguggcacgccgcccggaucaccgacguggacaacggcuacuacaccgucaaguucgacucccugcuccugcgcgaggccgugguggagggggacggcauccugccgccccuccggacggaggccaccgagagcgacuccgacagcgacgggaccggcgacuccagcuacgcgcgcgucgugggguccgacgccguggacagcgggaccugcuccagcgccuucgccggcugggagguccacacgcgggggaucggcucccgccugcugaccaagaugggguacgaguucggcaaggggcucggccggcacgcggagggccgcguggagcccauccacgccgugguccugccccggggcaagagccuggaccagugcguggagacccuccagaagcagacccgcgugggcaaggccgggacgaacaagccgccccggugccgcggccgcggggcccggcccggcggccgccccgcgccccggaacgucuucgacuuccugaacgagaagcugcaggggcaggcccccggcgcccucgaggccggggccgcccccgcgggccgccgguccaaggacauguaccacgccagcaaguccgccaagcgcgcccugagccugcgccucuuccagaccgaggagaagaucgagcggacccagcgggacauccgcuccauccaggaggcccuggcgcggaacgccggccgccacagcguggccuccgcccagcugcaggagaagcucgcgggggcccagcggcagcugggccagcugcgcgcccaggaggccgggcuccagcaggagcagcggaaggccgacacccacaagaagaugacggaguucuga

SEQ ID NO: 38944 - RNA, 2622 nt, Artificial Sequence
  derived and/or modified sequence opt1 from ZHX1__Homo_sapiens__NP_009153
auggccagccgccggaaguccaccacccccugcauggugcuggccagcgagcaggaccccgaccucgagcugaucuccgaccuggacgagggcccgcccguccucacgcccguggagaacacccgcgcggagagcaucuccagcgacgaggaggugcacgaguccgucgacagcgacaaccagcagaacaagaagguggagggcggguacgagugcaaguacugcaccuuccagacccccgaccugaacauguucacguuccacguggacuccgagcaccccaacgucgugcugaacagcuccuacgugugcgucgagugcaacuuccucaccaagcgguacgacgcccugagcgagcacaaccugaaguaccaccccggggaggagaacuucaagcucaccauggugaagcgcaacaaccagaccaucuucgagcagacgaucaacgaccugaccuucgacggcuccuucgugaaggaggagaacgccgagcaggccgagagcaccgaggucuccagcuccgggaucagcaucuccaagacccccaucaugaagaugaugaagaacaagguggagaacaagcggaucgccgugcaccacaacagcgucgaggacgugccggaggagaaggagaacgagaucaagcccgaccgcgaggagaucguggagaaccccagcuccagcgcguccgagagcaacacguccaccagcaucgucaaccggauccaccccuccaccgccagcaccguggugacgccggccgccguccugcccggccucgcccaggugaucaccgcgguguccgcccagcagaacagcaaccugauccccaagguccugauccccgugaacuccaucccgaccuacaacgccgcccucgacaacaacccccugcugcucaacaccuacaacaaguuccccuaccccacgaugagcgagaucaccguccuguccgcgcaggccaaguacaccgaggagcagaucaagaucugguucagcgcccagcgccugaagcacggcguguccuggaccccggaggagguggaggaggcccggcgcaagcaguucaacgggacgguccacaccgugccccagaccaucaccgugauccccacgcacaucagcaccggcuccaacgggcuccccagcauccugcagaccugccagaucgucggccagccggggcuggugcucacccagguggccggcacgaacacccugcccgucaccgcgcccaucgcccugaccguggccggcgugcccucccagaacaacauccagaagucccaggucccggccgcccagcccacggcggagaccaagcccgccaccgccgccgugccgaccagccagagcgugaagcacgagaccgcccucgucaaccccgacagcuucgggauccgggcgaagaagacgaaggagcagcuggccgagcugaagguguccuaccucaagaaccaguucccccacgacagcgagaucauccgccugaugaagaucaccggccugaccaagggggagaucaagaagugguucuccgacacccgguacaaccagcgcaacagcaaguccaaccagugccuccaccugaacaacgacagcuccacgaccaucaucaucgacagcuccgacgagaccaccgagagccccacggugggcaccgcccagccgaagcaguccuggaaccccuuccccgacuucacgccccagaaguucaaggagaagaccgccgagcagcugcggguccuccaggcgagcuuccugaacuccagcgugcugaccgacgaggagcucaaccgccugcgggcccagaccaagcugacccgccgggagaucgacgccugguucaccgagaagaagaaguccaaggcccucaaggaggagaagauggagaucgacgagagcaacgccggcagcuccaaggaggaggcgggggagacgagcccggccgacgaguccggcgcccccaagagcggguccaccggcaagaucugcaagaagacccccgagcagcugcacaugcucaagagcgccuucgugcgcacccaguggcccuccccggaggaguacgacaagcuggccaaggagagcgggcuggcgcggacggacaucgucuccugguucggcgacacccgcuacgccuggaagaacggcaaccugaagugguacuacuacuaccagagcgccaacuccagcuccaugaacgggcucagcucccugcgcaagcggggccgcgggcggcccaagggccgcgggcggggccgcccccggggccgcccccgggggagcaagcgcaucaacaacugggaccggggcccgucccugaucaaguucaagaccgggaccgccauccugaaggacuacuaccucaagcacaaguuccugaacgagcaggaccuggacgagcucgugaacaagagccacaugggcuacgagcagguccgcgagugguucgccgagcggcagcgccgguccgagcuggggaucgagcuguucgaggagaacgaggaggaggacgaggugaucgacgaccaggaggaggacgaggaggagacggacgacagcgacaccugggagccgccccgccacgugaagcggaagcucagcaaguccgacgacuga

SEQ ID NO: 38945 - RNA, 2514 nt, Artificial Sequence
  derived and/or modified sequence opt1 from ZHX2__Homo_sapiens__XP_011515234
auggccagcaagcgcaaguccaccacccccugcauggugcggacgagccaggucguggagcaggacgugccggaggaggucgaccgcgccaaggagaagggcaucgggacgccccagcccgacguggcgaaggacuccugggccgccgagcuggagaacagcuccaaggagaacgaggugaucgaggucaagagcaugggcgagucccagagcaagaagcuccagggcggguacgagugcaaguacugccccuacuccacccagaaccugaacgaguucaccgagcacguggacaugcagcacccgaacgugauccugaacccccucuacgucugcgccgagugcaacuucaccaccaagaaguacgacagccuguccgaccacaacagcaaguuccaccccggggaggccaacuucaagcugaagcucaucaagcggaacaaccagaccgugcuggagcaguccaucgagaccacgaaccacguggucagcaucaccaccuccggccccggcaccggggacagcgacuccggcaucagcguguccaagacgccgaucaugaagcccgggaagcccaaggcggacgccaagaaggugcccaagaagccggaggagaucacccccgagaaccacgucgagggcaccgcccgccuggugaccgacacggccgagauccucagccggcucgggggcguggagcugcugcaggacacccugggccacgucaugcccagcgugcagcugcccccgaacaucaaccucgugcccaagguccccgugccccugaacaccaccaaguacaacuccgcgcuggacacgaacgccaccaugaucaacagcuucaacaaguucccguaccccacccaggccgagcucuccuggcugaccgccgccagcaagcaccccgaggagcacauccgcaucugguucgcgacgcagcggcugaagcacgggaucuccuggagccccgaggagguggaggaggcccgcaagaagauguucaacggcaccauccaguccgucccgcccaccaucaccgugcuccccgcccagcuggcccccacgaaggucacccagccgauccugcagaccgcccuccccugccagauccuggggcagaccagccuggugcucacccaggugacguccggcagcaccaccgucuccugcagccccaucacgcuggcgguggccggcgugaccaaccacgggcagaagcggccgcuggucacgccccaggccgcccccgagcccaagcgcccgcacaucgcccaggugcccgagcccccgcccaagguggcgaacccgccccucacccccgccuccgaccggaagaagaccaaggagcagaucgcccaccugaaggccagcuuccugcagucccaguuccccgacgacgccgaggucuaccgccucaucgaggugaccggccuggcgcggagcgagaucaagaagugguucuccgaccaccgcuaccggugccagcgcgggaucgugcacaucaccagcgagucccuggccaaggaccagcucgccaucgccgcgagccggcacggccgcaccuaccacgccuaccccgacuucgcgccccagaaguucaaggagaagacccaggggcaggucaagauccuggaggacagcuuccugaaguccagcuuccccacgcaggccgagcucgaccggcugcgcguggagaccaagcugucccggcgcgagaucgacagcugguucuccgagcgccggaagcuccgcgacagcauggagcaggccgugcuggacuccaugggcagcggcaagaaggggcaggacgucggcgccccgaacggggcccugucccggcucgaccagcugagcggcgcccagcugaccuccagccuccccucccccagccccgccaucgccaagucccaggagcagguccaccuccugcgcagcaccuucgcgcggacgcaguggccgacgccccaggaguacgaccagcuggccgccaagaccgggcuggugcgcaccgagaucgugcggugguucaaggagaaccgcugccugcugaagaccggcaccgugaaguggauggagcaguaccagcaccagcccauggccgacgaccacggcuacgacgccguggcgcggaaggccaccaagcccauggccgaguccccgaagaacgggggcgacgucgugccccaguacuacaaggaccccaagaagcucugcgaggaggaccuggagaagcuggugacccgcgucaagguggggagcgagccggccaaggacugccuccccgcgaagcccagcgaggccacguccgaccggagcgagggcuccagccgcgacgggcagggcuccgacgagaacgaggagagcuccguggucgacuacguggaggugaccgucggcgaggaggacgccaucagcgaccgguccgacagcuggucccaggccgccgcggagggggugagcgagcuggccgaguccgacagcgacugcgugcccgccgaggccggccaggccuga

SEQ ID NO: 38946 - RNA, 1344 nt, Artificial Sequence
  derived and/or modified sequence opt1 from ZIC1__Homo_sapiens__NP_003403
augcugcucgacgccggcccccaguacccggccaucggggugaccaccuucggcgcgagccgccaccacuccgccggggacgucgccgagcgggacgugggccuggggaucaaccccuucgccgacggcaugggcgccuucaagcugaaccccagcucccacgagcucgcgagcgccgggcagacggccuucaccucccaggcccccggcuacgcggccgccgccgcccuggggcaccaccaccacccgggccacguggggagcuacuccagcgcggccuucaacuccacccgcgacuuccuguuccggaaccgcggcuucggcgacgccgccgccgcggccagcgcccagcacucccucuucgccgccagcgccgggggcuucgggggcccccacggccacaccgacgccgccgggcaccuccuguuccccggccugcacgagcaggccgccgggcacgcgucccccaacgucgugaacggccagaugcggcugggguucagcggcgacauguacccgcgccccgagcaguacggccaggugacgagcccccgguccgagcacuacgccgcgccccagcugcacggguacggcccgaugaacgucaacauggccgcgcaccacggggccggcgccuucuuccgcuacaugcggcagcccaucaagcaggagcucaucugcaaguggaucgagcccgagcagcuggccaaccccaagaaguccugcaacaagaccuucagcaccaugcacgagcuggugacccacgugacggucgagcacgucgggggcccggagcaguccaaccacaucugcuucugggaggagugcccccgcgagggcaagcccuucaaggccaaguacaagcucgugaaccacauccgggugcacaccggggagaagcccuucccgugccccuuccccggcugcgggaagguguucgcgcgcagcgagaaccugaagauccacaagcggacccacaccggcgagaagcccuucaagugcgaguucgaggggugcgaccgccgguucgccaacagcuccgaccgcaagaagcacaugcacgugcacacgagcgacaagccguaccugugcaagaugugcgacaaguccuacacccaccccagcucccuccggaagcacaugaagguccacgagagcuccagccagggcucccagcccagccccgccgccuccagcggcuacgaguccagcaccccgcccaccaucgugucccccagcacggacaacccgaccaccuccagccugucccccagcagcuccgccgugcaccacaccgcggggcacagcgcccuguccagcaacuucaacgagugguacgucuga

SEQ ID NO: 38947 - RNA, 1599 nt, Artificial Sequence
  derived and/or modified sequence opt1 from ZIC2__Homo_sapiens__NP_009060
augcugcucgacgccggcccccaguucccggccaucggggugggcagcuucgcgcgccaccaccaccacuccgccgccgccgccgcggccgccgccgcggagaugcaggaccgggagcugagccuggccgccgcccagaacggguucgucgacuccgccgcggcccacaugggcgccuucaagcucaaccccggggcccacgagcugagccccggccaguccagcgccuucaccucccagggccccggggcguacccgggcagcgccgccgccgccgcggccgccgccgcccuggggccccacgcggcccacgugggcuccuacagcgggccgcccuucaacuccacccgcgacuuccucuuccggagccgcggcuucggcgacuccgcccccgggggcgggcagcacggccuguucggccccggggccggcgggcugcaccacgcgcacagcgacgcccagggccaccuccuguuccccgggcugcccgagcagcacggcccgcacggcucccagaacgugcucaacgggcagaugcggcugggccugcccggggaggucuucggccgcagcgagcaguaccgccagguggccagcccccggacggaccccuacagcgccgcccagcuccacaaccaguacgggccgaugaacaugaacaugggcaugaacauggcggccgccgccgcccaccaccaccaccaccaccaccaccaccccggcgcguucuuccgguacaugcgccagcagugcaucaagcaggagcugaucugcaaguggaucgaccccgagcagcuguccaaccccaagaaguccugcaacaagaccuucagcaccaugcacgagcucgugacccacgucuccguggagcacgucgggggcccggagcagagcaaccacgugugcuucugggaggagugcccccgggaggggaagcccuucaaggccaaguacaagcuggugaaccacauccgcgugcacacgggcgagaagcccuucccgugccccuuccccgggugcggcaaggucuucgcccgguccgagaaccugaagauccacaagcgcacccacaccggcgagaagcccuuccagugcgaguucgaggggugcgaccggcgcuucgccaacagcuccgaccggaagaagcacaugcacgugcacaccagcgacaagccguaccucugcaagaugugcgacaaguccuacacgcaccccagcucccugcgcaagcacaugaaggugcacgagagcagcccccagggcuccgaguccagcccggccgcguccagcggguacgaguccagcaccccgcccggccuggucucccccagcgccgagccccagagcuccagcaaccucucccccgccgccgcggccgccgccgccgcggccgccgccgccgcggccgccgugagcgccgugcaccggggcgggggcuccgggagcggcggggccggcggcggguccggcgggggcagcggguccggcggcgggggcgggggcgcgggcgggggcgggggcgggagcuccggcgggggcagcggcaccgccgggggccacuccgggcugagcuccaacuucaacgagugguacgucuga

SEQ ID NO: 38948 - RNA, 1404 nt, Artificial Sequence
  derived and/or modified sequence opt1 from ZIC3__Homo_sapiens__NP_003404
augaccaugcugcucgacggcgggccccaguucccgggccugggggugggcagcuucggggcgccccgccaccacgagaugcccaaccgggagcccgccggcaugggccugaacccguucggggacuccacccacgccgccgccgccgccgcggccgccgccgcguucaagcucagccccgccgccgcccacgaccuguccagcggccaguccagcgccuucacgccccagggguccggcuacgcgaacgcccuggggcaccaccaccaccaccaccaccaccaccaccacaccagccagguccccuccuacggcggcgccgccagcgccgcguucaacuccacccgcgaguuccucuuccggcagcgcagcuccgggcugagcgaggccgccuccggcgggggccagcacggccuguucgccgggagcgccuccagccuccacgcgccggccggcauccccgagccgcccuccuaccugcuguuccccgggcuccacgagcagggcgccgggcaccccagccccaccggccacguggacaacaaccaggugcaccugggccugcgcggggagcuguucggccgggccgaccccuaccggccggucgccagcccccgcacggaccccuacgcggccggggcccaguuccccaacuacuccccgaugaacaugaacaugggcgugaacguggccgcgcaccacgggcccggcgccuucuuccgguacaugcgccagcccaucaagcaggagcucagcugcaaguggaucgacgaggcccagcugucccggcccaagaaguccugcgaccgcaccuucagcaccaugcacgagcucgucacccacgugacgauggagcacgugggcgggccggagcagaacaaccacgucugcuacugggaggagugcccccgggagggcaagagcuucaaggccaaguacaagcuggugaaccacauccgcgugcacaccggggagaagcccuuccccugcccguuccccggcugcgggaagaucuucgcccgguccgagaaccugaagauccacaagcgcacccacaccggcgagaagcccuucaagugcgaguucgagggcugcgaccggcgcuucgcgaacagcuccgaccggaagaagcacaugcacguccacacgagcgacaagccguacaucugcaaggugugcgacaaguccuacacccaccccagcucccuccgcaagcacaugaaggugcacgagagccagggguccgacagcucccccgccgccagcuccggcuacgagagcagcacgcccccggccaucgccuccgcgaacagcaaggacaccaccaagacccccuccgccguccagaccagcaccucccacaaccccgggcugcccccgaacuucaacgagugguacguguga

SEQ ID NO: 38949 - RNA, 1155 nt, Artificial Sequence
  derived and/or modified sequence opt1 from ZIC4__Homo_sapiens__NP_001161850
augcccccguucugccgcaacgccaagcugggccuccugagcuuccugaucugcgccgggcggucccuccugccccugggcaagaacgcguucuggcucgagcgcaucgagaacaacaacacccugugggagaaggcccagagccagaagaugcgguacaagaccucccuggugaugcgcaagcggcuccgccuguaccggaacacgcugaaggagagcuccagcuccagcgggcaccacggcccccagcucaccgccgccuccagccccuccgucuucccggggcugcacgaggagccgccccaggccagccccucccgcccccugaacggccuccugcggcugggccuccccggggacauguacgcgcgccccgagcccuucccgcccggccccgccgcccggagcgacgcccuggcggccgccgccgcccugcacggguacggcgggaugaaccucaccgugaaccuggcggcgccccacggccccggcgccuucuuccgcuacaugcggcagcccaucaagcaggagcugaucugcaaguggcucgccgccgacgggaccgccacgcccucccugugcagcaagaccuucuccaccaugcacgagcuggugacccacgucacgguggagcacgugggcgggcccgagcaggccaaccacaucugcuucugggaggagugcccgcgccagggcaagcccuucaaggccaaguacaagcucgucaaccacauccgggugcacaccggcgagaagcccuuccccugcccguuccccgggugcggcaagguguucgcccgcagcgagaaccugaagauccacaagcggacccacaccggggagaagcccuuccgcugcgaguucgagggcugcgagcggcgcuucgccaacuccagcgaccggaagaagcacagccacguccacacguccgacaagcccuacacgugcaaggugcgcgggugcgacaagugcuacacccacccgagcucccugcgcaagcacaugaaggugcacggccggagcccgccgcccuccagcggcuacgacuccgcgacccccagcgcccucgucucccccagcuccgacugcgggcacaagagccagguggccuccagcgccgccguggcggcccgcaccgccgaccuguccgaguga

SEQ ID NO: 38950 - RNA, 1992 nt, Artificial Sequence
  derived and/or modified sequence opt1 from ZIC5__Homo_sapiens__NP_149123
auguuccugaaggccggccgcgggaacaaggugcccccgguccggguguacggccccgacugcgugguccucauggagcccccccugagcaagcgcaacccgcccgcccugcggcucgcggaccuggccaccgcccaggugcagccccugcagaacaugaccggguuccccgcccucgccggcccgcccgcgcacucccagcugcgcgccgccguggcccaccugcggcuccgcgaccugggggcggaccccggcgucgccacgaccccccugggcccggagcacauggcccaggccagcacccucgggcuguccccccccagccaggccuuccccgcgcacccggaggcccccgccgccgccgcgcgggccgccgcccugguggcccaccccggcgcgggguccuaccccugcggcgggggcagcuccggcgcccagccgagcgcccccccccccccggcccccccccuccccccgacccccucccccccgcccccccccccgcccccccccccgcccgcccugagcggguacacgaccaccaacuccggcgggggcggcagcuccgggaagggccacagccgcgacuucgugcugcggcgcgaccucuccgcgaccgcccccgccgccgcgaugcacggggccccccugggcggggagcagcggagcggcacgggcuccccgcagcaccccgccccccccccgcacagcgccgggauguucaucuccgccagcggcaccuacgcggggcccgacggcagcgggggccccgcccuguuccccgcccuccacgacaccccgggcgcccccgggggccacccccacccccugaacgggcagaugcgccugggccucgccgcggccgccgccgccgcggccgccgagcuguacgggcgggccgagccgcccuucgcgccccgcuccggcgacgcccacuacggcgccgucgccgccgcggccgccgccgcccugcacggguacggcgcggugaaccucaaccugaaccuggccgccgccgccgcggccgccgccgcggggccgggcccccaccuccagcaccacgccccccccccggcccccccccccccgcccgcccccgcccagcacccccaccagcaccacccgcaccugcccggcgcggccggggccuuccugcgguacaugcgccagcccaucaagcaggagcucaucugcaaguggaucgaccccgacgagcuggccggccugccgcccccccccccgcccccccccccgcccccccccccgccccccgccgggggcgcgaagccgugcagcaagaccuucgggacgaugcacgagcucgugaaccacgucaccguggagcacgugggcggccccgagcaguccagccacgucugcuucugggaggacugcccccgggaggggaagcccuucaaggccaaguacaagcugaucaaccacauccgcgugcacaccggcgagaagccguuccccugccccuuccccgggugcggcaagguguucgcccgguccgagaaccugaagauccacaagcgcacccacacgggggagaagccguucaagugcgaguucgacggcugcgaccggaaguucgccaacagcuccgaccgcaagaagcacagccacguccacaccuccgacaagcccuacuacugcaagauccgcggcugcgacaagagcuacacccaccccuccagccuccggaagcacaugaagauccacugcaagucccccccgcccagccccgggccccugggcuacuccagcguggggaccccggugggcgccccccugucccccguccucgaccccgcgcgcagccacuccagcacgcugagcccgcaggugaccaaccugaacgagugguacgugugccaggccuccggggcccccagccaccuccacacccccuccagcaacggcaccacguccgagaccgaggacgaggagaucuacggcaaccccgaggucgugcggaccauccacuga

SEQ ID NO: 38951 - RNA, 1464 nt, Artificial Sequence
  derived and/or modified sequence opt1 from ZIK1__Homo_sapiens__NP_001010879
auggccgccgcggcccugcgcgcccccacccaggugaccgucagcccggagacgcacauggaccucaccaagggcugcgugaccuucgaggacaucgccaucuacuucucccaggacgagugggggcugcuggacgaggcccagcggcuccuguaccuggaggugaugcucgagaacuucgcgcuggucgccagccugggcugcgggcacggcaccgaggacgaggagacgcccuccgaccagaacgugagcgugggggucucccagagcaaggccggcuccagcacccagaagacccaguccugcgagaugugcgugcccgugcucaaggacauccugcaccuggccgaccuccccggccagaagccguaccuggucggggagugcaccaaccaccaccagcaccagaagcaccacagcgcgaagaagucccugaagcgcgacauggaccgggccagcuacgugaagugcugccucuucugcaugucccugaagcccuuccgcaagugggaggugggcaaggaccugcccgccaugcuccggcugcugcgcagccucgucuuccccgggggcaagaagccggggacgaucaccgagugcggcgaggacauccggucccagaagucccacuacaagagcggcgagugcgggaaggccagccgccacaagcacacccccguguaccacccccggguguacaccggcaagaagcuguacgagugcuccaagugcgggaaggccuuccgcggcaaguacagccugguccagcaccagcgggugcacacgggcgagcgccccugggagugcaacgagugcgggaaguucuucagccagaccucccaccucaacgaccaccggcgcauccacaccggcgagcggccguacgagugcagcgagugcgggaagcuguuccgccagaacuccagccugguggaccaccagaagauccacaccggcgcgcggcccuacgagugcucccagugcggcaagagcuucucccagaaggccacgcucgucaagcaccagcgcgugcacaccggggagcggcccuacaagugcggcgagugcgggaacagcuucucccagagcgccauccugaaccagcaccgccggauccacaccggcgccaagcccuacgagugcgggcagugcggcaaguccuucagccagaaggccacccugaucaagcaccagcgcgugcacacgggggagcgcccguacaagugcggcgacugcggcaaguccuucagccaguccagcauccucauccagcaccggcgcauccacaccggggcgcggcccuacgagugcggccagugcgggaaguccuucagccagaaguccggccugauccagcaccaggucgugcacaccggggagcgccccuacgagugcaacaagugcggcaacagcuucagccagugcuccagccugauccaccaccagaagugccacaacaccuga

SEQ ID NO: 38952 - RNA, 1584 nt, Artificial Sequence
  derived and/or modified sequence opt1 from ZIM2__Homo_sapiens__NP_001139799
auguaccagcccgaggacgacaacaacagcgacgugaccuccgacgacgacaugacccgcaaccggcgcgagagcuccccgccccacagcguccacuccuucagcggcgaccgggacugggaccgccgggggcgcucccgggacauggagccccgcgaccgguggagccacacgcgcaacccccggucccgcaugccgccccgggaccugagccuccccgugguggccaagaccuccuucgagauggaccgcgaggacgaccgggacagccgcgccuacgagucccggagccaggacgcggaguccuaccagaacgucguggaccuggccgaggaccgcaagccccacaacaccauccaggacaacauggagaacuaccggaagcugcucagccugggcuuccuggcccaggacuccgugccggccgagaagcgcaacaccgagaugcucgacaaccugcccagcgccgggucccaguuccccgacuucaagcaccugggcacguuccucgucuucgaggagcuggugaccuucgaggacgugcuggucgacuucagccccgaggagcucagcucccugagcgcggcccagcggaaccuguaccgcgaggugaugcucgagaacuaccgcaaccuggugucccuggggcaccaguucagcaagccggacaucaucucccggcucgaggaggaggagagcuacgccauggagaccgacucccgccacaccgucaucugccagggcgagagccacgacgacccccuggagccccaccagggcaaccaggagaagcugcucacgcccaucaccaugaacgacccgaagacccugacccccgagcgguccuacgggagcgacgaguucgagcgcuccagcaaccuguccaagcagagcaaggacccccucggcaaggacccccaggaggggacggccccgggcaucugcaccagcccccaguccgcgucccaggagaacaagcacaaccggugcgaguucugcaagcgcaccuucagcacccagguggcccugcggcgccacgagcggauccacacggggaagaagcccuacgagugcaagcagugcgccgaggccuucuaccugaugccccaccucaaccgccaccagaagacccacuccggccggaagaccagcggcugcaacgaggggcgcaagccgagcgugcagugcgccaaccugugcgagcggguccgcauccacucccaggaggacuacuucgagugcuuccagugcggcaaggcguuccugcagaacgugcaccuccugcagcaccugaaggcccacgaggccgcccgggugcucccgcccgggcugagccacuccaagaccuaccugauccgcuaccagcggaagcacgacuacgucggcgagcgcgccugccagugcugcgacugcggccggguguucagccgcaacuccuaccucauccagcacuaccgcacgcacacccaggagcggcccuaccagugccagcugugcgggaagugcuucggccgccccagcuaccugacccagcacuaccagcuccacucccaggagaagaccguggagugcgaccacugcuga

SEQ ID NO: 38953 - RNA, 1584 nt, Artificial Sequence
  derived and/or modified sequence opt1 from ZKSCAN1__Homo_sapiens__NP_001273983
auguggggccaggacagcacccugcaggacacgcccccgcccgaccccgagaucuuccgccagcgguuccgccgguucugcuaccagaacacguucgggccccgcgaggcccucucccggcugaaggagcugugccaccaguggcuccgcccggagaucaacaccaaggagcagauccuggagcugcucgugcuggagcaguuccugagcauccuccccaaggagcugcaggucuggcugcaggaguaccggcccgacuccggcgaggaggccgugacccuccuggaggaccuggagcucgaccugagcgggcagcagguccccggccaggugcacgggccggagaugcuggcgcgcggcauggugccccucgaccccgugcaggaguccagcuccuucgaccugcaccacgaggccacccagagccacuucaagcacuccagccggaagccccgccugcuccagucccgggcccugccggccgcccacauccccgcgccgccccacgagggcagcccccgcgaccaggccauggccuccgcccuguucacggcggacagccaggccauggucaagaucgaggacauggccgugucccucauccuggaggagugggggugccagaaccuggcccggcgcaaccucagccgggacaaccgccaggagaacuacggcuccgccuucccccagggcggggagaaccggaacgagaacgaggagagcaccuccaaggcggagaccagcgaggacagcgccucccgcggggagaccacgggccggagccagaaggaguucggcgagaagcgcgaccaggaggggaagaccggcgagcggcagcagaagaaccccgaggagaagacccgcaaggagaagcgcgacuccgggcccgccaucggcaaggacaagaagaccaucacgggcgagcgggggccgcgcgagaagggcaaggggcugggccggagcuucucccugagcuccaacuucaccacccccgaggaggugcccaccgggaccaagagccaccgcugcgacgagugcggcaagugcuucacccgguccagcucccucauccgccacaagaucauccacaccggcgagaagcccuacgagugcagcgagugcgggaaggccuucucccugaacagcaaccugguccuccaccagcggauccacaccggcgagaagccgcacgagugcaacgagugcgggaaggccuucucccacagcuccaaccugauccugcaccagcgcauccacagcggcgagaagcccuacgagugcaacgagugcgggaaggcguucucccagagcagcgaccucacgaagcaccagcggauccacaccggcgagaagcccuacgagugcuccgagugcggcaaggccuucaaccgcaacagcuaccugauccugcaccggcgcauccacacccgggagaagcccuacaagugcaccaagugcgggaaggccuucacgcgcuccagcacccucacccugcaccaccggauccacgcccgcgagcgggccuccgaguacagcccggcgucccuggacgccuucggcgccuuccucaagagcugcguguga

SEQ ID NO: 38954 - RNA, 1173 nt, Artificial Sequence
  derived and/or modified sequence opt1 from ZKSCAN3__Homo_sapiens__NP_001229824
auggcccugcucacccccgccccgggcagccaguccagccaguuccagcugaugaaggcgcugcucaagcacgaguccguggggagccagccccugcaggaccgcguccuccaggugcccgugcuggcccacggcgggugcugccgggaggacaaggucguggccucccgccugacccccgagagccagggccugcucaagguggaggacgucgcccugacgcugaccccggaguggacccagcaggacuccagccaggggaaccucugccgggacgagaagcaggagaaccacggcucccuggugagccugggcgacgagaagcagaccaagucccgcgaccucccgcccgccgaggagcugcccgagaaggagcacgggaagaucagcugccaccuccgggaggacaucgcgcagauccccacgugcgccgaggccggcgagcaggaggggcgccugcagcggaagcagaagaacgccaccggcgggcgccggcacaucugccacgagugcggcaaguccuucgcgcagagcuccggccugagcaagcaccgccggauccacaccggggagaagcccuacgagugcgaggagugcggcaaggccuucaucggguccagcgcccuggugauccaccagcgcguccacaccggcgagaagcccuacgagugcgaggagugcggcaaggccuucucccacagcagcgaccucaucaagcaccagcggacgcacaccggggagaagcccuacgagugcgacgacugcggcaagaccuucucccagagcugcucccugcuggagcaccaccgcauccacaccggggagaagccguaccagugcagcaugugcggcaaggccuuccggcgcuccagccaccuccugcggcaccagcgcauccacacgggggacaagaacgugcaggagcccgagcagggcgaggcguggaagucccggauggagagccagcuggagaacguggagacccccauguccuacaagugcaacgagugcgagcgcagcuucacccagaacaccggccucaucgagcaccagaagauccacacgggggagaagcccuaccagugcaacgccugcggcaagggguucacccggaucuccuaccugguccagcaccagcgcagccacgugggcaagaacauccugucccaguga

SEQ ID NO: 38955 - RNA, 831 nt, Artificial Sequence
  derived and/or modified sequence opt1 from ZKSCAN7__Homo_sapiens__NP_001275520
augaccaccgccggccgcgggaaccugggccucaucccccggagcacggccuuccagaagcaggaggggcgccugaccgugaagcaggagccggcgaaccagaccuggggccagggguccagccugcagaagaacuacccgcccgucugcgagaucuuccggcuccacuuccgccagcugugcuaccacgagauguccggcccccaggaggcccugagccggcuccgcgagcugugccggugguggcugaugcccgaggugcacaccaaggagcagauccucgagcugcuggugcucgagcaguuccuguccauccugcccggcgagcuccgcacguggguccagcugcaccaccccgagagcggggaggaggccguggccguggucgaggacuuccagcggcaccuguccggcagcgaggagguguccgcccccgcgcagaagcaggagaugcacuucgaggagaccaccgcccucgggaccacgaaggagagcccgcccaccagcccccugagcggcggguccgcccccggcgcccaccuggagccgcccuacgaccccggcacccaccaccuccccagcggggacuucgcgcagugcaccuccccggugcccacgcugccccaggucggcaacagcggggaccaggccggcgccaccgugcugcgcauggugcggccccaggacaccgucgccuacgaggaccucuccguggacuacacccagaagaaguggaagucccugacgcugucccagcgcgcccuccaguggaacaugaugccggagaaccaccacagcauggcgagccugggcugguccaccauggccuga

SEQ ID NO: 38956 - RNA, 867 nt, Artificial Sequence
  derived and/or modified sequence opt1 from ZMAT3__Homo_sapiens__XP_005247763
augauccugcuccagcacgccgugcugcccccgcccaagcagcccagccccuccccgcccaugagcgucgccacccgcuccaccggcacgcugcagcucccgccccagaagcccuucgggcaggaggcgagccugccccuggccggcgaggaggagcucuccaagggcggggagcaggacugcgcccuggaggagcugugcaagccccucuacugcaagcugugcaacgugacccugaacagcgcccagcaggcccaggcgcacuaccaggggaagaaccacggcaagaagcuccggaacuacuacgccgccaacuccugcccgccgcccgcccgcaugagcaacguggucgagcccgcggccacccccguggugcccgucccgccccagaugggcuccuucaagcccgggggccgggugauccuggccaccgagaacgacuacugcaagcugugcgacgccagcuucuccagccccgccguggcgcaggcccacuaccaggggaagaaccacgccaagcgccuccggcuggccgaggcccaguccaacagcuucuccgagagcuccgagcugggccagcgccgggcgcgcaaggaggggaacgaguucaagaugaugcccaaccggcgcaacauguacacgguccagaacaacagcggccccuacuucaacccccggucccgccagcggaucccgcgcgaccucgccaugugcgugacccccagcggccaguucuacugcagcaugugcaacgugggggccggcgaggagauggaguuccggcagcaccuggaguccaagcagcacaagagcaaggucuccgagcagcgcuaccggaacgagauggagaaccugggguacguguga

SEQ ID NO: 38957 - RNA, 462 nt, Artificial Sequence
  derived and/or modified sequence opt1 from ZMAT4__Homo_sapiens__NP_001129203
augaaguccagcgacaucgaccaggaccuguucaccgacagcuacugcaaggugugcuccgcccagcucaucagcgagucccagcgcgucgcccacuacgagagccggaagcacgcguccaaggugcgccuguacuacaugcugcacccccgggacggcgggugcccggccaagcgccuccggagcgagaacggcuccgacgccgacaugguggacaagaacaagugcugcacccugugcaacaugagcuucacguccgccgucguggccgacagccacuaccaggggaagauccacgcgaagcgccugaagcuccugcugggcgagaagacgccccucaagaccaccgggcugcggcgcaacuaccggugcaccaucugcuccgugagccugaacuccaucgagcaguaccacgcccaccucaagggcagcaagcaccagaccaaccugaagaacaaguga

SEQ ID NO: 38958 - RNA, 3204 nt, Artificial Sequence
  derived and/or modified sequence opt1 from ZMIZ1__Homo_sapiens__NP_065071
augaacagcauggaccgccacauccagcagaccaacgaccggcugcagugcaucaagcagcaccuccagaaccccgccaacuuccacaacgccgcgaccgagcugcuggacuggugcggcgacccccgcgccuuccagcggcccuucgagcagucccucauggggugccugacgguggucagccgcguggccgcccagcagggcuucgaccuggaccucggguaccggcugcuggccgugugcgccgccaaccgcgacaaguucacccccaaguccgccgcccuccugagcuccuggugcgaggagcugggccggcuccugcugcuccgccaccagaagucccggcaguccgacccgcccgggaagcugcccaugcagccgccccugagcuccaugagcuccaugaagcccacccucagccacuccgacggcagcuuccccuacgacuccguccccuggcagcagaacaccaaccagccgcccggcagccuguccguggugacgaccgucuggggcgugaccaacaccagccagucccaggugcugggcaaccccauggcgaacgccaacaaccccaugaaccccgggggcaaccccauggccagcgggaugacgaccagcaaccccggccucaacagcccccaguucgccggccagcagcagcaguucagcgccaaggcggggcccgcccagcccuacauccagcaguccauguacggccgccccaacuaccccgggagcggcggcuucggggccuccuaccccggcgggcccaacgcccccgccggcauggggaucccgccccacacccggccgcccgcggacuucacccagcccgccgccgccgccgcggccgccgccgucgccgcggccgccgccacggcgaccgccaccgccaccgccacgguggccgcgcugcaggagacccagaacaaggacaucaaccaguacggccccaugggccccacccaggccuacaacagccaguucaugaaccagcccgggccccgcggccccgccuccaugggcgggagcaugaaccccgccuccauggccgcggggaugacccccagcgggauguccggcccgcccauggggaugaaccagccccggccgcccggcaucagccccuucgggacgcacggccagcgcaugccccagcagaccuaccccgggccccggccccagucccugcccauccagaacaucaagcgccccuaccccggcgagcccaacuacggcaaccagcaguacgggcccaacagccaguuccccacccagcccggccaguacccggcccccaacccgccccggccccugaccucccccaacuaccccgggcagcgcaugcccagccagcccuccagcggccaguacccgccgcccacggugaacaugggccaguacuacaagcccgagcaguucaacgggcagaacaacaccuucuccggcagcagcuacuccaacuacagccaggggaacgucaaccggccgccccgccccgugcccguggccaacuacccccacucccccgucccgggcaaccccaccccgcccaugacccccgggagcuccaucccgcccuaccugagccccucccaggacgugaagccgcccuucccgcccgacaucaagccgaacaugagcgcccugccgcccccgcccgccaaccacaacgacgagcuccggcugacguuccccgugcgcgacggcgucgugcuggagcccuuccgccucgagcacaaccuggcgguguccaaccacgucuuccaccuccggcccaccgugcaccagacccucauguggcgcagcgaccuggagcugcaguucaagugcuaccaccacgaggaccggcagaugaacaccaacuggcccgccuccgugcaggucagcgugaacgccacgccccucaccaucgagcgcggcgacaacaagaccucccacaagccccugcaccugaagcacgucugccagccggggcggaacaccauccagaucacggugaccgccugcugcugcagccaccucuucgugcugcagcugguccaccgccccuccgugcggagcgugcuccagggccugcugaagaagcgccuccugcccgcggagcacugcaucaccaagaucaagcggaacuucuccagcgucgccgccagcuccgggaacaccacccugaacggcgaggacgggguggagcagacggccaucaaggugagccucaagugccccaucaccuuccgccggauccagcugccggcccgcggccacgacugcaagcacguccagugcuucgaccuggaguccuaccugcagcucaacugcgagcggggcaccuggcgcugccccgugugcaacaagaccgcgcugcuggaggggcucgagguggaccaguacauguggggcauccugaacgccauccagcacagcgaguucgaggaggucacgaucgacccgaccugcuccuggcggcccgugccgaucaagagcgaccugcacaucaaggacgaccccgacgggauccccuccaagcgcuucaagaccaugagccccucccagaugaucaugccgaacgugauggagaugaucgccgcccucggccccgggcccagccccuacccgcugccgccgccgcccggcggcaccaacuccaacgacuacagcucccaggggaacaacuaccagggccacgggaacuucgacuucccccacggcaaccccgggggcacgagcaugaacgacuucaugcacggcccgccccagcugucccacccgcccgacaugcccaacaacauggccgcgcucgagaagccccugagccaccccaugcaggagaccaugccccacgccggguccagcgaccagccgcaccccuccauccagcagggccugcacgucccccaccccagcagccaguccgggccgccccuccaccacagcggcgcgccgccgccgccgcccucccagccgccccggcagccgccccaggccgcccccagcucccacccccacagcgaccugaccuucaaccccuccagcgcgcuggagggccaggccggggcccagggcgccuccgacaugcccgagcccagccucgaccugcugcccgagcucaccaaccccgacgagcugcuguccuaccucgacccgcccgaccugcccagcaacuccaacgacgaccugcucagccuguucgagaacaacuga

SEQ ID NO: 38959 - RNA, 4200 nt, Artificial Sequence
  derived and/or modified sequence opt1 from ZMYM2__Homo_sapiens__XP_011533519
augugcauccugcucagcgccguggucaccuggauccccucccuggaccugcucguguucuucggcauggacaccagcuccgucgggggccuggagcugacggaccagaccccggugcuccuggggagcaccgccauggcgaccucccugacgaacgugggcaacagcuucuccgggcccgccaacccccucgugagccgcuccaacaaguuccagaacagcuccgucgaggacgacgacgacgugguguucaucgagcccguccagccgcccccgcccagcgugcccguggucgccgaccagcggaccaucaccuucaccuccagcaagaacgaggagcugcagggcaacgacuccaagaucacgcccagcuccaaggagcuggccagccagaagggcuccgugagcgagaccaucgugaucgacgacgaggaggacauggagaccaaccaggggcaggagaagaacagcuccaacuucaucgagcgccggccgcccgagaccaagaaccgcacgaacgacgucgacuucagcaccuccagcuucucccggagcaaggugaacgccggcauggggaacuccggcaucaccaccgagcccgacagcgagauccagaucgcgaacgugacgacccucgagaccggggucuccagcgugaacgacggccagcuggagaacaccgacggccgcgacaugaaccugaugaucacgcacgugaccucccuccagaacaccaaccugggggacgucagcaacggccugcaguccagcaacuucggggugaacauccagaccuacacgcccucccucaccagccagaccaagaccggcgugggccccuucaaccccgggcggaugaacgucgccggcgacguguuccagaacggggaguccgccacgcaccacaacccggacagcuggaucucccagagcgccagcuucccccgcaaccagaagcagcccggcgucgacucccugagccccguggcgucccugccgaagcagaucuuccagcccagcgugcagcagcagcccaccaagcccgucaaggugaccugcgccaacugcaagaagccgcuccagaaggggcagaccgccuaccagcggaagggcuccgcccaccuguucugcagcacgaccugccuguccagcuucucccacaagcccgcccccaagaagcucugcgugaugugcaagaaggacaucaccaccaugaagggcacgaucgucgcccagguggacagcuccgagagcuuccaggaguucugcuccaccagcugccugucccuguacgaggacaagcagaaccccaccaagggggcccucaacaagagccgcugcaccaucugcggcaagcugaccgagauccggcacgagguguccuucaagaacaugacgcacaagcugugcagcgaccacugcuucaaccgcuaccggauggcgaacgggcucaucaugaacugcugcgagcagugcggcgaguaccugccgagcaagggggccggcaacaacguccuggugaucgacggccagcagaagcgcuucugcugccaguccugcgugagcgaguacaagcaggucgggucccaccccagcuuccucaaggaggugcgggaccacaugcaggacuccuuccugaugcagcccgagaaguacggcaagcugacgaccugcaccgggugccgcacccagugccgguucuucgacaugacccagugcaucggcccgaacggguacauggagcccuacugcagcaccgccugcaugaacucccacaagaccaaguacgccaagagccagucccucggcaucaucugccacuucugcaagcgcaacagccugccccaguaccaggcgacgaugcccgacggcaagcuguacaacuucugcaacuccagcugcguggccaaguuccaggcccucuccaugcagagcuccccgaacgggcaguucgucgcccccagcgacauccagcugaagugcaacuacugcaagaacuccuucugcagcaagcccgagauccuggagugggagaacaaggugcaccaguucugcuccaagaccugcagcgacgacuacaagaagcuccacugcaucgugaccuacugcgaguacugccaggaggagaagacccugcacgagacggucaacuucagcggcgugaagcggcccuucugcuccgaggggugcaagcugcucuacaagcaggacuucgcgcgccggcugggccugcgcugcgugaccugcaacuacugcagccagcucugcaagaagggcgccaccaaggagcuggacggggucgugcgcgacuucugcuccgaggacugcugcaagaaguuccaggacugguacuacaaggccgcccggugcgacugcugcaagagccagggcacccugaaggagcgcgugcaguggcgcggggagaugaagcacuucugcgaccagcacugccugcuccgguucuacugccagcagaacgagccgaacaugacgacccagaagggccccgagaaccugcacuacgaccaggggugccagaccucccggaccaagaugacgggcagcgccccgccgcccucccccacccccaacaaggagaugaagaacaaggcgguccugugcaagccccucaccaugaccaaggccacguacugcaagccccacaugcagaccaagagcugccagaccgacgacaccuggcgcacggaguacgugcccgugcccauccccgucccgguguacauccccgugcccaugcacauguacucccagaacauccccgucccgaccaccgugcccgugcccgucccggugcccguguuccugcccgcgccccuggacagcuccgagaagaucccggccgccaucgaggagcucaagagcaaggucuccagcgacgcccuggacaccgagcugcucacgaugaccgacaugauguccgaggacgagggcaagaccgagaccacgaacaucaacagcgugaucaucgagaccgacaucaucggguccgaccugcugaagaacagcgaccccgagacccaguccagcaugcccgacgugcccuacgagccggaccucgacaucgagaucgacuucccccgggccgccgaggagcuggacauggagaacgaguuccugcucccgcccgucuucggcgaggaguacgaggagcagccccgcccccggagcaagaagaagggggccaagcgcaaggcgguguccggcuaccagagccacgacgacuccagcgacaacuccgagugcagcuuccccuucaaguacaccuacggggugaacgccuggaagcacugggucaagacccggcagcuggacgaggaccugcucgugcuggacgagcugaaguccagcaaguccgugaagcucaaggaggaccugcugagccacacgaccgccgagcucaacuacggccuggcccacuucgucaacgagauccgccggcccaacggcgagaacuacgccccggacuccaucuacuaccugugccucgggauccaggaguaccugugcggcagcaaccgcaaggacaacaucuucaucgaccccggguaccagaccuucgagcaggagcugaacaagauccuccgguccuggcagcccagcauccugcccgacggcuccaucuucagccgcguggaggaggacuaccuguggcggaucaagcagcucgggucccacagcccgguggcgcugcugaacacccucuucuacuucaacacgaaguacuucggccugaagaccgucgagcagcaccuccgccuguccuucggcaccguguuccggcacuggaagaagaacccccugaccauggagaacaaggccugccugcgcuaccaggugagcagccucugcgggacggacaacgaggacaagaucaccaccggcaagcgcaagcacgaggacgacgagcccgucuucgagcagaucgagaacaccgccaaccccucccggugcccggugaagauguucgagugcuaccugagcaagagcccccagaaccugaaccagcgcauggacgucuucuaccuccagcccgagugcuccuccagcacggacucccccgugugguacaccagcaccucccuggaccggaacacccuggagaacaugcucgugcgcguccugcuggugaaggacaucuacgacaaggacaacuacgagcucgacgaggacacggacuga

SEQ ID NO: 38960 - RNA, 4077 nt, Artificial Sequence
  derived and/or modified sequence opt1 from ZMYM3__Homo_sapiens__NP_001164633
auggaccccagcgacuucccgucccccuucgacccccugacccuccccgagaagccgcuggccggcgaccugcccguggacauggaguucggggaggaccuccuggagagccagaccgcccccacgcgcggcugggcgcccccggggcccucccccagcuccggcgcccuggaccuccuggacacccccgccgggcuggagaaggacccgggcguccucgacggcgccaccgagcugcuggggcucggcgggcugcuguacaaggcccccagcccccccgagguggaccacggcccggaggggacccucgcgugggacgccggcgaccagacgcuggagcccggccccgggggccagacccccgagguggucccgcccgaccccggggccggcgccaacuccugcagccccgagggccugcucgagccgcuggcgcccgacucccccaucacccugcagagcccccacaucgaggaggaggagaccacguccaucgccaccgcccggcgcgggagcccgggccaggaggaggagcucccccaggggcagccccaguccccgaacgccccccccagccccuccgugggcgagacccugggggacggcaucaacagcucccagaccaagccgggcgggagcuccccccccgcccaccccagccugccgggcgacgggcucacggcgaaggccagcgagaagccccccgagcggaagcgcuccgagcgggugcgccgggccgagcccccgaagcccgaggucguggacagcaccgaguccauccccgugagcgacgaggacuccgacgccauggucgacgaccccaacgacgaggacuucgugccguuccgcccccggcgcagcccccggaugucccugcgcagcuccgugagccagcgggccggccgcuccgcggucgggaccaagaugaccugcgcccacugccggacgccccugcagaagggccagaccgccuaccagcgcaagggccucccgcagcuguucugcagcuccagcugccugaccaccuucuccaagaagcccagcgggaagaagacgugcaccuucugcaagaaggagaucuggaacaccaaggacuccgugguggcccagaccggcagcgggggcuccuuccacgaguucugcacgagcgucugccucagccuguacgaggcccagcagcagcggcccaucccccaguccggggacccggcggacgccacccgcugcagcaucugccagaagaccggcgaggugcugcacgagguguccaacggcagcgucgugcaccggcucugcuccgacagcugcuucuccaaguuccgcgccaacaaggggcugaagaccaacugcugcgaccagugcggcgccuacaucuacacgaagaccgggagccccggccccgagcugcucuuccacgagggccagcagaagcgguucugcaacaccaccugccugggggccuacaagaagaagaacacgcgcguguacccgugcgucuggugcaagacccugugcaagaacuucgagaugcucucccacguggaccgcaacggcaagaccagccuguucugcucccugugcugcaccacgagcuacaaggugaagcaggcggggcucaccggccccccccggcccugcuccuucugccgccggagccuguccgacccgugcuacuacaacaaggucgaccgcaccguguaccaguucugcagccccuccugcuggaccaaguuccagcggaccagccccgaggggggcauccaccugagcugccacuacugccacucccucuucagcggcaagcccgagguccuggacuggcaggaccagguguuccaguucugcugccgcgacugcugcgaggacuucaagcggcugcgcgggguggucucccagugcgagcacugccggcaggagaagcuccugcacgagaagcugcgcuucagcggcguggagaaguccuucugcagcgaggggugcgugcugcucuacaagcaggacuucacgaagaagcugggccugugcugcaucaccugcaccuacugcucccagaccugccagcggggggucacggagcagcucgacggcagcaccugggacuucugcuccgaggacugcaagagcaaguaccugcugugguacugcaaggccgcccgcugccacgccugcaagcggcagggcaagcuccuggagaccauccacuggcgcgggcagauccggcacuucugcaaccagcagugccugcuccgcuucuacucccagcagaaccagccgaaccuggacacccagagcggccccgagucccugcucaacagccagucccccgagagcaagccccagacgccgucccagaccaagguggagaacagcaacaccauccccgugaagacccgguccgcgcccacggcccccaccccgcccccccccccgccccccgccaccccccgcaagaacaaggccgccaugugcaagccgcugaugcagaaccggggggucagcugcaagguggagaugaagagcaagggcucccagaccgaggaguggaagccccaggugaucguccugcccauccccgugccgaucuucgugcccguccccaugcaccucuacugccagaaggugccggugcccuucagcaugcccauccccgucccggugcccauguuccugcccacgacccuggaguccaccgacaagaucguggagaccaucgaggagcucaaggucaagauccccagcaacccgcuggaggcggacauccuggccauggccgagaugaucgccgaggccgaggagcucgacaaggcguccagcgaccugugcgaccugguguccaaccagagcgccgaggggcuccuggaggacugcgaccuguucggccccgcccgcgacgacgugcucgccauggccgucaagauggcgaacgugcuggacgagcccggccaggaccuggaggccgacuuccccaagaacccgcucgacaucaaccccuccguggacuuccuguucgacugcgggcuggucggccccgaggacgugagcacggagcaggaccucccccgcaccaugcggaaggggcagaagcgccuggugcuguccgagagcugcucccgggacagcauguccagccagccguccugcaccggccucaacuacagcuacggggucaacgccuggaagugcugggugcaguccaaguacgccaacggcgagaccagcaagggcgacgagcugcgcuucgggcccaagcccaugcggaucaaggaggacauccuggcgugcagcgccgccgagcucaacuacggccuggcccaguucgugcgcgagaucacgcggcccaacggggagcgcuacgagccggacuccaucuacuaccugugccucggcauccagcaguaccugcuggagaacaaccggauggucaacaucuucaccgaccucuacuaccugaccuucgugcaggagcugaacaagagccucuccaccuggcagcccacgcugcugcccaacaacaccguguucagccgcgucgaggaggagcaccucugggagugcaagcagcugggcguguacucccccuucgugcugcucaacacccugauguucuucaacaccaaguucuucgggcugcagacggccgaggagcacaugcagcucagcuucaccaacgucgugcggcagucccgcaagugcaccaccccgcggggcacgaccaagguggucagcauccgcuacuacgcgcccgugcggcagcgcaaggggcgggacaccggccccgggaagcgcaagcgggaggacgaggcccccauccuggagcagcgcgagaaccggaugaacccgcugcgcugccccgugaaguucuacgaguucuaccucuccaagugccccgagagccugcgcacccggaacgacgucuucuaccugcagccggagcgcuccugcaucgccgagagcccccucugguacuccgugauccccauggaccggagcaugcuggaguccaugcugaaccgcauccucgccgugcgggagaucuacgaggagcugggccgccccggcgaggaggaccuggacuga

SEQ ID NO: 38961 - RNA, 4551 nt, Artificial Sequence
  derived and/or modified sequence opt1 from ZMYM4__Homo_sapiens__XP_011540726
auggacaccgagaugagcgaggacaucgaccacaaccugacccccacgcucgacuccaugagcuacggcaugccgaaccagaccggguccgagaacagccugcuggacgaggacgacuacuuccucaacuccggcgaccuggccgggauccccguggucggcagcgacaacgaggacgagcaggacuucuccagcaaggacaaccugguguccagcauccacaccgacgacucccucgagguggagcgccgggucacccagcacgagagcgacaacgagaacgagauccagauccagaacaagcugaagaaggacuuccccaagcaguucgaccagguguccguguucaagagcauccgcaaggacuucucccugguccgggagaacagcaaggagacguucuccgggaaggagaagaaccgcgaccucaccuacgagcgggagaagcgccuggacaagccccacaaggaccuggacagccggcucaaguccagcuucuucgacaaggccgcgaaccagguggaggagacccugcacacccaccucccgcagacgcccgagaccaacuuccgcgacagcuccuaccccuucgccaacaaggagagcaucggcuccgagcucggcaacagcuucgccuccaacauccggaucaaggaggagccccuggacgacgaguacgacaaggccauggccccgcagcaggggcugcucgacaagaucaaggacgagcccgacaacgcgcaggaguacagccacggccagcagcagaagacccaggagggggagcugaagaucuccgccguguucagcgucuccggcagcccccuggcgccccagcucaccacgggguuccagccgucccuggccagcuccggcaugaacaagaugcugcccagcgugcccgccaccgccgugcgcgucuccugcagcggcugcaagaagauccuccagaaggggcagaccgccuaccagcggaagggcuccacccagcuguucugcagcacgcugugccucaccggguacaccgugcccccggcccgcccgcccccgccccugaccaagaagacgugcuccagcugcagcaaggacauccugaaccccaaggacgugaucuccgcccaguucgagaacaccaccaccagcaaggacuucugcucccagagcugccucuccacguacgagcugaagaagaagcccaucgucaccaucaacaccaacagcaucuccaccaagugcagcaugugccagaagaacgcggugauccggcacgaggugaacuaccagaacgucgugcacaagcugugcuccgacgccugcuucagcaaguuccgcuccgccaacaaccucacgaugaacugcugcgagaacugcggcggcuacugcuacagcggguccggccagugccacaugcugcagaucgaggggcagagcaagaaguucugcuccagcuccugcaucaccgccuacaagcagaaguccgccaagaucacccccugcgcgcugugcaagagccuccggagcagcgccgagaugaucgagaacaccaacucccugggcaagacggagcuguucugcagcgugaacugccuguccgccuaccgcgucaagauggugaccagcgccggggugcagguccagugcaacuccugcaagaccagcgccaucccccaguaccaccuggcgauguccgacggcagcauccggaacuucugcuccuacagcugcguggucgccuuccagaaccuguucaacaagcccaccggcaugaacuccagcguggugccccucucccaggggcaggucaucgugagcauccccacgggcuccaccgugagcgccgggggcggguccaccagcgccgucagcccgaccuccaucagcuccagcgccgcggccggccugcagcgccuggccgcccagucccagcacgugggcuucgcgcggagcguggucaagcucaagugccagcacugcaaccgccuguucgccaccaagcccgagcugcucgacuacaaggggaagauguuccaguucugcggcaagaacugcuccgacgaguacaagaagaucaacaacgugauggccaugugcgaguacugcaagaucgagaagaucgugaaggagacgguccgguucagcggggccgacaaguccuucugcagcgagggcugcaagcugcuguacaagcacgaccuggccaagcgcugggggaaccacugcaagaugugcuccuacugccuccagaccagccccaagcuggugcagaacaaccugggcggcaagguggaggaguucugcugcgaggagugcauguccaaguacaccguccucuucuaccagauggcgaagugcgacgccugcaagcgccaggggaagcugagcgagucccugaaguggcggggcgagaugaagcacuucugcaaccuccugugcauccugauguucugcaaccagcagagcgugugcgacccgcccucccagaacaacgccgccaacaucagcauggugcaggccgcguccgccgggccgcccagccuccgcaaggacagcacccccgucaucgccaacguggugucccuggccagcgcccccgcggcccagcccacggucaacuccaacagcgugcugcagggcgccgugcccaccgucaccgccaagaucaucggcgacgcguccacccagacggacgcccucaagcugccgcccagccagccgccccggcugcucaagaacaaggcccugcugugcaagcccaucacccagaccaaggccaccuccugcaagccccacacgcagaacaaggagugccagaccgaggacacccccagccagccccagaucaucguggugccgguccccgugcccguguucguccccaucccgcuccaccuguacacccaguacgcccccgugcccuucgggauccccgugccgaugcccguccccaugcugaucccguccagcauggacuccgaggacaaggugacggagagcaucgaggacaucaaggagaagcuccccacccaccccuucgaggcggaccugcuggagauggccgagaugaucgccgaggacgaggagaagaagacccucucccagggcgagagccagaccuccgagcacgagcuguuccuggacacgaagaucuucgagaaggaccaggggagcaccuacuccggcgaccucgagagcgaggccguguccacgccccacagcugggaggaggagcugaaccacuacgcccucaagagcaacgcgguccaggaggccgacuccgagcugaagcaguucagcaagggggagaccgagcaggaccuggaggccgacuucccguccgacagcuucgacccccugaacaagggccagggcauccaggcccgcucccggacccgccggcgccaccgggacggguucccccagccccgccggcgcggccggaagaaguccaucguggccguggagccgcgcagccucauccagggggcguuccagggcugcagcgucuccgggaugacccugaaguacauguacggcgugaacgccuggaagaacugggugcaguggaagaacgccaaggaggagcagggcgaccugaagugcgggggcgucgagcaggccagcuccagcccccgguccgacccccucgggagcacccaggaccacgcgcugucccaggagagcuccgagcccggcugccgcgugcggagcaucaagcugaaggaggacauccucuccugcaccuucgccgagcugagccuggggcucugccaguucauccaggaggugcgccggccgaacggcgagaaguacgaccccgacagcauccuguaccugugccucggcauccagcaguaccuguucgagaacgggcgcaucgacaacaucuucacggagcccuacucccgcuucaugaucgagcugaccaagcuccugaagaucugggagcccaccauccugccgaacggcuacauguucagccggaucgaggaggagcaccucugggagugcaagcagcugggggccuacucccccaucguccugcucaacacccugcuguucuucaacacgaaguacuuccagcucaagaacgugaccgagcaccugaagcugagcuucgcccacgugaugcgccggacccgcacccucaaguacuccacgaagaugaccuaccugcgguucuucccgccccugcagaagcaggagagcgagcccgacaagcucaccgucggcaagcgcaagcggaacgaggacgacgaggugcccgugggggucgagauggccgagaacaccgacaacccccugcgcugccccgugcggcuguacgaguucuaccucuccaagugcagcgaguccgucaagcagcgcaacgacguguucuaccugcagccggagcggagcugcgugcccaacucccccaugugguacagcaccuuccccaucgacccgggcacgcuggacaccaugcucacccgcauccugaugguccgggaggugcacgaggagcuggcgaaggccaaguccgaggacagcgacguggagcucuccgacuga

SEQ ID NO: 38962 - RNA, 627 nt, Artificial Sequence
  derived and/or modified sequence opt1 from ZMYM5__Homo_sapiens__NP_001034738
auggagaagugcagcgugggcgggcuggagcugaccgagcagacccccgcccugcugggcaacauggccauggcgacgucccucauggacaucggggacagcuucggccacccggccugcccccuggucucccgcagccggaacucccccguggaggacgacgacgacgacgacgacguggucuucaucgagagcauccagcccccguccaucagcgcccccgccaucgccgaccagcgcaacuucaucuucgcguccagcaagaacgagaagccccaggggaacuacuccgugaucccgcccagcucccgggaccuggccagccagaagggcaacaucuccgagaccaucgugaucgacgacgaggaggacaucgagaccaacggcggggccgagaagaaguccagcugcuucaucgaguggggccuccccgggaccaagaacaagacgaacgaccuggacuucagcaccuccagccugagccgcuccaagaccaagaccggcguccggcccuucaaccccgggcgcaugaacguggccggcgaccucuuccagaacggcgaguucgcgacgcaccacagcccggagaugcaccuccagcggcgccugauguccuucuuccaguga

SEQ ID NO: 38963 - RNA, 1323 nt, Artificial Sequence
  derived and/or modified sequence opt1 from ZMYND10__Homo_sapiens__NP_056980
augggcgaccuggagcuccugcugcccggggaggccgaggugcucguccgcggccugcggagcuucccgcugcgcgagaugggguccgagggcuggaaccagcagcacgagaaccucgagaagcugaacaugcaggccauccuggacgcgaccgugagccagggggagcccauccaggagcuccuggugacccacggcaagguccccacgcugguggaggagcucaucgccguggagauguggaagcagaaggucuuccccguguucugccggguggaggacuucaagccgcagaacaccuuccccaucuacauggucgugcaccacgaggccuccaucaucaaccugcuggagaccguguucuuccacaaggaggucugcgagagcgccgaggacaccgugcucgaccugguggacuacugccaccgcaagcugacgcuccuggucgcccaguccggcugcgggggcccgcccgagggggagggcagccaggacuccaaccccaugcaggagcugcagaagcaggcggagcucauggaguucgagaucgcccugaaggcccugagcgugcuccgguacaucaccgacugcguggacucccugagccuguccacccucagccgcaugcuguccacccacaaccugcccugccuccuggucgagcugcucgagcacagccccuggucccggcgcgagggcgggaagcugcagcaguucgagggcagccgguggcacacgguggcccccuccgagcagcagaagcugagcaagcucgacggccagguguggaucgcgcuguacaaccugcuccuguccccggaggcccaggcccgcuacugccugaccagcuucgccaaggggcggcuccugaagcugcgcgccuuccucaccgacacccugcuggaccagcuccccaaccuggcgcaccuccagagcuuccuggcccaccugacgcugaccgagacccagccgcccaagaaggaccugguccucgagcagauccccgagaucugggagcggcuggagcgcgagaaccgggggaaguggcaggccaucgccaagcaccagcugcagcacguguucucccccagcgagcaggaccuccgccugcaggcccggcgcugggcggagaccuaccggcuggacgugcucgaggccgucgcccccgagcgcccccggugcgccuacugcuccgccgaggcgagcaagcgcugcucccgcugccagaacgagugguacugcugccgggagugccaggugaagcacugggagaagcacggcaagacgugcguccuggccgcccagggcgaccgcgccaaguga

SEQ ID NO: 38964 - RNA, 1554 nt, Artificial Sequence
  derived and/or modified sequence opt1 from ZMYND11__Homo_sapiens__NP_001189394
auggcccgccugaccaagcggcgccaggccgacaccaaggcgauccagcaccucugggccgccaucgagaucauccggaaccagaagcagaucgccaacaucgaccgcaucacgaaguacaugagccgggugcacggcaugcaccccaaggagaccacccgccagcugucccuggccgugaaggacgggcucaucguggagacccugacggugggcugcaaggggagcaaggcgggcaucgagcaggagggguacuggcugccgggcgacgagaucuccaucaagaagaagaacaccaacaagcaggagaugggcaccuaccuccgguucaucgucagccgcaugaaggagcggaaggugaacgaggggaaguaccgcuccuacgaggaguucaaggccgacgcccagcugcugcuccacaacaccgugaucuucuacggcgccgacagcgagcaggcggacaucgcccggaugcuguacaaggacacgugccacgagcuggacgagcuccagcugugcaagaacugcuucuaccuguccaacgcccgccccgacaacugguucugcuaccccugcauccccaaccacgagcucgucugggccaagaugaagggguucggcuucuggccggccaaggugaugcagaaggaggacaaccagguggacguccgguucuucgggcaccaccaccagcgcgcguggauccccagcgagaacauccaggacaucaccgugaacauccaccggcugcacgugaagcgcuccaugggcuggaagaaggccugcgacgagcuggagcuccaccagcgguuccugcgcgagggccgguucuggaaguccaagaacgaggaccgcggggaggaggaggccgaguccagcaucuccagcaccuccaacgagcagcugaaggucacccaggagccccgggccaagaagggccgccgcaaccagagcguggagcccaagaaggaggagccggagcccgagacggaggccguguccagcucccaggagauccccaccaugccccagccgaucgagaaggucagcgugagcacccagaccaagaagcucuccgcgagcagcccccggaugcugcaccgcagcacgcagaccaccaacgacggggugugccaguccaugugccacgacaaguacaccaagaucuucaacgacuucaaggaccggaugaaguccgaccacaagcgcgagacggagcgggucgugcgcgaggcccuggagaagcuccggagcgagauggaggaggagaagcgccaggccgugaacaaggccgucgccaacaugcagggcgagauggaccggaagugcaagcaggucaaggagaagugcaaggaggaguucguggaggagaucaagaagcuggcgacccagcacaagcagcugaucagccagaccaagaagaagcaguggugcuacaacugcgaggaggaggccauguaccacugcugcuggaacaccuccuacugcagcaucaagugccagcaggagcacuggcacgccgagcacaagcgcacgugccggcgcaagcgguga

SEQ ID NO: 38965 - RNA, 465 nt, Artificial Sequence
  derived and/or modified sequence opt1 from ZMYND8__Homo_sapiens__NP_001268698
augcacccccagagccuggccgaggaggagaucaagaccgagcaggagguggucgagggcauggacaucuccacccgcagcaaggacccgggguccgccgagcggacggcgcagaagcgcaaguuccccagcccgccccacuccagcaacggccacagcccccaggacaccuccaccucccccaucaagaagaagaagaagcccgggcuccugaacagcaacaacaaggagcaguccgagcugcggcacggccccuucuacuacaugaagcagccgcucaccacggaccccguggacguggucccccaggacgggcgcaacgacuucuacugcugggugugccaccgggagggccaggugcugugcugcgagcugugcccccgcgucuaccacgccaagugccuccggcugaccagcgagccggagggcgacugguucugccccgagugcgagguguccagcuga

SEQ ID NO: 38966 - RNA, 3336 nt, Artificial Sequence
  derived and/or modified sequence opt1 from ZNF106__Homo_sapiens__NP_001271236
auggugcgcgagcggaagugcauccugugccacaucgucuacagcuccaagaaggagauggacgagcacaugcgcagcaugcuccaccaccgggagcuggagaaccugaagggccgcuucgggaucgagauggugccccucgugcagaacgagcaggaggcccuggaccuggacggcgagccggaccucuccagccuggagggguuccagugggagggcgucuccaucagcuccagccccgggcuggcccggaagcgcucccucagcgaguccagcgugaucauggaccgggcgcccuccguguacagcuucuucuccgaggagggcaccggcaaggagaacgagccccagcagauggucagcccguccaacagccugcgcgccgggcagucccagaaggccaccaugcaccugaagcaggaggugacgccccgggccgccagccuccgcaccggcgagcgggcggagaacguggccacccagcgccggcacagcgcccagcuguccagcgaccacaucaucccccugaugcaccucgccaaggaccugaacucccaggagcgcagcaucccgccguccgagaaccagaacagccaggaguccaacggggagggcaacugccugagcuccagcgcguccagcgcccucgccaucuccagccuggccgacgccgcgaccgacuccagcugcacguccggggccgagcagaacgacggccagagcauccggaagaagcgccgggccaccggcgacggguccagccccgagcugcccagccucgagcgcaagaacaagcggcgcaagaucaagggcaagaaggagcggucccaggucgaccagcugcugaacaucagccuccgcgaggaggagcuguccaagagccugcagugcauggacaacaaccuccugcaggcccgcgccgcgcugcagaccgccuacguggaggugcagcggcuccugaugcugaagcagcagaucaccauggagauguccgcccuccgcacgcaccggauccagauccugcaggggcugcaggagaccuacgagcccagcgagcacccggaccagguccccugcucccucacccgcgagcggcgcaacagccggucccagaccagcaucgacgccgcccugcugcccacgcccuucuucccccucuuccuggagccgcccuccagccacgugucccccagccccaccggcgcgucccugcagaucaccaccagccccacguuccagacccacggcuccgugcccgcccccgacagcagcguccagaucaagcaggagccgaugucccccgagcaggacgagaacgugaacgccgugccgcccagcuccgccugcaacgucagcaaggagcuccuggaggccaaccgcgagaucuccgacagcugccccguguaccccgugaucaccgcgcggcugucccuccccgagagcaccgaguccuuccacgagccgagccaggagcugaaguucuccgucgagcagcgcaacacgcggaaccgcgagaacagccccuccagccaguccgccgggcugagcuccaucaacaaggagggcgaggagcccaccaaggggaacagcggcuccgaggccugcaccagcagcuuccuccggcuguccuucgccagcgagacgccccuggagaaggagccgcacucccccgcggaccagcccgagcagcaggccgagagcacccugaccuccgccgagacccgcgggagcaagaagaagaagaagcuccggaagaagaagucccugcgcgccgcccacgugcccgagaacagcgacaccgagcaggacgugcugacggucaagccggugcggaaggucaaggcgggcaagcucaucaagggcgggaaggugaccaccuccaccugggaggacagccgcacgggccgggagcaggaguccgugcgcgacgagcccgacagcgacuccagccuggagguccuggagauccccaacccccagcucgaggugguggccaucgacuccagcgaguccggggaggagaagccggacagccccuccaagaaggacaucuggaacagcaccgagcagaacccccuggagaccagccgcuccggcugcgacgaggucagcuccaccagcgagaucgggacgcgguacaaggacggcauccccguguccguggccgagacccagaccgucaucagcuccaucaagggcagcaagaacuccagcgagaucuccagcgagccgggggacgacgacgagcccaccgagggcuccuucgaggggcaccaggccgccgugaacgcgauccagaucuucggcaaccugcucuacacgugcagcgccgacaagaccgugcgcgucuacaaccuggugucccggaagugcaucgggguguucgagggccacaccagcaaggucaacugccugcucgugacccagaccuccggcaagaacgccgcccuguacacggggagcuccgaccacaccauccgcugcuacaacgucaagagccgggagugcguggagcagcugcagcucgaggaccgcgugcugugccugcacagccgguggcgcauccucuacgccggccuggcgaacgggaccguggucaccuucaacaucaagaacaacaagcggcuggagaucuucgagugccacggcccccgcgccguguccugccucgccacggcccaggagggcgcgcggaagcugcugguggucgggagcuacgacugcaccaucuccgugcgcgacgcccggaacggccuccugcugcgcacccucgaggggcacagcaagaccauccugugcaugaagguggucaacgaccugguguucuccggcagcuccgaccagagcgugcacgcccacaacauccacacgggggagcucguccggaucuacaagggccacaaccacgccgugaccguggucaacauccugggcaaggugauggugaccgccugccuggacaaguucguccgcguguacgagcuccagucccacgaccggcuccagguguacgggggccacaaggacaugaucaugugcaugaccauccacaagagcaugaucuacacggggugcuacgacggcuccauccaggcgguccgccugaaccugaugcagaacuaccggugcugguggcacgggugcagccugaucuucggcgugguggaccaccugaagcagcaccuccugaccgaccacaccaaccccaacuuccagacccugaagugccgcuggaagaacugcgacgccuucuucacggcccggaagggcuccaagcaggacgccgccgggcacaucgagcgccacgcggaggacgacagcaagaucgacuccuga

SEQ ID NO: 38967 - RNA, 2352 nt, Artificial Sequence
  derived and/or modified sequence opt1 from ZNF107__Homo_sapiens__NP_001013768
augguggccaagcccccggucaugagcuuccacuucgcccaggaccuguggcccgagcagaacaucaaggacuccuuccagaaggugacccuccgccgguacggcaagugcgaguacgagaaccugcagcugcgcaaggggugcaagcacguggacgagugcaccggccacaagggcgggcacaacacggucaaccagugccucaccgcgacccccagcaagaucuuccagugcaacaaguacgugaagguguucgacaaguucuccaacagcaaccgguacaagcgccggcacaccgggaacaagcacuucaagugcaaggagugcuccaagagcuucugcguccugucccagcugacgcagcaccgccggauccacacccgcgugaacagcuacaagugcgaggagugcggcaaggccuucaacugguucuccacccucaccaagcacaagcggauccacacgggcgagaagcccuacaagugcgaggagugcgggaaggccuucaaccagagcucccagcugacccgccacaagaucauccacaccgaggagaagccgaacaagugcgaggagugcggcaaggccuucaagcaggccagccaccugaccauccacaagaucauccacacgggggagaagcccuacaaguacgaggagugcggcaagguguucucccagagcucccaccucaccacccagaagauccugcacaccggggagaaccuguacaagugcaaggagugcggcaaggcguucaaccucuucagcaaccugacgaaccacaagcggauccacgccggcgagaagcccuacaagugcaaggagugcgggcgcgccuucaacaucuccagcaaccugaacaagcaggagaagauccacaccggcgggaagcucaacaagugcgaggagugcgacaaggccuucaaccggucccugaagcugaccgcgcacaagaagauccucauggaggagaagcccuacaagugcgaggagugcggcaaggucuucaaccaguucagcacccugacgcgccacaagaucauccacaccggcgagaagccguacaagugcaaggagugcgggaaggccuucaaccagagcuccaaccugaccgagcacaagaagauccacaccgccgagaaguccuacaagugcgaggagugcggcaaggccuucaaccagcacagcaaccucaucaaccaccggaagaucuacagcggggagaagcccuacaagugcgaggagugcggcaaggccuucaaccgcuccagcacgcugacccggcacaagaagauccacaccggggagaagcccuacaagugcgaggagugcgaccgcgcguucucccagagcuccaaccugaccgagcacaagaagauccacacgggcgagaagcccuacaagugcgaggagugcggcaaggccuucaaccgguucagcacccucaccaagcacaagcgcauccacaccggggagaagccguacaagugcgaggagugcggcaaggccuucaaccaguccuaccagcugacgcggcacaagaucgugcacaccaaggagaagcugaacaagugcgaggaguucgggaaggccuucaagcagagcucccaccgcaccauccacaagaucauccacaccggcgagaagcccuacaagugcgaggagcacgggaagguguucaaccagagcuccaaccucacgacccagaagaucauccacaccggcgagaaccuguacaaguucgaggagcacggcaaggccuucaaccuguucagcaacaucaccaaccacaagaucaucuacaccggggagaagccccacaagugcgaggagugcggcaaggcguacaaccgcuucuccaaccucacgauccacaagcggauccacaccggggagaagcccuaccagugcgccgagugcggcaaggccuucaacugcagcuccacccugaaccgccacaagaucauccacaccggggagaagccguacaagugcaaggagugcggcaaggccuucaaccugagcagcacgcucaccgcccacaagaagauccacaccggcgagaagcccuacaagugcgaggagugcgggaaggcguucaaccaguccagcaaccugaccacgcacaagaagauccacaccuccgagaagcccuacaagugcgaggagugcggcaagagcuucaaccaguucuccagccugaacauccacaagaucauccacaccggggagaagcccuacaagugcggcgacuacggccgggccuucaaccucuccagcaaccugaccacgcacaagaagauccacaccggggagaagccguacaagugcgaguacggcaagaccuga
